United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 164

SEQ ID NO: 6870967 - DNA, 59 bp, Homo sapiens
ttacagggggatgagattgtgaccatgttaaatacatcaacatttgtatctcccagtgg

SEQ ID NO: 6870968 - DNA, 105 bp, Homo sapiens
tgaggcaggagaatggtgtgaacctgggaggcggagcttgcagtgagcctagattgcaccactgcactccagcctgcctgggtgacagagtgagactccgtctca

SEQ ID NO: 6870969 - DNA, 77 bp, Homo sapiens
tgtgcaattaatgagcttctgcactcatagacctagtagtccagtgagggaggtagatttcatcaaataattacaca

SEQ ID NO: 6870970 - DNA, 55 bp, Homo sapiens
ggccagctttctgtcttctagggaacctgttagttccatttaggggcggctggct

SEQ ID NO: 6870971 - DNA, 67 bp, Homo sapiens
gttgtgttgtagattagtccaacaggttttggggtaaaagagatctgggtttaaatctcagcttaac

SEQ ID NO: 6870972 - DNA, 84 bp, Homo sapiens
agtttaagatcttaacatgctctgtttcttggatgtttggaaaatgtttatttgagagacagagacaggaatgcgttttagact

SEQ ID NO: 6870973 - DNA, 96 bp, Homo sapiens
gctttggacttggaggtagggtggccaatcgtcccaaatttcctgggaatttgatgagaaaactgggacacattagtcaccttacatgtaggaagc

SEQ ID NO: 6870974 - DNA, 105 bp, Homo sapiens
gatgtttaataagattgtcctccatgattgaaacaaatgactctctttttgtcatcagaaatggaactgttgtgcatttgttttaggaatacaagatctgacatc

SEQ ID NO: 6870975 - DNA, 67 bp, Homo sapiens
gggttagctatctggcacatagactgtggaactgactagagttgccagcttatggccaaaataaccc

SEQ ID NO: 6870976 - DNA, 79 bp, Homo sapiens
cttttttagcacatggctcatgtagaggccattttatctgtgatggatttaccacagggccacagtgcttacaaagaag

SEQ ID NO: 6870977 - DNA, 88 bp, Homo sapiens
ggcaggtaggcagggctcattgccaggcattggaaacatgtggcggagctggaccactgcctggcagaggtttgcaaggccccgagcc

SEQ ID NO: 6870978 - DNA, 80 bp, Homo sapiens
gctggggtgtcttgaaggtgacatatctggagccatagcaaagctttgctctatgttgaccttcagtggacgtcctgagt

SEQ ID NO: 6870979 - DNA, 66 bp, Homo sapiens
ctttgttctctgcttctgtttgtattgagtcagcttgcttaggaatatagatcagtgagactaaag

SEQ ID NO: 6870980 - DNA, 129 bp, Homo sapiens
agggaaagcctagaaacagaggagcctaagcagaagaaaaggcagaaattcaactactggtcagcaaaacctggaactgagaattccagtataaggatacttctgtcttctctgcttcctctttccact

SEQ ID NO: 6870981 - DNA, 61 bp, Homo sapiens
ttgcttaaagggagtagagagagaggtcaaagagcagacctatttctaaacctataagtga

SEQ ID NO: 6870982 - DNA, 59 bp, Homo sapiens
tctgtagagaaggggaaaggcagagaccaactctctgagctgcccctttactttgtaga

SEQ ID NO: 6870983 - DNA, 56 bp, Homo sapiens
tccctgtgtcttcctcttgccccctggaacccagatggcaggtcctgaagacagga

SEQ ID NO: 6870984 - DNA, 63 bp, Homo sapiens
ccggcgcgcctcggaggcttatcaggctccccgcacgccccgcaagcttccttgggcgcccgg

SEQ ID NO: 6870985 - DNA, 84 bp, Homo sapiens
atcttcagtacacacagagcagcagggtgtaattgggcaggagtgcactgcacaaaggctccctgctgaggtggtaaatgagat

SEQ ID NO: 6870986 - DNA, 97 bp, Homo sapiens
catcaccacattctaggtgcttatcttcaacttgatcatttgaatattagtatatccgtaaatggttggttaaggcatgtgtgtgtatgtggtgatg

SEQ ID NO: 6870987 - DNA, 58 bp, Homo sapiens
ggccaaccaagggctatttacagaacaggtgaagtcacctctgtttattctattggcc

SEQ ID NO: 6870988 - DNA, 86 bp, Homo sapiens
catgccagctgacctttgccaggaaggcacccactgcttccctctagggcaagccctgcccctcttgagaagctcagcaaggtgtg

SEQ ID NO: 6870989 - DNA, 67 bp, Homo sapiens
gggtccttcccttccttagccttgaagcgggaataaccactagacagaaggctgtgagggaggactc

SEQ ID NO: 6870990 - DNA, 88 bp, Homo sapiens
ccaccaaggtccaggaggaaggttggggggatctgcaaggatggggcatcctgcccttttgacccagcctgtcctcaccttcaggtgg

SEQ ID NO: 6870991 - DNA, 70 bp, Homo sapiens
gcctaggtttggacctgatgtttagtcttgttccacatggtggcaagaaggcttcaggtagctccagggt

SEQ ID NO: 6870992 - DNA, 82 bp, Homo sapiens
cagaagctcccagtgtgggtaaagtacatgtagaacttccaacagaccctcttctattttgtcttctgctcatcaccttctg

SEQ ID NO: 6870993 - DNA, 74 bp, Homo sapiens
agggaaagactgcaaaaacgcacagataattgttgataatctcagctttctgctgactttttgcttctttcttt

SEQ ID NO: 6870994 - DNA, 64 bp, Homo sapiens
ggcctagctgtggaaatcaggcaatgagatggaagactctcagaggcctatgtctacaactgcc

SEQ ID NO: 6870995 - DNA, 103 bp, Homo sapiens
tctatagatttgttgctggccctgcaagccgtatgtggagtattagccccttgttggagttgctggtctctatagatgttgctggtctctatagatttgtgga

SEQ ID NO: 6870996 - DNA, 59 bp, Homo sapiens
ctgctggcctgaccagccacaggctgtgaaaagcctgctggatgtggccaggccattag

SEQ ID NO: 6870997 - DNA, 67 bp, Homo sapiens
taatattgtgtcaacaacagccttggatgtccctcagattattcctggacattgtttacacatgttg

SEQ ID NO: 6870998 - DNA, 101 bp, Homo sapiens
tgctcttctcttttgtacttttctgcagatgatctctttccagtagaatcaaggcagccatctgcaggaaggagaaaagagagataaacagaaaaagagca

SEQ ID NO: 6870999 - DNA, 56 bp, Homo sapiens
cagcactggcacagacctcgactgtgcccttcacagtgatggttctttccgggttg

SEQ ID NO: 6871000 - DNA, 60 bp, Homo sapiens
gattaaatcacgtgcctaaagatacacagctaagtattggagctgggatttgatttgatt

SEQ ID NO: 6871001 - DNA, 56 bp, Homo sapiens
gatgtattgaccatactactaaagaaactttactttttgattatggtctctgcatt

SEQ ID NO: 6871002 - DNA, 58 bp, Homo sapiens
gagcatctgatgagattggatttgtcaataagggcagtagccaggcccacgggtgttt

SEQ ID NO: 6871003 - DNA, 61 bp, Homo sapiens
taccctgcttagtcaacctagggccatcccatgtgggaatgacctggggctgggcttggta

SEQ ID NO: 6871004 - DNA, 93 bp, Homo sapiens
tttttgaaggaaggattctggaagtggcagtggaaaagactgactttattcttttcccattttatagacccatctcatctttgccttcaaaaa

SEQ ID NO: 6871005 - DNA, 55 bp, Homo sapiens
ccaggtgtttcaaatgtgaaactaggctaaaaccaatggttttttatacacctgg

SEQ ID NO: 6871006 - DNA, 60 bp, Homo sapiens
tggctcattgagctgttttgtaggataaaaatattttgtttagaatttagttttgagtca

SEQ ID NO: 6871007 - DNA, 59 bp, Homo sapiens
tttttctcacaaagccacacaaatataaatgtattaatgtagcctttatgtgagaagga

SEQ ID NO: 6871008 - DNA, 76 bp, Homo sapiens
aaatacagagttatggacctcagctctagggattctgactcaatagttctggcatagggtccaggactctgaattt

SEQ ID NO: 6871009 - DNA, 69 bp, Homo sapiens
aggatcaaacccttagggcctagaagggctttgtgtttccttccaggtcgccataggtttgagtttcct

SEQ ID NO: 6871010 - DNA, 61 bp, Homo sapiens
ctgatgcccagaccccactcccgaccacacttagaatttctggagatggggctgacatcag

SEQ ID NO: 6871011 - DNA, 56 bp, Homo sapiens
atgaactgtccaatcttagaggttccctcatgggcaaactttaagaacagcttcat

SEQ ID NO: 6871012 - DNA, 91 bp, Homo sapiens
ggtgctcaccccaggtgtttcctcacaagcttttcctcagacgtcttgtctcttccctttgcggagtaaggctcagaggaaatgcctcacc

SEQ ID NO: 6871013 - DNA, 60 bp, Homo sapiens
aggtacaaaagagtatatgagaatcttgaagggttaattcattgtctcttttgcctacct

SEQ ID NO: 6871014 - DNA, 74 bp, Homo sapiens
aacatttcctttggtcttgatgaactgttaggtcagtttacctcaaactgttttttggcctaaggaaatctgtt

SEQ ID NO: 6871015 - DNA, 69 bp, Homo sapiens
tggcacagtgattttaggatagatggacttcctgcatggtggccaactcctccaagggtgattgttcca

SEQ ID NO: 6871016 - DNA, 129 bp, Homo sapiens
gttatgtagaattttagtgaactttcagggaattccagatgaagatcatagaatagtatccttattaggatagacaatactcatgctctttttctaattcagaaagttgatactaatatttataataat

SEQ ID NO: 6871017 - DNA, 82 bp, Homo sapiens
ctgcatggttttggcttaacttgtagcaatagataaatgaagttatttatccaaagtagattaagtcacatgaaacctgaag

SEQ ID NO: 6871018 - DNA, 73 bp, Homo sapiens
gatgctgaaccagggctgggataggtcaggatggctctggggccctgcctggcttctcaccttgttctgtgtt

SEQ ID NO: 6871019 - DNA, 57 bp, Homo sapiens
atttcttcctctgtcagtaactacctcaagcagctttggactacagggggaagaagt

SEQ ID NO: 6871020 - DNA, 87 bp, Homo sapiens
gacaagttctgctgctgctggaagaattccatgctggcattatcagaaatgcagagtcattgacttccaggagtaatagatttttgc

SEQ ID NO: 6871021 - DNA, 69 bp, Homo sapiens
gccagaaacatacacatcacttccaaaagtttccttccacacattttgtcattgtgtgtgtttgtgtgc

SEQ ID NO: 6871022 - DNA, 82 bp, Homo sapiens
gaagtagatagcagagacattctccccattggacagatgcaataactaaggttcaaacagatgactctgctcttcccccttc

SEQ ID NO: 6871023 - DNA, 103 bp, Homo sapiens
cagtgtcctggggagccgctggtgctggcaacagagtagggagccccttcagccccatggtgtgctcagcactgcatgaacactttccccaggggactcactg

SEQ ID NO: 6871024 - DNA, 60 bp, Homo sapiens
gacatcaacataaagaagtcctcaggtgtgtgcttgggtgatgtgtatttgtgttgtctc

SEQ ID NO: 6871025 - DNA, 68 bp, Homo sapiens
agaaggcattgcctggattctcttctgatgaaatttcattagcaagttttccagctaattggcagtct

SEQ ID NO: 6871026 - DNA, 85 bp, Homo sapiens
aagggtactcatttctgaggaacatacttattattctggcataagctatgtgaacagactgttctctacagatttgagtatcttt

SEQ ID NO: 6871027 - DNA, 56 bp, Homo sapiens
ccaagcttctttcctactacagtaacttatactatttcgcagtgggaagagtttgg

SEQ ID NO: 6871028 - DNA, 107 bp, Homo sapiens
tcctctcagttcgttagctgaattgctaggctgcatgtgtccagaggcattattctagagacctgacagatacagtgcagtggcagagaggctgaaatttgagtgga

SEQ ID NO: 6871029 - DNA, 66 bp, Homo sapiens
atcctggggaccttccaggtctcgtggggactgagataacactgatgccctggaggtcttcggggt

SEQ ID NO: 6871030 - DNA, 92 bp, Homo sapiens
ggcttcttggcaaaatggctgatgccaggtctaggcataaagtgtaaaagatgagcctagaacatcttggcgtgccagtcagtgaggaagct

SEQ ID NO: 6871031 - DNA, 68 bp, Homo sapiens
caggtgggagcgaggagctactttaagtagggacaggaaaaagagactctgaggagccctgagacctg

SEQ ID NO: 6871032 - DNA, 69 bp, Homo sapiens
atagagatgcccaggcttcatcccagatgtacaaaattcaactctcagggacagggtctgggactctgt

SEQ ID NO: 6871033 - DNA, 73 bp, Homo sapiens
gtgagcaaagggcagaaatattgatactgtggtcattcagagccatttttataacttatattttgttcctcac

SEQ ID NO: 6871034 - DNA, 68 bp, Homo sapiens
aaggctcagaggtggatgccttgtggggtgcctcagcacatgccaagggccatcctatcacttgcctt

SEQ ID NO: 6871035 - DNA, 91 bp, Homo sapiens
ccaaaaaatttgtgttagggaaggttgccctagggtttgttgcctttaatagcatctttatattctgggcaagccttcttatacattttgg

SEQ ID NO: 6871036 - DNA, 84 bp, Homo sapiens
ccaagggtttctgcttcttcttgcttttgctttaagcagggcagctagaaaacatagcaggggtaacagaaggaaagaaaaggg

SEQ ID NO: 6871037 - DNA, 58 bp, Homo sapiens
gtttcacaggttggagccagcatcttcctacaagatgaacagctgccacctttggagc

SEQ ID NO: 6871038 - DNA, 82 bp, Homo sapiens
ggaaaggtgagctttgttgtttggtatccttaagttcactcaaatgatacaggtggaactaaataaatgatttcatgttttt

SEQ ID NO: 6871039 - DNA, 97 bp, Homo sapiens
gtggtacacaaaggcttccagaatagtgcattattggcctgggagatgatgcttttaccattccattcaggccagtgcaaagtttcaatgtgctcac

SEQ ID NO: 6871040 - DNA, 67 bp, Homo sapiens
agcaaatgtgacataagtagaggcttgaaaagtgcttgtgccttcaggcttccttatgcatttttct

SEQ ID NO: 6871041 - DNA, 79 bp, Homo sapiens
ttccttggttttaaactcttaactgccttatctgtgttatgtcaacatcagaacaaatcggttaagaacttgcaaggaa

SEQ ID NO: 6871042 - DNA, 129 bp, Homo sapiens
tgatgagtttgcttgatctgagaactcacaaaggatgttgaggaagaaagggcagctatgacctatcttggggttttgcattttgttcttgtgaccctgtggaaatgctcagatgagtgcacatgttca

SEQ ID NO: 6871043 - DNA, 115 bp, Homo sapiens
tttgtgctcagtagctggcttcagaaggcagccttgactagtgacttagttacaatctcatccctgctctgagtggctggtgaggttagccctggggtcagcttgggaatgtgga

SEQ ID NO: 6871044 - DNA, 58 bp, Homo sapiens
actgcaagataacctgcttcttcctgagattagggatttgcatgttgtctatgctagt

SEQ ID NO: 6871045 - DNA, 86 bp, Homo sapiens
ggagtaggacaacaagaaatgggagagatgtttatgtatgtttttagaacattctgggtgatgttcttcagttctttgttccaccc

SEQ ID NO: 6871046 - DNA, 64 bp, Homo sapiens
ttcagtttgccagtatttcactgatgattttcacattgatgttcatcagggatattggcctgaa

SEQ ID NO: 6871047 - DNA, 82 bp, Homo sapiens
tgtatgtgggatgtgtgtatatatgtatgtatatataaatatatatataaacagcataaaatacgcttaagaaaaacatgca

SEQ ID NO: 6871048 - DNA, 130 bp, Homo sapiens
gaggtgaaaaggggtaggtaactcatgtcctctgagtcttcagaagatcacatcagtgtaggatgaacaggggtaacattcgtgttatcttctgagcactcagaagacatgagttacccctgttcatctc

SEQ ID NO: 6871049 - DNA, 78 bp, Homo sapiens
gatggctacagtgcagagtgtctgtggactgaagtaataacctgagctccttggccatcgagactcatgtacatcatc

SEQ ID NO: 6871050 - DNA, 60 bp, Homo sapiens
ggacaggccccctcaggactgatttcttggcagtctatccaagtccttgggtgtctgcac

SEQ ID NO: 6871051 - DNA, 62 bp, Homo sapiens
ctagagaaaccccatgagcttttggagattggagtctatctgagagtttggggtcattttgg

SEQ ID NO: 6871052 - DNA, 65 bp, Homo sapiens
cactttaatttcttttccctagtgtcagctgctcaagcctgaccagggtagaggtgagaggagtg

SEQ ID NO: 6871053 - DNA, 55 bp, Homo sapiens
tgctgagtggcatggagtgcttagataacaatgagctccatgacttgaattagta

SEQ ID NO: 6871054 - DNA, 63 bp, Homo sapiens
tggagtttgggtgaggtataagaaatgggctgatccctgattccatactttattccccctcca

SEQ ID NO: 6871055 - DNA, 75 bp, Homo sapiens
taagccaaaatatcacagtggctacctctggatgcagattaaaatctggaaatccacttgccactgtatagttta

SEQ ID NO: 6871056 - DNA, 88 bp, Homo sapiens
gtttactgtcagtttagtcatcctgaagcatgaatgtcaaaaggctactcctgtttgctcacaatttttagtttgaccttcagtgaac

SEQ ID NO: 6871057 - DNA, 58 bp, Homo sapiens
gacagagctgctctagattctgctgtatttgatggtaagaaagggtgagcagcctgtt

SEQ ID NO: 6871058 - DNA, 86 bp, Homo sapiens
gaggtaaatatgtgtcttgtaaaagctttgtgtgatcagaatattttggtaattataaaatgtttttgatgatacacatttaactc

SEQ ID NO: 6871059 - DNA, 84 bp, Homo sapiens
cttaatgaaaactggtagtagaaggagggaaatgtctgacactggcgaataaaattttcccattctaattactcatttattaag

SEQ ID NO: 6871060 - DNA, 67 bp, Homo sapiens
gaagtgtgaaggtgatgtggagaatgcacaaaaagcttgctctggttgttaccttcctagacacttt

SEQ ID NO: 6871061 - DNA, 61 bp, Homo sapiens
cctgaaatccatagtttacactggggttcactcttggtgttgtacattctatgggttcggg

SEQ ID NO: 6871062 - DNA, 119 bp, Homo sapiens
gggagtttttttggagaaggagtcttgctctgtcactaggctggagtgcagtggcacgatctcggctcactgcaacctttgcctcccaggttcaagcgattctcctgccccaggctccc

SEQ ID NO: 6871063 - DNA, 83 bp, Homo sapiens
tgagataacatatgtacagtccttaacttaaagcctggcaaataggagtttaaaaatgttagctgccattattgttatcatca

SEQ ID NO: 6871064 - DNA, 101 bp, Homo sapiens
cattttgggaacaactgctgtggactaacaccacaccattgcactggatgtagtctgatgtgtggcagttaaactgtttgctatggttttttcctggagtg

SEQ ID NO: 6871065 - DNA, 60 bp, Homo sapiens
gaggtctgtggaagtaccacagtgactggagtcatcatgtttgatttccacagtttcctt

SEQ ID NO: 6871066 - DNA, 78 bp, Homo sapiens
cctctgggagcctgacagtgcccagcatgaaggtggggccagtgctgggggtttctgtaggtcccactcccacagagg

SEQ ID NO: 6871067 - DNA, 67 bp, Homo sapiens
ttttgcagacacagaaacctgggttcaaattaatgttctgacacccattatctgtgtgacctcagga

SEQ ID NO: 6871068 - DNA, 56 bp, Homo sapiens
acccaaagattagccaaacattagggaacatatcctgctgtggcaaagctttgtgt

SEQ ID NO: 6871069 - DNA, 56 bp, Homo sapiens
tgcttagccattgtcagcacatggctttcgccttgtgttttaagatggctgctgca

SEQ ID NO: 6871070 - DNA, 94 bp, Homo sapiens
cctcccgccactcgccggcggcggccggtgtgcggctgcgacaatgtggccattgtttgggagctgcaaaccaggccggcgcgcaggtgggagg

SEQ ID NO: 6871071 - DNA, 108 bp, Homo sapiens
gctaacaggcttttgaaagaatgggcaagaataggctcagggctgggtgacgggtgcctgcccattcactgagatctatagcatgcccactcctcagggccttgaagc

SEQ ID NO: 6871072 - DNA, 77 bp, Homo sapiens
ggttttactaccccaggcacactgtctacactgagtaactagaactaagctgaggaagtgttgctgagcggagaacc

SEQ ID NO: 6871073 - DNA, 61 bp, Homo sapiens
cctgggatgctgtcctcatctacatggtaaaaactattcaggaccatgaccgtattccagg

SEQ ID NO: 6871074 - DNA, 58 bp, Homo sapiens
gggctatagttttagcagtggctgtatttttctgcagccacagctggtctctgagccc

SEQ ID NO: 6871075 - DNA, 70 bp, Homo sapiens
ggtcttattgcaaggtttgtgaaaaacatgatagcattgttgtgttgatatagaaatcttataaaagact

SEQ ID NO: 6871076 - DNA, 58 bp, Homo sapiens
cagagacagcaagttgatttcctggagcaatacctagggaattattcttttggctctg

SEQ ID NO: 6871077 - DNA, 76 bp, Homo sapiens
gactcttagaaaggaaaataatcaactcacataggaagcactaatgtgcaaattattttgccagactctgagggtc

SEQ ID NO: 6871078 - DNA, 104 bp, Homo sapiens
ccagctgaagtggatgtgcaatcttaatcaagccgtcctccttcctgccgagcagatggctggaaagacctgcttgcttttgatagtcatgtctttgtaactgg

SEQ ID NO: 6871079 - DNA, 80 bp, Homo sapiens
gttcagaacagcttcttgggagctgggtgtcgtggcacatgcctgtagtcccagctgctcaggaggctgatcgcttgagc

SEQ ID NO: 6871080 - DNA, 60 bp, Homo sapiens
ggcaggtcagttttaggaaagagcacctatgggtgtcatgggtctaaacattgataagct

SEQ ID NO: 6871081 - DNA, 107 bp, Homo sapiens
gggtgggggcactggccgggcctatctttggagtctcgagaatgctggccacagggctgtggtcgtgccctcagctctctaggccataggctttggcagccccaccc

SEQ ID NO: 6871082 - DNA, 67 bp, Homo sapiens
gggtaaatgttctgatgtagggtttagaaatcaggattattgtcaccctaaccaaacacccttaccc

SEQ ID NO: 6871083 - DNA, 72 bp, Homo sapiens
gttgtgtttatctttgagagggaaaattatctctggtctctacctggataatttgatacctcaatcagcaat

SEQ ID NO: 6871084 - DNA, 78 bp, Homo sapiens
gaggcagctttgctcttcaccacaccttggacggaccaccttctttctgttccatggcctgaaggagtgcatctcctc

SEQ ID NO: 6871085 - DNA, 56 bp, Homo sapiens
caagcagccccaacatgaggatgaatcgtattcccagcttgcaaatgggttgcttg

SEQ ID NO: 6871086 - DNA, 58 bp, Homo sapiens
ccacagtctatgcaacaaggtccagccagatgaagcctgtagccaggtagaactgtgg

SEQ ID NO: 6871087 - DNA, 83 bp, Homo sapiens
gaaatgctttgagtagaaatgtagtgtagagaaacattctgtgtcgtttcagcctagtcactgcatttctatatggctttgtc

SEQ ID NO: 6871088 - DNA, 87 bp, Homo sapiens
ttgggaagagagaagcctctctccagcttggcagattcattgaggatgttgcagagctggggagggtgttaattgtgtacttctcaa

SEQ ID NO: 6871089 - DNA, 83 bp, Homo sapiens
gagtgaaaatggcttagcagagttagaagagtaaatgggcccaatatcttccttcttttaattccggttgctgccagtatctc

SEQ ID NO: 6871090 - DNA, 85 bp, Homo sapiens
agtaaatactggtaagaatgatcctgcaccttcaagaaaataatcagattattttaaagaaggcagagaatataacagtgtttct

SEQ ID NO: 6871091 - DNA, 116 bp, Homo sapiens
gagatttggtcctaattatgtctttgctcactatccaataaatatttattgacatgtacttcttggcagtctgtatgctggatgctggggatacaaagatgtttaaatttaagctc

SEQ ID NO: 6871092 - DNA, 61 bp, Homo sapiens
gccaggagaattaggaactcaagataaccaatcagttatttgctagtggaattttcctggt

SEQ ID NO: 6871093 - DNA, 68 bp, Homo sapiens
gtcagtttccaggcactggggctcttttctttggagaatgatacatccaggctgggacttcaactggc

SEQ ID NO: 6871094 - DNA, 112 bp, Homo sapiens
ggtgacgttgttgccttttctgcaatcttttgcgtctatgtgtgagccttacatggcaggctgggaaggcataagaataggggtaggggcggttgaaagggtgcaggttgct

SEQ ID NO: 6871095 - DNA, 63 bp, Homo sapiens
ggaagctctgcctagatttcagaggatgtatggaaatccctggatgtccaggtagaagtttgc

SEQ ID NO: 6871096 - DNA, 70 bp, Homo sapiens
agagcatagtgttaaattgattcacctttctccatgtgagaattgtaagcaatttgattagcttttctct

SEQ ID NO: 6871097 - DNA, 59 bp, Homo sapiens
aagtcacttgattgttgacagaatttatttctttgcacctgttgaattcatggtgactt

SEQ ID NO: 6871098 - DNA, 79 bp, Homo sapiens
cggcaaagactgagacagctccgctgcccgctgaactccatcctcccggcggtcgggcggcggcggctgcggtcggtcg

SEQ ID NO: 6871099 - DNA, 66 bp, Homo sapiens
tgagcaagactgaaaagcctccctcccaaaaggccaaaaatttagagagctttcccattttgctta

SEQ ID NO: 6871100 - DNA, 60 bp, Homo sapiens
gcaatttgtctaatgaaactcagagtgccacagcttgtctttggttgattagcagattgc

SEQ ID NO: 6871101 - DNA, 78 bp, Homo sapiens
tgttgagcagtctgctagagtgttaggtatttgtgtgactctctgtaatctcttagcagtctagtgaccattttaata

SEQ ID NO: 6871102 - DNA, 59 bp, Homo sapiens
cagatgctgcacagctggagcggctgttggggaggctgacgccagccctgcagcacctg

SEQ ID NO: 6871103 - DNA, 78 bp, Homo sapiens
tctgcgggatacagtgggaagggcagaggctttggtgtcagacagacgttagttctgatcttcccactaatgcgtaga

SEQ ID NO: 6871104 - DNA, 64 bp, Homo sapiens
agaatgtgtaaataagattcagtgacagatttctgaatgcctcgccttatttattttgcattct

SEQ ID NO: 6871105 - DNA, 68 bp, Homo sapiens
gcctgggctgcagcgggagcgacgcgccggccgccgggtgggggtggagccccgccgcggccccaggt

SEQ ID NO: 6871106 - DNA, 56 bp, Homo sapiens
gctgtcctctgatctctggaggggagaatggccccaccaagcagcagatgggcagc

SEQ ID NO: 6871107 - DNA, 82 bp, Homo sapiens
tgcaaagcgaccactggaaatgacacgtcacttgattacgttcaattggctaatgcaagtccatgtttgtatctgctttgta

SEQ ID NO: 6871108 - DNA, 81 bp, Homo sapiens
ggggcactgcagggagggccctcctctttctagctgaggtcaccgaggtgcagagaggtggagggactttctcaaagtctc

SEQ ID NO: 6871109 - DNA, 57 bp, Homo sapiens
tccttggtctgtgcctgactccctctgggacagggagatccaggcaaggccgcaggg

SEQ ID NO: 6871110 - DNA, 64 bp, Homo sapiens
tttagtcggttcagggtcacccagtagtgttgctctgggctgcggatgtctttggaccactgaa

SEQ ID NO: 6871111 - DNA, 58 bp, Homo sapiens
agctgtcaggcagaactgagcttcttggcttcaatctgctcagtgtggcctgagtgtt

SEQ ID NO: 6871112 - DNA, 69 bp, Homo sapiens
ctgtgaattgaatatgactatgttttgctcctgaatttcaaatacagatgatagtcatgttattctcgg

SEQ ID NO: 6871113 - DNA, 98 bp, Homo sapiens
cttctcagtactcaaacagatgccccatgtatcatgaagtttcttcattttgctattaaaatggaagctatttatgattctgaaggagctctgagaag

SEQ ID NO: 6871114 - DNA, 71 bp, Homo sapiens
ttcacagaatttttcgaatgtactgtgtgagtagaacttcaagcagccattgagcgaaaaaatctgttgag

SEQ ID NO: 6871115 - DNA, 73 bp, Homo sapiens
ggaccaagcactcccgagaggaagggcatgctcaaattgtttctgtaaaaagtctctggcggtgtttggctcc

SEQ ID NO: 6871116 - DNA, 71 bp, Homo sapiens
ggaagagagggctgggcctcaaacaaagcctgtggtgcctcaggtgagacctcctagccctctgtcattcc

SEQ ID NO: 6871117 - DNA, 94 bp, Homo sapiens
cagagttttgtttgcttaatagcttgactattctatgatgttggagttactaaccatagagaatgttaagtaccaaaatgaatactaaactctg

SEQ ID NO: 6871118 - DNA, 57 bp, Homo sapiens
caagggagaaggatgcttggtcattttgagtgtcatagtgtccttgatcttgccttg

SEQ ID NO: 6871119 - DNA, 72 bp, Homo sapiens
taccatttgagagagaacataatctttcatctgattttcttttaggatgtgtgctttttttcaaataaggta

SEQ ID NO: 6871120 - DNA, 92 bp, Homo sapiens
gaagagaggaggtgtagaaagagtgtgggctttggactcaggaaccctcagctgaattcacagttctgcaccttactaggcctgctcccttt

SEQ ID NO: 6871121 - DNA, 80 bp, Homo sapiens
tggaagcaagtattgtgctgcttactcagattgctacagttgctagctgcagccctggaagccacagtcctacgctttca

SEQ ID NO: 6871122 - DNA, 86 bp, Homo sapiens
taatggcataggagataattttcatttttgtaaaatgtctcatcgataggctgcaaaataatgaacgatttttttctgtggcatta

SEQ ID NO: 6871123 - DNA, 92 bp, Homo sapiens
atccctgaagatcttgttagaaagcagattctgatgcagtaggtctaaggtgagacctgagattctgtctttctgatgagctcccaggtgat

SEQ ID NO: 6871124 - DNA, 81 bp, Homo sapiens
gctggtcggagatgttgcaacttgaataggcatttctaggataccatggaaatgcacaaagtaagtgtaattgctaccagt

SEQ ID NO: 6871125 - DNA, 94 bp, Homo sapiens
ccaggagccatcgttttctagtaaacaggggtgaacttcattgtagcataaactatagaagatagcttttgtttctgtaaatgaaaacacctgg

SEQ ID NO: 6871126 - DNA, 79 bp, Homo sapiens
gctctgtcagagctgtgtgtttccactgagctcgggtttctccgatgtgtttctgtggtatgcagtttgtcacaggagt

SEQ ID NO: 6871127 - DNA, 58 bp, Homo sapiens
ccaaggcagtggttgtgatactgtgttccagtaaggtgcattagtagctagtgcctgg

SEQ ID NO: 6871128 - DNA, 90 bp, Homo sapiens
cagtaaaaatgctctatgtacacggtggctctgaaggacacatttcatctctttttcagacctgctgtgctatctattgctgttttggtg

SEQ ID NO: 6871129 - DNA, 70 bp, Homo sapiens
tttttgtgctgtttctgaacaccctgacctctctccagggctaggtggaagctccgaggcaccataaaaa

SEQ ID NO: 6871130 - DNA, 90 bp, Homo sapiens
atgccccacctctggtctggatgcccactatctgctggctgacctcctcttgcacatggagcctgctggtgggtgcccctggtgaagtat

SEQ ID NO: 6871131 - DNA, 56 bp, Homo sapiens
ggttcactccgatctctgcctccctctgacgaggccctctgcgattccagtggacc

SEQ ID NO: 6871132 - DNA, 71 bp, Homo sapiens
gaagattgcgtgaggattttgttactgttcaactttgagagctgtttgtaacaagaacctcatgtgacttt

SEQ ID NO: 6871133 - DNA, 99 bp, Homo sapiens
gaggcacgagaatcacttgaacccagcaggcagaggttgcagtgcgccgagatcgcgccactgcactccagcctgggcaacagagtgaaactcagtctc

SEQ ID NO: 6871134 - DNA, 66 bp, Homo sapiens
atctcagcactttggaaggctgatgcgggaggaatgcttactcagttactcttgagaggctgaggt

SEQ ID NO: 6871135 - DNA, 63 bp, Homo sapiens
tctttaccttctttgcttgtgccagtcttgtttcattgaaaggtttggcagtggaggaagaga

SEQ ID NO: 6871136 - DNA, 55 bp, Homo sapiens
ccactggttttattgtagcttaaaattgagctctccacacataggactagcttgg

SEQ ID NO: 6871137 - DNA, 77 bp, Homo sapiens
cagatctggaggttaggaagtccaagaccaaagtgctggccaatttggtacctggtgaagggcttctttctagtttg

SEQ ID NO: 6871138 - DNA, 85 bp, Homo sapiens
atctatgtaattgtcaaaaattgcaattgtcattcaatacacatgtttgagcacacaatgagctaacttttgggaattcaaagat

SEQ ID NO: 6871139 - DNA, 67 bp, Homo sapiens
gtgaacctgggaggcagagcttgcagtgagccgagatcgcgccactgcacttcagcctgggtgacac

SEQ ID NO: 6871140 - DNA, 68 bp, Homo sapiens
cagtgcacatcatgctataaaaatttgaaaaacctaatgagcccaagtgttagcaaagatgtggattg

SEQ ID NO: 6871141 - DNA, 71 bp, Homo sapiens
tggtcttcatgaatttatattattagtgactgagagatcatcattaatattaaggtggatttataagaaca

SEQ ID NO: 6871142 - DNA, 80 bp, Homo sapiens
gatttttgctctgggagaagctgatgtgaagcaccaatgccttcacttgctcatcatgctatttcctaaagtattggatc

SEQ ID NO: 6871143 - DNA, 64 bp, Homo sapiens
aggcagcttttcttactgtgcttgtctgggttaatttaaaccacacctgttaagaagagtgcct

SEQ ID NO: 6871144 - DNA, 66 bp, Homo sapiens
gacctactagcaaaaagcagggttgatatatttttctgttggtgtgttaaatgttttgctagtgtc

SEQ ID NO: 6871145 - DNA, 88 bp, Homo sapiens
tctgaattttattagagtatatgactttcttttgcagacactactagtaggtattttgcaaagtcttgtctttgaggctgattctaga

SEQ ID NO: 6871146 - DNA, 57 bp, Homo sapiens
agagttctgcggtatgtgagaaactgaaccacagacctctacattcccagcaactct

SEQ ID NO: 6871147 - DNA, 81 bp, Homo sapiens
gtgtcagaaacccctgggccaggggcctcttctgatagtcagcatacatttcaaggggtccttgcttgggggctcttgcat

SEQ ID NO: 6871148 - DNA, 58 bp, Homo sapiens
ccctggtcagggaaggcgcctggcttccagctgtgagacaggctccgcaggactaggg

SEQ ID NO: 6871149 - DNA, 62 bp, Homo sapiens
gctctggccagaccctcagtggggctgctgcccagcactgggcaattctgagcctaagatgc

SEQ ID NO: 6871150 - DNA, 106 bp, Homo sapiens
acccagaagtttatttaagctgcacatttctaggaaattaaatgcaataacacctaatttatctgatattattggagatgtgctctcttatgtggattttccaggt

SEQ ID NO: 6871151 - DNA, 74 bp, Homo sapiens
gctgcagagctcatgtttataaccattaggcaaactgttagcctgttgtggaaaaagcctgattgtcatgcagc

SEQ ID NO: 6871152 - DNA, 109 bp, Homo sapiens
agagactttagaagttatctggtcaggatctcccagtacatatctctcctgtgtatgtaaggttacaggcatatgtttgtggaagacttgttagataagaaggtgctct

SEQ ID NO: 6871153 - DNA, 76 bp, Homo sapiens
gggctgaatatatttttatgggagaaataaaatggatagttttaaacttgaatttagtttttcctaatggaggccc

SEQ ID NO: 6871154 - DNA, 78 bp, Homo sapiens
gagttgaggccggagacaagagacttatttttcacctggctcagccaccaggtctcttgctgtctctgggccttattc

SEQ ID NO: 6871155 - DNA, 63 bp, Homo sapiens
tcagttcttttctagattctggatctaaatctcatcttagaaggaatttaaagaggaattaga

SEQ ID NO: 6871156 - DNA, 63 bp, Homo sapiens
ggccaaaagaccacctcctggtcgaatacccttattgtattagtgacatttggtggtcttgcc

SEQ ID NO: 6871157 - DNA, 64 bp, Homo sapiens
atcagcttggaccaataagatgaggaaaagaaaataaaattcattctagcagttacaggctgat

SEQ ID NO: 6871158 - DNA, 82 bp, Homo sapiens
cccaaatctctttcagttttattccaatgtgcagcacagtttcattattttgtgtatgtgccacaatggaaagaggtttggg

SEQ ID NO: 6871159 - DNA, 57 bp, Homo sapiens
agtcctatgagagtttaatgctgccactgatctgacaggaggcagagctcagggact

SEQ ID NO: 6871160 - DNA, 107 bp, Homo sapiens
gtggtgatggtggcacaacgttgtgaatatacttaatgccactgaactgtatacttaagaacagttaaagtggcttatattatgtatattttgtcatacacacacac

SEQ ID NO: 6871161 - DNA, 59 bp, Homo sapiens
atttctgggctctaatccaggaacattgaatcagaatatctgggggtgagcctagaaat

SEQ ID NO: 6871162 - DNA, 62 bp, Homo sapiens
gttggtacatgaacttggtctttttaggtctatatcctgtcagtccagagtaatgtgctgac

SEQ ID NO: 6871163 - DNA, 55 bp, Homo sapiens
aggactggcaattctctaaggctgacactctcaagccaagggggtagctattcct

SEQ ID NO: 6871164 - DNA, 129 bp, Homo sapiens
agataaagaaattaaggccaaaagacatgcagttaaaagacagcagagccagtggctctagagtttcctctctttacagttacactctgctgctttagcaaatgcttttcaccacaattattaagatct

SEQ ID NO: 6871165 - DNA, 95 bp, Homo sapiens
ctcttttgaagaaactgggataaaaggaaagcctgttgtgacaaagctggcccatttgtagcataggcattttcccctttttcccggcgtatgag

SEQ ID NO: 6871166 - DNA, 59 bp, Homo sapiens
ctcacaagaactgctcagtcttccgcaggattattctgctggagaagcaaagttctgag

SEQ ID NO: 6871167 - DNA, 82 bp, Homo sapiens
tcaatgaatgtttgttgagtgaagaaatgagaacttgagaaatgaaggaattcagctccttcactcattcagcattcactga

SEQ ID NO: 6871168 - DNA, 71 bp, Homo sapiens
gaattagcacgtggcagagctcagacagaaacctacactttctgattccagagcattgctcattctatctc

SEQ ID NO: 6871169 - DNA, 59 bp, Homo sapiens
gctaggcttggcacaggtacaggggagaggttacggagtgggtgtgtgcagggcctggt

SEQ ID NO: 6871170 - DNA, 111 bp, Homo sapiens
gtcaactcagggggcatgtttggtttagtacctgccagcgtgttgttgacaaacaccatatactctctgttgcaaagccaaaacatgaccttttccacaaatggagtaagc

SEQ ID NO: 6871171 - DNA, 61 bp, Homo sapiens
gggctcagggatgcctgagagtaggctttggccattctgagcaccttatattcttgagccc

SEQ ID NO: 6871172 - DNA, 78 bp, Homo sapiens
atcttttcttgtcacttatactgctttggaggtcaaaagttctggctttctcaaaagacagaagtgaaagtaccaggt

SEQ ID NO: 6871173 - DNA, 62 bp, Homo sapiens
acagtccttgatccaatagtgggagaaagaagtatcttccattataaaattcagggatctgt

SEQ ID NO: 6871174 - DNA, 78 bp, Homo sapiens
ggagaaaggagtgttagagtagagctggcccatggggagctgcccactctgcgcacctctgtctctctctctctctcc

SEQ ID NO: 6871175 - DNA, 61 bp, Homo sapiens
ctcaagatattccagctctcaaggactttaggctctctttggggagctggaattgtcttag

SEQ ID NO: 6871176 - DNA, 67 bp, Homo sapiens
gagacttgaggaagcagcaagggatgatattgtagttagctctgtagcagctgcttcttcctgtttc

SEQ ID NO: 6871177 - DNA, 91 bp, Homo sapiens
cagattatgaaccaagcagttatattactctcaggtaagctaaggtataagtttactgagggtttttatactctttgttctatgtaacatg

SEQ ID NO: 6871178 - DNA, 69 bp, Homo sapiens
gaagacctatttgttcagtggagagcaaggcttacatctacctgttactcctttggcagattatgcttt

SEQ ID NO: 6871179 - DNA, 75 bp, Homo sapiens
tctctcttccttgcctttaacccctgaaaggcttcactttgcggccacaggcacttaagggctgggaggcaggga

SEQ ID NO: 6871180 - DNA, 84 bp, Homo sapiens
gcacataaagaatgtacagtttagaaccatagatggcaattttaaatggatcatctcaaaattatgctgcacatgtttatgtgt

SEQ ID NO: 6871181 - DNA, 55 bp, Homo sapiens
tgtagtcacaaaaactgtaagcaacccaactgcttacaggaggaaattggctaca

SEQ ID NO: 6871182 - DNA, 64 bp, Homo sapiens
tctgcttttcccctactaacactgagttatgtcttctaattctctgatgcaggtggaagataga

SEQ ID NO: 6871183 - DNA, 108 bp, Homo sapiens
gttaaaatatatatgtgagtaattaattgatttaggcttgttatgaccagtttatcatgcttgtcaacagtattaggacatttgaaagaacttatttagaagtttaac

SEQ ID NO: 6871184 - DNA, 74 bp, Homo sapiens
agagagcaaaagtgttcaagcccttttgaggtctacatttgggagaggaaatgccagcacttcaattgcactct

SEQ ID NO: 6871185 - DNA, 77 bp, Homo sapiens
caaggtcacacaggtggtacttaaagtcagaactcaaacccaggttttttgactcccaagtatagctaagactcttg

SEQ ID NO: 6871186 - DNA, 99 bp, Homo sapiens
tacctgtcccttcttgcaggaattcagccttgggatgtggagctgtctccatgcagtgctggagctgattgattcccaacagcaagatcgatactggtg

SEQ ID NO: 6871187 - DNA, 75 bp, Homo sapiens
gagtgtatttatgtcctgtggctgccctgacaaattatcacaaactgggtggttttgaacaacagaaatgtattc

SEQ ID NO: 6871188 - DNA, 76 bp, Homo sapiens
tctgttgagtatgagatctgggtcccccgtgggctagtggatggccaggggggcgtagatgctgggttcagctgga

SEQ ID NO: 6871189 - DNA, 81 bp, Homo sapiens
ctagaacatgttattttggaaaatacaaactatggaaaaccctcataggtgtttgtaattttgtaaaattataggttcaag

SEQ ID NO: 6871190 - DNA, 67 bp, Homo sapiens
tgtcctgacaggggtccctctgggctgtggtgctgtggtaaacagcagtgggggaaccctgcagaca

SEQ ID NO: 6871191 - DNA, 61 bp, Homo sapiens
gcagatgaggaagctaatgctgagaagaacctcatcaacaagttggtttctcatatcctgc

SEQ ID NO: 6871192 - DNA, 80 bp, Homo sapiens
gcccaggctggagtgcaatggcacgatctcggctcgctgcaacttcgcttgccgggttcaagccattctcctgcctcagc

SEQ ID NO: 6871193 - DNA, 73 bp, Homo sapiens
gggtcactcactgcaagctgggacttagcgcagatagcacttgattgcgccactccctgctcagagaaggccc

SEQ ID NO: 6871194 - DNA, 84 bp, Homo sapiens
cagcattaatttagtggattaaggatgtcaggttgaatttttgtgatttcttggcttttcccctatggtccaaattttctgctg

SEQ ID NO: 6871195 - DNA, 67 bp, Homo sapiens
tttaatcgacaaatgggctgccatggaaatgactttcaaatgcacctctcatttgttcaaggttaaa

SEQ ID NO: 6871196 - DNA, 120 bp, Homo sapiens
actaaatttgatttgcttcattagaagaattgatatttcattctacatgtgctcagagtgtctagaacttgtgaaatatcaatgttatttcttagtaataagcagtgatttgtagttagt

SEQ ID NO: 6871197 - DNA, 69 bp, Homo sapiens
catgtagatgggaatggaaggcattttttgtagctgtaacaattatttgaattccttctgatgtatatg

SEQ ID NO: 6871198 - DNA, 69 bp, Homo sapiens
gtggaaggaaatgatagttgctgtatttctaaataggttgactattaacattgctgcattctccttccc

SEQ ID NO: 6871199 - DNA, 80 bp, Homo sapiens
gctagtaatgggataatctgtaaggctgcactgtctgtactggacagtaagtgcagacttacagattatcccattactgc

SEQ ID NO: 6871200 - DNA, 123 bp, Homo sapiens
agataacatgtgtaaaaacacttcgcacaatctctggcacatagtcagcactcaagaaatttggacttattgtttgtgtatgtatttgtgtgtgtgtgtgtgtgtgtgtgtgtgtatgtgtct

SEQ ID NO: 6871201 - DNA, 99 bp, Homo sapiens
caggagtttagaccagtgttttagatggtggtgtctgccctggtagctgtaaagtagccctcgtgcatccatcatttagaatatttacttttgctcctg

SEQ ID NO: 6871202 - DNA, 64 bp, Homo sapiens
attggcattcattaacgaaagtctttgcagtggaattgcagaaacagtcattaatgtagctaat

SEQ ID NO: 6871203 - DNA, 94 bp, Homo sapiens
ccactaacaacgaaagtgagcccaccttcctggggcttcgggtcccagtgtcactgtgttcccaggtgggttggcctctgtcgtgaagttttgg

SEQ ID NO: 6871204 - DNA, 58 bp, Homo sapiens
ttaaggagcacagtgtattaatctgttctttttcagatgtgcactttttgtatcttaa

SEQ ID NO: 6871205 - DNA, 76 bp, Homo sapiens
tggcagccttatttacagatgatgctatttgaaatctagtgtttgtaaatagaagttggtgatggtaaggctgcta

SEQ ID NO: 6871206 - DNA, 62 bp, Homo sapiens
agaatagtggcaatgactgcacataaagtatattgtagacgtagtcaatgtcactgaattct

SEQ ID NO: 6871207 - DNA, 63 bp, Homo sapiens
atattcttctgcaccgcgtggccatttgactcattttttggcctatgaaacgtaatggaatgt

SEQ ID NO: 6871208 - DNA, 122 bp, Homo sapiens
atgaagaaatattatttaaagtatatttataggtcggagtaaggacaaaattaaaatttcatacatttttggttaactttgatcctttgaatatttgcacttattaaaattattttttacat

SEQ ID NO: 6871209 - DNA, 61 bp, Homo sapiens
gggcctctgtgcagaggggcctcctggtcgtcagagcagcctgcccctgtggcaggcgtcc

SEQ ID NO: 6871210 - DNA, 58 bp, Homo sapiens
ggctggggtgtttgccttcgtccctgtgggggactagaggtggggctgcacctctgct

SEQ ID NO: 6871211 - DNA, 71 bp, Homo sapiens
tgtaaatcagggagaaatatagagttagagttaaattcaacaaaatatatttttccagtgatccatttaca

SEQ ID NO: 6871212 - DNA, 68 bp, Homo sapiens
catctatgttcatagaaatcatgaccttcacatctttgaggagtgtcagtgaaactatgaatatgatg

SEQ ID NO: 6871213 - DNA, 74 bp, Homo sapiens
gtgataatctatctgttcttcattaaaactgatactaagttcacattaatgaatatgacaggagaggaagtcat

SEQ ID NO: 6871214 - DNA, 66 bp, Homo sapiens
gtctattgtgatgttgtggggtttgttgggggcatgtgataaataatttccacataatcataagac

SEQ ID NO: 6871215 - DNA, 90 bp, Homo sapiens
ctgatcatataaagactgagttgaacatatgcaatctctcatttatgctgctgcaagagatctgtgtgcttaattcattttctattccag

SEQ ID NO: 6871216 - DNA, 55 bp, Homo sapiens
acagtgtccttgtggtccctgttgagttggaattaggggagtctagggaggctgt

SEQ ID NO: 6871217 - DNA, 77 bp, Homo sapiens
gatgaatttagtctttggatgtaagataaagtgggccaaagggctcctgctttgtcattccaaaagagtccttcttc

SEQ ID NO: 6871218 - DNA, 129 bp, Homo sapiens
tgttctgtggttgaatgtgtttttgcttaaataaagcttttggtatttgtttaaattacacttcttgagaagtggaaattttaggatcatctttgctttgtttcagttttgtgatttttgaaatgaatg

SEQ ID NO: 6871219 - DNA, 63 bp, Homo sapiens
gaaggaagctttctgtgttaatgctgctcgtcagagacagtaataacacagaaagtttgcttc

SEQ ID NO: 6871220 - DNA, 71 bp, Homo sapiens
gcatggggtgcagcctttgtttctacttggtatgttaatttacataagcacagattgctgcatccatatgc

SEQ ID NO: 6871221 - DNA, 74 bp, Homo sapiens
taccctgcatattcctatatgtgatctcatttgggctgttgtttatataagacctcatatgggtagtgtgggta

SEQ ID NO: 6871222 - DNA, 61 bp, Homo sapiens
gtttctcaggtgctatacgcaactgtggtgaataccaaagtgatttaagtacctcaggaat

SEQ ID NO: 6871223 - DNA, 72 bp, Homo sapiens
aacagcacttttgatatcctatacaagtaaaggaacccctctatttgttctcaggatcatcctaggtctgtt

SEQ ID NO: 6871224 - DNA, 78 bp, Homo sapiens
gagttcttgcctctgtgtcctgtccttcctggaagtcaggactctgcttcctcagggagcccggggaaggcggagctc

SEQ ID NO: 6871225 - DNA, 69 bp, Homo sapiens
ccaaggaaaacttgtactacggttgctacatcaagggatgaggaccttggaataacaaattctctttgg

SEQ ID NO: 6871226 - DNA, 83 bp, Homo sapiens
tgttctctctctgctccatagcttccatattgacaccagtttctttctagtggagaagtggagtctgtgaagccagggaaaca

SEQ ID NO: 6871227 - DNA, 58 bp, Homo sapiens
ggcccttacctcagttatttttaacccgaagggtgaactgaaaacatgggtgagggtc

SEQ ID NO: 6871228 - DNA, 56 bp, Homo sapiens
ggagagatggaaaacctcccagccatgggagctggaaggggtcggatccatcctcc

SEQ ID NO: 6871229 - DNA, 115 bp, Homo sapiens
agcccgcggcttccctcctgctcgctacttgacactttggttcacctgagtttccctcgcagagcctggagctggtggccagagagcagaggtgggtgggctgccactgtgggct

SEQ ID NO: 6871230 - DNA, 103 bp, Homo sapiens
cagcgtggctgcagaggcgtggatgcttaggcagcctggggagggacaggtgggaacactcgtgctccgcaggcgcccacaggcccagtgcccacggctgctg

SEQ ID NO: 6871231 - DNA, 76 bp, Homo sapiens
aacaggcggaagcaagtcccaccctgcccttccaggggatggggcccggctgggcagaggggcgcttccctctgtt

SEQ ID NO: 6871232 - DNA, 66 bp, Homo sapiens
gaacatttgatgatgacattggcttagcaccatgtagttataatccatgttcttcatttaatgttc

SEQ ID NO: 6871233 - DNA, 79 bp, Homo sapiens
ctcaggtggtctgtgggacagctggagggtccctgctgatctcagctggggttactcatgcttcctcaggttggctggg

SEQ ID NO: 6871234 - DNA, 64 bp, Homo sapiens
ttttaacaaggatcaacttttaggcaaatcatagaagacttgtctatggttacatcctagaaga

SEQ ID NO: 6871235 - DNA, 55 bp, Homo sapiens
gggagatgcactggacttagcatagctgccctggtgtcctggtcactgctctccc

SEQ ID NO: 6871236 - DNA, 129 bp, Homo sapiens
tgggcgtccacagcctctgttcctgcccactccaccaagagccccttaggctgttccaggatacagaggagcatgcaaggaccaagggagcatcttggaaggacaggagaagcggtatcaaggagccca

SEQ ID NO: 6871237 - DNA, 72 bp, Homo sapiens
ggctcagacttgttttacaggcttgttgtagtgataaaataaagtctgtgagagcaacatctgacatatgcc

SEQ ID NO: 6871238 - DNA, 57 bp, Homo sapiens
ttgtcacccctagaggaattctgcgtcctttcgcggccctgcctctgtgggtggcag

SEQ ID NO: 6871239 - DNA, 97 bp, Homo sapiens
ggaacatgtattacctctgggcagaagcagtgcaaagtccccagagagccctctagctcactgctgctgctatagaggtctagaaatctcatgttct

SEQ ID NO: 6871240 - DNA, 79 bp, Homo sapiens
ctcctatctgtttcatataacaatgtgattgaagctagaagagccttctggagaataatcagcattgaacagaaagaag

SEQ ID NO: 6871241 - DNA, 56 bp, Homo sapiens
cccggagggccctgcccatggtggctgaggaagaagtgcaggtgggcccttctggg

SEQ ID NO: 6871242 - DNA, 129 bp, Homo sapiens
gtggccaggtggggacacagtgctcagggtctgggtccccaggcagcctgcggtctgcacagatgaggctgtgcctgctagatggttgtcggccgctgagccctggggattgcagccctgtctgtgccc

SEQ ID NO: 6871243 - DNA, 65 bp, Homo sapiens
ctcctgatttgccaaggagttctgagtccagatttacctgaccctgggctcttaggtagcagggg

SEQ ID NO: 6871244 - DNA, 60 bp, Homo sapiens
atgctcagggcacactctggaccaattaaatccaaatctcaaggagagtgacccaagcat

SEQ ID NO: 6871245 - DNA, 107 bp, Homo sapiens
ttaggacagtgtttatctctgggaagaaggtctttctacattttatatgcttgcactttctttggataacatagttgtggaaaggaaacttttcagtattgtcttgg

SEQ ID NO: 6871246 - DNA, 111 bp, Homo sapiens
gaggccaagaccttgtttaccacctcgcaggacagtgctaggactagtggttgagatttccttttgaagtccagggctctctgtgggatggttgacaattcttttggcctt

SEQ ID NO: 6871247 - DNA, 79 bp, Homo sapiens
gcggacttcccgtaattgttatgtctcaatgccattgggaccactaatagtgtttgaagcatgatagcaaattgtctgt

SEQ ID NO: 6871248 - DNA, 90 bp, Homo sapiens
tctccttggcagagctgcatgagcactcagagccattccttaaccagctgtcctgggccctgccatgtagttccttccttgccagcctga

SEQ ID NO: 6871249 - DNA, 83 bp, Homo sapiens
actgctaggctgtgcttcagagtcagtgctggactcaaactaggcagtatgcagtacctactttgacagcactgaatagtagt

SEQ ID NO: 6871250 - DNA, 77 bp, Homo sapiens
aaaatccagattccagttctcctctctaaagtctctaattcagtaggtctggggtggagattggcaatctgtatttt

SEQ ID NO: 6871251 - DNA, 95 bp, Homo sapiens
tcctcaaaattttctaagaatgttctctagggagttctttctgggagtgattctcccagattcatagaaactcatagattcaaaaaattgtagga

SEQ ID NO: 6871252 - DNA, 78 bp, Homo sapiens
gcaagggttttcagagcaacagtttatggtttttctgtttggtttatagagatactggctgctcttgagaaaacttgt

SEQ ID NO: 6871253 - DNA, 64 bp, Homo sapiens
gtggccagatgtccctctcaggtttgttttctctaaaataatcctgtcttgaccatcaggctac

SEQ ID NO: 6871254 - DNA, 56 bp, Homo sapiens
aggacctcgcatttactaagctcctggtatgagctaagaactgtgccaggtgacct

SEQ ID NO: 6871255 - DNA, 85 bp, Homo sapiens
tctgaagctgcaagaagccaatcgtgtgaacttagtaatcaatttgattaatgtgaataaagttggcattttgcctcctttatga

SEQ ID NO: 6871256 - DNA, 60 bp, Homo sapiens
tacttccactgtttgtgtagctctgcgtataaaaagaatgctgtgcacatagtagaagtg

SEQ ID NO: 6871257 - DNA, 120 bp, Homo sapiens
acggttcagggaaccagaagcctgaaagcaagctgtctggaggctctgagggagaaggggttccctccccctccctagcttccgggggctgccggcacttattggcatccctagactcgt

SEQ ID NO: 6871258 - DNA, 74 bp, Homo sapiens
ggccagggtcttggcgccatcacccgtggccatggggtagtcaatgttggagtcggggaggcgcagccctggcc

SEQ ID NO: 6871259 - DNA, 64 bp, Homo sapiens
tgcttcctgggatccagtcaaagtatcttaaataacaattccacttagacttttccagcaggca

SEQ ID NO: 6871260 - DNA, 57 bp, Homo sapiens
agttgacagaggtatgaggtttgagtatttgcaaagccctcaagcagactgacagct

SEQ ID NO: 6871261 - DNA, 84 bp, Homo sapiens
tgtgttcctggtgaattcctggcaccaccacttctaggtgggtatggaatcaggaagaagggtgttagggagccattgaatata

SEQ ID NO: 6871262 - DNA, 58 bp, Homo sapiens
ttggggcagagaggatacggcaactctcgattttgttgtgaacctaaaactgctgtaa

SEQ ID NO: 6871263 - DNA, 75 bp, Homo sapiens
gccaatcacaacctcttctccataatcaacactctttacctgaaggcaggcttgatatggggggactgtgagagc

SEQ ID NO: 6871264 - DNA, 90 bp, Homo sapiens
gggtgttcctgggcggggaggtccagccaagcggcaagggtctgcgctgtgcctttagtttttaggttgggcccctcctggggagcaccc

SEQ ID NO: 6871265 - DNA, 84 bp, Homo sapiens
gagggcaacatctttgtcactgccacaggctgtgttgacatcatccttggccagcactttgagcagatgaaggatgatgctatc

SEQ ID NO: 6871266 - DNA, 78 bp, Homo sapiens
acaaagcatgatagggagcccatgggcagatgtctgcaatttataaatgtgtgccctgaagcaccctcacccttctgt

SEQ ID NO: 6871267 - DNA, 64 bp, Homo sapiens
gtgtgccatttgcttcctgttagaactcggattgatagaataaccttggagtagattggcatat

SEQ ID NO: 6871268 - DNA, 75 bp, Homo sapiens
cagggggcgttatgaaaggtgctaacagatgcggatttcagctttgtcattaaaatgcttctcaaacgccacctg

SEQ ID NO: 6871269 - DNA, 60 bp, Homo sapiens
gcagatgcaggcagcaggcctgggtctggcttctggcctgggtttggagcctgcagaagc

SEQ ID NO: 6871270 - DNA, 75 bp, Homo sapiens
tgcacatgtggaatactttgttgtcttccaaattgtgtctaacttggcagaggagaaagaatgaatacatgggca

SEQ ID NO: 6871271 - DNA, 58 bp, Homo sapiens
tatcattgtgttatttcttccaccagggcgcagcagtctggaaatagaaacaatggtg

SEQ ID NO: 6871272 - DNA, 72 bp, Homo sapiens
gtaaggttaacatagtgctttatctggtgggtctcatgcacacacacacatataccacaatgcaaaccttat

SEQ ID NO: 6871273 - DNA, 56 bp, Homo sapiens
gggggaaagtggaggttcgtgaaactctaccttggtttcccctactcctttccctc

SEQ ID NO: 6871274 - DNA, 83 bp, Homo sapiens
tgttgattataacactgccttgtcaccattgtgttctttctaagcacagacacagcttggtcccctggcagtgatatacagca

SEQ ID NO: 6871275 - DNA, 55 bp, Homo sapiens
gggaggctcagtggtgtcctctactgtgtggttgggggtgcttagaaggtctcct

SEQ ID NO: 6871276 - DNA, 64 bp, Homo sapiens
tctagctagttcctgggtatggaagggatactaaggcaggcccatttctgggagacatgctaga

SEQ ID NO: 6871277 - DNA, 130 bp, Homo sapiens
tgtctgccatatttcctacacagcgattttggctacattaagcttttgcactgagagcataaagagttttgagaaaaagtgatgatgatgatggctcaatccatgtgggaaattaccatataaacagaca

SEQ ID NO: 6871278 - DNA, 57 bp, Homo sapiens
gtagtactgctattggaatagagtcaagagcctagccatttccagtagctgtatcac

SEQ ID NO: 6871279 - DNA, 64 bp, Homo sapiens
aggccgtggccgggcccggctgcttaggtaggccttctcctcttccagtgcccgacgcaggtct

SEQ ID NO: 6871280 - DNA, 76 bp, Homo sapiens
gccagcctgctgagatgcctctgtcctccaggataacccttatcactgcaaggaggcttctcaaggctctgttagc

SEQ ID NO: 6871281 - DNA, 56 bp, Homo sapiens
gtcaggtcttggaagataggcttctcatacaacccaagcctgtcttttgacctgac

SEQ ID NO: 6871282 - DNA, 72 bp, Homo sapiens
gatgcacatgtgagtatagaaggcaatctttgtcttttttcctttaaaatttaacttctcctcatatgtatc

SEQ ID NO: 6871283 - DNA, 130 bp, Homo sapiens
atattcagcctccagaataatgatgtattgattggataaggacaagaaaatggtatatttgcaaggaagtagcctagtcaggcaattactttcagatgtgctgtaaaacagttaatgtgaggcaagatgt

SEQ ID NO: 6871284 - DNA, 74 bp, Homo sapiens
attaaaatctgtgcctggggaataatcagatgctttaaaagcaatttaattgttcttctggctatagagataat

SEQ ID NO: 6871285 - DNA, 60 bp, Homo sapiens
gactagtcagtccctactaaagtatttccaggacttttggaaacttaagggggagatgtc

SEQ ID NO: 6871286 - DNA, 63 bp, Homo sapiens
tttgcactgtaccataggtaagctcagagaagagggttcttgcttaagatggcatagtacgaa

SEQ ID NO: 6871287 - DNA, 89 bp, Homo sapiens
ttatcacatgtttatggaatagattatttttatttctatttcacagatgaaactgaaacttaggaagtaatctttgtaaaatgtggtaa

SEQ ID NO: 6871288 - DNA, 129 bp, Homo sapiens
aggctatgatctctcggagtagtggggaaagcagtccttcccttaaggtcacctctttttgatctggtcacctttttccaatgagggaagtaatcagactgcattgctagtgtcctagagcatgaactt

SEQ ID NO: 6871289 - DNA, 93 bp, Homo sapiens
aatttgatagtctttgatagcaatatgacattgctacatccaagtgtgggagtcagtacacttatattgcgcatatcttggacattttaggtt

SEQ ID NO: 6871290 - DNA, 87 bp, Homo sapiens
gcctcagccagacaactgttgctgccttggagaagctcctgctgctgcagctgctgcttggggcggctgcacgcctggggctgaggc

SEQ ID NO: 6871291 - DNA, 77 bp, Homo sapiens
aatttctttccgcaagagtttgctgccctctggtgggtgttattgccatattgcacaaacttttcctggaaaagatt

SEQ ID NO: 6871292 - DNA, 55 bp, Homo sapiens
gtaggaattggctttggatgtgtaaaatcacaaataaccacagcagagttcttac

SEQ ID NO: 6871293 - DNA, 75 bp, Homo sapiens
tcttatcctggagaatctgataggaacaggctgagcagaggctggagtcaggtcaggttttccaaggagctcaga

SEQ ID NO: 6871294 - DNA, 78 bp, Homo sapiens
accctatgcctattttgctcacttccctattctggtgctttggttggtcctttgagcaagatccccggggctaagggt

SEQ ID NO: 6871295 - DNA, 67 bp, Homo sapiens
cttttgtagattcattgaacttttgtaaacacaccaggtgaacaggaaaggaaagggtctgggagag

SEQ ID NO: 6871296 - DNA, 56 bp, Homo sapiens
gggtgaattcacagacctggccagtctcctcctggcttcaaggtgataatttaccc

SEQ ID NO: 6871297 - DNA, 71 bp, Homo sapiens
ccgctggccctggggcaggagggtacagggagttggccctgagcccctctgacctcagagccgaggcgcgg

SEQ ID NO: 6871298 - DNA, 75 bp, Homo sapiens
tgtaacagttgctctagggaggcaatagcaatgttcagatgaatggtgaattcctttcctattgctgctctaaca

SEQ ID NO: 6871299 - DNA, 58 bp, Homo sapiens
ttctgggatgtacagttttgccttatcctttcagtttggcagctgtgcattcttagga

SEQ ID NO: 6871300 - DNA, 89 bp, Homo sapiens
cacattttgtttatctattcatcagctaatggacatttggattgtttcaattttttggctgttatgagtatcatgtacaagtttatgtg

SEQ ID NO: 6871301 - DNA, 118 bp, Homo sapiens
tgtgttattccttgggtgttctgatttcatatgacagctttttctaggattcaaaccataaacatttcctctagagactgtaatgagaggtacaattatcaacccaggggactgtaca

SEQ ID NO: 6871302 - DNA, 59 bp, Homo sapiens
cacggcctcctgggcccggcgatactcatagacgctgccgtgctcgggaaaggccagtg

SEQ ID NO: 6871303 - DNA, 71 bp, Homo sapiens
aggaatgggaggaggggagctgagagctggggacaaggaacttctcagagttcctctggagtcccaatcct

SEQ ID NO: 6871304 - DNA, 77 bp, Homo sapiens
tgcaactaggttaatcctttttgttgcttctttctttctttccggaaaagaactcagagaggattttactgtaggta

SEQ ID NO: 6871305 - DNA, 61 bp, Homo sapiens
cctctgtctgaaatgacctttccccactggcggcagcgctagttctttctcaccatagagg

SEQ ID NO: 6871306 - DNA, 56 bp, Homo sapiens
gtccagggccccgagcaccaggcccagcagggctgtcagtgattccggctcaggac

SEQ ID NO: 6871307 - DNA, 93 bp, Homo sapiens
tacttggtgacttgtgagttgttgatacgggagctagattacatgtcagtaaacatgagaatagaaatgtgataatagcttaaggaactagtg

SEQ ID NO: 6871308 - DNA, 95 bp, Homo sapiens
ccttaatgcacatatacctgtttgtaaattgtggtttcttctaattttactgaaaaagctgagcacattcaaacaggtctgtgtaatattgacgg

SEQ ID NO: 6871309 - DNA, 101 bp, Homo sapiens
ctgagatggagcctcgtcctgttgcccaggatggggtacagtggcacgatctcagctcactgcctctgcctcctgggttttaagtgactctcctgcctcag

SEQ ID NO: 6871310 - DNA, 72 bp, Homo sapiens
gttcattgttgtgtctcagcaggtagcatatagtagatactctctaaatgtttgtgggataaacaaatgaat

SEQ ID NO: 6871311 - DNA, 60 bp, Homo sapiens
gggcttcagaaggtggctccacttctgggtggcagtgacaggcagacctgctgagagccc

SEQ ID NO: 6871312 - DNA, 82 bp, Homo sapiens
caaagatgaataaagcagggtccttgcactagaggaaaccttgaggattcagaagtgaaggcactcattttatctatctttg

SEQ ID NO: 6871313 - DNA, 84 bp, Homo sapiens
ctgcagttgtcttgcatgtttattagtgtaatgaatcacatttatgaaagcattacaaagttataaacagttataacagcgcag

SEQ ID NO: 6871314 - DNA, 64 bp, Homo sapiens
cagagctagttagtgtcggagtcaggatttgagtctcgggtttctgacaattagcctagtcctg

SEQ ID NO: 6871315 - DNA, 76 bp, Homo sapiens
aagccagtgtgacaggaaactttgtgtcttctgtgtgacataaaaccatccattgtttcttaaattccatttgttt

SEQ ID NO: 6871316 - DNA, 58 bp, Homo sapiens
tgatggtttatgatagatgggaaatagttaactttttcctattaatgttaaccagtca

SEQ ID NO: 6871317 - DNA, 63 bp, Homo sapiens
atttcaaggatgttatataaatggaatcgtacaatatatagccttttgagatatccttgagat

SEQ ID NO: 6871318 - DNA, 60 bp, Homo sapiens
gtatacatgtggtaaaatgcacccatttggagtgttcagagagttttggcagatgtttac

SEQ ID NO: 6871319 - DNA, 78 bp, Homo sapiens
agtaaagagcagatttgctttcagccttaaggatagagatactgcctatcactggagtgaaaggcaaacatgcttact

SEQ ID NO: 6871320 - DNA, 83 bp, Homo sapiens
gcaaattccagcgaagaagccatgctgtcccaggctctagggatgcgcggagcactgagggagggtttcttctgaggaagagc

SEQ ID NO: 6871321 - DNA, 80 bp, Homo sapiens
taattcactagtattctttggttgtgtgcaaaagaaactgaccctgactaacatgaaccaaagaaaactgtggtgagtta

SEQ ID NO: 6871322 - DNA, 59 bp, Homo sapiens
atgagtatctgttgggattttgttgtgtcttagaaaattaaaatctcccagaaacttat

SEQ ID NO: 6871323 - DNA, 119 bp, Homo sapiens
cttacagtatactttccaacacccatatggtgagggacatcactcagccaacagatgtggctttatggtttcagtgactgtctctgcacatagaggggccagggatagataaaggtgag

SEQ ID NO: 6871324 - DNA, 76 bp, Homo sapiens
ggagagagtcccatctattcccttctgatttactccagggctgcctgggcacaggggaatggatgaaatgagctcc

SEQ ID NO: 6871325 - DNA, 77 bp, Homo sapiens
gatgctggtttaaaatgcaaattcctagattctctctccaatctagctgagtcagaattgtattttaaaccagaatc

SEQ ID NO: 6871326 - DNA, 64 bp, Homo sapiens
ctctgtcagcaccagttatcctcaggggtatcaccacttctgggaggctttggtgttgacagag

SEQ ID NO: 6871327 - DNA, 75 bp, Homo sapiens
ggatatgaaacctatttttacagcataagttcttcagtgaagatttatgactggtgaatagaacccaatgtgtcc

SEQ ID NO: 6871328 - DNA, 73 bp, Homo sapiens
cttggcctattccagcagctgtggactcctaacagttttccccactcacttacagctgcagaatcaggctaag

SEQ ID NO: 6871329 - DNA, 56 bp, Homo sapiens
gccttccctggctaggcaagcataggcttcaaggaccttatctgccagggacaggc

SEQ ID NO: 6871330 - DNA, 86 bp, Homo sapiens
gactacacttctctgggaatcagaatgaacgtcttcatgactacttatgatatagaacgattttacttttgaaatccagatgagtc

SEQ ID NO: 6871331 - DNA, 67 bp, Homo sapiens
actatgaatccacattgatttttgctttttaaatatatccacaagtgtgcatcgtgggattcatggt

SEQ ID NO: 6871332 - DNA, 79 bp, Homo sapiens
aaattcctgagcattttaggatcacattagaaagcaagagaaaaaaagtaaagtgacccttagaagctgcagcgaaatt

SEQ ID NO: 6871333 - DNA, 89 bp, Homo sapiens
aatagtaactaggaaaggaatactttctagatggattatttaactatttgggctaattcctagaaattattctcagacaagttactttt

SEQ ID NO: 6871334 - DNA, 130 bp, Homo sapiens
ttcttgacccggtggtcatatggtatgcacattatgatatgttaaaaaatatatatgtatgtgtgtacatatctgttgtggacatgcatacatatgtttcatgtactttgtccatattccacaataagaa

SEQ ID NO: 6871335 - DNA, 85 bp, Homo sapiens
aactgcctttcaaaacagttctccaggaagccagtctgaatttactctggtttttaaaaaagaatcatgtgtttgaccagcagtt

SEQ ID NO: 6871336 - DNA, 106 bp, Homo sapiens
gttgccctacacgtgatcacacatgaagaatgtacatagcatcatctaggatagcttgtgtccaggatggccctgacactttctggtattcatgttcttgggtaac

SEQ ID NO: 6871337 - DNA, 72 bp, Homo sapiens
aggagtgatataactatattattagaaaaaaatgtatggagttagctgataatggcttgtggtgttattcct

SEQ ID NO: 6871338 - DNA, 75 bp, Homo sapiens
agtcgggggaggtgtgaagctgggcaggtggccacgttcttattgtcagccagctcgcactcttgcccctagact

SEQ ID NO: 6871339 - DNA, 55 bp, Homo sapiens
ctgtctgccaataatctatggccactcccttcagtctggctgagaggcagcacag

SEQ ID NO: 6871340 - DNA, 61 bp, Homo sapiens
tgctgtgtagaagagctatcctcatggcttaagaatagaaagctaagtcattttgccagca

SEQ ID NO: 6871341 - DNA, 57 bp, Homo sapiens
cctgggtctgggcctcctggagttggcaagagctgctgactgagaacctgacccagg

SEQ ID NO: 6871342 - DNA, 74 bp, Homo sapiens
gcagctccaggcaggtgggctgcccttgaggtcagcctgggtgtttccaggggggctaccgtctctggagctgt

SEQ ID NO: 6871343 - DNA, 115 bp, Homo sapiens
tcgctaggccaagaacacaaatataggctgctgagatccctttagatgttggcatacaactagccgaagagagaggaggtctcagaggtttgtaagagttgagttctgctagcga

SEQ ID NO: 6871344 - DNA, 57 bp, Homo sapiens
acatagatgaggggctgatgggtgcagcaaaccaccatgtcacatgtatatctatgt

SEQ ID NO: 6871345 - DNA, 65 bp, Homo sapiens
acaggcacctgccaccacatctggctaatttttgtatttttagtagagatggggttttgccatgt

SEQ ID NO: 6871346 - DNA, 59 bp, Homo sapiens
gagtcagaagaaactatttacaggccagagaggtgcagcctgatgggtcattctggctc

SEQ ID NO: 6871347 - DNA, 60 bp, Homo sapiens
gttaacatatgtaaagtggatagtgactgattttcaaaacattattcatacatgtgtgac

SEQ ID NO: 6871348 - DNA, 117 bp, Homo sapiens
ggagctattatttctggaagtggctcctgatttcagctgcttcctgatgtgatggaggacacatggctctggagctggcggctgatgcagaggcacactgactggtttagtggctcc

SEQ ID NO: 6871349 - DNA, 85 bp, Homo sapiens
ccttattgagggaataaaggcaccataaggcaaaactgctgttttaggctttattgtttttgaacttaggcttccttctagttgg

SEQ ID NO: 6871350 - DNA, 56 bp, Homo sapiens
gcatctcttacccacgagccaggccagctggtctgttccactgactaagagcatgc

SEQ ID NO: 6871351 - DNA, 95 bp, Homo sapiens
tccgcggccccgggaagcgcggggcggggcctcgcgaacggcctcggggttccgcaggcccgccccggcctcacctgcgcgcacctggacgcaga

SEQ ID NO: 6871352 - DNA, 81 bp, Homo sapiens
aagtaccaatagtaattattagtgatgttgttactgtcattctgaaaataatagtaagtagctaatatttactgggtattt

SEQ ID NO: 6871353 - DNA, 86 bp, Homo sapiens
ggtcattgactgcgtctacacagggtatggcttgaggattggttaggttctccaagatgaagctgtgtaggatgtggtaatgcacc

SEQ ID NO: 6871354 - DNA, 71 bp, Homo sapiens
aatggcagagggattgaacagctgagaatatttttgtaacttaagaaagctgctcattactttctgttgtt

SEQ ID NO: 6871355 - DNA, 59 bp, Homo sapiens
cttcacattgggcttgatatgaccttttgctgctgctgatgtcagtcagtcctgtgaag

SEQ ID NO: 6871356 - DNA, 110 bp, Homo sapiens
gggtgggtaacaggagctacaggccagcaatgcccttcctgtcctcggcctggctcaaggactgggtgcagagggcatcagcgatgccaggcctagaatgtgcctcaccc

SEQ ID NO: 6871357 - DNA, 88 bp, Homo sapiens
gggagcaccattgtcgcgtgtccagatgaggagacgatgtgttgcacacagcattgtctgccatatcaggaacgtgctggctgctgtc

SEQ ID NO: 6871358 - DNA, 67 bp, Homo sapiens
gcagagacattttacaccaagacttcttcattaattgacatgtttgtgtgtgtgagtgtgtagatgt

SEQ ID NO: 6871359 - DNA, 130 bp, Homo sapiens
aaggaactcattatttcagatgtgtggactcagaatgtgacactgtaagatgagcttttttaactgggaaagttaacaaatttgttttaggtattgctatctgtcactcaatggaatgttctaccccctt

SEQ ID NO: 6871360 - DNA, 86 bp, Homo sapiens
tgcacaagtggaagagagtttaacacaagaaaagttaggaaaatctgatttggcttggatgattaaacactttggacaactttgca

SEQ ID NO: 6871361 - DNA, 70 bp, Homo sapiens
gagtgcttacaatgacaggtgtatcattatgactttacatatatcacctcatttattgttttgagcaatc

SEQ ID NO: 6871362 - DNA, 65 bp, Homo sapiens
gggtgggggagatgcttaggtccggggaatctctgagattctcggcttcccctctcccctcaccc

SEQ ID NO: 6871363 - DNA, 122 bp, Homo sapiens
gttgaaatgaacaataaggaagtacaggagttcaggaatgaaaatgttaaattaaatggaccatgtttaacattgttgttgatcctgaggaacagtttttccagtatatggagcatttcgat

SEQ ID NO: 6871364 - DNA, 106 bp, Homo sapiens
ggaaaatacttttcagaaatatgttacgtattcctgagcagtaaaatgggcaacttcacacatgctgataagaatataaaatggcacatttctgaagggcagttcc

SEQ ID NO: 6871365 - DNA, 61 bp, Homo sapiens
cctgcagtcttccttccttaggctccccagggagggcctgagagcacagaaagacagtagg

SEQ ID NO: 6871366 - DNA, 80 bp, Homo sapiens
tccctaatagcatcctaaaacatacttgcctttgccaacaagcatctggaagaggatagtttagaatgttattttaggga

SEQ ID NO: 6871367 - DNA, 66 bp, Homo sapiens
cctgctgcgccccctcggccacctgcggggacagcccctgcctcagccgagaaggggagcagaagg

SEQ ID NO: 6871368 - DNA, 74 bp, Homo sapiens
ccatgctgcccagggcctgccacttagcaagtactctgtagatatgtatttgatgagcaagggcctgagcatgg

SEQ ID NO: 6871369 - DNA, 60 bp, Homo sapiens
ggccatttcgtgctgaatcaaggaaaaacaccaagatttgggggcacggaatctgaggtc

SEQ ID NO: 6871370 - DNA, 55 bp, Homo sapiens
ctagttaaggagtcacttggactcacttttgagtcttggctgtaccattgactag

SEQ ID NO: 6871371 - DNA, 67 bp, Homo sapiens
ggctgctggattgtgtatctgtgagactttttagggatttattaacatgatacacaattagcaaacc

SEQ ID NO: 6871372 - DNA, 102 bp, Homo sapiens
gtggaattcttctaggtagtgcctgtttgtagactggacagggaataaaaccactactctgtgcccgtttataaatatttgcatttaccttggagaatgtac

SEQ ID NO: 6871373 - DNA, 64 bp, Homo sapiens
cctccgtaaatacaatgtcaagtaaataaagtatgatcttaattgacagaaagtttacgagggg

SEQ ID NO: 6871374 - DNA, 87 bp, Homo sapiens
actcaccctattccctacctcaagttggaaataaaatgttcatcttcagatgacatgtgtgacaacagaggtgagtatatgttgagt

SEQ ID NO: 6871375 - DNA, 70 bp, Homo sapiens
aacttttttcctaaggcaacatgatggcattaaatatttgtttgctttcaattatcaatggaaagaagtt

SEQ ID NO: 6871376 - DNA, 84 bp, Homo sapiens
tccctgctcttttaaactctgtcttgttacatggggcttgacagtttggaagctacattaagcagatttactagccagtaggga

SEQ ID NO: 6871377 - DNA, 87 bp, Homo sapiens
aagaaggcttctctgctcctatctgtgattctaagaagatttaatcagcttcctggtaatttccgaagtgagtaagaagagcctctt

SEQ ID NO: 6871378 - DNA, 55 bp, Homo sapiens
tttcctcttcgattaagtttgggatcctcatctgcatttgacttggagagagaaa

SEQ ID NO: 6871379 - DNA, 78 bp, Homo sapiens
tgatgctatggaattcaaatattaaacacgacgatgttgatgattgttctgcttaaattattgatcctcgtgggatca

SEQ ID NO: 6871380 - DNA, 114 bp, Homo sapiens
tattgaaagtgcacaggattcttggctgggtctgtggctgctccttagcaagtaaaattagctaacactgcccaaggatccattggctggagttaagaatcctgagagttagtg

SEQ ID NO: 6871381 - DNA, 58 bp, Homo sapiens
ttgaccagggagcaccgctgcggccgatcagaggagcaggaactggaaccctggccga

SEQ ID NO: 6871382 - DNA, 63 bp, Homo sapiens
ctgttccacctcagcatgctcacagagctcggccctgcctgctggctcagttgctgggcacag

SEQ ID NO: 6871383 - DNA, 105 bp, Homo sapiens
ggagcaggaaaccactgctgcatctctttgctctttccttggaaagaaacattatttcacagaaagacaacagataaatgctgaatggttgctttcccctgctct

SEQ ID NO: 6871384 - DNA, 58 bp, Homo sapiens
tgagatggagtctcgctctgttgcccaggctggagcacagtggagcgatctcgtctca

SEQ ID NO: 6871385 - DNA, 60 bp, Homo sapiens
tttttgaaggctgatgtgattaagaagtacttagctttcatcactgaatgccttcaagga

SEQ ID NO: 6871386 - DNA, 55 bp, Homo sapiens
agagtgggttataggcagacttgggagacctctccccaaggccacaagtcactct

SEQ ID NO: 6871387 - DNA, 110 bp, Homo sapiens
acctggcaccagctggatgtcctgtcaatgcttgctgactccctgtctgaatccatgggcaaatgagtgggtgtgttgtatggcgtcccaaagcactagtgtgcctaggt

SEQ ID NO: 6871388 - DNA, 56 bp, Homo sapiens
ctccctgggcctcagtttctctgtaacatctgtcagacttcatgggtccaggtgag

SEQ ID NO: 6871389 - DNA, 73 bp, Homo sapiens
gaggctgctggctggtcatgtcatgagcccaggtcttcttcttgggcacaaccagatgccatttctcagcctc

SEQ ID NO: 6871390 - DNA, 73 bp, Homo sapiens
gaatagtgcaatgttgttgaagtaagacgttttctgtagaaaaacaaatgactaagcaatagcattgactttc

SEQ ID NO: 6871391 - DNA, 64 bp, Homo sapiens
ccagatagtcatctcttctacaatatgggaactattctcagatgattgtaggatgaaaatctgg

SEQ ID NO: 6871392 - DNA, 63 bp, Homo sapiens
ctttggccctgaatcaaggccagcagtttgctgaagctgttggtttcaagcaggagcctaaag

SEQ ID NO: 6871393 - DNA, 61 bp, Homo sapiens
cactacccagggcctgctcccctctgaccttggaaatcggctgtgcagcctcttggtagtg

SEQ ID NO: 6871394 - DNA, 60 bp, Homo sapiens
tctgcgtgaaactagatggcagccggctcataaaggttcatttggacaaggcacagcaga

SEQ ID NO: 6871395 - DNA, 77 bp, Homo sapiens
cctggtgtctggcacacaggaagcgctcaacagatgctcatccccttctcctgtgtggggtccatggagatactagg

SEQ ID NO: 6871396 - DNA, 84 bp, Homo sapiens
ggaagttgtgggttgtgcagaagtgcctcagtaatgagaacttggtccttcaatgctgctgcttctgtacagcctttcgcctcc

SEQ ID NO: 6871397 - DNA, 78 bp, Homo sapiens
gcctcagaagtataggagacaaacaagactgactatttagggccttctcttgattgttttctgaccttatttctttgc

SEQ ID NO: 6871398 - DNA, 77 bp, Homo sapiens
cctgcgcttgctggagcggagcgggtgtcagcagtcaggagccttaccccgtgcactctgtctagtggaagctcagg

SEQ ID NO: 6871399 - DNA, 76 bp, Homo sapiens
gaaatatgacctcagtgagtgtcaaagtttacactggaaaataactttaaggtgacagtattgatggcaggatttc

SEQ ID NO: 6871400 - DNA, 71 bp, Homo sapiens
gaagatatgaagaaacaacttagtattggccatgcatttgggtgaaagtataggtatttctatcatgtctc

SEQ ID NO: 6871401 - DNA, 59 bp, Homo sapiens
tttccttccatagcaaaacatgccagccaccaaacagttgggtttagaatggaaggaaa

SEQ ID NO: 6871402 - DNA, 71 bp, Homo sapiens
ctgccagagtcacttgccacctttaccttggtatccttattcatggatgggggctggttgactctctgcag

SEQ ID NO: 6871403 - DNA, 84 bp, Homo sapiens
ccaaggattctaccaaacagggttgccaaatactaattaaactaattggttatcaatgctgttcttaaatgttatgatcctggg

SEQ ID NO: 6871404 - DNA, 90 bp, Homo sapiens
gtaactttggagaaagtattttctcaattagaaatgttattataatcttcagtaacattcaattgaggaagttaacagtttcaaatttat

SEQ ID NO: 6871405 - DNA, 76 bp, Homo sapiens
tttagccagaggtggaagattgttttgtggcattttaagtttgatgtggatcagaagtcttcactgtctggttgaa

SEQ ID NO: 6871406 - DNA, 55 bp, Homo sapiens
actaggagagactttgtctctggatgtctggaggaataacagagtgtcccgcagt

SEQ ID NO: 6871407 - DNA, 59 bp, Homo sapiens
atgggtgatgaggtcagtaattgatcatttttaaaataatgaattgtctcttcacttat

SEQ ID NO: 6871408 - DNA, 80 bp, Homo sapiens
ccctggggcgcccttgtaggggctggcggctatgagcgtgtgtctcttccctgcctcagctgttgcaggggcccctgggg

SEQ ID NO: 6871409 - DNA, 64 bp, Homo sapiens
agtccttcaaaggcacgcagttacaaaaacaccatttttctaatttgcctcctttgtgagggct

SEQ ID NO: 6871410 - DNA, 94 bp, Homo sapiens
catcttccactctctgcaggtggtacttctttttctttccttatttacaattgcatcaagaaatgagaatattgcttgtttaagtgagaggatg

SEQ ID NO: 6871411 - DNA, 61 bp, Homo sapiens
attgaaatggggatgttgcggatggaggtaactcatgccacaggtgtttcatcttctcagt

SEQ ID NO: 6871412 - DNA, 69 bp, Homo sapiens
acccagtcagctgacccagtgaggaggcaaagcccaggctgccttcttctccctggctcaggagtgggt

SEQ ID NO: 6871413 - DNA, 73 bp, Homo sapiens
gctcttggctgaaggtggacacttgagtcacccactctgatacaaatggggacacaggagcacccagctgagc

SEQ ID NO: 6871414 - DNA, 88 bp, Homo sapiens
tctccagtcttctcttaattgcttagttgcaactatgccctgatttggaggggataagtgtactggtaacctagaggacactgagagg

SEQ ID NO: 6871415 - DNA, 61 bp, Homo sapiens
tagctcttcatttcatctgattggtactgcccacttaacactcagaacagtagaggagcta

SEQ ID NO: 6871416 - DNA, 99 bp, Homo sapiens
gagatggagtcccactctgtagcccaggctggagggcagtggtgcaatctcggctcaccgcaaactctgcctcctgggttcaagcgattctcctgtctc

SEQ ID NO: 6871417 - DNA, 71 bp, Homo sapiens
ttgaaaggcagcaattgaaatcattgtggagaagattcaatcttgtagcagggattgtcaatgctgctcaa

SEQ ID NO: 6871418 - DNA, 73 bp, Homo sapiens
tcgttctgtcacccaggctggagtgcagtgacgtgatcgcagctcactgcaacctcctcccgggttcaagcga

SEQ ID NO: 6871419 - DNA, 67 bp, Homo sapiens
ctagaaataaatcttcactagcaacattacaagaaggaattccttcagtgtccctagtagaagttag

SEQ ID NO: 6871420 - DNA, 78 bp, Homo sapiens
ctgaatggatcttgagcaagcagctcatcctgtgttgaggacctgggatagggctattgctcacaaaggaaaattcag

SEQ ID NO: 6871421 - DNA, 61 bp, Homo sapiens
ctcagagcacttttgaaagctcctggctctacctggtgcttacagggtgagtgtatttgag

SEQ ID NO: 6871422 - DNA, 57 bp, Homo sapiens
aggtctctcaagtttccatagctgattctgaatcccagataggaagcgagctggcct

SEQ ID NO: 6871423 - DNA, 83 bp, Homo sapiens
atgaagattctatttatcacttggaaaaatatccatcacttattatgcttatgggagctgggtgaggagtacagagtcttcat

SEQ ID NO: 6871424 - DNA, 66 bp, Homo sapiens
ctgaatgtgctggtacagggaaataaaggaatctaggataattccttgttttcttgtccaatttgg

SEQ ID NO: 6871425 - DNA, 74 bp, Homo sapiens
gagttctggaggtagatggtggtaatgattgcataacaatgtgaatatatttaataccatttagctgcacattt

SEQ ID NO: 6871426 - DNA, 70 bp, Homo sapiens
gttctgtccctctagagaaccataactattacagactttggtaccaggagtggttctagagaaacagaat

SEQ ID NO: 6871427 - DNA, 55 bp, Homo sapiens
gctcaggcccagcggctggtgtcactggggccggtggctgggagctgaacatagc

SEQ ID NO: 6871428 - DNA, 73 bp, Homo sapiens
tgaaattattctgtgaaacagctctggcatgcaatccagaccctttgcagcctgctgtgttttcagaatttca

SEQ ID NO: 6871429 - DNA, 109 bp, Homo sapiens
ttgctctaataggacctgtgttgtccaggtatcttcataaaaatgtactcagagaaggttcattgcagtacaatttaatgaagatagcagatttatttgtccagagtaa

SEQ ID NO: 6871430 - DNA, 58 bp, Homo sapiens
gagaaacccaaaggcaggaagagggttaaaggaactcttggccactcttggtgtcctc

SEQ ID NO: 6871431 - DNA, 65 bp, Homo sapiens
agtgcattttagctctgattctgtgatttctaaatgagtgattacagtaacagctacaatgcatt

SEQ ID NO: 6871432 - DNA, 87 bp, Homo sapiens
gagaaattatataactgtgtattctaatgactaaagtttgggaaattatggtcttggagagtattgcaataggagtaataagggttc

SEQ ID NO: 6871433 - DNA, 77 bp, Homo sapiens
aatgatgtcttgagttttgagttttgccaggttctctacttctttggggtgtggcagagtgcagaagaggcattatt

SEQ ID NO: 6871434 - DNA, 58 bp, Homo sapiens
ctcactcactgctgtgtctcttgcacccagcatggtgctgggcagagctggtgctgag

SEQ ID NO: 6871435 - DNA, 71 bp, Homo sapiens
tctgtctccgagagctgtaccaggatgcttgcccactgtatagggcacctttctgcaagttctgggactga

SEQ ID NO: 6871436 - DNA, 74 bp, Homo sapiens
ccattgcccaactgtactccatggggaggtgctgacacctgatcccatcccctgcgaggacagtgggacagtgg

SEQ ID NO: 6871437 - DNA, 56 bp, Homo sapiens
aatttggtggcacgtgtcagtgcatctttctgttctgcacaatgcaccatcaagtt

SEQ ID NO: 6871438 - DNA, 67 bp, Homo sapiens
tgtctcgtgcagactatgagggtagcagattcctacatctgtgccaagcttatatctgtctgaagca

SEQ ID NO: 6871439 - DNA, 90 bp, Homo sapiens
tgctttaatcagggttcctgcaattagcgtattagtttattggtaaataagcactggtttgttaattccctctagaaatcttgtttagta

SEQ ID NO: 6871440 - DNA, 89 bp, Homo sapiens
atgatggttacattcaaaggcatgtcctattttgctctcaaacacagcaaaatagcaaaatagaacatgcctttgaacataagcatcat

SEQ ID NO: 6871441 - DNA, 95 bp, Homo sapiens
agtgtgttctagtgacactcaaactggactcactatggcttcagattgttctagtctgagctgagtgagcccaggcacctgcacaagagctgcct

SEQ ID NO: 6871442 - DNA, 67 bp, Homo sapiens
aggtcagtgaccttagtaaaaggaattatatgacttttgtttcctttatacaagaaaccgctggcct

SEQ ID NO: 6871443 - DNA, 66 bp, Homo sapiens
gtgaataaaacacctgccaagacgtggtaggatttaaaagtgatttggggcgggtgttttattcac

SEQ ID NO: 6871444 - DNA, 68 bp, Homo sapiens
aactcctgcagtatgtttctctatagtgttgacaaaataaaatagggaagaattgttgctctatagtt

SEQ ID NO: 6871445 - DNA, 66 bp, Homo sapiens
ttggtgcatcttcccatgtcatcaactatattcactgtaaatttaatgacctgggaagatgctcaa

SEQ ID NO: 6871446 - DNA, 69 bp, Homo sapiens
gtcattttctgccagtgaaattgtgtcagttttgtgactgaatcagtttcctggcactctgcaaatggc

SEQ ID NO: 6871447 - DNA, 81 bp, Homo sapiens
gatgggctggaaaacaggagtggagaggtgcctctgtgttgcctacagccatctggggtccatttcttctctctgcctatc

SEQ ID NO: 6871448 - DNA, 73 bp, Homo sapiens
ttctatttggtatcagtgacagctgccaatagccacagtgcttgtagattgtaggaactgtacaaaagtagaa

SEQ ID NO: 6871449 - DNA, 72 bp, Homo sapiens
tgcttccagacctttagtgtcatgttatatttgacctgggatattcatatgatgttgagggacatggaaaca

SEQ ID NO: 6871450 - DNA, 68 bp, Homo sapiens
tgagggacccaggcccaaggctgccaggtagtaagggcagcctgtgcagtggggctctgggttctcca

SEQ ID NO: 6871451 - DNA, 63 bp, Homo sapiens
gggccctgcgactcgcggcggaggcgcacagcaggcgctcaaacgatcgtgggttcagggccc

SEQ ID NO: 6871452 - DNA, 93 bp, Homo sapiens
ggccaggctggtctcgaactcttgacctcgtgatccgcccgctttggcctcccaaagtgctgggattacaggtgtgagccaccatgcccggcc

SEQ ID NO: 6871453 - DNA, 64 bp, Homo sapiens
tctccatcactgacaaacttaattttctgaagccaaattcagggcagagagttcagggaagaga

SEQ ID NO: 6871454 - DNA, 61 bp, Homo sapiens
cttcatttttaccgcgtgtcaaagagataggtctgtttggatttggggatggagtatgaag

SEQ ID NO: 6871455 - DNA, 55 bp, Homo sapiens
ctctcagcaaggaaagaggcagggaacaggttctacctcacagctttgttaagag

SEQ ID NO: 6871456 - DNA, 95 bp, Homo sapiens
tactgggagttggagtttgcttctctgtagttgggcagctgctcttggtctagtgaccaccagcctggacagctacggagaacccgccttaggta

SEQ ID NO: 6871457 - DNA, 86 bp, Homo sapiens
gcatgacctcaaaagggaaacaatattcaagttcagctatataccaaaaccagaggagagttgaacagtatttgcttctgtcatgc

SEQ ID NO: 6871458 - DNA, 63 bp, Homo sapiens
gtctgtgtgtatgtagtgaaaactgtagaaaatcagcagtttattgttgcgttcacatatgac

SEQ ID NO: 6871459 - DNA, 80 bp, Homo sapiens
agagactagctttgggtaggggacgtggaagaaaagaatagctttttttaatttcttctactcttaaaaagcttttttct

SEQ ID NO: 6871460 - DNA, 68 bp, Homo sapiens
accatgagctttggtgtaagatctaggttcaaatcctagctctgtcacatacactgcatgctcttggt

SEQ ID NO: 6871461 - DNA, 76 bp, Homo sapiens
acacccagggacagatgggcagctaacccaggtactgtgtcttctgcgtctggctttatacctttgccttggatgt

SEQ ID NO: 6871462 - DNA, 68 bp, Homo sapiens
agaggcagctttgttctgccaatggcccatatctcaagcagatactccagaacagaataaatttctct

SEQ ID NO: 6871463 - DNA, 107 bp, Homo sapiens
tgagacagagttttgctcttgttgtccaagctggagtgcagtgcaatggcgcaatcttggctcactgcaacctccgcctcctgggttcaagtgattctcctgcctca

SEQ ID NO: 6871464 - DNA, 86 bp, Homo sapiens
gagctggccctttgcctgtcagcagcatgcactgacttagtcctcaatttgtggcatgctatgggcaaaaggggttttctggtctc

SEQ ID NO: 6871465 - DNA, 70 bp, Homo sapiens
ttcatttaacagacgtttacctagggcctgctctgtctaaagtcacaggcactggggatgctgggatgaa

SEQ ID NO: 6871466 - DNA, 76 bp, Homo sapiens
aacatctcaagtcaaaccttgctcacaggagggaataaacccatcaggagcaacatctttgaatcatgagtatgtt

SEQ ID NO: 6871467 - DNA, 58 bp, Homo sapiens
ccttctctaggccttataggtcttcttgctcaagagaagattaaaatctgtgagaagg

SEQ ID NO: 6871468 - DNA, 62 bp, Homo sapiens
agtgaaggatgatgccaaggtttttggcccaagtaattgttagaataatggtatcatttgct

SEQ ID NO: 6871469 - DNA, 76 bp, Homo sapiens
cgggccacccacacagcctcctctggctcacggtgcagtggctgtgggggctgcgggaggctgcctggtaggcctg

SEQ ID NO: 6871470 - DNA, 56 bp, Homo sapiens
gtattcaaggattttgttctacagatgcaatggtgtcactggaaaatcttgaatgc

SEQ ID NO: 6871471 - DNA, 67 bp, Homo sapiens
cactgccatttggcctcttggaaactttaggagactcaggcacaagttacaagactaaatggaagtg

SEQ ID NO: 6871472 - DNA, 122 bp, Homo sapiens
ggtggctgttggaactggcctaggtcaaacacacttgggattaggggctaggtcacacacacaaatgatgaagcccagctccattcttggtgagctttgtgacctgggcagattgcttcacc

SEQ ID NO: 6871473 - DNA, 61 bp, Homo sapiens
ccatcagacaattctttctcttggtgatattaaccacttcaataagaaagagttttgaagg

SEQ ID NO: 6871474 - DNA, 57 bp, Homo sapiens
tcctgcttgttctttgtgcattcttgctattggattccatttagaaattggcatgga

SEQ ID NO: 6871475 - DNA, 85 bp, Homo sapiens
tcttgagtatttacaaagcacatgagtagtgtagtaggagaattgtatcagttaagataataagtatgtctatgtgaagccaagg

SEQ ID NO: 6871476 - DNA, 76 bp, Homo sapiens
gccattaaccaaatagtatacaaataaatgtgtaattaaaaaaatatatgtgcatttgtgtgatggagtgagtggc

SEQ ID NO: 6871477 - DNA, 84 bp, Homo sapiens
tgctaaatctggcaatgctatatagtgagctctctcaggaattgattctgagaacactgtaaagtcattgaagggtcttaagca

SEQ ID NO: 6871478 - DNA, 56 bp, Homo sapiens
tgctgaggcatttggacagagtgagaaatcatgtcatgttttcagtgtttctagca

SEQ ID NO: 6871479 - DNA, 58 bp, Homo sapiens
gccccaagaataaccagacaatagcacagaaatgaccgtgctgttttcatattctggc

SEQ ID NO: 6871480 - DNA, 77 bp, Homo sapiens
ggctgatgctggacacatgctggatgaattacctacacatggctcttttgtgttcacatggcattttcacatcggtt

SEQ ID NO: 6871481 - DNA, 65 bp, Homo sapiens
agttagtgcatgtaatgtgcttagagcgtgcctggcatgccagaagtgctttataagtgttaact

SEQ ID NO: 6871482 - DNA, 62 bp, Homo sapiens
ggaaaagtagcaaatgtgacataggcggtgaactgaaaatcgcttggttttggttacttgcc

SEQ ID NO: 6871483 - DNA, 70 bp, Homo sapiens
ttttctccagcaatctttaaaaatcaagtcgtttcccaagagtagtgagatgacttaagaaaggagagag

SEQ ID NO: 6871484 - DNA, 57 bp, Homo sapiens
gtagcacagctaggagcagagccaggacttaaaggcaggtcttctgaatgtggctgc

SEQ ID NO: 6871485 - DNA, 87 bp, Homo sapiens
tgacctggcggacaggtgggagccacagcgtacaccccagggttccctctgtgctgtgcgtagtgcctactgcttgcttccaggtta

SEQ ID NO: 6871486 - DNA, 85 bp, Homo sapiens
gctcaagtcttttcttgaattcctagagagaggattgtaaacagcttatttttatctttaggactttgcagattatgacttggac

SEQ ID NO: 6871487 - DNA, 79 bp, Homo sapiens
gctctcacagttctccagtgcctttgagatcctgaagaagggagaacctcagaaagggttgctgagggctgcagggagt

SEQ ID NO: 6871488 - DNA, 68 bp, Homo sapiens
cctaatatgtggatgaataaagtgcagacatactatcttgcctttgcttttgttcttcaataaatagg

SEQ ID NO: 6871489 - DNA, 76 bp, Homo sapiens
atgcgtgttctgtatctattgagatgatcacatgactcttctccttcagtctattaatgtggtacattacatgcat

SEQ ID NO: 6871490 - DNA, 57 bp, Homo sapiens
ggccacagctgcagacttcccagcaggagggctttgcctgggagatgcgttgtggcc

SEQ ID NO: 6871491 - DNA, 56 bp, Homo sapiens
tacttgttgcttttgtgatccaggagttgtagggactccaaaagcaattccaagta

SEQ ID NO: 6871492 - DNA, 91 bp, Homo sapiens
cttttctacagatccttgaatataataacagtagctaatatctgtttacttattacctgctaggcaatgtgatcaattttctgtggatcag

SEQ ID NO: 6871493 - DNA, 111 bp, Homo sapiens
gtgctttgggatgcaaaaataaatcacacatggattctgcatcagtactttccattccagtataggaatgaagatacaggcagggccatgtgaataaagtcctagtttcac

SEQ ID NO: 6871494 - DNA, 82 bp, Homo sapiens
ggttccaagtctttgctactgtgaatagtgccgcaataaacacaggtgtgcatgtgtctttacagcagcatgacttataatc

SEQ ID NO: 6871495 - DNA, 84 bp, Homo sapiens
agcggtttaatgctattcattgaagcacaagtgatcttgaaggaaactgagagatattctttttcaaggacagctttaatagct

SEQ ID NO: 6871496 - DNA, 57 bp, Homo sapiens
catctggatcttagacagtcaacggaggcatctccagagacttctgatgtccagatg

SEQ ID NO: 6871497 - DNA, 63 bp, Homo sapiens
gttattttatcgtatgtcatttggtcagcgaaacaatctctaagtgatttatgagagaatgac

SEQ ID NO: 6871498 - DNA, 73 bp, Homo sapiens
gtggttaaacgtttggtagtttgaaatcagccatggtgggaatatttacaccatggaaattggcaaatgctac

SEQ ID NO: 6871499 - DNA, 94 bp, Homo sapiens
gctctttaaagtgtctgtgtatggtcagttactctgttctcactgccactgcagagccaaaattacctcatacccggactattattacagaagc

SEQ ID NO: 6871500 - DNA, 117 bp, Homo sapiens
ccagctagagctcgtcatggtcgtcttcggtgggtgcttcaggcggtggctccgggcaggcggctggcgtcatcagctccatgaggtactcgcagcgactgggctctgtggtgctgg

SEQ ID NO: 6871501 - DNA, 83 bp, Homo sapiens
agtggactactacctcatggcatgttttgaggatgaaatgagctaataaacacagtcttcagccctacattaggtaagccatt

SEQ ID NO: 6871502 - DNA, 109 bp, Homo sapiens
ttctcttctttcggcaatgacttaagtaactttgcttttgtgggtaaaggccttggggcatttttgtcacaggaggagggatctgggcttgtcagtttggagaagagaa

SEQ ID NO: 6871503 - DNA, 81 bp, Homo sapiens
taggtattttcacagtttctgaacactttgcaagttggacaataaaactaatttttaatatgaaagaaattgtttagccta

SEQ ID NO: 6871504 - DNA, 69 bp, Homo sapiens
tcatttcaaaagaattgccagaattgaaaacctaacaatcgggtgcatttctgggaatgcttaaaatga

SEQ ID NO: 6871505 - DNA, 58 bp, Homo sapiens
aaaattctcagagggatccaacttcaaagatgctgagaaccattgctctggggatttt

SEQ ID NO: 6871506 - DNA, 63 bp, Homo sapiens
gagatttgttctgaaaactcaagtcccgtgaaacggtactctgaaaccccagaatcatatttc

SEQ ID NO: 6871507 - DNA, 70 bp, Homo sapiens
aagtgaatgttaggtggaaattcccaaatgcattttccaatgttaggaagcttcatacctttatttactt

SEQ ID NO: 6871508 - DNA, 59 bp, Homo sapiens
catagctgacagtgcctgggtccctctatttccaccagacaccaggaccattggctatg

SEQ ID NO: 6871509 - DNA, 62 bp, Homo sapiens
gtgaaagagaaaatgtcagacttggtcgcaaaagtgaaaaggggtgatatttttgatctcac

SEQ ID NO: 6871510 - DNA, 64 bp, Homo sapiens
tgaacccaggaggtggagattgcagtgaaccaagatggcgccactgcactccagcctggggaca

SEQ ID NO: 6871511 - DNA, 61 bp, Homo sapiens
ttagttgaatatgcatttttgctcaggtgagttcctgatagaagatgccaatattctataa

SEQ ID NO: 6871512 - DNA, 130 bp, Homo sapiens
tggcaaccttttccctgaaacaagttatttgatgagaagaatgaaaaccttggctcaaatggttgtggaaacgtctatcagttgaccacggtttgattttggaatctttagtcggcttgggaatggtaaa

SEQ ID NO: 6871513 - DNA, 114 bp, Homo sapiens
accgggcccgcgcggcggccgccgtcccggccaagccggggccccgaagccagagccggagccgggcgggccgcggggtcatggctgggccgcggggcgcgctgctggcctggt

SEQ ID NO: 6871514 - DNA, 70 bp, Homo sapiens
aagagacttattggaggatctaagagtcacaaccctctttgtggctctcagatcctccaataagtctctt

SEQ ID NO: 6871515 - DNA, 114 bp, Homo sapiens
tgggctgagctagcaggtgcctttgggatttgggtctgtgatgagaggttgtgaaggagaaattccggaaaggttacaaactcaggtgccaaaagcaactgcacagctcttcca

SEQ ID NO: 6871516 - DNA, 108 bp, Homo sapiens
ccagtccgtcggagaagcgctctttgattggccagtggacagcgccgtggcatgacgcgctggggcgctggccaatcggttgagagctgagctggacttggcggtggg

SEQ ID NO: 6871517 - DNA, 78 bp, Homo sapiens
tgtttctattctcatctccttggatcacgtttagtcacttgactgcacctagtggcaacggagtataggaaggaaata

SEQ ID NO: 6871518 - DNA, 59 bp, Homo sapiens
aaaggatggctctgcatatttgtgtaccaaccagaaatagattgctgaggcattacttt

SEQ ID NO: 6871519 - DNA, 97 bp, Homo sapiens
ttggccaggttggtctcgaactcctgaccttgtgatccacccgccttggcttcccaaagtgctgggattacaagtgtgagacaccgcacctggccaa

SEQ ID NO: 6871520 - DNA, 57 bp, Homo sapiens
tgcccaccctagggagcctgagagcagtggagcacactgcttggcactctgggggca

SEQ ID NO: 6871521 - DNA, 58 bp, Homo sapiens
ggaagtcagggagtgttggcaggatcagtgtctgctgattaggtctactcttggctcc

SEQ ID NO: 6871522 - DNA, 61 bp, Homo sapiens
gcattgttgttttctcatggagaatatggttactatgctttgttcacatggagcagaatgt

SEQ ID NO: 6871523 - DNA, 91 bp, Homo sapiens
gacccatttaacaataaactagctcttagtttagagggtagaaattcatactcactctgcagctgaagggctgggcagatttaagaaggtc

SEQ ID NO: 6871524 - DNA, 82 bp, Homo sapiens
agagaattttctatggagctgtttctgtgttagatgagtcttaggaaaggctagagaagcatgaatcagttctgaattgttt

SEQ ID NO: 6871525 - DNA, 64 bp, Homo sapiens
gggcagtaacatgaggcattatagttttataaagattcctagaatgcctcagcagttattattc

SEQ ID NO: 6871526 - DNA, 71 bp, Homo sapiens
ggaaacatttttactgggcatctgcatcaaaattcatgtgcagctagcgtgcctagtgaagcattgtattc

SEQ ID NO: 6871527 - DNA, 89 bp, Homo sapiens
tggcctggagcctggggccgccattgatcagcatcttcactgaggaagccagcttggccagtggccagtgggcacccaggtcggggcca

SEQ ID NO: 6871528 - DNA, 79 bp, Homo sapiens
ctgacccaagatcagtccaccatactcatcttttggggaggaacataaggataagaacaggttggactgaatttgccag

SEQ ID NO: 6871529 - DNA, 80 bp, Homo sapiens
cctacttgcatcatttatagactgtgaaatttaggcaagttatttaacttctctgggtctcagtttgtacatgtaaaagg

SEQ ID NO: 6871530 - DNA, 68 bp, Homo sapiens
tgatactgatgaaaaccagaactctcattgataatgcattgtctggtttcattttccaggtagtatca

SEQ ID NO: 6871531 - DNA, 58 bp, Homo sapiens
aggaagaccctgccaccatcctttgtatttacagtgttttgtctggcagggctgccct

SEQ ID NO: 6871532 - DNA, 101 bp, Homo sapiens
gccacttgtagtattcagctggcggctgacctggtaccttagcagaaatggctgaaggctgggctcagccagctctttttgaatacaggctcttacgtggc

SEQ ID NO: 6871533 - DNA, 114 bp, Homo sapiens
cacagaagagaccagagaagagcctcctggaggagagcctgcactttgaccatgctgtccggatgggtgcagtgctcttttctgcaaagtgttcacttctctgctttttctgtg

SEQ ID NO: 6871534 - DNA, 76 bp, Homo sapiens
ttgcagatagtctcagtaggtaggaaccagaatgccctcagtttgagttctggccctgctgctgtgagcactgtga

SEQ ID NO: 6871535 - DNA, 65 bp, Homo sapiens
tgtcagactctccagatttgggaataatgttgttctgtgacgacagttctctgatgggtttaaca

SEQ ID NO: 6871536 - DNA, 57 bp, Homo sapiens
aagtccttttggagaggagaccagcttttagtttaattttcaccaataaaaggactt

SEQ ID NO: 6871537 - DNA, 104 bp, Homo sapiens
tgttcttatggtcgtgaataagtctcatgagagctgatgactttacaaggggcttcccctttcactcagctctcattgtctcttgtctgctcccatgtaatgca

SEQ ID NO: 6871538 - DNA, 76 bp, Homo sapiens
tggccccagccatgaagactcagaagctaagataccgacggtgttcctctgaacttcttccaatggctaaaagcta

SEQ ID NO: 6871539 - DNA, 75 bp, Homo sapiens
ggagagcgaacattggtagagattctcaagatcttgtttcaccagatctttcagtttcataccaatttataattc

SEQ ID NO: 6871540 - DNA, 76 bp, Homo sapiens
tgcagtggagggtgagctcatgtttgtgtagacagacttgggtctgggatgtagaaggagcacactgctccattca

SEQ ID NO: 6871541 - DNA, 73 bp, Homo sapiens
tcttcgaaaaccttcaatcagcagtctagcttatattaatatttaggttattgaggctattgagtattgagga

SEQ ID NO: 6871542 - DNA, 64 bp, Homo sapiens
accatctaagagagagagcatgtcttggctagcttaaacaagcattgtcactctcttggcaggt

SEQ ID NO: 6871543 - DNA, 62 bp, Homo sapiens
ctccctttgtgtaagtcaaggagaaattgattaagtcattttgcttgagtgcacaaaatgag

SEQ ID NO: 6871544 - DNA, 55 bp, Homo sapiens
ttgtgcaaggctcttggaatgtactaaaaacactttttaagtcagtgttgcacaa

SEQ ID NO: 6871545 - DNA, 78 bp, Homo sapiens
gtcctctgttcctggtctctggagcttcaatttgggaaagtgacccattagcttctgaggaccagggtgagagagggc

SEQ ID NO: 6871546 - DNA, 70 bp, Homo sapiens
gtcctgtctgtcattagccttgactgtagctttctaaagtggtctacagaatagaatagggacaggggac

SEQ ID NO: 6871547 - DNA, 84 bp, Homo sapiens
acctggggagtctgtgcagcatgcctctgggtggctgctctggcagagcagcaccaaccagggcctgtttatatttccccaagt

SEQ ID NO: 6871548 - DNA, 81 bp, Homo sapiens
ccacgttgtgtcacacgtatcacactagaatgcattcagcgtcacacattgttgaattcatacagtggataccacacgtgg

SEQ ID NO: 6871549 - DNA, 76 bp, Homo sapiens
caatatgctgttttgaattctctagaactttgttgctccaaaatcaaatatcttcagataaagggagagtatgttg

SEQ ID NO: 6871550 - DNA, 62 bp, Homo sapiens
cagtgattcaggtgcctgttggaaaaacattctgtgtataatttggtatatctgaaccactg

SEQ ID NO: 6871551 - DNA, 109 bp, Homo sapiens
atcacttatcagccttttgaacttagaactgggcattctgccagaactcaatagcaagaagagggtggagagaaatgtccagggctaggatctgggctttaaaggggat

SEQ ID NO: 6871552 - DNA, 77 bp, Homo sapiens
tttacttaatattctgaatttttcttgggtcgctgttagtcaaatagagataactagattacagaagaataagtaga

SEQ ID NO: 6871553 - DNA, 69 bp, Homo sapiens
tatctagtatggcttctgctttcttgactgtacccagacttatacaccagtgaaagcatagcttagatg

SEQ ID NO: 6871554 - DNA, 104 bp, Homo sapiens
ggagaatttgtaacactttcacagttctgcactttgatttcagagaaggtgctaatctctctggaattttgagagtgacaaaatgagttgtatactgtttttcc

SEQ ID NO: 6871555 - DNA, 113 bp, Homo sapiens
gcaaggatggaggttgtcctgcaaaggcattttaattctaaagaaaaaggagattagtggcctctacccatcttagagaatagagtgtcctgacaccttcccttcctccttgc

SEQ ID NO: 6871556 - DNA, 71 bp, Homo sapiens
tgtgtcaatgatagacaagatctaaggtacctttggggagccattaccacttttccatcagatttggcaca

SEQ ID NO: 6871557 - DNA, 80 bp, Homo sapiens
tgtgatattgctaatttaactaccttgtttaaaagcattagtgaagtccagtgtaataagtggtataagttggggtcata

SEQ ID NO: 6871558 - DNA, 80 bp, Homo sapiens
ctgaggccagctgtggggccgagcctgactctccctgtctctcattcaggccaggcaaggcccctggattggcagcttgg

SEQ ID NO: 6871559 - DNA, 59 bp, Homo sapiens
ctttcaacctcatagaaagaaaatgttggacaatattttccgaacttgaggtagaagag

SEQ ID NO: 6871560 - DNA, 56 bp, Homo sapiens
cagctgaaactatgttctcataaaacttatttgtctctgtggccatggttcagctg

SEQ ID NO: 6871561 - DNA, 56 bp, Homo sapiens
ctcttctctgccaccaccttctctatgccacacggaggcacttaggcagagcagag

SEQ ID NO: 6871562 - DNA, 60 bp, Homo sapiens
gcccgctgcttgccacttccctctccaaacgctggcgggggtgggtggcagcaccgaggc

SEQ ID NO: 6871563 - DNA, 71 bp, Homo sapiens
gaagcagggatgcattttctgagtaatacaaaaagttatcaaaagacaacaaatgtgttccataatgcttt

SEQ ID NO: 6871564 - DNA, 74 bp, Homo sapiens
gactctccttggggtttgggggcttgacctgggtgcgctttctggacagactttacagccccgggggcacagtc

SEQ ID NO: 6871565 - DNA, 93 bp, Homo sapiens
gggcttcaagttcacggccctgtgatgggatgtgggcagggcctgtctgggacaggccgaacccagctccttacagggccgaatcctttgccc

SEQ ID NO: 6871566 - DNA, 67 bp, Homo sapiens
atcaggttatcctccttgaaacaaagtaacttttaataaagtgggctggtggcagggagaacctgat

SEQ ID NO: 6871567 - DNA, 61 bp, Homo sapiens
agtgcacatgcaggcacccagagcccactgcgtgccggagggaatgaaagctgcgtggcct

SEQ ID NO: 6871568 - DNA, 55 bp, Homo sapiens
gcctggtcctaaagatgggggctgctgtgtgtgagcgctccaccctggacctggc

SEQ ID NO: 6871569 - DNA, 91 bp, Homo sapiens
tttaaaaacaagtcctggtgaggtagtgggagggaaaggacctagaccttcacctccttctaactgctagaggctaccaatattttttaaa

SEQ ID NO: 6871570 - DNA, 79 bp, Homo sapiens
ccacatatatattagtttcctttctgccaacaagttgtcaccaaaatttattggaaagaccgaattcctgtttgtgtgg

SEQ ID NO: 6871571 - DNA, 129 bp, Homo sapiens
ctctctgtctattttgagatggagttttgctcttgttgcccaggctggagtacaatggtgcaatcttggctcattgcaacttcaaactcctgggttcaagcgattctcctgcctcagcctcctgagtag

SEQ ID NO: 6871572 - DNA, 57 bp, Homo sapiens
ggtctgagagccactgaatccccagccctaggattctccacagcaagttctcggatc

SEQ ID NO: 6871573 - DNA, 62 bp, Homo sapiens
gaaggctcacggaggtcagcgtggtggccagagcgatgagttaccttacttctgtgatcttc

SEQ ID NO: 6871574 - DNA, 79 bp, Homo sapiens
aatgtgtcagaaggcaatggggatatctgggccctagtttcaactcagctacaaattcacatttagcctctgacatgtt

SEQ ID NO: 6871575 - DNA, 64 bp, Homo sapiens
attgccatttctcaaatatgactagatattaaattttttttagttgctaaacagaagtggcaat

SEQ ID NO: 6871576 - DNA, 55 bp, Homo sapiens
cctgggcttctgtctagatgtttaagcctttgcacctttggacagagtgtccagg

SEQ ID NO: 6871577 - DNA, 77 bp, Homo sapiens
agtaaggcattgtaaagtcacaccttaggctctgcagtcagacagagctggctgtgggtgactttccgatatttact

SEQ ID NO: 6871578 - DNA, 85 bp, Homo sapiens
ccagcatagctaactcagcaggtcttgggtaggggttcagattttgcatttctaacaatttgccgggtgatgctcatgatgctgg

SEQ ID NO: 6871579 - DNA, 64 bp, Homo sapiens
cttgtggctctctgctctgtagatttgctgactcacagagtccaccggcagagatgctgacagg

SEQ ID NO: 6871580 - DNA, 62 bp, Homo sapiens
cttctaatataaagtctttgcaaacaaacctgtgctacagttgccagggctttaagttgagg

SEQ ID NO: 6871581 - DNA, 75 bp, Homo sapiens
ttgactgcctggctgtgcagtcttccagaagagcacggcatggacttctggaattcttgcagccactcgactcaa

SEQ ID NO: 6871582 - DNA, 64 bp, Homo sapiens
tgccatcctagcatcagatgagaagctgtgaggccagacacctacagttgcgtgatgtgaggca

SEQ ID NO: 6871583 - DNA, 89 bp, Homo sapiens
atttctacatgcattatttcatctccttaactttgaagtgggtaatgtgattattcccattttttaggtaagggattgagcacagagat

SEQ ID NO: 6871584 - DNA, 99 bp, Homo sapiens
gcctaaaaaaatgatgatccattgtccagttttctataaggttcaatatgtctcaatcttcgaattgcaagggaactagacagattataatttccaggc

SEQ ID NO: 6871585 - DNA, 72 bp, Homo sapiens
cacccctgaccaagaggcttcacatgtccacctgcctggccccttgcagcatgtgtaatttctggttgggtg

SEQ ID NO: 6871586 - DNA, 83 bp, Homo sapiens
tccttctgggaaatgtttgggtttgtgtgaaggttttaacttatgagagagttcacactaagacaaaataattttagtaagga

SEQ ID NO: 6871587 - DNA, 74 bp, Homo sapiens
gaggagatgactctgtgggaggaggctcagccgtagtctggatggtgatgctctgttctacgcacagtagcctc

SEQ ID NO: 6871588 - DNA, 92 bp, Homo sapiens
gttactggatggcaggaggccaggggtcagcaattggctatgtgaatcagggcaagttactttattctctggtcttctgttttctcttctac

SEQ ID NO: 6871589 - DNA, 72 bp, Homo sapiens
tggtgtacaagagttggaataaaagtttctggcaaactgtcgttttgcttttatgtaataaactgtacacca

SEQ ID NO: 6871590 - DNA, 58 bp, Homo sapiens
agggggatggaatagaactttgcaatgcatcaacagaggaatcctatttcatccttct

SEQ ID NO: 6871591 - DNA, 66 bp, Homo sapiens
tgtcatcttgactgggataagggatacccagataggtatttattatttacccagataggcatggta

SEQ ID NO: 6871592 - DNA, 77 bp, Homo sapiens
gatttgaagcatcagcagaggttcatcaggcaggaaagcttaactctgttctgaagagaatgctgctgaaccagatt

SEQ ID NO: 6871593 - DNA, 58 bp, Homo sapiens
ggggctgacgggcatgtggcttcccaattcattgtgaagagcccgtctgttcagctgt

SEQ ID NO: 6871594 - DNA, 58 bp, Homo sapiens
agaaggctgagactgggatgaaacttatcacaaaagtaaaggaaccacttagccttct

SEQ ID NO: 6871595 - DNA, 66 bp, Homo sapiens
gactattttgggctcttgctgacctgggccaaagtcaggtccagtcaagagggcccaaagtggctc

SEQ ID NO: 6871596 - DNA, 56 bp, Homo sapiens
tgctggtccatgaggccagatcaaaggctgatactgcactggcttcaggctgagca

SEQ ID NO: 6871597 - DNA, 91 bp, Homo sapiens
agacgattaggaaggggccactcccatcttgtttcttgtgctctgagtggtggtcacagagaactgtgggagtgtgcacttcatgtcttct

SEQ ID NO: 6871598 - DNA, 100 bp, Homo sapiens
aagggtgagtggtggcatggtgattgactgctgagcacacaagagtgtctgccacggaacatagtcttactcagcagtgaccctcttaccattttccctt

SEQ ID NO: 6871599 - DNA, 57 bp, Homo sapiens
gagaaagcttctttcccacaggctcccagcaagggtgtgaaagcaagtctagttctc

SEQ ID NO: 6871600 - DNA, 75 bp, Homo sapiens
tggcaatgaccaaatgtgtcacaggtgaaaatgtccagtagtttctggcatttatgacgtgttcggtcaatgtta

SEQ ID NO: 6871601 - DNA, 92 bp, Homo sapiens
gcggggggattgcttgaacccaaaggttgaggctgcagtgagccatgtttgtgccattgcactccagcctgggtgacaaagcaagaacctgt

SEQ ID NO: 6871602 - DNA, 129 bp, Homo sapiens
cccccaaacctaccccaaacaagaaactccccagacctcaggctaagaaggccaagtgcacatgagtgcctgcgccctctcttctctggcctctgctggtcggttctgctatgggactgtgttctgggg

SEQ ID NO: 6871603 - DNA, 60 bp, Homo sapiens
gtgttaagacaacatatgaggagcaagttcccttgttcacaagcagatgttgctttccac

SEQ ID NO: 6871604 - DNA, 125 bp, Homo sapiens
tcaagtaaacagatagatttgggccaggtaagttgattttggagagatgaagttctgtgtagggatttccctttattaagctcatgtctttagtgccacttttgtgtcctgattttctaacttga

SEQ ID NO: 6871605 - DNA, 56 bp, Homo sapiens
ctctctctcggtcttctgacccgaggatcctaccatgttatgaaggctggggggag

SEQ ID NO: 6871606 - DNA, 89 bp, Homo sapiens
aggtaacatatttataggttctggagaggaggatgtggacatctttggcggacgttattctgtctaccattcacctgaccagcctgcct

SEQ ID NO: 6871607 - DNA, 55 bp, Homo sapiens
aggggcagaggaagtggtgctgcattcctagttcaaatcattgatcttcacccct

SEQ ID NO: 6871608 - DNA, 71 bp, Homo sapiens
cagctcgaggccaggaccctgcaaaccctgttgcttgcaaatgagcatcaggatgggtttggcttaggctg

SEQ ID NO: 6871609 - DNA, 98 bp, Homo sapiens
tacagctttctgaacttagtattattgacatttacttggtgcagttaacttttttgttaaaggtctgttgtcaagcatttaagtaatttgtagttgta

SEQ ID NO: 6871610 - DNA, 59 bp, Homo sapiens
ctttatcatagtgcagttttctgactcctgtgtcagggtcacctgccgctgtggaaggg

SEQ ID NO: 6871611 - DNA, 56 bp, Homo sapiens
ttcagctagcatctcacttggtcatggttctttatctggtgggattaattgctgag

SEQ ID NO: 6871612 - DNA, 130 bp, Homo sapiens
aggagcagacttttctcttgtcactttggaaggagaggattgtgaggctgcccctttaaatagcattcccgtaggaggcagatcacatccatccgtcacctactgccaaagcatcatttttggtttctat

SEQ ID NO: 6871613 - DNA, 68 bp, Homo sapiens
actcgcagcctcagcctgcttcccccaacctggcccagtttggagggaacccaggctgctctgcaggt

SEQ ID NO: 6871614 - DNA, 64 bp, Homo sapiens
ggccactgtctgagcacagagggaccctggagggaggcttcccaaggtgctcggcaacagggcc

SEQ ID NO: 6871615 - DNA, 73 bp, Homo sapiens
tttaacgaatgtcattgagctccaatccttttctccaggaatttatgggggttggaggaatgagaccgttaag

SEQ ID NO: 6871616 - DNA, 56 bp, Homo sapiens
gcatttgtctgggattgtggatggatgcgcttccttcccatataaccagcaagtgt

SEQ ID NO: 6871617 - DNA, 80 bp, Homo sapiens
cctctgtgcagacatggggaagccccaggcccaaatgcttgctgaagggccttgcaggcattccatgaagttgcacaagg

SEQ ID NO: 6871618 - DNA, 130 bp, Homo sapiens
cagggatcttttaattttgagattatgattcagtagatgtaggtatacctgagagtctgcatttttaacaagctcacagatgatgtctatgtggctgatctgtagagatcaagatgtaggtatctcccag

SEQ ID NO: 6871619 - DNA, 119 bp, Homo sapiens
aaatctgtggtcttcctatgtacatgtgtgtgtacatgcttaaaatgcaatgttatagttaaatgtaattcattaaaagtatgtaactccagtggctacttagtttggctacttggttt

SEQ ID NO: 6871620 - DNA, 63 bp, Homo sapiens
ctttcatccgcagatgagcctcctcaaaggttgcgagaggctgatgctggctgaggctggagg

SEQ ID NO: 6871621 - DNA, 78 bp, Homo sapiens
caccccctggtgctgttctgtggtttccaagttttctgcattgagcaactgttacaagaacaacacaagggccaggtg

SEQ ID NO: 6871622 - DNA, 56 bp, Homo sapiens
cttctgtacatacgcgaatgtttgggagagggtccacataggcgaatgttcgggag

SEQ ID NO: 6871623 - DNA, 80 bp, Homo sapiens
cggcccagccgtggattggcctgtggtctgcgtgttgccagcagtgcagaagcagagccggtggcctcggtttggaaccg

SEQ ID NO: 6871624 - DNA, 125 bp, Homo sapiens
gagggagctggggtttggggtataggggtctggggttccagaccacgggtgttctgaggacaaaacctgaaggaggccgggattctggagattctgcctctaaatccacctcccccgtctccctt

SEQ ID NO: 6871625 - DNA, 75 bp, Homo sapiens
aggaattggggctcagggagacagtgcagatgtcaatactgtggcttctgctgttgccatgagtaataaagtcct

SEQ ID NO: 6871626 - DNA, 79 bp, Homo sapiens
gcaccttgatcttggacttctaacctgcagaactgggagaaaatcagcttctgctgttgaagccaccagtctgtggtgc

SEQ ID NO: 6871627 - DNA, 62 bp, Homo sapiens
atttgttcagcattgaatttggatttttgatttctgaattctacgcctgatgctgaacgaat

SEQ ID NO: 6871628 - DNA, 68 bp, Homo sapiens
ctgtaagaattatctcatggataattcatggataactattagaattatctcatggataattctcatgg

SEQ ID NO: 6871629 - DNA, 58 bp, Homo sapiens
tccttgggaatgaggccattgtccgaaaggccaactcttggccaagtatccaactgga

SEQ ID NO: 6871630 - DNA, 82 bp, Homo sapiens
gtgattcgagtagtccagccatatcttgtagcccttctttgaatgagagggtggctggagtggtctggtgctgggatatcac

SEQ ID NO: 6871631 - DNA, 68 bp, Homo sapiens
taagtagaaattatcatccttggagatgtaccacaaggaatattgacaagaaagatatttttaacttg

SEQ ID NO: 6871632 - DNA, 74 bp, Homo sapiens
agcctcaggatgccttcatcaccttgcagctcctctaatgagagagctacagtcggaaggacagactgcaggct

SEQ ID NO: 6871633 - DNA, 99 bp, Homo sapiens
tataagtctattcctagtaccagtctgaattattactagttctgaaataattgacaaagatttactgtaatcagggcttaggtacagaataaatttgta

SEQ ID NO: 6871634 - DNA, 62 bp, Homo sapiens
ctttgctaaacataaagttcatactggagagaaatcttacaaatatgaagaatgtggcaaag

SEQ ID NO: 6871635 - DNA, 63 bp, Homo sapiens
ggcggtgtccttgcagctctacccagctcttggctctgggaaaagggaacaatggacgctgtc

SEQ ID NO: 6871636 - DNA, 55 bp, Homo sapiens
gaaggctacttctcctcagggccacagagagacgggccctgaggcaaaagccttt

SEQ ID NO: 6871637 - DNA, 89 bp, Homo sapiens
gaggaggagccccactggcagtgctgaggagaggtactccagctccaggcctggagagccttcccggcatcgcctgcggaccccacctc

SEQ ID NO: 6871638 - DNA, 76 bp, Homo sapiens
gagtgaagtatctctttattgacaataaaactttccagggaagttttattgtcaatgaagacagagaagaccactc

SEQ ID NO: 6871639 - DNA, 107 bp, Homo sapiens
cggggatttttttttaaatgactagtgttcagctttatttccaggaagttaaatttaaatggtctggggtgaggctaagcatctgtgtgttatggaagcagtcctcg

SEQ ID NO: 6871640 - DNA, 83 bp, Homo sapiens
ccaattagagatcgatttcatatcctcttatctagcagcttagttttgagtgggagagaaatggaacagtgagaagctgatgg

SEQ ID NO: 6871641 - DNA, 66 bp, Homo sapiens
atttccctttgcttttaatctttgtacatccttttcagtagggtgtgggattagaggaggggaggt

SEQ ID NO: 6871642 - DNA, 74 bp, Homo sapiens
ggctgcagggcagtctgactcactcatgccctggttgacaagccagctcaggacagacagaatgcctaacagcc

SEQ ID NO: 6871643 - DNA, 68 bp, Homo sapiens
ggcggtggttgagaggacggcggccgagagacaacaagggggcacgttagaaactctcgaccattgcc

SEQ ID NO: 6871644 - DNA, 80 bp, Homo sapiens
agctttagggatggtcagagacaggatctcgaagactgtcttcagtccttggtctctctctctttcttcatctctcagct

SEQ ID NO: 6871645 - DNA, 126 bp, Homo sapiens
ggatgaaatgagtctacagagaatttagggagcactgaagatgcgactagtgctggggagacagtggacaagccccatcccatttaatcttcatgccgtccctgtagacgacatctattaccatcc

SEQ ID NO: 6871646 - DNA, 93 bp, Homo sapiens
cagcgacaaggattccggcagtgggcgccaggtctccgctaggtcaaagccggggtgatctagtccacggttgaactcttaccctgtttgctg

SEQ ID NO: 6871647 - DNA, 58 bp, Homo sapiens
gattttcagatcttgcagtcccctccatggcagctgtcacacatgggatctcagagtc

SEQ ID NO: 6871648 - DNA, 88 bp, Homo sapiens
acttgactctacttgaatccaaatgggagatgaatcattgcagatttccatctttttctccatgtgaggattcaagagagggcagcgt

SEQ ID NO: 6871649 - DNA, 62 bp, Homo sapiens
gaggaaactgaagcccatgcttcacgctctaagcacgagtaacagagcatgggttcagactc

SEQ ID NO: 6871650 - DNA, 74 bp, Homo sapiens
ggccagagagcagccaggattctgtctcccacaaaacatagctgacactactcctccagaggccctccttggcc

SEQ ID NO: 6871651 - DNA, 62 bp, Homo sapiens
ctttcatgttggagaggcccacattgcaaggaacctagcatggcctccagccaacagcaaag

SEQ ID NO: 6871652 - DNA, 88 bp, Homo sapiens
agtggcattacatccgggtcctctgtctcattttcattcacagatccctgtgggctgagcactgaggaaggaattcattaatgccgct

SEQ ID NO: 6871653 - DNA, 89 bp, Homo sapiens
ggggctgcgacgtctgctttgtctttcatgatactcaaccccaagcagagaaaaatatcttaaaaatcgaagcagattaacccagtccc

SEQ ID NO: 6871654 - DNA, 84 bp, Homo sapiens
agactgttgttgttttaaaattcatcatgtatggtcctggaaaaaaaggaagatgctcttaatgggtttatttagccacagttt

SEQ ID NO: 6871655 - DNA, 61 bp, Homo sapiens
gagaagggcttgggagtcaacacggccaggagtatttcagtgtcaggacaaagcccttctt

SEQ ID NO: 6871656 - DNA, 56 bp, Homo sapiens
gaacacagtcaagggctgctgtcctctcatccttggacagtcctgcactggtgttt

SEQ ID NO: 6871657 - DNA, 61 bp, Homo sapiens
acaagtaccaaatgctcaagtatatctgacatgatgcatttgaagcattttgtatcttagt

SEQ ID NO: 6871658 - DNA, 84 bp, Homo sapiens
gggaaggtagggtagcattctgagttcgcagagctacctgtgggctttgctgaagctcggaagctcccctgatgacctgatctc

SEQ ID NO: 6871659 - DNA, 108 bp, Homo sapiens
cttttaagaagctgagtattcttctgttagtttcaaatttggactaaaattacaccaaggttttggactaaagaggaagcaaataatctgttcttatgttcttaaaag

SEQ ID NO: 6871660 - DNA, 73 bp, Homo sapiens
agctgttatgaactttatttaaatttaatctggtagcagtgtttttgttactattagtttgagcataagagct

SEQ ID NO: 6871661 - DNA, 66 bp, Homo sapiens
tcatactcacaactgggacgcctgcaaagaggcacttctggaaatgtaggaaagttgtgagtctgg

SEQ ID NO: 6871662 - DNA, 76 bp, Homo sapiens
atttagtcacaactaggagcttctgccatagaaagcaaaaacagtcttctgggacattctctccatagtactgagt

SEQ ID NO: 6871663 - DNA, 61 bp, Homo sapiens
atgctacactccgcgaaaatgtaaaattttagaagaagttctctatttgtgggtgaagtat

SEQ ID NO: 6871664 - DNA, 79 bp, Homo sapiens
atgcagtgttatgtagcagaaagatgtttggcagaatgctatttgtccaacttttaactctgctgatgactggctgcat

SEQ ID NO: 6871665 - DNA, 91 bp, Homo sapiens
taatatagtatttacttctcagggttatagtgaggatttaaatgagttaatatacgtctaaagcccttagaatagtacatgacacatagtg

SEQ ID NO: 6871666 - DNA, 61 bp, Homo sapiens
taagttctgactctgaatctgggaatgtggtcaccttcctcagagacaagttgagaggttg

SEQ ID NO: 6871667 - DNA, 85 bp, Homo sapiens
acttttgttgtcaatgcccttatgccagaggcaatttggactaagaaataattgtcaaaaaatggcagggctttactacaaatgt

SEQ ID NO: 6871668 - DNA, 71 bp, Homo sapiens
aaattcatttaagaacatggtgctagctagatagaacatatctgtgagtatttttgtttatttgtggattt

SEQ ID NO: 6871669 - DNA, 85 bp, Homo sapiens
ttaagctatttaattctacttcagaaatactatctccttgtttattcagtggctgtgcgtctggagtggagtttgaactgcttaa

SEQ ID NO: 6871670 - DNA, 83 bp, Homo sapiens
taccatctatctttgggctatatctcttcctatatttccataatgcgtacatatagagagagatataagtataaataggggta

SEQ ID NO: 6871671 - DNA, 75 bp, Homo sapiens
cccttcctgctgggtctaactctggtttttagggtaagtaccaggggaacaaggcctaatgagcaggtgtcaggg

SEQ ID NO: 6871672 - DNA, 61 bp, Homo sapiens
tttcatgtttatggaaaatgaggacgtcttcctagttacatattctatgattaacatgaga

SEQ ID NO: 6871673 - DNA, 60 bp, Homo sapiens
gcctgaggagcagcgtcaacaggtagggctccccggtactgaccactgttctcctggggt

SEQ ID NO: 6871674 - DNA, 75 bp, Homo sapiens
gcaaagatataaagatgtttattatatcctctggatgccatgatgacatgattgccatttgataggtatgtttgc

SEQ ID NO: 6871675 - DNA, 64 bp, Homo sapiens
aactcctgacctagtgatccgttcgcctctgcctcccaaagtgctgggattacaggcataagtt

SEQ ID NO: 6871676 - DNA, 60 bp, Homo sapiens
gtgactctgcctgttgaaactgtctgctagctggcccagcatctccaggcatggcctcac

SEQ ID NO: 6871677 - DNA, 66 bp, Homo sapiens
ggagttgagagggtgccttgttactgtacagtcttacagtaactcatgtaaacctcacaacaatcc

SEQ ID NO: 6871678 - DNA, 63 bp, Homo sapiens
ctagatcacactggttggctgctttctattatgctaaaaatgcagctaacaggtatctactag

SEQ ID NO: 6871679 - DNA, 129 bp, Homo sapiens
caatgcacaatggttgatgagttagttctggaggcttctgaattttaatgatgctggagatgatattgtgtgtccttcagcttgttagagtgacaccagcactccataaatcataatacctgtgtattg

SEQ ID NO: 6871680 - DNA, 84 bp, Homo sapiens
cctacagggatgaacatttgtatgcgtttttactgtcagtttctaaactgtttagatttttaaccatcacaaatgtctttgggg

SEQ ID NO: 6871681 - DNA, 67 bp, Homo sapiens
ggacactaaggctcagtggccctactttgtggaagactcagtagaggctcagagagccgcagcatcc

SEQ ID NO: 6871682 - DNA, 67 bp, Homo sapiens
ctgccctcaggctggtccccacagtggaaagcctgctttgctttcttgctgtgccccagcagggcgg

SEQ ID NO: 6871683 - DNA, 92 bp, Homo sapiens
ttggagtggactgaaggggaggcacttgttaaactactattgttgccagcaatctggactagcacagtggcctctcctaatgtcccttccaa

SEQ ID NO: 6871684 - DNA, 79 bp, Homo sapiens
cggcgcgcgcccaagctgctggcgtgcttgcacaccttctgccaggagtgcctgagccagctgcagctccgcgccgccg

SEQ ID NO: 6871685 - DNA, 70 bp, Homo sapiens
gaactgtccttttaatgcagccgtgaaaattgttaccaagcaacaagcgggtcttgagaggtaagcattc

SEQ ID NO: 6871686 - DNA, 74 bp, Homo sapiens
cctagcatttacatccaagagtaccagaatctagttccaaatactggagggccatcttgggtgtgatggtcagg

SEQ ID NO: 6871687 - DNA, 98 bp, Homo sapiens
cccaaagtcagctagtaaatttgtggcagtataagagctagaacctagtccctcctctcagttcatagcattttgtcctgctctgtgctgcctttggg

SEQ ID NO: 6871688 - DNA, 85 bp, Homo sapiens
ggattgttcagaggaatttgcttttcatgttagcagactaatcactctctgtcctccatcaaataaagaaattccttggatttcc

SEQ ID NO: 6871689 - DNA, 98 bp, Homo sapiens
tttcttaacaaataaggggaagagatgttgaagtttattagtaatcaaattattattgattaaaatgagacatcatttttacttgttgaattaggaaa

SEQ ID NO: 6871690 - DNA, 64 bp, Homo sapiens
ttgggaggagggaatgcaaccccagattggcccctgatctggttttggctgtgtccctgcccaa

SEQ ID NO: 6871691 - DNA, 58 bp, Homo sapiens
gatgtactgaccacggttaccaagggagcagtttccttggcaatggccaacagtcatc

SEQ ID NO: 6871692 - DNA, 102 bp, Homo sapiens
tggtacttccgccctcaggtgattttatctaataaatctgataagtacagtagactctgatactcggatattagatgaatagctcatgctgtggggagacca

SEQ ID NO: 6871693 - DNA, 71 bp, Homo sapiens
tctcccaacgttaatattttataagtcttacatgcaatttgtgacatgacttatttaaagttagcgggaga

SEQ ID NO: 6871694 - DNA, 129 bp, Homo sapiens
ttttttaacccattataaatacatgtaaatgttgcatttatgggtagacagaactaaaagaacaaaatttggcctacttttgagatgcaagatttatctggcataatgcattgaacaggttattattga

SEQ ID NO: 6871695 - DNA, 90 bp, Homo sapiens
gcacatgtggcagggtctgggccctgagatgttcttctagttggggctgggagaacgagcgaggggccaggccctcctctacactgctgc

SEQ ID NO: 6871696 - DNA, 74 bp, Homo sapiens
ttagaagttagttttgggcattagaatattctttctcaaagaaagaagggcaggatcccaggacagctaactaa

SEQ ID NO: 6871697 - DNA, 78 bp, Homo sapiens
agggggatgctcaggaggctgcttggggcttttgggagaagcaccatgagagggctgagctgcctcccgcacccctct

SEQ ID NO: 6871698 - DNA, 94 bp, Homo sapiens
gaatgttcataaaatgtaactgttcatctcttagaaagtacaccaattttcaactggtatgcttgcaagagatgcaatgactatgttcacattc

SEQ ID NO: 6871699 - DNA, 61 bp, Homo sapiens
gggatttcaagtatcttgggcgagaagaaaaggtttttacgttctagctgcttcgaatccc

SEQ ID NO: 6871700 - DNA, 106 bp, Homo sapiens
tctcattctgtaatactttttgataagccaaaggcattacctaagtttgggacattttgtgctgtcctgtaattgtaaatggttactaggaattattagaatgaga

SEQ ID NO: 6871701 - DNA, 80 bp, Homo sapiens
ggtatgtgctctatgaagggctcttctatttatggccctgtgatgggcacattagacaatagcctagatagaccactacc

SEQ ID NO: 6871702 - DNA, 61 bp, Homo sapiens
acattagaaccaaggtacagtctattgctaggtgtctgcagcagctgcctggttttttggt

SEQ ID NO: 6871703 - DNA, 67 bp, Homo sapiens
ctgtagaacgatccaggcatttggctcaccaggtggacctactttttgtctagatttgttcttatag

SEQ ID NO: 6871704 - DNA, 108 bp, Homo sapiens
tccttatcgcaagaaggttgatgagctagggatctgatttgctgtttaaggattgctctaatgtaacataaaagatcgtctaatcatggcatctaattgctgagagga

SEQ ID NO: 6871705 - DNA, 70 bp, Homo sapiens
aggtggccacaaggtggctggccagggttagagctgaacttcaggaagacaagccatggttgtgacacct

SEQ ID NO: 6871706 - DNA, 75 bp, Homo sapiens
gaatgggcttggcaggcaccaacttcctggggagccaactgggcagcttcccgggggtgccaggagtgcaaaatc

SEQ ID NO: 6871707 - DNA, 116 bp, Homo sapiens
tcactttggaattttacaaaagctgtgatggtcaggccctatctccaaagattctgattcaatgcatttggaatggaacctagttatccacatgttgtataaagttccaaaagtga

SEQ ID NO: 6871708 - DNA, 128 bp, Homo sapiens
atttgagatgattctatggcaacagaaatgtgcttgagggaaatcagttgcggcatcttctataattgtgtcacctagattttgccttaggaatttctagatttccatagaacattgtgacctcaaat

SEQ ID NO: 6871709 - DNA, 91 bp, Homo sapiens
ggtttggtattctgtcactagcttctctgatttatacttctgcctataagagctaagagtctagaaaggcttccagagagtaacctaaatc

SEQ ID NO: 6871710 - DNA, 64 bp, Homo sapiens
gtaatttctcagggatctagtcccatctctttattcctttactcgttccctgggatataattac

SEQ ID NO: 6871711 - DNA, 75 bp, Homo sapiens
cccttcagatattttaatactacagatatacagtatataataactatgttatcagtagggttgaactttggaggg

SEQ ID NO: 6871712 - DNA, 55 bp, Homo sapiens
ctctatgacaccctattaagtactacctgtgcaggctgcttgaggtgtgctagag

SEQ ID NO: 6871713 - DNA, 58 bp, Homo sapiens
cttccatttacactccttggggactcttctttgagggactctgaggctgagaagggag

SEQ ID NO: 6871714 - DNA, 65 bp, Homo sapiens
acacaaacatcaatcctgttttccaaattacttttgatattcttggagctttagggagtttgtgt

SEQ ID NO: 6871715 - DNA, 60 bp, Homo sapiens
tttcaaggctgcttcctgtagagtcttttgtgtctcaacaggaatttgtgcaccatgaag

SEQ ID NO: 6871716 - DNA, 59 bp, Homo sapiens
gtggccgtgtaacttgagtacaaatttctggttccttttgttcatagttatccggccac

SEQ ID NO: 6871717 - DNA, 56 bp, Homo sapiens
ctgcagcctcctggggtacatgacacttgcgaaagtgacgtgagtggaggctgcgg

SEQ ID NO: 6871718 - DNA, 74 bp, Homo sapiens
ttttggcttttattagtggctagatggggagagggatgtaacctgaaccctaatgcagctgagaagggctaaga

SEQ ID NO: 6871719 - DNA, 67 bp, Homo sapiens
ggatgttgcactgaaggctaggattagatgatggaatcctctaattatttgtttttactaaatatcc

SEQ ID NO: 6871720 - DNA, 96 bp, Homo sapiens
taatatgacctggcacagtgtgtagcacatggtaagcacacagctagttttagtgctgctgctcctgctgctgctgctgctgccattatcatattg

SEQ ID NO: 6871721 - DNA, 82 bp, Homo sapiens
tgtctctgtatttttatgatgctatagaacttttgagtttctcgatatataatatgggtatcaatgacaaacatcagagaca

SEQ ID NO: 6871722 - DNA, 87 bp, Homo sapiens
atgaacgccaggggtaaagtatatgtgcagcatttttaattgtcctttgggattaaaattaagattcctgcatctgagccccttcat

SEQ ID NO: 6871723 - DNA, 60 bp, Homo sapiens
tcatctgtcatccacaaagctgtttgcattcttctggagtcttgatgggtctacagatgg

SEQ ID NO: 6871724 - DNA, 76 bp, Homo sapiens
acttgtagactaacagaagaatttataagataattctattctaggtaggaaaagtatgagttcagttatcttaagt

SEQ ID NO: 6871725 - DNA, 60 bp, Homo sapiens
gcaactgtgatttgttatcttgtatttcctacctcaagatgatgcacatttaacagttgc

SEQ ID NO: 6871726 - DNA, 75 bp, Homo sapiens
tgccaggcgtggtggtgcgcacctgtagtcccaactactcgggaggctaagcaggcggatcatttgggcttggta

SEQ ID NO: 6871727 - DNA, 62 bp, Homo sapiens
gcctctaatttagaactgagtttcttatatgttttagttgtgggaagtcataaaattagggc

SEQ ID NO: 6871728 - DNA, 91 bp, Homo sapiens
gctttccttgtgcttactctgtgggtgtgatttgggtttcctccaacatattttccaagagtgaaggttctcagaggacacaggagaatgt

SEQ ID NO: 6871729 - DNA, 56 bp, Homo sapiens
gacattgactttcccttctcctcatttcacagatgaggagtcaaggagtcggagtc

SEQ ID NO: 6871730 - DNA, 58 bp, Homo sapiens
atgaagcacatcctgttgaatcagcctagaggagaagcagcaggaatgatgctttcat

SEQ ID NO: 6871731 - DNA, 59 bp, Homo sapiens
aaggagaaacgtcagcaataagagtaaagtctataaacttggctggcttgtatttcctt

SEQ ID NO: 6871732 - DNA, 79 bp, Homo sapiens
gtcctttgggataaagggggaccaaatgactcctagctagaagctgggagcttgggtgtaccccagtacttgaaaggat

SEQ ID NO: 6871733 - DNA, 98 bp, Homo sapiens
ggataatgtccgtaagaatctttccagttttgatgtaggattctgtgatgtcaaaaataagagagattgtattattgcggattgaaaaataattatct

SEQ ID NO: 6871734 - DNA, 63 bp, Homo sapiens
ttcaaaaactcctacataattgctcaattatgatattaaggcagctttctgtaggggtgtgaa

SEQ ID NO: 6871735 - DNA, 67 bp, Homo sapiens
cagcacctatctctggagtctacagagtttccatctgtctggtctttgcttcagaacctgggtgctg

SEQ ID NO: 6871736 - DNA, 74 bp, Homo sapiens
ccggcgctgtctccccgcacccgaccgggccgagccggctgggccggcggggtgagggaaagcagtggagtcgg

SEQ ID NO: 6871737 - DNA, 58 bp, Homo sapiens
atcgaacagtgtatacacttagcctcccaagacacaaggcgtacaccaagtgttcgat

SEQ ID NO: 6871738 - DNA, 97 bp, Homo sapiens
tcatcctagtagactgcaggttaggagcactcctttagagcaaaacgttttagcatttaacccagtgacatcctttacctgttttttgtttttttga

SEQ ID NO: 6871739 - DNA, 76 bp, Homo sapiens
taccaggagaagggcctcctagagaatctccatgtgcttacatggggggtgaggaggagccaaatcttttccagta

SEQ ID NO: 6871740 - DNA, 67 bp, Homo sapiens
gccaggcagccaccctctgcgaagcccagcccagctggatgtatgtgatgggtgggctgtggatggc

SEQ ID NO: 6871741 - DNA, 69 bp, Homo sapiens
cgttatttttaagtagccttattgaggcatgattcatatgccataaaagccacctatttaaagtatacg

SEQ ID NO: 6871742 - DNA, 68 bp, Homo sapiens
aggaactggattcttactgggctgagcaggatgtgttggcatcacctggatgcagagtcgggcttcct

SEQ ID NO: 6871743 - DNA, 70 bp, Homo sapiens
tcctctagtttaagatctgttagtctgttattctgttacttatagttgaaaatattcctgaactagtgga

SEQ ID NO: 6871744 - DNA, 72 bp, Homo sapiens
ttcatttcctttaggaatgagaaagaattagatgagtttcagctggatccattttatttctaaaggagagaa

SEQ ID NO: 6871745 - DNA, 57 bp, Homo sapiens
cctattccacttttggcaaagcccagcaggggcaagctggctcctaaagtgggaagg

SEQ ID NO: 6871746 - DNA, 83 bp, Homo sapiens
ctgctatgttttagaatgagcatgaagccagtttggttattttattaaagaagaattaggtgcatgtttacaaaaacaagcag

SEQ ID NO: 6871747 - DNA, 82 bp, Homo sapiens
gcacagtgagagaaacagactccaccacaccttcttggctgtgcaaggaagtcagatgatgttggagtctgtgctactgtgc

SEQ ID NO: 6871748 - DNA, 64 bp, Homo sapiens
gacaggctaggttgctgtcctcaaagagcttgccatctcttatacatagtcgaccttgtttgtc

SEQ ID NO: 6871749 - DNA, 63 bp, Homo sapiens
ggacttacagctgatcacctttttacagacacaattcgttgaaagtatttacaggtgtagtcc

SEQ ID NO: 6871750 - DNA, 58 bp, Homo sapiens
cagtgactcatgcctgtaatcccagcactctgagaggctgaggcgggtagatcacctg

SEQ ID NO: 6871751 - DNA, 75 bp, Homo sapiens
gtataccaaggtttattaaaagttgatggcagcttgaaaactagtgctgacctgacagtggtagccttggcagac

SEQ ID NO: 6871752 - DNA, 63 bp, Homo sapiens
tccacttccttgctctatctctgtaatgttcattccagaggttacctagagcaagaaaatgga

SEQ ID NO: 6871753 - DNA, 70 bp, Homo sapiens
gcttaaatcccaatgctagacctggtggctagaccttgattgccaccgggtctagcattgggatttaagc

SEQ ID NO: 6871754 - DNA, 101 bp, Homo sapiens
ggggtttgggaagagaagattgagaagccacaggtgtctggagctggatggctcagggctttaggcccttgctggttctgagatttctcttctgtgaccct

SEQ ID NO: 6871755 - DNA, 64 bp, Homo sapiens
aaggagcaagataagatcatttacactattgttttaacattagtaatgattgtatcttgtcctt

SEQ ID NO: 6871756 - DNA, 56 bp, Homo sapiens
ttacatattatccaaaactgcttttgtgctacaacagcagagttgagtagtagtga

SEQ ID NO: 6871757 - DNA, 91 bp, Homo sapiens
ggacagaacgtgtactacaggggaatatttgtcttgagttgtcttacaaacttacaagattgatttgcttggccactgacagttttgatcc

SEQ ID NO: 6871758 - DNA, 71 bp, Homo sapiens
agcgatgagcaatgattgcagtagcagtttggtttgtgtttgtttatttgcttgtaatctttgctgttgct

SEQ ID NO: 6871759 - DNA, 81 bp, Homo sapiens
ttatttatattatgttgggcaggggtcagcaaactatggcctgcatgccaaatctggccccttgcctatttttgtaaataa

SEQ ID NO: 6871760 - DNA, 89 bp, Homo sapiens
tctgactagccctttctctgccttgtttgagctttgacagaatttgcaagggtggcgttaaggctgagcaggacactggaaaggccaga

SEQ ID NO: 6871761 - DNA, 56 bp, Homo sapiens
atgtctttgccatagttcatattgaataaaacagtagataaaagggcaaagggcat

SEQ ID NO: 6871762 - DNA, 72 bp, Homo sapiens
tgagcagtttctcttgtatcttcaggctctttaaaacaagaatgagtttccgaagtgcaaagagagtgaaca

SEQ ID NO: 6871763 - DNA, 80 bp, Homo sapiens
ccatctagtggcaaagtgcactagaatccagattctctgattctgaatctaatgttcttgtccattgcaccatctgatgg

SEQ ID NO: 6871764 - DNA, 71 bp, Homo sapiens
ctagcaactcactgctgctgtgctattacaacttagcaaggattgagagcactggtagctggaggggctag

SEQ ID NO: 6871765 - DNA, 72 bp, Homo sapiens
cccctgaccccttaatgctggtgtcgttcctgctttagggattggactgagcttgagagggttgtaaagggg

SEQ ID NO: 6871766 - DNA, 64 bp, Homo sapiens
atatttgattatattaactatgttccttaactagtgtgaggaactggtgaagtgtagtgaatat

SEQ ID NO: 6871767 - DNA, 80 bp, Homo sapiens
ccctgtcccgccactctgctgtctgatggcaggaatggagtgcctctcctacacagataacagagacgcgggggcagagg

SEQ ID NO: 6871768 - DNA, 71 bp, Homo sapiens
gacagccttctgtgtgtgtacaactgtatgtgcaaataaccagctcttgtggacataccagagtgcatgtc

SEQ ID NO: 6871769 - DNA, 96 bp, Homo sapiens
atagagcgtgggatgctaggaaaagagcccagtctggctggctgtctctctctcaactcatggtcctgaggcttgtttccactccttcatgcctat

SEQ ID NO: 6871770 - DNA, 67 bp, Homo sapiens
gctgcaatagattatgatctacagtgtgaaaagcttttcacactgtagatcataatctattgatggt

SEQ ID NO: 6871771 - DNA, 85 bp, Homo sapiens
cagggcagagatgaacagcctggcctcttgctaggcagccctgtgttgtctgagtggtgcaaggctgacatttcttcttgccctg

SEQ ID NO: 6871772 - DNA, 71 bp, Homo sapiens
tatccagaaaatttctccaagaatgcttagagagtccatatgtcatggcactcaagctcttgtctaggata

SEQ ID NO: 6871773 - DNA, 71 bp, Homo sapiens
ggctggcctcgcctgttgtagaatgagtccacagaggacagagccattccagatgaggccaggccctagcc

SEQ ID NO: 6871774 - DNA, 92 bp, Homo sapiens
aaatgtttcagagatgcatacagatttaaaattttcctatccaatttctgtaagagtgataatttaaattagtatgtgattgtgatacattt

SEQ ID NO: 6871775 - DNA, 74 bp, Homo sapiens
gtactatactgaaaataagtgagttgagtagattaagccactgcatcaagactatacttattttaagatggtat

SEQ ID NO: 6871776 - DNA, 69 bp, Homo sapiens
tccttcctcttggcctcgtatgtctcttgtaggctgtggagacccagagaaaagaggccaaggatggga

SEQ ID NO: 6871777 - DNA, 68 bp, Homo sapiens
tctaggaattctgtctctagacatttttcctaaggcagtaatgggacatggagacagatttatgtaga

SEQ ID NO: 6871778 - DNA, 130 bp, Homo sapiens
gcccggaggcgccgcattgttcctcggaggaggcggccgagcggcgctggggcggcccgggagctgcagctgcgcttccaaggcgcgccggcgccacctcgtggccgcagccccgctgtgcgccctgccc

SEQ ID NO: 6871779 - DNA, 60 bp, Homo sapiens
gacactttaggatttaaaagtctggctgtaaacagcttctctttgagtttttaaactgtc

SEQ ID NO: 6871780 - DNA, 124 bp, Homo sapiens
tcactttgcacacttctgagtggttttgatgtctcagggtctcaggtgtctcaggttcccatcccagcactgcccaggcacccatcttgtgctcatagatccaaacttgcaagaagtttgctga

SEQ ID NO: 6871781 - DNA, 55 bp, Homo sapiens
acttcgtcctggaaagttaatcacattttcagtgattaacttgtagatatgaagt

SEQ ID NO: 6871782 - DNA, 67 bp, Homo sapiens
tgagcagagcaataggactctcctttgtgttgactgtttttacaacatagtcttgtggctttgtgca

SEQ ID NO: 6871783 - DNA, 80 bp, Homo sapiens
gaaagagcagaactgaggggagcagggtcagcatgtgcctcttgctgcagctgccagcttctctccatcctgcctttttc

SEQ ID NO: 6871784 - DNA, 72 bp, Homo sapiens
cagttctgtggctgtgccctgtagatacccatgatgtgaggtggagagctgcttgctgcagacacggggctg

SEQ ID NO: 6871785 - DNA, 83 bp, Homo sapiens
ctaaggtggggtatggttgtgtgtgtgtgcacacgtgtgcacgcactgtgcaaatgacaggcacacaaatgtacccaaagtgg

SEQ ID NO: 6871786 - DNA, 78 bp, Homo sapiens
gcagtgactgaaccaccccggagcagacggcgggcgctccacagaggggccttcctgctgctccgggccgagcgctgc

SEQ ID NO: 6871787 - DNA, 79 bp, Homo sapiens
cgaacattaaaggtcatctactccgatgcctggtagctcatcagctcattgaagtcatgacctgtcttccccatgtttg

SEQ ID NO: 6871788 - DNA, 58 bp, Homo sapiens
cctggacagagggcagcggccaggttggagcctccagccacatgcagcctcttctagg

SEQ ID NO: 6871789 - DNA, 56 bp, Homo sapiens
actctggaagaggaaggtggaacttctcacagaaacaaagctgtcccttcaagagt

SEQ ID NO: 6871790 - DNA, 92 bp, Homo sapiens
gaagttcatttgcaagcctggtgacctctcactatgtcactggggcaacatgacaaagtgaggtcttcagtattgcacagatgtgaaatgtc

SEQ ID NO: 6871791 - DNA, 64 bp, Homo sapiens
ctgagcctgttgtcagccctggagcggctgctccgtcaggcagctcaggctggcagcaggctag

SEQ ID NO: 6871792 - DNA, 56 bp, Homo sapiens
agcatagagaagtggccgcttgctgtgcttcagcagctcaacagtgtctctattct

SEQ ID NO: 6871793 - DNA, 59 bp, Homo sapiens
ctgaaacagatgtgtgcattaatccacattcatttggtaaatgtattgttttgtttcag

SEQ ID NO: 6871794 - DNA, 86 bp, Homo sapiens
gctggggcaggtgctactggcatctgtgggtagaggccaggaatgctgctaaatctcctacaatgcacagggcagcccccacaagc

SEQ ID NO: 6871795 - DNA, 59 bp, Homo sapiens
tcagatcttagtgacatccaggatggataattttcatctttgttttgatgcagatctga

SEQ ID NO: 6871796 - DNA, 66 bp, Homo sapiens
gaatggatgactcatcctgctccaacctagtatgcacatcctgttggtccaggagagtcacttctc

SEQ ID NO: 6871797 - DNA, 78 bp, Homo sapiens
agtaccaagctagagggattccagggtaatgttatctctatctccctcactaagcccaagtccctttggtcaggtatt

SEQ ID NO: 6871798 - DNA, 83 bp, Homo sapiens
tgggccctggctggagggacccactcagaaggaaaccccattctctgctttcagagctgggtccctcccaagcatctggccca

SEQ ID NO: 6871799 - DNA, 92 bp, Homo sapiens
gtggtgtatttaatttggaccagtttattcattttaagttgttgttgaacaaacacacaaagtaggcagtgggctggaaatggggacattgc

SEQ ID NO: 6871800 - DNA, 58 bp, Homo sapiens
tcactgtgtaagaagatgggcttagtgacttactcaagtacatatatttagatagtga

SEQ ID NO: 6871801 - DNA, 61 bp, Homo sapiens
cttcttgcttatttgttcactatctgcctctgtcaatagaatgtgagcttcttgtaagagg

SEQ ID NO: 6871802 - DNA, 76 bp, Homo sapiens
aaggataaaactcaggagtttcaggtgtaagtgaactgaaacaacgcggcccatttattctcagatccttgtcctt

SEQ ID NO: 6871803 - DNA, 106 bp, Homo sapiens
gggaaagagcatccttgtaataaaattacttcttgatgtggaatttcttcccattattgaatttcaacgttagatgtaatagtgcaagtagagagcttcttgtccc

SEQ ID NO: 6871804 - DNA, 58 bp, Homo sapiens
tctgcgtccatctgcctgcttggcacagctgcatctgtagggcaccatggacagcaga

SEQ ID NO: 6871805 - DNA, 66 bp, Homo sapiens
ggaggtcgtgtttctgagcagcagaatactctccctgtcctggtgtttatctgactgcctacctcc

SEQ ID NO: 6871806 - DNA, 90 bp, Homo sapiens
gagacaataaccattcatttgccttgagcaatatttttcctttgatcagggagtggagcaaaagaggtagatgggtaggtatggggtctc

SEQ ID NO: 6871807 - DNA, 65 bp, Homo sapiens
atattttggggtgatgtgcatcctatagtttttgtggaccttgttgcccatcagctccaggatgt

SEQ ID NO: 6871808 - DNA, 57 bp, Homo sapiens
ctcagaggctttcaatgtgttttatgacattcatagagtcagttttgagcatctgag

SEQ ID NO: 6871809 - DNA, 124 bp, Homo sapiens
ggacagccagatgaaggtccagttctggtgtcgggtccctgaggagggagctctgtggactggctccgtagcacatgctcctggggcttgcctggcaccggtgcagggatcaaggtcggagtcc

SEQ ID NO: 6871810 - DNA, 60 bp, Homo sapiens
ccgctgcaggcagaatctcccaatgggcttccagggtttaccagtttgcattgcagatgg

SEQ ID NO: 6871811 - DNA, 66 bp, Homo sapiens
gaagtcagactgctgtggtctagagactttgtatttgcccatactctagatccgcagtaaaacttt

SEQ ID NO: 6871812 - DNA, 66 bp, Homo sapiens
ggaccagtggggctggatgctcccggaataccctagggaaggtagggggctggctcaactggatcc

SEQ ID NO: 6871813 - DNA, 68 bp, Homo sapiens
gggctggtgctgctttcagcatctattcagaggtttctgaatctggcatttgagagtaggactgggcc

SEQ ID NO: 6871814 - DNA, 94 bp, Homo sapiens
aagcatgaggatggatttcagagcccagcagtggggacccttggtcaattaatctccctgtagttcgtggtctttgaggcacattctcacgttt

SEQ ID NO: 6871815 - DNA, 124 bp, Homo sapiens
ggttaacgtatcacctaacgtacagcacttgtatttagtatttttcaagtatgatgagtttggagcaagattcacaatttttaagtagcgcaatgctcagtttaacatgttatgtcgttttatc

SEQ ID NO: 6871816 - DNA, 89 bp, Homo sapiens
ggtaaacatgtgtcatggggtttgttatacagattatttcattgcccccaaaatttgttaacaataagtccaggcattttccagctacc

SEQ ID NO: 6871817 - DNA, 77 bp, Homo sapiens
atttttgctgtgtcagtctaagaatggtgtttcttaaatgcaaaggagaaatcattttaggcttgatgtaagaaaat

SEQ ID NO: 6871818 - DNA, 62 bp, Homo sapiens
ggcttctgcatttcctgtttcctcatatatcccagactggatactggagaagccaagaagcc

SEQ ID NO: 6871819 - DNA, 69 bp, Homo sapiens
tttcaccccaaaggcattttgctgaccaatttggagacatggttacaactcgtcttatggtttgtggga

SEQ ID NO: 6871820 - DNA, 58 bp, Homo sapiens
gtagacaatttcaaagtaatattatctgcagattatatctagctttggagttctctgc

SEQ ID NO: 6871821 - DNA, 80 bp, Homo sapiens
gtgggattggttttctttgtccagacagctctcctaaccagaaaggctagacctgtttgttaagaaagcttctatcctgc

SEQ ID NO: 6871822 - DNA, 66 bp, Homo sapiens
gagacggggttttaccatgttggtcacgctggtctcaaactcctgacctcatgatccgcccacctc

SEQ ID NO: 6871823 - DNA, 62 bp, Homo sapiens
tgtcactgcaatgttgtttacagactgtaatgggtttattaagaacattttgtagaatgaca

SEQ ID NO: 6871824 - DNA, 84 bp, Homo sapiens
ggcatcttctggaacacaagcgtatgtctttgtctttaaaaaatgatttggggttgcttgtgattttgggggaatatggatgct

SEQ ID NO: 6871825 - DNA, 58 bp, Homo sapiens
ggctcccaggcatggaggtaattgggtcttggcttcaatgccacccttttgggaagcc

SEQ ID NO: 6871826 - DNA, 68 bp, Homo sapiens
gatggggaagggcagctgacagatgcttaagaaggcttaaaccatcctgctgctgctgttgcttggtc

SEQ ID NO: 6871827 - DNA, 98 bp, Homo sapiens
taaatacatagtaagtgaataaataagtcactgaccatttatatgcatagatagcattttgggtggcaaccgctgacttagaacatttgccctattta

SEQ ID NO: 6871828 - DNA, 80 bp, Homo sapiens
agcggcgagggagcgcctttgcctaccaggccggagaaccctgttcttcagtcgccttggcaggggcagcccctccttct

SEQ ID NO: 6871829 - DNA, 77 bp, Homo sapiens
tcgggcctgttggaatttgctcatccatttcatcgtgggccagtgtgaaatggtgagggaattgaacagcgtcacga

SEQ ID NO: 6871830 - DNA, 91 bp, Homo sapiens
aaatattttggagtttgtatgccatttgcttagttgtcttttacatgtaaaatccacaattccacatggcatgcaggttttctgtgtgttt

SEQ ID NO: 6871831 - DNA, 76 bp, Homo sapiens
tcgctctgtcgcccaggctggaatgcagtggcgcaatctcagctcactgcaacctccgcctgctgggatcaagcga

SEQ ID NO: 6871832 - DNA, 70 bp, Homo sapiens
gaaagcgccggctatttgagctactgaaagaaaatcagtttctttcaattctcctaatgctatgactttc

SEQ ID NO: 6871833 - DNA, 86 bp, Homo sapiens
ttggagacagctattaattgcttcccaagggaggtctttggcactaagtcagagtctcttttgcgaagagtgtttaggtgtgctaa

SEQ ID NO: 6871834 - DNA, 76 bp, Homo sapiens
aaatgggtaaaagaatgagttactcaaaagcagaacaccctgtctttttgacattggcttattctgttaatcattt

SEQ ID NO: 6871835 - DNA, 66 bp, Homo sapiens
attcttctcatagagacatgattatagaaaaataatcaatctgtgatgatgatctctgagctgaat

SEQ ID NO: 6871836 - DNA, 70 bp, Homo sapiens
ggtgtacgtgctgtagtcatgatgctgcaggttcttgtaggtagtgttgtcaaacggctcagcaggcact

SEQ ID NO: 6871837 - DNA, 55 bp, Homo sapiens
tgaggcctcgtcattgactgaggttctggcttttacagttaatgactaggcatca

SEQ ID NO: 6871838 - DNA, 108 bp, Homo sapiens
actagctgtaatgcttaacactgtggctgggattcaggcctaagtagggtcttattcttagcttgtctctcagccccagtcaagttactgttaagtcttagagccagt

SEQ ID NO: 6871839 - DNA, 70 bp, Homo sapiens
tattgtccagtagtttttggttttgctatctagctccctgcggatcttggcagatccaaaaatgacaatg

SEQ ID NO: 6871840 - DNA, 60 bp, Homo sapiens
gggtaatggaggaggcagccccaatctgcttgtagagttcctctgacttccctaatgccc

SEQ ID NO: 6871841 - DNA, 59 bp, Homo sapiens
tacattgttccagcgatagagaagcatttctggtttttgatttgctttgaacaatagtg

SEQ ID NO: 6871842 - DNA, 109 bp, Homo sapiens
cctcaaggaaaagataagtacagttgattcttgttatttgcagtagctgtattctataaagttgccaccagcactgaattagggaacactgaactattgttcctagggg

SEQ ID NO: 6871843 - DNA, 79 bp, Homo sapiens
atgagctgtgagggtacagatatttgctgaactatttacatgattaatgttcctataatgtttgcattcttattatcgt

SEQ ID NO: 6871844 - DNA, 65 bp, Homo sapiens
tacttttatgctgccatagataagtacataaaattatcataatgtgccatgacagcattaaggta

SEQ ID NO: 6871845 - DNA, 71 bp, Homo sapiens
tttctatgtgtgtgatttgggattggttgtttaacctctaagctattatttcctcatctataaaatggaaa

SEQ ID NO: 6871846 - DNA, 63 bp, Homo sapiens
cagctgctggcatggagactctgggtcccgaagctcctgggccctgcctccatcccagctctg

SEQ ID NO: 6871847 - DNA, 60 bp, Homo sapiens
gacctccattctgtcatgactgacaccatggtagtctgtcagcttgaccagtggagagtc

SEQ ID NO: 6871848 - DNA, 90 bp, Homo sapiens
tcaagttttacaatggcattttggggttcctgttcttggtagtattggtaatattagcagaaccagtcagtgagccattgaatgacttga

SEQ ID NO: 6871849 - DNA, 67 bp, Homo sapiens
aaaggccacacaactcttagagatttcagattaaattgtgtatatctctcaggaaggtgtggaattt

SEQ ID NO: 6871850 - DNA, 89 bp, Homo sapiens
cgtctgtgtcccacaggagcctgagtcccacagcacagcagctagagcataggctttggggtcaggctgaccagggctgaacacaggcg

SEQ ID NO: 6871851 - DNA, 60 bp, Homo sapiens
tttagacatctataattgctaaacacccacatgggtgtttagcaattatagatgtctaaa

SEQ ID NO: 6871852 - DNA, 69 bp, Homo sapiens
gttccagatacttagtaagctttttaaacaaatggttttgtacttacagagcttataagttaatgggat

SEQ ID NO: 6871853 - DNA, 86 bp, Homo sapiens
cacgatccaggctagcttcatacaatggtatatgcaatgattagttcagaattttgtgtgtgtgtgtgagtgtgtgtgtgtgtgtg

SEQ ID NO: 6871854 - DNA, 69 bp, Homo sapiens
ttcaagacaaacattaattaacatgttcgagacttgttgagaacatgattggaaaatgctgtctctgaa

SEQ ID NO: 6871855 - DNA, 93 bp, Homo sapiens
ccgcagcagatcatttcatattgcttccgtggagtgtagcgagtcagctaaatactttgacgccggtgggaatagcgatgattatggtagcgg

SEQ ID NO: 6871856 - DNA, 98 bp, Homo sapiens
gacttacacaaacgtacagccacaggtgactctcatttattcctgtaaatcatgtactcagttatctggctgtacaaatagagttaaaattgtagatc

SEQ ID NO: 6871857 - DNA, 87 bp, Homo sapiens
ggagaagtttgatgtgtgtaattcagtccttgctgagaagtgttcttgttgaattggggagactgtaattgacatgtcagctcttcc

SEQ ID NO: 6871858 - DNA, 76 bp, Homo sapiens
cctccctcccctgcgttctgcctccttccttaaccccaaaaacaacctaggaacggcagattcaagggtggagagg

SEQ ID NO: 6871859 - DNA, 66 bp, Homo sapiens
actgctttagacctagagctcttgcctcacactcactggctaaagttgagctttctctaaagtagt

SEQ ID NO: 6871860 - DNA, 76 bp, Homo sapiens
gcagatgttagctgttttttgtgaggaaataatggtgttagctatgagttttcttggaaagaaagagcttaaaagc

SEQ ID NO: 6871861 - DNA, 65 bp, Homo sapiens
gtgctacagactgagtacacttaggattcaaaactattttcagggtactattagtcatgtggcac

SEQ ID NO: 6871862 - DNA, 63 bp, Homo sapiens
ccagttagctttaggcccccaaaccagatcattaggtctctggaattggctgaggcaagctgg

SEQ ID NO: 6871863 - DNA, 72 bp, Homo sapiens
gtgtgtggttttgacagggtgatgaggtggtgagaagacattctgaatttccctgcaagcattttcacatac

SEQ ID NO: 6871864 - DNA, 78 bp, Homo sapiens
tgcgtggcagtgaagcagtccttgttgagctatggcatgttctaatttagcaagaaagattgcagcacttggtgtgta

SEQ ID NO: 6871865 - DNA, 56 bp, Homo sapiens
tctggaaagggtggtcacttttaagtcatgctacaaagttactactgtttccaaga

SEQ ID NO: 6871866 - DNA, 86 bp, Homo sapiens
tctgtgcttaatttactgtgcttacactaggggctattgtgggaaaactcataaacttagttaagcatattattacaagttgcaga

SEQ ID NO: 6871867 - DNA, 56 bp, Homo sapiens
ctaagacctgtgctcccaccatggtagactgccttggtgtcagttttggtcattag

SEQ ID NO: 6871868 - DNA, 66 bp, Homo sapiens
cacctagtctctatgagtgaatcacacgccagaaacatctgccctgtgattctatggagatttctg

SEQ ID NO: 6871869 - DNA, 94 bp, Homo sapiens
gggaaaagaggatttagatgctgagcttaagagaattccttatagtagaataagtaggttcaatctctcatgcattttctcttccttttttcct

SEQ ID NO: 6871870 - DNA, 73 bp, Homo sapiens
caggggaccgcatgtccttgggccagggtgcctggttgttgggccaggattcccagggtcatgcacacccctg

SEQ ID NO: 6871871 - DNA, 130 bp, Homo sapiens
cccaggacagcacctgcctgcccaggatgttactgcccttcccagtggaccctagacttgctgctggaatctagctggagagtttccaggaaggagggtgctctgcaagcaggctcaggcatggacttgg

SEQ ID NO: 6871872 - DNA, 88 bp, Homo sapiens
cagaattggacatgttgaattttagatggctatgggatatgcaggagcaggtatcctgggggcagctggaaacatgggtctggagctg

SEQ ID NO: 6871873 - DNA, 55 bp, Homo sapiens
agggaggcattagctactgcgatttaattcgtatcgctgggtgtaatgcccctct

SEQ ID NO: 6871874 - DNA, 107 bp, Homo sapiens
cttgcttccttggatttgtggctcccaataaggcatcagcacttaacccttgactcaggctctgctttttagggagcctaggcaaaagcaaatccaacacaagcaag

SEQ ID NO: 6871875 - DNA, 58 bp, Homo sapiens
ggcaggacagccccggaaatctttgagattcattgatttacaaaaccagcttcctgcc

SEQ ID NO: 6871876 - DNA, 111 bp, Homo sapiens
gaaatgtttcaccttctcaccacactctcagcttttcaacttactgtatacccatacacactgcagtgagtgctggttgttgttgatgatggcagtgatggtgaatatttc

SEQ ID NO: 6871877 - DNA, 98 bp, Homo sapiens
gtggctgttctcagtgaccctagtccctggacattggtaacaccatctcctccaatggttccttcagtccaggattgggagtgacttcctgctgtcac

SEQ ID NO: 6871878 - DNA, 83 bp, Homo sapiens
cccacctgtataggcaatcacattagtgaaacactgaaggatctcctttagtatttctaatgtaattgcctataaatattggg

SEQ ID NO: 6871879 - DNA, 91 bp, Homo sapiens
ggatgtaattattcttttgtctcttctgggaagcccagagtatacgttaataatcaagttccagaagatggcagcaaaggatttactatcc

SEQ ID NO: 6871880 - DNA, 78 bp, Homo sapiens
ggtaattcatgttgtactattcatcaatgattcattcttgttttcctgttgagtagtattccattgtatggatatacc

SEQ ID NO: 6871881 - DNA, 115 bp, Homo sapiens
cacaggagggaggttgagcagacagagaggctgagcagtacatccaaggtcatgctaaaagtgaatggttgaatatgtgtttctcatcctttccttttgattcagcactcctgtg

SEQ ID NO: 6871882 - DNA, 86 bp, Homo sapiens
actttgaggatattatgctaagtggaataagccagtcacaaaaagataaatactgcatgattccacttatatgaagtaacgagagt

SEQ ID NO: 6871883 - DNA, 58 bp, Homo sapiens
attgcatgacatatccacttgtacgtgaaaaattatgcatccaagtgtgtcgtgtagt

SEQ ID NO: 6871884 - DNA, 61 bp, Homo sapiens
gggctcaggtcagggcatcagcatccagttttacagtctttgaggcgcctgccttgagcct

SEQ ID NO: 6871885 - DNA, 61 bp, Homo sapiens
gctggtggtcagttaggcaatcatgtccagggagggatctggtgtctcactgtccagaggc

SEQ ID NO: 6871886 - DNA, 78 bp, Homo sapiens
gcaatacacacagaggccatgggatttccaactggctgtcaaaaaggaaagttctgagtccctggcctgtctgattgc

SEQ ID NO: 6871887 - DNA, 65 bp, Homo sapiens
ggctcagctactatgtgaaagccaggccaggcaggccttgccagctgcaaagtatgttgaaagcc

SEQ ID NO: 6871888 - DNA, 101 bp, Homo sapiens
tactgcttaaaaagggaaacactcaatttagtaattcggttgcctagatgaaatcgagtggctattgatccgtgatgtttctagatttttaagactatgta

SEQ ID NO: 6871889 - DNA, 77 bp, Homo sapiens
gacctgctggacctgccaccctctcaatgcattcctcaaatctgtctgctcagtgggtgagcttggtctagatagtc

SEQ ID NO: 6871890 - DNA, 65 bp, Homo sapiens
gagtttgagccctgacactgagggagttggttgtcaccaatcagatgtcagctggctttccactc

SEQ ID NO: 6871891 - DNA, 92 bp, Homo sapiens
gacctttctgtcaactccatttccctgcctcctgcactgcgaggctaccttcttgcctagggggccgggcagaagagagaactgagagcgtt

SEQ ID NO: 6871892 - DNA, 91 bp, Homo sapiens
tcctggctgatcagaatctgccccagtgatgggccatggttcagctagagaatgagccctaggtcagtggggaacaagctgtcagccagga

SEQ ID NO: 6871893 - DNA, 60 bp, Homo sapiens
gatctggaagctgccctcccgcacacctgggtgggtgtctggagggctggctccctgatc

SEQ ID NO: 6871894 - DNA, 75 bp, Homo sapiens
tatgtggtgtacatgtgtctgtatatctttggagaggcttacatgattatggagaaatatgtacaggcttacata

SEQ ID NO: 6871895 - DNA, 84 bp, Homo sapiens
tgtgggttggttaacactcccaggcttgtggattggagcgagtttgtgtttaattggctgtctttccaaagcaagtggcccaca

SEQ ID NO: 6871896 - DNA, 89 bp, Homo sapiens
cacccgactcctggatttggtgagagtgctttacaagcaaccatgtgtgttgtggctgatcaaagcgctcagaatccaggggaaggctg

SEQ ID NO: 6871897 - DNA, 88 bp, Homo sapiens
tttggaatggactcctgttcatgttgaggcatagggacttggtttgacgtctgttactctaccctcaaatgaatagtatgtctccaga

SEQ ID NO: 6871898 - DNA, 76 bp, Homo sapiens
atctgtcttctactttttaagtggttggaaaaaaatctaagtggtctcttccaactttgaaaatgttatgaaagat

SEQ ID NO: 6871899 - DNA, 61 bp, Homo sapiens
gcctgctgcccctgagctcagcctgtcacagtagtggggcagggcagagggagcagagggc

SEQ ID NO: 6871900 - DNA, 60 bp, Homo sapiens
gcacagctgccatggctgcacttgccagatgggggcaagagggctggtggcagctgctgc

SEQ ID NO: 6871901 - DNA, 103 bp, Homo sapiens
tattttggcctcaatgaaagtgcaaagagaatttccataatttacaatctacttaggtgtgaaattgagaaactttcacctaatgttcaattgggacagatta

SEQ ID NO: 6871902 - DNA, 57 bp, Homo sapiens
tattccctatttagtaattctgttctctaaaactgaggggtcactgagtgggcagtg

SEQ ID NO: 6871903 - DNA, 62 bp, Homo sapiens
tctcctgttgctcttgccccctgcaagtttcaagtctgaatggtggctagaaagcagtgaga

SEQ ID NO: 6871904 - DNA, 63 bp, Homo sapiens
cccagtctgtggtactttgtagggtcattggggtcacttttgagtctactcaccacaactggg

SEQ ID NO: 6871905 - DNA, 88 bp, Homo sapiens
taaaacctaaaatgtaaattaaaatgaacaaaatatgctttgcacatcaaactgtcaaggatttttgtctattgctttttcggttttg

SEQ ID NO: 6871906 - DNA, 58 bp, Homo sapiens
tagcatgctcaggaaatgctgcagagtggagcagttaatagatttcccagcagtgcta

SEQ ID NO: 6871907 - DNA, 64 bp, Homo sapiens
catgtgccccagccgctgctcctaagggaaccttagtgttcccagctgtggcgaggggaacatg

SEQ ID NO: 6871908 - DNA, 69 bp, Homo sapiens
cagttatagttgtggtatctgctgtttctgccttgaaatttccagcttacagctaagcaacaactactg

SEQ ID NO: 6871909 - DNA, 71 bp, Homo sapiens
aaacactaataacagtggctggtacatggtaaaagctccataaatgttagcattactattacatagtgttt

SEQ ID NO: 6871910 - DNA, 68 bp, Homo sapiens
tctaaaggctgggaaacctgaagttgtgatgtccaagggcagcagaagaagggtgtcccagctctaga

SEQ ID NO: 6871911 - DNA, 125 bp, Homo sapiens
aagaaaccaaaaactgctgtgctgaagacaaagatgtgtgtaatttaaagagaagtgggccatttaaaattactatcttccttatgcctatcaagtatcatgtaatttaggaaaaatcatttctt

SEQ ID NO: 6871912 - DNA, 57 bp, Homo sapiens
ctggcaggaaggagactcagcccctgcatggcggggctggttgtcctttgtgctcag

SEQ ID NO: 6871913 - DNA, 86 bp, Homo sapiens
aagtgtacattcaaaagctccatgtttgtttttatttcacaagttaatattaggaattaggcatatatgcttttaatagtacattt

SEQ ID NO: 6871914 - DNA, 75 bp, Homo sapiens
ctcctgcaatgcatgaattataaatatatacaaattttacatgtatttatgatagctgcattaaagaggcagagg

SEQ ID NO: 6871915 - DNA, 68 bp, Homo sapiens
gttccattctctgcctcttgccttccctggggtgtgccagggacttggctagtgatgcagggtgagac

SEQ ID NO: 6871916 - DNA, 61 bp, Homo sapiens
atgatttatgtgtaaccttgtgatttattgagagacagtggattatttgacacattatcat

SEQ ID NO: 6871917 - DNA, 86 bp, Homo sapiens
aagctggttctttttctgtttttaagattgtactgatttccttttgttttcagcagttttattatgatggaaataaacattagttt

SEQ ID NO: 6871918 - DNA, 55 bp, Homo sapiens
tgctgaactattccatggggaagtttctgcaatcttcattccaaatagttcagca

SEQ ID NO: 6871919 - DNA, 82 bp, Homo sapiens
tagttttaaatggtcttggtctaacccctagtggatacttgagtatattacaaaattttggaacaggattcaattaaaggtg

SEQ ID NO: 6871920 - DNA, 71 bp, Homo sapiens
gatgatgtcactcttctgcctaatgaataatgagagttaatgaaggctttgggcaggagagtaatgtgatc

SEQ ID NO: 6871921 - DNA, 81 bp, Homo sapiens
tggctggctgggatctgtctggaggcctggcatgagtactgagctgtgtgccacaaagtctgccacacagaccaaccaaca

SEQ ID NO: 6871922 - DNA, 62 bp, Homo sapiens
ccattccaagttttatctgcgggtggacaacagtgcctgtgttcaagtgaagcctgggatgg

SEQ ID NO: 6871923 - DNA, 58 bp, Homo sapiens
gcctcactgtcacttatagtggtcaaggaagatttcagagagcaagtggcattggggt

SEQ ID NO: 6871924 - DNA, 58 bp, Homo sapiens
tggctttctctaggagctttccaagatttgttttgcaaagctgccaaggagaatacta

SEQ ID NO: 6871925 - DNA, 106 bp, Homo sapiens
tatggagatttttgtgagattcattaataggacaggttggcaaggttagaacagattctagcatcagccacaccttgtactcagaatctctctaagtatctccata

SEQ ID NO: 6871926 - DNA, 57 bp, Homo sapiens
tgcaggcattggtgagagaagcagagaatgttagcttcctccttactgttgtttgta

SEQ ID NO: 6871927 - DNA, 90 bp, Homo sapiens
acattatttaacttttcttgcaaagtgcttttctatctcttttggtaagtgtaatttctattatgagaggagaaaagtcagggctaatgt

SEQ ID NO: 6871928 - DNA, 75 bp, Homo sapiens
gcatgcatcctttctaagatactgcaacttttgtgaaataagtgaaagttacctcgttttggaaaggaaagtagc

SEQ ID NO: 6871929 - DNA, 56 bp, Homo sapiens
gccttgtgaatccacagtagctatggtgacaagcctgctgcaactctttagagggt

SEQ ID NO: 6871930 - DNA, 73 bp, Homo sapiens
gtgcaggggcagagcatagctccaattatttttacatagtcttatatcactatgctctgtgcaggtcctgcac

SEQ ID NO: 6871931 - DNA, 57 bp, Homo sapiens
agtggaggaaacagaggtgcaagaattcaaccaacttgcagttcaagtcaatctact

SEQ ID NO: 6871932 - DNA, 87 bp, Homo sapiens
gggtagatgacatatatataagagaggcattaatttgaggagaaagatcacaggtttagttctgcttatattgagatgcaggtgctt

SEQ ID NO: 6871933 - DNA, 55 bp, Homo sapiens
gctctccactgaccacggggcatggtcaaatgtccagttggattgctgtgagagt

SEQ ID NO: 6871934 - DNA, 72 bp, Homo sapiens
gagtaactatcatcctgctgcctttgtttataatttccttaacttagaaatctaggccgggtgcggtggctc

SEQ ID NO: 6871935 - DNA, 57 bp, Homo sapiens
aacatttgctgactggatgcagttggttggcaccatgctgtgccattagcagttgtt

SEQ ID NO: 6871936 - DNA, 59 bp, Homo sapiens
gcttcctcacagcactgctgcaggcggcactgttgctgcaggagattttgagagtcagc

SEQ ID NO: 6871937 - DNA, 76 bp, Homo sapiens
agaaatcaagaggggagaaatgacaatgctaatgaaaatatttgcatagaatatcatattttcccatttattttct

SEQ ID NO: 6871938 - DNA, 63 bp, Homo sapiens
ttggggaatgaggctactttttcagaagatcaatagaaatgggaagagagtcctcatcctgag

SEQ ID NO: 6871939 - DNA, 103 bp, Homo sapiens
cattttcttctagatacctttacttgcaccttgtccatttttggcccagctcctgaaggctcctggcctggacaaatgcaccaaggttctcgtgaaagaaatg

SEQ ID NO: 6871940 - DNA, 55 bp, Homo sapiens
aatgtctttacttttgtgggcactagtaccacttgccagcaaaagtaaaggcatt

SEQ ID NO: 6871941 - DNA, 107 bp, Homo sapiens
ctctcagctatccctgtatagctccagtcctgttcatgttctctctcaccagcagtacatctgtgctgtgaggatgttaaggggatgagtgaagaggggtttgagag

SEQ ID NO: 6871942 - DNA, 65 bp, Homo sapiens
gtggtggatgaggagctctggccttgggctctgcacacctgggctccggctgctcctctccctac

SEQ ID NO: 6871943 - DNA, 59 bp, Homo sapiens
gtgtatgtctgagtaataatgtgtgtgtgggtgcatgcatctatgacttagacattcat

SEQ ID NO: 6871944 - DNA, 70 bp, Homo sapiens
ttgctgactctgccttagtcctggggctggctattcagtgggctcctcacttctggcagtgtaatagcaa

SEQ ID NO: 6871945 - DNA, 72 bp, Homo sapiens
gcagggaacagcatatctgaagggtttctacaaagaattacatcctcagggtaggctatgtattcctagagc

SEQ ID NO: 6871946 - DNA, 66 bp, Homo sapiens
acctcattcattcattcagcaggtacttactgagaagcagatgagctgagactgacatgaagaggt

SEQ ID NO: 6871947 - DNA, 103 bp, Homo sapiens
gaaaactgtctggctcacctgaacctttgcttatctgatttaattcaatgcttacctggattcttcagatcagcagggccttggggatccctactccattttc

SEQ ID NO: 6871948 - DNA, 127 bp, Homo sapiens
tgatagaaaaaaaaagtgaggacttgggaccgattgtgtaggggcagtctgggatgcctccatttcttgactcgtcctagcctctccctctgtacttacctaggtcgatcgctagatcccactgtca

SEQ ID NO: 6871949 - DNA, 69 bp, Homo sapiens
acataaatacttctcagattgttgaacatctttggttaatttccaggatgctgagatgattgtttttgt

SEQ ID NO: 6871950 - DNA, 64 bp, Homo sapiens
ggggattcccgagatagtcacccccagcaaccctggctgagaggcactatctccggaccgcccc

SEQ ID NO: 6871951 - DNA, 59 bp, Homo sapiens
atccatgttgttgcatgtatcagtacttcattccatctgtatgaatgcattgcatggat

SEQ ID NO: 6871952 - DNA, 88 bp, Homo sapiens
cagtttcttcctttgtttaataggtggtttaagcaaggtctgagcatccctcaagtcctgctgtggaccacacaaaggcaaggagctg

SEQ ID NO: 6871953 - DNA, 116 bp, Homo sapiens
ggggatctaaggggctctggccaatgtggcagcctcagtgatcctggtgggacagaaaacctcaccatgcgtggggcctccagcactaggcagccaccctgactctgaccttcctc

SEQ ID NO: 6871954 - DNA, 71 bp, Homo sapiens
aaatggcttcgagtatatacatagtctatgaaagggaataaaagtctgtttgtatgtgcttggatttgttt

SEQ ID NO: 6871955 - DNA, 75 bp, Homo sapiens
tggaagtaatttatccctgtaccgccttgtggggttgggtgtttcttgcccactgcatgagttggtattactcta

SEQ ID NO: 6871956 - DNA, 71 bp, Homo sapiens
ggcattgcaggcaaagtgctgtgtcctcagtgatgaaccctgaagggccatgctaggtgcccgcagctgcc

SEQ ID NO: 6871957 - DNA, 69 bp, Homo sapiens
cacttagaaggtcagccttggatttggtagcagtatgtgaaatgctcagagataaaactgatcagagtg

SEQ ID NO: 6871958 - DNA, 105 bp, Homo sapiens
cagccatcctccttcctgctggtgtggcggcgccctgtagggaccagtggctctgggctgcaacgggcctgccacccgtgtcctcggagccaggaaacatggctg

SEQ ID NO: 6871959 - DNA, 122 bp, Homo sapiens
ctgtaaatttttaacaatatgcactaaaatgtttgtatattttaccagttttgtatatttcctggtttggcaaacactggtatgatgtatagtaattgttgtagtttgtgtcaaatcagcag

SEQ ID NO: 6871960 - DNA, 129 bp, Homo sapiens
gagaaggtgccggagtgggcagtggaaagtactcttctggtctggggaccactagctgaatccctgaggagctctgaggccccacgggggagtcctagtttccaggtgcttctctgagcagtggtgctc

SEQ ID NO: 6871961 - DNA, 65 bp, Homo sapiens
tctacaatgttggtaaagtatcatggacatattttatgcaataaatactttccagctgttggcga

SEQ ID NO: 6871962 - DNA, 95 bp, Homo sapiens
ggaagtatcttcaagtgagcccagcagcagacatcttttatcttcaggatggagttccatttctgcaaagagtaagatgaggcccttgaacttct

SEQ ID NO: 6871963 - DNA, 77 bp, Homo sapiens
agttgtattagttatttctaaagtgcttagaacaattcttcccacattctaagggctatgtgactgattaataaact

SEQ ID NO: 6871964 - DNA, 130 bp, Homo sapiens
ccagcggatgcaccaacaatggcaatccggatttcactgtgactggaatgctgtttagagacttaattgtgtaatgagcagtggcaccaggtcaccaggtgtatctgattgaagtctttgcttccgctag

SEQ ID NO: 6871965 - DNA, 56 bp, Homo sapiens
agtctccacttgacatcagcagggtcacgaaggactcagatgaccaagagggggct

SEQ ID NO: 6871966 - DNA, 64 bp, Homo sapiens
gcccatcttattttcttctagtgctcttttacttggagaaacagaatacgaaagctaagagggc

SEQ ID NO: 6871967 - DNA, 55 bp, Homo sapiens
gaagaagagaactggcatcctaatctggtgatctggtgatccgttctcctttttt

SEQ ID NO: 6871968 - DNA, 78 bp, Homo sapiens
gcacctgtttgtgtttggactgcatttcagtggctagcacagttcctggggtgccccggatatgtgtcaagcaggtgc

SEQ ID NO: 6871969 - DNA, 82 bp, Homo sapiens
ctcggcttctccagcggacgctgctggctccattctcttaagtttgatgaagcaagccagccagttcactaggaaagtaaag

SEQ ID NO: 6871970 - DNA, 101 bp, Homo sapiens
ggagctttagaaaatggcattaagatgtctgctggttgagtgacctcatagaacagaagaggtttattctgccaggagcgtcagtgcaatgaaaagactcc

SEQ ID NO: 6871971 - DNA, 56 bp, Homo sapiens
tagagtccttcattctgtgcagatgcacttggcatctagagtgggaccggagtcta

SEQ ID NO: 6871972 - DNA, 67 bp, Homo sapiens
gaggatttatctttccgccgcttttctacctgcctaacaagctggaagtggcagaaaatgaacactt

SEQ ID NO: 6871973 - DNA, 87 bp, Homo sapiens
tgtttctaattttagttcagccaaaggagcgagacatgtgttcaacatgttttctctattttcctttggttctctaagatgctgaca

SEQ ID NO: 6871974 - DNA, 76 bp, Homo sapiens
agctgaggcggttggatcacctgaggtcaggagttcaagaccagcctgaccaacgtggtgaaaccctgtctcttct

SEQ ID NO: 6871975 - DNA, 69 bp, Homo sapiens
gtcctcaactgcacaccaagcttgtgtgattaataccacccacgccaggcctgacgtcagtgattggac

SEQ ID NO: 6871976 - DNA, 90 bp, Homo sapiens
gtgggtgaacgaatgcatgactgagtgggtttctgcttgtcaagtcttcctctttggaagcatacccccttagcacacattagagctcac

SEQ ID NO: 6871977 - DNA, 62 bp, Homo sapiens
ctgggtctgtcactagataaataataccagagaagtgttgaagacctagagacaggactcag

SEQ ID NO: 6871978 - DNA, 55 bp, Homo sapiens
ggcagagtcagaggtggttctgggccaaacactaggagaagcctcagaatttgcc

SEQ ID NO: 6871979 - DNA, 59 bp, Homo sapiens
ggagctatctctgagtcaccgtggagacgttgagaatgtcgcagggtctttgaggctct

SEQ ID NO: 6871980 - DNA, 56 bp, Homo sapiens
ctccgactttctcaccgtgttctgagccttgtaccagagcagggagtggttgtggg

SEQ ID NO: 6871981 - DNA, 59 bp, Homo sapiens
gccttctgttgcagcagtatgtagccttgtggagaaatgagtctgtctgcgcatgaggt

SEQ ID NO: 6871982 - DNA, 112 bp, Homo sapiens
tatttatacctttatgcctatacctaaatctctacctatttgtttctgtgtcatctgaatgaatacacagctagatggatagatagatgatagatagatagatagatagata

SEQ ID NO: 6871983 - DNA, 89 bp, Homo sapiens
gaactggacttaattatttagatatggttggagtagcacagacccaagcaaaactgcacctcctttgttttagattataagtctaattc

SEQ ID NO: 6871984 - DNA, 88 bp, Homo sapiens
gggccttctgatggcacagcctgttctcttcccagtttgcttatggcaagacgagggcccccaggacagcaatgccgatggatggtcc

SEQ ID NO: 6871985 - DNA, 71 bp, Homo sapiens
caggtgaggtgggactgggctgcaagatctggtgccgcttttctccactgtgcagcctgtcccttctcctg

SEQ ID NO: 6871986 - DNA, 72 bp, Homo sapiens
ggcctggccacctggactccttgggagtggctagagaactcctcctgagagcagagtccaggtgtttgggcc

SEQ ID NO: 6871987 - DNA, 78 bp, Homo sapiens
tatgtccatgacagtgattcccaaagtgttgtccccaaaccagcagcatcagcatcacctgggaacttgttagacatg

SEQ ID NO: 6871988 - DNA, 94 bp, Homo sapiens
aatgtgtgaaaaatacttgcttcaaataaatgtttaattatagacattataatgacaatattaatttggagggagtgtatttaactaatacatt

SEQ ID NO: 6871989 - DNA, 71 bp, Homo sapiens
ggcagtttctgaggttccaggttttgagatttgtgaccccatagagagaactcgaatttcagaggactgcc

SEQ ID NO: 6871990 - DNA, 66 bp, Homo sapiens
gagtcaacaagtcagatctcacaggaaattctgagagcccagcacatctggccttgaaaatggctc

SEQ ID NO: 6871991 - DNA, 59 bp, Homo sapiens
cttgaaagcactcctttgactgatttcctcccttgatgcggtcaggaagtactttccgg

SEQ ID NO: 6871992 - DNA, 130 bp, Homo sapiens
gctacattcaggtctgatttaggcattcgagactgtgtggcagggagttgaagagctgtgattatgacccatttatacagcttttgcagctgttttgctaagttgtgatatgtgagatggaaaactgaac

SEQ ID NO: 6871993 - DNA, 59 bp, Homo sapiens
atgatattgagagacaactgcacaattgcaacgcagagcagcaggtctgtcaatgtcat

SEQ ID NO: 6871994 - DNA, 55 bp, Homo sapiens
ttactgaatatctctgagccagaaatgattgtagatgctcaggatgtagcagtag

SEQ ID NO: 6871995 - DNA, 73 bp, Homo sapiens
ttcttccctgccagaaggttcctgctgcagctctcctgctagtttagcttagccttctggtttgagggatgag

SEQ ID NO: 6871996 - DNA, 60 bp, Homo sapiens
ccacaggtgatgacatttgaaccaagccttaaagaattggcaagaattcttaccgtgtgg

SEQ ID NO: 6871997 - DNA, 64 bp, Homo sapiens
ttttatctgttgtacctgcattgtctctgtaacggggattacaacgcatgttcaatatgtgaaa

SEQ ID NO: 6871998 - DNA, 94 bp, Homo sapiens
agctgtgtggctttggttgcatttactcagtgcctcttggcctcagttctctctaagcggcatgaggagtaagtagtgcagggctccgctggct

SEQ ID NO: 6871999 - DNA, 65 bp, Homo sapiens
actgtgagaggggtgtccttgctttgttattattaatggcagcagtagccaccccagcttactgt

SEQ ID NO: 6872000 - DNA, 72 bp, Homo sapiens
ggtgaacagagggtctctcgtctgagcgtgtggtccgtgggccgtgtggcagcctcagacaaggacctcacc

SEQ ID NO: 6872001 - DNA, 57 bp, Homo sapiens
tcatttcacttctctagggagagatttttatatccatcttttgaagagatgagatga

SEQ ID NO: 6872002 - DNA, 80 bp, Homo sapiens
ggctggaaaacccttaagcaaactcatttattttctttaactatcacaaagtagtcacagtcctttagggatttcttgct

SEQ ID NO: 6872003 - DNA, 61 bp, Homo sapiens
cctcatgatgctgagagtggattgactatgcagttattccactccaataagtgtcaatagg

SEQ ID NO: 6872004 - DNA, 58 bp, Homo sapiens
gaagctgtagccctccccgaagtgcttccatctcagggtcttgggggctgcaagcttc

SEQ ID NO: 6872005 - DNA, 63 bp, Homo sapiens
cctcaacccaggaaagaatttagagccatttgtaatgtttctaaggaaattcctgcactgagg

SEQ ID NO: 6872006 - DNA, 63 bp, Homo sapiens
cagtgctgcattctctggacagctttcataggctgtacgaactcagagagtcacagtgaactg

SEQ ID NO: 6872007 - DNA, 75 bp, Homo sapiens
actgagggcaggggaggggctttgggctaaggtggtcctgagtccaaatcccttctctgattttaccccctgagt

SEQ ID NO: 6872008 - DNA, 60 bp, Homo sapiens
ttttcagtacgctcacgtatatgattcagttgcaggcaagaatctgggagctgctggaag

SEQ ID NO: 6872009 - DNA, 74 bp, Homo sapiens
tcccggaagcccaggcagcgcccgagtccgcagctgccgtcggagctgggacgccgctgcctccagctctggga

SEQ ID NO: 6872010 - DNA, 66 bp, Homo sapiens
ccaggagctcaaagatgccaggaggaacttaggtctatatcttgcctctgctctctgagtttttgg

SEQ ID NO: 6872011 - DNA, 80 bp, Homo sapiens
ggcctcagcttccctatctgaccataaaaattgctatctcattggcttgctgtggagattaaataggggagctaagtgct

SEQ ID NO: 6872012 - DNA, 89 bp, Homo sapiens
ccacaggcagaggctggccgagctggtgctcaggggcatggactcagaagtcctgagctgccgcatcagcagcacagcggtctgcgtgg

SEQ ID NO: 6872013 - DNA, 63 bp, Homo sapiens
taccatggctcagctgactcggcttctcccagtaaaggaagaatgggctggctgagcccggtg

SEQ ID NO: 6872014 - DNA, 95 bp, Homo sapiens
tcctcttataatcagactttctggaagctaaaaacacagcagtttggttttattggttcttctacttgaaagtgacatttctgagacatagagga

SEQ ID NO: 6872015 - DNA, 57 bp, Homo sapiens
tcatgattcttctaccacagcagaattccattcagtgttgtgtttggagaattttga

SEQ ID NO: 6872016 - DNA, 83 bp, Homo sapiens
gagggagcaggggaccatgaacttgtatgccagactcagggcctgggtgcccagctctgggctgacatgctccctgcttgctt

SEQ ID NO: 6872017 - DNA, 63 bp, Homo sapiens
tggaggcttctccttcctaccttcctcctcactctgagcagtgaaggaaggggaggggcaacg

SEQ ID NO: 6872018 - DNA, 86 bp, Homo sapiens
gagggctgtttctaaattcagtttattttgatactttaatggcagtcaaagcctggatcaaaatggaagaatttggctgcactttc

SEQ ID NO: 6872019 - DNA, 60 bp, Homo sapiens
ttagagtttggcagagcttgggtggtgggcatacacttaccataatctctctaagcctaa

SEQ ID NO: 6872020 - DNA, 55 bp, Homo sapiens
tgctggttagtgctgcctgggtaaagggagctgggcccaggcagagctagcggca

SEQ ID NO: 6872021 - DNA, 61 bp, Homo sapiens
tgtgtacagcattagaaactattgctgcaaggtttacctgtgctgcattctaacgcacaca

SEQ ID NO: 6872022 - DNA, 73 bp, Homo sapiens
cactcagctcctttctgaaagtgtcctcccttaggcctctagaaacgccatggactttaggaagggccaagtg

SEQ ID NO: 6872023 - DNA, 68 bp, Homo sapiens
tgaatcaattgtcttaagacatgaagtagatcccaaactgcattttgtctttctgaaaattgaattca

SEQ ID NO: 6872024 - DNA, 77 bp, Homo sapiens
tgaaggcttgtgtaaattatttttaatgattccctcctggcacatcattatgtttgtagttgcacacaggcacttca

SEQ ID NO: 6872025 - DNA, 99 bp, Homo sapiens
aggggagtgttttttcttggctattcttgaattctgctttttaagtatatggtcagtaggaaataggacgttaagactggccaagttcacgtttctcct

SEQ ID NO: 6872026 - DNA, 72 bp, Homo sapiens
ctatgttgaaatcctcacccccagaatgatggtatcagaaggtgaggtctttgggaggtgattcatttatgg

SEQ ID NO: 6872027 - DNA, 63 bp, Homo sapiens
tctacttcccagtactgcctgccacaactatatcccttagaatccagaacagctgggaagaga

SEQ ID NO: 6872028 - DNA, 70 bp, Homo sapiens
agggtaagggcttagttactggcagagcagcgatgatttgccctaagatcctaactgagccctaaatcct

SEQ ID NO: 6872029 - DNA, 65 bp, Homo sapiens
ccgtctccagggcagagaatagcaatggcaggaaacgtcactatccagagttgctgctggagcgg

SEQ ID NO: 6872030 - DNA, 87 bp, Homo sapiens
tggaattctagtacaagtctgaaggtctgagaaccaggagagccaatggtgtagttcctgtctaaagacctgcaggcttgagaccca

SEQ ID NO: 6872031 - DNA, 70 bp, Homo sapiens
gccctcagctccttccctggtgggctctgagcaccgcgcctctcccaaggggtaagggagctgtgagggt

SEQ ID NO: 6872032 - DNA, 62 bp, Homo sapiens
tgccttgagggtagagtcgatgacttatttccatttgtgtatttcctgtacctatcaaggca

SEQ ID NO: 6872033 - DNA, 66 bp, Homo sapiens
tggaggctttcagattaatgctgtggtaagagatgacatcacattttgagaaatgacaagcttcca

SEQ ID NO: 6872034 - DNA, 63 bp, Homo sapiens
aggagggtgcagtaggggagaattgaatacagaatgtgggaggtcactttgctgaactcttct

SEQ ID NO: 6872035 - DNA, 58 bp, Homo sapiens
ggaggcctcctgggggaggttcatgtctcactttgcagcctccagccagatggcctcc

SEQ ID NO: 6872036 - DNA, 69 bp, Homo sapiens
cagacccatctgcagggctttttgaaacatggtccactggacttcactttcagagtctcagtaagtctg

SEQ ID NO: 6872037 - DNA, 74 bp, Homo sapiens
aatgcacatgtcttggcctcacctccagcctactcaattataatttctggttttagagcccagatgtctgtatt

SEQ ID NO: 6872038 - DNA, 57 bp, Homo sapiens
acgtgctgaagttatccctgttgcaagaacaagcatcaaacacaggactgggcacgt

SEQ ID NO: 6872039 - DNA, 78 bp, Homo sapiens
tgcatctaaaggaaggccctcccgatgtgctactcagtaatgtagcaaaggtaccacaagggcacttttgctggagca

SEQ ID NO: 6872040 - DNA, 85 bp, Homo sapiens
ccacctgtaaacaaacacaggcaaggccagtgagaaatcagaaaccaagttgcttattatttcatggtgttgctgtgtgttgtgg

SEQ ID NO: 6872041 - DNA, 79 bp, Homo sapiens
cttttaccacaaaatggatgtttcccttctgatttgggagactatgtcttcttagaagaaacatctaaaaatgggaaag

SEQ ID NO: 6872042 - DNA, 56 bp, Homo sapiens
gtctggcagcccctccacctggctactgaagccagtcaggtgtgggggctgcagac

SEQ ID NO: 6872043 - DNA, 115 bp, Homo sapiens
cagcacttcaggttttgatatgcccaggactgaggtccttttaggttttcagaagactgagaattcttaggaacctagacagggcctctgttaaggctgagcaagctgcggtctg

SEQ ID NO: 6872044 - DNA, 89 bp, Homo sapiens
ggcctgtttgccttggccccgggccagggccgccccgccagtgagtaatgcgtgaggaccgcctggctccggttcaagggaaacgggct

SEQ ID NO: 6872045 - DNA, 57 bp, Homo sapiens
gcatgtgtggggttatggtgtatatgggaaatctttgtacatttcactccattgtgc

SEQ ID NO: 6872046 - DNA, 56 bp, Homo sapiens
tgcagtggaatctggagagcagtttgtgtactgcttttggctggagttctactgta

SEQ ID NO: 6872047 - DNA, 93 bp, Homo sapiens
ttttccatcaaaatagtcaaaactccttggattgttggttttggtttaaaatatcaaagtaaccaaggctcaattaactaagaagttggagaa

SEQ ID NO: 6872048 - DNA, 56 bp, Homo sapiens
ctgagcagggagacaactctggtgcagggtctcactagtcttcatcccatgctcag

SEQ ID NO: 6872049 - DNA, 92 bp, Homo sapiens
tttggttgtgttttcttattgttgctaaaagtcctgtgattaaccatatcctgtttcttacagtaagggtaaataagaacatgctaaccaaa

SEQ ID NO: 6872050 - DNA, 114 bp, Homo sapiens
ctttatttttcttaaatggcagtaattatagcatggctatattgttgctccaagtttctctggcttctgtattttatttggtttgctgtaaatgcctccttaaggaacataagg

SEQ ID NO: 6872051 - DNA, 112 bp, Homo sapiens
agagcttgttcatggctaaaaaccattctaatatcattcctgagggagttgacttacagaaggatggcctccctccagaatggtgaggaagtttagctgtggtttctacttt

SEQ ID NO: 6872052 - DNA, 74 bp, Homo sapiens
gcatggcacgggcaggccggctgtgctgggggacctggcgcccccctctgcagctgctggcccaggtgctaagc

SEQ ID NO: 6872053 - DNA, 75 bp, Homo sapiens
taccttacttttgtttaaggaatatatgttctggtgtgtagaatgtagaatgatccttaggataataagaaggta

SEQ ID NO: 6872054 - DNA, 126 bp, Homo sapiens
agctccagggccttgcccccttttctttcttacaaagaaaacggtggcttgactcagcaaaaactaagaagggtagctgtttctccaggtcaggaaggatacgggggtcagcacttcctggcagtt

SEQ ID NO: 6872055 - DNA, 56 bp, Homo sapiens
gacagacaggaggcattcagggaagacagagtcccattgagtggccagatgctgtc

SEQ ID NO: 6872056 - DNA, 73 bp, Homo sapiens
gctcaccagggcctgcttctctgggctttctagagactagaaagtcttttcagaggccaaaaagtccctgggc

SEQ ID NO: 6872057 - DNA, 100 bp, Homo sapiens
gtttcttttgtgttaacttgacttccctgaatgacctagttggtgaattagtcactagtaatttggtcactaggaaaatcaagccttcaagaaaggaagc

SEQ ID NO: 6872058 - DNA, 78 bp, Homo sapiens
aggcaaagtcttttgatttgcaagaggctgcttttgctgagagaagaaaatgctcttgaaaatcaaaagggaaggcct

SEQ ID NO: 6872059 - DNA, 55 bp, Homo sapiens
ggtgcagtgtgattttctggctgagtggtgtctgcctcagtcatatatctgcacc

SEQ ID NO: 6872060 - DNA, 69 bp, Homo sapiens
ctttgcctgtgtcagcaggtggaagtgctcaccagacattaaatattcagcttgctgactgcggcagag

SEQ ID NO: 6872061 - DNA, 74 bp, Homo sapiens
aactgtcccagttggcctgggaccgagggtctactattaaacctgtagtagtctcaggcaaaccaggacaagtt

SEQ ID NO: 6872062 - DNA, 61 bp, Homo sapiens
tgctggggccaaaatacttgaccttgcttccatggcagggtcaaaggaaaggcccacagta

SEQ ID NO: 6872063 - DNA, 61 bp, Homo sapiens
ggctaatgttaagatattattatcatttcttcaggggtagtaatgatattttgattatgtt

SEQ ID NO: 6872064 - DNA, 129 bp, Homo sapiens
ggctctgctcccggttggtgcagcgggtgcagaggctggctggccggagcgaggcgggcgacacgccgcgccgggcttcgcctgcctgtcctccacctccgcagcaagtttccctaccttcgggcggac

SEQ ID NO: 6872065 - DNA, 82 bp, Homo sapiens
ttgcttggatgtagtaaatttttgttcaatataaattaacaattatgtactgagttcttattgaatagaaatcattgggcaa

SEQ ID NO: 6872066 - DNA, 79 bp, Homo sapiens
tctttgatgctccttccagtcttttcagtggagtcagaagcagagacttgactgcctgagatgggaaaggcattggaga

SEQ ID NO: 6872067 - DNA, 111 bp, Homo sapiens
tttcagtccaataatagaggcaagattcggggcccacgatgcatttcatttacttttgggtaataaaccaggaatgtcaagtagatgtgcgtgggcttcgatgacatgaaa

SEQ ID NO: 6872068 - DNA, 61 bp, Homo sapiens
ggcaaaccaaccagagacagtttgctcccaagaggggacacctggcttgagttggtgggtc

SEQ ID NO: 6872069 - DNA, 64 bp, Homo sapiens
gacactagacattagacctgctagtggcccctcaaaggctggcctctgcagcctagttagtgtc

SEQ ID NO: 6872070 - DNA, 56 bp, Homo sapiens
tctgggtgatgaaatgcactgtctggagtcagtccattcattttttttcacctaga

SEQ ID NO: 6872071 - DNA, 77 bp, Homo sapiens
tcattagaaagagcatctagttttataaaaagtctcaccagtgacgcagagatggaaagagatgttgtttctgaaga

SEQ ID NO: 6872072 - DNA, 122 bp, Homo sapiens
gcagcctgctgctggtcaggtggcagattgtgttttccaaagactgcctcccctgcacatccgtcctgcagggctttgcaatgcacagtgggcctgtcacccctgccagaagagggggctgt

SEQ ID NO: 6872073 - DNA, 67 bp, Homo sapiens
ttcctgtttccagctgaaattagatacgatagagttcaatagataaagccacgctggaaatcaggaa

SEQ ID NO: 6872074 - DNA, 73 bp, Homo sapiens
ggcttcgatacctgaaacttgtgatttgcaggttcaaaagcaatcgtttatatacactgtttcagttgaagtt

SEQ ID NO: 6872075 - DNA, 64 bp, Homo sapiens
gtatgcatttacggtacaacagcaggccactagaaaagacagcttgttgcctctgagatcatac

SEQ ID NO: 6872076 - DNA, 60 bp, Homo sapiens
ggtgggtcacttgaggtcaggagttcaagaccagcctgaccaacgtggtgaaaccccatc

SEQ ID NO: 6872077 - DNA, 58 bp, Homo sapiens
tctgtctgtagttttacatgattttgatcatataatacatgtaaaattataaggctga

SEQ ID NO: 6872078 - DNA, 68 bp, Homo sapiens
gttttaaacacaactttgtgtgaataaaatgatgtgtctgcatctctccaggaagcagtgtttggagc

SEQ ID NO: 6872079 - DNA, 125 bp, Homo sapiens
agtctgcagtgtttggatgggcaggtgaactactgattttcaaccaaaaattgtttttctcattgttctttggagtgttatcagtaattactaattttgaatctataccaagcaaaccccagatt

SEQ ID NO: 6872080 - DNA, 60 bp, Homo sapiens
aatgcaactgagatggcctctggaagacaaattgctgtcccattccaagtcagttgcatt

SEQ ID NO: 6872081 - DNA, 75 bp, Homo sapiens
tagacatttattcattttttgagtgcctacttcttacctgcgtatttggggcacaaagatgaatacagaatgctg

SEQ ID NO: 6872082 - DNA, 87 bp, Homo sapiens
cctaccctttcagaatgtgaccttatttggaaataggccattgcagatgtaattagttgagatgagatcatattggagtagggtagg

SEQ ID NO: 6872083 - DNA, 58 bp, Homo sapiens
ctttgaccccggctttctgacagcaagcacctcttttggcagcaggtatggggcaagg

SEQ ID NO: 6872084 - DNA, 63 bp, Homo sapiens
gggacagggcgtggggtagaggaagaagctagaatgctgatccctgagatgctgctctgtccc

SEQ ID NO: 6872085 - DNA, 63 bp, Homo sapiens
ttgatttctaaggatgtacctaccattccacacaataaataggtacatatacttggaggtcag

SEQ ID NO: 6872086 - DNA, 64 bp, Homo sapiens
gaagtaggtgagcttgtgcttctgtgctgtcccacccagccggtctgccaggtctctctgcttc

SEQ ID NO: 6872087 - DNA, 62 bp, Homo sapiens
ggtatgtgtgtgtgtgtgtgtgtgtgtgtgtgtgtgtgcgcgtgcatgcatatcacatttcc

SEQ ID NO: 6872088 - DNA, 83 bp, Homo sapiens
cagtattcaacatatggtcatgatgtgggtcattctttgtgattacagaatgcttcctaaccatggccgtgtgccgattactg

SEQ ID NO: 6872089 - DNA, 60 bp, Homo sapiens
gtcatgatgaagtagttgagtagaatgtaatgaagtcttgttcgattagatcatgatgac

SEQ ID NO: 6872090 - DNA, 92 bp, Homo sapiens
gcatcatatcacttgagagcttgttagcaggctccgtcccaaactgactggatcagaatctgcattttaacaagatcccaggtgatttatgc

SEQ ID NO: 6872091 - DNA, 58 bp, Homo sapiens
tccactggcctgggagctactgaaggaatgtgcctctccccatcccaggccaggtgga

SEQ ID NO: 6872092 - DNA, 68 bp, Homo sapiens
gctgactaacctggagttgtttcattgcagagaggctggctgtggcagatgcaactgcaggtgagtgc

SEQ ID NO: 6872093 - DNA, 56 bp, Homo sapiens
gctgggagacaaaaggaccacgtgcctccttgagcgtgactctggcttcttccagt

SEQ ID NO: 6872094 - DNA, 67 bp, Homo sapiens
cagcctcaggcccctccacttctcagatcaggtcccagacctgcccatgaaaatggggagcaggctg

SEQ ID NO: 6872095 - DNA, 57 bp, Homo sapiens
tttttggcccttagctctgtatgtcccagcttggactcttagagataaggcggagaa

SEQ ID NO: 6872096 - DNA, 88 bp, Homo sapiens
ggccttctggactgtgaactggcttagttctagaaatttggtgaaaagctgtacttctccatctactgacttagcctcatttctggcc

SEQ ID NO: 6872097 - DNA, 82 bp, Homo sapiens
gaaagagttgatgtataaatacctcagttccctcaccctcagatgggttgagataactctgatttatgttttacactctttc

SEQ ID NO: 6872098 - DNA, 79 bp, Homo sapiens
taggttgatgcaaaagtagttgcagtttttgccatttaaaagtaattccaaaagcagcaaatacttttgcaccaaccta

SEQ ID NO: 6872099 - DNA, 55 bp, Homo sapiens
gtggggctctcggcgcggcaggcgcttcccggccctgtctggccgcgggctccgc

SEQ ID NO: 6872100 - DNA, 63 bp, Homo sapiens
tcttccagggcctgctttcttctgttcgtgatagaatcatcccagtgtggcaggccatggaga

SEQ ID NO: 6872101 - DNA, 60 bp, Homo sapiens
gttgtttctgtaagagacagctctataaataatgagctgtttgtttctatgagagatagc

SEQ ID NO: 6872102 - DNA, 79 bp, Homo sapiens
agaaattacagaaagcaatattgagtgaagtactgttattaaccagatgaaacttaaagtagttttactgtggtattct

SEQ ID NO: 6872103 - DNA, 59 bp, Homo sapiens
ttgagggacagaggtgctgtctaggaagtcagatagcgttttccagttctgtccctcag

SEQ ID NO: 6872104 - DNA, 71 bp, Homo sapiens
ggcacgtcgcggcaatgaccacacactgggctcttttggaaagagtttacagttctcatcgcaacgttgcc

SEQ ID NO: 6872105 - DNA, 84 bp, Homo sapiens
aaggattatagccaggtcacagagctagctagctcatttacagctgagattagctctagatctgggctattttgtttgattctt

SEQ ID NO: 6872106 - DNA, 60 bp, Homo sapiens
gcattgcctcaggcacctggcaggttttgtgaagctggcatgtcacctgagaatcagtgc

SEQ ID NO: 6872107 - DNA, 64 bp, Homo sapiens
ttagcagcggtcagttttgaagctctaaagtgaagcggagctttaggtatttccccttgactaa

SEQ ID NO: 6872108 - DNA, 60 bp, Homo sapiens
ggagggtggcagcgtcctgggctccatgcacttggccaaagaggacttctgaacccgtcc

SEQ ID NO: 6872109 - DNA, 61 bp, Homo sapiens
agactgtttgggttccaaatctggctgaaccactaccagctatgtaaccttgagcaagttt

SEQ ID NO: 6872110 - DNA, 81 bp, Homo sapiens
ttagccacattggccaaatttggtgtaacttgacattttaacatctgcaaccctcttcactagtttggtcagtagggttga

SEQ ID NO: 6872111 - DNA, 58 bp, Homo sapiens
gctgtgagaaacagggagtgtctctcctctgctatctgagacctgtcaacatcacagc

SEQ ID NO: 6872112 - DNA, 58 bp, Homo sapiens
attttcctaaaagagcaaagtggaccattccccctcctctcagctcttcagggcaagt

SEQ ID NO: 6872113 - DNA, 79 bp, Homo sapiens
agttttcagaatcttaagacattacttccactaactttaactcaggggagagaattcagcttaagattatctgactact

SEQ ID NO: 6872114 - DNA, 57 bp, Homo sapiens
ttagccatgcttcttgggtctagtgataggtctcccttgatgagaatgcaaggttga

SEQ ID NO: 6872115 - DNA, 60 bp, Homo sapiens
ctggtctgaaatgtgacttttgaaccattcctttggttaaagtaagtgtttcagaatcag

SEQ ID NO: 6872116 - DNA, 75 bp, Homo sapiens
ttattgaaaaggtcactgatcagttgagtacagatgaaaggttcttagagtagatcaatgacctgttgttagtga

SEQ ID NO: 6872117 - DNA, 69 bp, Homo sapiens
ctcgggtccttctctagcctcctgggtaatctctgcatatagagtgcccaagcagaggagtgattcggg

SEQ ID NO: 6872118 - DNA, 72 bp, Homo sapiens
gctgggggccagtgtctcttccttggtgatttgcctccactttgtttctaggaagagctataggtccccagt

SEQ ID NO: 6872119 - DNA, 68 bp, Homo sapiens
cagtcagttgaagatggccatgcattagtcatacttctgtctgtgtaaatggcatctctcagctgctg

SEQ ID NO: 6872120 - DNA, 74 bp, Homo sapiens
actgagttaaacagaggtagcagactggtggtccccagtaatggattgctagtctgtcttttccagaaaccagt

SEQ ID NO: 6872121 - DNA, 56 bp, Homo sapiens
cccaggaggcagaggttgcagtgagccaagatcacgccacttcactcctgcctggg

SEQ ID NO: 6872122 - DNA, 55 bp, Homo sapiens
actgctcatgaggacctttcatttgtcttttaaagatgtgtgggtttagagtagt

SEQ ID NO: 6872123 - DNA, 56 bp, Homo sapiens
cagtgaacatttgtgctagccctgcctatgcagaaggccagctgcatatgtcactg

SEQ ID NO: 6872124 - DNA, 84 bp, Homo sapiens
tctacaatttatagttattctgattatctgtgtttgaaagttgatagacacagatttcactggaatagatgaaagaattttaga

SEQ ID NO: 6872125 - DNA, 118 bp, Homo sapiens
tgctaagtattctggagttgcttctggtttactctgcactgctcacctccgagggccagatccacacccctgtgacagatgcggaaactcagagaagccacccagctagtgaacagca

SEQ ID NO: 6872126 - DNA, 55 bp, Homo sapiens
gaaacgttgtggaaaatcctctggggaatagctgagaggacttttttgatgtttt

SEQ ID NO: 6872127 - DNA, 58 bp, Homo sapiens
ctaaagcttcttttaccaggaagttgcaattctgcaactgaatgctggaagaagagag

SEQ ID NO: 6872128 - DNA, 111 bp, Homo sapiens
agaaatgggctgtgtcttctaaacattatgatagtagagttaacattgagttgttggttctttaaagaaattatctctgatgtaggcattgtatttcctagccttaattct

SEQ ID NO: 6872129 - DNA, 62 bp, Homo sapiens
gagtgtgcagcaggcctcatctcctgggccttagccaaggtctctgagtactgctggacctt

SEQ ID NO: 6872130 - DNA, 67 bp, Homo sapiens
cattgtttgagcatctgggatccagctacgttcagatggctgggcttttccatgtactgagccaatg

SEQ ID NO: 6872131 - DNA, 57 bp, Homo sapiens
gcctctgatgatgatcgagctgtggtgatcctatcagccaagcagccatcatctggt

SEQ ID NO: 6872132 - DNA, 105 bp, Homo sapiens
accactgaaaccagagtttcaagtggatacaatgttgggaagggtcaaactaacttcaagggattgacccttctcaacattatatccattctttggggtcatggt

SEQ ID NO: 6872133 - DNA, 85 bp, Homo sapiens
ggctctgacatgtgtctccttccgtctcatagtcatccccaccccagctggagggaggaggcggggaggcgctgctgtaggggct

SEQ ID NO: 6872134 - DNA, 86 bp, Homo sapiens
ccttgcgcccggccggcctgctgctcacagtccctccacgtacccacaggaggcccagactcagcggggcgggtgcaagcgcgggg

SEQ ID NO: 6872135 - DNA, 56 bp, Homo sapiens
ctcattcactctacccttccttcctcacaaaaccaaggctcttggagtgaatgcag

SEQ ID NO: 6872136 - DNA, 55 bp, Homo sapiens
aggctggagtgcagttgcatgatcatagcccactgcagcctcaaactcctggcct

SEQ ID NO: 6872137 - DNA, 74 bp, Homo sapiens
ttaaatcgttgggagcaaataggaaagaggaagagtgggagcaaagcctcttccggtttgcttttaaatgttaa

SEQ ID NO: 6872138 - DNA, 62 bp, Homo sapiens
tcaacattggaggcaacattcactgcaatgtgtgaatgccagtacttgcatccagatgctga

SEQ ID NO: 6872139 - DNA, 63 bp, Homo sapiens
tgaaggtgctcgttatggccagtggaaggatgcttttaacacagagatggccagggcacatca

SEQ ID NO: 6872140 - DNA, 65 bp, Homo sapiens
cctgtcgtcactgcagaggtgctgaacagaaattgcgcaggacacttgcagtgacctctttcggg

SEQ ID NO: 6872141 - DNA, 82 bp, Homo sapiens
ggtcacactgatcacaggtggtaggaaaagaaactttaatgatttccttttctcattaccacccgtgcccttggttctggcc

SEQ ID NO: 6872142 - DNA, 90 bp, Homo sapiens
agcacctccatccgccctaaccaaccaattaatcagatcattaaggagcctgaggagttgtaattgggtggtttgggacgagggggcgct

SEQ ID NO: 6872143 - DNA, 57 bp, Homo sapiens
gcttttccagtgtttttattgatttttcctggactcaggaaagaaggattggagagc

SEQ ID NO: 6872144 - DNA, 72 bp, Homo sapiens
cttgttacagaatagagactgcctgctctggaaattcttttggtttcagtttagtttttatctatctacaag

SEQ ID NO: 6872145 - DNA, 73 bp, Homo sapiens
ctctgctgaaaaccactgtactgaaaagtaagcaagttaagaacttgttctgctttccagagcattcagagag

SEQ ID NO: 6872146 - DNA, 56 bp, Homo sapiens
ggaccctggagccgtctgaggcaggtccttcctggccctgtccgtgatttaggtcc

SEQ ID NO: 6872147 - DNA, 68 bp, Homo sapiens
caagcatgcatcttttcaaggtatttctaccagcatgagtggaaatggcttgcagacatgcttgcttg

SEQ ID NO: 6872148 - DNA, 78 bp, Homo sapiens
ggaatgagtgcccttctcatgatttggatatcttagatgagtttatgagcagaggagcagagaagggaattcataacc

SEQ ID NO: 6872149 - DNA, 94 bp, Homo sapiens
gatgtattataggttggtgcaaatgtaattgcggtttttgccattgaaagtaatggcaaaaaccgcatttacgtttgcactaacctaatatatt

SEQ ID NO: 6872150 - DNA, 64 bp, Homo sapiens
tgcgctgtatgagaaacagatgtaagctctctgggaattgggcaggcatttctctttacagcca

SEQ ID NO: 6872151 - DNA, 96 bp, Homo sapiens
agtgaaatgattgccttgtctcgtcctgggtctgggaaggcattacagaggaagagatgcttgagctgagtctaggcaagcaaataacattttcct

SEQ ID NO: 6872152 - DNA, 66 bp, Homo sapiens
attactctgcatttgtgaagatgcacctcctccaatgatcagatgtattacagatgcatcagtgat

SEQ ID NO: 6872153 - DNA, 62 bp, Homo sapiens
ggacaactgtcttcttcatgctccaccattattgcacaggtgaggacagaatttggttgtcc

SEQ ID NO: 6872154 - DNA, 108 bp, Homo sapiens
accccctcaggtcccgttgcctcctggtcctttcagggattcctggtccttccttcccacactagcctccctggggtatcgctgaggcagcctggcctgcacccaggt

SEQ ID NO: 6872155 - DNA, 79 bp, Homo sapiens
atgagttcagactacaggagtaaaataatttcaatttgttttgaaaagtgctttatttcctgtctaaatgttgaaccat

SEQ ID NO: 6872156 - DNA, 56 bp, Homo sapiens
ggcgcaggcccccctggagggccccgctcagggcctctcgccagcggggctgcgct

SEQ ID NO: 6872157 - DNA, 96 bp, Homo sapiens
gtttgccatgcttttgcattggtttaattttgctttgggttttattcaattaataaagtaaggcagtgaatgagattacgtatctgtatggctaac

SEQ ID NO: 6872158 - DNA, 65 bp, Homo sapiens
ggctccgatgtaccagtgttgttggcaagcacaggtttttgtccaggactggttcacacggtgct

SEQ ID NO: 6872159 - DNA, 68 bp, Homo sapiens
gagctggcattctcactcccatgtctgcagggatttctctggtttcatgagatgagaatttccttctc

SEQ ID NO: 6872160 - DNA, 85 bp, Homo sapiens
ctccataaaaactgacccatcctttgcatcaacaatagtggcttgatgacgctcttcagtagaggattttgcatttcatatgggg

SEQ ID NO: 6872161 - DNA, 56 bp, Homo sapiens
cacctcagcgcctgcttactaccatgaaacccatcagaaaggcatggtctggggtg

SEQ ID NO: 6872162 - DNA, 62 bp, Homo sapiens
cttctttcaatttcccaagaccatagatggaaagacctttctttcctggggaatgatagaag

SEQ ID NO: 6872163 - DNA, 71 bp, Homo sapiens
ataggcagtgttctcacttgtaaacattcactaaacgatgactattgttaccagtggtacacatgacctat

SEQ ID NO: 6872164 - DNA, 70 bp, Homo sapiens
agctcattgaagtatttaagctccccttgattagatgttataatgatcagacagagaagtacaatgagct

SEQ ID NO: 6872165 - DNA, 56 bp, Homo sapiens
ggctcgtgcgtcactgctattcatcttgtttagtgcttggcttggctgcagatgct

SEQ ID NO: 6872166 - DNA, 64 bp, Homo sapiens
ggacaaatttttgtgatgtgctgacgcacaccgaagaacacagcatcattactgagatattgcc

SEQ ID NO: 6872167 - DNA, 99 bp, Homo sapiens
ggcagaggtgtctgagaagaggcgaggccacacctgcttctgggcacctcctgccctggtataggggtggcttgctgcttttcgaggctgacttctgct

SEQ ID NO: 6872168 - DNA, 61 bp, Homo sapiens
tggtttttagcttttgtgtcagataagaatggtgttgttcccatctgaatgagttaaacca

SEQ ID NO: 6872169 - DNA, 71 bp, Homo sapiens
gtatttcatccattctgatgtattttgttttgtacctgataaaatgaagataaaatgggatggagagagac

SEQ ID NO: 6872170 - DNA, 130 bp, Homo sapiens
aggagctaatatttagagctttgcaaattcgtcactgttaaacacctatgtttaaaaatacatgaagccctaaatgttttgacagtgctgctaaaatgcaaagtaaaattccatgtctcatattgtttct

SEQ ID NO: 6872171 - DNA, 55 bp, Homo sapiens
tgtgaggcaaagacaaagcagcatctagaaggggcagcttgttcctttgcttcca

SEQ ID NO: 6872172 - DNA, 77 bp, Homo sapiens
acctgatgtgggccagcttttctcctgggtgtgtgactgaatccttcttcccagagcatgtgctgcctttgttaggt

SEQ ID NO: 6872173 - DNA, 108 bp, Homo sapiens
ttgtcttcctgtggtaactctgggtagaactcatgagtatgaagcaacttgtatctgtgcttccatggtttattagagcttattttatgaaaaggatgggaagggcaa

SEQ ID NO: 6872174 - DNA, 74 bp, Homo sapiens
caaaagtatattcccatgaagaggtagagagttcttttctagaggtctctgggaaatggagaattttatttctg

SEQ ID NO: 6872175 - DNA, 72 bp, Homo sapiens
caagtggcagtcggaagtcaggagaatcgggtggtaattctggctctcttaccacctggctgtctttacttg

SEQ ID NO: 6872176 - DNA, 112 bp, Homo sapiens
gggcctggagaggttttgtgttcatagctggaagtgcagggcattccgaagccacggaaaggattgaaaccctggattgtcctagtatcatagtctcactccacaggagccc

SEQ ID NO: 6872177 - DNA, 68 bp, Homo sapiens
gttccttagagttgatatggtaacttttaatgagaattggattcttttaccatatagactgaaggaat

SEQ ID NO: 6872178 - DNA, 94 bp, Homo sapiens
gctgccccctgtgtgtagtcagttcatggctctgtcctcattctaagcaggaaccagagagtcagagctgaaggcaaacgctggcatgtgcagc

SEQ ID NO: 6872179 - DNA, 118 bp, Homo sapiens
ttaaaactgtagatctggccatgagagatggtatgggacagctgttttgcagtggggtaaacatgtaaggttttagggcttcattttatcttatcatgcagttttacagtcccattaa

SEQ ID NO: 6872180 - DNA, 59 bp, Homo sapiens
tgctcaggacagtggaacctaattcccagaacctctggttgtggaggctgacctgggca

SEQ ID NO: 6872181 - DNA, 64 bp, Homo sapiens
agaggtaagaatagaggattggggatgggttgtctggctttcaatttcctcagttcttactcct

SEQ ID NO: 6872182 - DNA, 63 bp, Homo sapiens
gttctttcttcttggagtggtcacatccatccctggcacatgtgggccttcaggagaaagagc

SEQ ID NO: 6872183 - DNA, 57 bp, Homo sapiens
aatcaaccaggaaactattttgcttgaagagagagtatgttggcttcttggtaggtt

SEQ ID NO: 6872184 - DNA, 93 bp, Homo sapiens
actcccctgtgacccgtttctggctagcacctcagctcagaaggctcttatttcttggtttgcctggcaagagatgggttcaccatctggagt

SEQ ID NO: 6872185 - DNA, 56 bp, Homo sapiens
gagtccagcagaatgagccaagcagtgtgaaatgtgtggaaacatgttgttggctc

SEQ ID NO: 6872186 - DNA, 88 bp, Homo sapiens
gcaactagaaaatatttgttgaggtaatgcctatcaaagaactgatagctatattgtttttatctaatagcagttatgatttatttgc

SEQ ID NO: 6872187 - DNA, 83 bp, Homo sapiens
caggcccccatatagccagtgagtgggaagctacaattcctgctctgtcctcttaccactacatttgctaatggcaaggtctg

SEQ ID NO: 6872188 - DNA, 81 bp, Homo sapiens
ctgcctcaacaatcagcactgagtttatctttatgcttggcaccaagtaggtgctcagtaattgattgttaactgatgtag

SEQ ID NO: 6872189 - DNA, 78 bp, Homo sapiens
tttcccagtctccagatcaattggcagaagcctctggttatttccttctggatgcttctattatttggagctgagaag

SEQ ID NO: 6872190 - DNA, 103 bp, Homo sapiens
ttgagacagggtcttgcactgtcacccaggctagagtgcagtggcgtgatctcggctcactgcaacctccgcctcccaggttcaagcgattctcctgcctcag

SEQ ID NO: 6872191 - DNA, 70 bp, Homo sapiens
ggagggggtggtgccacgtgtggctctgtggacggctccgacgaccctgacagtgtgcttctctccctcc

SEQ ID NO: 6872192 - DNA, 87 bp, Homo sapiens
ttgaaaaacttctggcactaatagacagctttttaaaaaccaatttaaaagctcttctgttgagttaaaaagcaagaaggctttcaa

SEQ ID NO: 6872193 - DNA, 58 bp, Homo sapiens
cctactgtgggtgagggcaaatcaacagctgctgtagaatttccagcacctacagagg

SEQ ID NO: 6872194 - DNA, 82 bp, Homo sapiens
agatgttgcttctggattatataggacttgcccttccagtcacaggcatgtctgggagttcattgtgtaaaaagcaacatct

SEQ ID NO: 6872195 - DNA, 65 bp, Homo sapiens
tctgtaaattaggacattaaaaatcatgtcaggagaattgacagaaatagttcttaatttatgga

SEQ ID NO: 6872196 - DNA, 81 bp, Homo sapiens
tacgttaagaaaaatatcttcttttgtgacccagtagacaagcacatgtgtttatggctgggacaaaagcttcttaaagta

SEQ ID NO: 6872197 - DNA, 94 bp, Homo sapiens
catgcctggtttagaagattttggggacttgccctcagctttattgctcttggggctcctgtagatctctaaagcacctcaagcccaggctatg

SEQ ID NO: 6872198 - DNA, 74 bp, Homo sapiens
attcacacctccacaggagctgcagtgctcaataaatgtttgatgaatcagtgaatgagctcctcgtggtgaat

SEQ ID NO: 6872199 - DNA, 72 bp, Homo sapiens
tctacttcctgcagaactagctctccagcacagcagcaggtctctgtgccatttctattctgcagcaggaga

SEQ ID NO: 6872200 - DNA, 96 bp, Homo sapiens
ggagcagtaactgccgtgaatcgggtggtttaatgttgttgtgttcagaaacccaggcccaacaacatgaaactacctaattcactcagcagttcc

SEQ ID NO: 6872201 - DNA, 67 bp, Homo sapiens
gtcactacctaagtgttgttgggagtgttagaagagttactacatataaagggcttggaatggtgac

SEQ ID NO: 6872202 - DNA, 129 bp, Homo sapiens
aagacactggcagaagaagagttgggagagagagacagcagccagctcaggaaggattttgtgtgctgtgcaaagccttctccatggtggtgactgcctcctttctcattagccgcttcctcaggaact

SEQ ID NO: 6872203 - DNA, 79 bp, Homo sapiens
tgacttagtttcctgtggtgtgaagttatatgaattaaatcatatagtctatgaaaaacacctaggataacttttgtta

SEQ ID NO: 6872204 - DNA, 70 bp, Homo sapiens
gacatcgtgtctaggtgtgcagcagcagggctaacatgcccttcccatgtcttcacatcagatatttttc

SEQ ID NO: 6872205 - DNA, 128 bp, Homo sapiens
agaaaaagaagcacccagatgggtgatggtgatagggcttgtggtggacacagggttgtggtaagattcctcagtgcttcggcgagcacctaagactattaccctggaactgactgctttctagagct

SEQ ID NO: 6872206 - DNA, 74 bp, Homo sapiens
aagcctgcattcttacaactttcaatggttttcaatccctttccatattaaggtctgtaaggggtcatgggctt

SEQ ID NO: 6872207 - DNA, 64 bp, Homo sapiens
gagacaagagaccaagggaatagtctcatttcctgatggttttctatttcctggtttccatctc

SEQ ID NO: 6872208 - DNA, 61 bp, Homo sapiens
gtagtgggtggattccagcaacgctgcctaatatcctacagtgctccaaacacacccacac

SEQ ID NO: 6872209 - DNA, 56 bp, Homo sapiens
ttgggagtgaagaattaggctatttggggagccaaatgatatgcttgtatttccaa

SEQ ID NO: 6872210 - DNA, 76 bp, Homo sapiens
ggtgatagtgttagagccagtatgttcctaagagatacagtgtcatcagaacaaactggcactgaaacatttctcc

SEQ ID NO: 6872211 - DNA, 79 bp, Homo sapiens
agttgggtacctcaagggtaattagggctcattattgcttagaatacagtgctaaacacttcttgaaattattcaaact

SEQ ID NO: 6872212 - DNA, 70 bp, Homo sapiens
tctgtaggtgcctgggagctccctgaggatgaagtcatctgcctagggcctaaccagagcctgccacaga

SEQ ID NO: 6872213 - DNA, 61 bp, Homo sapiens
ctttcctgtttttatttagtaaatcaggaggctatttcttgagtctcgaaatgcaggaaag

SEQ ID NO: 6872214 - DNA, 76 bp, Homo sapiens
gtaagattatgggtattttttgcctcgatgttacatttttatgaactttcaggcaatgaatatttgttacttttat

SEQ ID NO: 6872215 - DNA, 129 bp, Homo sapiens
ggctcctcggtagctgcctgaaagtctggactctgggggctgggctgggctgggtggggagattgctgttggtcccactgtgcctgttgtaatccccaggttcatgaaagaggtgcctgccttagagcc

SEQ ID NO: 6872216 - DNA, 61 bp, Homo sapiens
attgccaagggtatgggcaagatagcttgagtccagctactttgcattacaacctggtgat

SEQ ID NO: 6872217 - DNA, 69 bp, Homo sapiens
gttgttcagcctagagtgcagtggcatgatcatagctcactgcagccttgaactctgggctgaagctac

SEQ ID NO: 6872218 - DNA, 77 bp, Homo sapiens
atcagaaattctggggacatgaccgtcatctgttttagcaagtatacccagtgattctcatgttcctgaagtttgat

SEQ ID NO: 6872219 - DNA, 94 bp, Homo sapiens
ccgcagtggtgggccacagggagggccctgggtgcagctctggtgggacccatagcctccatgggagccagtgccctctggtggacaccagcgg

SEQ ID NO: 6872220 - DNA, 55 bp, Homo sapiens
aggaccagcctccaggtctcttttccccagagaataaagactgcaggtttgtcct

SEQ ID NO: 6872221 - DNA, 65 bp, Homo sapiens
ccagccccctccatgacgtcttcagccgcgcgcccgacgtcggctgagacggccatagacactgg

SEQ ID NO: 6872222 - DNA, 82 bp, Homo sapiens
tagtttagagtagtgagtctaggacaagttcaggagctagaaagcctgggttttgaatactggattcactacttactagcta

SEQ ID NO: 6872223 - DNA, 55 bp, Homo sapiens
agcagagacatgaaatatgcttgtgtagttgagcttggtctcttgtgtctctgct

SEQ ID NO: 6872224 - DNA, 87 bp, Homo sapiens
acagcatctcctggggctgggccctgctctgggagcagccttccccttcttctctctcaggggcctggagtcctgggatggtgctgt

SEQ ID NO: 6872225 - DNA, 101 bp, Homo sapiens
gtaaaaaaaaaagtggaaccaagtaggatacaaggagaaaataatgttattctttttattactgttccttaaatcctctcatgggctagttcttttcctgc

SEQ ID NO: 6872226 - DNA, 55 bp, Homo sapiens
gatcaaggcagtagggccagctgtggactggcagtgaccttggtgcctttgactc

SEQ ID NO: 6872227 - DNA, 75 bp, Homo sapiens
caacgctacaggcagagccaatcgtggggtaagaagtgtcaaatctaccacccccggccttctgtctgatgcttg

SEQ ID NO: 6872228 - DNA, 75 bp, Homo sapiens
cgccagccctgggtcccggcttctatccaccgggtgtgacccggctgggcggcctgcttgggacccagggcggtg

SEQ ID NO: 6872229 - DNA, 65 bp, Homo sapiens
tgcgcccgcggctcccctccctggggctgcgctgcgaccccagaggaaggggcgccgggcgtgca

SEQ ID NO: 6872230 - DNA, 71 bp, Homo sapiens
agactaagtgatgtagctcatttgtgcaataggtcagggactgggttgcaggaagcacacacatgtagtct

SEQ ID NO: 6872231 - DNA, 66 bp, Homo sapiens
gaagtcccaatccctggcctgctgcagttatatccttcagagacagcaaccattctgggaagcttc

SEQ ID NO: 6872232 - DNA, 77 bp, Homo sapiens
tcccagtcagaaaaatctattatttttattcgagggaaatcatattttccatgcttaacagtgacagatatgtggga

SEQ ID NO: 6872233 - DNA, 85 bp, Homo sapiens
attgtgcatcagaaattgctaccagtggagaattaaattaattagaatcctattaaataactggttgcagttaagctggtacggt

SEQ ID NO: 6872234 - DNA, 57 bp, Homo sapiens
ctgttctgcagacttggaaggtggtctggtgactcctgtcctattctgcagtaacag

SEQ ID NO: 6872235 - DNA, 67 bp, Homo sapiens
gggactggtgagagagggaagaggaagagaggagggagaggattcttggtcttctactcatcagcct

SEQ ID NO: 6872236 - DNA, 64 bp, Homo sapiens
tgcccacccactaccctacccagagtccactgtggatggaccggcagtggctatacagtgggca

SEQ ID NO: 6872237 - DNA, 65 bp, Homo sapiens
gttcggcaccgcacgtctcagcctgtatcactctagaaagcagggcctgagaccgtggcttgaat

SEQ ID NO: 6872238 - DNA, 55 bp, Homo sapiens
tcaaatgcaggtctggtcttggtagaggtgtccctcctcccctacctccgtttga

SEQ ID NO: 6872239 - DNA, 85 bp, Homo sapiens
gaaatcttagcatgctcttcaaatgatttccttaggacacatttcctaaaagtgggattcattggacagattgtatgcgtatttc

SEQ ID NO: 6872240 - DNA, 57 bp, Homo sapiens
aagggccagggctctagagataagcagcccttgtttcgaatcccagctctggccctt

SEQ ID NO: 6872241 - DNA, 58 bp, Homo sapiens
ctcccaccttggcttcagtagctcacccagctcacaggggagctgccctgggctggag

SEQ ID NO: 6872242 - DNA, 93 bp, Homo sapiens
ctgtatatgattcccttgccaaattaaagagctttgattcaatgtagaaacatgaaatgcaaagctctttaatccttgacaaggattgtgcag

SEQ ID NO: 6872243 - DNA, 77 bp, Homo sapiens
ttggtttggagaagctgtaggtggactcattagacatggaacattttatgtgagtgcttaaggatttctctagctga

SEQ ID NO: 6872244 - DNA, 83 bp, Homo sapiens
gctcagccattagctaaacttagtctcagtatagatacagtagtgaatctgtactaattaattaatgtagatatagtgggggc

SEQ ID NO: 6872245 - DNA, 101 bp, Homo sapiens
ctaagcaggaggatcccttgagcccagagtttgaagatacagtgagctatgatcacgtcactgtactccaacctgggcaacagagtgagtccctgtcttag

SEQ ID NO: 6872246 - DNA, 106 bp, Homo sapiens
tccatgctttattcctttggggctcagcaggctgttttcatcttgcctggtgaaacaaatgtgtggcagtgtgggagagctcataaggaacagtctgaaatgtgga

SEQ ID NO: 6872247 - DNA, 129 bp, Homo sapiens
aggctagattccagtttcccatttgcttgggggtcggtgggatgggagatcttgaggcttattttttataggaaataagttccattttggtctctggctccttgcatttggggagtggacttagggtct

SEQ ID NO: 6872248 - DNA, 96 bp, Homo sapiens
taagcctggagctgaggggcctctggggagcagccctggtgagttgggtcacctcatttcatgagggccagccctcggggaggctccacaggctta

SEQ ID NO: 6872249 - DNA, 95 bp, Homo sapiens
ttatgaagtccctagcccatatggctggtagtgaattaatctgtgtctgagcagcaggtagcacgagccagtctgtctgttggggctgttagtaa

SEQ ID NO: 6872250 - DNA, 59 bp, Homo sapiens
aggaaactgtcccctcatcctaggagttggaaactgtgatgatgaggaacagtcatcct

SEQ ID NO: 6872251 - DNA, 121 bp, Homo sapiens
gttaatacaaacagaaaagcatacagcagcccttgctttgcacacttctgatacaaatgagtttcagttaacacagcactgtgcaaagcaaaggctgcctgtattcaattctcaaaggagc

SEQ ID NO: 6872252 - DNA, 66 bp, Homo sapiens
gcagaaatttcatgtgaacacacagtactttgtccagtacgtgcactcatacctgaaatgttttgt

SEQ ID NO: 6872253 - DNA, 77 bp, Homo sapiens
actcatctcatagtgcagtgctgtaatctactgacattaccaagtttcttgactacagtttttcactgaagatgtgt

SEQ ID NO: 6872254 - DNA, 71 bp, Homo sapiens
gcctttcaaatgtcttcaaatattgaaatcctgggtatacactctaggattcgtttagttaaggataaggc

SEQ ID NO: 6872255 - DNA, 91 bp, Homo sapiens
tgaagcttagagccacagagaatactgctcttgctagaagctaggaccctaattgacctagggcaaagcggccctgtggccagaagcatca

SEQ ID NO: 6872256 - DNA, 62 bp, Homo sapiens
gggggcgatgacggtgatgatgagaatcccaggttcaaaataataacgtctgtcttgtctct

SEQ ID NO: 6872257 - DNA, 79 bp, Homo sapiens
gcctcaggtccagggaatggcatgacttgcccaaggccacctggcagggtaagagcagggccaggtgtccggcctgggt

SEQ ID NO: 6872258 - DNA, 83 bp, Homo sapiens
ttcagctgtttatggtgatgctacattttggtttataaatatgtttgtggtataaaaaaatgagtataaccataggttttgaa

SEQ ID NO: 6872259 - DNA, 84 bp, Homo sapiens
tagctatgcagctatgtttgacagaaagtgacaatgagagcatttcttgaaatcatttttctcttacacgtagatatatatctg

SEQ ID NO: 6872260 - DNA, 60 bp, Homo sapiens
gaacgtaaatgttcatgtttgagagggaacaatggcactgggaatgtgaatatttacttc

SEQ ID NO: 6872261 - DNA, 89 bp, Homo sapiens
aagccattttttctgacctatctacatttagaaaaacacacatttggggaaagaataaatcagtagatatggtataggagcagtggctt

SEQ ID NO: 6872262 - DNA, 81 bp, Homo sapiens
tagcctgtcaggttctagtgagactctccctgctgtcttctgtaaagacccaggcaatgaacttacttagcctatctgcta

SEQ ID NO: 6872263 - DNA, 89 bp, Homo sapiens
ggggtgggggagagtgatggctagttttaatgttaaaatttttctttagtctgttattgtggcagtaaaattgggcaacaaaccacccc

SEQ ID NO: 6872264 - DNA, 55 bp, Homo sapiens
gacctcagtgaatggtcatgtaaatggacaatttgcagaaattccagctggggtt

SEQ ID NO: 6872265 - DNA, 66 bp, Homo sapiens
ccagctgcagggatcctagctgaagaggcctgtgtggctcacctctctcaagttccctgcatctgg

SEQ ID NO: 6872266 - DNA, 57 bp, Homo sapiens
ctctcatgtagtatctgtatggcctcccagtgcagtcagtgttgactacatgcagag

SEQ ID NO: 6872267 - DNA, 83 bp, Homo sapiens
tctgaggcaggcactttgctgggggcgcacacaggattccaaaacccactgtgaaaatgcacaccccagggagtgcattcaga

SEQ ID NO: 6872268 - DNA, 73 bp, Homo sapiens
gataatttggggcaaggaaaccagcagggatatcacccagatgagcaagctggtgaccttgccccaggtcatc

SEQ ID NO: 6872269 - DNA, 81 bp, Homo sapiens
ttggctcatgatacccaagtacctagaaatatttttgaagctatgtgtctgtatgtgtgtctgggtatgtgttagggttaa

SEQ ID NO: 6872270 - DNA, 63 bp, Homo sapiens
cagctctgcaacttctagcagtgtcatcaaggaaaagagactctcattagagttgcagagctg

SEQ ID NO: 6872271 - DNA, 70 bp, Homo sapiens
attttgtcatggtttcctcagttgttcttcagcagtgaacatgaaggtatttaaggtttaccagcaaaat

SEQ ID NO: 6872272 - DNA, 69 bp, Homo sapiens
gccctcaggtcctcgggggaggccggctgcaccgagccgggtgtcggccttgtccctgtcctgagaggt

SEQ ID NO: 6872273 - DNA, 66 bp, Homo sapiens
tattgctttccacaagtgatatctagctggtttaacaaaccagtccctgttgtttgggagacaata

SEQ ID NO: 6872274 - DNA, 66 bp, Homo sapiens
aggtttgtttgtttaggtctctttttatttgttttcagatgactcagatatgaatactgcaggcct

SEQ ID NO: 6872275 - DNA, 57 bp, Homo sapiens
ctatttctaatacatgttaggattctacccactgattcgggcatgtataagaagtag

SEQ ID NO: 6872276 - DNA, 56 bp, Homo sapiens
tgttgttatcaggactggaaacaacataaagttttcatatgttgctgaaaacagca

SEQ ID NO: 6872277 - DNA, 56 bp, Homo sapiens
tccagatgcattcccttttgccctggagaaggccctgcacctgaatgcatcttgga

SEQ ID NO: 6872278 - DNA, 67 bp, Homo sapiens
ccttttatactcagtgatatcacggcttctccgtagctgttttattcacgtctgggagataaagtgg

SEQ ID NO: 6872279 - DNA, 75 bp, Homo sapiens
caactatgtcttatcttttcaaagctctgctgcttgtgtttccaacaaaatcagtgctcatttgaaaggaagttg

SEQ ID NO: 6872280 - DNA, 68 bp, Homo sapiens
ctacagtggccagccagggtgctgatgtgaggggccctttgtaaagcagtgtggttgtgtccctgtag

SEQ ID NO: 6872281 - DNA, 80 bp, Homo sapiens
agagggaagcgtccttctgctggtcatcccagtggtcacagagtacaccatgctccagcaggacacacctcacgccctct

SEQ ID NO: 6872282 - DNA, 97 bp, Homo sapiens
ggctcttgagactatggaggctgagaagtctcatgatctacaatctaccttcggcaagttggagactcatgagaaccagcagtatagttcagaggcc

SEQ ID NO: 6872283 - DNA, 64 bp, Homo sapiens
gattgatactaaatgcctgatagattagggagaacttaatgaaactcagttttagtcatcagtt

SEQ ID NO: 6872284 - DNA, 61 bp, Homo sapiens
caacctggcttttgtggcatcttgcttaccctattttgcagaacacagataccaaaggttg

SEQ ID NO: 6872285 - DNA, 56 bp, Homo sapiens
gtctgtccttttcatctcccaatcaccgacatggtgggagatgttgagggcagtgc

SEQ ID NO: 6872286 - DNA, 80 bp, Homo sapiens
ctgaagggagaggggtcttgagtcaagtaactaagactttatgtcctgctaagtcactcaagacctctccactccctcag

SEQ ID NO: 6872287 - DNA, 71 bp, Homo sapiens
ttgtctttccgcaaattgtttattgattgcaaaggaacaagtagtaaatacacagtggaaaaaataggcag

SEQ ID NO: 6872288 - DNA, 59 bp, Homo sapiens
atgtatgctcctattggaatgatagtatgttactattgctgttaggaaggagtacatat

SEQ ID NO: 6872289 - DNA, 72 bp, Homo sapiens
ccattggggttcacaacacccggctgtccccagacttgtgtccagggaagatagtgttgagggccctcaagg

SEQ ID NO: 6872290 - DNA, 64 bp, Homo sapiens
tcttcagtgtcatatttatgttcagtaccctggctggccacaaactagcagtgtgacctgaaga

SEQ ID NO: 6872291 - DNA, 55 bp, Homo sapiens
agttggggtgagatcaaggaagccctccctgaggaggtggcatctcattccacct

SEQ ID NO: 6872292 - DNA, 74 bp, Homo sapiens
ggtttatagaggtctttatgctgcaagaataggctaacaacctgtttaagctgatgaggtatcgctacaaaact

SEQ ID NO: 6872293 - DNA, 57 bp, Homo sapiens
agaagaggcctgggagagctcacagtgggcagggctgggggctccttgggcctctct

SEQ ID NO: 6872294 - DNA, 70 bp, Homo sapiens
agagtgaatgtaagtgatttgctaagtcatgtaactagtgagtgattgttctggatatttacattgctct

SEQ ID NO: 6872295 - DNA, 78 bp, Homo sapiens
tttggaaggacgaaggggtcaatatttgctaatcacacaaccaaaaatatcaacgatagcctctgtccagcatccaga

SEQ ID NO: 6872296 - DNA, 61 bp, Homo sapiens
tctagcaagcctaccacgaaactgggaatacagttaccttgtcgtggcttgctcttaaaga

SEQ ID NO: 6872297 - DNA, 75 bp, Homo sapiens
tctttagtttcttgattagccactttggcctgtgatgtttggaaataggaaaacagtggcattaagacacaaagg

SEQ ID NO: 6872298 - DNA, 112 bp, Homo sapiens
cacctgaggatgtgttaggaatgcagtttcctgggccccaacccagacctactgaatcaggaactctgggaatgaggcccagcgattttcattttagcaaaacttgcaggtg

SEQ ID NO: 6872299 - DNA, 83 bp, Homo sapiens
ttattttgtccagtgttccatggagtgattacccacattatgctaattgatataattgctccaaggagaactaatcgaagtag

SEQ ID NO: 6872300 - DNA, 86 bp, Homo sapiens
catgtgtacaagggataggggaccagttaatccaggagttagatggtgactgagactccaggaatttcccctttcctgtaaacatg

SEQ ID NO: 6872301 - DNA, 74 bp, Homo sapiens
ttaaatcagtaggctactccttaaaatgacttcctaaaatatctttgtcaaacatttggaagcctttggtttaa

SEQ ID NO: 6872302 - DNA, 86 bp, Homo sapiens
gtttgggaccagtaagtaggaattatgatgctatcaaggttctcgtccatggcaatgacatcatttctagttgtatgatcacagac

SEQ ID NO: 6872303 - DNA, 59 bp, Homo sapiens
cggagtctggcgtaagtgttcctcctctgcacgcctctgaggacatttgcaaaggtctg

SEQ ID NO: 6872304 - DNA, 89 bp, Homo sapiens
ccgcctccgaattcgtttcctcatctgtaaaacggggctatgaagtctttcttgcaaggatgcaggaaattggagtatgcgagaggtgg

SEQ ID NO: 6872305 - DNA, 64 bp, Homo sapiens
accaagtttacagtctgtctagcaatgtgtttagggaaaatatccatattgacagctatttggt

SEQ ID NO: 6872306 - DNA, 57 bp, Homo sapiens
aatattctcttgtcaccctcaacctgcttttccccagggaggtcagcaagaagtatt

SEQ ID NO: 6872307 - DNA, 67 bp, Homo sapiens
acaatgggtgttggagggaagacaaaattcttaatctcatctttcctgcagacatttacacctttgt

SEQ ID NO: 6872308 - DNA, 61 bp, Homo sapiens
accctcaatgtaatttaatgttggaaatcagtactgtatgtcctggattgaattgagaggt

SEQ ID NO: 6872309 - DNA, 83 bp, Homo sapiens
tgaatgaatttgccaggcttgtttctaggctttgaagatataactgctgacagtttagacaaagtcttgcattttctagttca

SEQ ID NO: 6872310 - DNA, 64 bp, Homo sapiens
tttggaccctgttgatttagctggaatgccatacacattgcagccaatctatgctgggttcaaa

SEQ ID NO: 6872311 - DNA, 68 bp, Homo sapiens
atgtgcttaaagacacacagccagcaagtgatggaaccatgaaaccatttctaggtgtgtttggccat

SEQ ID NO: 6872312 - DNA, 63 bp, Homo sapiens
cagtggctgcctctgccatccaggagcactcagaggggtgagtggagaacagaggctctcctg

SEQ ID NO: 6872313 - DNA, 63 bp, Homo sapiens
ctgccttcctggtcactgctgttccctgagtcctcagcagtagcctgaccgtggaactggtag

SEQ ID NO: 6872314 - DNA, 96 bp, Homo sapiens
tgactaacagccacccctggtgtggatgtgattggcagttccgagagaaatatggggacgtcttcacggtacacctgggaccgaggcccgtggtca

SEQ ID NO: 6872315 - DNA, 74 bp, Homo sapiens
gggacggcagggggcaagggtggtggcagagcactccactgtcgctgctctgcagactcccggattgccttccc

SEQ ID NO: 6872316 - DNA, 55 bp, Homo sapiens
gcatgactcttcactcctcttgagtcctcattaagatgaagcagaagagttatgc

SEQ ID NO: 6872317 - DNA, 82 bp, Homo sapiens
ggggtcaggctgggccagagcagcagcactctccagcagttataatgctagccctgggctctggcccccgccctctgatcct

SEQ ID NO: 6872318 - DNA, 64 bp, Homo sapiens
cttaccatgggaaaaaggaagaagagggaacttaccttcttttctcttacattccactggtgag

SEQ ID NO: 6872319 - DNA, 70 bp, Homo sapiens
gattgtgaactttcttgagaccagaggctgtatcttatttatctttggatcttcagaaactagcacagtc

SEQ ID NO: 6872320 - DNA, 68 bp, Homo sapiens
ggctggtttagaccaatcataatttatccctggccctgggatgaatcacgattggtttaaacccatcc

SEQ ID NO: 6872321 - DNA, 63 bp, Homo sapiens
tggtataaaactttttattgaaactacctgtgtcgtaaaacagggagagaagttttgctaccg

SEQ ID NO: 6872322 - DNA, 80 bp, Homo sapiens
cagtagcactctgtcagtgaagcgagggtattttatgatgtttctgacctcccattctatctgaggatgtgctaactctg

SEQ ID NO: 6872323 - DNA, 61 bp, Homo sapiens
tatactttcctgcaactttgattttgaccttggaatgaatatgggcagcaggactagtgtg

SEQ ID NO: 6872324 - DNA, 113 bp, Homo sapiens
gagatttggtgaaattgaaggagaaaatttaagtgagtctttaaaatatattctgaatgaaaactgtattgaggattcatttttgttccttttttttctttttctcttttctc

SEQ ID NO: 6872325 - DNA, 57 bp, Homo sapiens
agccaggtcaggaaaggtcccagggcgcaggggtggctgcttttcctcatcatggct

SEQ ID NO: 6872326 - DNA, 91 bp, Homo sapiens
tcataattgccactttttcatatatggtgttcagaatcatgataattataaagctgatgatggaggccgtgatggacgtggctgtctgtgg

SEQ ID NO: 6872327 - DNA, 82 bp, Homo sapiens
tttactttggatgtattggaggaaaccaagaagaaaaggcctctttctcttcacatgcttgctccaagactcaaagaataga

SEQ ID NO: 6872328 - DNA, 59 bp, Homo sapiens
gagtggaccttttacagtgatgcccgtgactaaatggcagatgcttagcaggtcctctc

SEQ ID NO: 6872329 - DNA, 59 bp, Homo sapiens
ttttcagtctgatgtggttttcacagttcttatttaccttagatggcttggactgaaaa

SEQ ID NO: 6872330 - DNA, 87 bp, Homo sapiens
ggttaaggagcttaactctgattagctcaagttaagcttgcagtcacatagcaggttgttgagaatctagaggctatactcttaacc

SEQ ID NO: 6872331 - DNA, 84 bp, Homo sapiens
atcctttcaatcagcgtttaaagatagctaataagcaaacaattctgttttctttagttttgcttttaatgaaggacaagggat

SEQ ID NO: 6872332 - DNA, 73 bp, Homo sapiens
ccttttcttgatagttgagtctccagcgaagtaggatactattctatctgcatgctgagagattcagagaagg

SEQ ID NO: 6872333 - DNA, 70 bp, Homo sapiens
gaaatcatctttcagtttataagtctgctatagctaattttatagtattggatttctgaaagatgaggtc

SEQ ID NO: 6872334 - DNA, 128 bp, Homo sapiens
tcaactccattctatggatagaaaagcagtttctgagaggttaagcaatttgaccaaggtcacaaggttagttgctggcagaccctaggagtaggaaagctagagtgttgtgtgtggggaggagtagg

SEQ ID NO: 6872335 - DNA, 62 bp, Homo sapiens
tccatggctttctttcattgtaatgtctttttttgatatcagagaaatgctgagctcatgga

SEQ ID NO: 6872336 - DNA, 65 bp, Homo sapiens
ggtattgccacttttgaacagttggtggctccaatgctttgcaactgtcttgcaagtgtgatacc

SEQ ID NO: 6872337 - DNA, 73 bp, Homo sapiens
ccactgaagcctgtggtcctttctcgccattagcccctcggtgggtcctttacaggagcacagggtttagtgg

SEQ ID NO: 6872338 - DNA, 83 bp, Homo sapiens
agtactctgtgtgcgagttctctgtgtgtgcgagtactgtgtgtgagtgctcagtgtgcacgagtactctgtgtgtgagtact

SEQ ID NO: 6872339 - DNA, 121 bp, Homo sapiens
gtggcattgcctggggtcttccttttttcagatgtgattcttccctcagctattcctggaggggctgctgagagatagaactatataagaggaagagagaaacaccaaaggccatggccgc

SEQ ID NO: 6872340 - DNA, 73 bp, Homo sapiens
tggggcttgtagttgctagaacctgatggctccatcctaaaggtttggaactcaataattcttcttagtccca

SEQ ID NO: 6872341 - DNA, 73 bp, Homo sapiens
gcagcggtgggaggtagggggaggaaccgaggctcggtctgagatgtgctgcctctgccacctcccacgaggc

SEQ ID NO: 6872342 - DNA, 57 bp, Homo sapiens
ctagtccaaaccagggtccctctgaggtccaaagagagtgccctggtgtggggctgg

SEQ ID NO: 6872343 - DNA, 94 bp, Homo sapiens
tccagcaagaccatgatgggaagctcagggcccatggcagattgcttctcccaacaggtgcctttgctatgactcattcattggtgcttctgga

SEQ ID NO: 6872344 - DNA, 61 bp, Homo sapiens
cgggtggccaagagataaaattgtgtgcatgtatccatacactctaattctttggtccttg

SEQ ID NO: 6872345 - DNA, 103 bp, Homo sapiens
gaagaatgtgtagaaactgagagaagggattttaagtcaccctttcataattcacctcagaggatactaaacattcttgtctctcaataagtacatctttttc

SEQ ID NO: 6872346 - DNA, 68 bp, Homo sapiens
tcttggctacatcgaggctccagcagcaaacagtttaaaagctgctcatctgccatgatgagttttga

SEQ ID NO: 6872347 - DNA, 56 bp, Homo sapiens
gtgttcagccagcatcagctaagtgcctagcattgtgccagatgctggcagaagat

SEQ ID NO: 6872348 - DNA, 63 bp, Homo sapiens
ggccccagctccctggtatttgtgctacagaactctggcaggcacccagggacttggctggcc

SEQ ID NO: 6872349 - DNA, 68 bp, Homo sapiens
gcccctgggctgcccattccactggatggtcacattaatttgcaaccacaggaggatggctgctgggc

SEQ ID NO: 6872350 - DNA, 60 bp, Homo sapiens
tgtgtgtgtgtgtgtatgtgtgtgtgtatgtttgtgtgtgtatatgtgtacatacacaca

SEQ ID NO: 6872351 - DNA, 126 bp, Homo sapiens
tgttactcaaaatgtgattgcagatcaatggcatcagcatcatctgggaggttcttagaactacagaaacagacctctccagatctgctgagccaggctctgcattttatcaaaatcatcagagca

SEQ ID NO: 6872352 - DNA, 100 bp, Homo sapiens
tgagatggagtctcgctctgtcactaggctggagtgcagtggcatgatctcggctcactgcaacctccgcctcccgggttcaagcgattctcctgcctca

SEQ ID NO: 6872353 - DNA, 67 bp, Homo sapiens
tcctttctagattgtgttgaccagcaccaaattatctcagtttggtgacacatagtttgataaagga

SEQ ID NO: 6872354 - DNA, 75 bp, Homo sapiens
ggtgatttcaaatatagagtgagatttgataacttgtgatgaaggactttttattgctatgtcttgattgtcacc

SEQ ID NO: 6872355 - DNA, 75 bp, Homo sapiens
ggagggtctggcttttggaaacaggctcaggaccacatgcctgagattcctgtgccccaggtgccaggagcctcc

SEQ ID NO: 6872356 - DNA, 56 bp, Homo sapiens
agcttcttctgctgtctctgtttgcttgaagagtaacctgagattgcaagggagct

SEQ ID NO: 6872357 - DNA, 76 bp, Homo sapiens
agtctgaaccatatgaaattgccaacgtttgaccacatttgtcctaccgagatggcaagttcatatggtttaagct

SEQ ID NO: 6872358 - DNA, 65 bp, Homo sapiens
tcctccctctcagcctgcaggaaacagctctgacttgctgactgtctgccagctgaagaggtgga

SEQ ID NO: 6872359 - DNA, 63 bp, Homo sapiens
ccagatgcagcaaaatgacaggctaaagaacatgtgaaggcatgcctttaatttgctatttgg

SEQ ID NO: 6872360 - DNA, 57 bp, Homo sapiens
ccctgcagcattctctaactgggacttcagaaacccattaggaaaaggagtgcaggg

SEQ ID NO: 6872361 - DNA, 73 bp, Homo sapiens
gtctctggaaggatgtctgattgcttgacttcgcagcagcctggtcagagccgttagcattcagtctgaggac

SEQ ID NO: 6872362 - DNA, 57 bp, Homo sapiens
atggtgcctgtctcactccctgtgcactccaagtatttcttgaggccatggcaccat

SEQ ID NO: 6872363 - DNA, 107 bp, Homo sapiens
tttagagaaagcatgtctgaatctatatatagtgggaattacgatatactggagcaaccatgtaatattatcttactctgttattagtgattcagcatggtcctgaa

SEQ ID NO: 6872364 - DNA, 58 bp, Homo sapiens
acataggcagacagctatttaagtggcttattaccaccatattagctttttcctatgt

SEQ ID NO: 6872365 - DNA, 80 bp, Homo sapiens
ccagagaaggcagagataagtagacaggatgagtcagctgcctttcttacctacaagttattccatttctgccaacttgg

SEQ ID NO: 6872366 - DNA, 73 bp, Homo sapiens
tgaccaaatgtctcacaggaagaggtgtctatctctttccgaaagagaattcctcctctgggacacttggtca

SEQ ID NO: 6872367 - DNA, 69 bp, Homo sapiens
gcagtgagatgatagcaggagacaaatgaacacatcacccaacctctctgggcctgttttctcatctgc

SEQ ID NO: 6872368 - DNA, 87 bp, Homo sapiens
agagaggtaaattatacagatatctaagatgtaaacggttctagaccttttggccatttgttgcatttatttggtgtttatctcttt

SEQ ID NO: 6872369 - DNA, 73 bp, Homo sapiens
cccagggctggactagaagcagggctcatgaaaagcgcatggcctctgaggctctgcttctgtggctcttggg

SEQ ID NO: 6872370 - DNA, 70 bp, Homo sapiens
cacttgcccaagatcctacatcctgaaagtctgaattttggcttgtcagggacagttcttagggtgggtg

SEQ ID NO: 6872371 - DNA, 99 bp, Homo sapiens
agcggagcctaagcttcagctgcgacaggggcctgagcatcacgcgtgaggggcggggcccaggttgcacctcagcgctgaaaggcttaaatttctgct

SEQ ID NO: 6872372 - DNA, 66 bp, Homo sapiens
cattcacatcttgttccatcaccctttccagtcacaggagagcctgggaaagccaatgtgtggatg

SEQ ID NO: 6872373 - DNA, 57 bp, Homo sapiens
gtggagccttatttggatcttctgtggggtcccagacagaagaaagggaggttttgc

SEQ ID NO: 6872374 - DNA, 57 bp, Homo sapiens
tgttcgcatgtctagctctacctttcagggaaagggctcaatggtgggcatgtagca

SEQ ID NO: 6872375 - DNA, 94 bp, Homo sapiens
tccttacaattgagtttctgtttctggaaagtagatgtactaaggattagaacattttttctgtattttctccttttcccaggtactcagagga

SEQ ID NO: 6872376 - DNA, 71 bp, Homo sapiens
gaggctgcccaactggagtggacccagggcctcccagactgccctcccgccactgtgagttggctggcctc

SEQ ID NO: 6872377 - DNA, 76 bp, Homo sapiens
tgatcacattgttcactagcttgcagactcaatgacagtgcaaagcaagttacataatctgtgaattttgttgtca

SEQ ID NO: 6872378 - DNA, 92 bp, Homo sapiens
ggccactaaaatatttgacctgaaactttgcttttctacaaaacttaaaggaaaataagtttagtattagggaaaagttcagggataatgct

SEQ ID NO: 6872379 - DNA, 68 bp, Homo sapiens
cttgtatgctgaatagttcactcttctgccatgaatattgagggcaggggggccattcagtgtgtggg

SEQ ID NO: 6872380 - DNA, 129 bp, Homo sapiens
atgagtgtgctttaaaaccaaaaattgtttttgtcattggtttggtttgtttttaaatcatcggtttggaattacttactcaagccttgtaacatcaagcaggactatcttttttattgtgtatctctt

SEQ ID NO: 6872381 - DNA, 57 bp, Homo sapiens
tcttgtgttctgtatgtgaagtctgatggacaatggagcatgtgcatgagcacagga

SEQ ID NO: 6872382 - DNA, 57 bp, Homo sapiens
gccatcttgagacatgaaaggtgtccaaattgggatgaattcagcactgaagatggt

SEQ ID NO: 6872383 - DNA, 57 bp, Homo sapiens
cctactccctttctagagtatggcagagccaattctcaaccctagtaagggagtagg

SEQ ID NO: 6872384 - DNA, 70 bp, Homo sapiens
ccaacagacactgacagggtccatggaattcttcgggaaatcctccaaggactcttgtcagctgtgttgg

SEQ ID NO: 6872385 - DNA, 55 bp, Homo sapiens
gcagacatcaagcacaggcccagtgtgcatctgctgggcttttggaatggtctgt

SEQ ID NO: 6872386 - DNA, 57 bp, Homo sapiens
gtctggctgtgtgacagtgttttttggtctatttccagtcacactgacatgccacac

SEQ ID NO: 6872387 - DNA, 72 bp, Homo sapiens
ctggcctcagattctctctggatgcacctgcacatgtttttcatggcaccggagagcaatctgaagagccag

SEQ ID NO: 6872388 - DNA, 77 bp, Homo sapiens
gacgtgctttccggaatggcagggtagctcataagcctttgcagggtctggctctgccatccgcagaaggcagagtc

SEQ ID NO: 6872389 - DNA, 65 bp, Homo sapiens
ctgatattccagatacctgtaaacactcatgagttccaatgaggtgaaaggtgctggagcatcag

SEQ ID NO: 6872390 - DNA, 63 bp, Homo sapiens
ggcctgggaaggtaagccttgcctgagaaaaggctgctgggcctgcagggctgcctcccagct

SEQ ID NO: 6872391 - DNA, 69 bp, Homo sapiens
cagagaaggaggcaagaggagggtcctggaaaactgtgacctggggcttctttctgccaccgacctttg

SEQ ID NO: 6872392 - DNA, 74 bp, Homo sapiens
aaaagatcatgctacgaatggtgatggagtccagtcacacccgtctctctccagagtcatcgagcattcctttt

SEQ ID NO: 6872393 - DNA, 105 bp, Homo sapiens
ttggtggcaggacctggagtctctctctctcaggccaggcgctatccatggtttctggataaagcatcctttgtgtctgggggagtgacatcctctgctcagcga

SEQ ID NO: 6872394 - DNA, 84 bp, Homo sapiens
gatatgaaagggaattgagaagaagcgggaaaaggagcatgagaaatattccctgggtttatgaattgcattccctttattgtt

SEQ ID NO: 6872395 - DNA, 87 bp, Homo sapiens
gataattaattgcttgtgcaagaaacctggaatggtaaattcttactattaccaaatcattcatgctaacaagctgcttggattatc

SEQ ID NO: 6872396 - DNA, 88 bp, Homo sapiens
ggcttttgaaggaaaacttacaaaggaaacttcttttccctcaaaggaaattgggggaattgatgtctcatttgtctccatcaaaacc

SEQ ID NO: 6872397 - DNA, 61 bp, Homo sapiens
ttgaactctggctgggaagtataagggcagagtctttctactttctcaaatcagactttaa

SEQ ID NO: 6872398 - DNA, 91 bp, Homo sapiens
cccagttactgcatatgatttctcttatttgaacattattttttgctatattaatgttgcacacataggagtgatccaagcaagactaggg

SEQ ID NO: 6872399 - DNA, 69 bp, Homo sapiens
gtgccagagatgacaggcctgcctgctacccactcacaccctaccagtgaggtttgtcacctcttccac

SEQ ID NO: 6872400 - DNA, 66 bp, Homo sapiens
ggcaatgcatttaagggtacagcctctacactcagcacctgggatttttaaatgtattaagcagcc

SEQ ID NO: 6872401 - DNA, 65 bp, Homo sapiens
gactgttgaatctcaggggagttactggagtgtcctaacttccagttcttctgagaatcattatc

SEQ ID NO: 6872402 - DNA, 74 bp, Homo sapiens
cacacaccagaaagcctgggacaaagcctgggctagagccctcaggattcattctcaggcttcctggtgctgtg

SEQ ID NO: 6872403 - DNA, 90 bp, Homo sapiens
tgctatgaaacagcatcaagtgctacagagaaatctttcacgaaagaaagaggcaatcaatgtagcaaacttcattgttgtcttattgta

SEQ ID NO: 6872404 - DNA, 60 bp, Homo sapiens
aagtgagttaatggatgtgaacacgcctagtacagggctggcccactccgtagcccattt

SEQ ID NO: 6872405 - DNA, 110 bp, Homo sapiens
gtacctgtatgtaactaagtctgcagaaataaatgttgaagaataaataaataaccatttctagtgcattaatatctgtcacttataaagcacttacacgatcttggtat

SEQ ID NO: 6872406 - DNA, 61 bp, Homo sapiens
gtatgtgtcttagaacttgggacttagaactctccccttctccctggaatgagatgcatat

SEQ ID NO: 6872407 - DNA, 103 bp, Homo sapiens
ttgagacggagtcttgctctgccacccaggctggattgcagtggcacgatctcggctcactgcaagctccgcctcccgggttcacgccattctcctgactcag

SEQ ID NO: 6872408 - DNA, 80 bp, Homo sapiens
ccaggccagcagctgccccgactgtgagtccagtggccacccacaccggcagccaggaggggtagagcagctgcgtctgg

SEQ ID NO: 6872409 - DNA, 130 bp, Homo sapiens
ggacacagacataaggggcggagtggcaaagggctggtgagcctggcctcctgcctcagcctgcaggggctgcaggcctggccggccacttcctggctgcctcacctcgccagatcctgtgtctcagttc

SEQ ID NO: 6872410 - DNA, 61 bp, Homo sapiens
gagctttgatcgctaagcctcagggtgggtgagcattttttgaggctgccaatccaagctt

SEQ ID NO: 6872411 - DNA, 77 bp, Homo sapiens
gcaggctggtgcacagggcatattttagagggaccataacacacccctatactagaaatgcagtgtactgtgtctcc

SEQ ID NO: 6872412 - DNA, 66 bp, Homo sapiens
agccagtgtttttcaaggtcctgtgaagatccaaaggtagttttaggcatttgatgaagattggct

SEQ ID NO: 6872413 - DNA, 90 bp, Homo sapiens
ctatatcctcatgtttctcttacagcagctctgtgtgggattcagcaaaaacatagctgcaccttataagcaggaaagtgaggaatatag

SEQ ID NO: 6872414 - DNA, 58 bp, Homo sapiens
ctcctgtgttcaagcgattctcctgcttcggtttcctgagtagctgggactacagggg

SEQ ID NO: 6872415 - DNA, 60 bp, Homo sapiens
tgctcttgctctgcagtccagacagtagaatttatggatcaaagattcagagcaattgta

SEQ ID NO: 6872416 - DNA, 80 bp, Homo sapiens
taactgatgcacagtgacccctggtgactcactttgaaaaaaaatcagcatgttagtcatggatcatggtgcacatgtta

SEQ ID NO: 6872417 - DNA, 129 bp, Homo sapiens
catgaatagtgaataggaaaatgatgaaattgttgctgctttttatagaggcttagaatcatggaaatcatttgctttaaggtataaaagggaataatttcattttctactttttactttaaatttctg

SEQ ID NO: 6872418 - DNA, 55 bp, Homo sapiens
gctgtgcattgagcctgagagtggatttttaaaccattcacagctctgtgtcagt

SEQ ID NO: 6872419 - DNA, 66 bp, Homo sapiens
ctgggtctcagtcttcccacagtgagaccggggatgtccctgaagctgtgtgaaaactgggcctgg

SEQ ID NO: 6872420 - DNA, 58 bp, Homo sapiens
tcatgatcaaaatgtctgattaatgtacacagtgcattaagcacacttttgaatgtga

SEQ ID NO: 6872421 - DNA, 55 bp, Homo sapiens
aagacctgcgttatcctgcctggtgtctctctccaaagcagatgtgccaggtttt

SEQ ID NO: 6872422 - DNA, 82 bp, Homo sapiens
tccccacatgggaaaacaatgaaatatttttatggaccacacaatggaattatattatgctcgtttactgattatgtgggga

SEQ ID NO: 6872423 - DNA, 64 bp, Homo sapiens
tttcccaggaagttatttgctatctactgagctaaatggtcagtttaaatgacttccttggagg

SEQ ID NO: 6872424 - DNA, 89 bp, Homo sapiens
gagcggggtggcattaggccaggtgcatagcccagtgctgctctctctggactttctgctctctctggacttgtttgctagctgagctc

SEQ ID NO: 6872425 - DNA, 66 bp, Homo sapiens
gtgtcctgcttactgctttggacgtgtggaatatgttgtaagtgccagggccagtaagattggcat

SEQ ID NO: 6872426 - DNA, 58 bp, Homo sapiens
gggagcactcatgaaggtgagttggctcctgcccattctgccctccatagatgttccc

SEQ ID NO: 6872427 - DNA, 80 bp, Homo sapiens
attgtgtgttgcattattgtctgaaaaggtaaatatttaggttaaattaaatgactttgtaggctggtaaaacatacaat

SEQ ID NO: 6872428 - DNA, 110 bp, Homo sapiens
tgtgctaaggttattctatttcacatgccttttactctgcactctggggctttctcttgctggtgtagagtgtaggcctaaagtgtcaggaattattgactttaggaaca

SEQ ID NO: 6872429 - DNA, 61 bp, Homo sapiens
atggaggtgatgttaatgatgctgtccatctctcaggttccgaagttttcatcacctttat

SEQ ID NO: 6872430 - DNA, 69 bp, Homo sapiens
agcctaggcttgttttcatcagctccaaatttgccttgacacaggaatgttgactctacaacctgggct

SEQ ID NO: 6872431 - DNA, 80 bp, Homo sapiens
aggaccttgctagtgaagaattgggcaggggcaggcaaggctgttgagaagctctgccaccacctacactagtatgtcct

SEQ ID NO: 6872432 - DNA, 78 bp, Homo sapiens
ggggtgaggttggcctcagggaggctctgagccaggatcttcagcagtcctgagacctccatctgtgcctctcattct

SEQ ID NO: 6872433 - DNA, 117 bp, Homo sapiens
agctatgtcgggacttgcagaaaatgcacatttcccagccccaccaggtcgttcaggtccaggctgggctcagggacacatgtgtgtttcttttccactccaggccggcaggtggct

SEQ ID NO: 6872434 - DNA, 120 bp, Homo sapiens
cacagtaatttgatgtagtttgttttggaactcatacatagtctacaaataccaaagagagatacaaagagtttgcagatatatggagtgcattataggtgttttcaaatttctcctgtg

SEQ ID NO: 6872435 - DNA, 58 bp, Homo sapiens
ggaagcaagtggcctgattcagataatcactttctctgggagagtctaacttgtttct

SEQ ID NO: 6872436 - DNA, 57 bp, Homo sapiens
gagcagtggctaagctcgcatgcatgtgtttatgcgtcatggaagtagttactggtc

SEQ ID NO: 6872437 - DNA, 78 bp, Homo sapiens
tgctccttcagagaagcaaaggcagattgtttggatcaagagaattgcccaaggcttcattgactgttcagaggagca

SEQ ID NO: 6872438 - DNA, 80 bp, Homo sapiens
gatgccattacaaatgcctgtggagatatttaaggagccagatgctactgtttcatgtcttccgcagctctgaatgtgtc

SEQ ID NO: 6872439 - DNA, 56 bp, Homo sapiens
gggatggagggtagagcaagtggatgtggctttgtttgctcatttaacttcatctc

SEQ ID NO: 6872440 - DNA, 58 bp, Homo sapiens
tccttagagatactgtcttgaattcagtaccattgctctattacagtttctttcagga

SEQ ID NO: 6872441 - DNA, 84 bp, Homo sapiens
aggagcaggctcccatccagtgggacagagaaaccctggggtgtagctctgtgtcccactgtgtgatgacgtgtgcgtgcttct

SEQ ID NO: 6872442 - DNA, 106 bp, Homo sapiens
tatatgtagatgtacttggttggtacaaaagttattgcggtttttgccatggaatgtaatggcaaaaccacagttacttttgcaccaacctatacatgtagatata

SEQ ID NO: 6872443 - DNA, 81 bp, Homo sapiens
ctcaggtttttcatctctgctttgtaccttgcaggaaacaaggcgaggcacaagtgctggggatgagatttcaagcccgag

SEQ ID NO: 6872444 - DNA, 60 bp, Homo sapiens
gcagccttcctgacttgagctgccattgttccattgtcacgggcagcttgggaaggtagc

SEQ ID NO: 6872445 - DNA, 68 bp, Homo sapiens
tgcttttgctgcattccttggtttaaaacaagtcaggggccattccagattcaaggaatggggaagca

SEQ ID NO: 6872446 - DNA, 88 bp, Homo sapiens
gatacaatcccaaggtagcctcttgaaatgaacatggataattgctccaatgttattatctagaggcaagaaccttgagaaatgtgtc

SEQ ID NO: 6872447 - DNA, 114 bp, Homo sapiens
gagttacggttgcaggagaaaggcacattactcaaacagagggccactgaggctcgggatgatgtaactggagagggagtcctctgcttggtgccagttttctaaattgatttc

SEQ ID NO: 6872448 - DNA, 120 bp, Homo sapiens
agacagttgagttgagccctgtatctgtaaatgcaaatgtagctttttgggaaaaaatataattaactttgaatttgcatttacatagcatagatttcagattaatttaacttaactgct

SEQ ID NO: 6872449 - DNA, 64 bp, Homo sapiens
cagtgcagaggccagggaggattgattttgtggcactgttccatcctggcctggattgcaactg

SEQ ID NO: 6872450 - DNA, 84 bp, Homo sapiens
cattttcacagatgcaaaagcagattggggatttccatggcagtgttataaagatattcaaaatctgcatgtatagttaaaatg

SEQ ID NO: 6872451 - DNA, 59 bp, Homo sapiens
gaactgtgtctcattcatcattgtcaccaaccaggaggacagtagctgacacacagttt

SEQ ID NO: 6872452 - DNA, 76 bp, Homo sapiens
tttggggtacgatcatggggaaagctattctggagttaaacattaaaagaaactgaagtcccatgttgtttttaaa

SEQ ID NO: 6872453 - DNA, 90 bp, Homo sapiens
agttcctcaagatgtgttaattagaaataaaatgcagcatggttatcggctgcagagctttctgaatgaagcagactctgaagagggact

SEQ ID NO: 6872454 - DNA, 71 bp, Homo sapiens
tggcgttgtctatacataaaaggtagtcagaataaaaagaattctagcaacatgtgttagacaatagacca

SEQ ID NO: 6872455 - DNA, 87 bp, Homo sapiens
gaattctaaagatattttgagaaatggcagcattactgggatatgagtcccagttgtgacttcatttcacaaaacacattggatttc

SEQ ID NO: 6872456 - DNA, 73 bp, Homo sapiens
ctcaaccccacaggcagccctctccctggttcccaggacccagggtcagggtttgttttaaaaggaagttgag

SEQ ID NO: 6872457 - DNA, 66 bp, Homo sapiens
gagtcaagagtgccctgctctgagctctgctcccggcagacgcactcactgcagggcatgatggtc

SEQ ID NO: 6872458 - DNA, 55 bp, Homo sapiens
ggctctgcagcttgctaactgtgctcttgcataagttgcaccacttctgcaagcc

SEQ ID NO: 6872459 - DNA, 59 bp, Homo sapiens
ggtcacaagcttatatacctgcaggagaccacacaggtaatgcagatgagtagtgtacc

SEQ ID NO: 6872460 - DNA, 59 bp, Homo sapiens
atctcttctgaaacctgtctttagaataaggaatctagggcaagcaagcagaaagaggt

SEQ ID NO: 6872461 - DNA, 64 bp, Homo sapiens
aacagacagaaaaatgtgatctgcatcctccaaataaaaatgagatctgcatcctctttctgtt

SEQ ID NO: 6872462 - DNA, 76 bp, Homo sapiens
ccaatatcagacagctggttccttcttgaagcaactcttaaagacagatggaccagccatgtcttcaaagtgttgg

SEQ ID NO: 6872463 - DNA, 89 bp, Homo sapiens
cggcggcggtggcggtggtggcagtagcactgggcctgcgggcggtccgggatccaggccggggcggcgccatcttgtgcccggggccg

SEQ ID NO: 6872464 - DNA, 130 bp, Homo sapiens
tcagaagcttcatactcaggctgcttaccaaaccccaccatgtagaaactgagaaagcttactaatttttttaagttgtgtgtgtgtgtgtgtgtgtgtgtgtgtgtgtgtgtgtgtgttattattctga

SEQ ID NO: 6872465 - DNA, 61 bp, Homo sapiens
ggctttgagttcctgctatgtcctcttaaacaaacatcaagagagccaggaacacacagct

SEQ ID NO: 6872466 - DNA, 79 bp, Homo sapiens
gttatgtggcaaggctgtgggggcagagctgctatgaaaacagaagtctctggagttctctctcagcctgctgtgtcac

SEQ ID NO: 6872467 - DNA, 99 bp, Homo sapiens
agataatatggacatttatgaaggagatatgcaagggcacagcaagccatgtgctttcagtatttaagcatcctcctacatgacatgttgaatacttct

SEQ ID NO: 6872468 - DNA, 62 bp, Homo sapiens
ttcccagagacttagtgacacttagaaccaatggtatctgtaaaccaaggaggctttgggaa

SEQ ID NO: 6872469 - DNA, 76 bp, Homo sapiens
gaagttatgttttatatgtctctgctgacatttacaagtccagtgtctgttgaacagtaagacaatgagtaacttc

SEQ ID NO: 6872470 - DNA, 69 bp, Homo sapiens
ggcacttccgtgagattaagcagaattcttcatgtcaccagaaagcagctaagtcttatgatggtgacc

SEQ ID NO: 6872471 - DNA, 108 bp, Homo sapiens
cagcaaaatgaaagagcagagcctacatgggttcctaggacaggacctggcttctgaaccgtgaaggaggcacaggaacttactggccacttgtggcctgcgatgctg

SEQ ID NO: 6872472 - DNA, 62 bp, Homo sapiens
gaccacactttgacaaccttgagtacttgagttttcaagccaccttcaagccagaggtggtc

SEQ ID NO: 6872473 - DNA, 63 bp, Homo sapiens
gagctgaagttctttgcatagatttggcttaagcttgaattagatccctgcaaaggcttgctc

SEQ ID NO: 6872474 - DNA, 64 bp, Homo sapiens
gtgtgcagcagcagacgaaattgcaagcctctctctgaaacttcatcagttgctgttgcagaac

SEQ ID NO: 6872475 - DNA, 57 bp, Homo sapiens
gctgctgatgggcagggagtcggccagtggagtctggatgacctgccggtcaccagc

SEQ ID NO: 6872476 - DNA, 64 bp, Homo sapiens
cttcctggatgagcaggctgataaacatggcattcatgacccgcacgtccgccatacctggaag

SEQ ID NO: 6872477 - DNA, 65 bp, Homo sapiens
gtgagatgcctggcacccagcaaggagttattaaatgttagctgtttgtggttgttagctctggc

SEQ ID NO: 6872478 - DNA, 130 bp, Homo sapiens
tacaggtgagaaaaccaaggtgtagggagttttaacaacttactcaaggttgcatggctagtaactgatagagatggaattaaaagtcaagtaatgtaattctatcaccctggttattaatcaaaatgta

SEQ ID NO: 6872479 - DNA, 61 bp, Homo sapiens
ccgtgtgtgggccttcaaccctgtctgggtgggttctggacagtgggtggggacccggcgg

SEQ ID NO: 6872480 - DNA, 63 bp, Homo sapiens
cctttctctcttccaccaggcttccattgtttgcaacatctttcctggctggtggaggaaagg

SEQ ID NO: 6872481 - DNA, 79 bp, Homo sapiens
ggctagaggggtcctgggaaggaagccagggaaggccacaccatctgcctctttcatcaggaatctaatatcttttccc

SEQ ID NO: 6872482 - DNA, 62 bp, Homo sapiens
catcaggctgggaacacagatcaggatttcaaatgcccccttctctgtggccttccctgatg

SEQ ID NO: 6872483 - DNA, 59 bp, Homo sapiens
gtattttctattcattgtctatggtggtctagctactttagaaaaggaacagaggatat

SEQ ID NO: 6872484 - DNA, 79 bp, Homo sapiens
ctagcgaaatgcttggcacatagtaggtcattaaatatttttctaatgaagaagccaattctgtgtgagtcattgctag

SEQ ID NO: 6872485 - DNA, 82 bp, Homo sapiens
actgataatgtgtgataagttaaattaaaccttgtaaaccgaagtgccatggacaggttcccttaacttgcataactttagt

SEQ ID NO: 6872486 - DNA, 57 bp, Homo sapiens
tctgctgcaaaagggttgactgatgctctacacatcagcatgacagtctgcagcaga

SEQ ID NO: 6872487 - DNA, 56 bp, Homo sapiens
ccctttacctcttcagggttgattcactaataacccagcactataaggggaaaggg

SEQ ID NO: 6872488 - DNA, 81 bp, Homo sapiens
agatcgatcagcaaatagatgggcctccccgtattctgaattacagtgtgtgtttgggcggtttattgacagttgataact

SEQ ID NO: 6872489 - DNA, 61 bp, Homo sapiens
aactgtcagtgtttggctttcatcagactgaacattttggtgtacacttgaactgacggtt

SEQ ID NO: 6872490 - DNA, 79 bp, Homo sapiens
ttaagaatctgctatggtgtttttagaagattaactttaaaatagattcttcattaaaatgcacagtattgatttttaa

SEQ ID NO: 6872491 - DNA, 58 bp, Homo sapiens
cctcctgcagctttcgctccatcagcagcagctggggagggagaggcgcaggtgtagg

SEQ ID NO: 6872492 - DNA, 104 bp, Homo sapiens
ggctttgccattccaaacttctgcagggcagagggaaactcctttgcaggaaaattgccaaacagaaatttcctcatgctcctatggaaggtaatgcagaagcc

SEQ ID NO: 6872493 - DNA, 108 bp, Homo sapiens
gcctccatggcccagcttagctctcaggacagaaggctgccagggtcctctgtgggatgctggctcaacttccttctcctcccctcagctaagctggaccacggatgc

SEQ ID NO: 6872494 - DNA, 73 bp, Homo sapiens
ctgcatgagtgaggtgtctgagtggggacctgtggacagcgtggcttggctcaggccctggctttacatggag

SEQ ID NO: 6872495 - DNA, 61 bp, Homo sapiens
gagggtggcctttagagcccatgaactgtatctttcagcttcctttgttcagaccaccttc

SEQ ID NO: 6872496 - DNA, 62 bp, Homo sapiens
ggctcagcttcctctgaaaaacgaggctggtgtcgcctgccaggcctctcagagggtgtgcc

SEQ ID NO: 6872497 - DNA, 63 bp, Homo sapiens
agtgaagtctgctggagcctctcctagtctcttagcagaggcactgttcttagcgacttttct

SEQ ID NO: 6872498 - DNA, 99 bp, Homo sapiens
ggtcttgcaaataaattcaaattttattctacatgcaatagagatttactggagattgtaagtagaacaacataatctgatttgagtttttgcaaagtc

SEQ ID NO: 6872499 - DNA, 104 bp, Homo sapiens
ggaaaagaggatgtgttgaaagacatggctgcctgtggacactgctgagtaaattttggccagtgtggtgtagtcatgaagctccaaaaacatatattttttcc

SEQ ID NO: 6872500 - DNA, 116 bp, Homo sapiens
gagcgtgctgtggcccttccctgcgctgcctcagggtgcctcccgctcgccgggactgagttccgcgccggcgtggcctgctgggttccaagcgccaggagtcggcgcagccgctc

SEQ ID NO: 6872501 - DNA, 66 bp, Homo sapiens
tagatattggaaattgagtgagaattggccaagaaggaactctatacttaaattccttgatattta

SEQ ID NO: 6872502 - DNA, 81 bp, Homo sapiens
ctgacttcgatgctactgaccttgtgagctggccccatcttctctctgggccactgtttcctgggcagtttgcattctcag

SEQ ID NO: 6872503 - DNA, 127 bp, Homo sapiens
cttccatctttcattatgggcatgcttacctccctgttatctccatgacaagttggttaggccaaggcctggctagcccttgtggggagaggatgagataagcattaaataggagattagattgaag

SEQ ID NO: 6872504 - DNA, 67 bp, Homo sapiens
ttagaaccaaaaagtccagctctaaatatctgactggcttggtcagagctgagctgtgaggttttaa

SEQ ID NO: 6872505 - DNA, 58 bp, Homo sapiens
tccagtgagcactacatgaactaaatttcttgtcttgatgcatgttggtgccactgga

SEQ ID NO: 6872506 - DNA, 106 bp, Homo sapiens
ttgaccaggttaaaagagctgccatgactccaggccaagtggtcatctcaggtgctccttgtgcatatagagttagatggctggagttcctcttagccaggattaa

SEQ ID NO: 6872507 - DNA, 57 bp, Homo sapiens
tggagatgcctggagattagggactgggtcatgtagcatcagataacaggtactcca

SEQ ID NO: 6872508 - DNA, 58 bp, Homo sapiens
tctagagcctgcctaaggggctgggtggatcctgcctttaaagctggcaggctttaga

SEQ ID NO: 6872509 - DNA, 65 bp, Homo sapiens
ggtgtgcctggggcttagctgctctcagggaagctgcccctctgcccagtgcaagtccccacacc

SEQ ID NO: 6872510 - DNA, 79 bp, Homo sapiens
cttaaagggtttggaatttcggtttgcagaatttttctggtccgcagagtctgttgaccaagtcttcttccccttagag

SEQ ID NO: 6872511 - DNA, 73 bp, Homo sapiens
tttcctggggccagcactggtggacttatggtaaatgattgtacttcttaattcaatgctggtcctaaagaga

SEQ ID NO: 6872512 - DNA, 125 bp, Homo sapiens
gagatgaagggaggctgagagccgctgaggccagcctcatcccttgatagttttgcagaagttgagctgtctttggagagggagaggaggactgagagcagcaggctggagtccatcaaaatctt

SEQ ID NO: 6872513 - DNA, 78 bp, Homo sapiens
tggaatattatacagctgtccaaacacattaactgcagcataacttcagtgatgtaggtggattctggcaatatcata

SEQ ID NO: 6872514 - DNA, 56 bp, Homo sapiens
gcttgtaggaggcagtggggagtggctgcccaaacggccccactgtccccacaggc

SEQ ID NO: 6872515 - DNA, 63 bp, Homo sapiens
gctcctgtcttggggcactggctccccccacacccctgccatgctcccaccctagtcaggggc

SEQ ID NO: 6872516 - DNA, 98 bp, Homo sapiens
ccgctcagtagggagcacacggccaaggtacatattttcatcccaccatcctttccagattattttgcacttggctgtgatctctaggcccagagtgg

SEQ ID NO: 6872517 - DNA, 95 bp, Homo sapiens
ttggtttttcagatcaaacatgtagttaatggaaatgatggaaagtacagctgtcttctctgttaggcccttggaaacatgttatccagaactaa

SEQ ID NO: 6872518 - DNA, 93 bp, Homo sapiens
aggagatctcacatcactttagggagctgatttgttttggcatttggttgaagaagaattattccctaatcatttgtcaggtgagatgctttt

SEQ ID NO: 6872519 - DNA, 73 bp, Homo sapiens
gtcacatgtgacagttttgctaaaaggttgagattagtcgtaaagtgtctttatcaagtctgttctttgtgac

SEQ ID NO: 6872520 - DNA, 64 bp, Homo sapiens
ttgagtggtagtttctagaggtgttatttccaatatgttaaagttttagaatactactatttga

SEQ ID NO: 6872521 - DNA, 70 bp, Homo sapiens
tggctgagctggatggatctgaagaactggctcaccaggagaggtcagcttgatccatccaactatgcca

SEQ ID NO: 6872522 - DNA, 63 bp, Homo sapiens
cctgagagggtggatcagcctgattgggaagagcacctaaacaggaaggagcacctgagcagg

SEQ ID NO: 6872523 - DNA, 70 bp, Homo sapiens
gtgggaacaactctgagaaacttgcagttgagggtgtcataagaactccttttaactggtttcttcccat

SEQ ID NO: 6872524 - DNA, 62 bp, Homo sapiens
ggtgtggcctcctgtcccaggctgaggagtctggactctgagctccatgcaggaggctaacc

SEQ ID NO: 6872525 - DNA, 81 bp, Homo sapiens
aggctgaacattcttgaacatctgtccaaaagactctcctccacatgtgtaccaggacacatgttcaagaatgttcagctt

SEQ ID NO: 6872526 - DNA, 58 bp, Homo sapiens
aggcaacatgactcacttgcacaaatctacaagataagtttatttgatttatgtgcct

SEQ ID NO: 6872527 - DNA, 73 bp, Homo sapiens
acaagtgatcttatgaggaagtctgataatggtatatagagttatactcatcataatttttcttgtaacttgt

SEQ ID NO: 6872528 - DNA, 57 bp, Homo sapiens
taaaacttaactatccagattattatttctttggtgtttctggatggctaagattta

SEQ ID NO: 6872529 - DNA, 57 bp, Homo sapiens
aggaagagcttacttgttgttccaaggcctaattggagatctaggttggcatttcct

SEQ ID NO: 6872530 - DNA, 64 bp, Homo sapiens
ttttctgtacaattatttaaatggtgaaaccaatgtttctatcatctagatgatggttagaaaa

SEQ ID NO: 6872531 - DNA, 57 bp, Homo sapiens
cagccccgatgtggcctgcggtgactggttggagggtgtaggaggcatctggggctg

SEQ ID NO: 6872532 - DNA, 63 bp, Homo sapiens
agaggcaagtagtccaaagctggcatgatgaggccacccatcattgttagggactctaactct

SEQ ID NO: 6872533 - DNA, 69 bp, Homo sapiens
gttacagacaggaagttcagaagaaatgagccagtcccttttatttcttcttcctcttttgtctctaac

SEQ ID NO: 6872534 - DNA, 68 bp, Homo sapiens
cctttctacttccagcagcctgcttgctggtaatttcttcagtgcccggacaactggacagagaatgg

SEQ ID NO: 6872535 - DNA, 72 bp, Homo sapiens
tggtgaggaaagtttggaatccaggagagacttggctattggtcttttaagggattgtgattttcacttcca

SEQ ID NO: 6872536 - DNA, 82 bp, Homo sapiens
aggtatctgagtgtctcttgagctcagttctgatgtctctgacatcaagtggttctccaggttgcactcacaactgatgctt

SEQ ID NO: 6872537 - DNA, 100 bp, Homo sapiens
gattaaatacgtggagtaagtctttacagtttctgttgcccaggtaataagcatctgctttaacagtattgaagataaactaactaatcatgtactaatc

SEQ ID NO: 6872538 - DNA, 57 bp, Homo sapiens
gtgacagcattgcagggcctctaagcaacaaagccggagcccttgttgatactgcac

SEQ ID NO: 6872539 - DNA, 56 bp, Homo sapiens
gcaggcctaagagaaggcattggcacaatagccccttacttccttcaaggatctgc

SEQ ID NO: 6872540 - DNA, 95 bp, Homo sapiens
gctggggccagaggttggatttcacgggaggtggctggattcattattcatgtgggtctcacacttgtctgaggatcaggtcttctcattccggc

SEQ ID NO: 6872541 - DNA, 56 bp, Homo sapiens
ggatgttgggggcggctgcatgcattccctgcacctgggctgccttctgctcatct

SEQ ID NO: 6872542 - DNA, 67 bp, Homo sapiens
ttgatgatcaggtgtcaatgcctggttctctgcctaattcccagtaacttgcagacacctgtctcaa

SEQ ID NO: 6872543 - DNA, 60 bp, Homo sapiens
catggtggtacacgcctgtagtcccagctactcaggaggctgaggcaggagtaccacttg

SEQ ID NO: 6872544 - DNA, 57 bp, Homo sapiens
tccctggctctcgctgggagtacttgaccctgagagcttaactcagagagctgtgga

SEQ ID NO: 6872545 - DNA, 70 bp, Homo sapiens
ctattgctccctctttaaatgggatcaagaatagtatgattcctgatattaagaaggagtgagtaattag

SEQ ID NO: 6872546 - DNA, 100 bp, Homo sapiens
aaaattctgtaaatgagaagtggaaaaattatggagtagtagagaatgttaaataaccatctatattatacatccaggattgcttttaaaacaggatttt

SEQ ID NO: 6872547 - DNA, 69 bp, Homo sapiens
tgagatccacttaatttttttgctctgtaaatggatacaatttaaaaatgtattgagttcagtggctca

SEQ ID NO: 6872548 - DNA, 59 bp, Homo sapiens
gcaaaaattctgagatccactgagagcttggatgactctcagtgaatctcagaattcgc

SEQ ID NO: 6872549 - DNA, 129 bp, Homo sapiens
ttaccagaggcaacttagcagacgttaacagtctacgctaaggcagccaaacttgggttttggtttgaaacctggctgtgtgaccttggcaattcttaattctgctaagtttatatggtctcatatgta

SEQ ID NO: 6872550 - DNA, 96 bp, Homo sapiens
gctggactccgggcgcgggtggcgcggcaaaactccgggcgcaggtggcgcggctgagaggggcgcgcagctcgcgaaatgcccggcgtcaaaggc

SEQ ID NO: 6872551 - DNA, 59 bp, Homo sapiens
ttaagtattctactagggtcctatgcattttaaaaggattcctggtggatactgcttaa

SEQ ID NO: 6872552 - DNA, 56 bp, Homo sapiens
cccatttagacctattctgcccaaaatgcagtggtacagaaacctgtcaaagtggg

SEQ ID NO: 6872553 - DNA, 76 bp, Homo sapiens
ggaaaatggaacttaataagttttgtaattatggggcaaatctatgcaaattgcgatttttattaggtaattttcc

SEQ ID NO: 6872554 - DNA, 58 bp, Homo sapiens
cctccggcgtctcttccacttcctactccaaggtggggagtgcaggcggggtcagagg

SEQ ID NO: 6872555 - DNA, 61 bp, Homo sapiens
tggaaaactgatataatctctggaactggcagctccagatgaataatttgttagcttttca

SEQ ID NO: 6872556 - DNA, 80 bp, Homo sapiens
gagcacagggcttagagtcaggcatgtttaaataccacttattactagttgcttcactttgcttcagtttcctagtgctt

SEQ ID NO: 6872557 - DNA, 75 bp, Homo sapiens
agaagcctatagagaagcagtttggggtcagaaagatgccttcaagaatccagatttttctcttattggtcttct

SEQ ID NO: 6872558 - DNA, 58 bp, Homo sapiens
ggtgactaaatgtagtaggatttactacatagtaagttctcaatacattgtagctatt

SEQ ID NO: 6872559 - DNA, 68 bp, Homo sapiens
ggagcgtgcagcatgagctcatacctgcctgggctgcaggctttgtttcatgattgctgtcattttcc

SEQ ID NO: 6872560 - DNA, 101 bp, Homo sapiens
gaagttcatcaggcaggtgggctcctggcatgggtggagagagcacaagatccatttctctgtgactcctttgctcttgccctttcctgcgtgttggcttc

SEQ ID NO: 6872561 - DNA, 65 bp, Homo sapiens
ggccctccctgggaaatgtcagtttcagaggattttgaagtctatcagatcccagggcctgagcc

SEQ ID NO: 6872562 - DNA, 92 bp, Homo sapiens
cagtgtaggaagtggtgggtaggcagtgcgtcctgcctccagtccctgggaaggtcccaggccgctctgcctcttctgtccctctcatgctg

SEQ ID NO: 6872563 - DNA, 57 bp, Homo sapiens
gtctagagcctgatgaggatgaacgtcatggaaacccattctcacatggctccgggc

SEQ ID NO: 6872564 - DNA, 68 bp, Homo sapiens
tccatcacctgtcaaagactaaggttcttaagatctgtttaagcactagagtcttgacaagaagtgga

SEQ ID NO: 6872565 - DNA, 57 bp, Homo sapiens
tgcagcagggcccaggcacagagcaccatctcttcctgtcaacaaggccccactgta

SEQ ID NO: 6872566 - DNA, 58 bp, Homo sapiens
ctgcgttcgcctcctttctgaggatggggtctttacagggcagaagcaggcagtgcag

SEQ ID NO: 6872567 - DNA, 59 bp, Homo sapiens
ggtaagaagtacaaaaattttctgtgtaggtggataccagaagggtttgtcttttttct

SEQ ID NO: 6872568 - DNA, 55 bp, Homo sapiens
ctgccttggaaaatgtggtaattaaaaagtgctttaatataacatccaggagcag

SEQ ID NO: 6872569 - DNA, 95 bp, Homo sapiens
gggaaactgaacactgtcccacaagacaaattattcctttaaagtattcgagataatctttgctagtgatttgtttagggtcagtcatgtgtccc

SEQ ID NO: 6872570 - DNA, 76 bp, Homo sapiens
ggggaaaacagaaggattatctagggtacatgcttttaaaagctgttacttcaatcttctcccgttttatctcccc

SEQ ID NO: 6872571 - DNA, 85 bp, Homo sapiens
cttatgtgtacatacatggtggaatggttaaggtaagctaattagcatacacagtagctcatttctcattttgttgtgtggtgag

SEQ ID NO: 6872572 - DNA, 71 bp, Homo sapiens
gcagtgcagctccttcaatctcaccatggcctctgccagaatgcagatcctgggagtcgtcctgacactgc

SEQ ID NO: 6872573 - DNA, 130 bp, Homo sapiens
tgtgtgcctgccaaggcctggcaggtgaagggaggcgggggccacatcagggctgcttgggggtctctggggagagggtcccatgcctgagcccccgcccgccctgcctcccagggtctggcgtgcgtca

SEQ ID NO: 6872574 - DNA, 65 bp, Homo sapiens
tctttcctctcaggcttgggtcgtggcatggctatttatgcctttctgatcttgaagtggaatga

SEQ ID NO: 6872575 - DNA, 71 bp, Homo sapiens
gagtgtactttttaccaggaggcattctctgaattcccttggggttcagcattgtatctcctgtgtcactc

SEQ ID NO: 6872576 - DNA, 67 bp, Homo sapiens
gctggactttctcagttccatctagagcctgaaactcaaaatccagaaaccactgaagagatccagt

SEQ ID NO: 6872577 - DNA, 56 bp, Homo sapiens
tttctttcatttgtagaacactgtatgagttttacagacaacactgatgagagaaa

SEQ ID NO: 6872578 - DNA, 55 bp, Homo sapiens
tttctagaatgactcatctgagacccgggtctcagagtgtgagacatattggaga

SEQ ID NO: 6872579 - DNA, 59 bp, Homo sapiens
ctgttcgggcccaggccgaggacctgccagtagggctcagttgcctggagcccgttcag

SEQ ID NO: 6872580 - DNA, 57 bp, Homo sapiens
ttaagattttgttacagtgtgtaacaaaatggttacacactgtgtcataatgcttaa

SEQ ID NO: 6872581 - DNA, 77 bp, Homo sapiens
tgtctcagttttttcaaccataatatgggggtaatattagttcctacattatgcaattgttgtgagaataggagaca

SEQ ID NO: 6872582 - DNA, 75 bp, Homo sapiens
ttttcattcttatatttactcattcaacaagtatgcctcatgtgccaagtggagaggaaaaagtgagaaaggaaa

SEQ ID NO: 6872583 - DNA, 59 bp, Homo sapiens
ctgaatagagttttctctgggaaggagtaagattcctctcccagggagagcctgagcag

SEQ ID NO: 6872584 - DNA, 84 bp, Homo sapiens
ccagggtgagcagcagggtgccagctttgcacctgcaagaccctgagagcaagtgtcctgagtgccttgctagtctcaccctgg

SEQ ID NO: 6872585 - DNA, 92 bp, Homo sapiens
ttttattaatgcactctagggacagttgtgtttgagtcaacctccagctaaaatgatagaaaacagatgtccttaaaacaggctatgtgaaa

SEQ ID NO: 6872586 - DNA, 70 bp, Homo sapiens
tttatacttgtttaaataagatagcagtagccatgcttccagttactgtatgttgttgaagcaaaatgag

SEQ ID NO: 6872587 - DNA, 58 bp, Homo sapiens
ggtgacagtaaggtggcttcttcttgtgggtaggttgacaagggcctctgctgtcttc

SEQ ID NO: 6872588 - DNA, 100 bp, Homo sapiens
tgaggcaggagaatggcatgaacccgggaggcggagcttgcagtgagcagagatcgcgccactgcactccagcctgggcacagagcgagattctgtctca

SEQ ID NO: 6872589 - DNA, 70 bp, Homo sapiens
gctcctccggaaattagacctttggaaatcaatgcagagtttctattacatttctggacattcagagagc

SEQ ID NO: 6872590 - DNA, 111 bp, Homo sapiens
gaacctactcaaatctttcccaggaacccagtccaggtgcagcctcgcctgcagaaggccgccatgctgggtgtggtgcctggggaaggtgaaaggtccaggagcaggttc

SEQ ID NO: 6872591 - DNA, 56 bp, Homo sapiens
ggggttggtttaaatgcttgagcagataccaactgtccacagccacagccaacctc

SEQ ID NO: 6872592 - DNA, 72 bp, Homo sapiens
gttgaatatcagatctggctactctagccaactttcatgtctggcagcaattagctagagctgagtctcagc

SEQ ID NO: 6872593 - DNA, 58 bp, Homo sapiens
tgtaatataccaaactgtaatttttctaccttacaagaagaacggttgggtatttaca

SEQ ID NO: 6872594 - DNA, 63 bp, Homo sapiens
aatttcctcttgtcatattttgggcttcactaacgcatccccttgacaggacgaagggaagtt

SEQ ID NO: 6872595 - DNA, 65 bp, Homo sapiens
tagagtcctccatccctatctgtgttcgtcaacagcaggtgaccttcacaaatgatgaggacctg

SEQ ID NO: 6872596 - DNA, 58 bp, Homo sapiens
gactgaagtgatgtggctaaggggccagtttggatcccggcttcattttcttctggtt

SEQ ID NO: 6872597 - DNA, 88 bp, Homo sapiens
caagcttaagtttttctacaacacttctgaatctcccaagttgaatagctgacagattcaggagagttgtgaaaaaaacttaaggttg

SEQ ID NO: 6872598 - DNA, 58 bp, Homo sapiens
gtcttgcccctctgcccagtcctcagagcactgggagccaggcatatcggggcacgat

SEQ ID NO: 6872599 - DNA, 66 bp, Homo sapiens
ctagatggtggttgctcaaaaaattaaacatggaattaccatatgattcagcaagtccacttctgg

SEQ ID NO: 6872600 - DNA, 59 bp, Homo sapiens
gatgaggtgaaaagtggatggagaggctcagactcaccaactacagttgttccttcatt

SEQ ID NO: 6872601 - DNA, 64 bp, Homo sapiens
gtaagtgcacatccctgtgctttcccttcttacaaccacggtgaagtgcaagatgcgcgcttgc

SEQ ID NO: 6872602 - DNA, 59 bp, Homo sapiens
tctggctgctgcgtgagtgctttattgattacagagcaccgatcaaattagctgtcaga

SEQ ID NO: 6872603 - DNA, 101 bp, Homo sapiens
tagaaaatacagtgagatttgctgggtaaataggttttgaaccatgaaaaaattgatggcatgcaagatcttcctcaatagacctaagagtctcatttcta

SEQ ID NO: 6872604 - DNA, 63 bp, Homo sapiens
gtattatgaatgccgaggcggcaacaaaaattttgacagaattgcgccgccttgctcgtgaac

SEQ ID NO: 6872605 - DNA, 71 bp, Homo sapiens
ttgctgaaagtggcaagaagtaaccaggatctgtcaacataaattatatctactttttcccctgacagcaa

SEQ ID NO: 6872606 - DNA, 57 bp, Homo sapiens
cacccaggcaggtggctgagaatgggcaattggcctacacgcacccctgtcgggctg

SEQ ID NO: 6872607 - DNA, 77 bp, Homo sapiens
gggtagcatttatcaccatctcatgcaggggtctgcgaactagcaaaccactgcccatggtgaaaactgaaccaccc

SEQ ID NO: 6872608 - DNA, 64 bp, Homo sapiens
cctcttgtctaggctgccatggtgtgacagctgaccacttctggctctaactaggcatcagagg

SEQ ID NO: 6872609 - DNA, 98 bp, Homo sapiens
cagatgaggaaactgaggctcaggtaggttaactcactatatcaggtcatacgagttgacatgtggctttgacccaggatttggactcagccctcctg

SEQ ID NO: 6872610 - DNA, 66 bp, Homo sapiens
gtttttacatgcagagggaagggagaagacaggccatttcttctcccccagtgcatgtggccaagc

SEQ ID NO: 6872611 - DNA, 61 bp, Homo sapiens
agcctagaagaagtggctacttctgcctgtggtttatagccctactttattctagacagct

SEQ ID NO: 6872612 - DNA, 58 bp, Homo sapiens
gcccaggctggagttcagtggtgtgaacacagctcactgcaacctccacctcctgggt

SEQ ID NO: 6872613 - DNA, 74 bp, Homo sapiens
tagttttctcgaggaaatatttacaactgattgaatttaatttcaattgtactaattttccatgagttgagcta

SEQ ID NO: 6872614 - DNA, 94 bp, Homo sapiens
actgagtaacagatgtgtatcatgatcagcaactaatcacgtcacatctctcaacatttgtcagtgaatggtcactgagcatctgttactcggt

SEQ ID NO: 6872615 - DNA, 72 bp, Homo sapiens
ctgaatgatgaaggattttttgtgttgaacttttagaaaatttcaaccagagtttttcttaatatgatttag

SEQ ID NO: 6872616 - DNA, 61 bp, Homo sapiens
acgtttttagtctccaatctttcagagaatcctgctggacaggatctgagactgagagagt

SEQ ID NO: 6872617 - DNA, 76 bp, Homo sapiens
ctatgttgcgagaaggttctgtattatttaaaactgaattattctgttcctaaatctggaggacctcacaacatgg

SEQ ID NO: 6872618 - DNA, 88 bp, Homo sapiens
tctgacttggctgtcgtgctctgagtttgcatgtcaggaagtaaacacctttcacgtttttatgcctagagcactgctccaactctga

SEQ ID NO: 6872619 - DNA, 68 bp, Homo sapiens
ttgtttgaaatatttgggagtgtttgacttagaactgttaatacttttgccttgtattcattgaacaa

SEQ ID NO: 6872620 - DNA, 59 bp, Homo sapiens
aggaggaagggaagacaagtaagagggtgaagccagtctccctgtcttccttccatcct

SEQ ID NO: 6872621 - DNA, 85 bp, Homo sapiens
cagccgacagggaaaacaactttcacactccacatgctctgcacctggatggcaggtgggtgagaggtttgcccccttcgagttg

SEQ ID NO: 6872622 - DNA, 69 bp, Homo sapiens
acagggcctggctcaataaatattagctgctggcttctgctcacttactgtttattgactggctactgt

SEQ ID NO: 6872623 - DNA, 83 bp, Homo sapiens
caagagcggatcactcttctggatctcagaaattttagaaagcaaatactgtgggatgcagtaggaacaattatccgtttatg

SEQ ID NO: 6872624 - DNA, 57 bp, Homo sapiens
atggcatttcttgacagggcatgttcctaaggatatgcagagaataacaaatgccat

SEQ ID NO: 6872625 - DNA, 103 bp, Homo sapiens
ggtgctcactggccaaggccaccttctggtctgcctgacagccgtcctggataggcaggtactgctgggccagaaggtggtggtcgtgcactgcaaaggcatc

SEQ ID NO: 6872626 - DNA, 59 bp, Homo sapiens
gtaagagagaccaggaataacagtggcataaacaccacagatgtttatttttctcttac

SEQ ID NO: 6872627 - DNA, 81 bp, Homo sapiens
aggggaccagatgcctgggccagagagtaagaaaggtcattggtatggccaggctgagtaactcctgcccagtggacccct

SEQ ID NO: 6872628 - DNA, 90 bp, Homo sapiens
ggcaaagcagtggcttttgaggattcgctgcagggaggagttcaccatccggcccctggcatccggaacctggaaaacctctgctgcgcc

SEQ ID NO: 6872629 - DNA, 123 bp, Homo sapiens
cattcagagcagaagctgctgattttattctcaggaaatttatattgtgcccagttagggagaaagaaacctcttctagctatagtgttttcttagttcttagaaaaagagatctgaagaatg

SEQ ID NO: 6872630 - DNA, 55 bp, Homo sapiens
ctggtctctgttcacaccgggtgctaataacccacagctgaaagcagaggctcag

SEQ ID NO: 6872631 - DNA, 75 bp, Homo sapiens
tgcacccagtgggatgcttagcatccgggcctcgaccctctagatactccttttgccaaatacccactggttgca

SEQ ID NO: 6872632 - DNA, 56 bp, Homo sapiens
cccctagctaatgaaaagtgtagaagtaacttctttagcttccctttagttagggg

SEQ ID NO: 6872633 - DNA, 62 bp, Homo sapiens
gtgtctgagaggattcctgtcccgaccctgcccggtgggcgtgctggcttcctctctgccac

SEQ ID NO: 6872634 - DNA, 129 bp, Homo sapiens
aagatggggcttgagataggccttggcggccccattcagtttgccttggtggagagaaaacagtgatcctctactgtagtgatgctgcagtgtagggctgtgaatgtaggcatgcttaagccaggtctt

SEQ ID NO: 6872635 - DNA, 63 bp, Homo sapiens
ggcggcccctaattggttggttagctgaaagtcaagggatggcagttgcccagccaatccgcc

SEQ ID NO: 6872636 - DNA, 64 bp, Homo sapiens
ttggaacttgagaatattggctgtgatttcaatcaggaatgagtctagctctgtcttattccaa

SEQ ID NO: 6872637 - DNA, 104 bp, Homo sapiens
gagaaaggaaaggagagaggagtgaggggcagaatgtgatcagggtcttctgagtaccctgaccctggtttgtactcccccacctgctcttgatgctttatctc

SEQ ID NO: 6872638 - DNA, 56 bp, Homo sapiens
ggaaaagcacattcaattttgtatgagatctctcaaacatttgaagtcgcatttct

SEQ ID NO: 6872639 - DNA, 81 bp, Homo sapiens
gtagatttaagaagttctgaaataaaatcctgtcttgaatttctagagtagtgatttccatttcagggttttggaatttat

SEQ ID NO: 6872640 - DNA, 73 bp, Homo sapiens
aaaggcattgctgatcctcaggttgtgccatacatagtccttggtgctatcagagctctcagcacatgccttt

SEQ ID NO: 6872641 - DNA, 57 bp, Homo sapiens
ttactacaagattctgttttattgctatccgtggctttatttacagacttgaagtga

SEQ ID NO: 6872642 - DNA, 58 bp, Homo sapiens
tgaagagtgccactgacaggtccctgctgcagcccaggctccacatgggcactttgca

SEQ ID NO: 6872643 - DNA, 93 bp, Homo sapiens
ggtggggacaataagaaaagaggaggcagaggactgaggaggtcagacaactcttgagagagatgcctgctctttattttatgatcccattcc

SEQ ID NO: 6872644 - DNA, 75 bp, Homo sapiens
ggcgtcttctctccctgcttcctgtggcacatcctgagctttgggtgctcaacagagggtgtggaggaagacgct

SEQ ID NO: 6872645 - DNA, 64 bp, Homo sapiens
cctcagtttcctcatgttaatatggaatattccctgtttcatagtatgatgaggattgactagg

SEQ ID NO: 6872646 - DNA, 84 bp, Homo sapiens
cagtattcataactatccaaattagagccaggatgtttatgctcaaatcttgtcttggctctgtgttgatgggactgaataatg

SEQ ID NO: 6872647 - DNA, 88 bp, Homo sapiens
ggactctggtactgtggctgtagaagaaaaatctcctttacttattttagtatccaggttcctcttcatgttcaacagtaaggactcc

SEQ ID NO: 6872648 - DNA, 56 bp, Homo sapiens
tccagtaaatgtgatttttcttgtaagtaatttccttatgggaacattgaactgga

SEQ ID NO: 6872649 - DNA, 79 bp, Homo sapiens
ctgagatgtctgagactcagcccctgctctcaaggagctcagagtccattgggagaaatagttgatccgcagcatccag

SEQ ID NO: 6872650 - DNA, 60 bp, Homo sapiens
gaagtggtagtcacagggacagtaaggcaagcccagtctgtgtctaatgactatttcttc

SEQ ID NO: 6872651 - DNA, 56 bp, Homo sapiens
tttcagtttaagtaactgctattacttaagtgattgcacttttgctcaaattgaag

SEQ ID NO: 6872652 - DNA, 62 bp, Homo sapiens
ggctgggagctcctggagggcaggaagctggtcctattgggttctgtccccggagcctggcc

SEQ ID NO: 6872653 - DNA, 57 bp, Homo sapiens
gtatattcacaaaatgaggtcctcagggtgaccttgagtgagtgctgtgggtgttac

SEQ ID NO: 6872654 - DNA, 73 bp, Homo sapiens
gtccttaatagagaccttctctgacttagccagccatgggaaggaagatgaaagtactgctaacaaaggggac

SEQ ID NO: 6872655 - DNA, 65 bp, Homo sapiens
cctggaaggcatttattccacaagcaggtcagaagacatgttttaagggtcaactgtcacctagg

SEQ ID NO: 6872656 - DNA, 62 bp, Homo sapiens
gaccttggcacattttgttcttctgtatgtccccttacggaggctgctttctgttgctagtc

SEQ ID NO: 6872657 - DNA, 67 bp, Homo sapiens
gatgccttccaggattttggcttctctctagagcagtgaatctcaatcttggatgcacattggtatc

SEQ ID NO: 6872658 - DNA, 57 bp, Homo sapiens
tgccagagccaggctttaggaagtggccactctgggaagtctgtgggttcaaaggca

SEQ ID NO: 6872659 - DNA, 99 bp, Homo sapiens
agatcttcaaaaacacttccatgaactttctttacagttttgtgctattctctttctaaatttgccaattgtatgtggtaaggttgatggtgaggattt

SEQ ID NO: 6872660 - DNA, 81 bp, Homo sapiens
gaggcttcccagcagaggaaagactctgaccttaacaatgaagagttttagacccccttatgcaaggaagaagagtacctc

SEQ ID NO: 6872661 - DNA, 96 bp, Homo sapiens
agacaaattatgtagcttgttcaaagtcataaaacttgtaagtggatcagagattcaaatttgagtccgtatgactttttcacccctgctaattct

SEQ ID NO: 6872662 - DNA, 59 bp, Homo sapiens
tgaagagatagaagtacatgctgtaggttgtacagcagaacagtcttctagttctttca

SEQ ID NO: 6872663 - DNA, 67 bp, Homo sapiens
ctgagaagtcagagatcaaggtgtctacagcaatggtgtctggtgagcgctgctctctgcttccaag

SEQ ID NO: 6872664 - DNA, 89 bp, Homo sapiens
tgaggaaagtttatgctcttgaggctaaagacataacagatgtaatgtaaaagtattcaggatgtaaacccaatatgaatatttcctca

SEQ ID NO: 6872665 - DNA, 68 bp, Homo sapiens
cagtctctgttgtggcccaatgcaaagctttacctaacagatgctttgaatagggtggcaacaaactg

SEQ ID NO: 6872666 - DNA, 77 bp, Homo sapiens
ccgccacttgaaatatctttgttctcaccctatctttaaacttcaatttggtgataataatatggtttttagtgtgg

SEQ ID NO: 6872667 - DNA, 86 bp, Homo sapiens
ggcagtcacaagcagggtgctgggacaaggtcttttagaagatggctgttcagaagtccccccagcatcgtagcttggaagtagcc

SEQ ID NO: 6872668 - DNA, 61 bp, Homo sapiens
gggtgtttggctagagtagaacagctattgtctaaatgttttttgtcttgctaggctgccc

SEQ ID NO: 6872669 - DNA, 129 bp, Homo sapiens
agtattttatttttttgtagctctcaggtgattcaactgtgcagtgaaggttgagaaacactactctaactcctttggttctgtcgaatttagtatgacattaagatgctacaggaaagtattagcact

SEQ ID NO: 6872670 - DNA, 59 bp, Homo sapiens
atgagccgagaccaatattaagaaagcttgacttttttgattcctagtctaggcatcgt

SEQ ID NO: 6872671 - DNA, 56 bp, Homo sapiens
ttccttagcagacctggtatccttgaattaagaggatgtcaggcacttatgaggaa

SEQ ID NO: 6872672 - DNA, 70 bp, Homo sapiens
ggtacaatgtagatgttcacttgatttttattgaataaatgaaggaataagtgagtactttgcaggtact

SEQ ID NO: 6872673 - DNA, 68 bp, Homo sapiens
catgaaaatattcaccatggcatttaaagtctcccctttaaaaggcatcataggtgaatatgattatg

SEQ ID NO: 6872674 - DNA, 66 bp, Homo sapiens
ttagagaaaagcttgcttgcttgagtataattattgttttgcctgagtttgtaaactattcactaa

SEQ ID NO: 6872675 - DNA, 65 bp, Homo sapiens
cctgatggaggagagaaatgttttctgtgggacctacaatgttcgcattctctctgacacgtagg

SEQ ID NO: 6872676 - DNA, 91 bp, Homo sapiens
gttgttgcatcatcaaagacagcagccctttggctgaactgtgagcccatttcccgtcaccatatgccgcgggctgctgttgagcaataac

SEQ ID NO: 6872677 - DNA, 60 bp, Homo sapiens
gtcacagacgggacaacgtgcagctgccgccaccggccaggctgctgtcaccgctgtcac

SEQ ID NO: 6872678 - DNA, 65 bp, Homo sapiens
ttagtttgttattctgttgttcagggttgggggaaacctggagcctgacagctgaattgtactga

SEQ ID NO: 6872679 - DNA, 89 bp, Homo sapiens
tctgtaagttgtagaagtttcccaggtgctgcatattagtcctggactccacattgccatttgggaattatttgcctaattttaacaga

SEQ ID NO: 6872680 - DNA, 59 bp, Homo sapiens
gactcacacagaccttcctgctcccaagagacatcatgaagcccaggcctgtgtgagtc

SEQ ID NO: 6872681 - DNA, 76 bp, Homo sapiens
ccaagtaaatggtgtttccgttaagctgaactataaaatgtgggttacttaaacagaaatgcagaaaggcacttgg

SEQ ID NO: 6872682 - DNA, 74 bp, Homo sapiens
atgtgatgttttgatatatgcatacattatgggatgattacatcaagctaattagcatatgcatcacttcacat

SEQ ID NO: 6872683 - DNA, 55 bp, Homo sapiens
gagagattacagtaatctctgttcactggggcagcagaaaatacctgtaactctt

SEQ ID NO: 6872684 - DNA, 74 bp, Homo sapiens
gggattttctcagttgacgttatagacttatttcttggtcaatcgttttgggtttaaactcaactctaaattcc

SEQ ID NO: 6872685 - DNA, 107 bp, Homo sapiens
cccaactccttcttagttgacttgggaggattgtccatctgggaggcatccactcattcttcccttcctggggcaatttaaagagttaatataatatggaccaaagg

SEQ ID NO: 6872686 - DNA, 59 bp, Homo sapiens
ggggataccagtgtgtgccaatcacctgctgattgacttccatagctacctggtaccct

SEQ ID NO: 6872687 - DNA, 86 bp, Homo sapiens
cagtctggtggaggaagacagagttaaataagcattaactttaaagtaggggaagtgcattaagctatgggtcacctagcaggctg

SEQ ID NO: 6872688 - DNA, 56 bp, Homo sapiens
atttatttggggaattggctcacaaactatggaggctgagaagtcccatgataggt

SEQ ID NO: 6872689 - DNA, 58 bp, Homo sapiens
ttgcacagcacagcaacatgttttggaaaataaaacctttaatgcatggctgtgacag

SEQ ID NO: 6872690 - DNA, 130 bp, Homo sapiens
aaatttcaggggagatatgtgtaatatttatatttaatactgctatgagaatagatatacatttattagtttgtcagtgtaactcttatagcagctgtggaagggaggaggcgtatatattttccttgat

SEQ ID NO: 6872691 - DNA, 81 bp, Homo sapiens
tgtgtgcgtctatctcctggtacccttcctagcatcaattctgtatttgtaggagtccaatcaggagacacaaaccactca

SEQ ID NO: 6872692 - DNA, 62 bp, Homo sapiens
gagccaggagatacctaaggggcttgtcaacacctaatgctgtctctccttctccttggctc

SEQ ID NO: 6872693 - DNA, 61 bp, Homo sapiens
ggtcctgggatgacagggatgctgtgttttatttactcatctttgtaacttccacataacc

SEQ ID NO: 6872694 - DNA, 78 bp, Homo sapiens
gactccagcgctggggtaggagcaccttgaaggtgaaggagcccagcgagctgcagcttcctagtccagcctcacgtc

SEQ ID NO: 6872695 - DNA, 68 bp, Homo sapiens
gacaatttgacttttgaggttgtactcctaattaatatgctagaactgcaatgtcaagggtcaaagtc

SEQ ID NO: 6872696 - DNA, 89 bp, Homo sapiens
tgctgattgattgattatagactcactaatctcctagattcaaagatacctgaagaaaatgtgaacttgtgaattccggtcaaacagta

SEQ ID NO: 6872697 - DNA, 86 bp, Homo sapiens
tcatgttagagttataaaagatttctggaggctcattagccattcctgattagagtccctttggagttttaaaagttttaatgtga

SEQ ID NO: 6872698 - DNA, 96 bp, Homo sapiens
gtcaccaacttgtctgagtccagtgggagcaaatacactcatatgcaacaagttatatgaagcagatttattactcacagattggcagcaagggac

SEQ ID NO: 6872699 - DNA, 76 bp, Homo sapiens
ttactttgaacatttttctgcaagtgtagatacccagcgtttaagctggaatttgctttgagaggcttttaggtga

SEQ ID NO: 6872700 - DNA, 62 bp, Homo sapiens
tgctagatttgtcctgctttctacctcccagtaaacagtgtacagaggtcgggacagaagca

SEQ ID NO: 6872701 - DNA, 64 bp, Homo sapiens
gttcgaaggagccaccttcaactcaggaattgataaaattctcccagtggaagtggcttagaat

SEQ ID NO: 6872702 - DNA, 64 bp, Homo sapiens
acatggagaaaccccgtctctactaaaaatacaaaattagccagacgcggtggtgcatgcctgt

SEQ ID NO: 6872703 - DNA, 59 bp, Homo sapiens
ttctccatctgtaagataggggaaattgtcattttcactgtcttttaaggtggttagaa

SEQ ID NO: 6872704 - DNA, 59 bp, Homo sapiens
gttcacaggacagccttccacccgcttcaccagccgtggagaatcgctggcctttgaac

SEQ ID NO: 6872705 - DNA, 59 bp, Homo sapiens
gcggtcggcgaagctgaggggctgcagcccggttccaggctctggctccgcgtgaccgc

SEQ ID NO: 6872706 - DNA, 76 bp, Homo sapiens
gaacatagatagcaaactggcagcttgtgggctaaatacagcctaccgacatgttttgtttgctctcccaatgttt

SEQ ID NO: 6872707 - DNA, 125 bp, Homo sapiens
ctgattgtatgaattttaattgttcagttaacgtgtttctaggttgtaatttgtagtaaagcacttcaatgcttttgcacttaaatttacaacactgttggtgtgtgattgatttactcattcag

SEQ ID NO: 6872708 - DNA, 56 bp, Homo sapiens
gaggttgccatgcatcctggttacatttctgaattgggtgaagtgctggaaacctc

SEQ ID NO: 6872709 - DNA, 80 bp, Homo sapiens
gaagtcgagttgcacaactccagggggcattcagataaaatatcatgtgaatgatgccctggagttttgcaggtagcttt

SEQ ID NO: 6872710 - DNA, 57 bp, Homo sapiens
agccatagagccgggataagaaagagccttctgccctggctgcctggctctgtggtt

SEQ ID NO: 6872711 - DNA, 67 bp, Homo sapiens
ggtatcagagagtgcaaaatatagctacttacctccaaaggaagcaatatgcatactttctgaatcc

SEQ ID NO: 6872712 - DNA, 74 bp, Homo sapiens
ttgggcacatgacacaggcctggccaatcagaggagtctcatacctctggttgaagggatgtgcatgtgatcaa

SEQ ID NO: 6872713 - DNA, 61 bp, Homo sapiens
tacttcacagtaaatccagaagaaattatgcacttaatttttctgggtgaattgtgttgta

SEQ ID NO: 6872714 - DNA, 77 bp, Homo sapiens
ggcaggacctcaccaggaacagctgcggaggggtgaccttgggcagtagcctcttggtgttggcaaataatcctgtc

SEQ ID NO: 6872715 - DNA, 68 bp, Homo sapiens
gaggggagctaacaccagagcccaggtccccagctccccacccagggcttcactgcttggctccagtc

SEQ ID NO: 6872716 - DNA, 100 bp, Homo sapiens
ggggagtcagggagctagagcaagggctgggcttggggctggcagaacagccaagaacccagagctccggtcctgcccatgcccctgagaaattctcccc

SEQ ID NO: 6872717 - DNA, 56 bp, Homo sapiens
agctctgtgtccagtgctcgctccccacagcgccccgcaactcacccacagcagct

SEQ ID NO: 6872718 - DNA, 77 bp, Homo sapiens
agggtaagttaagaacacttatagcaagggataaatcctccctgcccctcgcatggtgtgccttaacatttagccct

SEQ ID NO: 6872719 - DNA, 103 bp, Homo sapiens
gctcttcatggcagctgggagcagtgggccaggagtcacccgggcatgaccatgtggtgtggccaggtcagggacttgtggctcctgcccctccctttggagc

SEQ ID NO: 6872720 - DNA, 78 bp, Homo sapiens
tgtgactatatgcacacaacagttctgtgttctggttgttagttttgccattcacggttgtgtgatgcagatcccgca

SEQ ID NO: 6872721 - DNA, 82 bp, Homo sapiens
tctttcagatgtttttttccccagcctccagtagttgtctcacactttgagctaatcagtactgtgctgaatatttgagagg

SEQ ID NO: 6872722 - DNA, 59 bp, Homo sapiens
cccagagaattccacatagaggcaatggtaattgacttctttttgccaagtttactggg

SEQ ID NO: 6872723 - DNA, 67 bp, Homo sapiens
atcatgtcctaactttgtcatcttccctttctgaatcagaacatggattgtcaaaggtaagactgat

SEQ ID NO: 6872724 - DNA, 76 bp, Homo sapiens
gaagccctgtgcagggtcagccaaagctgtctctaagcctgcatcacagctcagctttgccctttgcccaatcttc

SEQ ID NO: 6872725 - DNA, 105 bp, Homo sapiens
aggctgttttggttatgacagtcttatagtacaatttgaagtcaggtaatatgatacctccagctttgttctttgtgcttaggattgtctttggctattcagttt

SEQ ID NO: 6872726 - DNA, 62 bp, Homo sapiens
atctgtgtgcagggatgagtgcaggtacgtgtgagtgtgtaagtgtatgtgtgtacaggggt

SEQ ID NO: 6872727 - DNA, 67 bp, Homo sapiens
gtgagcaaaagttgatggtgctttctttcctggtcacatccttggaagctcccattaactgagccat

SEQ ID NO: 6872728 - DNA, 65 bp, Homo sapiens
taaggttaaccaaggcaccaagtgtacttttacaaggtcactgttgaaccctcttggtggcttta

SEQ ID NO: 6872729 - DNA, 106 bp, Homo sapiens
tacaggttgggagcttagagaatagtctaggctcagagtatctagttggggctcatcatcttctggaagacgtttgaagccatgggtctagttgagtttacctgta

SEQ ID NO: 6872730 - DNA, 55 bp, Homo sapiens
cctgtgaggtcttgcatgtgaaatggctcacatattcatggcagccacccacagg

SEQ ID NO: 6872731 - DNA, 130 bp, Homo sapiens
tggttctagaacccatcctaggagcaggtttggatgttatggagtcaggcaatgcttgcttggtattcctgtctcataaagcttgtagagtttgacttcctccagatagtttctcactcttggttcatca

SEQ ID NO: 6872732 - DNA, 56 bp, Homo sapiens
gtggtgacgcatggaatgtgccttaaactgctttggcaccagtcatgagtcaatac

SEQ ID NO: 6872733 - DNA, 63 bp, Homo sapiens
gcctcggcggctgctgccaccacagcccggagtcggggcctgggagggcagcagtgtgggggc

SEQ ID NO: 6872734 - DNA, 63 bp, Homo sapiens
aggccagcaagaaagagagtctttgatggtttcaaccatgctgactgcttctttctctgacct

SEQ ID NO: 6872735 - DNA, 95 bp, Homo sapiens
cttctgggtgcaggtgggtcgatggcagggacttgttgccgtgtggtctactaattgcccagcagtcccatgccaaatgcatcctggcccagaag

SEQ ID NO: 6872736 - DNA, 71 bp, Homo sapiens
tcagtgggcagattaatttctcaatacgtgctaatctacaattgagatgcttaaatcttcacctgcactga

SEQ ID NO: 6872737 - DNA, 65 bp, Homo sapiens
tttgatctgagggtctgattatagagaaataaaattttaactttgacagagacttcagagccaaa

SEQ ID NO: 6872738 - DNA, 94 bp, Homo sapiens
gcttaacccttgctcctccctgtgcagacccagctagacagaagaatccagagctgggagggctgggagctggtggagggagagcagggcaagc

SEQ ID NO: 6872739 - DNA, 60 bp, Homo sapiens
gtacgggtcatgtgcctaatcctggctgcaaggacagctggagatgcaagtgtatctgac

SEQ ID NO: 6872740 - DNA, 71 bp, Homo sapiens
tgatataggcagaaaggaaggcaagtttttataactttgtctaaatgaactttctaaatgcctgagtatta

SEQ ID NO: 6872741 - DNA, 77 bp, Homo sapiens
gagtttgccagagagtctcttattccctattgctgctgctcctcaccaggccctggcagatgaagaccttggccctc

SEQ ID NO: 6872742 - DNA, 83 bp, Homo sapiens
gggaaggaggttacaagtgtcaggcgctggcaccaggctttccaggtgccagtacctgacacttgtaatcccagcgatttccc

SEQ ID NO: 6872743 - DNA, 61 bp, Homo sapiens
cacacttaggttcattactaccttggctattgtgaataatgctgtaatgaacgtgagagtg

SEQ ID NO: 6872744 - DNA, 101 bp, Homo sapiens
caacagtttggatgaaggttgaggtgagtcatgcattggaggaactaaaagaaagtcctaagccaggtaggactcaattcctcttcctcatccagatggtg

SEQ ID NO: 6872745 - DNA, 57 bp, Homo sapiens
tattccaccagagatgtgaattgtggaatcgaggcaatttatgtttggggtggaatg

SEQ ID NO: 6872746 - DNA, 64 bp, Homo sapiens
aagtttcagagaattagaagctgattttagaaaagtaagattaggtgaatattctctgaaattt

SEQ ID NO: 6872747 - DNA, 58 bp, Homo sapiens
gggaatatgggactctccagtggagtttgttaaaacacagcttcgaggatctcatccc

SEQ ID NO: 6872748 - DNA, 95 bp, Homo sapiens
cacaaggaaaatgattctagaatttaaatttgccaagttaagctaagctatgtgcaaattaagtagattttcctgtgtatattattttccatgtg

SEQ ID NO: 6872749 - DNA, 84 bp, Homo sapiens
ctttcagcagccctggagccgcatggagcagggaagggagttgtctaccctccggcatcctgtgtgttccaggctgtgtgggag

SEQ ID NO: 6872750 - DNA, 62 bp, Homo sapiens
ggttgtggggaccctgactacacagccccgggtgtggctcaaagtgtcagtctcccactgcc

SEQ ID NO: 6872751 - DNA, 76 bp, Homo sapiens
ccggctccagttctcaggctgtggagccgtctaggcaccgtgcacgaagtgggtctccagggctctgagaggccgg

SEQ ID NO: 6872752 - DNA, 93 bp, Homo sapiens
ggagagttcagaggacagagtccaggctggtcaaatagcttcccagctgggcgagatctggcagaccgtgtgggctgtgttctcttcctctcc

SEQ ID NO: 6872753 - DNA, 79 bp, Homo sapiens
ggggaagtgacaggagtcaagggcctgactgtttctataacctgttccctggtccttgacaccctcctccagcgtcccc

SEQ ID NO: 6872754 - DNA, 74 bp, Homo sapiens
ttgacttcctctgagggaagaaatttgtaaaacataaactcactaaacaaacctctttccattagaggaattga

SEQ ID NO: 6872755 - DNA, 66 bp, Homo sapiens
taccagacatgcttctcaaatgggttgatgactccttggaagttgcctggagaagcatgaaatgta

SEQ ID NO: 6872756 - DNA, 83 bp, Homo sapiens
gttgaatccttaccattcgagttctgaggactaaagagtgactagctccaaatcccaaagaactgaatagtaattgttgcagc

SEQ ID NO: 6872757 - DNA, 58 bp, Homo sapiens
ggcgcaggtgttctcagaggaggcttggaagagctgactttaaagggacacctatgcc

SEQ ID NO: 6872758 - DNA, 79 bp, Homo sapiens
tttatcttttatgctctcctcccagtcccagctaggaatgcagttgagggagataggaaggagggcacagggagatgaa

SEQ ID NO: 6872759 - DNA, 109 bp, Homo sapiens
tgggatatctttcctatgtctcctccttcgagacttccagatcctactggtgtcttcctaggaagtgatcttgatctcggtggatgtggagtttaggggaaaaatccca

SEQ ID NO: 6872760 - DNA, 76 bp, Homo sapiens
ttctggtgcaccgtgaagcttgagaactactgtcctagaataattccaggatgtcttcaagctcagtgcagtagag

SEQ ID NO: 6872761 - DNA, 81 bp, Homo sapiens
caagcttttggtgtgggggacatcttagctgaagtggtcaaggaaggcacttccaggaggtgtcactgaagctgagatttg

SEQ ID NO: 6872762 - DNA, 58 bp, Homo sapiens
gggcaggcacttggcctctgagctctgcatccagtgctcactccccacagtgcccccc

SEQ ID NO: 6872763 - DNA, 57 bp, Homo sapiens
tagtgcaaaggtcttgcaccaggctactttttagactatgggccaacctatgcacta

SEQ ID NO: 6872764 - DNA, 83 bp, Homo sapiens
gggattccaatagcatctaaataaacgtgggagtcaaaagacacataaaggacttcccttgctttacgatgttgtggtttccc

SEQ ID NO: 6872765 - DNA, 65 bp, Homo sapiens
agatggtggctgagtggtcgagtcagaattcaagctgaaactcttcctcacgctcagctgcctct

SEQ ID NO: 6872766 - DNA, 57 bp, Homo sapiens
cagctgggtgatcttgggcaggttattgaacctttcttggctttgatcacccatctg

SEQ ID NO: 6872767 - DNA, 70 bp, Homo sapiens
agccccatgaatcatgccactgagctcccaagttattgtcaactgggttgacagcctcaggtatgatgct

SEQ ID NO: 6872768 - DNA, 61 bp, Homo sapiens
tcagacagggagtcagaaaatagaacttgtatgttaattttttattgttttcctgtactga

SEQ ID NO: 6872769 - DNA, 72 bp, Homo sapiens
gcaaagctccacaaataatggaacctgcctttagtaagagttttagttttgtttatttgtttgatgctatgt

SEQ ID NO: 6872770 - DNA, 62 bp, Homo sapiens
cctaccctgggaactggaaactggatttggcaagaatcccaggaagatcccagggacccagg

SEQ ID NO: 6872771 - DNA, 67 bp, Homo sapiens
actatgaagcagcaagtataggacagggtaaactccacttcatgaactttgacttgttgttttttgt

SEQ ID NO: 6872772 - DNA, 113 bp, Homo sapiens
gttggagggagattgcctctaggcgcaatgtgaggcttggttttgagcatatacaaagtacggaaacaaaaccggggcctttccacaatggcaggtagctcagcacctttggc

SEQ ID NO: 6872773 - DNA, 80 bp, Homo sapiens
agatggtgacaaaatagttcagccacggtgactagtgaaaagagctgaatcagcgaagctgactatgctatggtccattt

SEQ ID NO: 6872774 - DNA, 81 bp, Homo sapiens
ggcctgcccctgccctactctgtcccccccatgcccacggcagacaggcagtgggcaagcaggagggcctcagggcaggtc

SEQ ID NO: 6872775 - DNA, 78 bp, Homo sapiens
tcgctccctgcaggacctgggcatggcgcagcacagttcctcgatgtttgccctcagcagcagctcctgccacagtga

SEQ ID NO: 6872776 - DNA, 56 bp, Homo sapiens
gtgcgatgcctgcttcttagggaagccaataactcactggaagcaggtcttcatac

SEQ ID NO: 6872777 - DNA, 75 bp, Homo sapiens
gggggagtcattagtagagaattgtgcccttaaatttatttttatagttggattctgctagttaatatctctctc

SEQ ID NO: 6872778 - DNA, 80 bp, Homo sapiens
agtagccggaatttacaggtgcactcgccatgccctgcagaagcctcatgtgttagggcgcacctgcaattccagccact

SEQ ID NO: 6872779 - DNA, 79 bp, Homo sapiens
aatgatatttcacattagtggttctatatacaatggtatgtaaaattattatggtggagattaaattttctgtatcatt

SEQ ID NO: 6872780 - DNA, 82 bp, Homo sapiens
caggtgagggtgtggtacttaccgctatgttccttccagaatttaagtaggaaaaattggtaaagtgctctaacttcatttg

SEQ ID NO: 6872781 - DNA, 58 bp, Homo sapiens
catagccagccattgctcccaattgttattcacaacaatggagagcctctggactgtg

SEQ ID NO: 6872782 - DNA, 67 bp, Homo sapiens
gaatttaaatttaaatctaccaggggtgtcatgatgccaactggaaaattagattaaaattgaattc

SEQ ID NO: 6872783 - DNA, 83 bp, Homo sapiens
gagaatcgcttgaacctgggaggcggaagttgcagtgagccgagatcgcgccattgcactccagcctggtaacagcgagactc

SEQ ID NO: 6872784 - DNA, 64 bp, Homo sapiens
gagtggtgatgacagcagtttctggctcaagtgccacagactaccactgttcttactgaaattc

SEQ ID NO: 6872785 - DNA, 65 bp, Homo sapiens
tgtctagcccagatacaaatcatgataaaagatctatccatgtgaaatgtatggggccaaggata

SEQ ID NO: 6872786 - DNA, 57 bp, Homo sapiens
tgtctttacttaataaatatacgagcacctctcgtgtttcaggtatgggtaaaggca

SEQ ID NO: 6872787 - DNA, 74 bp, Homo sapiens
acaattgtattactgagcttatacatgtaaggaacctactgccaagtcttgtatgggatcggtgctcaatttgt

SEQ ID NO: 6872788 - DNA, 129 bp, Homo sapiens
atgaaagccttaaaaagtctcaaaccattagcagttttcattatattatgctcaagaaactttattctgagggaatattgatagatccgctaatggattatgcaaagatacagttatacgaatgttcat

SEQ ID NO: 6872789 - DNA, 102 bp, Homo sapiens
gcttagcacatttcctcctcccgtggatgttcttcagtcagagggtggggaagactaaggacagaaggcatctagggcacgaggtgagagaaacgactgagc

SEQ ID NO: 6872790 - DNA, 110 bp, Homo sapiens
ggtgctctgatgtggccagcggcgtgggctggaccctcctgctccctcctccctcccggcctggggcagggtttgtccccaggagccccgcgtcgcatccctagggtacc

SEQ ID NO: 6872791 - DNA, 80 bp, Homo sapiens
ttatttacagtattgttatgctgtgggctatagggcaagtttctaaaatggctttatgtgttacgaaaatgggcaaatga

SEQ ID NO: 6872792 - DNA, 64 bp, Homo sapiens
gtttgcaggtgaagtgccctggaggcaggatgtctgaaaactccttcaggctcttcccctggac

SEQ ID NO: 6872793 - DNA, 61 bp, Homo sapiens
atttggaagtttggagtgaagggaaacaataagcttacttttacatacgcaaactccaaat

SEQ ID NO: 6872794 - DNA, 69 bp, Homo sapiens
tggtatgaaagaagggtggaaaatgtaggaacactttagtctctgtttactttccttctcacagggcca

SEQ ID NO: 6872795 - DNA, 91 bp, Homo sapiens
ctctgtttcccaatgctgtggaagttcctgaagcaatttctcaaaatcagcattgacacacagggctcagggagtttcacagtgtacagag

SEQ ID NO: 6872796 - DNA, 95 bp, Homo sapiens
ttgctacgcccacccagatcactgtgtcagagtatgatgatttccagcgagatgtcagctccatgtacagaaagatgacgctgggacagctgcag

SEQ ID NO: 6872797 - DNA, 73 bp, Homo sapiens
gccttgtctagaatactcgtattattcccctggcttattaagtaatggtaaataataccagtatctaagaggt

SEQ ID NO: 6872798 - DNA, 58 bp, Homo sapiens
tgcaggttctgaccagccaactcctctccttggaggtctggtttgtgagagctgagca

SEQ ID NO: 6872799 - DNA, 59 bp, Homo sapiens
ttggtctgttatttccttgaggatgggaattatccctaatatcttggagtaatgatcaa

SEQ ID NO: 6872800 - DNA, 103 bp, Homo sapiens
atgcatcagggttagctgtatgagaagtatgagaaaatctgcttatattatttttggctacagacaggtgtttccaatttctcatgtttagtcttaaatgcat

SEQ ID NO: 6872801 - DNA, 130 bp, Homo sapiens
tcagcctcccaaagtgcagggattacaggcatgaccccctgtgctcaactaagttataatttttaaaaattatgtctcaaccgggcacggtggctcacgcctgtaatcccaacactttgggaggccaggg

SEQ ID NO: 6872802 - DNA, 83 bp, Homo sapiens
tattaggttgatgcaaaagtaattgcagtttttgccattgaaaataatggcataacctgcattacttttgcacctacttaata

SEQ ID NO: 6872803 - DNA, 60 bp, Homo sapiens
tctggcccaagttttcggtgaggacttgacttgggttaaaatcatccacttgggtccgga

SEQ ID NO: 6872804 - DNA, 59 bp, Homo sapiens
taatgttgagggtatggagggccaccccagtggatctttccaggtgaccgtcagaatta

SEQ ID NO: 6872805 - DNA, 83 bp, Homo sapiens
gggaggggtaggtggaggaggtgctgcaaggggtcccaggccaagccagctcccctgcagctgcttgattcatcttgtctctc

SEQ ID NO: 6872806 - DNA, 57 bp, Homo sapiens
gggcctctcagtaggatcaaatgcacagcactgctatccatccttgatgagaggtct

SEQ ID NO: 6872807 - DNA, 57 bp, Homo sapiens
aaccagatgcttccccagatgccgttccgcaagatggagctctctggagtgctggtt

SEQ ID NO: 6872808 - DNA, 66 bp, Homo sapiens
ccagatattcacttttacatgcagtaaattgtttatcatcaatagcatgtattagatgatatctgg

SEQ ID NO: 6872809 - DNA, 69 bp, Homo sapiens
tcccttcctttggatttttagcagctttggtagaatagttcaaatggctgactaaattaaatttgggga

SEQ ID NO: 6872810 - DNA, 79 bp, Homo sapiens
ctggcaatgtctgcaatgggtgtgggatgggaagtggcagcccatgggccacataattattgtcagtatgcattatcag

SEQ ID NO: 6872811 - DNA, 62 bp, Homo sapiens
agcccctgctgtcagcatcctcgcgagtgacacagctcagcctgccagcagcagcaggggct

SEQ ID NO: 6872812 - DNA, 62 bp, Homo sapiens
atggttcatattatgcatctgaattttttgaaacacttcagatgattccaatgtgcagccat

SEQ ID NO: 6872813 - DNA, 55 bp, Homo sapiens
gggctaagcagagtgggaacagggaccaacgccacctgcttccagtgctcagcct

SEQ ID NO: 6872814 - DNA, 65 bp, Homo sapiens
accctcattgtggggaatgtaacactattgctgctatatgcataaatggctttcattcctagggt

SEQ ID NO: 6872815 - DNA, 96 bp, Homo sapiens
acagcactcaacagggcagcctaggatgcgttttgtgtgcaaagatgtatagattcacttgtacaacacatattctacagtgcctttgggagttgt

SEQ ID NO: 6872816 - DNA, 62 bp, Homo sapiens
tttaatagagaatgagactgaggtatgagaaacagtttggtatttcagcattctcagttaaa

SEQ ID NO: 6872817 - DNA, 66 bp, Homo sapiens
atagttacagatccttcgttagttgaatttggagtaactccaagctactgaaggtttgggttctat

SEQ ID NO: 6872818 - DNA, 69 bp, Homo sapiens
ggaacatggagtaagccaagttagaagagataaagaacattttctggcttatcctaactctaactttcc

SEQ ID NO: 6872819 - DNA, 78 bp, Homo sapiens
ctcctaactcctgatttagcaccaggaaggtttaggattgaagtgcaattaatagaaggtggaatggggagtggggag

SEQ ID NO: 6872820 - DNA, 60 bp, Homo sapiens
agggcatggggccctctgacttatgtattcctttacttggagactcagtttctatgctct

SEQ ID NO: 6872821 - DNA, 84 bp, Homo sapiens
aataaaacttattttaagccaggggttggtatgctatgacctgcaggccaggctggcccacctcttgtctttttaagttttatt

SEQ ID NO: 6872822 - DNA, 64 bp, Homo sapiens
aagaagattctgcttaccatttgatctgcagatttgtaggttccttatctgagctgagcttctt

SEQ ID NO: 6872823 - DNA, 59 bp, Homo sapiens
tcctaacttggctgtaaaatcagaggcttggcatagccttagatgtaaataccaaggga

SEQ ID NO: 6872824 - DNA, 85 bp, Homo sapiens
gtaaactttctacattgatgtaaactttgatttcatgtaaactttctacattgatccaaaatttgaatctgtgaggaaggttggc

SEQ ID NO: 6872825 - DNA, 75 bp, Homo sapiens
tgggtatatcctgctcacagcgtgatgaatgtagcgttatcatcagtaatgtaattattaacacctgtgctccca

SEQ ID NO: 6872826 - DNA, 72 bp, Homo sapiens
ctgtaatcatctgcatgacttgattctttatttcagtaatatgaaaattgtcaaattatggatgaattatgg

SEQ ID NO: 6872827 - DNA, 83 bp, Homo sapiens
tttcccctgatgacttgagtaaagacattagattaacgtacatctgcttttatttgtgtgtgtgtaatgtcttttagggggaa

SEQ ID NO: 6872828 - DNA, 129 bp, Homo sapiens
aagcagagaaaggataagtaactcattcaagacatacagacagtgagccacagaaccaacacttgaaatcaggtattttggactccagtgtctgtgttcttggctgtttgtaatactgtcttttattgt

SEQ ID NO: 6872829 - DNA, 107 bp, Homo sapiens
agccagcaagaaagcgtcttctggaatcagcctgagcacaaggccaggctttattgcttctggctgtgcggcctcgggcagagcttcagtttcttgccatcatggct

SEQ ID NO: 6872830 - DNA, 100 bp, Homo sapiens
actggaggtattggttggtgcaaaagtaattgtggttcttgccattactttcaatggcaaaaaaacacaatttcttctgcgccaacctaataactgtagt

SEQ ID NO: 6872831 - DNA, 90 bp, Homo sapiens
catcacaggattcagcttctgagcagtaatagattttattactcttattataatgcatatttagaagctgaaagagaaaagctgatgatg

SEQ ID NO: 6872832 - DNA, 85 bp, Homo sapiens
cttattaaacttttcctaggccctcaaagagcataagtgaataaagacttattcctagagcttgggagtgtgaaggtttggtgag

SEQ ID NO: 6872833 - DNA, 65 bp, Homo sapiens
gctttcctctggggccacctcttcagctcttgtcctagctgagtgaggaagcggtggaggatggc

SEQ ID NO: 6872834 - DNA, 106 bp, Homo sapiens
cagccagatcccattccccatcttcacctcatgcctccaggacctattctggcccagtgtctaggaggtgaactgaaggggaggatttccccacatattatggctg

SEQ ID NO: 6872835 - DNA, 69 bp, Homo sapiens
tctgagacttctgtagcttcaagactgagtctttaatggctgagtatggtcaagcacaggtgtttcagg

SEQ ID NO: 6872836 - DNA, 101 bp, Homo sapiens
agcaacctacccaaaccctgcacccccttcaaggctccaccacatttaagtgggaattgaggtgattgtgagggaatcagggcagaggatgggatggtgct

SEQ ID NO: 6872837 - DNA, 67 bp, Homo sapiens
cttttatgaaccataggcaagacaatacattgaactgtactttcttccaaatgcctgaggtttgaag

SEQ ID NO: 6872838 - DNA, 77 bp, Homo sapiens
gcacacaatagtcagaagactgtgccagggagtgtgtttgccctggctagctctggccagttactgctattggctgc

SEQ ID NO: 6872839 - DNA, 90 bp, Homo sapiens
aagatgtagcactagttctgactaagtcgtaattaacttcatcgggagttacatgatagcaacatagaacagaatttggctgaacatttt

SEQ ID NO: 6872840 - DNA, 86 bp, Homo sapiens
tttactctgtttatgaataaaacattttaatcagtgctgtatcaacactgatcaatttttttcatggaagtgtaatacagggtgaa

SEQ ID NO: 6872841 - DNA, 65 bp, Homo sapiens
ggggacccaggcagggggcagcacagcgccccaagggcagccagcccctctgacctctcctcccc

SEQ ID NO: 6872842 - DNA, 85 bp, Homo sapiens
cagaaaggaccacctttgcaactcccatgtgttgatgctgtatggtaacgcagtaataagctggagggtgtggaggtgctgactg

SEQ ID NO: 6872843 - DNA, 68 bp, Homo sapiens
ccacattgtagagattagaaagagagttgttactggccttttatttctcttttcatttctgaatgtgg

SEQ ID NO: 6872844 - DNA, 81 bp, Homo sapiens
gtcatgctgagccacccttgcttccctgcaggcctcctgagtcgcagcctaggaatgtagcaagaggtgagccagtgtggc

SEQ ID NO: 6872845 - DNA, 59 bp, Homo sapiens
ttgatgacacattttagaagattgcttagcaatagattcttctagtttggagttattaa

SEQ ID NO: 6872846 - DNA, 55 bp, Homo sapiens
ccatttgttttcgctaccatggcagagttgaacaactgtagtggaaaccttatgg

SEQ ID NO: 6872847 - DNA, 79 bp, Homo sapiens
gctaataccttccattttagatgtttgttatagtgcttacttttcggtactagttctcatatgaaataaggaagatggc

SEQ ID NO: 6872848 - DNA, 63 bp, Homo sapiens
ttgggatgaaaacagtgtcaggtaaggagttaagtagccttatcttggcctaagttcactgaa

SEQ ID NO: 6872849 - DNA, 88 bp, Homo sapiens
ccgccctccttcttctctcccctggccgctacgcgcagcgccgctctatgcaggccgcagcggccaaggcggggagcccggggcgcgg

SEQ ID NO: 6872850 - DNA, 74 bp, Homo sapiens
agccactcacagggcctcagttttcccatctgcacagggagaagggaaggttcagtggccctgtgagctttgct

SEQ ID NO: 6872851 - DNA, 80 bp, Homo sapiens
aggctgcttcttgtccttggcatagtgatgtataaaacaaacaaccccatcacaattttgccagacaaaagtaactgcct

SEQ ID NO: 6872852 - DNA, 88 bp, Homo sapiens
gaacaaaaggcatctttgatctctggagtaaattattcaaaatgccatagccttgcaccaaatgagttaaaattgcctagttttgttc

SEQ ID NO: 6872853 - DNA, 70 bp, Homo sapiens
gcttgttctaggagatgagctgtgaaaagcataatcaattatgttacttcttatttcttacatttcaagt

SEQ ID NO: 6872854 - DNA, 58 bp, Homo sapiens
gagtccagccctgttctagtaaaatattacttacaaaagcaggcagtgggctggattt

SEQ ID NO: 6872855 - DNA, 78 bp, Homo sapiens
gactttgaaccttaattagtgttgtccattgccctccaaaaagccagtgccagcagtgttaatgcgagtgttcatatc

SEQ ID NO: 6872856 - DNA, 64 bp, Homo sapiens
tcttactctaagtgcccctcttgacccaaactaagtgtcaagcaaaagggagttttagggaagg

SEQ ID NO: 6872857 - DNA, 65 bp, Homo sapiens
ttgtgctaaataagtggaatagacaccttgcatttacaatggactgtctattttatttggcgtgg

SEQ ID NO: 6872858 - DNA, 84 bp, Homo sapiens
gggctcggctccacgcaggcaccacggctcaggtctcctgtccccagaggctgtgggaatggctgcttgcttggttatgagttc

SEQ ID NO: 6872859 - DNA, 60 bp, Homo sapiens
tcttccctcttctgccaaatacatctctctccatgggaagagacaggtaaagatggaagg

SEQ ID NO: 6872860 - DNA, 57 bp, Homo sapiens
gccctctctttgattttcttctctagagcctagtagcttatagccaaagagaggtgc

SEQ ID NO: 6872861 - DNA, 130 bp, Homo sapiens
attaataattgctagaggctccctgagcacattaacaatttccatgtccaaaaattagttttaacctgtaacagtacttttggatttgtgaaagattgtgtgtggtagaagcattgaggtttgttatttt

SEQ ID NO: 6872862 - DNA, 65 bp, Homo sapiens
tatcagaaactctggggcaggggcacagtaatctgctttaataaattctccaggtaattctgata

SEQ ID NO: 6872863 - DNA, 60 bp, Homo sapiens
ttcagagatgatccctgagtttcatagtatcatatagaaattcagtccttcaactctgag

SEQ ID NO: 6872864 - DNA, 63 bp, Homo sapiens
gtggcagtcatcaaggacagattccacattcccccatttctttgtgatttgatgatctgtcat

SEQ ID NO: 6872865 - DNA, 63 bp, Homo sapiens
gtggaggtcccgggcaggagcagacaaagcccctcgtaggcagcaccaggcctggctctccac

SEQ ID NO: 6872866 - DNA, 77 bp, Homo sapiens
cctctgaaagatggtgctgggacagagcagtagggtggcagagggggggccggctctgcccaggaccgtccttgagg

SEQ ID NO: 6872867 - DNA, 81 bp, Homo sapiens
aattgtatatggttcaacctaatacagcagaaagaaattcccacattctttctgctgtattaggttgaactgcataaaatt

SEQ ID NO: 6872868 - DNA, 58 bp, Homo sapiens
agcaaggattatcctgggaagggagcttaactacctctaaatccaggatgctttttct

SEQ ID NO: 6872869 - DNA, 64 bp, Homo sapiens
ggctgctggccagcctaggagtgggtcccctcaggtcagacacaccctgggcaggtcagcagcc

SEQ ID NO: 6872870 - DNA, 63 bp, Homo sapiens
acattatgatgcaacttggcaactgtaataaacagagagtgccatcctgtgtcatgctcatgt

SEQ ID NO: 6872871 - DNA, 56 bp, Homo sapiens
atgttcctcattcttgcaaccccagcactttaggggaagccagaaagtgagaatat

SEQ ID NO: 6872872 - DNA, 57 bp, Homo sapiens
tcagaggcttctggccagtctgtttggggacaattgcctgagatatgaggcctttgg

SEQ ID NO: 6872873 - DNA, 58 bp, Homo sapiens
gacatagtctctgtcttcatggagtttttgatctaataatggagattgagatgtgatc

SEQ ID NO: 6872874 - DNA, 85 bp, Homo sapiens
tcatgcttaagatattaatgacatgtgagaggaatgacctgaaagacaagcttctgttcacattttatctattttaagtcaatga

SEQ ID NO: 6872875 - DNA, 94 bp, Homo sapiens
tatatttctatctctatatgttactctttcaagcagagataatctgttcatagtagtgtatatgtagagaggacaaggactttatagacatata

SEQ ID NO: 6872876 - DNA, 73 bp, Homo sapiens
gcagtaatgaggagcccagcaccatcacttgggtaatagagaacaagtggggaacctggacttctacctctgc

SEQ ID NO: 6872877 - DNA, 80 bp, Homo sapiens
agtgcactactgtgatacatagccagtgcactatggcaatacatagccagtgcactactgtgatacacagccagtgcact

SEQ ID NO: 6872878 - DNA, 74 bp, Homo sapiens
aagattcccacagtttctgatgtgtgtgtttatagtcttcaatgtatgttaacatgttaggaactgagtatctt

SEQ ID NO: 6872879 - DNA, 62 bp, Homo sapiens
gcctgtgtccttcccagtggggcactgcaggcagctccccaattggcaagggcactcgaggt

SEQ ID NO: 6872880 - DNA, 64 bp, Homo sapiens
agcaagattgaggcttcctcagcttttggatcgacaatcgacagctgagaggctattttttgct

SEQ ID NO: 6872881 - DNA, 57 bp, Homo sapiens
ataagaacaagatgttcctgttttgtggtaaggaaaacaggatgttcttgtttttgt

SEQ ID NO: 6872882 - DNA, 78 bp, Homo sapiens
taagccacacagtctgtggtactttgttatggcagcccaagctgagtaagacaaatactatttcaagaaagtgactta

SEQ ID NO: 6872883 - DNA, 106 bp, Homo sapiens
ttaagacattgaaagagagagtgctattattaatgtggggctttgggatagtttcctcaaaatgtaaacacaagtaactggcttctttttgttcttacagtcttaa

SEQ ID NO: 6872884 - DNA, 63 bp, Homo sapiens
ctacccaattctgcctttgtactgtgaaagcagccatcactgtacataaaggaataggtgtag

SEQ ID NO: 6872885 - DNA, 64 bp, Homo sapiens
tgtggagattgagatggttcacatgtgtttcaggatgtcatttgaaccactcagaactcattca

SEQ ID NO: 6872886 - DNA, 64 bp, Homo sapiens
gcgcaggtgatgcgtctgccttggcctcccaaagtgctgggattacaggcgtcagccaccgcgc

SEQ ID NO: 6872887 - DNA, 62 bp, Homo sapiens
gattctggggagtcaaagagacctgagctcaaattcagactttgccatttactctccgtgtc

SEQ ID NO: 6872888 - DNA, 63 bp, Homo sapiens
accatttactttggaaaagcataccaaggagaaagcttcatcctttgtctttgcatagatggt

SEQ ID NO: 6872889 - DNA, 70 bp, Homo sapiens
taagttcatctcacagataggcagtttcaaatactctgtacttggaaactgtttcttgaaatagaacttg

SEQ ID NO: 6872890 - DNA, 69 bp, Homo sapiens
gtgccctgtttactggagaagatgacctgtgggtagttccatatttaagctagtgaaaagaattggtac

SEQ ID NO: 6872891 - DNA, 58 bp, Homo sapiens
tcctgagaaggagtttccatggccttgctttagtatttaacaaacttcattctcagga

SEQ ID NO: 6872892 - DNA, 62 bp, Homo sapiens
caccacatgtgctcttctttcagtttaggcataccagcgcagctgcagaagacacagtggtg

SEQ ID NO: 6872893 - DNA, 114 bp, Homo sapiens
tgcgactgtaagaaaataacgtggtgctgccttgtgctgcctttcattctaaatggattttgggtgacaaggtttaacagagtagaatcacaggaatgattttctaatttctca

SEQ ID NO: 6872894 - DNA, 83 bp, Homo sapiens
catggcagttccaaatgattgatagtggctacctttcttgcaggaagaaattgtgctgtgatcaattactgatgctcgctatg

SEQ ID NO: 6872895 - DNA, 77 bp, Homo sapiens
ccttaaaacttggatatggtgagagcctgaagtgaacaaagtacagatgctggagctaccttatcagagtggtaagg

SEQ ID NO: 6872896 - DNA, 58 bp, Homo sapiens
gcctctgctgacaagatggacagcaatgtgtgtgcatctttcaacaatgcagacttgc

SEQ ID NO: 6872897 - DNA, 57 bp, Homo sapiens
cggcttagcaactgaagacagatttcattggctggctgtctgcagacttgcttgttg

SEQ ID NO: 6872898 - DNA, 99 bp, Homo sapiens
ttataccaaattaaatgttgaatgttttagtccatccaggctgctataacaaaataccacagtctgggaggcttataaacagaaatttatttgtcatag

SEQ ID NO: 6872899 - DNA, 64 bp, Homo sapiens
tggagcaaacccatggctgtgctgtctgtcatgtgtccttttaagacatagccaggaaactcca

SEQ ID NO: 6872900 - DNA, 63 bp, Homo sapiens
tcagtgggctattgagaatgaagaaatgattcactgttctttttgtagtccaagttcagctga

SEQ ID NO: 6872901 - DNA, 94 bp, Homo sapiens
tgtgagacaagggtggccgggtgctctggaggtgctggggtggtcccctcacggcccctctgagcttactctgtcttccacactttgttgagca

SEQ ID NO: 6872902 - DNA, 59 bp, Homo sapiens
ttgagaggtcattaggccatgaggatgcagacctcatgaattagattagtgccttacag

SEQ ID NO: 6872903 - DNA, 65 bp, Homo sapiens
tgttacttatctcacgtgatgcaagtaaaaatctctgttatcatgacatctgagtttaagtaaca

SEQ ID NO: 6872904 - DNA, 55 bp, Homo sapiens
agtggtctgcctgcctcagcctcctaaagtgctgggattacaggcatgagccact

SEQ ID NO: 6872905 - DNA, 60 bp, Homo sapiens
ggaaaaggatgcagggacccaaggctttttaagtgtaactagtctgcctgctccttctcc

SEQ ID NO: 6872906 - DNA, 77 bp, Homo sapiens
actgggttagtcacaaatagctatattaaggatgtttttcacattttttaaacactagcaatttggacccacccagt

SEQ ID NO: 6872907 - DNA, 73 bp, Homo sapiens
gttaaaaatgcagatccctgaatctcaccccaaacttttaaatatgggtgggcctggacatctgtattttaac

SEQ ID NO: 6872908 - DNA, 98 bp, Homo sapiens
gaaaatttactaataagtattgggccacattcaaagctgtcctgggctgcatgcagcccttgggccacggatgggactagcttgttctagatattttc

SEQ ID NO: 6872909 - DNA, 95 bp, Homo sapiens
gttacgtctagtctctgaggtggacatgtaaaggctcaaggtctccgatttcctgcgacggccttctcttttgatgtccaaatcaagatatgaac

SEQ ID NO: 6872910 - DNA, 64 bp, Homo sapiens
aatcttttctaggaacaagtacatggctgctttgacattatgtctgcttggttttggaatgatt

SEQ ID NO: 6872911 - DNA, 71 bp, Homo sapiens
gtggatagaatttacagggaatattttggcttcttatgaagaagcactcccaagtaaatggacttatccac

SEQ ID NO: 6872912 - DNA, 70 bp, Homo sapiens
gtattcatgaacgaacatatgtataaatataaacattcaggtaattatgtgtatgttcattcatgcatgc

SEQ ID NO: 6872913 - DNA, 64 bp, Homo sapiens
cttggccttcggagtggccatgctccatccctcgtctttctgtgtggcctctgtagaggccaag

SEQ ID NO: 6872914 - DNA, 69 bp, Homo sapiens
taacagatactttcatcactcaccaggtgattgtcatgattaactgctcagaggaaggaatgtctgttg

SEQ ID NO: 6872915 - DNA, 63 bp, Homo sapiens
tttggatttacaggctagggagggacagagtgataaaattactgcttccaactgtgatctaga

SEQ ID NO: 6872916 - DNA, 67 bp, Homo sapiens
ctcttagatttccctcttgtatttgcatgcaggcgagcatagcaaattgactgggggaagggaagag

SEQ ID NO: 6872917 - DNA, 73 bp, Homo sapiens
ttttgtttcactaattgttgagactgtgatgcataaatggttccaaatttcagcaattggaatttagacaaga

SEQ ID NO: 6872918 - DNA, 79 bp, Homo sapiens
aaaagagcaacactatcggattatttatattactcaagagacaatatatatgaattcttatgaaagtgcttgagctttt

SEQ ID NO: 6872919 - DNA, 84 bp, Homo sapiens
agaagcactgctgggagctgtcaggagcgtgtttcagaagtaaagggacttggcaggcagttgcagttttctagagtggtttct

SEQ ID NO: 6872920 - DNA, 65 bp, Homo sapiens
cctcagtccacgcagcctcctgaggcctggaaaatgggggctcagagagacttgcggggctgggg

SEQ ID NO: 6872921 - DNA, 70 bp, Homo sapiens
gcgggagggggctctgccaacctgtccccatccctttgttcctttggacagctctgagcacccctccagc

SEQ ID NO: 6872922 - DNA, 65 bp, Homo sapiens
ggaggttcagaggtgcatggacactctgtggatgatgacttatgagatgtaccatttgaagttct

SEQ ID NO: 6872923 - DNA, 127 bp, Homo sapiens
tttaatagaactctgtgcatttcttgggacaccaaaggaatgttttgactctagtcatagaagtgaagtgttttttatatctatctagttatacgtatgaggtgtccccagtgtttctgttagtgga

SEQ ID NO: 6872924 - DNA, 58 bp, Homo sapiens
tccagcaggttggtcaggtgcaggctttcagctcaacctggctgctcaacctgcaggg

SEQ ID NO: 6872925 - DNA, 60 bp, Homo sapiens
ccaaagtccatagtttactttaagggtcactcttggtgatgtatattctatggattttgg

SEQ ID NO: 6872926 - DNA, 76 bp, Homo sapiens
ggcactgcatggtgtaatttgctcagcatttttgaactcagactgactagacttacaacagagcagaagcagtgct

SEQ ID NO: 6872927 - DNA, 71 bp, Homo sapiens
gaatcccgccttgcaaatagacacttccttctctagtctgggtaggagattgtggtgcaaggaatggggtc

SEQ ID NO: 6872928 - DNA, 67 bp, Homo sapiens
gccaatgtgttttctcgctatttatcaaatcttttatactctgatgactaatggaaaatacaatggc

SEQ ID NO: 6872929 - DNA, 67 bp, Homo sapiens
tccttagcttttttgagtagtgctatattgtctcccacatttaacactgctccaaaaaaggctttga

SEQ ID NO: 6872930 - DNA, 96 bp, Homo sapiens
ttgaatcctgcctttttcagttactgtttatgtgaccttgagaagattcttagcctctctaaacctttacataacggtatgaaaaatgggaatcaa

SEQ ID NO: 6872931 - DNA, 61 bp, Homo sapiens
gactgaacctcaaatttggctctaaacttcttggcagcccaaaaaagaggtagattcagtt

SEQ ID NO: 6872932 - DNA, 78 bp, Homo sapiens
tctgatttattctccacagtaatcacacaaggtagtcatttcttgctccattttacaggtggagaagtaaggctcaga

SEQ ID NO: 6872933 - DNA, 69 bp, Homo sapiens
cagaagagaggggaactgggtgtgcatggcagttatgctatgagcacagctcagtactccctctggatg

SEQ ID NO: 6872934 - DNA, 59 bp, Homo sapiens
tggcttgctctgctgataggattccatgcttgcctggtgccctttcagaacagaagcca

SEQ ID NO: 6872935 - DNA, 62 bp, Homo sapiens
tctctttaaagttggagcttgcaaggaaatgaatataccaccttcaagaaggcttaaaggga

SEQ ID NO: 6872936 - DNA, 56 bp, Homo sapiens
gctccacactttgttctttggaattcccccagagactgaagagcatgtgtaggagc

SEQ ID NO: 6872937 - DNA, 58 bp, Homo sapiens
gcagtagccagacactcccataactcttcttgagctatcagtgtgatgaggctgctgc

SEQ ID NO: 6872938 - DNA, 118 bp, Homo sapiens
tggatgagataaatgggaaaaatgaatgggtttatggatgagtggatgagtgtgcctgatggaaaacagtaccttctgaccagttatcttgaattccttcctcttccccttctgttca

SEQ ID NO: 6872939 - DNA, 57 bp, Homo sapiens
gccctctggggaagcagccagctggggagtgctctcggcctgtgaccccgggagggc

SEQ ID NO: 6872940 - DNA, 85 bp, Homo sapiens
gtgacatgtgtctgtagcttcttgagaggccaagtcaggaggatcacttgagcctgagttcaaggctgcagtaagctatgatcgc

SEQ ID NO: 6872941 - DNA, 58 bp, Homo sapiens
gcatgcatggtttgtgactgtgggtttgtgtttttgtggtctttgtggctgtgtgtgt

SEQ ID NO: 6872942 - DNA, 57 bp, Homo sapiens
tgccctcaagcaacagagaggagctactaccaggggctcttctagcttctgagggta

SEQ ID NO: 6872943 - DNA, 86 bp, Homo sapiens
gtggtagcaaatataaaagttaaaggtataaaacaagcacatttttgtcgattttatatgtttgtacaattaagtttgccactcac

SEQ ID NO: 6872944 - DNA, 59 bp, Homo sapiens
cttcactttcatttgtaataaacttcccatgctggctgggaagttaattgaaagttagg

SEQ ID NO: 6872945 - DNA, 79 bp, Homo sapiens
atagttatttcatctctggaacataactggtctgctggcattacacccacgttactcgaagagatgaaaataaaattat

SEQ ID NO: 6872946 - DNA, 130 bp, Homo sapiens
gctccatcttgcgggccgaagcgcgagtgctgctctgtgacagcctccggccgcggccttcccagctgctaccgccgcttttcggatgggctgtgatagatggagtagcagcgaagactgctagaagagc

SEQ ID NO: 6872947 - DNA, 93 bp, Homo sapiens
caactgtgggcacatcttttgtgtggtgctcctctttgtctctgccagtgactagcagggatattatataagcagcaaatgtgctctctgttg

SEQ ID NO: 6872948 - DNA, 81 bp, Homo sapiens
tctgttataatgtttgctctgaaaatgttgactttgtttcaatacaattgatatgttagggaacaatttgagcataacaga

SEQ ID NO: 6872949 - DNA, 57 bp, Homo sapiens
cctcatcgccttcatcatctacgagtttgtcctgggagattgtatggaggtgagagg

SEQ ID NO: 6872950 - DNA, 61 bp, Homo sapiens
ttgtgcactggaattacctttatcaggggtgcactctgcacacaagtaatttcatgctcag

SEQ ID NO: 6872951 - DNA, 68 bp, Homo sapiens
gaaatccatgtgagctcagaattgctaataaaattcaatataggccattcttggagcttactgatttt

SEQ ID NO: 6872952 - DNA, 59 bp, Homo sapiens
gaggtgtctggcctttgtaggagtatctcattgaggagtctgctaaggtcagaattctc

SEQ ID NO: 6872953 - DNA, 75 bp, Homo sapiens
ccagggtgggaatttcagatcagagaccattcttctctatgagtgatccatagattaagattccttttatcttgg

SEQ ID NO: 6872954 - DNA, 91 bp, Homo sapiens
aatggatttaagcataatttgattttatagttggtgaacgtggctcaattaacttcaccaggtgtacagttagttgatcttgggctctatt

SEQ ID NO: 6872955 - DNA, 67 bp, Homo sapiens
tggtgaagacacagtattgggactaacgcccactgtagtcacacttctttctgtgtctcttccacca

SEQ ID NO: 6872956 - DNA, 74 bp, Homo sapiens
gttctaatgcccagtacctcagaatgagactgtgtttggagacagggtctttatagaggtacttaagttagaat

SEQ ID NO: 6872957 - DNA, 55 bp, Homo sapiens
gttggcttccactccccaaatggaacaatagttcctcctgagtgagagtgccagc

SEQ ID NO: 6872958 - DNA, 59 bp, Homo sapiens
cccctgagattctggcttgggactggacttggatttgtccagccagagtggcccagggg

SEQ ID NO: 6872959 - DNA, 65 bp, Homo sapiens
aattgcccttatttgagttcactgaggaacactgttgggtcaagttaggtcaagttaggtcaatt

SEQ ID NO: 6872960 - DNA, 55 bp, Homo sapiens
ctgtctctgttgcctgtaggtgaaatgatcccaacagaagaacatcggagaccag

SEQ ID NO: 6872961 - DNA, 129 bp, Homo sapiens
ggatctgcattcacagagataaggagataagacagattagtcagcaagccagtgtgcaacttggctaagttcatgcacatgaggctgtctttgtcttctggtctccagtctctctgcatctacagattc

SEQ ID NO: 6872962 - DNA, 66 bp, Homo sapiens
gttctcattctccttgcctggtggaagtccattcatcctttaagacccagccaggtggaatggaac

SEQ ID NO: 6872963 - DNA, 58 bp, Homo sapiens
tgttctatgctctttaaggtgatggccacagtttttccatagcttagagtgtaggaca

SEQ ID NO: 6872964 - DNA, 61 bp, Homo sapiens
ggtggtcaggcagtgggagagaactggagtcctcctcagttctcactgctctctgaccacc

SEQ ID NO: 6872965 - DNA, 70 bp, Homo sapiens
tgcatcaaaagaataccctgggtcataaatagcagtcattaattgcagctgcttttacacctagtatgca

SEQ ID NO: 6872966 - DNA, 66 bp, Homo sapiens
tgacagctgctcacctgtgagcccagccggctactgggctgatggccagtgaagtcaaggctgtca

SEQ ID NO: 6872967 - DNA, 104 bp, Homo sapiens
cccgccacgcctcgcgcgctgcggctcttagacccctggagccccttttttgccagagctaccggtccacggtttaaatgatcgcagcgaagatacataaaggg

SEQ ID NO: 6872968 - DNA, 74 bp, Homo sapiens
atgtggtagtctccagcattccttccatccctcacccattgtgtaggatgtggattgtaggaaactgatctcat

SEQ ID NO: 6872969 - DNA, 65 bp, Homo sapiens
tggtcagctgtatcagaaatacaatgttcatttctactgttgtttttgttctctatagcttccca

SEQ ID NO: 6872970 - DNA, 57 bp, Homo sapiens
gctctaggttcctagccaagtcagtttccttcagatgtctggctgcaatgccagggt

SEQ ID NO: 6872971 - DNA, 56 bp, Homo sapiens
gctgaagtggcgtgatcagaattattattagggctgtgaacatggccatcttctgc

SEQ ID NO: 6872972 - DNA, 93 bp, Homo sapiens
ctaacaaattaagtctctacctgcttttgactaacaggagcatctacacactgtgctttccttaataagcaggtataaggggcagtctgggag

SEQ ID NO: 6872973 - DNA, 85 bp, Homo sapiens
acagtgtggttggcccaggaggccagagggcagcaccctgtcattgtccttaccctcctgggagatcttagccaaccttttctgt

SEQ ID NO: 6872974 - DNA, 106 bp, Homo sapiens
cggctgcgacagctctcgtgtcctttgcagggggagcttggctactcctgccttgggcttaggcagagcgcagttctctctcagaaagtctagagcctcgcagctg

SEQ ID NO: 6872975 - DNA, 55 bp, Homo sapiens
tatagtcttcagtggtctatctccggtagtgaaggggagagcagggaagacagta

SEQ ID NO: 6872976 - DNA, 129 bp, Homo sapiens
tgatgcttctctaaatgtgtaattttaaaagtttttataggatatgggggaaggaggagggattcactccatttgtaccaaacaatcctagaaagccaatggggtaagcacacaagaatgaagacatgg

SEQ ID NO: 6872977 - DNA, 75 bp, Homo sapiens
ttctcccatgtggttgcctttctgtcctttgttgggactgcaatgtgaagggtaggggctgacaaacatggagaa

SEQ ID NO: 6872978 - DNA, 79 bp, Homo sapiens
tctatttgaaatatgaggcattatgagaagactgttaagttttgaaatcactcactgtcttatttttgcaagttttgga

SEQ ID NO: 6872979 - DNA, 122 bp, Homo sapiens
tggagggtccccacaagacacatcagcttcctgtctaggtagaagccaagaaacacctgctcacaaggggctttcttaggctctaaaatgacttgcagatgccatgggatgggggagcccca

SEQ ID NO: 6872980 - DNA, 64 bp, Homo sapiens
gagctgggtggttttgatgtgaattgtgggagcaatgagatcagattttggccattttgggttt

SEQ ID NO: 6872981 - DNA, 79 bp, Homo sapiens
cttatagtgttttcctcattcccttcctttttaaacagatgtttgaaaaaattggtagaggatggaagagaaatgtgag

SEQ ID NO: 6872982 - DNA, 80 bp, Homo sapiens
ggtgagaagtttgtcatctgatgtggtcagatcagagctttgtcgagtccaggccacatggatggcgatacttacaagcc

SEQ ID NO: 6872983 - DNA, 61 bp, Homo sapiens
tctagagactataatgtgtccttgaagaataatctgtaggactatatcagagtttcctgga

SEQ ID NO: 6872984 - DNA, 98 bp, Homo sapiens
agaaattacagggtcagaaggtttgaaagttcaacaggaaaaaaggtcccattacctttttaagaagcttccaggcctagcactgacatttgttttct

SEQ ID NO: 6872985 - DNA, 70 bp, Homo sapiens
ccctttcagagacagcctgggagggacagccaaggccggctgttttctcagcctgtttagtattaatggg

SEQ ID NO: 6872986 - DNA, 68 bp, Homo sapiens
gggggagcctggggaggtcccgccacccctgtgggctgagctggcgatttcttcctcatcgctctccc

SEQ ID NO: 6872987 - DNA, 60 bp, Homo sapiens
ctgcaagctggtaataagcagatataaatgatttgactctgccaatttctagttgtgcag

SEQ ID NO: 6872988 - DNA, 61 bp, Homo sapiens
ggggagggattttcccaaaataagaagcaggggattcagattctgggactccttcctcccc

SEQ ID NO: 6872989 - DNA, 55 bp, Homo sapiens
ctgacagtgatggtacaggctggaagaggctgtataagataccacactgaatcag

SEQ ID NO: 6872990 - DNA, 68 bp, Homo sapiens
aaaagaacttgatattctgagaagctgaagaacaatttgttttcctcagctaggtatttaggactttt

SEQ ID NO: 6872991 - DNA, 65 bp, Homo sapiens
tcagaatgagagactgtgtgttgggagttgggggactgcttgtgtgaaacacttctctcttctgg

SEQ ID NO: 6872992 - DNA, 76 bp, Homo sapiens
ttgagagagatcatcatcaatattccaaggtacccgtggagctgggaggctggattcatgctgggatttttctcag

SEQ ID NO: 6872993 - DNA, 71 bp, Homo sapiens
tattaggttggtgcaaaagtattgcggttttgccatttaaaaactgcaattacttttgcaccaagctagta

SEQ ID NO: 6872994 - DNA, 66 bp, Homo sapiens
gtctccgcccgccgcccgggcccacggccgctcggctgcggctcggccccgacggccggcggcggc

SEQ ID NO: 6872995 - DNA, 77 bp, Homo sapiens
ccgactgcctcagcccagttgtcagagcagacggctcttgtgtccagagctgctgagggctggagctgaggcctcgg

SEQ ID NO: 6872996 - DNA, 80 bp, Homo sapiens
tgtacacattttatatacatgctacatttgtgtaagtgttttatgtgtatatgaaaatgtacatgtgtataagtggtata

SEQ ID NO: 6872997 - DNA, 122 bp, Homo sapiens
ggaaaacaatcccccaagaccttggccttctccctgtggaggaccccttacccaccttgtcatggacgtcagggacccctctgagtggaggagtcagatagggcttggggggtgtcagggcc

SEQ ID NO: 6872998 - DNA, 68 bp, Homo sapiens
gcctgcccaaccagatcatccctctaatagccgttggagtaattgatttctgcttctagggcaaatgc

SEQ ID NO: 6872999 - DNA, 67 bp, Homo sapiens
agatggcagcagaacaaacaggaaagtcatgatcattaatgtggtctgttcttttagctgatcattt

SEQ ID NO: 6873000 - DNA, 103 bp, Homo sapiens
accaggccagaaagtgcagtgaccctggagagctgggaagcaggctagatgagctctacagtttgtccaggttactgcttggcaaaattttcaaggccatggt

SEQ ID NO: 6873001 - DNA, 73 bp, Homo sapiens
ggtgcagtctttatcccatgagtatgttagtcttcatatatcactaagtcctttgggaaaaatgactactacc

SEQ ID NO: 6873002 - DNA, 66 bp, Homo sapiens
tagcctgctaggctccaagagcgaactcagatctgccttgagaaagcagggagcctgaagacgctg

SEQ ID NO: 6873003 - DNA, 86 bp, Homo sapiens
gtgaaatggtgataatacctaacattgtgcagaggtttctgatttcagactcgaaggccctctctacatgttagacgctgtttcat

SEQ ID NO: 6873004 - DNA, 92 bp, Homo sapiens
tagatttgtcatcccagctcacatatggtaactctatcaagaaagaatatcgtattaatgtgaagtaatttagggataatattataaatcta

SEQ ID NO: 6873005 - DNA, 61 bp, Homo sapiens
acctgagacttgggatgggaatatatgtttcaatgcattcaaaactcttgagtctctaggt

SEQ ID NO: 6873006 - DNA, 72 bp, Homo sapiens
gtattcatgtcagaatctacattctactttgcaaaattagttaagagattgtatttctgagttaatgagaac

SEQ ID NO: 6873007 - DNA, 88 bp, Homo sapiens
aacatttagaccgacatgtttattattttatgtaatgtatttatatagagttggtgtgcttaaagtagtggattgttattgaaatgtt

SEQ ID NO: 6873008 - DNA, 62 bp, Homo sapiens
gatctgtgtccttataagagacaccagagttctctcttgatctactatgtgaggacacagtc

SEQ ID NO: 6873009 - DNA, 90 bp, Homo sapiens
acatttcccagacttccagtggttctggagggaggttaccttcctgcttcttcacagtagctactggcaagcacccctatatgggtttgt

SEQ ID NO: 6873010 - DNA, 65 bp, Homo sapiens
ctggaacaaaagagcaccagcagtcccctggcagcctttgctgggggtaatgtggggttctccgg

SEQ ID NO: 6873011 - DNA, 114 bp, Homo sapiens
gtttcctttgctagaaaagcccaggtgtctggacagtgagccaggtgtactcccattgttaggttcagctgccagttcctgctcttggtgctactacttgaacccagaggaagc

SEQ ID NO: 6873012 - DNA, 125 bp, Homo sapiens
gttgacgctgggtggaggttaggcccgacaggagcccaggatgggcggaggagatcctctctcccactctctgcactcctgggtcttgaccccctgcttcccaattaccaccaccaaaaacatac

SEQ ID NO: 6873013 - DNA, 68 bp, Homo sapiens
ttctgatgctgacctttacactcacatggaaaatttccaggctgtgcaattagggtaagacatttgaa

SEQ ID NO: 6873014 - DNA, 64 bp, Homo sapiens
gggcagagaggagccctagcactacccagaagctcaacaggtgctgggagccctggtctgctcc

SEQ ID NO: 6873015 - DNA, 74 bp, Homo sapiens
ggttggtgcaaaagtaattgcggttttcgccatttagaataatagcaaaaaccgcaaatatttttgcaccaacc

SEQ ID NO: 6873016 - DNA, 94 bp, Homo sapiens
tattaggttggtgcaaaagtaattgaggtttttgctattacttttaatttttgctattacttttaacctgaattacttttgcaccaacttaata

SEQ ID NO: 6873017 - DNA, 100 bp, Homo sapiens
ggaccagatactttttaaacatgctaattcccaggccccaagccagacattctgattgaattgggcaattaggcagagtggaaactagatgtctgtgttt

SEQ ID NO: 6873018 - DNA, 67 bp, Homo sapiens
gttctgtagtcatagagcaattcatactgagtcaaaatgctcagcttctgttccacatgatcagaac

SEQ ID NO: 6873019 - DNA, 74 bp, Homo sapiens
tgggtcggtgcaaaagtaatcacagtttttagcattataatggcaaaaactgcgattacttttgcaacaaccca

SEQ ID NO: 6873020 - DNA, 84 bp, Homo sapiens
tccctctggtggctttttctccctctagtgctgggagctctccatgcagatggtggatggagaaagagaacaaaaagtggggga

SEQ ID NO: 6873021 - DNA, 60 bp, Homo sapiens
tagccacaggagcgagctgaaatctcattatggttttgatttgcacttccctgatggtta

SEQ ID NO: 6873022 - DNA, 61 bp, Homo sapiens
gaggcaagcccagtgggtctaaacgcagtggtctgaggtagatcgggtgggctttcacctc

SEQ ID NO: 6873023 - DNA, 78 bp, Homo sapiens
ccacccaattagcagtaacagaatatcctttgcatataaaaagtgcaaaaaatgcttgttgcttagttggctgggtgg

SEQ ID NO: 6873024 - DNA, 87 bp, Homo sapiens
tggccacctagtaatcttgcttattgtttctaatagacgagatcatctttggtgtcttagagaggaaagcaagtgctctaggagcca

SEQ ID NO: 6873025 - DNA, 57 bp, Homo sapiens
catgagctcttctcttggatccaggattcaaacatccatcttgggacagggcacatg

SEQ ID NO: 6873026 - DNA, 99 bp, Homo sapiens
gccactgaccttcacagaattgtcttgactggaggtagcaagaatgtgctcgctgtctgggtgccagtccaggccatggattttggagaggtgggcggc

SEQ ID NO: 6873027 - DNA, 91 bp, Homo sapiens
tagctggggtggagtgtgggttcccaagggggcagggggcactgagagtgggaggcctcaggcctagggagccacaccaggccacatgctg

SEQ ID NO: 6873028 - DNA, 84 bp, Homo sapiens
gcattttcccaaatgaggaatgtttggcatctcacttaaaccgtggcgtccagcagtcacaggaaatgctgccttatttggtgc

SEQ ID NO: 6873029 - DNA, 107 bp, Homo sapiens
atttccatcttaattaatccacaatatcctgaccagtaaactaatcttccattatcaaatttcgaccaaagattgcgacttttctggtaagggtgccaagaagaaat

SEQ ID NO: 6873030 - DNA, 105 bp, Homo sapiens
cctgctgagactgctgggccaccccagcgcatatggtctgcggggcttacttgattcccttagcttcccagccaaggtgctggtgttgccagcagtgctggcagg

SEQ ID NO: 6873031 - DNA, 69 bp, Homo sapiens
tctcactccaaaccccaggcttgtacaaacagatcatcatcatataagttctcagggtttggagtcaga

SEQ ID NO: 6873032 - DNA, 71 bp, Homo sapiens
ttccatgcagggactagagaacaggaagagcaacagtagtcctcttgttctaccctatccactacatggga

SEQ ID NO: 6873033 - DNA, 64 bp, Homo sapiens
gaagaaaagttgtcatgccctgtttataagctaagaagaacagtaagtgtctccacttttcttc

SEQ ID NO: 6873034 - DNA, 61 bp, Homo sapiens
gagaacagagcaggtggaggagtattatcaccgatggccctgctaccacttttctaatttt

SEQ ID NO: 6873035 - DNA, 55 bp, Homo sapiens
tccaagtcttccttcccaaacctttgtcatttagggattgagaagctgagttggg

SEQ ID NO: 6873036 - DNA, 58 bp, Homo sapiens
acccaggctagggtgcagtggcacgatcttggctcactgcagcctccgcctgccgggt

SEQ ID NO: 6873037 - DNA, 80 bp, Homo sapiens
ttctcttgtcatacagatggctctcttcttggtggtgccccagcccaccctcaagggtgtctataagtaggagaagagaa

SEQ ID NO: 6873038 - DNA, 72 bp, Homo sapiens
tggtgcatgcctggtatgaagcaaggaaggagtgagctgaggaatcttccaaggccagacagggcagtacca

SEQ ID NO: 6873039 - DNA, 87 bp, Homo sapiens
agtactgctggagagaaatgacaaagctaaacttttggatgacacacaatttcatggtttgttatctcagctccaccaagcagtcct

SEQ ID NO: 6873040 - DNA, 78 bp, Homo sapiens
atagatgggattgtgaattgagagtacttctctcatcttcagagagaggtccatgtctcaattcttaacactatttgt

SEQ ID NO: 6873041 - DNA, 77 bp, Homo sapiens
accatagtcaaggcacgttagtaggtattattagtgaaaggcactttatttactgtgcagctgtgctttggggtggt

SEQ ID NO: 6873042 - DNA, 63 bp, Homo sapiens
agcgagggggctagcgcagtgcccagctcgctgggtgacctcgggcacggctcgtcccctcct

SEQ ID NO: 6873043 - DNA, 75 bp, Homo sapiens
tggtgtacagaagtcactttcagaggaaaaagctccttgtagagtgaagcctgctgaaagtggccggctgaccca

SEQ ID NO: 6873044 - DNA, 58 bp, Homo sapiens
acccaggctggagtgcagtgatgcaatctcggctcactgcaacctccacctcctgggt

SEQ ID NO: 6873045 - DNA, 55 bp, Homo sapiens
gcctcaggtgcatctctcattccaagtgtctggaaggagtaactgaatcagaggc

SEQ ID NO: 6873046 - DNA, 129 bp, Homo sapiens
ttcgggtaaagggggagtatttgtgtgggcatggctccatagcttcgtttagtatcagccctaaacttttgtggggaggagtctttcaatgagcccggggccatagtcacgcactcttcccaacccgga

SEQ ID NO: 6873047 - DNA, 77 bp, Homo sapiens
gacaaattgaagaacataatagctacttgtagtatattgacataagtgattctgatgtgtttctttaataatatgtc

SEQ ID NO: 6873048 - DNA, 83 bp, Homo sapiens
gtgtcgccagcctctggccctagactgcttcatcactccccatcttatattatgaacagctttgtgctcagatttgtggacac

SEQ ID NO: 6873049 - DNA, 82 bp, Homo sapiens
agttttagggtacatgcgcacaatgtgcaggtcagttacatatgtatacatgtgccatgttggtgtgctgcacccattaact

SEQ ID NO: 6873050 - DNA, 130 bp, Homo sapiens
ccccatgcccagtatactcttagagcagagaggaggtctggaggagacaagggcctaaggcttcacccttgctcacttggaactaggcattcttgctgtcatctggtttagtcaagggggttgtgaggcg

SEQ ID NO: 6873051 - DNA, 62 bp, Homo sapiens
tcaaggaggatgagattccagggtcaattgttatcattaacaagaccatcttgtcgttctga

SEQ ID NO: 6873052 - DNA, 77 bp, Homo sapiens
aggggaattccaggaggaaagtttgggtgtttagcgtctcatgtctgcctggagcttttccatcctggaaacctgct

SEQ ID NO: 6873053 - DNA, 74 bp, Homo sapiens
ggttatattgtcctgcagatggtaatatgttgcagatacttatcttcaaattaccacatttgcttatgtttacc

SEQ ID NO: 6873054 - DNA, 56 bp, Homo sapiens
ccaatgagacagaaagagcctcctaggaggagacagtgtcttgaatgtcccattgg

SEQ ID NO: 6873055 - DNA, 71 bp, Homo sapiens
ttcttccttctttgctccttctttctacccccagtctccctggggtgggatctgtggagcctcaggaagaa

SEQ ID NO: 6873056 - DNA, 62 bp, Homo sapiens
agatttgtgttgttttaagctgttaagtttgcagtaacttgttacagcagcaatagaaaact

SEQ ID NO: 6873057 - DNA, 112 bp, Homo sapiens
ggacaatgcaatgtgactcagaaaatctgtttattcatcctgtttcaccaattcctagttgggtgtcatggggaaaataacagacttctcaggagttaagttttctttgtcc

SEQ ID NO: 6873058 - DNA, 71 bp, Homo sapiens
caggcaacatagcgagacactgtgtctacaaaaatatttaaaaattagccaagtgcagtgctgtgtacctg

SEQ ID NO: 6873059 - DNA, 98 bp, Homo sapiens
agcttcggtggtgactgcatccctcacatccgaggagggtgagatgctcgccggccagcattcccttcttaggatgggtcaccgccatcggtgaagct

SEQ ID NO: 6873060 - DNA, 64 bp, Homo sapiens
tgacgttgtagcgtgaaaacagccatagacaacaaatgaatgagtgtggccatgttccaactca

SEQ ID NO: 6873061 - DNA, 55 bp, Homo sapiens
tgtggcagaactgggactcaaacttggagtgccttgggtttcattttctagccca

SEQ ID NO: 6873062 - DNA, 64 bp, Homo sapiens
tcaaggctttgtgctgagttgtcgtttgaaccaagcatgatgttatcaagcacaaagcacgtgg

SEQ ID NO: 6873063 - DNA, 58 bp, Homo sapiens
tgaagctagaatgtccatatttaatcaagggatgagtgaacaggaaaagctggcttca

SEQ ID NO: 6873064 - DNA, 69 bp, Homo sapiens
cataatgagctgtgggattccagaggatgtagatctccacgaaccctctgactccacacttgaactgtg

SEQ ID NO: 6873065 - DNA, 73 bp, Homo sapiens
cgattctgcagttctttggcttttagaatttctgcttcagaattccgtaaggctgaagatgctgcacactttg

SEQ ID NO: 6873066 - DNA, 59 bp, Homo sapiens
ccaactgtacctcaaactctggaacctgattaaggaccagatcgctgatgtgcacttgg

SEQ ID NO: 6873067 - DNA, 79 bp, Homo sapiens
cattccaagtatatacatgatatgagtgtatttcctgactccctttttgatggtatcatgtgactaggtttggccaatg

SEQ ID NO: 6873068 - DNA, 80 bp, Homo sapiens
cacaggttgttggggaaggtgggagaatgtaagtgtggtctgcagacgtcaacatggtcactcttccttgtgtacctgtg

SEQ ID NO: 6873069 - DNA, 55 bp, Homo sapiens
ccctttcctctgacttcttgtctgtaacaagacactggtgttgatttggaagggg

SEQ ID NO: 6873070 - DNA, 64 bp, Homo sapiens
acataaaggtgactaacatcttgagacatatgcctttgtcgccaagatttaataatcttcatgt

SEQ ID NO: 6873071 - DNA, 60 bp, Homo sapiens
cctagggatgctggttcaaagtgaagatccttgtctacacaactaatcagaatctctagg

SEQ ID NO: 6873072 - DNA, 88 bp, Homo sapiens
agtttcaggtagcatctctccaggaagccctccctgactcattcaggctgagctaggtgatagcttcctgggagctatcctagggatt

SEQ ID NO: 6873073 - DNA, 73 bp, Homo sapiens
caccaatggacttacttaactagacgctctgggagggggatacagaaatctggttcagtaagtcctccaggtg

SEQ ID NO: 6873074 - DNA, 73 bp, Homo sapiens
ggggcgtaggaactggccacaactagcccaggaccgcaggtcctctacttgccgttgggcctccctgggcccc

SEQ ID NO: 6873075 - DNA, 57 bp, Homo sapiens
gcaactgaatcattttgcattcccagcaggaatgtacaagggttccagtttttctgc

SEQ ID NO: 6873076 - DNA, 64 bp, Homo sapiens
ggctatagtgtctctagatcaaagacagaggatttcctcctcactctggagtccgctaccagct

SEQ ID NO: 6873077 - DNA, 71 bp, Homo sapiens
catttagtatgcatttgacgggatatattttatggttctatgaagtcctgccagcaaatgtataagcaatg

SEQ ID NO: 6873078 - DNA, 79 bp, Homo sapiens
cctcattcgatctcatgcgatgctcttcacttcagggcagatcctttgacctaagcagattattgtagatgcatgaagg

SEQ ID NO: 6873079 - DNA, 57 bp, Homo sapiens
tgagggctgtcatttgacatcttagcgcagattaatttgtcagataactagctgtta

SEQ ID NO: 6873080 - DNA, 56 bp, Homo sapiens
gggatgaaagagagccaattactaacaggcaggtttcacaggctttaatttatccc

SEQ ID NO: 6873081 - DNA, 81 bp, Homo sapiens
ccgctgacaaagattcctgtgtccacgcactggcatgatccctcctgatcgtgcctttcgttgacagatcctggaagacgg

SEQ ID NO: 6873082 - DNA, 70 bp, Homo sapiens
aaggagattaagatgatgaggagtggcagggagtttatgttggctgctcctttaagatatcttattcctt

SEQ ID NO: 6873083 - DNA, 60 bp, Homo sapiens
gcagagcatgacttaatctagaaaccttatcttccagaattagttaagcatgtaatctgc

SEQ ID NO: 6873084 - DNA, 60 bp, Homo sapiens
ctgaggctccagcgacacctaggcccccaggaggttagggggccaggcctggacctgcag

SEQ ID NO: 6873085 - DNA, 65 bp, Homo sapiens
ggtcaggaggttatgtcccaggtgctgaccatgattatactgctttgggagatgatctccttgct

SEQ ID NO: 6873086 - DNA, 57 bp, Homo sapiens
tcacctgctcttagcacttcttcagaggtttactctggagtgaatgaagtagtgtga

SEQ ID NO: 6873087 - DNA, 104 bp, Homo sapiens
ttgagcagatgttttgaattctctgcctggaagctgatgtttaggactggccatgactgccgttcttggcatcatttctatttggctgtgagtcgtccgcttga

SEQ ID NO: 6873088 - DNA, 78 bp, Homo sapiens
ccacatttactgagcgcctggtttatgccagatcctgtgctttgtatgatttgtgctgaacacagggttgtaatgtgg

SEQ ID NO: 6873089 - DNA, 79 bp, Homo sapiens
caacctgctctgttttttggcgccagctggtttgcttgactggaggaggccacgctaatggggccaaggtcacaggttg

SEQ ID NO: 6873090 - DNA, 89 bp, Homo sapiens
gggagtgttcataggtagctcctgttctgagagcaggatgtcaccgttccactcctgccagtctcgatgcaggtatctctgagcctccc

SEQ ID NO: 6873091 - DNA, 63 bp, Homo sapiens
tctgtggtggtggcttcatgaatctgcatgtggcagcattgcatagaaccacacacacacaga

SEQ ID NO: 6873092 - DNA, 60 bp, Homo sapiens
ggctttgggggtgtccaagaaatgtcagttgtgggaaggatttggagcatcccaaaggct

SEQ ID NO: 6873093 - DNA, 102 bp, Homo sapiens
ggaagatgacgtgctggagcttttctagagccgcagccctatgttttagtaagaaagaaaacattacagatggatctagcaaaatatttcacaatttcctcc

SEQ ID NO: 6873094 - DNA, 74 bp, Homo sapiens
tcttcaagagtcaatatgtggatatctgagtgtcaaatctggcatgcactgtatttaagtatcacttaggaaga

SEQ ID NO: 6873095 - DNA, 112 bp, Homo sapiens
gcctggatgaattaattgttatagtttccaaggagtcttaagttacattggtgttcaaacttgtttgcatgatagaaaggacacttggtgattatgatgttgttttcagagc

SEQ ID NO: 6873096 - DNA, 56 bp, Homo sapiens
gaagtgagctaggggagtttatcatgtgtgtgatccttggcttctctgtttatttc

SEQ ID NO: 6873097 - DNA, 129 bp, Homo sapiens
atctgaaaaatcacttttgtctttgcttctaaatgttttgctcccatgtggttatttaattctgcaaatggcacagggacagaatttttatgactagtaatgtgcaagtaaatgtgtgttccatctgat

SEQ ID NO: 6873098 - DNA, 76 bp, Homo sapiens
actgtaactggatggttatatgtaaggtacctctaagctgtagcaccttaggatttcccatatagctccatacagt

SEQ ID NO: 6873099 - DNA, 72 bp, Homo sapiens
tgttacaggcactgaaatgcttattaatacataatatggataaaggttagagtattaaagtgccttgaaaca

SEQ ID NO: 6873100 - DNA, 59 bp, Homo sapiens
gcctctgaagcagggagtgtctgcattaaaaatgacctgtagttctctgcttcataggt

SEQ ID NO: 6873101 - DNA, 64 bp, Homo sapiens
ttacagacaaagtgctatagggtggggacagaaaggtgagccagccatagctctatgcctgtag

SEQ ID NO: 6873102 - DNA, 77 bp, Homo sapiens
tcaagtagccaggctggaagcaaaagggggcaaattcttccttcctccaccttttgttcttttcaggctggaaatga

SEQ ID NO: 6873103 - DNA, 78 bp, Homo sapiens
ccaggtaacccatgccctgctgccatctggccggaccgggatggtccaaggagaggaggcagggcaggggcctcctgg

SEQ ID NO: 6873104 - DNA, 56 bp, Homo sapiens
tctcagaggcccgacgttctccatctggctgatcctgggagcctcgtcctctgtgg

SEQ ID NO: 6873105 - DNA, 101 bp, Homo sapiens
acctggggtggcatttggaaagtacagattcctggccaggttctgactcagaaagtttggtagattgcccagaaatctgtatacctttaaagtccccaggt

SEQ ID NO: 6873106 - DNA, 83 bp, Homo sapiens
gaggggagagtcattgttaactcccagattcatgggaattttggcatctgtgagggtttttgagcagtgattctattttgctc

SEQ ID NO: 6873107 - DNA, 55 bp, Homo sapiens
caccaataattttatatcacatcacaacacctgaggtggtagataaggattggtg

SEQ ID NO: 6873108 - DNA, 69 bp, Homo sapiens
gccacatgcatatgcatggacactcagaggttgtttattacctttgatttcaaaatatatgcttgaggc

SEQ ID NO: 6873109 - DNA, 82 bp, Homo sapiens
tttaattgttaatgccattaggaaatttattactactggtggaaatgatctccataaattacttaaggtttgactaattgaa

SEQ ID NO: 6873110 - DNA, 56 bp, Homo sapiens
ccatgaggtttaggttcctcctctacaaaatgaagatgaagatacctacctgatgg

SEQ ID NO: 6873111 - DNA, 55 bp, Homo sapiens
gattgacaattagcccttaggtgagaatgttcactttggacaagctgggtcagtt

SEQ ID NO: 6873112 - DNA, 82 bp, Homo sapiens
gattgaaatcacagggctggtttgtcgaagaaaattgtcctaatgatgggttttcggatggggaatgcagctcttttctttc

SEQ ID NO: 6873113 - DNA, 58 bp, Homo sapiens
gacttctgcctcaggggaaggtcttggttcaaatttgatcattctctcagtagaggtt

SEQ ID NO: 6873114 - DNA, 58 bp, Homo sapiens
ctgctgcttgattgcaggaagttctccccaatgtcactcctgccttagtccagagcag

SEQ ID NO: 6873115 - DNA, 58 bp, Homo sapiens
agagtgcagaggtcaaagaacaggagcttcattgttttacatcaacactctgtacttt

SEQ ID NO: 6873116 - DNA, 89 bp, Homo sapiens
gggttttggaagggctctgtcttagtttggggtggggatagttggagctgattatgtgtacctcaatctgaggcctttcctcaaaatcc

SEQ ID NO: 6873117 - DNA, 72 bp, Homo sapiens
tggaaccaacaatgcgattcccatgccccttgtgaggggtgggatgggagccatcgcatttgctggtagcca

SEQ ID NO: 6873118 - DNA, 62 bp, Homo sapiens
gcagcagcaggcgcacggccgtctggatctccgggacgtgatggtggagcgcttgttgtagt

SEQ ID NO: 6873119 - DNA, 67 bp, Homo sapiens
tccacattgcacagccagaacagtttcactaagaagactcagagatcaccagggtatgcagtgtgga

SEQ ID NO: 6873120 - DNA, 68 bp, Homo sapiens
gtctcctgatgatggtactggcatttcatatcaaagccatgcttgccagtgactgtcgctcattaggc

SEQ ID NO: 6873121 - DNA, 83 bp, Homo sapiens
attctgccatcacataggaatcaaggcactgttggacacacattgaacactccaaatgccctggttctgtgggtgagctgaat

SEQ ID NO: 6873122 - DNA, 86 bp, Homo sapiens
atttcttatcttaggatataggttcatagtgttacagcttgcagtctgtaatcttagtattaggatcatatttgaagatcagaagt

SEQ ID NO: 6873123 - DNA, 59 bp, Homo sapiens
tcagacatggggagagagacctggcctaggcctgtagagtttttaagcttcatgactgg

SEQ ID NO: 6873124 - DNA, 61 bp, Homo sapiens
cccagggcttggtggcttgtatccagttttattgttgatacagatctttaactgccctggg

SEQ ID NO: 6873125 - DNA, 58 bp, Homo sapiens
gacattatgagcatgccaaattggggcatctaatgcctagattcaaagcttataattc

SEQ ID NO: 6873126 - DNA, 60 bp, Homo sapiens
caaagcgcagaggagcctccggcacgcagatgtggattcagggcccatcctcttgtcttg

SEQ ID NO: 6873127 - DNA, 78 bp, Homo sapiens
ggctagaaatccaagatctaggtgtcaacaggtttgatttctcccaaggcctctctcttacttaggcttgttttggcc

SEQ ID NO: 6873128 - DNA, 60 bp, Homo sapiens
ggaggtcccagggggtggcgtgtgcctctttgagcacatgcaggcctatggtggggcccc

SEQ ID NO: 6873129 - DNA, 92 bp, Homo sapiens
tgtgtaaggaaagaactgttaactttttacagaaatgaagcctcgtctgcatggtttttatgccttggaaagattgattttttattactaca

SEQ ID NO: 6873130 - DNA, 76 bp, Homo sapiens
gtgcgactgcagtgcaggccccaggccaggccgctgttggcccagaggcttggcaggtgccctgcgcaagttgcac

SEQ ID NO: 6873131 - DNA, 66 bp, Homo sapiens
ttcattcttggcccgtcctcacgcaaaggcaagagagccaggtgctgggatggagccagattagag

SEQ ID NO: 6873132 - DNA, 89 bp, Homo sapiens
gcagcctcttgtgccctgatttgtggaactctcttcttgcatgatttccacttcttgcaggggtttccactaaatctaggagtgtttgc

SEQ ID NO: 6873133 - DNA, 81 bp, Homo sapiens
catagaaatatagatttactcaagagaaagggaactgaacccaatcctgccttctcccaatggtaagtcatgtgacctgtg

SEQ ID NO: 6873134 - DNA, 58 bp, Homo sapiens
ctttgagcttcaatttttggcagggaaaaaaatgacacctgtcttaattaactcagag

SEQ ID NO: 6873135 - DNA, 60 bp, Homo sapiens
gcttttcatgttgggtcttccttcttctcattgagtgaaattgaataccctgcatgaagc

SEQ ID NO: 6873136 - DNA, 65 bp, Homo sapiens
tcttgagaatgtgttttgctaagtttggtgggtattttttagcttggcattgaccattatcatga

SEQ ID NO: 6873137 - DNA, 62 bp, Homo sapiens
gcagcagtgcgggcagctacagaagctcatcggcatctccatcggcagcctgcacgggctgc

SEQ ID NO: 6873138 - DNA, 80 bp, Homo sapiens
ctcaccacttggttccaaagacagaaagcttgtgtcaaagcgacctgtcacagctttcacgatttggaacaggtgaagag

SEQ ID NO: 6873139 - DNA, 58 bp, Homo sapiens
cccttttgttggggtgtattcaagttgttttgcatgcattttttttaacaaatgaggg

SEQ ID NO: 6873140 - DNA, 65 bp, Homo sapiens
gctgaatacagcatgccttatgctacgaaattaatgctttcataaggcattttttctgtatcagt

SEQ ID NO: 6873141 - DNA, 130 bp, Homo sapiens
gtggtgctgggaggtgaaggtgttgtgtcacttgagcttggccagctctggaaagtggtagattcttcctgaaggccagtgcttgtggagctggcaggggtcagtgttgtgtgtagcgagccagtgctgc

SEQ ID NO: 6873142 - DNA, 60 bp, Homo sapiens
tgccaaataagtggaatcacacaatatagtcttttgttgtctggtttcttttatttagca

SEQ ID NO: 6873143 - DNA, 73 bp, Homo sapiens
gcagtggtcctgccagccaggtccaggtcccctcagacagaccctggatcccagaagcacagggcccaccagc

SEQ ID NO: 6873144 - DNA, 81 bp, Homo sapiens
agttagggagttagggaggatgagtggcatctgttgaacacaccagagtgctaaaatcttatctttgctgatttcctaact

SEQ ID NO: 6873145 - DNA, 57 bp, Homo sapiens
gatgatcagactccagcttaattctcaaaactcagagaagggaaggattctgtcatt

SEQ ID NO: 6873146 - DNA, 112 bp, Homo sapiens
cattgtattggaaatcaaattctttaatggtgataggctgggcagaggccaatgaagggctatttgctgtgcttattccattgtgggctcttgaatattcctaacaacaatg

SEQ ID NO: 6873147 - DNA, 81 bp, Homo sapiens
gggaataattgtaaatatctttaatgcttggaggttaagagaaacttgaactttgtagtaatggagattaaagctattctc

SEQ ID NO: 6873148 - DNA, 59 bp, Homo sapiens
tttcccatcaaatccttggagtttttgttgatgtttagagagcccacggaggtgtgaaa

SEQ ID NO: 6873149 - DNA, 66 bp, Homo sapiens
ggctttccgggaccagagctctgttgggaactgctgctgcttggacaggtgtgttcccggaaagcc

SEQ ID NO: 6873150 - DNA, 64 bp, Homo sapiens
agaggcccagcatcttgtgaagtttctagagagaaactttgtagagaatgctggcatatcctct

SEQ ID NO: 6873151 - DNA, 76 bp, Homo sapiens
gcatgatctcagcatgaactccagcagacagacaaagagtctgcagtaagttaatagtgctggtaaacatcattgc

SEQ ID NO: 6873152 - DNA, 58 bp, Homo sapiens
ggttctttttcctttcagtccttccttaattatcagtaggctgaaagtagaaagtatt

SEQ ID NO: 6873153 - DNA, 60 bp, Homo sapiens
ccagggagactagtgtggaggtcaccaaaagagcaggaagagccccaaaagtcaccctgg

SEQ ID NO: 6873154 - DNA, 58 bp, Homo sapiens
taaaggcttttacaggagtgcagggggaaaaaaatctgatcattcttggcagcttttg

SEQ ID NO: 6873155 - DNA, 58 bp, Homo sapiens
ccaacccacgaccgtcctggattcctctcactcagagaagctgaggtcaggtgggtgg

SEQ ID NO: 6873156 - DNA, 58 bp, Homo sapiens
cagttaggggctcaggctctgggcctggggcttcaggatccagctttgcctctaactg

SEQ ID NO: 6873157 - DNA, 56 bp, Homo sapiens
ttattatacacacaatgtgactggcattattctagggagcataatgtgtatattga

SEQ ID NO: 6873158 - DNA, 77 bp, Homo sapiens
ggaccaaggcagggaccagaggaatgggaggggaggcatggctggccctcactcaggtttggaccctgcctcgggcc

SEQ ID NO: 6873159 - DNA, 73 bp, Homo sapiens
agggcagcactggggctgatgcgttcgtgtgactcccaggtcagcatgcgcttgatcagctccaccatgctct

SEQ ID NO: 6873160 - DNA, 125 bp, Homo sapiens
gctggtgactgcggaggatggggtcgatatagagatgggagggttgggacaccagggtccccaggtggcagggcctgggaccagccctcctcactctgtcaggcctggggctgcaggctgccagt

SEQ ID NO: 6873161 - DNA, 63 bp, Homo sapiens
gggcagtggattagccagagctggattcaaaaactggttcctagctaagttaattaacttccc

SEQ ID NO: 6873162 - DNA, 56 bp, Homo sapiens
tactacagtttggatcctatgagggcggcgacctgcatgtcttccacactgtagta

SEQ ID NO: 6873163 - DNA, 57 bp, Homo sapiens
tgtcaggcctgaggctggatgtcaggccaaagctggctccagcccagcagcctgaca

SEQ ID NO: 6873164 - DNA, 71 bp, Homo sapiens
tccacaacagagcacatagattggagtttgtggagccaatttgagctttggctgtgttgctctgtcactga

SEQ ID NO: 6873165 - DNA, 57 bp, Homo sapiens
gtataaagacatccatagcaggctttatccagccagcttctttgggattctttatat

SEQ ID NO: 6873166 - DNA, 81 bp, Homo sapiens
ttacaaatagcgtctcctattaggctagtcaatagagatccttgaggatttattttaatgattaccaagacagacttgtaa

SEQ ID NO: 6873167 - DNA, 57 bp, Homo sapiens
cagcagggattattgaggagcttgttttatttaagagcttcttcattaaccctactg

SEQ ID NO: 6873168 - DNA, 58 bp, Homo sapiens
acagcatccttctaaagtagctgtctcagtgaaaaatcactttagggaaggttgctgt

SEQ ID NO: 6873169 - DNA, 63 bp, Homo sapiens
ggcagccagtagggccagcctgacctccaggcacaagagaggctgcttccttacgtggctgcc

SEQ ID NO: 6873170 - DNA, 60 bp, Homo sapiens
agcctcaacagggtgaagatgtaggtttgatgcaatgcctatcaaaatcctattgaggtt

SEQ ID NO: 6873171 - DNA, 61 bp, Homo sapiens
tgaagcagagaatttgacagtcatgacattatattgtgaacctttaagttttactgcttta

SEQ ID NO: 6873172 - DNA, 100 bp, Homo sapiens
ctggagtattttcttggactccttgttttgtcatttgtgcttttataaaatagaaaattatgacatatgagtacaagtaaaatgagttagtagaaaccag

SEQ ID NO: 6873173 - DNA, 75 bp, Homo sapiens
atctgctggctttagtaataagtttctcccttaaaaggtgaacgggctttgactaaagtgtaaataaacagtgat

SEQ ID NO: 6873174 - DNA, 55 bp, Homo sapiens
gttttctggcagttattccttatttcagtagggaacaaattcactgtcagaatgc

SEQ ID NO: 6873175 - DNA, 82 bp, Homo sapiens
gttttaggggatcttgggagttgtgatttggactgggtgcctctatttctcagggtccaggtcccatgtggtcctttagaac

SEQ ID NO: 6873176 - DNA, 61 bp, Homo sapiens
ctggcttcagagcccacactgttaatcactattctatatgattaacaaagtctgaagtcag

SEQ ID NO: 6873177 - DNA, 79 bp, Homo sapiens
tgaatcaaacactgtttttgattttttgtaaattatctctacagaatggtgtgcaggctatcacagacagagtgtttca

SEQ ID NO: 6873178 - DNA, 106 bp, Homo sapiens
tcccagccccgtccactgtcattcctccttgttcatcaagagctttgcctctggtagcagaaagcaggtggccacgaggaggagctgtgggacttgggtgcaggga

SEQ ID NO: 6873179 - DNA, 71 bp, Homo sapiens
tctaaaatgtatcacagcaatgtagtcactcagtgcctgccctgactgtatgaactgtgtctcattatgga

SEQ ID NO: 6873180 - DNA, 68 bp, Homo sapiens
ctggctcagcctggccctttcatgaacaaatggaaatgagtatctcaggaggggcaaggcttagccag

SEQ ID NO: 6873181 - DNA, 111 bp, Homo sapiens
gggtaagagatgtgagctttgtaccaaaaaagaactaattctgactttttccacaattttaaacaaaagccaggataaagttgttttaaagtttaaagggtacaattacct

SEQ ID NO: 6873182 - DNA, 129 bp, Homo sapiens
gttttttctttgttttacccatttggataactgagccagaggcattactgaaaaggtgagtttcctcccattgttctagaatgccaactttgtcataattcaagtgtctacaggtaattatcagttttc

SEQ ID NO: 6873183 - DNA, 71 bp, Homo sapiens
tgctgttcagaagagcctctgtgggagaacccagggtgggtgcggaggggatacattttctgaacaaagca

SEQ ID NO: 6873184 - DNA, 62 bp, Homo sapiens
gctggggaggagtggccagagcaccggccaaatcttcatgctctggggagctcctctgcggt

SEQ ID NO: 6873185 - DNA, 56 bp, Homo sapiens
tgagacagcagtcagggaaatatgacatcgaagttttgttatgactgcttgtctca

SEQ ID NO: 6873186 - DNA, 60 bp, Homo sapiens
gggtgaataagctgaacacttgggtaaataaaaatacctagggattgttcttattcattc

SEQ ID NO: 6873187 - DNA, 61 bp, Homo sapiens
atagcaggaccaggcgttctgggctgtcttcctcaaaggcagtctggatctgtgctgctgt

SEQ ID NO: 6873188 - DNA, 57 bp, Homo sapiens
tgctagctcacccttgcctcccaacagccctgtgagggcatgagagggcagctggca

SEQ ID NO: 6873189 - DNA, 69 bp, Homo sapiens
tcacacctggagtagcaaggtaattggatacacactcccaccattacctccattacctcacagtggtga

SEQ ID NO: 6873190 - DNA, 75 bp, Homo sapiens
ttgggtgactaacttgacaggacatgaggaatctcttcaagaggaatcagattttcttcaggatacgtcatccag

SEQ ID NO: 6873191 - DNA, 59 bp, Homo sapiens
attctctgagtatggttccaggatctgtagcatcagtgtccagggaacttctcaggaat

SEQ ID NO: 6873192 - DNA, 60 bp, Homo sapiens
tggtcttctgactcctgccgggctcccattggccaagcccagctggaagttagaggacca

SEQ ID NO: 6873193 - DNA, 88 bp, Homo sapiens
gggcccggacgatggcttatcctttttgtattattcacagcacctaatatctgttgtgaaattacttaaaggaaatattccctagcct

SEQ ID NO: 6873194 - DNA, 84 bp, Homo sapiens
ttctagcaaattattgagtctgacagtggtcttggtaacctcaaactataacgagtcacacaggtttgcaatgatttgttagag

SEQ ID NO: 6873195 - DNA, 73 bp, Homo sapiens
atgttcattatgactagatttagatgtgtattttgtataatgtagaggcataggacatctatgtcatgaacat

SEQ ID NO: 6873196 - DNA, 112 bp, Homo sapiens
acttagtgatccacccgcctcggcctcccaaagtgctgggattacaggcttgagccatcgctcccggctgagttgcagcattttcttgcctagggtgggcagactcacaagt

SEQ ID NO: 6873197 - DNA, 92 bp, Homo sapiens
cctttctgcctgctgtttctgagccagagctacaagtgtctgtgtgagttatgggttcttatctcttggcaattagagcagctcagcaaagg

SEQ ID NO: 6873198 - DNA, 75 bp, Homo sapiens
agtattttctgagacacagtggctgaaaagttgtaattttatgatttatcagaggctatgtttcatattgatgct

SEQ ID NO: 6873199 - DNA, 90 bp, Homo sapiens
cctgacatgttgctagaaatatcaggattattaaatctggattaatattttggctagatttaactttttggccttttagcaaagagcagg

SEQ ID NO: 6873200 - DNA, 87 bp, Homo sapiens
ttaaaaagataacagaatcctgttattgccaagaaatttgggggtaagaccatggtggcaatttaagcaggttttgttttgttttag

SEQ ID NO: 6873201 - DNA, 60 bp, Homo sapiens
acaccctgaaccaatcaccgtggccagaaacacgtggcgttctgattggctcaaggctgt

SEQ ID NO: 6873202 - DNA, 60 bp, Homo sapiens
agccatggaaagctaagccatttacctattagtataggtgcccgcaatggttttcctgct

SEQ ID NO: 6873203 - DNA, 61 bp, Homo sapiens
ggaatgtcccaccagggtatgacaggctgtagcttgcctggcaggcctgttggggctttcc

SEQ ID NO: 6873204 - DNA, 69 bp, Homo sapiens
ttctgtcagatactgtggcttatgggctagacatagtctgtgcccttggataatacagtacctgaagag

SEQ ID NO: 6873205 - DNA, 67 bp, Homo sapiens
gtgaccctctagatggaagcactgtctgttgtctaagaaaagatcgtgcatccctttagagtgttac

SEQ ID NO: 6873206 - DNA, 61 bp, Homo sapiens
atttctttactttggattctattactcattcgttagagtgtaagtctggagtaaaaggaat

SEQ ID NO: 6873207 - DNA, 65 bp, Homo sapiens
tgactagttctagccagtgaaatgtaagtgaaattgatgcatctcatttctggctgaagctttta

SEQ ID NO: 6873208 - DNA, 89 bp, Homo sapiens
tggaagtgcacaggcagccaagtcctgggcatttgaacaggaaggatgttcctcagtagctcacaaggaccctaactgctgcatttcca

SEQ ID NO: 6873209 - DNA, 59 bp, Homo sapiens
gtatgtgtgtgtttctgcatatttttaaggaaactagaagacaggaaatacaaacctac

SEQ ID NO: 6873210 - DNA, 55 bp, Homo sapiens
catcagtgtgttgccttgctcagacacctgggatgggagttgtctgccattggtg

SEQ ID NO: 6873211 - DNA, 59 bp, Homo sapiens
ccgtggtttgggctgttaagagactgatcaagtcttaggtgactctccaggccaaaagg

SEQ ID NO: 6873212 - DNA, 64 bp, Homo sapiens
ggatttattttaatgcagcctggaaacacacaactttaaatctctgggctgcttaaggagatcc

SEQ ID NO: 6873213 - DNA, 71 bp, Homo sapiens
gtgcagtctctccagctcagggagccgaacaatgaggcattttcttctctccctggctgcagagctctgac

SEQ ID NO: 6873214 - DNA, 76 bp, Homo sapiens
tgtgctggtgctaatggatggcgaattagagtgaagtggccagaccagatccctgtttgcctctggccccagctca

SEQ ID NO: 6873215 - DNA, 58 bp, Homo sapiens
attgggctggccttctggagaggccttctggcttaatccagacctagggcaccccagt

SEQ ID NO: 6873216 - DNA, 60 bp, Homo sapiens
tcctagattatccaggtaggccgactgtaattaaaaaggccataaaatgtggatgaggga

SEQ ID NO: 6873217 - DNA, 83 bp, Homo sapiens
ttgcacagatgtccagggccgggtagcttatgtaatttcaggtggaatagacaagcaccctggtaaaatggacatcttggcaa

SEQ ID NO: 6873218 - DNA, 81 bp, Homo sapiens
cccctaattgatcttcctgcaagactgagctgcccgtccaaatggcagaacagccaactgtgtaggaggagagcttaaggg

SEQ ID NO: 6873219 - DNA, 73 bp, Homo sapiens
tttcgggaaaaactggtaagacgcttggttcaaatcacttgaaaagaaaatcacttgcatagttcacctgaag

SEQ ID NO: 6873220 - DNA, 104 bp, Homo sapiens
gggcagaatttatgtgcagtttttagagttaattccattctgtagcttacatctcattgcttacagaagggaattaatgctaatccccttacattattttcccc

SEQ ID NO: 6873221 - DNA, 102 bp, Homo sapiens
tctctttccgtcctcctccctgaactctgtgcccagctccctgactgctgttttataggggaggggtctctggccaagaagcacgaggagggcacagagaga

SEQ ID NO: 6873222 - DNA, 64 bp, Homo sapiens
aagtgtatcatatctttggtggcatgtttcttaaggaacctgcccatgtttaatatatacattt

SEQ ID NO: 6873223 - DNA, 130 bp, Homo sapiens
tctgctcctgtattttctactcagatgttaggcagttttcttcattctgctgagcttcagaatctcagctgtgaaatggggatgacacaaacttcctaaggttttggtaaagacttgatgaaatgacgga

SEQ ID NO: 6873224 - DNA, 88 bp, Homo sapiens
cagagagacagtatgttgaaatagaagggacatgtgactaagatcttagtgaccccacatgtgtcctagctattctcctatttccctg

SEQ ID NO: 6873225 - DNA, 70 bp, Homo sapiens
gagatagaggctcctgatcctggggtctggagatggtgtagctcctgacccctcaggctgcttagacctc

SEQ ID NO: 6873226 - DNA, 60 bp, Homo sapiens
ctagctcatgtgaagacgtcacatccccaggttatttgtgatagatatgcacatagctgg

SEQ ID NO: 6873227 - DNA, 60 bp, Homo sapiens
aaaatgttaggcatcttctggtttcatttgccagagatttcttttgatgcctgtcttttt

SEQ ID NO: 6873228 - DNA, 68 bp, Homo sapiens
gcatttggatggaggttcaagcactaaaagaaaatgtctcttggtatgcttattatcttcaacagagc

SEQ ID NO: 6873229 - DNA, 67 bp, Homo sapiens
gcgtgttgcgtactgtttatacatgtgtgtagatacactgacagatgagagacaatgtgctacaggc

SEQ ID NO: 6873230 - DNA, 67 bp, Homo sapiens
ccaaattacactggtgatggtcagtgacaggtttcttatttcaaagccctgcctggccattccttgg

SEQ ID NO: 6873231 - DNA, 79 bp, Homo sapiens
ggagggtgctaacgtggtcacctgaattatgcatgtctattgtgttcaaatatcataaatcggtgcatgaataccctcc

SEQ ID NO: 6873232 - DNA, 78 bp, Homo sapiens
agtccacagatttgtcagggtaaattatgtaaaatgtagctgctgtacagaattaacatttgatgaatatgctggtct

SEQ ID NO: 6873233 - DNA, 72 bp, Homo sapiens
gttgccagcttgttttaaaacatatttgtactggatccaattgctacatgtttctaaaacttgcatggcaat

SEQ ID NO: 6873234 - DNA, 72 bp, Homo sapiens
tcttgagcagctggaattacaggcacgcaccactacacctggctgatttttgtaattttagtagagacaggg

SEQ ID NO: 6873235 - DNA, 106 bp, Homo sapiens
gagagaatgaagggaaatggggcaacagtcagcatgagcaagggctgacctatggtgggtcttagcctttactgtgctcagtggccccacagcaccatcgtctctc

SEQ ID NO: 6873236 - DNA, 56 bp, Homo sapiens
ggctggagtgcaatggcacgagcctctgcctcccgggttcaagccattctcctgcc

SEQ ID NO: 6873237 - DNA, 90 bp, Homo sapiens
gactggctgcagttgtttgtgaggcagaacaaattataaaatgattatggcttcagagatgtatgtttctaaatgattgcttcgccagtc

SEQ ID NO: 6873238 - DNA, 57 bp, Homo sapiens
ggctgtgtggccgtgggctctagcacctgccaggcgtcaggagacccccactacacc

SEQ ID NO: 6873239 - DNA, 83 bp, Homo sapiens
atgtgtgtgtgtgcatgtgtgtgtgcatgtgtatacatggtgtgcgtgtgtatacatgtgttcatgcatgtatgtgcatgtat

SEQ ID NO: 6873240 - DNA, 57 bp, Homo sapiens
gcagcctggatggtctgactctagagctcactctctgaatcacagtcattcagctgt

SEQ ID NO: 6873241 - DNA, 86 bp, Homo sapiens
gctctacaggttgaagatttgttgcattttaaaaagtctcaccctgatgggagaagaatgcaagataaactttattactgtaaagc

SEQ ID NO: 6873242 - DNA, 127 bp, Homo sapiens
ccagaaacccattttagacttctgactgcaaaactgtaagagaataaatgtgtggtgccttgagccaccaaatccatggtaatctgttacagcagccataggaaactaacatgggcctcattcctgg

SEQ ID NO: 6873243 - DNA, 63 bp, Homo sapiens
atttacctcagagagaccaagctttcccagaattgtctggcacctctggctctgaggctgaat

SEQ ID NO: 6873244 - DNA, 90 bp, Homo sapiens
caccaggttggtcagaagagacacagctttgagcagccagtggcaaagcattgtcatgtggcaattaaagcaggtgactaatgctggatg

SEQ ID NO: 6873245 - DNA, 121 bp, Homo sapiens
gccagttttttcagggttgctaaaggcagaatgggttctagtaactaccagaatgggtactggttttcatgctgaaagaccgtatttatctgctcttaagcctctaactgaaatggatggc

SEQ ID NO: 6873246 - DNA, 57 bp, Homo sapiens
gggtgccctgggccctgcagcccatactccttgagggcagcaggctatggggcaccc

SEQ ID NO: 6873247 - DNA, 74 bp, Homo sapiens
cagagaagaacatattttgagggtgctaaaatagtgagctatatcatctttggtaagtcaggaatgcttccctg

SEQ ID NO: 6873248 - DNA, 69 bp, Homo sapiens
ctcaagggcaggtgtgagtggacggtgaaggtggctgtcaccaggccaaaatcatatttacttcttgag

SEQ ID NO: 6873249 - DNA, 55 bp, Homo sapiens
gcaattctggaagctccattcatagactgtgatgtgaatgatgccccagagttgt

SEQ ID NO: 6873250 - DNA, 121 bp, Homo sapiens
gaaatgtcagttctcagaccacactccaatctgctgtgtcagaaactctggggatgtctcacttgcattccttgaaccactggcttggtgggtgtggaatgttgttcttactcatcatttc

SEQ ID NO: 6873251 - DNA, 60 bp, Homo sapiens
ggagggccacagtcagttttgaagcaactccagcaagtgatccaaccagctgtcccctcc

SEQ ID NO: 6873252 - DNA, 100 bp, Homo sapiens
aatgattgtgtcttagaacctaatgaaagtttgcattcctcagtaaaatcagagactgctgattgacttaaatgtttatagcttcaaagtcctcctcatt

SEQ ID NO: 6873253 - DNA, 72 bp, Homo sapiens
gcttcagtttaggggttaattgtaatgtttaaaaacagaatgacatcgtctcaggcctctagaatatggagt

SEQ ID NO: 6873254 - DNA, 57 bp, Homo sapiens
gcgtggtgctgccctgcacacaggagatgctcccaggtgctgatgggcaacactggc

SEQ ID NO: 6873255 - DNA, 77 bp, Homo sapiens
ttcaggggatatttgaggaaacttacaaggcagaaggggcagtctctttcttgtctctttttcactcagcccctgga

SEQ ID NO: 6873256 - DNA, 66 bp, Homo sapiens
gtatttctagttctagatccctgaggaatcgccacactgacttccacagtggttgaactagtttac

SEQ ID NO: 6873257 - DNA, 62 bp, Homo sapiens
gtgtccatataagaagacggagagagaccagagccgtttctctctctaccatgtgaggacac

SEQ ID NO: 6873258 - DNA, 91 bp, Homo sapiens
ggggtcatgaggaggttctgggggtctgcctggcccaggagcctggtacccgctggcttggcctttcacccagagcccccttcatggtctc

SEQ ID NO: 6873259 - DNA, 72 bp, Homo sapiens
catctttagaatttaatggtacagaaatcatagttagcttagtgattctgaaatattagaaaaatggagatg

SEQ ID NO: 6873260 - DNA, 58 bp, Homo sapiens
gggcaagcacttggcctctgagctctgcatccagtgctcactctccacagtgcccccc

SEQ ID NO: 6873261 - DNA, 57 bp, Homo sapiens
gctgtctgtctctgtcccaccactttctaggctgtgattgggtccagggattacagc

SEQ ID NO: 6873262 - DNA, 55 bp, Homo sapiens
ggtagctactagtcatatgtgcctattcagcacttgaaatgtgtctagtgcaacc

SEQ ID NO: 6873263 - DNA, 130 bp, Homo sapiens
gcgttcaggtcccaatcaatggctctgcatcttttaaatcttctacatcatcataatgtcattattgttgtcattgtagaggatttcagaagatcttttgagttccttgttagtaaagatttgtctttgc

SEQ ID NO: 6873264 - DNA, 97 bp, Homo sapiens
gacaaattatttattacaaattattaagctactttttttatcctaggcattacctgaagtacatgctgtaatgattggtgacaaatggtttttagtc

SEQ ID NO: 6873265 - DNA, 63 bp, Homo sapiens
tgtattggttacttgattttatgttctgaggttgttagggccagtattaaggtaattaataca

SEQ ID NO: 6873266 - DNA, 72 bp, Homo sapiens
cagcaaattgtaaggcagggatttaaaccaaggtaatgtggtctcagaattcctgtcttaacagttctgctg

SEQ ID NO: 6873267 - DNA, 57 bp, Homo sapiens
cagggctgctgtgtggattcaatggcttatctatgtaagtgtccagcacagtatctg

SEQ ID NO: 6873268 - DNA, 86 bp, Homo sapiens
ggtatttgagaagagtctgtgaacttggcagggaaaggctattatgcaatttccttgaatgagtcatggaaaaaccttaaattgcc

SEQ ID NO: 6873269 - DNA, 75 bp, Homo sapiens
ggtctgcatctggcctttgctggctagtggcctctgagggatggatttggtttaaggacagagagccaggtggcc

SEQ ID NO: 6873270 - DNA, 58 bp, Homo sapiens
gggtagatgggtataattctcctgtaaaacttcatttgcaggaaaacacctatcaccc

SEQ ID NO: 6873271 - DNA, 55 bp, Homo sapiens
agtgatctgcctgccttggcctcccaaagtgctgggattgcaggcatgagccact

SEQ ID NO: 6873272 - DNA, 62 bp, Homo sapiens
tattaaaccatccagagactcttccaggccatagatctgaaactgtcatgggtagtttagta

SEQ ID NO: 6873273 - DNA, 60 bp, Homo sapiens
cagactgcctggggcacaatatggctctggctgggccacatgctctctctccaggttctg

SEQ ID NO: 6873274 - DNA, 74 bp, Homo sapiens
agggaattaaaatccagtgttggtggatagagctatttctgtggcgttctcttgcctttggatttcagtttcct

SEQ ID NO: 6873275 - DNA, 84 bp, Homo sapiens
ttctttgtacattctgacttaaatagaactcctcaatagggaaacagttcttatgaggatttttctttgactttatgcagagaa

SEQ ID NO: 6873276 - DNA, 61 bp, Homo sapiens
ggcagtggcgtgatccggcaccaaatcggcccgcggtgcggtgcggagactccatgaggcc

SEQ ID NO: 6873277 - DNA, 59 bp, Homo sapiens
tcaaaggtttttatttatcctggagcccactgggcatccaagatcaattgaacctttga

SEQ ID NO: 6873278 - DNA, 64 bp, Homo sapiens
gcactgaggtttgttaactgagtggtgagctggcacacactgcagagggctcagacctgagtgc

SEQ ID NO: 6873279 - DNA, 72 bp, Homo sapiens
gacaaatgtacacaatgataaattattaagcaaaaccttgagtggtaatttacgcatttctgtaactatgtc

SEQ ID NO: 6873280 - DNA, 71 bp, Homo sapiens
tcaaaagagagtatgtaattttcaatgtgtttaataaacacgaagtatgaatttaggtactttcaaattga

SEQ ID NO: 6873281 - DNA, 93 bp, Homo sapiens
gagttaggtaggggcaggagtgtggccagggctctggtctggctctttgacagtgctcctttgattcctgtccacttctacccaagccttatc

SEQ ID NO: 6873282 - DNA, 120 bp, Homo sapiens
gattacaggttatctctgtggccaggtccaatatggtcaggctcctagactcatcccattgggctatccatggatctgaactcatatgtgtcttggacccacagggatcaatccttagtc

SEQ ID NO: 6873283 - DNA, 57 bp, Homo sapiens
ctcctcttggctgtcactgtcagttcaggttgttgcctgatgcatgcctttgagggg

SEQ ID NO: 6873284 - DNA, 56 bp, Homo sapiens
tggaagacattttggaccttgggatactgcacacttcatttccattttgtctttta

SEQ ID NO: 6873285 - DNA, 110 bp, Homo sapiens
ggtggggagggttagttgttggcaatggaccagccactggggaggtgagtggggtgagagcccccaagtcggtgggggtccgtccagaaactccatgcccctgcctcacc

SEQ ID NO: 6873286 - DNA, 61 bp, Homo sapiens
attagctaatgtggactctatcaaagttaagtttctgattttgataatcatgttagagaat

SEQ ID NO: 6873287 - DNA, 70 bp, Homo sapiens
ggttctatggcaattgtctaagttttaccacttgggagataatttagagcttagtaatttttatatggcc

SEQ ID NO: 6873288 - DNA, 57 bp, Homo sapiens
gcccagggcgatggtcggggcctaacctgccggctcggccccccccggcccttgggc

SEQ ID NO: 6873289 - DNA, 61 bp, Homo sapiens
atcaacagaagtatctttttagctccatctaaaatagagagccaggatgtcttctggggat

SEQ ID NO: 6873290 - DNA, 116 bp, Homo sapiens
cgctggtgctgagcagaagcgggcagaagtggggtctgctttcaggacttcatttcccccactcgttccggccccgcatgctccacgtctgccctttggtctgagttaaaactgcg

SEQ ID NO: 6873291 - DNA, 72 bp, Homo sapiens
catgacgactgagtcctagaagtggctttatttttccaagaagtaagaacacttaaggctttttgatacatg

SEQ ID NO: 6873292 - DNA, 112 bp, Homo sapiens
cttcacaactgctatttcacttcttgaaccacctgaggctgttagtctaggtctcaccttcactggtgagaccaaagcagaggtttcagagtggtagaggagcagcatgaag

SEQ ID NO: 6873293 - DNA, 92 bp, Homo sapiens
aactgttaatctgtaacagagatttaggagttctgtccaccaagggcaacgtgtgggcctgattcttgaatcctgatgcagacagaccagtt

SEQ ID NO: 6873294 - DNA, 58 bp, Homo sapiens
gatactttccatccaaatgcattcctactgaatgcacacggacagagtggagagagtc

SEQ ID NO: 6873295 - DNA, 61 bp, Homo sapiens
tacactaatgtttttgcaaagcctatacgtatgacaggctttgcaaaaacattagtcagtg

SEQ ID NO: 6873296 - DNA, 59 bp, Homo sapiens
tggtagcaaagagggtgaaggcaggtaaaagacctgcaagcaaatcaactctttgccca

SEQ ID NO: 6873297 - DNA, 62 bp, Homo sapiens
aaagtacagagcctcagtttgacatcttaagatggagatgacatctgtttatcttgtgcttt

SEQ ID NO: 6873298 - DNA, 88 bp, Homo sapiens
ctgacataccaagaatgttagtagcctcaaattgtagagatgagtgtgcactcacaatttgaggctactcaattgggatggtagttag

SEQ ID NO: 6873299 - DNA, 117 bp, Homo sapiens
ttcttgttttttagaagtttcccaagtgattttcatgccctgctagggtcaggaaccattgctgttactgaagcagggagtgatgaagtaggcctgtggatctttctaaatgtggaa

SEQ ID NO: 6873300 - DNA, 70 bp, Homo sapiens
ttgatgttgagtgggaagggggactttctgtttggatccaatcccagaatacccatcccttcaactccaa

SEQ ID NO: 6873301 - DNA, 71 bp, Homo sapiens
agctcattttaccttcttgtacaagaaagaagtgcatttctacatctgaagagctttgcaagagggaagtt

SEQ ID NO: 6873302 - DNA, 60 bp, Homo sapiens
tcccttggcagctcttgatggcaccccttcctggggggctggtcatgaatgcctcatgga

SEQ ID NO: 6873303 - DNA, 69 bp, Homo sapiens
agacaagagaggcaacatggggaacagatatgggtgtgtcagcattttacatgtgtcatctgcaggtct

SEQ ID NO: 6873304 - DNA, 85 bp, Homo sapiens
gaaggatggagaagcacaaaacacattttgacaatgtgctggtgtttgcagctggaaacttggcgcatgtcagatcccatccttc

SEQ ID NO: 6873305 - DNA, 59 bp, Homo sapiens
gaactgcattgtggtatatgttgggattggtccaattccaatcacagggtgcttagttc

SEQ ID NO: 6873306 - DNA, 61 bp, Homo sapiens
ccagaagctgcagtgatctgggagcacacgcagtgatctgggagcacacgcagtgatctgg

SEQ ID NO: 6873307 - DNA, 65 bp, Homo sapiens
tctaacttgtaaaatagagtgtacatagttcaatacataatgtgtatgctttcattacagggtga

SEQ ID NO: 6873308 - DNA, 75 bp, Homo sapiens
gagtgcatcctaaatgtgatctgtcatgatggcaagaacaatattgatgattgttattatgccagattttgcctc

SEQ ID NO: 6873309 - DNA, 65 bp, Homo sapiens
tgcatttttatgcggcagtgcaatagaatttgaattttatgcacaattagtcttatattgatgta

SEQ ID NO: 6873310 - DNA, 85 bp, Homo sapiens
ctcacccattggctgttttataggtcagttaagtgtgcttagctaatgtactgagacttaaaagcaagcccaagaatagggtggg

SEQ ID NO: 6873311 - DNA, 61 bp, Homo sapiens
agtgaggcttccaacatgtgagaacaaaagtaaactcataattttggtgggcacgttcact

SEQ ID NO: 6873312 - DNA, 56 bp, Homo sapiens
ctaggctctgccagcactgtcgctgcccacagtgagggtgcaggtgtggagtctag

SEQ ID NO: 6873313 - DNA, 77 bp, Homo sapiens
tgtaaatgtttctctagcagatcataatgaaaaagtgaaattgctggttcatagtgattgttcagatagatattaca

SEQ ID NO: 6873314 - DNA, 80 bp, Homo sapiens
gtttacagaaaagtgttaacatcttggactcgtgaagcaatgttttcacacattctaggtatgttgacctaatatgaaac

SEQ ID NO: 6873315 - DNA, 83 bp, Homo sapiens
tcagccttagtcaacaagtgtattaatggaaatactatggctcagtatgttccacattggtaaacttgacagaaatagcctga

SEQ ID NO: 6873316 - DNA, 84 bp, Homo sapiens
tttttacacatggcatgagacaagagtctaaattcatattttttgcatgtggatattcaattgtgtcagagccatttgttgaaa

SEQ ID NO: 6873317 - DNA, 65 bp, Homo sapiens
ggtagaaacaaccttgacccttagtcgggtgaacagcttgctcacctggcaggagcgagtctacc

SEQ ID NO: 6873318 - DNA, 62 bp, Homo sapiens
atttagctcagcccaggtgagaaggaggatcactagctgatcaccccaaagttgagtttgat

SEQ ID NO: 6873319 - DNA, 78 bp, Homo sapiens
ggacacctctaaagtggaacactacattgttgtttaaaagttgagctacaaatgtatgtgctgatgtgggcggtgtct

SEQ ID NO: 6873320 - DNA, 101 bp, Homo sapiens
gggtggaggaaggtgagggtgatgctttggtctgaattttcttggtaaacttacaagtggatctatcaaaaccagagggttttttcttaaccacaccaccc

SEQ ID NO: 6873321 - DNA, 125 bp, Homo sapiens
ccacatttattacctcccctcctgctccacactaaatcttgtggcaatgcttctaaaagtcaataaaatgagaaggaagatgcgataaaattaaggtggaaagtgcgatggggagaggaaatggg

SEQ ID NO: 6873322 - DNA, 73 bp, Homo sapiens
gtctgagcgctggagcttgtgtgtggttaaaagcattttgttttcatgtaagccacaggcttacagtttagat

SEQ ID NO: 6873323 - DNA, 87 bp, Homo sapiens
gcacagaggtgacgggagggagggctgcactggcaattaggaaaattggattctagccctgcttcaccatttacttctctcctgtgc

SEQ ID NO: 6873324 - DNA, 59 bp, Homo sapiens
ttgagtaccatctatgtgccaagcattctattaggtgctgactatatagtggtgaacaa

SEQ ID NO: 6873325 - DNA, 59 bp, Homo sapiens
ctcctactcagaaggtttagaatctcagggatgacattcagaagaaatgagtacaggag

SEQ ID NO: 6873326 - DNA, 110 bp, Homo sapiens
ctgttgcatggagaacaatgtgtctgcctaaaattcagggctttgttaaaggagaaaggggagaaggaatattggagtaggcagatggtgttcttagccattgtcaacag

SEQ ID NO: 6873327 - DNA, 75 bp, Homo sapiens
ttacattataggtcctgttagtgttagacttccctgtatgtgctaagggaagactttgaaaggctttaagtgtga

SEQ ID NO: 6873328 - DNA, 69 bp, Homo sapiens
taggagtgctatcggcttagctcctgagatgatgcctaaagttgcaagagaatatcgatagcactcttg

SEQ ID NO: 6873329 - DNA, 60 bp, Homo sapiens
gggggatgtgggaggagaaaaagccatttattctttttggtcgttcctctcacatttttt

SEQ ID NO: 6873330 - DNA, 79 bp, Homo sapiens
cagaggctctagcagcaggcatggccgccctggcaggagccccgatcaggcgtggacgccgcattcactggagaccctg

SEQ ID NO: 6873331 - DNA, 74 bp, Homo sapiens
ggcttttctttggagggtaatacattttaaaacatttagtgtgccacctactgctccacagtgactagagagcc

SEQ ID NO: 6873332 - DNA, 73 bp, Homo sapiens
ggcagagtcaggctaaggaaaggctcaggtttctcaaatctgaccaaggctctttcttgtgtctcatgctgcc

SEQ ID NO: 6873333 - DNA, 85 bp, Homo sapiens
cagctgcagttttgttacatggatatattgtacagtagcgaagtttggtattttattgtatccatcacccgaataatgtacgttg

SEQ ID NO: 6873334 - DNA, 60 bp, Homo sapiens
tggcagctcctcaaaaaattaaacgtgaatacgaaattatttaatgggtgaggagtttca

SEQ ID NO: 6873335 - DNA, 57 bp, Homo sapiens
atctggtgtcctgatgaaattgagcctgtaggctgggtcagtgctcaggcaccaggt

SEQ ID NO: 6873336 - DNA, 59 bp, Homo sapiens
ccacctggggctgtggccccttcacagggaatgaagctggccagcagcgtccactgtgg

SEQ ID NO: 6873337 - DNA, 89 bp, Homo sapiens
gagattgtgggagtcaggtatcccttgctgtccagccacaggaggtggacagatctggacagaaagggctgctgtgtccccagattctc

SEQ ID NO: 6873338 - DNA, 128 bp, Homo sapiens
gcatcagcatcacctgggaacttattagagatgcaaattattgggtcccaccccagatctattgaattggaaactggggcagagcccagcaatttgggtttaacaagcctgccaggtgattctaatgc

SEQ ID NO: 6873339 - DNA, 80 bp, Homo sapiens
attgaaggcaaagcgataccagagctaaaacgttaatgaaaaacctaattaacttggctaggtagctttctgctgtcaat

SEQ ID NO: 6873340 - DNA, 75 bp, Homo sapiens
gagccaggcatgttttccatatttagaccaacttgttgcctattataagaaagctgatggaaaggattttgggtc

SEQ ID NO: 6873341 - DNA, 61 bp, Homo sapiens
ataaaaccaaagcagcagtgttatggtaggagaactttcaagcatccatgctttgttttat

SEQ ID NO: 6873342 - DNA, 58 bp, Homo sapiens
atttggatgggcattaggaaagtcagggatatcctttggcaccaatcctactccaagt

SEQ ID NO: 6873343 - DNA, 67 bp, Homo sapiens
caggagagagaaggcctgtgggtgtggggtcctttgcacctcacctcaacagatctgctctcccctg

SEQ ID NO: 6873344 - DNA, 64 bp, Homo sapiens
tgagatgaacttgattgttttaggactaaatgtttttattcaattgacaattagagatcactca

SEQ ID NO: 6873345 - DNA, 61 bp, Homo sapiens
atagtctcagaatatttgctgatttgcacacttgtgaggcattggcagatctctggattgt

SEQ ID NO: 6873346 - DNA, 128 bp, Homo sapiens
ggccaattggggtactgtttggagaattaacaggcaacagttgactctgagtttgcctttcatgagtttctatcaaattcagggcatccattgcctgttgaattgtttcagtattagccatgattgcc

SEQ ID NO: 6873347 - DNA, 117 bp, Homo sapiens
ttaactttaaagatcaatgagtccgtaaaactagaccgtgagtctaaaagaaccttaatgtcctcagtcttttagtaccttttctgtctggatttcatgggttggtctgatagttga

SEQ ID NO: 6873348 - DNA, 56 bp, Homo sapiens
gaaacagctttaagtgatactgctgctgctactggtggttttagttcagctgtttc

SEQ ID NO: 6873349 - DNA, 88 bp, Homo sapiens
gtggagaaggagaagagtgggagggaggctgtagatagcttgtaggtttgggctgtacagggttatcctttcccatggcctttttgat

SEQ ID NO: 6873350 - DNA, 77 bp, Homo sapiens
agagcatgcagagacttgaagacacatgataaacatggatatgcatttccagttgtccttcttatttgtagtggtct

SEQ ID NO: 6873351 - DNA, 86 bp, Homo sapiens
taagtgatttccatgggtagccctggttgagaatccctgctctactcttctgccacaggcctccactggggcttcccaggtccttg

SEQ ID NO: 6873352 - DNA, 68 bp, Homo sapiens
acagtagtcctttattttggtttagtggaaagactttcagaggtcagtgccgaatgaaggatgactgt

SEQ ID NO: 6873353 - DNA, 66 bp, Homo sapiens
gagccaccatgcccgcccgcttcgtcttttcactggactaatgaagatacaggtgtggaatggttt

SEQ ID NO: 6873354 - DNA, 82 bp, Homo sapiens
gctatatactcatggcattgtttatagattgcatgagacaatgcatgtaatatacttagcacagtgcagcctgtcatatggt

SEQ ID NO: 6873355 - DNA, 83 bp, Homo sapiens
agagcatgcggtgtcctggaagaagctacaagcggtgagtgatagcctctctccagctgaggccttcttcccatcacaactct

SEQ ID NO: 6873356 - DNA, 67 bp, Homo sapiens
ggagacccagcctacaaagctcacctttagggtgtttgaaaggcgagcgtgattgtcagggtgggcc

SEQ ID NO: 6873357 - DNA, 91 bp, Homo sapiens
tggaggcaggtgtcttaggttggtgcacaagtaactgaggtttttaattgaggtcaattacttgtgcaccaccctaatagcttgcattcta

SEQ ID NO: 6873358 - DNA, 55 bp, Homo sapiens
gctcacggtattttccgaagtcctccgtgtaaaaagggcgggcggtgcagtgggc

SEQ ID NO: 6873359 - DNA, 80 bp, Homo sapiens
ttacaaaagaagaaacagactgaagagttgaagcttcacccaagctcttgactcccagttctgtgcactttaccttgtaa

SEQ ID NO: 6873360 - DNA, 74 bp, Homo sapiens
gccttacgcgtccttgcccagggcctttctgaattttagaagctgccaccagcccagggcaggatcagggaggc

SEQ ID NO: 6873361 - DNA, 66 bp, Homo sapiens
agtgaatcgttaatacaggcttccattgtctataaacaatgatcacttgagaattaactgttcatt

SEQ ID NO: 6873362 - DNA, 71 bp, Homo sapiens
gcccagtggcattgacatgtaaacagtatggtgtgcttgagatgctgtaagctgttcagaattgctggagc

SEQ ID NO: 6873363 - DNA, 63 bp, Homo sapiens
agttaacctggaggactgcaatccatgtgctagcccacatggccattcatcgactccagcact

SEQ ID NO: 6873364 - DNA, 92 bp, Homo sapiens
gctgttcattataatattcataagttttctggtgatatttgacatcttagcagtgtgcagagcccacaggcagctgaaatataatgaattgc

SEQ ID NO: 6873365 - DNA, 85 bp, Homo sapiens
tcttcaatagcttttctgttctttccaacaagacagtgtatttgcttctgccaaggagagaaggtatgtaaaaagctgatgatga

SEQ ID NO: 6873366 - DNA, 84 bp, Homo sapiens
tgttaggttggtgcaaaagtaatggcggtttttaccattcaaagtaatggcaaaaaacgccattacttttgtaccaaactaata

SEQ ID NO: 6873367 - DNA, 63 bp, Homo sapiens
cctatcacccatcctggatgagattctgcagattcagagctgagatcttggtgggcaggcagg

SEQ ID NO: 6873368 - DNA, 57 bp, Homo sapiens
tcctgcagatcaaagcctttgacctagggcagtgcttttcaaagggtggtcccagga

SEQ ID NO: 6873369 - DNA, 81 bp, Homo sapiens
cttcttgcatgcaaggcctccgtggcaatggttccccatggggaatatcttcaagccattgagtccatgcattttaaggag

SEQ ID NO: 6873370 - DNA, 70 bp, Homo sapiens
ttttattgggtatcttctttctcagttgtccacacataggatgattatacaaggctggtgcctaattgaa

SEQ ID NO: 6873371 - DNA, 78 bp, Homo sapiens
tttatagttaaagattctgttaagagctaagtgatttaagtacatctgggataaagtggccttggctttaactatgaa

SEQ ID NO: 6873372 - DNA, 60 bp, Homo sapiens
tgagaggtcaaagggcatggagctgaaagaaacatctggattccatcttttgaactttta

SEQ ID NO: 6873373 - DNA, 61 bp, Homo sapiens
ttggagaggtacaccctttaaacttgagaacataaagtttgaaaacaactgccttggccaa

SEQ ID NO: 6873374 - DNA, 104 bp, Homo sapiens
tcctgtttactctgtgaaaattatttgtttacatatgtctgtctgcacctgtattaggagttgaagactagtaaattatgttattcagtttacagggtatagga

SEQ ID NO: 6873375 - DNA, 68 bp, Homo sapiens
tgagaaattaccattgtaaagtatttctacacttattattaagaaagtctcattgtggtagtttcaca

SEQ ID NO: 6873376 - DNA, 80 bp, Homo sapiens
gagagtaatataaatggctcaaattaggctctatttggatgatggtccaactgagtgatttaagctatttttaacgcctc

SEQ ID NO: 6873377 - DNA, 83 bp, Homo sapiens
tgagacatgatgtgctccagaagcttcaaggagattctagactcaagtctagacccctccctgcttctcaccatcacctctca

SEQ ID NO: 6873378 - DNA, 130 bp, Homo sapiens
tgttattgttctatttattttttctgtgtttacctcaagttggcatgaacaaattagtaaaatagcttgcaaatttgtgcatctgttaattatgtctaaggcccagtactagaatatatgaatttaaaca

SEQ ID NO: 6873379 - DNA, 61 bp, Homo sapiens
ccaggtgctagcaatcactgtcaagggaaatacaatgatggagatcaacagtgagccctgg

SEQ ID NO: 6873380 - DNA, 57 bp, Homo sapiens
gcaaggctgccgcagccaatggttggcgagccgccggctggctgggcggggccgggc

SEQ ID NO: 6873381 - DNA, 69 bp, Homo sapiens
cagtcatttgaaatgtatacagccgattctttgtttaaatgtggaagttggcacatagcaaattcgctg

SEQ ID NO: 6873382 - DNA, 61 bp, Homo sapiens
tagagctggtttgggagaatcaattcagataaatcatttctctaaatgtgaaccggcttta

SEQ ID NO: 6873383 - DNA, 66 bp, Homo sapiens
gcaatagtctctcccacaccatcctatttccttggatatgaggcatattgctggagatgactgtgc

SEQ ID NO: 6873384 - DNA, 104 bp, Homo sapiens
tccctagtatcatcactcagtcgtgtacttagcaccttgaacagaccctggcacacattaggttctcagtaagtgttgaatgaatcagtgagtgaatacaggga

SEQ ID NO: 6873385 - DNA, 116 bp, Homo sapiens
cctctactgatccacctgcgttggtctcctaaagtgccaggaatacaggtgtgagccaccatgcctggccgggtcttggatttttataagaagaaaaaaaaggtgtggggtagggg

SEQ ID NO: 6873386 - DNA, 64 bp, Homo sapiens
atgctccactaggaatctgctcttctctgtgaggcactgctgaagagcattcctaaaggaccat

SEQ ID NO: 6873387 - DNA, 77 bp, Homo sapiens
cttggctattctgcttttgttgcttgtacttttggagtcatacccaagaaatcatgactaagagcagtgtcatcaag

SEQ ID NO: 6873388 - DNA, 70 bp, Homo sapiens
attagcttcattaaccaaaatgcaatatgactgtctccattgttgctctcagatgttgactgacgctaat

SEQ ID NO: 6873389 - DNA, 61 bp, Homo sapiens
gtgcatgtaaggagccctcagaggaaggatgcccatttgaactacctctccttagcagcac

SEQ ID NO: 6873390 - DNA, 65 bp, Homo sapiens
cagccatggatctggataaaccatctgtttggggctcattaaaacagcggaccaggccattgttg

SEQ ID NO: 6873391 - DNA, 77 bp, Homo sapiens
tcatgcagttgtagtcaggcaggggctggggcgagagtcatctccaaggcttcctgacctacatgtctgctgcctgg

SEQ ID NO: 6873392 - DNA, 72 bp, Homo sapiens
tcttcctggccaggcatggagtcacagcagaggagggggctgtgactgaggatcttcctggccaggcatgga

SEQ ID NO: 6873393 - DNA, 55 bp, Homo sapiens
gggggagctctctcgaggatatctgggctgcttgttctccagggggagctctctc

SEQ ID NO: 6873394 - DNA, 86 bp, Homo sapiens
agcccagcagagagaccctttttcctcctgtagcagcagaagagaaggcagcagggtgcaggactgaaggagggctgggctgggct

SEQ ID NO: 6873395 - DNA, 111 bp, Homo sapiens
cccggcactttgggaggctgaggcgggcggatcacgaggtcaggagatcgagaccatcctggctaacaaggtgaaaccccgtctctactacaaatacaaaaattagccggg

SEQ ID NO: 6873396 - DNA, 82 bp, Homo sapiens
gcccaaggaagccttgcctgaatacaaaattctgtctgaaggaaatcttggagataatgtgtttacaggagtgtctgtgggt

SEQ ID NO: 6873397 - DNA, 86 bp, Homo sapiens
tgtagctggtgactttagttctaatgcattgaaattctatctaataagtgtttttcttgtgctggatctaatcacagaaggttaca

SEQ ID NO: 6873398 - DNA, 84 bp, Homo sapiens
ctgttgcccaaagagtgtccctcactggaccatatgaaaacaatttttctctggttggtggggacccttgaatttgggatatgg

SEQ ID NO: 6873399 - DNA, 60 bp, Homo sapiens
agtccctggattgtctctgtcaagcaccatctgtgcacaccagagacatatccaaaggct

SEQ ID NO: 6873400 - DNA, 61 bp, Homo sapiens
ctgcatccaacatgatcataaatggccagtcccagcagcttcccacatggctggatgacag

SEQ ID NO: 6873401 - DNA, 58 bp, Homo sapiens
tagactgtctacacagaaacggtcagattcacaggtgtgacctctgcagagatgttta

SEQ ID NO: 6873402 - DNA, 55 bp, Homo sapiens
ctgccttctctggggagctgtctatggggtccccgcagccctccagtggaggcag

SEQ ID NO: 6873403 - DNA, 65 bp, Homo sapiens
ccttctttttacagctttcttcttgttttggccagaactggagggtccatcttgtgaaaaggagg

SEQ ID NO: 6873404 - DNA, 76 bp, Homo sapiens
ctatgcctacaggtaaacatactgctgtcttcttggaagaccgagaagtataaagaatgtttatgtgcaggtctag

SEQ ID NO: 6873405 - DNA, 109 bp, Homo sapiens
tggtaggcttgataaagtacagattccttggacccactcccagaattgctgatttagtaagtctggtgtgggatccaataatttgtattatatttttagtaagtttcca

SEQ ID NO: 6873406 - DNA, 68 bp, Homo sapiens
gatttacattttatttggggatttattgacctttggaaaggttgaaatcccagatagtaatgtatttc

SEQ ID NO: 6873407 - DNA, 91 bp, Homo sapiens
gcacagctcccggctgacctcgtccaggcgcttctgcagggcctcctcactctccctgtgggacgcctggggacgggcaggggagtggggc

SEQ ID NO: 6873408 - DNA, 99 bp, Homo sapiens
gatgcagcgatgacagagaccacagggcgctctgattcctggtggctttgtaaccccataagtcctggctgtgtttggtttctatcatacctctgcatt

SEQ ID NO: 6873409 - DNA, 118 bp, Homo sapiens
ttaaagaatgagtcattgagtttacaaaacacaagaagcagggtacagttattccaaaacaacattgtgcctgtgcttttgtttgaagagaagtaaaatgtttccactcaagttttaa

SEQ ID NO: 6873410 - DNA, 80 bp, Homo sapiens
gctggtcgggcagggccggtggcttttgtctccccttcccctccctgaaggctgacaggccccggtccctctgtccacgc

SEQ ID NO: 6873411 - DNA, 78 bp, Homo sapiens
atgggaagagacccctagagataggaggaacgttatttggttaggttctggttctgctctctggggaaagcttcctat

SEQ ID NO: 6873412 - DNA, 59 bp, Homo sapiens
gcgcggggcatgtcccgctgtgcaccgggaaccggcgtccggtgcagacagcccctcgt

SEQ ID NO: 6873413 - DNA, 65 bp, Homo sapiens
ggcctgtcctccaagagcacatctgacgtgaaaggttagaagatgtgtcagaggatgttaaggtc

SEQ ID NO: 6873414 - DNA, 77 bp, Homo sapiens
ggaaatatgcctacaatgcattcgttgtctcggccagtggctcgtgaccctctgcacttggaaggtatataatttcc

SEQ ID NO: 6873415 - DNA, 81 bp, Homo sapiens
aaagtcacagttagaaagtgtctgcttgggtcctgaatctatctaattcctagcccagtgcctattctacacattgacttt

SEQ ID NO: 6873416 - DNA, 85 bp, Homo sapiens
cccttgttgggtcagggcaggtggttgtggcccagttgtttggccttctgcaggctgcacccctgccctgctgcctgccagtggg

SEQ ID NO: 6873417 - DNA, 56 bp, Homo sapiens
tcacaaagtgaagtgtgtcatgggtaaaaagtccagacatcataatgactttgtga

SEQ ID NO: 6873418 - DNA, 67 bp, Homo sapiens
ggggaccttcccttgtgcctgcctttgctagctctttgctatgcctggggtgctcaggccaggcctc

SEQ ID NO: 6873419 - DNA, 77 bp, Homo sapiens
gcaatatttggaatccatattagtaaattctgacacatacatgtgcagagttttatgtatgcatgtagaagaattgc

SEQ ID NO: 6873420 - DNA, 74 bp, Homo sapiens
ttctaaagaagtactagaaatagcagtgcctcaaagtgagggcttctagaatttctgatatatattccttggaa

SEQ ID NO: 6873421 - DNA, 73 bp, Homo sapiens
gcatgtaggaaaatgtacgggagtagaattagagaaggaaaaatcactagtcatgacccgatgttactacagc

SEQ ID NO: 6873422 - DNA, 70 bp, Homo sapiens
tcagtttaagatgactaacaattcagtaagtatgagaatacaggtagaattaaagttgaaattgaactga

SEQ ID NO: 6873423 - DNA, 62 bp, Homo sapiens
cttgtaatggcagagacctgtcactaaaagtgacttattaaccaggtttctaactattcaag

SEQ ID NO: 6873424 - DNA, 57 bp, Homo sapiens
ccacaagactctgtcagcataatccacagaacgacttgtgttgaagattatttgtgg

SEQ ID NO: 6873425 - DNA, 56 bp, Homo sapiens
accattacatgatccttacccagtgctggattctgagtgggagatcaataagtggt

SEQ ID NO: 6873426 - DNA, 88 bp, Homo sapiens
tctcttcactttaagtccttctttatatgagagtaaggtcaaatgaaaacttgtcatggaaaagataatagtatgaaaagttaaggga

SEQ ID NO: 6873427 - DNA, 77 bp, Homo sapiens
gacacttgaatacttgtttctgagcttccagagtacactgaatgataccctgggagcttagaagaatgtagcctgtc

SEQ ID NO: 6873428 - DNA, 77 bp, Homo sapiens
gacttagctgatcgtggcagtgttttttccagtctgtttaatttttgactctgaaacatcaccattttacctaattc

SEQ ID NO: 6873429 - DNA, 75 bp, Homo sapiens
cggtcctgggacacagccttacctgggggttgcagggaggggcaggatttagcatagggtctgtggacaggactg

SEQ ID NO: 6873430 - DNA, 80 bp, Homo sapiens
tggtaattggactttctaggtgctattgtgattacaaaagactgtaatatgcgatgctcctgagactctacacgaggcca

SEQ ID NO: 6873431 - DNA, 80 bp, Homo sapiens
ccaaatccaggaacaaagccccatccaccttcaggacttggcacatgaggtacctgtggcctggggtttgttctgagtgg

SEQ ID NO: 6873432 - DNA, 70 bp, Homo sapiens
cgcttgttcttttcggcctgtgagaaggccacaaacagttgttactttttcaagtcaaagagggtatgcg

SEQ ID NO: 6873433 - DNA, 56 bp, Homo sapiens
cctttgcaatcctgtaggcctttctcaaggaagagccatatatattttgcactagg

SEQ ID NO: 6873434 - DNA, 85 bp, Homo sapiens
gacaatttgctttttttgagttgcctctaagtccctggtgatgttattgtataaataccaacaaggcaataagagctcaattgtc

SEQ ID NO: 6873435 - DNA, 59 bp, Homo sapiens
acttcttttcaaatcatgcaaagttatacgacttaactgattgctctggttgaggaagt

SEQ ID NO: 6873436 - DNA, 58 bp, Homo sapiens
gggaggtcccgcggtgcccaccgcgcagagctcagggggtggtgcgcccggcccttct

SEQ ID NO: 6873437 - DNA, 62 bp, Homo sapiens
ggtctaaggaatgcatgggtactcagggctttaccggcagggctccatgcatttctccaacc

SEQ ID NO: 6873438 - DNA, 110 bp, Homo sapiens
acattagcttctggaatccttgcattatacagatagagttctcgtgggactaccacaagcagcaggaatctgttctgtataagaattatagattttgaattagaaaatgt

SEQ ID NO: 6873439 - DNA, 77 bp, Homo sapiens
ttatacagctggtaagtggcagagattctggaggcagactgcctgcatttgaattctgtcgcttactagatgtatga

SEQ ID NO: 6873440 - DNA, 62 bp, Homo sapiens
tatgcgcacaagcacgagcagcgtgcgtgcgtgcgtgcacgatgcgtgtgtgtgtgtgtgtg

SEQ ID NO: 6873441 - DNA, 60 bp, Homo sapiens
tcaaggaagggatattcttgaaacaacctgttttcccagctgttctttcccattccttga

SEQ ID NO: 6873442 - DNA, 86 bp, Homo sapiens
ctttctttgcaatttgacattgagagagcaccttggaagggttattatgaagaccaagctgttctctaagtttcatgcagagtgag

SEQ ID NO: 6873443 - DNA, 126 bp, Homo sapiens
gcatcagcatcttctggagacttgttagaaatgcagattcttgatgcccagacccagtgaatcagaaactctgggggaggtggcccagcagtctgtttcaacaggtcctccacttgattctgatgc

SEQ ID NO: 6873444 - DNA, 57 bp, Homo sapiens
ataatagcagacctctgagtgataactgatactattcctcctgggactgctggttat

SEQ ID NO: 6873445 - DNA, 58 bp, Homo sapiens
ttttcatctcccaggggcccaaggagctgcctagaggggctgcctgggaagaagaaga

SEQ ID NO: 6873446 - DNA, 59 bp, Homo sapiens
cattattacagtcccagggagtaggggagtcccatcctggccctggctctgtgatcatg

SEQ ID NO: 6873447 - DNA, 65 bp, Homo sapiens
cctggaattgtaggtttggccaggagtttgccaggattgctcgaaggtcatcttccaatcccagg

SEQ ID NO: 6873448 - DNA, 84 bp, Homo sapiens
tagaccgtatagggtaacttccttgggttgccatggcatttataaactgtcatggtgctggtgggagtgtattttaaccggcta

SEQ ID NO: 6873449 - DNA, 57 bp, Homo sapiens
tgattgaggggatgtgctgtggcatttctgcaggctttacatgtttccctttaagca

SEQ ID NO: 6873450 - DNA, 69 bp, Homo sapiens
gtatactttacaaattagctctcgggactcttccaaatggagttttatgagggatttgctaaggtaaac

SEQ ID NO: 6873451 - DNA, 98 bp, Homo sapiens
ttctccaagaagaggatcagattacttaaaattgttggagaattctggttgtttgtgcaataatcatagtgatttacattgcttttcttctttcagag

SEQ ID NO: 6873452 - DNA, 63 bp, Homo sapiens
tgtgtgccctgcattaggtgacttccagttcacaaactcagtctctgcatgatgcagcacaca

SEQ ID NO: 6873453 - DNA, 57 bp, Homo sapiens
cacatgccaggcacccgctggactttccctctttcctctcagtggtgctgggatgtg

SEQ ID NO: 6873454 - DNA, 83 bp, Homo sapiens
tagcaaaagcttgctgacacccattcaatgtgactggttttgcaaggattggaaaacatgcacattggattcagctgctgcta

SEQ ID NO: 6873455 - DNA, 60 bp, Homo sapiens
gctaatgaggtcctagagagtgtgtggggttcaccgtgtacaatctagggcctcaggagc

SEQ ID NO: 6873456 - DNA, 64 bp, Homo sapiens
ggatttagggcaatcatcaggagcagccctgtgacatggagctggccttgaggtgtctttattc

SEQ ID NO: 6873457 - DNA, 64 bp, Homo sapiens
ggaaaaattggctgagtaatattggaccttgcatcctgtccaaggtcacgcagctaataaatcc

SEQ ID NO: 6873458 - DNA, 76 bp, Homo sapiens
ctagaacagggatcggcaaactatagcctgctggcaaaatctagcctgacagctatttttgtagataaagttttag

SEQ ID NO: 6873459 - DNA, 56 bp, Homo sapiens
tagaaggagtatatatatgtatacacaagtaagtttaaatgtataggacccttcta

SEQ ID NO: 6873460 - DNA, 75 bp, Homo sapiens
ctggcccagagggagacactcctagccattccctgtaagctgccactaagtcccggaggtcccttctggtttcag

SEQ ID NO: 6873461 - DNA, 60 bp, Homo sapiens
tatgtgtgcattagcattctagggagtcatttaattgaccctagaggagagtttaccata

SEQ ID NO: 6873462 - DNA, 71 bp, Homo sapiens
cccatgcacccccacggaaggccgtacgccccaacactcacccccagggcggccgcctcctggggccaggg

SEQ ID NO: 6873463 - DNA, 78 bp, Homo sapiens
ttcagtggttattgccttgtacatttcatttaaatgatgttttattatgactctaaaagtgaagtgtggtccactgag

SEQ ID NO: 6873464 - DNA, 58 bp, Homo sapiens
cactaaaactacattggaaacacattccctaccacttgtgctaagagtggttttagtg

SEQ ID NO: 6873465 - DNA, 57 bp, Homo sapiens
tcagaatatgctaatgacatttaggaggggaaaaaactcatttttagtatattctga

SEQ ID NO: 6873466 - DNA, 59 bp, Homo sapiens
ggacagtgggtgaaatcctgtagccctgggatgcagagcttctaggagactggctgtcc

SEQ ID NO: 6873467 - DNA, 67 bp, Homo sapiens
tgggattcaaccaatgtttattgaatgaatgagcactgaagttcatttaatgctgagttgaatgtta

SEQ ID NO: 6873468 - DNA, 58 bp, Homo sapiens
gaaaacgagccatttatctgcaaataaacattgcactaggagtaaatggtttattttc

SEQ ID NO: 6873469 - DNA, 66 bp, Homo sapiens
tagtttatgtatctggatacatcagtgagttacaatgcattgccctgtgttccagaactctagcta

SEQ ID NO: 6873470 - DNA, 59 bp, Homo sapiens
ctgcgatttatctcttaggaagaccgaattttgtaaaccttcctgcaggtggcttgcag

SEQ ID NO: 6873471 - DNA, 64 bp, Homo sapiens
taatgttgtacctatgctgagaggaagagaaatcctcttgctctcagcataagtacaaacatta

SEQ ID NO: 6873472 - DNA, 91 bp, Homo sapiens
tccaaaggtatgaaggaaagaagggtggctgactgttttgtggattatagtaggggtttttagattactcagccaccattcatcaccagga

SEQ ID NO: 6873473 - DNA, 65 bp, Homo sapiens
gcgcgggcaggccttccgagtggaacctctatgccgacatcgacgccgcctggcaggccctgcgc

SEQ ID NO: 6873474 - DNA, 70 bp, Homo sapiens
ttaagaagaagtaaaactttatgtttgttttagattggagaaatgatgcaaattctttgcttcttcttga

SEQ ID NO: 6873475 - DNA, 66 bp, Homo sapiens
cctctgaccaggctcagccaaggcgaagctgcccatttcccagagggccttgctgagcttcacagg

SEQ ID NO: 6873476 - DNA, 102 bp, Homo sapiens
ttgagacggagtctcactctgtcgcccaggctggagtgcaatggtgctaactcggcccactgcaacctccgcctcccggattcaaggattctcctgtctcag

SEQ ID NO: 6873477 - DNA, 71 bp, Homo sapiens
tgaggatgactccgatatgcccagagcctggggttaccaggatatgcctgctgattggagttgaattgtca

SEQ ID NO: 6873478 - DNA, 56 bp, Homo sapiens
tagatttggactttattcacaaataaagtacagtgtgagttaaggatccaattctg

SEQ ID NO: 6873479 - DNA, 75 bp, Homo sapiens
gcgctccctgcctcccaggccccgcgcttcccgcacagggcagatggcgcaggccttggatcctggttcggaggc

SEQ ID NO: 6873480 - DNA, 92 bp, Homo sapiens
ggcaacatgttaatgggtaatagacaagatttctgtggtcatgtaatgtcaatttaaaagacatcactaaatgttgtctatgacatgttgtc

SEQ ID NO: 6873481 - DNA, 55 bp, Homo sapiens
tcaggccacggctcactgagacagcccagattgtcttgctgattagcctgcttga

SEQ ID NO: 6873482 - DNA, 60 bp, Homo sapiens
gcctcccctccttaggtcttctagccaccagagaggagggcagaggtaggagagggatgc

SEQ ID NO: 6873483 - DNA, 125 bp, Homo sapiens
ccgttattaatctaggtttttaatccatatgtaatgtattatgaggactggtgtaaggtggagctctaacttcaatttcttcatatcactcgtagagctgacatttcactacctggtttggatgg

SEQ ID NO: 6873484 - DNA, 55 bp, Homo sapiens
cagattgcagcagtttaatgcagggtttcttagccttgttgctgttgacattttg

SEQ ID NO: 6873485 - DNA, 67 bp, Homo sapiens
ctagaagtccaagatgcagttgtcagtagagctggtttcttctgacatctcccttcttggcttgtag

SEQ ID NO: 6873486 - DNA, 86 bp, Homo sapiens
gacagaattttttaggagagtattacaaattttacaactttatagttacaatttgtgtatactgtcattttaagaaaagtgatgtt

SEQ ID NO: 6873487 - DNA, 91 bp, Homo sapiens
tttctagcagaggtcagaaggagctgttttgttcagcaaagctttaatgcttcatgaacacacggaaagctaatctctggctagttagaaa

SEQ ID NO: 6873488 - DNA, 86 bp, Homo sapiens
gtcagctatcagaagtcttcagactggagagattcctggagggggagtggccctttaatccatcagctgaagccatctggtaggac

SEQ ID NO: 6873489 - DNA, 66 bp, Homo sapiens
tgtagtagctgtgaaagtctgcttagagagatacagtttctattagtcaaactattacctgctaca

SEQ ID NO: 6873490 - DNA, 70 bp, Homo sapiens
accagtagtgcctcatttttaagtgttatataaatattctgtggccaaaataaaatgaggtctaacaggt

SEQ ID NO: 6873491 - DNA, 128 bp, Homo sapiens
taagttactgattatcaaaactacagaaaaagctgaaacattagcctaaactggtgattaatccccctaagcctgttatctattgtattagttttttatcactgctgtaacaaattatcacaaattta

SEQ ID NO: 6873492 - DNA, 85 bp, Homo sapiens
ttcccagaatgctggcttctagcagtgttgatttttctgtccaaacaatgcaaatcacacaagctggcagcaaggattcaaggaa

SEQ ID NO: 6873493 - DNA, 71 bp, Homo sapiens
ttggcataagtgtattttattatttaactggtagagtggattctgctatttgaaaccaagaatgccgccaa

SEQ ID NO: 6873494 - DNA, 110 bp, Homo sapiens
tacatccctttagccactcatcaaactaaagttgataaggtatcgtagttattcagactgatgatacttttctactttcatatggggtgattaattcaatagagaatgta

SEQ ID NO: 6873495 - DNA, 56 bp, Homo sapiens
gtgggcaggagagaagctaaagaaagtatcctttctttgatttccttacctttcat

SEQ ID NO: 6873496 - DNA, 64 bp, Homo sapiens
atcatgggcgtggcctctatccaaacatttaaaagacatatttgcatagcagctatacccagat

SEQ ID NO: 6873497 - DNA, 59 bp, Homo sapiens
tttcctcactcatgtcatcagtgtagcaattggtttgggtcaggtgtatggggagggaa

SEQ ID NO: 6873498 - DNA, 79 bp, Homo sapiens
tgagatgggtgattgttggtggtgattatcattgagcctttcttggtgttcttaaaatcacagtcacccagtatcctca

SEQ ID NO: 6873499 - DNA, 65 bp, Homo sapiens
ctcaaccatgtccttaatctgaatgttagagacctttccttgactctcaggacgaggttcttgag

SEQ ID NO: 6873500 - DNA, 55 bp, Homo sapiens
agcggtagtctacagtgccagaatgcaaattgcatgcctgatgtttgctattgct

SEQ ID NO: 6873501 - DNA, 65 bp, Homo sapiens
gcaagaggctgttagacattgcctcttctcctcacctggagtgagtgttcatagcaggctcttgc

SEQ ID NO: 6873502 - DNA, 66 bp, Homo sapiens
ttctagacattatttctacccacaatttacttttgtgctttgtgtgtgcatgtgtatgctttggaa

SEQ ID NO: 6873503 - DNA, 105 bp, Homo sapiens
ccagactgcttggctctgagtcagccacttctgctgtcatcctttttattctgcagatggggaaactgatgctcagagaggggcgagtaggcctagtagctctgg

SEQ ID NO: 6873504 - DNA, 65 bp, Homo sapiens
ttgaccaatgggcttggagcattgagaccacaccctattctgagttctagtgtggccctggttaa

SEQ ID NO: 6873505 - DNA, 70 bp, Homo sapiens
agcggaatgaaatccagtcatttccattgttcccaggcttttttcttgctacagctgactgtcattccct

SEQ ID NO: 6873506 - DNA, 102 bp, Homo sapiens
gagattcagggatgtggtagagtcaataaaagctttagattcagacctgggtctgaatcccaatctgttattgacatgcaaccttaggcaaatcagattctc

SEQ ID NO: 6873507 - DNA, 57 bp, Homo sapiens
gtgttagtttgctaaggataatggcctccagtgcatccatgtccctgcaaataacat

SEQ ID NO: 6873508 - DNA, 85 bp, Homo sapiens
agcctctgtttgctgtctgtgaggagccactgagatcaagcaggtctagtctccacccatgacagtacacagcacttcataggct

SEQ ID NO: 6873509 - DNA, 64 bp, Homo sapiens
cctgacatgtgccattgcttttagtcttgaggcatttgcctatttgagaacaatggctgaaagg

SEQ ID NO: 6873510 - DNA, 77 bp, Homo sapiens
ttgaccagctgtatgatggatgtggctctggagctgctcccaggcagggttcagccccaagagcctcatctggtcaa

SEQ ID NO: 6873511 - DNA, 61 bp, Homo sapiens
gccactgcgggagacctaggcttttacacagaggccacattgtgattcccgcaggaatggt

SEQ ID NO: 6873512 - DNA, 69 bp, Homo sapiens
cctcccacttcttgctgaggtcaaaggcctgcgtcagttgcactgtagcctcggcagtgaaccgggagg

SEQ ID NO: 6873513 - DNA, 57 bp, Homo sapiens
ggcaatggggatgaggcatgctggtgagtgacagtcgtggctctgggctcctttgcc

SEQ ID NO: 6873514 - DNA, 127 bp, Homo sapiens
attagcgtcaatggccccatcaggctctaggttagtaggagaacattctcaagcatttcagagagtataagggacgtctcttctaattagggtccatgatgtagtcatactttcttattgatctaat

SEQ ID NO: 6873515 - DNA, 72 bp, Homo sapiens
gccaaaagagacaagggacctctggagaggcacccgggagcgggcgtctgcagggcccttggctcctgtggc

SEQ ID NO: 6873516 - DNA, 69 bp, Homo sapiens
tgttgtatatatgtcctatttcccagctgggtggtgttcttctgtctggaaaaggacatagacacggca

SEQ ID NO: 6873517 - DNA, 62 bp, Homo sapiens
tacagaatgatgtgtttaaataaattgtcctgttgactgaattttgatcacattattgggta

SEQ ID NO: 6873518 - DNA, 107 bp, Homo sapiens
gtttatgaattttttaatgtctatttaaaaagataaagaaattgagaatgtcaataccatgtttcaggacctatcttttagaaaagcaatggagaggaggaatggac

SEQ ID NO: 6873519 - DNA, 93 bp, Homo sapiens
tgagttaggtttgtaaatgtcatggtgaaaaaatattaatatctcaaaacgtctatttttaaaattgatctcatggcttaacaagcccactta

SEQ ID NO: 6873520 - DNA, 80 bp, Homo sapiens
gtcttataggtggtatttaaaattatttggctctttcaaataaaaaggggagtgaataatcttgggtattaataaaaggc

SEQ ID NO: 6873521 - DNA, 74 bp, Homo sapiens
ggcctccggcctcggcgcgggctcagccgcccggggctgggcgcggcagctccgcgccgtaggacgagggggcc

SEQ ID NO: 6873522 - DNA, 118 bp, Homo sapiens
taaaatcacgtaccttagagctagcctgccttggttcaagtcatactaacttcaagttagaacttggttcaatactaacttgaaccaaggcaggctagctctaaggtacatgatttta

SEQ ID NO: 6873523 - DNA, 66 bp, Homo sapiens
gtgaagatcagggtcctagagtaacttaatattttgtacattggttatttgactcctcatttttat

SEQ ID NO: 6873524 - DNA, 77 bp, Homo sapiens
atttgcttactggtagtggaggttacagctgtacatgaagcatgtactgactgtacttttaaattggtttgtcaagt

SEQ ID NO: 6873525 - DNA, 77 bp, Homo sapiens
gccagtcataaaaatttattatgtacaggcactataccttttcatgtataggtcactagcatgtaaatgaaactggc

SEQ ID NO: 6873526 - DNA, 65 bp, Homo sapiens
cctattgtcctttatcttgtatgtctagggagagaattggctagcacacaaataaaggagaaagg

SEQ ID NO: 6873527 - DNA, 61 bp, Homo sapiens
tctgataatgtgcttcgtgaccttatggtcatttcatcattcagaagctacaagagtcgga

SEQ ID NO: 6873528 - DNA, 120 bp, Homo sapiens
gtcgacacaattatgggaatagctaaaattcaccagtagacctagtgggttcaattcaacaagattattgagagcctgttttgtgggagatgctattgctcatatgctagtgaaacagac

SEQ ID NO: 6873529 - DNA, 61 bp, Homo sapiens
tacagtttctcattatgctctccagtctagtccatgtgttgagcagagtgaggtagctgtg

SEQ ID NO: 6873530 - DNA, 63 bp, Homo sapiens
tgtttacttatgtgggtcacatggtcctgctgaccatggaaagagaagactgataagtgaaca

SEQ ID NO: 6873531 - DNA, 70 bp, Homo sapiens
gtcatcacacatttacccttgtataggcaaaccccgtgtatgctgttctacaagtgtaagcttgtgagac

SEQ ID NO: 6873532 - DNA, 57 bp, Homo sapiens
ccatgtttgaaggatatccaggctggcaggaaagcctgtgtctcgttaaagcattgg

SEQ ID NO: 6873533 - DNA, 84 bp, Homo sapiens
gggaaaggaggaggaaaccctgttcctctgatgtttggtggcctgggtgtcagcaggcagcatgggaccctcctgtctgatctc

SEQ ID NO: 6873534 - DNA, 71 bp, Homo sapiens
cccagctgcacctctatggcctttccctgagcataacccctagctcccctgggccttgagtgtgcggtggg

SEQ ID NO: 6873535 - DNA, 80 bp, Homo sapiens
gacagaaagcagccagaacctaggatgagctggaagaggttgtccccacacagctcaggcttctgctccttctttgactc

SEQ ID NO: 6873536 - DNA, 79 bp, Homo sapiens
acctcattcatggctctttgtggccacctaatcttgggattatgccagtgacatgaccacaaagcagcatgactgacgt

SEQ ID NO: 6873537 - DNA, 85 bp, Homo sapiens
gtaaatcctgcggaatcggagcccaacgtgtgtaatgccggggctgtgcttacaagatcgtgctccagtccgcatggaaaattac

SEQ ID NO: 6873538 - DNA, 77 bp, Homo sapiens
gttcctgtagcagtagccattcctaaccctataagtagaggtattagttgtatggctctgcactgacagacttgaac

SEQ ID NO: 6873539 - DNA, 84 bp, Homo sapiens
gcgcgagcctctttatctccaggttgtgcctgcgtccggagaccacccaatcttggcgatggcgctctgagatggcctctgtgc

SEQ ID NO: 6873540 - DNA, 83 bp, Homo sapiens
ctacttattctacatttggagtgatgtctttagccgtggtcactatacctctgcctggacctcttctcgagtagagtaaccag

SEQ ID NO: 6873541 - DNA, 101 bp, Homo sapiens
tgcagtcttctgcctgctgcctgtattgcccttcactgcaagcaggactgtgccctactgctgcaagagctgtggcaaaagcagctggctaggcagatgca

SEQ ID NO: 6873542 - DNA, 114 bp, Homo sapiens
ggagggaagaaaatgaaaggggcttttgtgcagagaggaaaaggggcaaggctgcatgtcaaagcaaggtcagtcttttctgccagctgagccctgcatctcatggttccaccc

SEQ ID NO: 6873543 - DNA, 118 bp, Homo sapiens
ttacgattcagtttttaaaagtaaaacagataaaagtttggatccagcaaaagagcagttagattgttttgctagtctagatttaatagtctctgtattaggtgtcattgaatggtaa

SEQ ID NO: 6873544 - DNA, 58 bp, Homo sapiens
tgaacattagttgagtaaagtccacagaatggtgctatctttgctccattaatgatca

SEQ ID NO: 6873545 - DNA, 55 bp, Homo sapiens
gactggtttctagcctcatagttgttactaagaagctgtgtcctagcagccagtc

SEQ ID NO: 6873546 - DNA, 56 bp, Homo sapiens
caggaagctcttagcagtcaccttccgattggggttgattgggttaaggccttctg

SEQ ID NO: 6873547 - DNA, 56 bp, Homo sapiens
ctctggttgagtgagaaccaaggtaaagcccctggggttacaacagttaaacagag

SEQ ID NO: 6873548 - DNA, 88 bp, Homo sapiens
atcttagtttaagatgatgatttaagtggccaaagtagacatatttaattctacttatgtaactaaaaatcagtttttaaatgaagat

SEQ ID NO: 6873549 - DNA, 90 bp, Homo sapiens
tgaataaatcttgtctttcactcgcctctgcctttgcgtagaggatacctgctgtgcaaaggtgatgtgagaaagtcaggtctaaattca

SEQ ID NO: 6873550 - DNA, 84 bp, Homo sapiens
aagatgtctttggaaggaatcatgatccaaattacttagtctgtaattacaagccaccatcagtgacttcttccaaagtttctt

SEQ ID NO: 6873551 - DNA, 57 bp, Homo sapiens
gtattcatcattttttggatgatgattcaaaaaatcgtcatcctttggatgaatcac

SEQ ID NO: 6873552 - DNA, 68 bp, Homo sapiens
cctgtctgccctcaacccagaggcagtgaaaggaagaagccacggccttgggatggggggcgtgcggg

SEQ ID NO: 6873553 - DNA, 114 bp, Homo sapiens
tcattcaggtgttcatcatcatcgacaaaggatgattgttggctctcttgatgaaagatagaaacatctgggatagtaatcatcgttagtgatatcaggaattatttagaatga

SEQ ID NO: 6873554 - DNA, 55 bp, Homo sapiens
gatcagagagttagaaatgtcagagcccagaactggcatcttctgacttcagatc

SEQ ID NO: 6873555 - DNA, 60 bp, Homo sapiens
caggaaccctgacaggtgtccgaagcaggaaagccatgctggccctggctcagggaactg

SEQ ID NO: 6873556 - DNA, 63 bp, Homo sapiens
ttgggtgatgtgggggagctaaagatcctgagggatgactttgctgctgtatatggagcccag

SEQ ID NO: 6873557 - DNA, 57 bp, Homo sapiens
tgagtatattttccctgggtggtagttgatttccactcagctttgggagatgactca

SEQ ID NO: 6873558 - DNA, 85 bp, Homo sapiens
actctgccctctgtatgggatttactggttcctccgtaacaaacaacattgtttcaatcagcaaatgcttactcagggcctaagt

SEQ ID NO: 6873559 - DNA, 68 bp, Homo sapiens
ttgctgttgttctgtctttctgctgcctggccttggtcaagggtgcagtcacaggaaatgtgcagcag

SEQ ID NO: 6873560 - DNA, 71 bp, Homo sapiens
atgcagattccttggtccctccccagaccaaatgactcattgtctccaagggtagggccaagaatctgcat

SEQ ID NO: 6873561 - DNA, 84 bp, Homo sapiens
gcgccctctctaaggcactctgccaggtctcctgatttccagtttccgggaggtgaggccggctagggtgccccgagggcctgc

SEQ ID NO: 6873562 - DNA, 64 bp, Homo sapiens
gagattctgggcctctctgcagactaagcaatcagaaactttgcaggtagggcccagcagtctt

SEQ ID NO: 6873563 - DNA, 55 bp, Homo sapiens
gctttacacatgagacctgcaataattgttattattcggtgtgatggtgtggagc

SEQ ID NO: 6873564 - DNA, 55 bp, Homo sapiens
acaaggtttattaataagttggtagtagtactgacttgttagatataaagtttgt

SEQ ID NO: 6873565 - DNA, 80 bp, Homo sapiens
attggtcttttctggccttcagactcggactgaaacactgactcttcttgggtgtgaagtctgttggccttgggactggt

SEQ ID NO: 6873566 - DNA, 123 bp, Homo sapiens
ctttgtgtgccaaggaccctgttagtctctgtgaagctcccgttaggcctgtctgctaactaagtgcctacaactttcagagctaggatttacagagtaacagaatactaccttcttacaaag

SEQ ID NO: 6873567 - DNA, 57 bp, Homo sapiens
caggcctcccaaaagcagctgagagattttcctgctccctggcccttgggagacctg

SEQ ID NO: 6873568 - DNA, 56 bp, Homo sapiens
catgtcttccattagactctcagattcccattactctgaaaaggtcaggagacatg

SEQ ID NO: 6873569 - DNA, 61 bp, Homo sapiens
atttattgagacttaacaacccagttatgtgtgttgtgtggttgttaaggtctcaataaat

SEQ ID NO: 6873570 - DNA, 75 bp, Homo sapiens
agttataaacacagcgtcccagaagcctgccccgggcccgcgcaccccgcttctgggtgcctgtgagtgttcact

SEQ ID NO: 6873571 - DNA, 83 bp, Homo sapiens
tatatgacgcatgacctttacacaatgattttctttatcctactgtaaatcttagtcttggtaggtggcttgggtgtcaagta

SEQ ID NO: 6873572 - DNA, 96 bp, Homo sapiens
cagacagtcttaggctgtaagagagggcagagtgccctggaacacacacaagggaaggagcgctgctctctcttggggtctgtgggaggctttctg

SEQ ID NO: 6873573 - DNA, 59 bp, Homo sapiens
gccttcagaggtcagcccccagctctcatcctgatatggggatctaggcttatgagggc

SEQ ID NO: 6873574 - DNA, 98 bp, Homo sapiens
tatggcattgtggcttcactgcatttgtttgtttgtttttctgggataatcaacaggatggtgagaaagatacatagctgtgagcacacacaaccata

SEQ ID NO: 6873575 - DNA, 59 bp, Homo sapiens
agctcattattatcctagccatgtggatcccccattgagcaattaggaaataaagagtt

SEQ ID NO: 6873576 - DNA, 90 bp, Homo sapiens
tgctacatataacatggtgaaataggtgctagatttgtgggctttatagaatgtgatatctgtacttgttagtcttcatgaagtgtagta

SEQ ID NO: 6873577 - DNA, 69 bp, Homo sapiens
tcctctggggtgtgctcagagcagggggcctgaagaatgcttcttctgtttacaacacacccaatagga

SEQ ID NO: 6873578 - DNA, 72 bp, Homo sapiens
ccttgcacaagacggaggttgtggcagctgcttgagtgacagcaaaggacgaacactctgtactgtgtgggg

SEQ ID NO: 6873579 - DNA, 65 bp, Homo sapiens
ttcattagttctgaagatgtcttagagccacatgtccacttaaagattatttccagactaatgaa

SEQ ID NO: 6873580 - DNA, 95 bp, Homo sapiens
aaaataatggtccttagaacaatgttaaattattaagaagttctagatatgtttgctgttttgataattaaaaattgtagttgactagttgtttt

SEQ ID NO: 6873581 - DNA, 76 bp, Homo sapiens
aggaaaagagactgaactctgctgtttggcctttgccctatcctggcttgtcttgcagtagagcagagattttcct

SEQ ID NO: 6873582 - DNA, 76 bp, Homo sapiens
ccagtacctagtatatctttagtacatagtcacagctcttatccctgctggactgtgagttcgagggcaggactgg

SEQ ID NO: 6873583 - DNA, 58 bp, Homo sapiens
actttgctggggtgacccgaggggtgcagccatgtggctctgttgctcgcagttttgt

SEQ ID NO: 6873584 - DNA, 93 bp, Homo sapiens
gaagggaagaattgaagcagcattgtggtaggggagcactgaaaccccattgcatcccccatctgtgcccaatttgttccaatctggcccttt

SEQ ID NO: 6873585 - DNA, 59 bp, Homo sapiens
ctggattatagaacatgcatttgactgtaacatgtttaaatgcatgtagaataatagag

SEQ ID NO: 6873586 - DNA, 61 bp, Homo sapiens
ggaagaactcacagctgagccaggtggaatgtgttccctgggccacagctgtgagctctcc

SEQ ID NO: 6873587 - DNA, 64 bp, Homo sapiens
ccttatctgcacacaatttatctttctcagggatgacgaaagaggacacttggtgtagtaaagg

SEQ ID NO: 6873588 - DNA, 58 bp, Homo sapiens
catttgatccccaaaatttcaaaggaagaatttttttcattgacagttgggggaaatg

SEQ ID NO: 6873589 - DNA, 96 bp, Homo sapiens
tggtttgcggccttgtgcccagtctcgttgaggcgcttgtccctgtctgctttcctggggcatgcctgatcagcgtgggctggagctcctagacca

SEQ ID NO: 6873590 - DNA, 70 bp, Homo sapiens
tgctgtgcttgagtacagatcatattatttcatttcagaaataatttcctgatgctgtatttaagtagca

SEQ ID NO: 6873591 - DNA, 69 bp, Homo sapiens
gggatttgggcttgcagcagagcatcacccgcacagacaggggcaggcttgggttggagcccaggaacc

SEQ ID NO: 6873592 - DNA, 90 bp, Homo sapiens
aggggtcattgttaattctgttggttagagttggagagggagcatcatgctgctgtttaacccaaataaccacaggagccagtggtctct

SEQ ID NO: 6873593 - DNA, 63 bp, Homo sapiens
gccaaagtcctccagccatgcacacacacgctctgtgctccactgggcaaagggggcattggc

SEQ ID NO: 6873594 - DNA, 63 bp, Homo sapiens
gctctgcagcttatttgctgtgtgaccttaagcaagtcactacacctctctgagctgctgagt

SEQ ID NO: 6873595 - DNA, 65 bp, Homo sapiens
ggtttcaggaggccgtgtgctcagtggagtgtctctgcctgtcttcgctaagcttgcccctgacc

SEQ ID NO: 6873596 - DNA, 91 bp, Homo sapiens
ttgcaagggagctggcaggaggctccccgagacgaagcaggtaaatgtactctcacctgctgattgatgagtgtcctgtagcccttggcag

SEQ ID NO: 6873597 - DNA, 70 bp, Homo sapiens
atctttagcctggaagaacctgaagtctccactgcttcccaagagactcagatattaaaggacttaggat

SEQ ID NO: 6873598 - DNA, 86 bp, Homo sapiens
gtggggtctgaggttacagtggtgggctcacagcgaggctcatcctgcgtgtggcgagaacattggaccatcagtcaccaccccac

SEQ ID NO: 6873599 - DNA, 69 bp, Homo sapiens
ggaaaattgagagtcttgtgcaagttgtaagctttctgcttaatcttctggaaacttttccaattttcc

SEQ ID NO: 6873600 - DNA, 67 bp, Homo sapiens
aattaattcagtttttaagggaaggaggagacccaaatcatatccctaaataaattctggatgaatt

SEQ ID NO: 6873601 - DNA, 105 bp, Homo sapiens
atgttaaggacccattgtttgggtccttattgataccaatggccataataatctctaaatttatttattcattaacagggaccaaagtcaatagggccttaatat

SEQ ID NO: 6873602 - DNA, 63 bp, Homo sapiens
actatgaagtgcaagctgctttgtttcttcttggtgtacattcagcatcttgcatcttcaagt

SEQ ID NO: 6873603 - DNA, 57 bp, Homo sapiens
cagtcttgttacagagtgtcttttctggcaatttcaagaaggcaccagcaaggactg

SEQ ID NO: 6873604 - DNA, 68 bp, Homo sapiens
ccggtgagtgagctctgcggtgtcttcccacatcacaccttggactgctggggctcattcatctccgg

SEQ ID NO: 6873605 - DNA, 76 bp, Homo sapiens
ccaagttgttgggtcattcccatggaaagaggcagtaacttacaggtcttgccatggcaatggtaaactgacatgg

SEQ ID NO: 6873606 - DNA, 90 bp, Homo sapiens
ctgaggtcatctcatccttaagagaacttttaggaccagacaggaatgctcatctctctgtgcccagtagttctctgggggtggcctgag

SEQ ID NO: 6873607 - DNA, 64 bp, Homo sapiens
ttctctgcctctagctatattctgtagaccggttggggagggagtacagaggagagggagggaa

SEQ ID NO: 6873608 - DNA, 55 bp, Homo sapiens
tgccgaggtctctcaggatgcttggatttctatattttcttccgagaccctggta

SEQ ID NO: 6873609 - DNA, 73 bp, Homo sapiens
cggcaggtggattaggctcacatgctagatttggtttacttgctagatttggcccatgggctataacttgctg

SEQ ID NO: 6873610 - DNA, 62 bp, Homo sapiens
tgtgtgtcctcataagatggaggggaaaagggctcccccacgcctcctttataaggacacca

SEQ ID NO: 6873611 - DNA, 94 bp, Homo sapiens
ccatttctttgactatgcagttgtcatggtttctagactttttagcacacatctttagaaactcacgttatcattgcctcttgttaaattatgg

SEQ ID NO: 6873612 - DNA, 62 bp, Homo sapiens
tccaggttatggatggtgttatagtcagtttgggatgctataacaaagtaccatagactgga

SEQ ID NO: 6873613 - DNA, 111 bp, Homo sapiens
ccaatgaacacattacgtcctctgtatggtttttatcaagtaactgccccagtgctcccatgacgctgggcaggtccacttgttaggccagtgagggccatagttcgttgg

SEQ ID NO: 6873614 - DNA, 72 bp, Homo sapiens
ggaccagtcacagggaggacatcaacagtgtggaagtgaacagcattttgatctgttctccctggactctct

SEQ ID NO: 6873615 - DNA, 87 bp, Homo sapiens
ggccggcatgaagactacaggaggatgtgcagccagggagaacgaagacatcttggcatgttcatctgcttggtacagatcctggtc

SEQ ID NO: 6873616 - DNA, 74 bp, Homo sapiens
gaggaggggtctgggtggccttcatagctcagggtgagatacccttgggtcctgagtgaccccatcccctcctc

SEQ ID NO: 6873617 - DNA, 129 bp, Homo sapiens
ttctctcttgtcaatgctgatgacatccatgaatccagcagggtaggttgtatcagttcaaaccttgccatcgatcttaatgaactgctgcatgcaaatcttctttacttcatctcctgtcagggcata

SEQ ID NO: 6873618 - DNA, 76 bp, Homo sapiens
gtccatgttccctgcaacctttccctgggctcttgagggtttatcagggttgagggttgccttagtaggcttggac

SEQ ID NO: 6873619 - DNA, 79 bp, Homo sapiens
gggctccctaaggacctgctctcccagttctctactcttccctctgaggcagaggctgggcaggacccacaggcagccc

SEQ ID NO: 6873620 - DNA, 80 bp, Homo sapiens
tgtgtgataatgggcacatatgctcattaacatgctgtcataaacagctgtgttaaatgtattatgtgttctgtgacata

SEQ ID NO: 6873621 - DNA, 63 bp, Homo sapiens
tctgagggctgtactatgcacggaagaatcagaaatgagtatagtatttttctggccctccga

SEQ ID NO: 6873622 - DNA, 96 bp, Homo sapiens
ttaagcagaagcaattgtaagctttaagcactagcaaatgtgaagacgctttacaatttgctgtgtgctttagagactcgtattgaccatgtttga

SEQ ID NO: 6873623 - DNA, 55 bp, Homo sapiens
gcttcttgtagcccccttgacctcaccagtaaggcagctaagggggaaacggagc

SEQ ID NO: 6873624 - DNA, 79 bp, Homo sapiens
gaagacggcccaaaccaagtacctcaaatccagtgtcccaagaactgtttttagtgtttgaggttgtgtacctgtcttt

SEQ ID NO: 6873625 - DNA, 75 bp, Homo sapiens
gcaaatgcatatcaaagacttgaacaggcaatctcttgaaatttgaggatttttagtttttaatgctgtatttgc

SEQ ID NO: 6873626 - DNA, 58 bp, Homo sapiens
cctcagggtggcatcagatctttttatcttctaacctaagacggaggccgccctgagg

SEQ ID NO: 6873627 - DNA, 57 bp, Homo sapiens
gagctcaagcacattttgtggtgccaaaatatggcttgcctcagagggtttgagttt

SEQ ID NO: 6873628 - DNA, 76 bp, Homo sapiens
gcactgcctgcagttcatgggctctgccttgaagacttggaggccaaggggcaggtgtgcagagctgttggtcagc

SEQ ID NO: 6873629 - DNA, 86 bp, Homo sapiens
gcgcgggccagctggggccgggtctgcgttcccaggagctgccaccgttccagggagcaagtcaggccgggacgtagcgcctgcgc

SEQ ID NO: 6873630 - DNA, 66 bp, Homo sapiens
tgctctgaggtcctcagagggaaaggttcgggatcccccgtgcctctccctgcagggcccagggca

SEQ ID NO: 6873631 - DNA, 87 bp, Homo sapiens
aggcaaactgtttaaagtcttctcaccatagcaaaggtcagtgcctccataaagtgggagaagacgtactttagacattttattcct

SEQ ID NO: 6873632 - DNA, 63 bp, Homo sapiens
tggagaatctggaaactgttgactttctctacttcttctgagaaacagttccaaatctctcta

SEQ ID NO: 6873633 - DNA, 64 bp, Homo sapiens
ccagacatagcaacagcatcaagtcaaataaatgttagactggaaggctgagttgatagtctgg

SEQ ID NO: 6873634 - DNA, 70 bp, Homo sapiens
gcagttcctctgctagttttgcctgggcttattcatgcatcagcaaggcagtcagctggctgggaggtgc

SEQ ID NO: 6873635 - DNA, 59 bp, Homo sapiens
ctcttagctagaggcaattatgttggattaattaatattcatagcctagtggctaagag

SEQ ID NO: 6873636 - DNA, 59 bp, Homo sapiens
gctagggtgtgccggggctggagctccccgtggacacggctcctggaggcaccactggt

SEQ ID NO: 6873637 - DNA, 59 bp, Homo sapiens
ggcttaagatttgagatacctaatacctagctggcattaggtatcgcaaatcttaagcc

SEQ ID NO: 6873638 - DNA, 57 bp, Homo sapiens
gagctcagggcattgagcaagaaaacatacttttgtaacagtagtgctctgagactc

SEQ ID NO: 6873639 - DNA, 58 bp, Homo sapiens
tgaaatttagtcttagtgtataacctgttttgggtcataggctttgacttagttgtca

SEQ ID NO: 6873640 - DNA, 70 bp, Homo sapiens
gagcgcagcggctggaccagcgttcaagcccaagcacaggcctgcgagaaccttgttccagccgccgttt

SEQ ID NO: 6873641 - DNA, 64 bp, Homo sapiens
agaccgcagagcactggggagggatgcgccgatcaggtgggccaagcccaggctttgtgggtct

SEQ ID NO: 6873642 - DNA, 100 bp, Homo sapiens
ttttcgtgttagtctctcctgctgaactgcatgtgtcttagggattgtaagtatgccatctgtgtatagcagtttccagtctagtgcatgacactgaaaa

SEQ ID NO: 6873643 - DNA, 55 bp, Homo sapiens
gcacagacccaccatctatagttttcagattcaagggagaagtggtgggtctggc

SEQ ID NO: 6873644 - DNA, 77 bp, Homo sapiens
gttattagttgacttttactaaaacatgcacctttacgatggtgtttttgtagaaacataagtagtcaaatagtaac

SEQ ID NO: 6873645 - DNA, 73 bp, Homo sapiens
tttctatatatcctggatagttgtgaagctcacatgagactgggcatttgaaactattcggagaggtgagaaa

SEQ ID NO: 6873646 - DNA, 73 bp, Homo sapiens
ggttcccaatgtggggaaatgtcctgccttccctcccattccaggtaaagtagtaaatttcccattggtcact

SEQ ID NO: 6873647 - DNA, 84 bp, Homo sapiens
caatccttttccttggtaagattatcatatgtaagagctttacaagctttcatgaaaataatctacttacgggggcagggattg

SEQ ID NO: 6873648 - DNA, 62 bp, Homo sapiens
tcgcacctgtcctctgattatggtgtctctcaaaaattccatcaggttctggtaggctgtga

SEQ ID NO: 6873649 - DNA, 61 bp, Homo sapiens
cagggctctgaccagaatctggactctgattgtggtgcaattttctgaatctggtgccctg

SEQ ID NO: 6873650 - DNA, 83 bp, Homo sapiens
agtgttgcatgaaaatatcttgtatagccctggcacatacaaagtgctcagtaaatggtacgtatatttttatcattaacatt

SEQ ID NO: 6873651 - DNA, 63 bp, Homo sapiens
tctgggtgtggatgctatgagattatcaactatttattaatctttcattcattcatacataga

SEQ ID NO: 6873652 - DNA, 115 bp, Homo sapiens
gggcctggcaggactcttaacacccctctactgggctgggtacgtgcaggatgtgcctcgcataacgggagcctgtgcccatccctctggagtgtgtgagggttgagcttggctc

SEQ ID NO: 6873653 - DNA, 66 bp, Homo sapiens
ggtgcagggagaggcaggcccccaaacacagggggctattgtgcccctcccaggaacacaggcacc

SEQ ID NO: 6873654 - DNA, 62 bp, Homo sapiens
ctgtgatctggctgggacttcagggtcattgtgaccctgccagggtcctgacagacaagcag

SEQ ID NO: 6873655 - DNA, 95 bp, Homo sapiens
caactctttgatttcttgtcagcagatgtggtgaaaagtcgggttttgtcttctgtaggcttttcatggatatgtgccaagataattgggagttg

SEQ ID NO: 6873656 - DNA, 58 bp, Homo sapiens
ccagccagccttgatctgagtatcaaagcccctgtgacctagactggggctgggctgg

SEQ ID NO: 6873657 - DNA, 57 bp, Homo sapiens
gctcaatgaggtgattgctgtcctctgtgaagatgaaggcagttaaacgtcatctgt

SEQ ID NO: 6873658 - DNA, 70 bp, Homo sapiens
gagatcaatagcatgtgtgtctagtggttatcataaaggacagcacagctcttgacaacagcaacttctc

SEQ ID NO: 6873659 - DNA, 58 bp, Homo sapiens
tcccctctggagcttctgtaagaagagtccattgtttccacagaagcatagaaaagga

SEQ ID NO: 6873660 - DNA, 65 bp, Homo sapiens
gcatccattgtttatgtgtttctcattcctgttaaactgtgagctccatcatctgcaagggatgc

SEQ ID NO: 6873661 - DNA, 105 bp, Homo sapiens
tatgttgttgccagatattttaggaaggccttgaatgccagtctgagtgtcaacagttttggtatttcaagcagggccactattccatatgctcaaagcaacata

SEQ ID NO: 6873662 - DNA, 68 bp, Homo sapiens
gcatgacaggtgtttgtagtggcaagatgatagtaactgtagctaccattattgagcacctactgtgt

SEQ ID NO: 6873663 - DNA, 84 bp, Homo sapiens
accttagttggagatggggtctctatggggataatcaagtcaaaataaagttattagcctaggccctaatccaacatgactggt

SEQ ID NO: 6873664 - DNA, 70 bp, Homo sapiens
ggatacattgtttaatggtggggtttgggattccagtgtacccattgcccaaatagtaaacattgtatcc

SEQ ID NO: 6873665 - DNA, 100 bp, Homo sapiens
ttaaatttctgataaacagtggacaattttgagtataagtatgtccgaatattgcatggaatatacttatactaagaatgtacttgggattcaaatttaa

SEQ ID NO: 6873666 - DNA, 71 bp, Homo sapiens
ccttgagaaattaatgatgggatctctgaaacttcattgaagacagcagatactttcattgaagaataggg

SEQ ID NO: 6873667 - DNA, 55 bp, Homo sapiens
ggcacttctccagcctgcctgcttagtgctgggcaggtgctcccagagaagtgct

SEQ ID NO: 6873668 - DNA, 56 bp, Homo sapiens
tgtctggggaactgtgcatccagggccacacggctagagcgcaggcccatcagata

SEQ ID NO: 6873669 - DNA, 62 bp, Homo sapiens
accagttggtttgtcccactccattgtctctgcagattgatgggtgccccagacaagctggt

SEQ ID NO: 6873670 - DNA, 72 bp, Homo sapiens
ttcttgattaggaggactttatggtggcaatgcaaggactgtccttatgttttggaggtcctcactagagaa

SEQ ID NO: 6873671 - DNA, 64 bp, Homo sapiens
gtataatcctgcatagaaatacagaaactgtatgttctttctggctttcttgtcaggatgttac

SEQ ID NO: 6873672 - DNA, 64 bp, Homo sapiens
atttttaagcttccaatttctccaagagagttgtttagctctgttgtctgtggaagcaaaaaat

SEQ ID NO: 6873673 - DNA, 63 bp, Homo sapiens
ggtgccacactagagattgttctgtgtatacccaatacagattttaaatttgtagttgacacc

SEQ ID NO: 6873674 - DNA, 76 bp, Homo sapiens
gcatgcagggataatgccccggagtctaattagggctggaaagatgttgccctgagatggggattattccaacagc

SEQ ID NO: 6873675 - DNA, 59 bp, Homo sapiens
caggcccatgtactactttctgagctccatgtctttcctggagatctggtacgtgtctg

SEQ ID NO: 6873676 - DNA, 56 bp, Homo sapiens
gatatcatatcagacaacctctgtagtaacccactggtgaattgtgatatgatatt

SEQ ID NO: 6873677 - DNA, 63 bp, Homo sapiens
gccaagcctgtagacacaagcttcccaccccctctttcaaagcctccctcttcaggtttgtgc

SEQ ID NO: 6873678 - DNA, 65 bp, Homo sapiens
gatgaaaaattgctgtgtcatactgagactactaagaacaatgtgtgatgcagcaataactcatc

SEQ ID NO: 6873679 - DNA, 65 bp, Homo sapiens
tacttcctgtttccatgtctgtcctggagcgctaagaaagggcatgtgggagatttcaggaggtg

SEQ ID NO: 6873680 - DNA, 79 bp, Homo sapiens
agtagtgagtagagaggcagagctgggatttgaagcctagtggactggctccacagttgctgcttttaatcaccctgct

SEQ ID NO: 6873681 - DNA, 129 bp, Homo sapiens
tctgactttattaagattgagcataaaaagcaagaggctggattaaaaaccaccattaaaatacccaagtgaatttaattcagtatttatggaactgagtatgttttactctaataaggaacagcttaa

SEQ ID NO: 6873682 - DNA, 75 bp, Homo sapiens
gggaaacaatgaattcttagcatgaagtcctgagatggctgtctgtggattaatgagggggttccggtggctccc

SEQ ID NO: 6873683 - DNA, 86 bp, Homo sapiens
aggcccccagcagatggagaatggagtcaggaccagaatccaggccttctgactccttaccatatgctttccagggagactggcct

SEQ ID NO: 6873684 - DNA, 65 bp, Homo sapiens
gggagcagagacagtacaactggcaatgtgagagttaccttcccgccagtgctgtctgtgtgatc

SEQ ID NO: 6873685 - DNA, 68 bp, Homo sapiens
ggcattaaactccacgttgatgagttagtcaatcccactagcaggcagactgacatgtgggggatgtc

SEQ ID NO: 6873686 - DNA, 59 bp, Homo sapiens
ggaaagtgctgttggataatgctgtcttagatagaccttcattcacaacgcacccctcc

SEQ ID NO: 6873687 - DNA, 61 bp, Homo sapiens
gctcagccgaacttcagagcagaaggctggttcttcttgcccttgttgttcggtggtgagc

SEQ ID NO: 6873688 - DNA, 125 bp, Homo sapiens
gtcacttatttcacaaataatagctccataacaaagtgctgtcattgtgtggacatggagaagaggagctcctcttctgtgttctgtgcaatgagcacaaagcattgggtgtgaatcttcctggc

SEQ ID NO: 6873689 - DNA, 69 bp, Homo sapiens
tagtgggtgatttgatgaggaatatgatatttccatagcctgaagtactttctcataaaatactcatta

SEQ ID NO: 6873690 - DNA, 77 bp, Homo sapiens
tgaggtgaagatgaggctcttcctgttggctggagtctcagcagaggctctagaagctgaggggcccaagcacctca

SEQ ID NO: 6873691 - DNA, 92 bp, Homo sapiens
ggaaaaatagccatgattttctcattttcatgtggtattctattttttccttcatttgagatgtaatagaaaattgctattctgaaatttcc

SEQ ID NO: 6873692 - DNA, 81 bp, Homo sapiens
ggggctcccccaccgtgttcctgctcggcatccacaaagcagcgcgtgtgccggacgccccctactggtcgggggagcccc

SEQ ID NO: 6873693 - DNA, 55 bp, Homo sapiens
cgagggcttcactgatgttctttgggagtggagattcatcaagtggagtatctcg

SEQ ID NO: 6873694 - DNA, 123 bp, Homo sapiens
cccatccatctctgaacctctgtgtccccatcagttttgaggatggaatggctgagagaggcaaagtgtaggcctgtggcttctgctcccagaatgatgagggatggggaagaaggggctggg

SEQ ID NO: 6873695 - DNA, 95 bp, Homo sapiens
tttgaaactgagagttattctgaatttagcccttttcagtgtgagcaattaatttaaaaaaagtgctaaatttatgtagtggcttcattaacaaa

SEQ ID NO: 6873696 - DNA, 113 bp, Homo sapiens
cgtgcgtgtcagatttaggccaggaagcggaagtcgccagcagcgagagtttaacctctgtgggcgcagagggttgcggggattcagcgcccgggaccgtggatctgtgcagg

SEQ ID NO: 6873697 - DNA, 98 bp, Homo sapiens
cttggaatgacctaaattcccaccttctctcttttgtcagtataaattaaaaataagagagagcaggtggttaacataatggaatttgcttcaccagg

SEQ ID NO: 6873698 - DNA, 68 bp, Homo sapiens
gtttctttgtttgataagtatgctgcacttcacgacaggtgagtattctagcttattagcagggaggc

SEQ ID NO: 6873699 - DNA, 59 bp, Homo sapiens
gccctcacaggctaaatttatgcaggttgctgatgctttgtgtgaatcagcctgggagc

SEQ ID NO: 6873700 - DNA, 60 bp, Homo sapiens
cacatgtgcaaatactgaggctcacaaatcattcctgtgaactcagctgtagctcatgtg

SEQ ID NO: 6873701 - DNA, 60 bp, Homo sapiens
cagtctagagaaaggagcaggagctgattacagataagctttgctgaagattttaggctg

SEQ ID NO: 6873702 - DNA, 87 bp, Homo sapiens
ggagaatcacttgaacccaggaggtggaggttgcggtgagccgagatcacatcactgcacttcaccctgggtgacagaggagactcc

SEQ ID NO: 6873703 - DNA, 65 bp, Homo sapiens
ttttcttggagtggctgtccttttcctcttagattattagaagccagcagttcctcttaagagaa

SEQ ID NO: 6873704 - DNA, 79 bp, Homo sapiens
agttttaggtggtgattctggaattttctatatatgctgtgattgggcaaaagcttagaaagcagaaaccatcagagct

SEQ ID NO: 6873705 - DNA, 57 bp, Homo sapiens
ctggagtgactttgttccttttatcctctttgaacccctgcaaagtattcactccag

SEQ ID NO: 6873706 - DNA, 66 bp, Homo sapiens
gatgatgtttaatgcttgaatgtttggaagaagagtgctttgcaaatgtcaagggttagtgttatc

SEQ ID NO: 6873707 - DNA, 89 bp, Homo sapiens
gattacaactcaaaataaaagctgggttaggagtagtacgtgggtctcccagtacccactatcctgagttttttgttgttgttgtcatc

SEQ ID NO: 6873708 - DNA, 64 bp, Homo sapiens
atgtgttcattctgtatatgctgtatgcatatcatgctacatgcatgtcacagaatgaacacat

SEQ ID NO: 6873709 - DNA, 105 bp, Homo sapiens
cccccaagtctttttactgatacaaaatattttacatgtttatgggggtacatgtattttttatgtacataaaatgtataatgactgagtcagagcctttggggg

SEQ ID NO: 6873710 - DNA, 67 bp, Homo sapiens
tcttaggttcacacacacaaaaagataagatgtagtgcatgatctggttgctgtgtgtgaatgagga

SEQ ID NO: 6873711 - DNA, 75 bp, Homo sapiens
cagtgagcccccagcagagcccggtccaagtgcgggatggactgtggcgtagatgctgggaagaggtgtccactg

SEQ ID NO: 6873712 - DNA, 63 bp, Homo sapiens
gtgcctagtctagaagcaacgtcattgtatcagggcctgcaatcagttctagaaattaggtac

SEQ ID NO: 6873713 - DNA, 67 bp, Homo sapiens
agaagcctcactgtccagcccccagcatcacaggtattgaatggtgagcagcagcagtggggcttct

SEQ ID NO: 6873714 - DNA, 99 bp, Homo sapiens
ggacccaaattgtagtaaggttttacgttcccactagaaatggtaaaatattgagtctaagtagaatgtgaaaagttaaaaatttatatattatggtcc

SEQ ID NO: 6873715 - DNA, 82 bp, Homo sapiens
tggatgttgccacagcaaagtaagctgacatgtatttgaggtcatttgcatgagtcaaactttgcaatgagtaactcaccca

SEQ ID NO: 6873716 - DNA, 73 bp, Homo sapiens
ggtccctcctgggagagcacggaggggtcatctcccttaggagccaccctcacagcttcccggggctggggct

SEQ ID NO: 6873717 - DNA, 68 bp, Homo sapiens
tgctgtgaagggctaagaaatgtgttcatcccacagaggatgaaacaacagacttggtcaaaaaagta

SEQ ID NO: 6873718 - DNA, 82 bp, Homo sapiens
tctgcaatttggactactgggaccttgtgatttaaatgacttttctaaagccatgatcctggtaagtgccagaattgtaaga

SEQ ID NO: 6873719 - DNA, 81 bp, Homo sapiens
agggcagcacagctgtgctcctgttgacaaggggcagatgatgcagaagagtccccaggagccaagatgctgtctggccct

SEQ ID NO: 6873720 - DNA, 92 bp, Homo sapiens
catattaaagtgtagctctagatcataggtcattattatagtctgtaaaaatttcaaagtagttccagatcatagagcattattgtagtctg

SEQ ID NO: 6873721 - DNA, 58 bp, Homo sapiens
ggcaggcaggagctctgtctcccggccttctccactggagcctgaagcacctcctgcc

SEQ ID NO: 6873722 - DNA, 56 bp, Homo sapiens
taggaggtggaagttgtggagcagtgtttctgctgtccataagagaccatctccta

SEQ ID NO: 6873723 - DNA, 73 bp, Homo sapiens
gaaaagaagggactttgtcagctttccaggaaagaagctgggacgcctttgacaaagtttccttagctttttc

SEQ ID NO: 6873724 - DNA, 67 bp, Homo sapiens
agcctagtcaagcaatccaatgtcctgagatgggtatttactctgacaagggattgttgagtagtct

SEQ ID NO: 6873725 - DNA, 66 bp, Homo sapiens
gaggaaagcaatggctgagaacactgaaagaaagaagcaatgttaggcagcaatgcttagatcctt

SEQ ID NO: 6873726 - DNA, 99 bp, Homo sapiens
tttggcttgagctgctgtattcatcacagggtccttctgttcctgagcaactattgtggggtttatgagccctggaaggaatagcaagttagagctgga

SEQ ID NO: 6873727 - DNA, 74 bp, Homo sapiens
ccacagatggccatattactatatttttcaaaaaatggtgacatttcactgtgtaagtggttggccatccttgg

SEQ ID NO: 6873728 - DNA, 75 bp, Homo sapiens
gtgtgtgtgtgtgtgtgtatgtgtgtgtgtgtgtgtgtgtgtgtacgcatacatagaaacacacagagtacagac

SEQ ID NO: 6873729 - DNA, 80 bp, Homo sapiens
ccttgagtttgcaaccttaataggttaactgtggtgaggaaaaaacacatagacagctagggctgcagggacctcagagg

SEQ ID NO: 6873730 - DNA, 101 bp, Homo sapiens
tcttcatcctgagcccattgctagatcagcagaagtatagaggccatttattaaaagggccagtcgtgtattactgtttcttatggggcaaagagacaaga

SEQ ID NO: 6873731 - DNA, 83 bp, Homo sapiens
gtcttgatcacatatttccagaacagaatccagagaaaggaggggtgctactggagctgaggggaatgctgagagcttggggc

SEQ ID NO: 6873732 - DNA, 55 bp, Homo sapiens
tccggtccgggtactcctctctaatcttgttcatgagcagagtgcccatcccgga

SEQ ID NO: 6873733 - DNA, 76 bp, Homo sapiens
taatcaaggctgcataagacgagagaattttatgtaagaatttcctatcctggtcttaaaaatgtagctttttttg

SEQ ID NO: 6873734 - DNA, 112 bp, Homo sapiens
agctatacctcagatgctgttggccttggcagtgagaagagttgataaaagtcagtaagtccattcttccggaacttgccagggaagacctagtcttcaaccaagtttggct

SEQ ID NO: 6873735 - DNA, 57 bp, Homo sapiens
caggaacagagtggcattgtctggccagctgggttcctggagaatgcctctgtactg

SEQ ID NO: 6873736 - DNA, 76 bp, Homo sapiens
cctggccttggcctgggacagagcagcagtggggaggggcctttgtgcatctctgctcctacagctcagggctggg

SEQ ID NO: 6873737 - DNA, 72 bp, Homo sapiens
tttagtctctggtttataaatctgtggccagttactagtggcatttttgttagcctgaaaaaagagactgaa

SEQ ID NO: 6873738 - DNA, 56 bp, Homo sapiens
caggaagaccagggctgtggctccagctcccccgaccaccccctgagtcactcctg

SEQ ID NO: 6873739 - DNA, 92 bp, Homo sapiens
cttgctggctcatgatgaagtggcatgggggtccccagttgctgggtcccacacaggccctctgctcacttcctattctggagatcaatgag

SEQ ID NO: 6873740 - DNA, 73 bp, Homo sapiens
gctgctttagtaatccagccttgtgcttaattttcacatatccatacagggatgaggaagattactgagaagt

SEQ ID NO: 6873741 - DNA, 110 bp, Homo sapiens
tttaagactacattatcctgtttctaattccttttctttcttcctgcggaaatgtaattgcagaagctgggagaagggattggagtgtgggcttctatatctgtcttgaa

SEQ ID NO: 6873742 - DNA, 103 bp, Homo sapiens
ttgagacggaatctcactctgtcgcccaggctggagagcagtggcacgatctcggctcactgcaacctccacctcccgggttcaagtgattctcctgcctcag

SEQ ID NO: 6873743 - DNA, 65 bp, Homo sapiens
cagatgagagtggccagggttcatggtcatgctcacatcctccctggacacacacttttattctg

SEQ ID NO: 6873744 - DNA, 66 bp, Homo sapiens
tggctgccctctcaggtgaggcacatgtggtggaaaaccaactacaaccagcactggagggcacca

SEQ ID NO: 6873745 - DNA, 57 bp, Homo sapiens
tttctgagaatatttctgttcatcgtgaaatagatgaaaaatgaagttgttcaggaa

SEQ ID NO: 6873746 - DNA, 64 bp, Homo sapiens
attttggggagacatggccagctgacttcacaattacttagtctgctccaggctctcccaaagt

SEQ ID NO: 6873747 - DNA, 60 bp, Homo sapiens
aaggaagttttcttggttcctacttgtacgacctgtggaggtttcatgacaaatttcctt

SEQ ID NO: 6873748 - DNA, 96 bp, Homo sapiens
gttttgctttaggtattataaaatagtgtatttttcaaaattatagccataaagttgtagatttgcaatgaaaatactctctttgccaggctagac

SEQ ID NO: 6873749 - DNA, 63 bp, Homo sapiens
agtggtagagtcaaggttgtaactcaggtccagatgattccagcatagacactcttaaccact

SEQ ID NO: 6873750 - DNA, 102 bp, Homo sapiens
ccagtccagcagtatttacacagttttgggcaggtctagggtagaaccagagattctgaattcacaccaagcttcccaaagatgacaaaactcctgttttgg

SEQ ID NO: 6873751 - DNA, 64 bp, Homo sapiens
ctggttttccaatgttttgactggagggcaaaattttactactactcatctttttggagaccag

SEQ ID NO: 6873752 - DNA, 56 bp, Homo sapiens
gcccaaggtcacacacaggaaggaaggcaaaattcctccagtatgttatttggtgt

SEQ ID NO: 6873753 - DNA, 58 bp, Homo sapiens
ccaagggaaaccgagaggctgggagtgccaagtactgcagtctctctgtcttccttgg

SEQ ID NO: 6873754 - DNA, 71 bp, Homo sapiens
ggcctcccaaagtgctgggattacaggcgtgatccaccgcgcctggcagcccctagacatttttatcggct

SEQ ID NO: 6873755 - DNA, 61 bp, Homo sapiens
cagcagctcccatccgctgagcaagacactcaccaggcacgccggcgggaggaagctgttg

SEQ ID NO: 6873756 - DNA, 100 bp, Homo sapiens
tttttcaccaaatatctatagcatatacagataagctgtgtgtgtgtgtgtgtgtgtgtgtgtgtgtgtgtgtgtgtgtgtgtgtgtgtttggagaaaga

SEQ ID NO: 6873757 - DNA, 64 bp, Homo sapiens
gctgagtgggagataacttaacagcttgtccccgattgtaatggcatgtttttccccactccgc

SEQ ID NO: 6873758 - DNA, 55 bp, Homo sapiens
agataaaagtatgtgtacacttgaaatttctacaaagtgcatatactgcctatct

SEQ ID NO: 6873759 - DNA, 69 bp, Homo sapiens
gtgactattgccagggtcaggatgagatctgcccgtcagccgactttattactaaccctgtgaagttgc

SEQ ID NO: 6873760 - DNA, 110 bp, Homo sapiens
cctgtgtgtggtggccatggtgggcaaaggatgcaggggcagcagagcctggtggagactgcaaggatttgtggctctgagtctgcccttggctagccatgagacacagg

SEQ ID NO: 6873761 - DNA, 66 bp, Homo sapiens
ttttacagctgaaggagctagtccagatgaatttaaccatttgttttaacgactcagcttgtaaaa

SEQ ID NO: 6873762 - DNA, 83 bp, Homo sapiens
ggtgtaaggcattggtctttttccagttccctcacttatctccaagaaaagagggctctgaaaggaggtcactgctaaacatc

SEQ ID NO: 6873763 - DNA, 79 bp, Homo sapiens
agaatcttgctctgaggctggagtgcagtggtgctaccttggctccctgcaacctctgcctcctggttcaagtgattct

SEQ ID NO: 6873764 - DNA, 57 bp, Homo sapiens
tcattctctgggatgcagtttgtccatgtgtgaactgaagtcgttccagagtagtga

SEQ ID NO: 6873765 - DNA, 77 bp, Homo sapiens
aatggccttacaggtctgtgtcatcatctgtaacagagaaggctgagaagatggtgtcagtagattctggggacatt

SEQ ID NO: 6873766 - DNA, 78 bp, Homo sapiens
gtgcgatagctagaaacaggtcaataaattattcatgatcaaaatgaatttgctgtttctctggccacattattgcac

SEQ ID NO: 6873767 - DNA, 87 bp, Homo sapiens
caggcttgttaaataggtaaattgtgtgttgctaggggatggtgtacggattattttgtcacccaggtaatagcagtttggagcctg

SEQ ID NO: 6873768 - DNA, 62 bp, Homo sapiens
agcatcagtctcagcacctagtcacatgtgtttttcgtgttttcgtggatgaggctggttct

SEQ ID NO: 6873769 - DNA, 61 bp, Homo sapiens
atggtaacttgtacatttccctgtgttcacagcagcacagtggaaagaaacgaattagcat

SEQ ID NO: 6873770 - DNA, 60 bp, Homo sapiens
tttcctcagaagtgtctactatggggctccacctcatgtgagtgatgcatttctgggaaa

SEQ ID NO: 6873771 - DNA, 58 bp, Homo sapiens
tgggctagcagggaagagagacttgtttttctcttttttcctgaccagttgctgccca

SEQ ID NO: 6873772 - DNA, 65 bp, Homo sapiens
ggaggatctgggagtgtccctctggtaataagcctcttatccccaggggcattcaagcttccttc

SEQ ID NO: 6873773 - DNA, 72 bp, Homo sapiens
gctgtcctcggtccccgggaggaaagttgcatgaaggggtctctttgaggcgggctcggggacaagggcggc

SEQ ID NO: 6873774 - DNA, 58 bp, Homo sapiens
taatctgacctcccagtgatagatttactgtttctacttagtcacctggatcagatta

SEQ ID NO: 6873775 - DNA, 63 bp, Homo sapiens
catgtatctgtttatcttgtcatctggcttccctcagcacagtgcatgatgggcagaagagtg

SEQ ID NO: 6873776 - DNA, 81 bp, Homo sapiens
acctatgttgtatagtgcctggcataaaccaggtagccaataaaaagctattgattaaatgcaggacttataaggtaaggt

SEQ ID NO: 6873777 - DNA, 95 bp, Homo sapiens
taaatgttattaggttggtgcaaatgtaattgtggtttttgccattgaaagtaatggcccaaactgcaattacttgtgtaccaccccaatattta

SEQ ID NO: 6873778 - DNA, 80 bp, Homo sapiens
gctgggcctgcaagttctggagccgggcctgggcagtggcgacataggtgcagctgggcctagggaagcagggacccggc

SEQ ID NO: 6873779 - DNA, 68 bp, Homo sapiens
gggagactgaggaaatgctggctttaggccaaaaaaccctggctcaaaacagcttcctccagtggctc

SEQ ID NO: 6873780 - DNA, 77 bp, Homo sapiens
gagccaggacatctctagctgctgcaaggacagcttccccgagggctgaataagcagactggagaactcctgtgctc

SEQ ID NO: 6873781 - DNA, 74 bp, Homo sapiens
atcagtattaaaggaggactttgtctgggatgaactgctaaattccagcaatccaagctttctttaaagttgat

SEQ ID NO: 6873782 - DNA, 70 bp, Homo sapiens
attaagtgtcaggcagggagtgtcttttatcaccatgtgatgttttctctggtgctctttgtcacttgat

SEQ ID NO: 6873783 - DNA, 101 bp, Homo sapiens
ggaggctggcctgtcttctgtaggtaccagttgaaatagatgtatccattactgtgaagggggctgtgactagacctgcaggagatggaggctggctctcc

SEQ ID NO: 6873784 - DNA, 76 bp, Homo sapiens
cgtgtactgttatgagtcctcatatactatttcatcagttaggaagttgtaaataaagaatcataacagtgacatg

SEQ ID NO: 6873785 - DNA, 62 bp, Homo sapiens
gggcacctagctgaggagtgtgagtggcagaagccactggtgtctgagcagggtgagggccc

SEQ ID NO: 6873786 - DNA, 57 bp, Homo sapiens
gcttgtctgtggttctaatggtggctgtgctcctccatgctccagctccagacaggt

SEQ ID NO: 6873787 - DNA, 60 bp, Homo sapiens
caggaatctgggaagtagatagtttgtctccagttgcctgcctgcttccttccctcactg

SEQ ID NO: 6873788 - DNA, 69 bp, Homo sapiens
gggctcttggccactgatttcaaggccggtgatgcgacgcctggagacagcagaggcggcaggagcacc

SEQ ID NO: 6873789 - DNA, 56 bp, Homo sapiens
cctgtctgttacctccaagaccattctaatagaggtcatatggaaggagcagttgg

SEQ ID NO: 6873790 - DNA, 77 bp, Homo sapiens
agatcagtttaaggagtgttgccatcttaacaatgaatcttctgattcatgaacatggaatatctttttatttatct

SEQ ID NO: 6873791 - DNA, 63 bp, Homo sapiens
gccttggctggctacctgggccgagcacaaaaaatgagatgctcacccttgtggcagcgaggc

SEQ ID NO: 6873792 - DNA, 57 bp, Homo sapiens
gagttggtataatttctgcagcccattggcaggctgtggaaaatttgtatgtaattc

SEQ ID NO: 6873793 - DNA, 61 bp, Homo sapiens
tgttaggagcttcctgggctgaagaagttcagaccctagccagtccagggtgctcctaaca

SEQ ID NO: 6873794 - DNA, 84 bp, Homo sapiens
ctcagctttatacatgtcaatttagtactcttaagcatctgtttactgtttgataaatatttttgttggcatgacaaagttgag

SEQ ID NO: 6873795 - DNA, 74 bp, Homo sapiens
ggcccagacccaagagtggtggaggtggtacaggccttctcccactcccacccccgccacctctaagctgggtc

SEQ ID NO: 6873796 - DNA, 109 bp, Homo sapiens
cacattttcctctcagaaatagcaaggagtagatagattctaagcactaaatatgattttggtgtcatgttggggtttatttacctcccgtgagattaaggaatttgtg

SEQ ID NO: 6873797 - DNA, 68 bp, Homo sapiens
agagcacagactttagaatcagatagcctggatttggactcaggcttcgcaaggttagagctggcttt

SEQ ID NO: 6873798 - DNA, 67 bp, Homo sapiens
aattttgggacaggtttattatgtagcattattgaagcaatagctgattaatgtactacctaagatt

SEQ ID NO: 6873799 - DNA, 69 bp, Homo sapiens
ggaagacgcaagatttgccagtggccaacttctgtttgaagactccgtgacagatttgcacaactttcc

SEQ ID NO: 6873800 - DNA, 110 bp, Homo sapiens
gaaagtcatatggttggaatcatatagtatgtatagaatcatacagtctgtatattcagactagtttctttcacgtagtaatatgcacttaaattttctccatgcctttc

SEQ ID NO: 6873801 - DNA, 73 bp, Homo sapiens
gtgccctagttcacagggttaggaatcactatattatttagttggtaattttcctttctgtggcttctggcat

SEQ ID NO: 6873802 - DNA, 60 bp, Homo sapiens
tacctgcaggagctttcttcccaaactttacatgtaaagttcgaaaaagctccccaggtg

SEQ ID NO: 6873803 - DNA, 56 bp, Homo sapiens
ctccattgttcgcgcagctgcaagcctgcaatcccatggctgtgagaaacatggag

SEQ ID NO: 6873804 - DNA, 70 bp, Homo sapiens
acggtgcctagcacagtgctctggacagagtggaaacgctacctgcatagtcattgagcgagggcatcgt

SEQ ID NO: 6873805 - DNA, 61 bp, Homo sapiens
gtccctggggaatcagctggaggcaggcaggcatcagtctcttctgcttttgcttagggac

SEQ ID NO: 6873806 - DNA, 130 bp, Homo sapiens
aagtttcctgagccgctctccttaggcattgggaatattttgtgaaccctcaagcaatgcagtagcactgcatactactcaactgtgtgatcgccaaaattcccactgtgtctaatgcactaggtatgct

SEQ ID NO: 6873807 - DNA, 55 bp, Homo sapiens
gggaagtgaagtgtagctgtcttaacactgacagaaagaccttgtaacacttctc

SEQ ID NO: 6873808 - DNA, 68 bp, Homo sapiens
gagcacttagatgctatgaatggtatttcactgccattaaaaggaagcattctttgaaaaaagtgttt

SEQ ID NO: 6873809 - DNA, 74 bp, Homo sapiens
gtcctaatccaataggactggtgtccctatcatcttctcttcttataaggacaccggtcctattggatgagggc

SEQ ID NO: 6873810 - DNA, 64 bp, Homo sapiens
tagcaggtgctcatttaactcctttatttatgtccttgggagtgctggtgaaggcacactgttg

SEQ ID NO: 6873811 - DNA, 111 bp, Homo sapiens
gcgctctgcagtgacatggagtatttttgagctgtgaacatagcggcatctgttggacactgtatgaattattagctcaagggagttcacagttttattattgcatggtgc

SEQ ID NO: 6873812 - DNA, 67 bp, Homo sapiens
aaagggcccatttggttgaagagttgatgtttaaaatgacaagggctcacacatgactgggctcttt

SEQ ID NO: 6873813 - DNA, 94 bp, Homo sapiens
ggctctgcctttttgaggcttcccttcctctgggggtgctgatgctgtggcatattctagatcgaggtgatgcggccccacttctaggtgagcc

SEQ ID NO: 6873814 - DNA, 70 bp, Homo sapiens
acttcgcacctagcagaacagaggtgctggcctagttgtgccaggccttgaaccttgctgggtgtgcagt

SEQ ID NO: 6873815 - DNA, 73 bp, Homo sapiens
acagaaaccagtgtcagaaggtctagcacaaggctggccactcaggcctgcagcccttcctgcatgtttttgt

SEQ ID NO: 6873816 - DNA, 67 bp, Homo sapiens
gaagtcatatagggccctggacttttggcctctgtcttctgagattcttggaaccctatgtgatttc

SEQ ID NO: 6873817 - DNA, 74 bp, Homo sapiens
gtcttcagaatgctatttctgaaatgctacctttgagttggttcagccctcatttgagaaagtatttttaagac

SEQ ID NO: 6873818 - DNA, 92 bp, Homo sapiens
ggtttatcctgttctttactagcagagtagtgcctccagattatttatatagtcaggatttacaaacttcagtttggctggaatgggaagcc

SEQ ID NO: 6873819 - DNA, 100 bp, Homo sapiens
gctatctcttatcctagaagaggcttgacaatatgattggcggtttattcccccactaaatagactaattagtgtgtcaacagccttggagtgagaaagc

SEQ ID NO: 6873820 - DNA, 86 bp, Homo sapiens
aaagaaacagtgaccacaccctgcagaccttttggtgtaaaagaggtgacaatgaactagggtgggaacaggtcatgtttatcttt

SEQ ID NO: 6873821 - DNA, 85 bp, Homo sapiens
ggagccttgctctgtcatccaggctgaagtgcagtggtgcaatcacggctcactgtagcctcgtcctgggttcaagagatcctcc

SEQ ID NO: 6873822 - DNA, 57 bp, Homo sapiens
gatgattttgttggtgattcaatctgtaaaccttgatgagttattcgcttagtcatt

SEQ ID NO: 6873823 - DNA, 62 bp, Homo sapiens
tccctaggctgaaatcagctctcccagggtcagatcctgagatggcaacaccagctttggga

SEQ ID NO: 6873824 - DNA, 86 bp, Homo sapiens
cggccccgctgcccctcacctgggcctccagctctgccagccgggcctggctatgcagcagctcggcctggagctcagcggggctg

SEQ ID NO: 6873825 - DNA, 87 bp, Homo sapiens
ggagaattgcttgaaccctggaggcagaggttgcagtgggccaagatggtgccactgcactctggcctggtgacagagtgaggctcc

SEQ ID NO: 6873826 - DNA, 58 bp, Homo sapiens
aaataacagtcagggacaacattgatcctacacttgtatgtgcctgtgctgtgcattt

SEQ ID NO: 6873827 - DNA, 76 bp, Homo sapiens
ctctacatgcagcgaggggactttccagaacacacatctgaccaagttccactcctgcctgtcacccttccaagag

SEQ ID NO: 6873828 - DNA, 80 bp, Homo sapiens
ggcagcctttctggttctctggcagaggtgctgtttaaatgacatttttcttgaagatcagagagctgttgagagctgcc

SEQ ID NO: 6873829 - DNA, 129 bp, Homo sapiens
agagggtatgttaaagaaccaatggatagtttcaaggtcgggagggctaacagcatcagaaaagaagggttaggatttaatgctggattctttcttgtcttacattatttgttctatgtgcaccagtct

SEQ ID NO: 6873830 - DNA, 78 bp, Homo sapiens
agaagaggtgagggtcttttgggggtctcttttatcctattcctgagggctctgcccccttgacctaatcacctttct

SEQ ID NO: 6873831 - DNA, 98 bp, Homo sapiens
ctttgcaagtctacctggccctggcatgtaatgacagaatatagaggaagatttcatggaagatgtagggtcagggaccttcttgaataaatacaaag

SEQ ID NO: 6873832 - DNA, 57 bp, Homo sapiens
tccttatgcagtagtgctcccagtcccgtctgatggacaatgccctctgcataagga

SEQ ID NO: 6873833 - DNA, 61 bp, Homo sapiens
cagggtctggggggcatgggcaaccataggaagggatgtaaatgcaccctcagggtccctg

SEQ ID NO: 6873834 - DNA, 69 bp, Homo sapiens
tggtgtttgtaccaaggctgtgtctcccatgggtagctcctggcaaggaagagcctggtgcagacacta

SEQ ID NO: 6873835 - DNA, 107 bp, Homo sapiens
tccaatgaacccctgagttcagtctcactccctggggtggttacagctaggccacggaacactgtgatcagtcagggctgtgaactgccactcctggggtcggagga

SEQ ID NO: 6873836 - DNA, 66 bp, Homo sapiens
ggctccctggaagaggtggccttctgtgtaggaggacatagacattatggctttcactgggcagcc

SEQ ID NO: 6873837 - DNA, 79 bp, Homo sapiens
ccatcactggctgcttgggacagccatgaaaccgttcgtgattgtgtactcccaagatggccttttgtagagtatgtgg

SEQ ID NO: 6873838 - DNA, 71 bp, Homo sapiens
tttaatatttggtgactgctctaaggaaaacatagtaatttggggcagcataacaatcactgaatgttaga

SEQ ID NO: 6873839 - DNA, 75 bp, Homo sapiens
gatgactaagtctagattctagttggaagttaagaaactgagcttcacttctggatagagtcagctttcaccatc

SEQ ID NO: 6873840 - DNA, 80 bp, Homo sapiens
gttttgaaatttagttcttctctggcctgagatggtctcaattcttaactcttagccttagaaaaataagattttaaagc

SEQ ID NO: 6873841 - DNA, 60 bp, Homo sapiens
gcttttgaccttctctgtctcagaacgttctgcatagttctatccagagaggacagaggc

SEQ ID NO: 6873842 - DNA, 89 bp, Homo sapiens
cagcctggtagtcctctgtggaccagggtataaggaatgaatgtgcttccttctaaagccttgcacagagtgatggtttttcgggactg

SEQ ID NO: 6873843 - DNA, 65 bp, Homo sapiens
cctgacctatagtttgggcaaagaggacctacatgtaggtttgaaaatgtcagctttaggccagg

SEQ ID NO: 6873844 - DNA, 68 bp, Homo sapiens
gaattacagagggtcggtcgttttatcatcacggtttgctttggctaaaacctgactctgtgtgtttc

SEQ ID NO: 6873845 - DNA, 78 bp, Homo sapiens
ctttaatctgcatacttgctgcattgtaaatttcttgatcatgatgacacagttaataagtagtaagtcagtgtgaag

SEQ ID NO: 6873846 - DNA, 60 bp, Homo sapiens
agtatttagctgactcgctacactctacggaagcaatatgaagtgatctgctgcagtact

SEQ ID NO: 6873847 - DNA, 72 bp, Homo sapiens
ggaagggcagggacaggatagggttttggggggaagctatccccaaagccctggcacttgttctgcagctcc

SEQ ID NO: 6873848 - DNA, 70 bp, Homo sapiens
tttatctcatgctatttatacataagtctttgcaccccacacagcttatggtgaagtagtagagggtaga

SEQ ID NO: 6873849 - DNA, 76 bp, Homo sapiens
gggagcgggggctgcagggacccaagtctttggttttctcagtgactcaaagatcctctctcacccacctgagcct

SEQ ID NO: 6873850 - DNA, 57 bp, Homo sapiens
gcattcacaccaaagacaaacagggtctgtcctgcatccctcttgagtgtggggtgt

SEQ ID NO: 6873851 - DNA, 77 bp, Homo sapiens
atgctcacaggcaagttgtttgctatctcagaaattaattaaccctgggaggggcaggtcccaagttgtcaaagcat

SEQ ID NO: 6873852 - DNA, 65 bp, Homo sapiens
ccttgttgtttgacatgcaaagcactttagactatatttagtacctaattgatgtggcagcaggg

SEQ ID NO: 6873853 - DNA, 64 bp, Homo sapiens
tgttccagtgggaaagcatagccaggccctgagatgggaatgtgcttgacatgtcctaggaata

SEQ ID NO: 6873854 - DNA, 68 bp, Homo sapiens
tggctttgatggacagaggtcatttgtccaaacaagtgactccgaagcctcatgttcacaaaacgcca

SEQ ID NO: 6873855 - DNA, 95 bp, Homo sapiens
aagacaagtaccaatatgtacagtgatagagcagtattatcaaaattgtgttagataattacaactatcattttacatggttggtgtttcatctt

SEQ ID NO: 6873856 - DNA, 61 bp, Homo sapiens
cacaatctctggtgcttctgagagcaacatgaaattgttctctacttcacaagggatggtg

SEQ ID NO: 6873857 - DNA, 61 bp, Homo sapiens
cttaggcttcttgataaaatgcagattcctatgaatctgaattgctaagggcaggcccagg

SEQ ID NO: 6873858 - DNA, 74 bp, Homo sapiens
tggaattcccaagtaacttttaaaatgtaaaataggtgccctttagtttaatgtgcaaaggttagggagttcca

SEQ ID NO: 6873859 - DNA, 79 bp, Homo sapiens
gctttacttaagggaatgttgtggttggtttgatcttctatctagaccactaaaactttctctatatcagcggtgaggc

SEQ ID NO: 6873860 - DNA, 60 bp, Homo sapiens
taagtgaaggaagtgtgtttacaaatgtcatttttgtctgatttcacttaccttcattta

SEQ ID NO: 6873861 - DNA, 76 bp, Homo sapiens
ttggccttaacctctctgtgcctcagtttcctcatctgtaaaagagggatacagtgtacagggatagtagtgtcaa

SEQ ID NO: 6873862 - DNA, 107 bp, Homo sapiens
ttatcacttttttttttttttttggtgcaaagcttaacattctgcaaactttttttccccttgagtatgcattgcatttgtcatgaagagtaaaaagaatgtaataa

SEQ ID NO: 6873863 - DNA, 85 bp, Homo sapiens
ccttgcccagggccagctctgattttgacctccagatgcttcctactttttctggctcctcatcacagttggtggtgatgtaagg

SEQ ID NO: 6873864 - DNA, 65 bp, Homo sapiens
gaagtttgtagtcatatatttgctcctaaaatcaagttagtcagatatatgacttacgtgatgtc

SEQ ID NO: 6873865 - DNA, 79 bp, Homo sapiens
atagtttcctaagaattctaggaagagactgggttattaccctcccatttccatgtagcaattttctcaagggtgctgt

SEQ ID NO: 6873866 - DNA, 129 bp, Homo sapiens
aggcaggcagaacacagggaggagtctgatgttggaaggttctggtcatggttttgctactaatttatcacataaccttgaataaacctctttatctcttagaccctctgttttcttctctgttaaact

SEQ ID NO: 6873867 - DNA, 70 bp, Homo sapiens
gctgtgtagctctgggtgcaagtcaaagatcaagctgaagtaaaggtatgctcactcagggttcaagggc

SEQ ID NO: 6873868 - DNA, 113 bp, Homo sapiens
gtttggtggaatacacacgtttcccaaggcagggattttctgctgctttgtttactactcttatctgcagcagctagaatagtgcctggtacagaggaggtgttctgtggaat

SEQ ID NO: 6873869 - DNA, 57 bp, Homo sapiens
ggatgggtgtgaaaatggtcatcttgatttatacagaaccacatttacagcccgtcc

SEQ ID NO: 6873870 - DNA, 77 bp, Homo sapiens
atgctgaaggccttcccacagtgatcgcattcgtacggtttctcccccgtgtggcttcgcatgtgcgtcttcagcgt

SEQ ID NO: 6873871 - DNA, 66 bp, Homo sapiens
actccactgattcaagaattaacgtacagaaaaagattctgtctctttgttctgtgagtcgggggt

SEQ ID NO: 6873872 - DNA, 67 bp, Homo sapiens
ccaggacactgaggcctgctggagaggggggtaaaccctacctggggcaggcctcggggaagcctgg

SEQ ID NO: 6873873 - DNA, 66 bp, Homo sapiens
tggctaacattttagttttaggtagaaatgtagaattgacaatatcttgaaattggatggtagcta

SEQ ID NO: 6873874 - DNA, 63 bp, Homo sapiens
tatcattgttactgctggagcaggtcggagggtatctgtatgccagaggcagtcacagtggtg

SEQ ID NO: 6873875 - DNA, 69 bp, Homo sapiens
tcaaatactctggatgtgtttgtgaatctgtgtgaatctatatcactacataaccatcctgatatttga

SEQ ID NO: 6873876 - DNA, 127 bp, Homo sapiens
tggcatttatttagctcacatttctgtgagtcagttagtgtttatctaatctagactagtctaggctattttactttgtgaatattgactgggatttcttaaatatttgtgggttgactaagagtca

SEQ ID NO: 6873877 - DNA, 83 bp, Homo sapiens
agtggtggagctgggatttgaactgcaaagtcttgctattaatcgctgccctatattgccttcaagacccatcctccaacgct

SEQ ID NO: 6873878 - DNA, 56 bp, Homo sapiens
tcctaaggaagtgacagtgggattgactaggacaagccccaaggaacttcctggga

SEQ ID NO: 6873879 - DNA, 60 bp, Homo sapiens
agtagtcatttatgtggggagccgcaatactcctgcaatcctacagcacagatgtttact

SEQ ID NO: 6873880 - DNA, 67 bp, Homo sapiens
ggattggttggaaggagacattctatggagaacaggacacccatgcggttcaccatctcaccaaacc

SEQ ID NO: 6873881 - DNA, 74 bp, Homo sapiens
gcaggcccccaaatttgtgctttcatagtcatcgttaatcaaataggcagaaacactgtatttagggaacctgt

SEQ ID NO: 6873882 - DNA, 59 bp, Homo sapiens
tgcctggcacatagcaacccctccctcaataaagggtagctgttaatatatgccaggta

SEQ ID NO: 6873883 - DNA, 55 bp, Homo sapiens
tgccctggatgctgcaggtgtgtgccccaatacaccctgtcagctggcctgggca

SEQ ID NO: 6873884 - DNA, 78 bp, Homo sapiens
tgatacttggttttaagactcttgtagtacacactcagttgtggtactcaaagtgtggtcttgcaactagcagtatca

SEQ ID NO: 6873885 - DNA, 60 bp, Homo sapiens
tggactatgtgaagtgtgaatagggctcagttgcatttgttcacatgtcatgtacaacta

SEQ ID NO: 6873886 - DNA, 65 bp, Homo sapiens
ccactgctacagctgttcagtgccctaccttgcagggaggagctttgctcagctttaggagatgg

SEQ ID NO: 6873887 - DNA, 81 bp, Homo sapiens
aacgtagatggcagtgaaggatgccaatgatcaatgaagtacttttctgtcacaagtaatccttttcttgctttttgtatt

SEQ ID NO: 6873888 - DNA, 59 bp, Homo sapiens
gagcacgctctatttaggagaattctatttaatttgatctcctaactataaagtggctc

SEQ ID NO: 6873889 - DNA, 74 bp, Homo sapiens
gaggaactgccagactcttttccaaagcactgcattttacatttccaccagcagtgtatgagtttcagttcttc

SEQ ID NO: 6873890 - DNA, 100 bp, Homo sapiens
agcgatactcatttctagagtagaagagattttattccttataactgtaaactctatactatccaagataatactcttcttcctagaatttgaattcgtt

SEQ ID NO: 6873891 - DNA, 109 bp, Homo sapiens
caggccaggggttcccagggagcctggctccacaggccagggtgtgggaggaccgcctggccacacctcagccatgtggaggcggcacctgcacacccaagctcgcctg

SEQ ID NO: 6873892 - DNA, 56 bp, Homo sapiens
tattgtcactaaaggaagctgggcggtcaccagcactggctttctatgcgacagta

SEQ ID NO: 6873893 - DNA, 118 bp, Homo sapiens
ccttgacagctttgagcataaatgtaggtatttaggaagatgagtatcaacttgcaactctcactttttgcagacgcattgttcctaaacatccctaatgctgatcatagctccaggg

SEQ ID NO: 6873894 - DNA, 60 bp, Homo sapiens
ctggaggttgtctcctagctgtaagctctcagcttgtattaggaagaatgctttcaccag

SEQ ID NO: 6873895 - DNA, 71 bp, Homo sapiens
ttttgattcctgcttgctctgctccaccaagaaaatggtttcttcaggaaaaagagtaatgggaaaaaaaa

SEQ ID NO: 6873896 - DNA, 77 bp, Homo sapiens
tttccgtctctcagccttagcaggatcatctgagccactgccagttcagagtgagctggggctgcttttccaggagg

SEQ ID NO: 6873897 - DNA, 72 bp, Homo sapiens
cacagagcgagggagagccaagatgtgagctcttctctgactccacatttcgtgctctgttttgttgctgtg

SEQ ID NO: 6873898 - DNA, 88 bp, Homo sapiens
aggaggatagtgatgatatctcatgatttgagtagtaaacttcctttaggaatacttaactgtggagtcattgagatcattgttccct

SEQ ID NO: 6873899 - DNA, 89 bp, Homo sapiens
gtcctggagaagtgtaacttatgagataggacgaggcggcagaggtaagctgttttgcactctaagtagtttggactttctcctaggac

SEQ ID NO: 6873900 - DNA, 123 bp, Homo sapiens
atttcccagtagttccctaaatttagtaaatattagaatcatctggaaagtttgtttcaatgtagtttcattggaccaattcctgatattttgtttactatatatggagtggattcctgaaat

SEQ ID NO: 6873901 - DNA, 89 bp, Homo sapiens
cccaagccaacatcttccctccctgggacctctgcctgcaagaagaagcgcgttgcgaggtgaggtttgggaggtgtcagctgtctggg

SEQ ID NO: 6873902 - DNA, 86 bp, Homo sapiens
agaactgctgctagaatccaaatttaccttacagatatcacaaaagttaagtggtgttactaaaatttgattcttaggacgtttct

SEQ ID NO: 6873903 - DNA, 79 bp, Homo sapiens
gggcgcgtggcgacgggtgtatgctcccagccacattacctggtgtggaagtggctcagcattcactggtcttgtgccc

SEQ ID NO: 6873904 - DNA, 63 bp, Homo sapiens
tggccacactgcccccactggggtcgtttgctgaattcccatgacctggcgggcactgggcca

SEQ ID NO: 6873905 - DNA, 67 bp, Homo sapiens
agagatttggaaatacgcgtaggcagattaggatgaaaatctgctcacgtgtattctccattttttt

SEQ ID NO: 6873906 - DNA, 56 bp, Homo sapiens
gccttcctgacttggctgttggccctaggtgctagggatagagagagaacaggggc

SEQ ID NO: 6873907 - DNA, 106 bp, Homo sapiens
gcctgggatgtatacacagaagttagtcttaattataaggcatgctccccatttctaatagtaactggttgtgatgaaagattggctaagtgtatattcaacaggt

SEQ ID NO: 6873908 - DNA, 58 bp, Homo sapiens
tgttcatactcttccctgggcaaagctatcttttgtttgcctaatgaagactatgtca

SEQ ID NO: 6873909 - DNA, 64 bp, Homo sapiens
ctgaaggaagacttgagaaggttccctaaaactcaactaggaaatgtcaaaagccttcccttag

SEQ ID NO: 6873910 - DNA, 96 bp, Homo sapiens
aaaaatttagcccaccgtggtttagccttcattaacctggtatgcatttgaagaattcaatagagttaatgcaggccaagcctgaactaaattttt

SEQ ID NO: 6873911 - DNA, 87 bp, Homo sapiens
ttggctgtgcttcatggggtggagtccgggcagcgctctgagaagtgcgtgcagcctagggcctttctcaccgagagctcagaccga

SEQ ID NO: 6873912 - DNA, 129 bp, Homo sapiens
agcctcccaaggacagtaaaatccttttgaaaaaatccttagccgagtgaggtggctacaggcgtgagccaccacactcggtgaagggttttttcaaaaggactttactgtgatttttttggcagtgct

SEQ ID NO: 6873913 - DNA, 69 bp, Homo sapiens
tgtggactttgtaatagaatttaaggttaagtaaagtttctgctttccttaggctgtttgcagtgccca

SEQ ID NO: 6873914 - DNA, 69 bp, Homo sapiens
ggtctctcttgattacctagcagttagtgtactgatcagcacttgcatgtcaggaaattaacaaagacc

SEQ ID NO: 6873915 - DNA, 58 bp, Homo sapiens
caccatcatccatccatcttctccaattaacttgggggagaatatgaggatgatggtg

SEQ ID NO: 6873916 - DNA, 94 bp, Homo sapiens
ctgtctttgatgcttagacctcatgaaaattcatttgtgtgctcaatgacattagaaaatacactgatctttttatggggtgtgctttatacag

SEQ ID NO: 6873917 - DNA, 63 bp, Homo sapiens
tgcattatgcttgtgctgtatatacatgtgaataaatatatatggcacaaaatgtataacgta

SEQ ID NO: 6873918 - DNA, 74 bp, Homo sapiens
gagaaggccaggaacccagtgtctattcagcactttgctgaattccctatgtccatcttggttctggtttactc

SEQ ID NO: 6873919 - DNA, 66 bp, Homo sapiens
gggagaaaagtctccactgggaaccaaattcaaagatctggctgattccctgggactggacatccc

SEQ ID NO: 6873920 - DNA, 81 bp, Homo sapiens
cactaaagctttaggaaagttcttcagacatgggatttttgttacagtccattgaagatctctcttccacaaattttagtg

SEQ ID NO: 6873921 - DNA, 76 bp, Homo sapiens
ggaatgatccgagggaggaaaaatgtgggggtcaaaagaaaagtaacagcctcctacattccaccttggactttcc

SEQ ID NO: 6873922 - DNA, 58 bp, Homo sapiens
ctgtgccagggtctattccagagagtcagtggtttcttttgaaagagtcctgctacag

SEQ ID NO: 6873923 - DNA, 104 bp, Homo sapiens
ggaacaggcattggcgtgtacctgacttcagctgtggcaccaccccccagcaatggtgtggtggcatcagtgaagtacaccgtggtcacccccatgctgaaccc

SEQ ID NO: 6873924 - DNA, 101 bp, Homo sapiens
tacagtgagaagtgaagcttgtgatactgacccagaggaactgcaaagttctccatcaacccagctagggcctttgggatctgtaaacttcatgctctgtg

SEQ ID NO: 6873925 - DNA, 55 bp, Homo sapiens
tttttggatgggggttctaattcttcacaaatagaatagaatgcccacttaaaaa

SEQ ID NO: 6873926 - DNA, 70 bp, Homo sapiens
agatggcagtgaataaattttgacttgacttaaggacttgaatttcccttgcatttatagactgccattt

SEQ ID NO: 6873927 - DNA, 68 bp, Homo sapiens
tggagggctttgtggcagtcactatatgagatgctgaggttatagttgtgaattaaataaagtcccta

SEQ ID NO: 6873928 - DNA, 75 bp, Homo sapiens
tctgactgctggttagtcttagtgggatttgtttggcttttatgaatgccattaaattttaatgtgcagatcaga

SEQ ID NO: 6873929 - DNA, 63 bp, Homo sapiens
tgaaggctggagatggttggaatggctcacctggggctgtatatctggcgcctccattcttca

SEQ ID NO: 6873930 - DNA, 91 bp, Homo sapiens
gagatggaatctcgttctgtcgcccaagctggagtgcagtggcacgatctcggctcactgcaagctccgcctctgggttcatgccattctc

SEQ ID NO: 6873931 - DNA, 99 bp, Homo sapiens
gaggcaggagaatcacttgaacccagagggtggaggttgcagtgagccgagatcgcgccattgcactccagcctgggcaacagagtgaaactccttctc

SEQ ID NO: 6873932 - DNA, 72 bp, Homo sapiens
ccagcttggaatatgccattgtaccttcaatctcagaagtgctacatcacaatagtataaaattcatgctgg

SEQ ID NO: 6873933 - DNA, 120 bp, Homo sapiens
taaaagtttatctttctcatggcattttttacaatcgtagttgaaatgaatctcttcctagcatgggttcagactaaagctatgcagttaagtagaataaatatcattagaacacttttg

SEQ ID NO: 6873934 - DNA, 67 bp, Homo sapiens
gcacagggaccttggaagctggaatgacactttggagttgttccatttggaacaagagtctctgagc

SEQ ID NO: 6873935 - DNA, 73 bp, Homo sapiens
agagtctgatatttgtaccagagtgagtcactgcttttaatcccttattttggatttgccaacattagactct

SEQ ID NO: 6873936 - DNA, 63 bp, Homo sapiens
gctgaggcctcaggaatgtcgtgtgtcctcctggaacctgctccgagatctgggggccccagt

SEQ ID NO: 6873937 - DNA, 57 bp, Homo sapiens
tctaatgtgtgcttctttgccccaaacagtcatagggcagaaggtctaagctttaga

SEQ ID NO: 6873938 - DNA, 98 bp, Homo sapiens
gattaaaattttgaaaatattagttggcacttcataatatgaaatgaaattatgaaattttatatacaagagggttaattatttttaaagggctaatc

SEQ ID NO: 6873939 - DNA, 73 bp, Homo sapiens
tgtactgtgtagtctagtgagtctcccctgttattttgggaaccattccacagaagctcaagagagcagtgca

SEQ ID NO: 6873940 - DNA, 66 bp, Homo sapiens
ggagcgagctctgggaaacaaagtgtagctcttgttgctgcctgccctttccacacagccagctcc

SEQ ID NO: 6873941 - DNA, 59 bp, Homo sapiens
aggtgaacccaggtgcttcacgggaccagacttccccagcagtgaagcaagggtcacct

SEQ ID NO: 6873942 - DNA, 56 bp, Homo sapiens
cagtgtgagctaatagcagagccaggtgtagaagctgggcctctttgctcattctg

SEQ ID NO: 6873943 - DNA, 70 bp, Homo sapiens
tccagaaaccatgactgctctgggctcccatgacatctcatgggttttctcaagtagtcacctttttgga

SEQ ID NO: 6873944 - DNA, 82 bp, Homo sapiens
gctgagtttcttgcgaggatcattgtgtccagatgctcaacgtctcttaacgtcaaacattcacaactgatccttgctcagc

SEQ ID NO: 6873945 - DNA, 88 bp, Homo sapiens
actagctgactatcaggacatatgagtggcaaataaatcaagatgtgattcacattatttatggccctcacctgatatagggcttagt

SEQ ID NO: 6873946 - DNA, 83 bp, Homo sapiens
ttcaggaagcagctgtatcacttttaaacattttgcctgtctggtggctgtaaggtgatatcgcattattgctttaatttgaa

SEQ ID NO: 6873947 - DNA, 82 bp, Homo sapiens
tcctcttgctgcatttcttatctgaggtctacatgaatgctccagttagagtgtgctttaggttaagataagtaaaagatga

SEQ ID NO: 6873948 - DNA, 71 bp, Homo sapiens
caggactggtgggaggatgggcatcagccagggctgaacactgagtctacctccctctgggacacagcctg

SEQ ID NO: 6873949 - DNA, 68 bp, Homo sapiens
ccccagggaagctttgcttactgtcctatgtctataccccttgggttgtctctgagcttctcttgggg

SEQ ID NO: 6873950 - DNA, 75 bp, Homo sapiens
tcacttgaacccaggagacggaggtgcagtgagccgtgatcgtgccactgaactccagcctgggtggctgagtga

SEQ ID NO: 6873951 - DNA, 76 bp, Homo sapiens
gtggcaaatgccctgtctctctgctaggcctccagtgataccatcaatggtagctatgggagttagggcatctcac

SEQ ID NO: 6873952 - DNA, 69 bp, Homo sapiens
ataaatcaacttgtgacgttaggtactttatcaggtagtacagcaccagatgtttcaagcattgtttgt

SEQ ID NO: 6873953 - DNA, 85 bp, Homo sapiens
ccctctcaggcccacaggttggggacttaggatgacttagaatgaaagtcagcttagactccctgcctggccaggctgaggaggg

SEQ ID NO: 6873954 - DNA, 111 bp, Homo sapiens
atgtaatcttactttaggagaaactgcttctaattttaggcatttgttcatagcaggtgctacatgaaccaatgccaaattagcattgtttttagggtaataaatctacat

SEQ ID NO: 6873955 - DNA, 130 bp, Homo sapiens
agtaagatggactattgtaaagaattaatcagagtccttagttagagatgaattttgtctggaagaaaattctttgcagagaaagtggcatttgagctagaccttgatgacttggtatatttaaattact

SEQ ID NO: 6873956 - DNA, 82 bp, Homo sapiens
ctctcctatgtccaaggaaatacttctgcagagcacgttagagtttccaatgcatgtgtgttatctcagagacaaagggcag

SEQ ID NO: 6873957 - DNA, 124 bp, Homo sapiens
ctgtctctgactttgtcttttcttcctcttgacatgttctcctgggcattcctgctgcttactgcaatgtcaatctcagagaacacagagctgcgagagttgtgaaatcttagagtcagaatag

SEQ ID NO: 6873958 - DNA, 74 bp, Homo sapiens
gctttcatcgagttatgtatattattatgtcatctccctgtatttgagttagttattacaaactccttgaaggc

SEQ ID NO: 6873959 - DNA, 68 bp, Homo sapiens
tgattttggaggcaattttagcttaacttctaaatctctagaatttgaagagtgccttccagacatca

SEQ ID NO: 6873960 - DNA, 72 bp, Homo sapiens
gggggcccccagatggccagataccatgggcgcccgcaccccatggcttgtcttgtcttctgattggtcccc

SEQ ID NO: 6873961 - DNA, 68 bp, Homo sapiens
acacaggacacagattctgaagtctagctgctggctcagctctagcctctgactctgattagctgtgt

SEQ ID NO: 6873962 - DNA, 55 bp, Homo sapiens
tgttgtcttctccaggtgaaaggaaaggtattcactgtcctggtctagaggcaca

SEQ ID NO: 6873963 - DNA, 68 bp, Homo sapiens
aaaaggcatggaggttgatagtacaaaggcctacatctgtgggaacatttctagccactattcttttt

SEQ ID NO: 6873964 - DNA, 77 bp, Homo sapiens
cattctcgcaatgagttgcacaaaagtgtgcatatagttaatactactgtactgtacatgtaaacattgtcaagatg

SEQ ID NO: 6873965 - DNA, 67 bp, Homo sapiens
agacctgggacatgcttggaatctagaagctaatctttcctaagttccgttttcgtgtcagagttct

SEQ ID NO: 6873966 - DNA, 83 bp, Homo sapiens
ttgtgtgattaattggatgttctctggaagcatgaaatatgaactgatttctagtttttgtaaggacgctagttaatttataa

SEQ ID NO: 6873967 - DNA, 59 bp, Homo sapiens
gctctaccttcagcaccacggagctgtccacagcactctctggaactggagagtacggt

SEQ ID NO: 6873968 - DNA, 89 bp, Homo sapiens
ctcaggggggaacatccccaggggcctgggcacagtggcgttcaggacataaaccactgtggccaaagcctctgggacaggcctctgag

SEQ ID NO: 6873969 - DNA, 129 bp, Homo sapiens
gagtgtcagaatccctggggaagcttgttagaaatacaaatgcctagatcctaccccggaatcaaacttggggaggggaattctgggtgtttgtatttctaacaagctccccagggcattatgatgctc

SEQ ID NO: 6873970 - DNA, 66 bp, Homo sapiens
ggaggggagggacccagtctgggcccaggtgtcatcatctcagccacagcagggccctctcaggct

SEQ ID NO: 6873971 - DNA, 69 bp, Homo sapiens
cagcctctgccatgttggaatttcaaacccaaaacagctgcttggaaggagccagcatgccagaggctg

SEQ ID NO: 6873972 - DNA, 92 bp, Homo sapiens
tggccattttggcaaatttaagttagaaagcaatatgctctagttaaatttctaaatctgttgcctgacctggacctttagccaaggggtta

SEQ ID NO: 6873973 - DNA, 62 bp, Homo sapiens
accgacactctccaggttagagcacttatccagtggatggttcagctttctggaggataggt

SEQ ID NO: 6873974 - DNA, 67 bp, Homo sapiens
tctgccgaaagatgtacacattgaaagtaactagaaaaatctttaggtgggatacaattacggcagg

SEQ ID NO: 6873975 - DNA, 84 bp, Homo sapiens
ctccccatgcatttctttgagttagtacagtccagagtgggatatggcattttccgtggaattctgactcaggagatgggggag

SEQ ID NO: 6873976 - DNA, 101 bp, Homo sapiens
ctccaaattatgatcaagtgatgggagaagcagcagccaagtgccagagagagtctgtgagtggacatgtggctgctgttcctcatgaatgttggtgggag

SEQ ID NO: 6873977 - DNA, 83 bp, Homo sapiens
gtttctattcaacttataagatattaatggtcctaatccactggaaaagattgattctgtaagtcaacaatgagtgaggaagc

SEQ ID NO: 6873978 - DNA, 82 bp, Homo sapiens
attcaggaccaagactgcagcagaaacatctaagctgaattgtcatctgtctttgtttattgctgcaattgtgccactgaat

SEQ ID NO: 6873979 - DNA, 76 bp, Homo sapiens
gtttatttgtgtgtttagcattagcagggggaacagaaaactgtctctcctttaggctgagcacttgggaatagac

SEQ ID NO: 6873980 - DNA, 65 bp, Homo sapiens
gaatgaaatgagataatttaagtgcctggtgcacagtaagcactcggtagatgtcattattattt

SEQ ID NO: 6873981 - DNA, 78 bp, Homo sapiens
atgtgtcattgctgcttttagttggatagaaggaaaacagtttctttctgctgaaaacagccatgtaaaactacatat

SEQ ID NO: 6873982 - DNA, 55 bp, Homo sapiens
cttggtcccattgcagatgactgtagaacacaccattctctgtgatgggattagg

SEQ ID NO: 6873983 - DNA, 64 bp, Homo sapiens
aatgcaaaattaccattctgttctgctcctgacagcagtgtggaaaatgtgatttctctgtatt

SEQ ID NO: 6873984 - DNA, 75 bp, Homo sapiens
ggtatagccttctcctctgagtgactccattggtgggtgagcagcagggatggagcagaggaagaaggctttccc

SEQ ID NO: 6873985 - DNA, 71 bp, Homo sapiens
ccgattcagaattccactgatcgcaggcggcgggccctttaccgcacttctgcttcaaggaaatgaatcgg

SEQ ID NO: 6873986 - DNA, 69 bp, Homo sapiens
tgctggcctgggtgctgctgacatctggccatactccacccagatagctctgctccccagagccctgca

SEQ ID NO: 6873987 - DNA, 116 bp, Homo sapiens
ggtaaatgcccatgctgctgggctaggacgacacgtggagaacaattgctctaaaaattgagcagatcaacactctctttcaagtctgcacctggcccagcaccatggggatcccc

SEQ ID NO: 6873988 - DNA, 73 bp, Homo sapiens
acagaaaaggatgctgctgcatagcttctccaatgtaccagtcattgaggccagcgcgcagcacttttaatgt

SEQ ID NO: 6873989 - DNA, 128 bp, Homo sapiens
ggtgcctggcctgatgggaggtgggcacatcacacagagcattaggggccatgtgtaaggctcggttcaaattcaatgctctgtgtgatgtccagcacatctctctacctctcagggccttggtcacc

SEQ ID NO: 6873990 - DNA, 66 bp, Homo sapiens
ataggttgagtagtaaggatattatctttgttggaggaaaaacagtctttattattttaggcctat

SEQ ID NO: 6873991 - DNA, 105 bp, Homo sapiens
gagagtctgtttggccaatactgagtcatgtattcacttagcttctgctgggatgcaagggtgtatgtatgatgggtggtctcagacttgcccaggcaggctctc

SEQ ID NO: 6873992 - DNA, 61 bp, Homo sapiens
tgctttatatctctcttcttagggaatatgcaaactccccaagaagaaaaggcatagagca

SEQ ID NO: 6873993 - DNA, 57 bp, Homo sapiens
gggtagcatttgtagctatcacagtcatggtgattccacatacagctgcaagcatcc

SEQ ID NO: 6873994 - DNA, 77 bp, Homo sapiens
ccacacagagacagaagcacttatgagtaataattctaccctgactcacacagagatgctgtgtcctcctgagctgg

SEQ ID NO: 6873995 - DNA, 100 bp, Homo sapiens
cacaggaatccaggagccctttactgtgatgccgaccactccagtagcgtataactcgctgggtgcagtgattggcattgcagtgctggggtcccttgtg

SEQ ID NO: 6873996 - DNA, 74 bp, Homo sapiens
acaattcttccaatgtggcccagggaagccaaaagattcgacacccctgctgtaaagcttcatggaagggttgt

SEQ ID NO: 6873997 - DNA, 60 bp, Homo sapiens
ctgaattctatctctggatgtctgcatgtttctacatttgaagttgggagtagagatcag

SEQ ID NO: 6873998 - DNA, 64 bp, Homo sapiens
cgggagatgagtggagccaggagttgggatgggaactttgctctgtggctccttcaggctgctg

SEQ ID NO: 6873999 - DNA, 129 bp, Homo sapiens
agcccctgagaacacagctcctcaccatggactgtacctgggggatccgcttcttggtggcagctgccacaggtaaggggctcccaagtaccagtgatgaggaggggattgagttcagtcaagggggct

SEQ ID NO: 6874000 - DNA, 77 bp, Homo sapiens
ggctgaagtgcagtggcgtgatcttggctcgttgcaacctccacctcccgggttcaagagattctcctgcctcagcc

SEQ ID NO: 6874001 - DNA, 61 bp, Homo sapiens
tagttaaatgtgttagccagggttctctggagaaacagaaccaataagacacattgagcta

SEQ ID NO: 6874002 - DNA, 130 bp, Homo sapiens
ctgttgccaaaactttattctaggctgtgtctggcagctaataaaagcagttctttctgtacacagaaattcactgtatttcttgggcttcacgttgctagtcaatggttattagaggcttgcaagcatg

SEQ ID NO: 6874003 - DNA, 78 bp, Homo sapiens
tcattttcatggagtcatcttaatctaggcaactccataagttgcctagatatgttggtactctgtgagcacagatgg

SEQ ID NO: 6874004 - DNA, 63 bp, Homo sapiens
caaactggtagggccccacatccttagaatttaagttctaagacatgagactcagccagtttg

SEQ ID NO: 6874005 - DNA, 64 bp, Homo sapiens
gtggctgaactgggacacactaggtagttggactcacgccccataccttgaacccgccagccat

SEQ ID NO: 6874006 - DNA, 81 bp, Homo sapiens
gagagtgtttccactgctcattccacaggcaagccacagatcctggccactccttgccttggaggcagtacagacacattc

SEQ ID NO: 6874007 - DNA, 57 bp, Homo sapiens
gcttctgtggtgcatctttgcttgtgggtgggttccagatgatggattaacggaagt

SEQ ID NO: 6874008 - DNA, 87 bp, Homo sapiens
gtggactgaactctgtgacccctccattgaaaaggcaaaactgtatcactgtgttttcatgcaagcaggcactgggaagcagttcgc

SEQ ID NO: 6874009 - DNA, 123 bp, Homo sapiens
gatgtgtttagtttgttcacaatttcgtaaatgaagccttaatatggatgttcttgccatgttgagatgacaatgcttagatccagttaatagcttcattgtatgttgaataaacctcacatc

SEQ ID NO: 6874010 - DNA, 62 bp, Homo sapiens
actcaaaggatgctgccgattccatcagtcaggtgcagttggcattcctgcatcctatgtgt

SEQ ID NO: 6874011 - DNA, 102 bp, Homo sapiens
ataattcaaaaacattatttgtctacattttgtggcatgtcatgacaattacatggtattatatatgctgacaagttgagatgattactgtctttttattat

SEQ ID NO: 6874012 - DNA, 76 bp, Homo sapiens
gtgtttcacagatgcagaggccatggggcatttttcagagtctgagtctatccccagtctttcattgtcagaatac

SEQ ID NO: 6874013 - DNA, 61 bp, Homo sapiens
ataaagacctacaaatacttactttgattccttgttagggttgtaagtgtatggtttctat

SEQ ID NO: 6874014 - DNA, 64 bp, Homo sapiens
gtttgcatatttgcacaggaatataagcatttgttaattggtttctgtgttgatatatacaaat

SEQ ID NO: 6874015 - DNA, 65 bp, Homo sapiens
tgtgtacatatatgccctctgggtggctgtttactatgcggcatacaagagaaatataagataca

SEQ ID NO: 6874016 - DNA, 71 bp, Homo sapiens
tgtggtatacatctcatgaatgataaatcattgtgccattgctgatcaattacaaatgggactgtattaca

SEQ ID NO: 6874017 - DNA, 56 bp, Homo sapiens
gtactcattgattcctttactcagtaaacagtattgagtgcaaggcactgagatac

SEQ ID NO: 6874018 - DNA, 93 bp, Homo sapiens
cctcagctcatcttacaccatatacttactctcctgtttgcagcctcaaacctgcaacaggagagtaaatatatgatgtaagatgagccgagg

SEQ ID NO: 6874019 - DNA, 57 bp, Homo sapiens
gaaagttcgtcctgtggcttctctgtcaaaccaaggagtgctcctggatggatttcc

SEQ ID NO: 6874020 - DNA, 110 bp, Homo sapiens
ttgtttacaaacaggttggcagactttctctgtacagtaccagatagtaaatatttaactttatgggttatggtcactgttgcatctgtcttgtttttgtttttaaacaa

SEQ ID NO: 6874021 - DNA, 59 bp, Homo sapiens
ctttcctcctgtagctccggagccccctggagtccggccctggagatcgggagaggaag

SEQ ID NO: 6874022 - DNA, 80 bp, Homo sapiens
gaggggtggttctgagatgaggaggaaaaagctattagttggctttttgcaagagtttctcatcccagacttagctcctt

SEQ ID NO: 6874023 - DNA, 91 bp, Homo sapiens
ccagaaaccaggaaaatgcgtggaaggatccttcctccagagactttggagggagagtgaccctaccaacacattgattttggatttctgg

SEQ ID NO: 6874024 - DNA, 55 bp, Homo sapiens
gcagccaggggctgtgacctgttgagctggtggctggtcagagctacctggctgt

SEQ ID NO: 6874025 - DNA, 88 bp, Homo sapiens
gactctggaatattaactaattttcccaaggccttctatctaacaagggatggggcctgtatttaaaattcagttttattccgaagtc

SEQ ID NO: 6874026 - DNA, 80 bp, Homo sapiens
tccattggcctgctgggtctctgggtgtaacaagaggcaaagactcaggtgtcttggacactgagactagcaagcaggga

SEQ ID NO: 6874027 - DNA, 72 bp, Homo sapiens
tggaaatgtttgtcaggctgccagtctttattgtgttcttttatgcacaagatgtgcctggcagaatgtcta

SEQ ID NO: 6874028 - DNA, 64 bp, Homo sapiens
tgctacagataggaggaatctgaaagagccagcgggacctctcctttcccactgtctgtgggca

SEQ ID NO: 6874029 - DNA, 63 bp, Homo sapiens
tttgtccaggttagcttcaaacacatagcatcgccagcttgtgcgccaggacaacctgacgga

SEQ ID NO: 6874030 - DNA, 60 bp, Homo sapiens
gggacaaatgattatcacagaggagtacatgtgtgttctctctgtgtcattatggacacc

SEQ ID NO: 6874031 - DNA, 68 bp, Homo sapiens
gatggtgtggggagcttgggtgtttgtttcccatttcacaaaacaaagcagccaaccttacattcatc

SEQ ID NO: 6874032 - DNA, 71 bp, Homo sapiens
gtgagtctaaagtgtgttttgatgaaatatattaggaaacttgttttcaagtaagatacatttcagaaagc

SEQ ID NO: 6874033 - DNA, 84 bp, Homo sapiens
gagagaaatgcagccagccacttcagctatggcttcagctgaggcaaaagctgtgctgccaagttgctgaacctgctctttctc

SEQ ID NO: 6874034 - DNA, 79 bp, Homo sapiens
aatacataaattgaagtcctaatctccagtacctcagaatgtgactgtatttggagatgggatcttcaaagaggtgatt

SEQ ID NO: 6874035 - DNA, 87 bp, Homo sapiens
ggtcttttttcttctcatctcttaaaataaagtgatataagcccagtatttcctgtggccatatactttgttgtgagaaaaagggcc

SEQ ID NO: 6874036 - DNA, 81 bp, Homo sapiens
gtagtacctagctcattctgagacttcagtaaatattggttaaatgagagactgcaggaattcaaagtgagctgatgctgc

SEQ ID NO: 6874037 - DNA, 62 bp, Homo sapiens
ttcacacctgctcaattatgaggtcttgatttattccaaaggcatgagaagggcagtgtgag

SEQ ID NO: 6874038 - DNA, 96 bp, Homo sapiens
gcaaatgtgatgtgagcagagacatgaaaagctcttgagcattggccctcttgctgcttttgaggtcctgctcagccaccatatcgataagcttgc

SEQ ID NO: 6874039 - DNA, 88 bp, Homo sapiens
ctggctctttcccttgcatgcatttgaagatcatgagtcacgagtctgtgaaatgagacaggactgtatgcagggctgggagagttgg

SEQ ID NO: 6874040 - DNA, 62 bp, Homo sapiens
aggtgtctggaactttttaacaagctgctggagaacccagagcatgaataaaagttacactt

SEQ ID NO: 6874041 - DNA, 64 bp, Homo sapiens
acaaacagccagtccaaacatactggagaccaaatggagctttagtggaagggtggttaattgt

SEQ ID NO: 6874042 - DNA, 121 bp, Homo sapiens
ggggagcaacatgaatgatgccaggaaaggctttcacggcacccagggaatctgcattacgtatttgcaaattaaattggacgctgggggaagatcctggtgtggtgagcaacagctcccc

SEQ ID NO: 6874043 - DNA, 70 bp, Homo sapiens
gcctttcatcagctcatctgctcctaggatccactcttcctctggctggcacctgatctgagcccgaggc

SEQ ID NO: 6874044 - DNA, 55 bp, Homo sapiens
cagttaatcttgccattatatccaatttaaacattgggtgttcaaagattaactg

SEQ ID NO: 6874045 - DNA, 59 bp, Homo sapiens
aggaggggcatggtcaggtgcctggggtgattgcagggcaccaacctctgctccctctt

SEQ ID NO: 6874046 - DNA, 61 bp, Homo sapiens
aatggtcatagcaggtctccttttaggttctgttaagcagaggcctggtctatgagatgtt

SEQ ID NO: 6874047 - DNA, 117 bp, Homo sapiens
tttttaaacataagcaaggacttaggtagccaagtgtctccgtttactcagccacaggatgttgggtatcatgtagcaatttgtgcagacctctcaatctgtttgtgttttcaagaa

SEQ ID NO: 6874048 - DNA, 70 bp, Homo sapiens
gagccttctaggatgtcatctgctactggtgtccattccagttgtgtctgtctgcatccctatgaggacc

SEQ ID NO: 6874049 - DNA, 62 bp, Homo sapiens
ttgttggtgaagtaggaaggtgctgtgggatgaattctgcactgtgcttagttcactattaa

SEQ ID NO: 6874050 - DNA, 85 bp, Homo sapiens
gaaatactgacttgaaagaagggtcttttaattgatgaaatcaaagattctcaaaatctttcttttactgtcttgaacgtatttc

SEQ ID NO: 6874051 - DNA, 92 bp, Homo sapiens
tgcagaagatgtgttctgatttaatctaggtgtcaagtctttgatgccatggattaagtgggtggcttaaattaaaaaaaaaaatttctgta

SEQ ID NO: 6874052 - DNA, 76 bp, Homo sapiens
gactctgaacttaccagcaggtgaccttgggaaaggcagtgccttacctgagcccctgctggtgtattctctggtc

SEQ ID NO: 6874053 - DNA, 58 bp, Homo sapiens
tagctctgccaaatggaggctgctctgagaaggtggcagctcttttttgcagcagctg

SEQ ID NO: 6874054 - DNA, 82 bp, Homo sapiens
caagagacctagcagaagctgcaatgccttttatagcctgccattagaagtcacacactgtcagttctgctgtgctcttttg

SEQ ID NO: 6874055 - DNA, 57 bp, Homo sapiens
gccagcttggcatgtgaggagtggggagcctcagtctacctctcgttttaacctggc

SEQ ID NO: 6874056 - DNA, 56 bp, Homo sapiens
gtggcagtcgctgacagatacacttgccacctaagttatctttccaaaactgccat

SEQ ID NO: 6874057 - DNA, 129 bp, Homo sapiens
gtgcaagcttccatgctaatttaataatttttaactgaaagctctttcttctttggcatcttatctttgaaaattcagtgcctaggatggaggtgggtttctgtggagtggatttgcatttgcttgtgc

SEQ ID NO: 6874058 - DNA, 62 bp, Homo sapiens
gtgttttgaggttgtaaagatgatattacttcaaggtgttttatctgaaaacctcaaaatat

SEQ ID NO: 6874059 - DNA, 56 bp, Homo sapiens
agagttgggcaaattatcccagatattctgcagtcagggatgagagtcctagctct

SEQ ID NO: 6874060 - DNA, 58 bp, Homo sapiens
acatgcaaagggatgcaattataagaccatagtattattgattgatctctgtgtgtgt

SEQ ID NO: 6874061 - DNA, 87 bp, Homo sapiens
acaaaaatcgaggagagagatgctgtgggtagaggcatgtgggttgcccctgcatgtgttctgagcagtttcctcctcgcttttagt

SEQ ID NO: 6874062 - DNA, 55 bp, Homo sapiens
aacagctattagaacttcatggagaataatttcctccactgaactttaagctgtt

SEQ ID NO: 6874063 - DNA, 78 bp, Homo sapiens
gagccactttgaatagcactttattcaggaactccaaatgccaatttgttttctactgtgaggtgtgtgttcaagctt

SEQ ID NO: 6874064 - DNA, 62 bp, Homo sapiens
ctcatgagactctgtagaactggtaggttagttactattaactccattttacagagtaggag

SEQ ID NO: 6874065 - DNA, 74 bp, Homo sapiens
acagtttacatattttaattggtgaccataggtttcggaatgccaaagttacaggtacaatatgaataaactgt

SEQ ID NO: 6874066 - DNA, 73 bp, Homo sapiens
gtcactttcccagcctcctttgcagctaagacataagcaggtggctgaggagctgctgggatgataaggtgac

SEQ ID NO: 6874067 - DNA, 61 bp, Homo sapiens
ggagagttgatgttccatgacattcagactcttaattgtcagaggatcatcaaacgttttc

SEQ ID NO: 6874068 - DNA, 64 bp, Homo sapiens
cagactccagagagttctcttgtcctcttttggccatgtgaggatacaagaagatggcagtctg

SEQ ID NO: 6874069 - DNA, 81 bp, Homo sapiens
gcaaaggagtgtgttttctctccagcaggcagtggggaccttagacatttgtaagcaagagagaggcacattcagatttgt

SEQ ID NO: 6874070 - DNA, 62 bp, Homo sapiens
aaagactgtcattgacagaaaatctccccctcagcttttgatcatctgtctgtgttgtcttt

SEQ ID NO: 6874071 - DNA, 89 bp, Homo sapiens
gctaaggaaagcttttaaaagtggccttgattaagccaggaaggaggatctcccttggaccaaggtctgctctttctcacttttcttgc

SEQ ID NO: 6874072 - DNA, 80 bp, Homo sapiens
gtgacttaccagggggttagggatgtagccagaacttaaatcgcaagggctggggttcctgagtcccgggtaaagattgc

SEQ ID NO: 6874073 - DNA, 102 bp, Homo sapiens
ctgggttcttagacctggtagggcttggctggggccaccagaccccagggagaagggatcatggcacatgccctccagggagccaggtactgcagaccccag

SEQ ID NO: 6874074 - DNA, 108 bp, Homo sapiens
ttgcatatttcgatggggttgagatgaagttttctgcttctattgtgtttgttctcaggactgaatacaaagcagaactcatactgaaggctctgtaggtgtgtgtgg

SEQ ID NO: 6874075 - DNA, 59 bp, Homo sapiens
caacactgttgtgaggattaaatgagctacttcatgtaaaacactcagaacagtgcttg

SEQ ID NO: 6874076 - DNA, 69 bp, Homo sapiens
tgatgtcacatgcattaaaaatacttgtgagtgcctcttctttacaggccctgttgatgctgtatatta

SEQ ID NO: 6874077 - DNA, 71 bp, Homo sapiens
gaaggtagcactatagggtcttgccttggcctaaggctatgaaaaagcatgataccataggttttgccctc

SEQ ID NO: 6874078 - DNA, 63 bp, Homo sapiens
tttagtcaggtaagatgcagggtgtagaggtgttaacctttccttaaaattttaatggctaga

SEQ ID NO: 6874079 - DNA, 65 bp, Homo sapiens
gggggcagcattcaggtcccggggtgcccgagccaggtcagacccagggacacgatgacacctcc

SEQ ID NO: 6874080 - DNA, 56 bp, Homo sapiens
gcatgaaagatgtttggggctttttctaatccaagacccagagcactttttcatgt

SEQ ID NO: 6874081 - DNA, 130 bp, Homo sapiens
gctgccacgtgtctgtggccagggcctcctcgagggtcctgcacagttggtgcttgaatctctgagtggacaggggacactttcataggcagcactggctcctcagagggcctcctcacacctggacggc

SEQ ID NO: 6874082 - DNA, 67 bp, Homo sapiens
gcagtcacctgaagacttgaccatggctagagaatctgatttgatgatggctcatctacaggactgc

SEQ ID NO: 6874083 - DNA, 62 bp, Homo sapiens
ccaggtgtgctctgcagtggatacagctgtacgttcggtgacagttcggcagatacgcttgg

SEQ ID NO: 6874084 - DNA, 79 bp, Homo sapiens
tgagcaatttataagagtgaaggccaggttacagttaattagcttaacatgatttttctttgactctacaaattgttta

SEQ ID NO: 6874085 - DNA, 129 bp, Homo sapiens
ggcggggaggcccgggcagggcggctgcggcgcagctctggcagagcccaaccctggccccgcccaggtcgcaggcctcgcccaggtcccgctgggccgcagcccggcctgcactcagccgccaaagtc

SEQ ID NO: 6874086 - DNA, 68 bp, Homo sapiens
ggcattgtgtgctttccttgcccttgggttctgatgcctctagatctgcaagagagcacatgtgtgtc

SEQ ID NO: 6874087 - DNA, 94 bp, Homo sapiens
tgaggattatatggattaatgcatgttaagctcttaaaatagtgtgtagcacatggaaagtgctcaacatgtatttgtcactgtaatcagctca

SEQ ID NO: 6874088 - DNA, 80 bp, Homo sapiens
ggaagtccaagatcaaggtgtcagcaggtttcatttatctgaggcctctctccttggcttggagatgaatgtttttttcc

SEQ ID NO: 6874089 - DNA, 108 bp, Homo sapiens
gttggaagccaagtactttacattccttcgtttagagatttcatgcttttcgaaagtcgtggcggttctgatcgctaaacaaagtagaaatgaagtgtgctcaccagc

SEQ ID NO: 6874090 - DNA, 82 bp, Homo sapiens
gttcatggctgggaaatcatctgtctctgcagttgaacaaatatgcttccttgtagtggacagtgagagccaggaaatgaat

SEQ ID NO: 6874091 - DNA, 83 bp, Homo sapiens
agtcagaggctttgtgagccacagggtttcttgtgttgtgcccaacacaggacggccctgtggcttccacaggtagcagggct

SEQ ID NO: 6874092 - DNA, 107 bp, Homo sapiens
tcttgtggcttgttttgaagccagcgtaacaaaacatttgcctctattacttttgcagtactgctgggcaagtgttttgtctgcctgggctctctctagccaggaga

SEQ ID NO: 6874093 - DNA, 65 bp, Homo sapiens
ataatgtaggtatgtgtatttatatgttaacctattatgctatatatgcatgtatcatacattgt

SEQ ID NO: 6874094 - DNA, 79 bp, Homo sapiens
ttggactgaatctttctcacactgctgcttttggttaatggctctcaagagaatctaaatgtagaaagatttactccag

SEQ ID NO: 6874095 - DNA, 88 bp, Homo sapiens
ggttttgggggttaggacagggacatctttttgaggccaccatccaactcaatacacatgccgctgttctcctcttcccccaacagcc

SEQ ID NO: 6874096 - DNA, 59 bp, Homo sapiens
ccctctctgcactttgggaatgttgggcctccaagttttctgggttcagagcaacaggg

SEQ ID NO: 6874097 - DNA, 57 bp, Homo sapiens
acattctataggcaacgtaactaccacatgaagggtggcattgttgtagtagattgt

SEQ ID NO: 6874098 - DNA, 58 bp, Homo sapiens
ggtcatatctttctgattgttctcagctcactggcctagaatagggagaggtggggcc

SEQ ID NO: 6874099 - DNA, 73 bp, Homo sapiens
gcactgactgacctaacaaaggaagctgccctggtgcctgtcaccaggaaaaacactgtgttggtgtcagtgc

SEQ ID NO: 6874100 - DNA, 69 bp, Homo sapiens
ctggcgagggtcgctggggactgcttggtcctgataacgcgcgtgggcccctcagcgacccctgctcag

SEQ ID NO: 6874101 - DNA, 78 bp, Homo sapiens
ggagagggtggcaggggctggcttatctgagagtctcaggtctctgggaacctctggcagagccgctctgccctctcc

SEQ ID NO: 6874102 - DNA, 73 bp, Homo sapiens
agcaaattatccagcaccaatgtcagaggtgtagctctcccttctggatattcagttggataaactcattgct

SEQ ID NO: 6874103 - DNA, 66 bp, Homo sapiens
gacttatgtataatgttccacatacccgtgtaatacaatggatagacggaaagctgtacataaatc

SEQ ID NO: 6874104 - DNA, 65 bp, Homo sapiens
aatgggctggaagacaggaaatgctattttatttctcttagctccatggttctttatagttcatt

SEQ ID NO: 6874105 - DNA, 64 bp, Homo sapiens
tgttcccatggatatctgcatacaagtctttgtgtggacatatgttttaatatctctgggagca

SEQ ID NO: 6874106 - DNA, 94 bp, Homo sapiens
cccatctgtttgggcaaacagggtgtgaacagtgtaaaacatgattaatgctgcaagttagtatacattctgtgttcaagtatgaacaggtggg

SEQ ID NO: 6874107 - DNA, 73 bp, Homo sapiens
ggctctgtggcctttctccagagctcccagaactgctgagctcagcaaagtggaggcaggatgctaaggagtc

SEQ ID NO: 6874108 - DNA, 59 bp, Homo sapiens
tcctgagaggggtgggtttcccatgaagcttaagtctcagggctcctctctctcaaggg

SEQ ID NO: 6874109 - DNA, 63 bp, Homo sapiens
acagaatgtcctttttcttaggaaatatacaaggaagtatctggaggcaaaggggcgtgatgt

SEQ ID NO: 6874110 - DNA, 76 bp, Homo sapiens
ctgggaacaatcaagtttaatcattgagcattggagacactctccaagggcaacaatggaacacactgtatctcag

SEQ ID NO: 6874111 - DNA, 60 bp, Homo sapiens
gccgggatcgggcttgaggggccctacgaaattcggtttgggggcgtgcccggtcggggc

SEQ ID NO: 6874112 - DNA, 57 bp, Homo sapiens
ggaatgcacaatgttttgatttgagatagttttattctctagtcataatgtgcttct

SEQ ID NO: 6874113 - DNA, 62 bp, Homo sapiens
ggggattaaacaccacttgaaggagtcttcccagagaaatcttcattgctgttttattgccc

SEQ ID NO: 6874114 - DNA, 76 bp, Homo sapiens
gaagttgaagaagccaccctggctgcacatgccatcagccatgactgtgtatgctctggtggtggtgtcttacttc

SEQ ID NO: 6874115 - DNA, 70 bp, Homo sapiens
acctcctggtaaacaaactctcaggccagtctcttaaagagacagtatgtgtttgttgccatctggatgt

SEQ ID NO: 6874116 - DNA, 56 bp, Homo sapiens
ggcagtgtcttgtaggctgtgctgggaagtcccggcctcagcgcacagaaactgct

SEQ ID NO: 6874117 - DNA, 80 bp, Homo sapiens
gtcactgtctgccgtgcagagcccttcctcccacgggggcctacctcacctgtgccaagggcttgtctgtggtcagtgac

SEQ ID NO: 6874118 - DNA, 83 bp, Homo sapiens
ggtacatagttaagaaacagtttctaatcatggagaattagtgaactctctctgaagagaagctttacactcttattatgtcc

SEQ ID NO: 6874119 - DNA, 89 bp, Homo sapiens
cctagagtaggttctgttattaccctggaatatgtttgtaatagagtgggctattacaatcatctaggataaagataatcgtggcttgg

SEQ ID NO: 6874120 - DNA, 77 bp, Homo sapiens
agaactctgttgcagagctcttggcacttcagcttctatatatggcagaggtgatggcagctttgctattagtttct

SEQ ID NO: 6874121 - DNA, 85 bp, Homo sapiens
gagaatcagcatagaaggttttggtatcaactctcttgtatatttaaataatttgatttcagaattttggtgcttttttattctt

SEQ ID NO: 6874122 - DNA, 81 bp, Homo sapiens
gatacaagggcagtggatgtttgctgggcagtaggacaaatactcgagtgcattactttggcaaactcctgcccttggatc

SEQ ID NO: 6874123 - DNA, 64 bp, Homo sapiens
tgtcactttggggagagttttgggaaggtctggtcatccctaagggctcttcctgaaagagata

SEQ ID NO: 6874124 - DNA, 104 bp, Homo sapiens
gcacaggatatcatgggtgtatcaagaagaggcaccagacatggcctcatatagaaaatgtaaaagccactgttgtctttcagataattcccagatagagctgc

SEQ ID NO: 6874125 - DNA, 113 bp, Homo sapiens
ggttctcgatccttgcctcagacctagtaaatcagaagctgtggggtgcagctcagccctttgtcttcacaggtttcctaggccattttgacacaggctaaagtttaagaacc

SEQ ID NO: 6874126 - DNA, 77 bp, Homo sapiens
cattatctttgggaattttggtcagtgtatatttatatttataatatacattgagtattatttagccatagctaatg

SEQ ID NO: 6874127 - DNA, 61 bp, Homo sapiens
gttcatggtcttttgcgttgtttcccactttatggcagataggaataatgctgctgtgaac

SEQ ID NO: 6874128 - DNA, 77 bp, Homo sapiens
gggagcctggattgtcaccgacttgtcccctcggcccccatctcgactcttagagcggtgtcggtcccggcggtccc

SEQ ID NO: 6874129 - DNA, 55 bp, Homo sapiens
tcaggtttaagtgactggaatcatttctacatgattcctggaggcagaaacgtga

SEQ ID NO: 6874130 - DNA, 83 bp, Homo sapiens
gcctaaagcccccggtgggaaggggccagtgtgcggcaaggcggcccaggcagagggatccccatcctaggcagggggcaggc

SEQ ID NO: 6874131 - DNA, 63 bp, Homo sapiens
gcatggggtcctggcagtctttggttgtctgctagtagatccatgagtcaggacctacattgc

SEQ ID NO: 6874132 - DNA, 84 bp, Homo sapiens
gttgcagtaagttgacgattgaatataccctgagcatatggcaaaggatgaatagggatgggagattctcaaacgtggctgagc

SEQ ID NO: 6874133 - DNA, 69 bp, Homo sapiens
aggaggtgaccaggtgcctgggggagctgctggctgcggcctgtgccagctgggccctgcccacgtcct

SEQ ID NO: 6874134 - DNA, 68 bp, Homo sapiens
gaggcgggagagcgcgctagggccgagcccacgacccggggccgctccgcgcttctcctgggaccctc

SEQ ID NO: 6874135 - DNA, 91 bp, Homo sapiens
tctaaccaagttgctgggaaaattcagagagcttgcatttaattcccaaggcaagctttatgctacgatttctagttttaacaaggttaga

SEQ ID NO: 6874136 - DNA, 111 bp, Homo sapiens
tcaactgggaatttttttttaaatgcagaatctcaaccttacccaagacatcttattttgcatgtcttgggtagggctgagattctgcatttccaacaagctctcaggtga

SEQ ID NO: 6874137 - DNA, 59 bp, Homo sapiens
taaagcgatgggctaggcagtgaattttcaaaaatgttcaatgttcagtaattgtttta

SEQ ID NO: 6874138 - DNA, 61 bp, Homo sapiens
cagctgaccagcatcttctggaggactgaggattacagggcttccgggctgtgtcaggctg

SEQ ID NO: 6874139 - DNA, 61 bp, Homo sapiens
tcagaatttagcattttaacaagatctcctgcagatctgttgtttgtttgctaaagcttga

SEQ ID NO: 6874140 - DNA, 78 bp, Homo sapiens
ctggaaggcaaggagggaagccacctctctctggagttctcagggactaatggaggctctcctggccttgtcttccgg

SEQ ID NO: 6874141 - DNA, 62 bp, Homo sapiens
aggagcaccatgactcagtcctcagaagaagtgatctgtgaggtggttactgtggtgctctt

SEQ ID NO: 6874142 - DNA, 105 bp, Homo sapiens
agggcttcttttgagggccactggccaggatctaagacattaattctgggatgtctcaaaccctcgacatttcttagaaattccccagtggctgaaggattctct

SEQ ID NO: 6874143 - DNA, 113 bp, Homo sapiens
ggtatttggccagcttcgagaaagccccatgcatgccttcaggagggttccagacaagggcaccctgtcccaacccacttgtaggtgccctggcctcaaagttgtaaaatccc

SEQ ID NO: 6874144 - DNA, 60 bp, Homo sapiens
ctgcaagtgtctgtacaggatactagctttaatcttgagctcctcagaagacatttgggg

SEQ ID NO: 6874145 - DNA, 91 bp, Homo sapiens
cttgctcctctgctcccacagcttcgtgcttcccctgcctggtcatcctttaacttgccactggggaggctgatgtgggcaaaggagtgag

SEQ ID NO: 6874146 - DNA, 62 bp, Homo sapiens
tttagaccctgggagattgactggcttataaagtcctatgttggcaatttcaatggtctgaa

SEQ ID NO: 6874147 - DNA, 102 bp, Homo sapiens
ctagctttgtgccaaatatatattagaaatgcactgtcagtattgttgatttcattaatataatcaaaatatcatgcaaataagtgttttcttgaaggctag

SEQ ID NO: 6874148 - DNA, 97 bp, Homo sapiens
tgctagcaaattttgccacaatacttgctgaagcctgaaagatacattgtatcatcatgctacaatcagcaaggttagtggcaaatgtgggaaagca

SEQ ID NO: 6874149 - DNA, 76 bp, Homo sapiens
cttaaatgaggcacctggggtgatatcctggcacccaatatacaggaaaaatattgcctgagtgtttcataataag

SEQ ID NO: 6874150 - DNA, 94 bp, Homo sapiens
gaactaaaagtgtggtctcaagatgtcagggcacctgcttactcagtcctagaaatggcatgcttatctggcattttgagtctcactgactttc

SEQ ID NO: 6874151 - DNA, 68 bp, Homo sapiens
cattcccatgactcctgctcaggaatactatttgatatcccccctgaattatatggagtgtgggaatg

SEQ ID NO: 6874152 - DNA, 96 bp, Homo sapiens
gctttcctttgtttaatcatttatatcttctctgagaacactgagctaaagtttaatattacagaaagggatgattgatctaaatgccaacaaagc

SEQ ID NO: 6874153 - DNA, 80 bp, Homo sapiens
ttatagacacatagataggcagaagaacattttgtaacaatgaggcaattgttaacatgtgtattgtatgatgtttataa

SEQ ID NO: 6874154 - DNA, 56 bp, Homo sapiens
gagcctgcgagggagtaaggcagagagcactattttgcagatttgaaagcaggctc

SEQ ID NO: 6874155 - DNA, 62 bp, Homo sapiens
gcaagattgaggcttcctcagcttttggatcgacaatcgacagctgagaggctattttttgc

SEQ ID NO: 6874156 - DNA, 66 bp, Homo sapiens
tgcctaggctggagtgcagtgacttgatcgtagctcgctgcatccttgaactcccaggcttaagca

SEQ ID NO: 6874157 - DNA, 62 bp, Homo sapiens
ttctttgttgggaactgctgagtaggaatataaacaaaattactttgcaggagaacagagaa

SEQ ID NO: 6874158 - DNA, 57 bp, Homo sapiens
cgctgcgcaggttcgtgcccagcgccccctgttggacacagtaggagctgcgcagcg

SEQ ID NO: 6874159 - DNA, 59 bp, Homo sapiens
ctgtcctggtactttgaggttctggggatatagtgataaatgtcagggttttaggagag

SEQ ID NO: 6874160 - DNA, 72 bp, Homo sapiens
tttctgtgttctttatttagtgatgctggttgactacaagaagtatttttaattagaagagaatttaagaaa

SEQ ID NO: 6874161 - DNA, 77 bp, Homo sapiens
ggtatgaataaatgtaaatggtgcttgctggccttaggtgtgtgagagtcagaagcatccatttcaccactcaggcc

SEQ ID NO: 6874162 - DNA, 73 bp, Homo sapiens
tagaggggagctgcagaaggcactcacactggcacggctcccaatgctagtagcagtgtcttgctccgccctg

SEQ ID NO: 6874163 - DNA, 73 bp, Homo sapiens
ttcctttctagctctaattttaggtttaactcctttctcagagaattgaggagagaatcagagtggaaaggaa

SEQ ID NO: 6874164 - DNA, 65 bp, Homo sapiens
cttcctccgtctgcccctcaccccagcacatgttaggacagtgaggagctgacactggggtgaag

SEQ ID NO: 6874165 - DNA, 86 bp, Homo sapiens
taattcaggtgggacttgcccatttctccttgtctctcaaagatgcaaggagagaagtacagtccaaacccagtcaaaaagaatta

SEQ ID NO: 6874166 - DNA, 62 bp, Homo sapiens
gagcaaaggcagcaactaatggatctcagatgcctgggaccatttatatgactgctgttgtc

SEQ ID NO: 6874167 - DNA, 90 bp, Homo sapiens
atgattctactatttcatacatttccaagaagtcaacaggtagtaacagatgcagcctgattgatttctggaagggaaatgacagagcat

SEQ ID NO: 6874168 - DNA, 59 bp, Homo sapiens
ccctaaccaaagggcctaaggaatgaccgtttggtattccttgggacccttggtgaggg

SEQ ID NO: 6874169 - DNA, 72 bp, Homo sapiens
tccctggaaggtaggttaacctgcaggagctttattagggagggctcttgggatacactgccatagaaggga

SEQ ID NO: 6874170 - DNA, 88 bp, Homo sapiens
tgtgggctgtacttagatgtagacatgcttttctgatgaaatataattatatactctgaggaataagatgtctaaaactaagcccata

SEQ ID NO: 6874171 - DNA, 92 bp, Homo sapiens
gcagagtgtctgttgagtttcaaaaggcttaaataagggatctcactacttcataaatctaaagctcaacaggcactatttttcatatttgc

SEQ ID NO: 6874172 - DNA, 72 bp, Homo sapiens
gattgcaaagatatttatgttgtttgtggcttagcaagataattaaaggatataaattaatcaagtgcaatt

SEQ ID NO: 6874173 - DNA, 89 bp, Homo sapiens
cctccacggattttgttttgacagaatgttacatatagagatacaaatatttttaaaagttatcatctgtccaacagtttttttggggg

SEQ ID NO: 6874174 - DNA, 100 bp, Homo sapiens
tgtgtggaaagagcactctgctcctgatgttggggatgtcatgccacccacgtacatcactgtcctcagcattccagcactcttgcctattctccgtgca

SEQ ID NO: 6874175 - DNA, 55 bp, Homo sapiens
aggctcaagagagctggatgtcaagatagattcttcacacatgctcctggagcct

SEQ ID NO: 6874176 - DNA, 60 bp, Homo sapiens
gtggaagtgatggtgtgctagtggtcagcctgtgcctccagagctctttcatgcttccat

SEQ ID NO: 6874177 - DNA, 55 bp, Homo sapiens
ctcaatggggcccacacacccaagcatcagagttggctggagagggtcccatgag

SEQ ID NO: 6874178 - DNA, 79 bp, Homo sapiens
attaggttggtgcaaaagttattgcggtttttgccattaaaatatggcaaaactgcaataatttttgcaccaacctaat

SEQ ID NO: 6874179 - DNA, 91 bp, Homo sapiens
ctctaaagtccttccacagctggggcagggatgggaaactatggtgacctcaagtgctcccatatcctgcccttcctagggcagaatggag

SEQ ID NO: 6874180 - DNA, 57 bp, Homo sapiens
ctataggactgagattgtcagtttgctagcaaaagggactactctcagctcctagag

SEQ ID NO: 6874181 - DNA, 63 bp, Homo sapiens
gaaggagctaaagggagccctgccggcacataacgaccgccgggctccatcacaggctccatc

SEQ ID NO: 6874182 - DNA, 58 bp, Homo sapiens
ggccagcggtcagtgcccactggattcaaccacacagaagcttttggtgaccttggcc

SEQ ID NO: 6874183 - DNA, 57 bp, Homo sapiens
ttgctagtgggaactgagtattgcttggtagataagtaatctcagtatcctatgcaa

SEQ ID NO: 6874184 - DNA, 78 bp, Homo sapiens
gttaatgcagacaccgacactcagattaatgaaaggaagcaatttattgaactgatatttggtgtagatgtcattagc

SEQ ID NO: 6874185 - DNA, 96 bp, Homo sapiens
cgatttaagggataattgcatggagtttcttagtcctagagtgatttttatattccagaggtagcttgttttgattaagccatgctttttaaattg

SEQ ID NO: 6874186 - DNA, 57 bp, Homo sapiens
acagcttctcctcgatgtcatgcacgatttcccgcttggccgtggtggtgaagctgt

SEQ ID NO: 6874187 - DNA, 81 bp, Homo sapiens
cacaggcaccactctaacttttttgatatgtgccccttgtttcgcaggcattcttcgaagtaagtagtgttgtgtcgtgtg

SEQ ID NO: 6874188 - DNA, 70 bp, Homo sapiens
ggcagcaggttgttttgtggccaggtttggcaaagtggcttcctggcagctagaaggcagcctgtctgcc

SEQ ID NO: 6874189 - DNA, 93 bp, Homo sapiens
caaaggcaacttcctccttctcatggtgttgctgtttgctcttgacatcagggtattcttaggctggcagtgtgagagagggatgtgcctgtg

SEQ ID NO: 6874190 - DNA, 85 bp, Homo sapiens
gagcccaagtttcttcatctgtaagataagcaaatttactaaggtcatgggtatctagtacatgatggacagagatttgaagctc

SEQ ID NO: 6874191 - DNA, 76 bp, Homo sapiens
gtaatgtgttaacatgacaattggcttatcataaaaagttatgaaagcaggaattgttctgttttacacatgatac

SEQ ID NO: 6874192 - DNA, 61 bp, Homo sapiens
ctccagataggagggggtccccagtgtctgggagctgtggactcccaattcttgtcttgag

SEQ ID NO: 6874193 - DNA, 58 bp, Homo sapiens
gccttttcaactaagattctgcaattataaataaatcaattgttagtcttgaaagggt

SEQ ID NO: 6874194 - DNA, 69 bp, Homo sapiens
tccatgtctgtaagaggcctgctgcatgatcttttgagacagaatggcagaattttaaagacagatgga

SEQ ID NO: 6874195 - DNA, 100 bp, Homo sapiens
ggaatgctttatcaaactttaaggatcccgattttctagaaaacaaaagcatctatgaggtgctagagaattgtcttgagagttcataggtcaccattcc

SEQ ID NO: 6874196 - DNA, 72 bp, Homo sapiens
acttggaaagagaaagttaaagactgaggcaaaggatattagcctgcttcaagttgaaatattcttacaagt

SEQ ID NO: 6874197 - DNA, 77 bp, Homo sapiens
gtcagctggcccactcctattaaccatgccttcatctgtagtggaaggaacatggctcacaggatgggctagcaggc

SEQ ID NO: 6874198 - DNA, 56 bp, Homo sapiens
cctttgatttcccccgtctcagctagttagtttcttgagaggggagagaacagagg

SEQ ID NO: 6874199 - DNA, 63 bp, Homo sapiens
cctgtgctcttgtctgtgactaaccagtgcttctcttgtgggattagtcttcaggatcacagg

SEQ ID NO: 6874200 - DNA, 84 bp, Homo sapiens
gctgtggggaaatgaagcctgagaccagggtcagaaccaataaagggaccatctgggactgtcaggttagcattttgctgcagc

SEQ ID NO: 6874201 - DNA, 58 bp, Homo sapiens
tgagtgaagtacaaaggggcaagcagaaacattctaggtctcttaaggctttggctca

SEQ ID NO: 6874202 - DNA, 56 bp, Homo sapiens
ggctttgcagcctcattgctcttggcgtgaggagctgggggtcggggggcgaggtc

SEQ ID NO: 6874203 - DNA, 56 bp, Homo sapiens
cactgtcctagtcttcctggagtttatactcttgattatggggaggtggagaagtg

SEQ ID NO: 6874204 - DNA, 63 bp, Homo sapiens
aaactgaagacattactggtctaaaagcacatgcttattatggctattttgtctttatagttt

SEQ ID NO: 6874205 - DNA, 88 bp, Homo sapiens
ccatcccagggtactttctattcccacagagatagtcatggtccataatgagacttagtcctgatgaaagaatattactcatgggtgg

SEQ ID NO: 6874206 - DNA, 89 bp, Homo sapiens
tgttgctttaagaaatacagaaagggctgaatgtggatgtattgcgtgagctaatttttttgtattattattatttttagaagtcaaca

SEQ ID NO: 6874207 - DNA, 101 bp, Homo sapiens
gaatgttttgtcctctaagttttaattggcaatgtttcttctaaacaaatatccagaaatattttttaaataaagcttggggagttgtttacaaagcactc

SEQ ID NO: 6874208 - DNA, 55 bp, Homo sapiens
gtgcttgatctcacctgatctcaccagttctgtaagaggtcagtggctcaggcat

SEQ ID NO: 6874209 - DNA, 82 bp, Homo sapiens
tcccaagctgtggcttggcacagctccatggctttgccaagaaggttgccagatggcgctgttgctcagcagctggaaggga

SEQ ID NO: 6874210 - DNA, 91 bp, Homo sapiens
gtttgtggcagagttggacagcattccatctgcaggttagtaggaaagcctgtaccagcctttgtggaatgtcctagtctgccacactgac

SEQ ID NO: 6874211 - DNA, 91 bp, Homo sapiens
aagatttatataatatacaagggactgtgaattgaagaaagaactgagagttttctccaaggatacagtcctgtgtaacactgtaaatgtt

SEQ ID NO: 6874212 - DNA, 63 bp, Homo sapiens
aggaggggcagcctgagagcgacaacgtggagttcccatgtctcaggtacatgcgtcctgcct

SEQ ID NO: 6874213 - DNA, 86 bp, Homo sapiens
cttcacatgctcatctagtttgaacattggggaggaaattattttcttctgaaacagtgacagacagcaagaaagagcgtatgagg

SEQ ID NO: 6874214 - DNA, 111 bp, Homo sapiens
gtgtgtgggcatcgctggttcccggcacagccaatcctgggaaagtgcatgtccctcatggcattcggagtcagggtggccagccagggccccaccagcaagccatagcat

SEQ ID NO: 6874215 - DNA, 66 bp, Homo sapiens
ggctgggaggatgacttgctacatgaacttgaacatgggagtgatagcaagggatctgctccagtc

SEQ ID NO: 6874216 - DNA, 57 bp, Homo sapiens
ctgaccttgtgatcttcccgccttggcctcccaaagtgctgggattacaggtgtcag

SEQ ID NO: 6874217 - DNA, 59 bp, Homo sapiens
gagaaggtggacctgaaggagcgagtggagaaactggagcttcaattcatccacctctc

SEQ ID NO: 6874218 - DNA, 96 bp, Homo sapiens
cctttattgttgcttctattgtggctttatgtagttaaacccagaaaagttagagtttccaaatatgaagccataggacagaggataagaaagagg

SEQ ID NO: 6874219 - DNA, 129 bp, Homo sapiens
ctgttcatagcaaaacagctgatgttctttaaaattagtcattttttagtggtttagtcatttatagtggttccacatgactataattacttaaatatgtggcagtatagacagctctcctatctgcag

SEQ ID NO: 6874220 - DNA, 87 bp, Homo sapiens
tagcagcacaatgtaattgaggaatggataagaaccatctgagaatttactggtcttttcctattgattctgttacttgtgattcta

SEQ ID NO: 6874221 - DNA, 63 bp, Homo sapiens
aaatgagcaggggaaaatttagctagaaagcatagcttagctaaggcaatcttttgcacattt

SEQ ID NO: 6874222 - DNA, 130 bp, Homo sapiens
ggctatggctccagctatggctgtggctatggctctggttatggctgtggctatggctccagctatggctgtggctatggctctggttatggctgtggctatggctccagctatggctgtggctatggct

SEQ ID NO: 6874223 - DNA, 129 bp, Homo sapiens
ttctcaactagggacatgtactggggtcacctgcagagcttttcaaaatacatctgctagggccatggcctgggactgcatattttgacgattttatgcaaatgattcttatgcatacctaattgagaa

SEQ ID NO: 6874224 - DNA, 55 bp, Homo sapiens
tgcaagtcctcaaagggctctgcttttcataggaagcaaaatccaagcacttgca

SEQ ID NO: 6874225 - DNA, 98 bp, Homo sapiens
tgtatccttttgtagattcgatggggccatttctagagttcagtcttgacctaaagacttggatctcaaggcactcaaaccgtcttacagaatgtgca

SEQ ID NO: 6874226 - DNA, 91 bp, Homo sapiens
gccagagtgcttgtgactgcttttcactgatagagttatgtcaggcatccagccatatagatcatgttaaaagctccagtgcactcttggc

SEQ ID NO: 6874227 - DNA, 57 bp, Homo sapiens
ctgggtgctccggcctcccccttcccgaacctcagacgggggtggctggggctccag

SEQ ID NO: 6874228 - DNA, 69 bp, Homo sapiens
ggactctctggagtcttatccccagcccccaggtggataatgagaactgggagactccagaactgatcc

SEQ ID NO: 6874229 - DNA, 57 bp, Homo sapiens
ctcaccccctgactttatatcccgaggttttgatgtgcccaggagtggtggggtgag

SEQ ID NO: 6874230 - DNA, 71 bp, Homo sapiens
gatgttaaatgtaaatagctgctcagaagtaatttttagctgctattgttgtggttattttcattagcatc

SEQ ID NO: 6874231 - DNA, 111 bp, Homo sapiens
ccatatcgatccctgaagaagacatggttctggagagtcctgctcacgtccagtttgatctggtggatgtgttcagaagacctcttgcccttctccttcatgatctgtagg

SEQ ID NO: 6874232 - DNA, 69 bp, Homo sapiens
tagatgctgatggatgagctgaagtgaaagtagctgctttaggatcagcctacactccaacagcatgtg

SEQ ID NO: 6874233 - DNA, 55 bp, Homo sapiens
tgccatgcccacctcccttctgacagtgtgtaggttgacagaaggaagcatggca

SEQ ID NO: 6874234 - DNA, 75 bp, Homo sapiens
tcttcttcataggcagtcctgttctttgtagctccgggggtctcataaccaaagaatgggacttcagaaagaaga

SEQ ID NO: 6874235 - DNA, 56 bp, Homo sapiens
caggaggtggagctcaagtggtaatgctcacttgcctgcccactgttcacctcttg

SEQ ID NO: 6874236 - DNA, 87 bp, Homo sapiens
gaggcaacagcaaggccattggatgcagtctttatttgtccaggtggccataatttcaacactgcaaatcagccttgctgctgtttc

SEQ ID NO: 6874237 - DNA, 60 bp, Homo sapiens
ttaggtgattgtaagcattaaataaggaaatatacttaaagtgcttggcacgacacctgg

SEQ ID NO: 6874238 - DNA, 55 bp, Homo sapiens
gctccttcaggtggtagctgttgtggcagaatagaagagtgctggactgaggagc

SEQ ID NO: 6874239 - DNA, 78 bp, Homo sapiens
taagatgcagatgcctgggctgcaccaccctttgagactttaagcaggtcatggtggggtccaggaatctgcatttta

SEQ ID NO: 6874240 - DNA, 69 bp, Homo sapiens
gccctggaggcagaaataggacttgtgattcaccttcagtttaaaagcgctaatttctgccttctgggt

SEQ ID NO: 6874241 - DNA, 98 bp, Homo sapiens
gggctaatatgatggtaccacaaaggcattggagaccctggctgcttctagccatttgttctccatccttagaatgtgtgatcattggctcatggccc

SEQ ID NO: 6874242 - DNA, 86 bp, Homo sapiens
ttttattcctccacagctctacctattcaatatcttataaaatttattttatgggtaaagggctagggtttggggcaaaaatgaaa

SEQ ID NO: 6874243 - DNA, 84 bp, Homo sapiens
gctatatgaacatttgcatagggttcaaaggctgtagagttgctttttaaaagtctttaaaattctgtaataatggtttatggt

SEQ ID NO: 6874244 - DNA, 57 bp, Homo sapiens
caatgggcactagggccacccatgtcaggcaggaggtagggagcccagagcccagtg

SEQ ID NO: 6874245 - DNA, 98 bp, Homo sapiens
ctgtgttttagtaattcgcagggagacaggctctctcttttcctattatacttggacagaagagccttttaccttgtgaaatgaaattgtaactacag

SEQ ID NO: 6874246 - DNA, 79 bp, Homo sapiens
gagtttgaaaaagtcatgtttttgtttagcataaatccaaatatttatatgttatgtaaaatacttggcatttaaactc

SEQ ID NO: 6874247 - DNA, 59 bp, Homo sapiens
tgaagcatctttatagggaccctataaaaacctgtaggattctgatctgagctgtttca

SEQ ID NO: 6874248 - DNA, 58 bp, Homo sapiens
aggcctctgtagggccctgaagggagggaccagccctttagggtctcctgccaggtct

SEQ ID NO: 6874249 - DNA, 63 bp, Homo sapiens
acttgctctgggggaagccagctgttctgttgtaagaacactcgagcagccctacagaggggt

SEQ ID NO: 6874250 - DNA, 64 bp, Homo sapiens
ttgccagctcttgatgggtgggtagtcactcctttcagtggttgccccctgggggagaaggtag

SEQ ID NO: 6874251 - DNA, 74 bp, Homo sapiens
tggcaccagggtgctgtgttctggcaggtgcaatataaatccagctcattcagaggacaagctccctggtgaca

SEQ ID NO: 6874252 - DNA, 58 bp, Homo sapiens
ggctcacaacagttttctgtaaagtaccaggtagtaaatattttagcttttgtgggcc

SEQ ID NO: 6874253 - DNA, 83 bp, Homo sapiens
gctccccagggcccctcaattctccaccagtgcaggtctagatatacatctgcctgaaccactcttggagttttcttgggggt

SEQ ID NO: 6874254 - DNA, 60 bp, Homo sapiens
gggaaaggaatcatatcctgtgaagtacatttccaggtgtaagacatggtcctacatccc

SEQ ID NO: 6874255 - DNA, 88 bp, Homo sapiens
ttctatgatgtggcagttgctgtggcaataatggggctggaagctccattattgaagcttcaattgtcccatttttccatgtgtagaa

SEQ ID NO: 6874256 - DNA, 83 bp, Homo sapiens
ggcagactagattgcaaactctagggaggcaggaagcaattacatcttgtccctgctgtacttagagcatccagttccctgcc

SEQ ID NO: 6874257 - DNA, 84 bp, Homo sapiens
gcatgataacataaagcagactgatttgcatcacttggtattgtcagccctgtgtgtttgagtttgttctcttatttaatatgt

SEQ ID NO: 6874258 - DNA, 62 bp, Homo sapiens
gccctgctcttttgcccacccacctgacctcctgttgtttgtgttggccaaagtgccagtgc

SEQ ID NO: 6874259 - DNA, 59 bp, Homo sapiens
gtctcctggcctccagtttctctgcttgaagcgcccttgaaactgatggccaggatgat

SEQ ID NO: 6874260 - DNA, 56 bp, Homo sapiens
tttttgagggctagtagacctatctttgtgattacccctgctttaggccttaaaag

SEQ ID NO: 6874261 - DNA, 67 bp, Homo sapiens
catggggtaccttggtatgcttggtagagctatgacaggttctgctgaagccagggagcaagccatg

SEQ ID NO: 6874262 - DNA, 86 bp, Homo sapiens
ctcattgtttcatctcccttggtcacagattcctcgtctgtagaagatgatggttcctccttcatgggatgagaaatgcaactgag

SEQ ID NO: 6874263 - DNA, 100 bp, Homo sapiens
tgttgcttgctcagcttagcttactattttaaccaaaagtttggaagccatagctaatgaaggtatccaaaaaacgtttgaatagttgctgtatgcaata

SEQ ID NO: 6874264 - DNA, 62 bp, Homo sapiens
gggcttgataaccacaggccagtctgtatcttcaatatagatgcctgccagttatttagctc

SEQ ID NO: 6874265 - DNA, 55 bp, Homo sapiens
gccactagtcaagagattggggctctctaatgagccaagactcccatctagtggt

SEQ ID NO: 6874266 - DNA, 67 bp, Homo sapiens
gagacatctccaaggcaacctgttcagaccaatgactgaggatgaaacaggataatgggggtgtctc

SEQ ID NO: 6874267 - DNA, 66 bp, Homo sapiens
taaattgctgggtcccacccccagagttactgattcagcaggtctgaggtgggacccaggaatttg

SEQ ID NO: 6874268 - DNA, 76 bp, Homo sapiens
cttcacagacgcctcccctcgcctctaggaatcctgtcccccatgggctgggaggtggtgggggcagtctatgaag

SEQ ID NO: 6874269 - DNA, 60 bp, Homo sapiens
tggcccagggaacattgattactgagtggaactcagaataattcagtgttcacttggaca

SEQ ID NO: 6874270 - DNA, 75 bp, Homo sapiens
cagttgaggatttagtggtccatgtggcaggctactgctcagtagcttcagggaaaccactgcttgcctcccctg

SEQ ID NO: 6874271 - DNA, 79 bp, Homo sapiens
gatgagagccctccgggtggatgggagcaagggaagatttcctacccaaagctgtaccccaacctatgagtcttctttc

SEQ ID NO: 6874272 - DNA, 70 bp, Homo sapiens
tccggggcttccccgcagtgccctcctccgccaccaacagcagctgggcccgggcgggagaagccttggg

SEQ ID NO: 6874273 - DNA, 112 bp, Homo sapiens
gtcagagcaagttatttctgaatgttgtgggtgatgttttactgattaattttctgaaggaattacagtaatgtattatttaactataggtctaaaatagctttgttctgat

SEQ ID NO: 6874274 - DNA, 63 bp, Homo sapiens
acagatgagttaaagcagagtgagatctagagcccaaatctcctgtgtgccattcttatctgt

SEQ ID NO: 6874275 - DNA, 79 bp, Homo sapiens
tgggttacaatgatgaataaatggcattaattaaatgtgctatataattgttcatcattgttaattaaagtttttccca

SEQ ID NO: 6874276 - DNA, 61 bp, Homo sapiens
ccttttctccctgagtttgtggctaagttccaggaggcttatgtcacagctttgggaaagg

SEQ ID NO: 6874277 - DNA, 57 bp, Homo sapiens
gaggggtgtggagccatcagttagcaaatataggggaactggagctgcacacctttc

SEQ ID NO: 6874278 - DNA, 56 bp, Homo sapiens
accaggaaatcactctgattttggttcatgccagctcctgagcatggtttccaggt

SEQ ID NO: 6874279 - DNA, 81 bp, Homo sapiens
gactgtatcaatagtaagatggaggctgcatttggatggatgtctgcccgactccagtctttattcactattgataaagtt

SEQ ID NO: 6874280 - DNA, 96 bp, Homo sapiens
tgaggcaggagagtcgcttgaacccaggaagtggaggttgcagtgagcgagcaccacttcactccagcttgggcaacagagtgagacttcgtctca

SEQ ID NO: 6874281 - DNA, 77 bp, Homo sapiens
agagtgaagtttttgaaagtgacaagtgttccagaggcaaaaaggagaggaaagttgactttcaaaaatggcatttt

SEQ ID NO: 6874282 - DNA, 68 bp, Homo sapiens
gctgagcccctggccgggctggcatatggaactgatttagtgccctgctggggcaggagaaggcgggc

SEQ ID NO: 6874283 - DNA, 76 bp, Homo sapiens
aaaagttaatagaagtgatacattagctttcttgggcaaagtgcttaagaagtgagtgcaccttcttcatcctttt

SEQ ID NO: 6874284 - DNA, 77 bp, Homo sapiens
accagtgaaggaaaagtggcttgtccgtggtcacatggctaaccagggtgacagaggatcaagccatatctcctggt

SEQ ID NO: 6874285 - DNA, 101 bp, Homo sapiens
gaacaaggattctaaatgattagggttacacttctaaaaaaagcaggccttgtcttttatgtctgtgttttgtgttagagtgcatttagagatttttgttc

SEQ ID NO: 6874286 - DNA, 81 bp, Homo sapiens
aagggagaggagggtcttgttgaacttgaaaaaactaaataagcaaagttgatacataaggacacccttctctttaccctt

SEQ ID NO: 6874287 - DNA, 57 bp, Homo sapiens
ggagatgttaactacatagctacaactacctataaggtaggtagtgttagtatttcc

SEQ ID NO: 6874288 - DNA, 81 bp, Homo sapiens
ggccaggtgagggcgatcactccgtttctctatccagttacctttgtacgttagaaaagcaggagctcaatacacctggct

SEQ ID NO: 6874289 - DNA, 58 bp, Homo sapiens
gcagtccttatgagatgctgccttcctcttttttgaaaggcatagatgataaggaggt

SEQ ID NO: 6874290 - DNA, 61 bp, Homo sapiens
cccctccctgggcctggcttggtggggtgagcccaacaggtgagctctatctagggagggg

SEQ ID NO: 6874291 - DNA, 90 bp, Homo sapiens
ggtgcctccccatccatggctgtcacgccactgtgaggtggatggagaatgcccactgtggcagcacagtccacaggacggggaggtgtc

SEQ ID NO: 6874292 - DNA, 60 bp, Homo sapiens
ggacagcatatcagcagggcagggtcaggtccctgctactctggctgtatgaccctgacc

SEQ ID NO: 6874293 - DNA, 93 bp, Homo sapiens
gctgggtggaaccttggatgtcatctcctccagctctccgatctcaggatggagtcccagagaagggaagggattcacccagggtcacccagt

SEQ ID NO: 6874294 - DNA, 67 bp, Homo sapiens
cctgaggaaattgtaatgacttcacttgaggcagctgccttggaagacaatgctgattctcttcagg

SEQ ID NO: 6874295 - DNA, 75 bp, Homo sapiens
ttgtaaggcagagctaggaagaattgtggcaacctcctaacaactctttctagtctctattcttgctgccttcaa

SEQ ID NO: 6874296 - DNA, 58 bp, Homo sapiens
gcagctcctcctgggctggagactaggtgtgcaccactccccctctgggtggggctgt

SEQ ID NO: 6874297 - DNA, 65 bp, Homo sapiens
tgacggggaagcggggattgtctactgtcattcattaatgcataaatagtacctgcttttcttca

SEQ ID NO: 6874298 - DNA, 81 bp, Homo sapiens
gtaatgtaatttagtaaattatgatttgatggctgggcatcagccccagtgttgaacagtatttggactatgattacttgc

SEQ ID NO: 6874299 - DNA, 96 bp, Homo sapiens
taggctcatgggaccctggacacaaagatcaaatattggtgtcattaaatagctacttgaatccaataagtgcttttgtttagcaactatgtctta

SEQ ID NO: 6874300 - DNA, 64 bp, Homo sapiens
gtttgcctgtgatgtacatttctcatgaagttacctgggatatgctacaccaacacaggggaat

SEQ ID NO: 6874301 - DNA, 58 bp, Homo sapiens
agtgtcaagctttctgtctcttatgggatgactcagcagaacaaggaagcttaacatt

SEQ ID NO: 6874302 - DNA, 68 bp, Homo sapiens
taatgttttgttttctaaatcagtagcttccaaagtggagtgcattgggccacaagaagaaaatattg

SEQ ID NO: 6874303 - DNA, 55 bp, Homo sapiens
tatttctttcttgatattttggctgctcataatgtcagttactgagagagaagtg

SEQ ID NO: 6874304 - DNA, 66 bp, Homo sapiens
acaggacaggtaggattcgcaggggcttgaaagtcccataactcaagtgcatttcacctgtactgt

SEQ ID NO: 6874305 - DNA, 57 bp, Homo sapiens
gggagaaggagctagttcttgagggattaggaagttttcagttggctgccatctccc

SEQ ID NO: 6874306 - DNA, 78 bp, Homo sapiens
agtgggggtgccccagacacgcatgtggggtctagtgtgaccaccagcagcggtgtgagggtgcatacagcccccact

SEQ ID NO: 6874307 - DNA, 108 bp, Homo sapiens
gacagccgcaggtgggcgatgcgcagcctctgcagctaggggtcttgagctgggagaggcttctggaggagctgggctgatccaagcccacctctatgtggttttgtc

SEQ ID NO: 6874308 - DNA, 102 bp, Homo sapiens
tgtaaattagagtataagcattgcaagggcatgtgtgcgtgtgtatgaaatagagagaaagtgcacagtcaatgtttttgcatgtgaatgactaaaaccaca

SEQ ID NO: 6874309 - DNA, 79 bp, Homo sapiens
agaaggcagtggagctcagattccaatgttggcctatttgactgcaggccaagttgctaaaggagttctttgtccttct

SEQ ID NO: 6874310 - DNA, 96 bp, Homo sapiens
gtttctccatggcaaatagactctgttaagggtaaacagcagtaatttaaatttctaaatggctctgtggtcttagcatgctttgctatgagaaat

SEQ ID NO: 6874311 - DNA, 76 bp, Homo sapiens
gtgttgtaggcagtggggtctctctgtacctcccacccttgaggagggaggtaaagatgagctcagtgtccaacac

SEQ ID NO: 6874312 - DNA, 55 bp, Homo sapiens
ccgaggctggagtgcagtggcgtggtctcagctcactgcaacctccacctcccgg

SEQ ID NO: 6874313 - DNA, 61 bp, Homo sapiens
ctgggttgcaactgcctacagtattcagtaccgtcacatactgtaaaggtttgtagcccag

SEQ ID NO: 6874314 - DNA, 100 bp, Homo sapiens
gtttagcaaatatccactcttactaccagccctcctccatcagaggagtttacttgctcactccattgatggtgggcttggtcatgtgagttgctttgac

SEQ ID NO: 6874315 - DNA, 57 bp, Homo sapiens
ggcttctcagatctcagctttgaggtctcatcttggaggtttccgcttctgagaacc

SEQ ID NO: 6874316 - DNA, 103 bp, Homo sapiens
tgtgggcctggggtgcacacagtgctgtgcagtctgccctcggggataggcctgaggaaggaggctaagcagcaccttttcatcgtggcatttcaggactcca

SEQ ID NO: 6874317 - DNA, 75 bp, Homo sapiens
aggaccaggcccttttggaattgtgaataggtttattgccttacatcctggtacacatgtccaaggtcaggtcct

SEQ ID NO: 6874318 - DNA, 71 bp, Homo sapiens
caactgtaaactagggctgataagggtgcccaagtacacactttcataatgccaggtttgtaatccagttg

SEQ ID NO: 6874319 - DNA, 90 bp, Homo sapiens
atgactgctaaaatggtatgaaaagagatttcaactccctatggcactgctaatgtacctgaaatttttaaagtgcattttagtagttat

SEQ ID NO: 6874320 - DNA, 80 bp, Homo sapiens
tagaggagtcttgaaaccagcgaggtgagtcctccagctctgttcttcttcacggtcatcttgctgttttagatcttctg

SEQ ID NO: 6874321 - DNA, 74 bp, Homo sapiens
cagctggataaggatcagtttctttcactttgggtcatgggccctccaagaatgaaatgatactttattcactg

SEQ ID NO: 6874322 - DNA, 88 bp, Homo sapiens
gggcttgactataagtggcacagtccagactcctggagttgcccctggggtaacagcagggatggggtggccagtgcagtgtgggccc

SEQ ID NO: 6874323 - DNA, 67 bp, Homo sapiens
gacattctgggcttggctgtttccattattttactgacaatgaaaagtggtcaagttccaggaagtc

SEQ ID NO: 6874324 - DNA, 68 bp, Homo sapiens
ggggcatttattacactttactcttacaccattgcctacctttggcaaaggaagtttgtaagtgtcct

SEQ ID NO: 6874325 - DNA, 108 bp, Homo sapiens
tgctagacagacagtaggaggcctctactcatggataaccccctggatagaagaaactaccccaggtcatctgagagtcctatcttcctaactgtgtaccacctagca

SEQ ID NO: 6874326 - DNA, 58 bp, Homo sapiens
gccccatccctccagatgctgccggagatccaagattcgcgggcctggagggtggggt

SEQ ID NO: 6874327 - DNA, 66 bp, Homo sapiens
ggcccctccttctcttcttgaccactagaactgacatccagggctactcagaaggcaggagaggcc

SEQ ID NO: 6874328 - DNA, 68 bp, Homo sapiens
agggtgtaggtgtcagctggggggtaactgctgtctcagatcagcatctagctgacaacccacagcct

SEQ ID NO: 6874329 - DNA, 56 bp, Homo sapiens
ggtccagtgggttcctccaatagccagggctggcctatgaaggacacctacttgcc

SEQ ID NO: 6874330 - DNA, 59 bp, Homo sapiens
aggaatttttctagccggagttacaggtcaaataccatgctttttactagaggattcct

SEQ ID NO: 6874331 - DNA, 61 bp, Homo sapiens
tggccttcctggtgactcatgagcattacccagagtatgacctgtgagtgtccagagacca

SEQ ID NO: 6874332 - DNA, 65 bp, Homo sapiens
tgtttccattgtttttgaaatgctttggttatcccaatcccaagaaatatttcccaatggaaaca

SEQ ID NO: 6874333 - DNA, 130 bp, Homo sapiens
tttcattcacaagtggactaagtaaaagcatacagcagggcgctgtgatgaacacgctttaaggtggcttcaactcctggtgctcatgccccgtgtgtgtgatttgcttctaactagtagaatatggaaa

SEQ ID NO: 6874334 - DNA, 92 bp, Homo sapiens
tgttacatgatgtttgaaaatttttactgggttatctgtaattctaaatagacatgccaagaaacccagtggcttctaagcagcatgtatca

SEQ ID NO: 6874335 - DNA, 58 bp, Homo sapiens
acctattctaaccttgacttctgacctgtcgctgaggaaaagcaagctttgagtgggt

SEQ ID NO: 6874336 - DNA, 130 bp, Homo sapiens
aaagatgatgaggcaggaattaataaagaaatgaagtcgtgtgtgtttggttgcctgtcagagggcacacaatttcataaacaccatgcctggacaatttgatattaatatttaacacctctgcatcttt

SEQ ID NO: 6874337 - DNA, 130 bp, Homo sapiens
tgggaggagtttataggcaggtctggttgatgcccctgtgctctttttcctgcttccttcggagtgggaacgatggttagagtgggaagtatctgaggccccgccaatacctgcaactctctaattccca

SEQ ID NO: 6874338 - DNA, 64 bp, Homo sapiens
tctccaggcactacctgggtaagccagattctggacatgatctaccagggtggtgacctggaga

SEQ ID NO: 6874339 - DNA, 62 bp, Homo sapiens
tcggggcgcacctgccctttcatcagccttttgttttaaaatgaggggttggtgcaacccga

SEQ ID NO: 6874340 - DNA, 70 bp, Homo sapiens
tgctacccagggtagaacctcagagcaagagagaagactaggctctgaacttccaccttttcagggggca

SEQ ID NO: 6874341 - DNA, 71 bp, Homo sapiens
cagcttgctaattttagatacaatttccagggtgacctaccctgaagagcactctagagttgactgagttg

SEQ ID NO: 6874342 - DNA, 86 bp, Homo sapiens
caacgtatttggcagtctttgttcccattactgagctcctctttggagctgccaggctttggtcaaaggctgcagggggtactttg

SEQ ID NO: 6874343 - DNA, 55 bp, Homo sapiens
acaaccgcggggcccagcggttcctgtgggtgctgacaggagcctggcggtgagt

SEQ ID NO: 6874344 - DNA, 56 bp, Homo sapiens
tactttcagaagatgtgtagtaattttctcaccaactccacatcttttgagatgtg

SEQ ID NO: 6874345 - DNA, 69 bp, Homo sapiens
taggatttcatgaggcattttgcatttaagtagatcttacttctttgaaatgtttcttgattaatccta

SEQ ID NO: 6874346 - DNA, 64 bp, Homo sapiens
ccagccttctgggactctcatctagggctctgttttggatgatctgagagtcccaggggcttgg

SEQ ID NO: 6874347 - DNA, 81 bp, Homo sapiens
tttgcaaaggaccattgtgtagcagacataaggtgttcactataattgttccggatgtcagctttacaattcgtttctaaa

SEQ ID NO: 6874348 - DNA, 58 bp, Homo sapiens
ccatccttggcagctcagacctaccctttagtactgtgttctctgctgccaaggctgg

SEQ ID NO: 6874349 - DNA, 62 bp, Homo sapiens
tttatccacagtatccaaaatctggcccctggtgggtaccttttgaatagctgctggataaa

SEQ ID NO: 6874350 - DNA, 66 bp, Homo sapiens
ttgcattgatgttccttcttgcctccttcagcaatgctgttcttggtgctgaggatacagtagtaa

SEQ ID NO: 6874351 - DNA, 58 bp, Homo sapiens
gagaatattgtcacaatcaaattgtgtccttacaatgtgacctgacagtgttattttc

SEQ ID NO: 6874352 - DNA, 100 bp, Homo sapiens
tgaggcaggagaattgcttgaacctggaaggctgaggtcagtgagccgagatcttgccactgcactccagcttgggcaacaagagcaaaactccttttca

SEQ ID NO: 6874353 - DNA, 58 bp, Homo sapiens
gctaggccacagggcaaaaaggaggcctcatgagccttcgggcccccatggcattggc

SEQ ID NO: 6874354 - DNA, 61 bp, Homo sapiens
ggatagatattctgcaggtctaatttgggtcagcaaattcccatttgcagaaaatcatttc

SEQ ID NO: 6874355 - DNA, 62 bp, Homo sapiens
aaggtggcagactacggaacacattcatagagtgtgttacaaatcacctgtgctgtcacttt

SEQ ID NO: 6874356 - DNA, 129 bp, Homo sapiens
ttgcagtctttttcaagttactttaaatctatgattctgctaggtgattttattacttgctgttacctgatttctgcggtaataataattcacttatgttttagatttttacaatgaaaaaaattttaa

SEQ ID NO: 6874357 - DNA, 60 bp, Homo sapiens
actggagttctatgtgcttgtgaccattcttggtttctccgaatatcctagaactttggt

SEQ ID NO: 6874358 - DNA, 60 bp, Homo sapiens
cttggaaactttccctgggcacctaataaaactaaactgtgtccaggcactctttccaag

SEQ ID NO: 6874359 - DNA, 127 bp, Homo sapiens
ctttagagttagaaagctttgaattcttgtcctgggaactggacagctaaaactttccaagataacctagataactttagtatgtgcaggcttttccctgtaggacaagaaagcttacactttgtag

SEQ ID NO: 6874360 - DNA, 59 bp, Homo sapiens
tctgaggcctaggccctttctgagccctgaggcccctcagctcagggcctgggtctgga

SEQ ID NO: 6874361 - DNA, 78 bp, Homo sapiens
gctgcctgccatctgccctggccatgcccgttccgctaatgaaggataaacacaaggccaggccagatgacagtcagc

SEQ ID NO: 6874362 - DNA, 77 bp, Homo sapiens
ggatggaagagggagggcaaaggcactgagcaggaatgtgtatggtgtctccatcctgccctgccctcctccactcc

SEQ ID NO: 6874363 - DNA, 83 bp, Homo sapiens
ttagattctcataggagcgtgaacctgattgtgaactgcacatggtgagggatctaggttgcatgctccttgtgagaatctaa

SEQ ID NO: 6874364 - DNA, 57 bp, Homo sapiens
cagactccacctccagaaagtcttgtgcattaagtctacaagaggaatggaggtctg

SEQ ID NO: 6874365 - DNA, 86 bp, Homo sapiens
ggtgtggacaccagagggctggggcaggaggagcgtgggagcgagcggccgacccccgtctctggcccggcccctgggtaaacgcc

SEQ ID NO: 6874366 - DNA, 121 bp, Homo sapiens
cctttccctctagtagtactcaacacacttgtaattacatgttcaaatttgtctttcttatttctacttaggttcatgaaggcaagggacatgcctgtgttgcttactttctcttggcagg

SEQ ID NO: 6874367 - DNA, 55 bp, Homo sapiens
cagtgggggtgaggccgaggtacctggattgtcagtggcctcccacaccgccctg

SEQ ID NO: 6874368 - DNA, 62 bp, Homo sapiens
agggcggaggcgttaccatgatgtccgcgtagtccgtgggcatctggatctgcttctcccct

SEQ ID NO: 6874369 - DNA, 88 bp, Homo sapiens
ggagtcttgctctgtcaccgaggctggagtgcagtgaaatgatctcggctcactgcaagctctacctcccaggttcaagcgattcttc

SEQ ID NO: 6874370 - DNA, 79 bp, Homo sapiens
attcctgaagttgctggaaagttaaattttggaaaggtgacactgcttctccagtgactcatctgagcgcctcaggaat

SEQ ID NO: 6874371 - DNA, 58 bp, Homo sapiens
aacacagatcaaaatatttcctgtctgtatatgaaggtaatgccattgatctgctgtt

SEQ ID NO: 6874372 - DNA, 61 bp, Homo sapiens
gcacagaggtggaggacaaatagcgctgagaatgctgaagaggttcttttcacctctgtgc

SEQ ID NO: 6874373 - DNA, 63 bp, Homo sapiens
ggtttcctgtcaaggattgtttgttgaaatcatcttacagccccattcttcagcagtgagacc

SEQ ID NO: 6874374 - DNA, 80 bp, Homo sapiens
tgtagcttttggtggttagtggagggaaaccttttatgatttaaatacttttactccactgattggttaccatcactgca

SEQ ID NO: 6874375 - DNA, 103 bp, Homo sapiens
aagccacttggaatagcgtcaatatgttagctatgtaggcgttcactcagctctggaggactcatcgcctgcttaacgaattgtgttaactccagccaagctt

SEQ ID NO: 6874376 - DNA, 63 bp, Homo sapiens
tggggggagagtgctactggcatctagtggttagaggccagggatgctgctgcacatcctgca

SEQ ID NO: 6874377 - DNA, 103 bp, Homo sapiens
actcaatttataattgacagtatactgtcaattactgtatactgtatacaatatactgatactgacaggattgacagtaaatgtacaacattgagatttgagt

SEQ ID NO: 6874378 - DNA, 84 bp, Homo sapiens
gtcatattctctgaccactgtagccacttaagatagtctcaaatatgaataattttcagtggccatagtggagaagatgctgac

SEQ ID NO: 6874379 - DNA, 103 bp, Homo sapiens
gccatcaagtacttctaagacaaacctggcatgccttgggtgcctctgggctcatacctaggagttcagagaggttggctaggatgtttgaatagatctaggc

SEQ ID NO: 6874380 - DNA, 64 bp, Homo sapiens
gcccctggatttgggttgtcactgtggttctcctgccagtgctataatccagtgtcgtaggtgc

SEQ ID NO: 6874381 - DNA, 56 bp, Homo sapiens
ctgccgtcagctctgtttccaagcaattagaaggcagagggagaagagcccggcag

SEQ ID NO: 6874382 - DNA, 68 bp, Homo sapiens
ttcagaatgattacattctggtgacatctcttcagaaacagggtcttcttagaggtaatcaatctgaa

SEQ ID NO: 6874383 - DNA, 84 bp, Homo sapiens
cccatcctcatcagatttcagatgctcggcagttgacacagctacagcaaaggactctgagtcatcatctcattgtgggatggg

SEQ ID NO: 6874384 - DNA, 65 bp, Homo sapiens
gtaaagggttccctctccccggtcgcaggaagacgcctgagggggcgctcggagggatcccctgc

SEQ ID NO: 6874385 - DNA, 119 bp, Homo sapiens
tgacctaaatctccattttgaatacttggcatattacttccagcaatctgcatatttagaatgggatgaatttgtgtgtgtgttggaggtggtagtggtgttggaggaggtggtggtta

SEQ ID NO: 6874386 - DNA, 83 bp, Homo sapiens
tgtggagacttagctcatagaagttgaactaaaaatattttaagaaggaaataaactgccgatttttgttgagagattctaca

SEQ ID NO: 6874387 - DNA, 66 bp, Homo sapiens
cacctcaggctccccgggggtgagcactgtgaatcacagaagtgtcctcctctgggagccagggtg

SEQ ID NO: 6874388 - DNA, 80 bp, Homo sapiens
ccattgtggtcagagaacatattttgtatgatttaaatctttttaaatctattgagacttgttttatggcccatatgtgg

SEQ ID NO: 6874389 - DNA, 59 bp, Homo sapiens
ctccccccacagtgttcttgccaatgagagaaatgagcaggagcattgttgtggtggag

SEQ ID NO: 6874390 - DNA, 129 bp, Homo sapiens
agaaatttaaaaatacggtatttactcttaaggaaggaatagcttagtaggtaaaattataatacagcgttataagaaacttaactgggaactataccacctggtcatttaacccagttttgggtttgt

SEQ ID NO: 6874391 - DNA, 109 bp, Homo sapiens
ggctcacagggtgcatttgacaaagagaagggcatgagtctataaacctgggacaattgcaggtttagaggcatcttgcttttctgggaacaaaggcatccacagagtc

SEQ ID NO: 6874392 - DNA, 75 bp, Homo sapiens
ttatcacttggtcagaggggctggcatgatgtgtctccaagcaaaccatgttggttgtttttctcaaagtgatgg

SEQ ID NO: 6874393 - DNA, 72 bp, Homo sapiens
gtagagatgggttcaccatgttggtcaggctggtcttgaactcctgatctcaagtgatccacccatctcggc

SEQ ID NO: 6874394 - DNA, 96 bp, Homo sapiens
tgttgtgttgcaagttgtgcctttactataaaggatctgaaatatgttttgcacacctttctcttagtgaatgtggcatataattgtggagctgca

SEQ ID NO: 6874395 - DNA, 64 bp, Homo sapiens
gaggaaagggcaggaagaggagcccctgtctgagaaacacagtcagggtctggccctgttcctt

SEQ ID NO: 6874396 - DNA, 76 bp, Homo sapiens
gtccctggcactgtgccttcacactggtcactgtgaaaagcagatcacactggactcagaggccagaatccaggac

SEQ ID NO: 6874397 - DNA, 55 bp, Homo sapiens
gtacttctgccccacgtccctgcaaaggttagggtaagcttggggctggcagtgc

SEQ ID NO: 6874398 - DNA, 55 bp, Homo sapiens
ctcagagctcagctttgttagttaattgatgacatcactagcctttagttctgag

SEQ ID NO: 6874399 - DNA, 56 bp, Homo sapiens
tgccctctttctgtacagctcctccccctcaatggtgccacattacagaaagggca

SEQ ID NO: 6874400 - DNA, 75 bp, Homo sapiens
cagggcaattgaacagtgggcatgtgaagactgaaggctcatgtagtatattatcccactcatttgatgactctg

SEQ ID NO: 6874401 - DNA, 75 bp, Homo sapiens
gactcctgggacctctgggaaggctccttagcccaggcaactgaggcagttgagcttcctgaggacctgggggtt

SEQ ID NO: 6874402 - DNA, 61 bp, Homo sapiens
cccagtgggtgctgggctctgccgatacttggtcttgaggcagctgggcagcactcatggg

SEQ ID NO: 6874403 - DNA, 97 bp, Homo sapiens
gtgaggagaggctgagtggcagttctaattgaccatttctacccatgttcctcttagaaacatacaataagagctgtcacagcttcctgccaatcac

SEQ ID NO: 6874404 - DNA, 65 bp, Homo sapiens
gagcaggattttgaagacagcgaaagcagcattgttctctggctggctgtctgcggggcctgttc

SEQ ID NO: 6874405 - DNA, 88 bp, Homo sapiens
ggtgtgggcactaggtaagtgggtggcaaccggctctttgggaccattggtgctgacctttgcctggtcacctgcctgtgcctaggcc

SEQ ID NO: 6874406 - DNA, 65 bp, Homo sapiens
ggaggaattcacctgctttcccaaggtcacacaattatttagggacatggctaggattccaatcc

SEQ ID NO: 6874407 - DNA, 98 bp, Homo sapiens
tgggatgaatgagccccagtcatttttcagtctttgtgtcagccagtttgcgtctctgattccagagagagaaaatttgattggcttagttcggatca

SEQ ID NO: 6874408 - DNA, 129 bp, Homo sapiens
cccctgatctcaggtgatccacctgcctcggcctcccaaagtgctgggattacaggcatgagccacctcgcccagcccaatcctagcactttgagagtccaaggcaggcagatcacttgagcacgggag

SEQ ID NO: 6874409 - DNA, 63 bp, Homo sapiens
gagcagaaacagccctagtacagcctgtgacatttacaacatgaggtttatctgtttcttctc

SEQ ID NO: 6874410 - DNA, 73 bp, Homo sapiens
ctgaggctgggtcggcagggggccagcagcccgggtgacccctgcctggctcctaatgctgcccagactgcag

SEQ ID NO: 6874411 - DNA, 56 bp, Homo sapiens
gagtgacctggtttaccagttctctgcacttagactggtgtttattacaggtgctc

SEQ ID NO: 6874412 - DNA, 94 bp, Homo sapiens
tgactatattgattaataagagttgcatagtgcttttaagcaaccaagtgtcgaaatgcaagtgtgcaccttagcctagtgatccaatgtagca

SEQ ID NO: 6874413 - DNA, 76 bp, Homo sapiens
aacttgcatcattttcttcttcctgcaggtaaaagaggcaaatgaaaacttgcaagaggatgaagacgatgcagtt

SEQ ID NO: 6874414 - DNA, 129 bp, Homo sapiens
taagaacctgttaaatattatgttacaagttatagaaggaaaatgtaattaacaatgaatctctgtgcttggcaagattacattctccttgtattaggatttgtgcatgtgtgatacagcaggttgtta

SEQ ID NO: 6874415 - DNA, 97 bp, Homo sapiens
ggcctaccacaaaaagggggactgttattgttaatagcatgtggctttgcacacctgaagttggtcatagcttccttattttccattgctggtggct

SEQ ID NO: 6874416 - DNA, 129 bp, Homo sapiens
agtaatcacggtgaataacagtcgtaggggtgaagtgacagctcaaggttttactgttgtcataaaagtggtgcagttttagagctttaagatgagcaaatctctggggtctatgtccaccgtggttct

SEQ ID NO: 6874417 - DNA, 84 bp, Homo sapiens
gggaaaatggaactctctttagagagggacaaagtatcagatttgattaattgttcttacttaagagtgaattcatttacaccc

SEQ ID NO: 6874418 - DNA, 79 bp, Homo sapiens
ggatgattgtgaggttttgaatgatagtattggacctaagaaataggattagcatcatgatcagaactgttgagaatcc

SEQ ID NO: 6874419 - DNA, 65 bp, Homo sapiens
gctgaagagacttctgttcgaaacaaggaaaaccttgtcagcaaggaacagaaaattttttgagt

SEQ ID NO: 6874420 - DNA, 59 bp, Homo sapiens
ttgcttctcggtctttcaggttcattatggcagctccatcactgaaggcaccagggcag

SEQ ID NO: 6874421 - DNA, 68 bp, Homo sapiens
ggtaaggagctccggcttctgccttaaaagtcaagatggctgctggcagagcagctgcagctcctgcc

SEQ ID NO: 6874422 - DNA, 61 bp, Homo sapiens
gtgtcagatagtacaccaagggatttatctaactcccttaagaggtaggtattactgatat

SEQ ID NO: 6874423 - DNA, 102 bp, Homo sapiens
atggtatgtatctgcttttccagagttgtaagtgttgacaaagacaatgtcattctggatattgtcaacacttacaactccggaaaagcagatacataccat

SEQ ID NO: 6874424 - DNA, 68 bp, Homo sapiens
ttcagtgtaagtttttggataggtgcacatggtttagaattcaaaaagcctaagagatatacactgaa

SEQ ID NO: 6874425 - DNA, 62 bp, Homo sapiens
atgtttcatccactggcctttcccaccctaaatgttgggaaaaggccaccaacatgaagcat

SEQ ID NO: 6874426 - DNA, 73 bp, Homo sapiens
ccacctcttgctcatcctgcccaattatatgtcattataatgtggcaatataatttgtgggatatctgagtgg

SEQ ID NO: 6874427 - DNA, 67 bp, Homo sapiens
ggatgactgatgtctggggcagagtctagctttttagaaggcagactcttcctccgacatcctctcc

SEQ ID NO: 6874428 - DNA, 124 bp, Homo sapiens
gctcagatagggatagagggctgggggccgggggagcgcacagaaggaagcagccacctccctctcgtggcctagtcaatcttatcgcaacgccccaagcgcccctgaaccccccgctctgagc

SEQ ID NO: 6874429 - DNA, 129 bp, Homo sapiens
gagacaggagagcagtacgtttctgcacttggtggtgtcagggttgaagtctggttgcctgttgcttcgtgagggtggttattagtttcacctggacttccgcagtgcagcctgctgtgcgtttttccc

SEQ ID NO: 6874430 - DNA, 71 bp, Homo sapiens
ctcatttctttacgtttcattcattttccttgtattgatgattaatggaggatgtcgaatgttagagtgag

SEQ ID NO: 6874431 - DNA, 71 bp, Homo sapiens
cgcaggccgtgggcgcgcacggccgctgccgccgtttgttctggtggaggctgcgagtgcctgggcctgtg

SEQ ID NO: 6874432 - DNA, 77 bp, Homo sapiens
gatttaagtagactatttcaatctcctttggtgctttcctacctgagcacagagtgggtgagatgtggatttgtgtt

SEQ ID NO: 6874433 - DNA, 74 bp, Homo sapiens
ctacttttatggagcatacattctagttggaggagagagaccacaaataggtaaatgtatgctgtgcggcagag

SEQ ID NO: 6874434 - DNA, 66 bp, Homo sapiens
ttgcttctctcctcagaacaggccctctagctccagcaggtggcactgcccctgggattcaagcag

SEQ ID NO: 6874435 - DNA, 61 bp, Homo sapiens
ggacagtgactgggaatgccaggaggacattcatttcctagaaacagcattcctcatttcc

SEQ ID NO: 6874436 - DNA, 83 bp, Homo sapiens
ggtttattttcatgtgcatttaggttcatgtgtatgtttgtccctgtgtacttttgtgtatctgtgtgcatatgatgtgagct

SEQ ID NO: 6874437 - DNA, 79 bp, Homo sapiens
gactggtggttcttcaaggctattaattctgtgagtttggagcaaggcatctggtaatgggcctggggtgctattagtc

SEQ ID NO: 6874438 - DNA, 129 bp, Homo sapiens
gtgggttttgtgtgtatgtatgtattttatttttcacaaggttattgctggatagatacatcatgacttaatgttgatattccagaataatgtagaaaatgatacaatgtctaaatacgtgttactgac

SEQ ID NO: 6874439 - DNA, 76 bp, Homo sapiens
gacaggtaacacacagctagacaccttctgatactatagatattttagtagcagaatgcttaaagctagtgctgtc

SEQ ID NO: 6874440 - DNA, 61 bp, Homo sapiens
gtttccacttgagaggactcctcccttttttgggggtatgtcctccctcaggagggttaac

SEQ ID NO: 6874441 - DNA, 81 bp, Homo sapiens
tatgaagactctgaccattcccttgattttttgaatcactgtaaaaccattcacaaagaagaaaatggcagagtttttgta

SEQ ID NO: 6874442 - DNA, 63 bp, Homo sapiens
cctttacagtagcccttttgaaacctctaggcagcaggaaacagagaagggctgctctgttgg

SEQ ID NO: 6874443 - DNA, 130 bp, Homo sapiens
acattacaaagatgtggaagcatattgccaagtagttctccagaaagtacatgggattcatttacccaatgacaggtgcctgtttccctccatttttactaacttgatgttttcattctttcaattcttt

SEQ ID NO: 6874444 - DNA, 76 bp, Homo sapiens
tgtttgttgtttttatttatgaccctgtgtgtatactgcaatatgcacatatattactagtaaagacagagaaata

SEQ ID NO: 6874445 - DNA, 86 bp, Homo sapiens
aagtgttataagacagtacttacagtttacataagaattgtttacctgaggatttagcatgaaatgtgaaaactgttttaatattt

SEQ ID NO: 6874446 - DNA, 129 bp, Homo sapiens
ggtgggtaatgaggtgcatatgtgaaatctcggtgcccatgtctctgctcaatgaggtatctatcagctgtttgggactttaggtgagaaggcatttatttcactcactgatgttgaaatcatcctacc

SEQ ID NO: 6874447 - DNA, 94 bp, Homo sapiens
ccaggagataaccaaaatgtagctctatacaatcatctttcatagttgttatggcaggtgaagttgttagggacatttgaatgttatttttcgg

SEQ ID NO: 6874448 - DNA, 85 bp, Homo sapiens
gttctcacttgcttggagggcagctgtatttgcaactggtagaactcagctttgcttttaggtgtctaacaataagtgtaataac

SEQ ID NO: 6874449 - DNA, 80 bp, Homo sapiens
cccagggtgggcttctttctggggtccttcggctgcagtacaagtggggcatgcacagatgagactccatctaccctggg

SEQ ID NO: 6874450 - DNA, 63 bp, Homo sapiens
gccaggcacagagttattcatttattcaataaatatttactgaatgcctactatgtgccaggc

SEQ ID NO: 6874451 - DNA, 56 bp, Homo sapiens
cccagctacctctgctaggagaggccacataagctccatgtagatgtgtggctggg

SEQ ID NO: 6874452 - DNA, 84 bp, Homo sapiens
ttttcttgtgtagctcggaatggaacaacagcggtccctttcattgacaaggcatcctccatctccatcggactgccaagagag

SEQ ID NO: 6874453 - DNA, 55 bp, Homo sapiens
tcctggagaatggacaatgcaccgatggtatggtttcaaattcacttctccagga

SEQ ID NO: 6874454 - DNA, 79 bp, Homo sapiens
gcttcatagacaaagcagcaggtcagtggccaggaccctggattctggcccagttctgcgttttgctctctatgtgagt

SEQ ID NO: 6874455 - DNA, 79 bp, Homo sapiens
tccttgggcagtttggtctcgctcaattctggccccgctggtcagggatgagcagatggagcaacactttgcaaaggga

SEQ ID NO: 6874456 - DNA, 79 bp, Homo sapiens
gagcagggagaagagtttagactagttggaagtgaccaaggaatggccagttcactgcttaagcctttgaccaatgctc

SEQ ID NO: 6874457 - DNA, 64 bp, Homo sapiens
cctgcttcagggatgatggcactgtgtcaaaaatgtcatgatttgcattgttgctgagagcagg

SEQ ID NO: 6874458 - DNA, 103 bp, Homo sapiens
tgagatggagtcaggctctgtcgcccaggctggagagtgcagtggcgtgatctcagctcactgcaacctccgcctcccgggttcaagcaattctcctgtctca

SEQ ID NO: 6874459 - DNA, 90 bp, Homo sapiens
gaaacaagaagtctgagatcaaggagtcaacagagctggtttcttctgagagccctctcattggcttattgatagctgtcttcttgtgtc

SEQ ID NO: 6874460 - DNA, 88 bp, Homo sapiens
agggtggggatggtggggacggtggtggtccagggacagacaaaggtgtcactgctctctaagcatcgccacttcccatccccatcct

SEQ ID NO: 6874461 - DNA, 83 bp, Homo sapiens
aagcgttggaatcacagaaggtggccatagctgagttggcatgactggtctgcagcagaagtgttactttcatgaaaacgctt

SEQ ID NO: 6874462 - DNA, 60 bp, Homo sapiens
gggaagagagatcccatagatgtggacgctctttagtacgcatcgtggcatcctcctccc

SEQ ID NO: 6874463 - DNA, 99 bp, Homo sapiens
gagctcacctccagcagaggaagagacaaatggtgccgacctgctccactcctgggactggcagaggttggacaccattcctttctcagagaggtgctc

SEQ ID NO: 6874464 - DNA, 73 bp, Homo sapiens
ggcatgaagagctttacttgatatggagctgaggagtgattctcacactatttcaggtgactttctttatttc

SEQ ID NO: 6874465 - DNA, 113 bp, Homo sapiens
gcattatacctctattaggttggtgcaaaagtaattgcggttttcacaattatacttttaattgtgaaaaccgcaattacttttgcaccaacctaatatatctgtgttaatgt

SEQ ID NO: 6874466 - DNA, 80 bp, Homo sapiens
tctgtttcttgaaaagtcttgtcaaggttcccagtctgaagacaaatatgtggtcctctgaaggcttttcacttaataga

SEQ ID NO: 6874467 - DNA, 75 bp, Homo sapiens
acacattgtagtaaattaaaatattgactttccacctggatagattacaggaagttcttttggtttattctgtgt

SEQ ID NO: 6874468 - DNA, 65 bp, Homo sapiens
aatactgctgctgctgaaatcactgttgttgctccttccagaactgtcggcaccgcagcattatt

SEQ ID NO: 6874469 - DNA, 61 bp, Homo sapiens
ttaaaggccaaagtgctccttttagaggaaaatacttctagcactatactgtggcctttaa

SEQ ID NO: 6874470 - DNA, 56 bp, Homo sapiens
cttgttttgtcttgtttcccttctttgaagtgagaatttgtaaaagataagacaag

SEQ ID NO: 6874471 - DNA, 75 bp, Homo sapiens
ttcatcaggtctttggagacagtggtgtcaaagtacatccccccctctttctccctgtctccagggctgagtgga

SEQ ID NO: 6874472 - DNA, 59 bp, Homo sapiens
cgccgacggcgctgggggcgcgaaggggctcacgctcctgcgttcccctggcgccggtg

SEQ ID NO: 6874473 - DNA, 56 bp, Homo sapiens
cacacagtttacagggatttgagcttacttaattgtagagctggttaaactgtgtg

SEQ ID NO: 6874474 - DNA, 68 bp, Homo sapiens
ttgagtcactttcctggaggcagcacttcaagtccaattagagtggcagccgagcaggagatggccaa

SEQ ID NO: 6874475 - DNA, 55 bp, Homo sapiens
agcaagctgtcaagagagctgacaggtgagataattgttagctctctggcttgct

SEQ ID NO: 6874476 - DNA, 88 bp, Homo sapiens
gatgggagaaaattcttctgaccttggagtgaatgggggcaggtgtccagttatacttctttccccaaactctaaaatcgtctgcctc

SEQ ID NO: 6874477 - DNA, 66 bp, Homo sapiens
ctgcttccagactatcagcagcaggatgggaatgtgttagtcagcccctgtggatttgggtggcag

SEQ ID NO: 6874478 - DNA, 64 bp, Homo sapiens
ggctgacactttagctttgaagtcattaaccactaggtggtagttaaagctatggtagtgggct

SEQ ID NO: 6874479 - DNA, 68 bp, Homo sapiens
gcagatgtgtcctggagggagggacagaacaagggccgttccagccctaccccgggaccatgagctgc

SEQ ID NO: 6874480 - DNA, 73 bp, Homo sapiens
gtaaatggctttgaagttcagcttttggaataaaataaaccaagagcaatagcacagagcaatcaatatttac

SEQ ID NO: 6874481 - DNA, 72 bp, Homo sapiens
ggggagtggcaggagggcatcacttggaagccgacattacctgtccctagagccgcacctcctccacacccc

SEQ ID NO: 6874482 - DNA, 55 bp, Homo sapiens
cctcagacgcaggcctatgggccatgggccctaactaggacctgctgtgctgagg

SEQ ID NO: 6874483 - DNA, 130 bp, Homo sapiens
aaattggccctgaaaaaaagacaaagaaactataggacacagatatgtttcagtattcaagtcaaacaatgttgaaatggattgggtgctgaagcatagtggtccagatagttctgacatggccaatgat

SEQ ID NO: 6874484 - DNA, 69 bp, Homo sapiens
ctggtgggcgtgtctcttagcctgctaatgcattataattagtatataatgagcagtgaggaccaccag

SEQ ID NO: 6874485 - DNA, 65 bp, Homo sapiens
aactttacactgggcttccccgtgtatatggctctcgcttatgactatagggcttagtgtttgtt

SEQ ID NO: 6874486 - DNA, 92 bp, Homo sapiens
agtcatgaggagacaggagagagctctgtgcctgggatagttgtgttgtgacattctaaatcagagagctctgttttagtcaacttgagatt

SEQ ID NO: 6874487 - DNA, 56 bp, Homo sapiens
ccgcgccgcagagtcgggcttcctggatacatagaggcttgtgccaggcggggtgg

SEQ ID NO: 6874488 - DNA, 77 bp, Homo sapiens
cagatggaacaagggctggccctgggaagagttcagacaggatgtccactggttcctggccacctcttccaccactg

SEQ ID NO: 6874489 - DNA, 67 bp, Homo sapiens
tccagtggagtgtgggggtgaatatggctccacttctaaatcccttccttcatctccatccactgga

SEQ ID NO: 6874490 - DNA, 80 bp, Homo sapiens
tccgggctgcttggaggaggcgctcatattacaaacctacaaggatggggcgcgggggtgcctgcctcaggcagtgtgga

SEQ ID NO: 6874491 - DNA, 69 bp, Homo sapiens
tgatggaaatgttcctgatccctgatttcatggacaagctgaaatcagtgtgtaaatattttgccatca

SEQ ID NO: 6874492 - DNA, 55 bp, Homo sapiens
ggctctgtctttgcagtctccaactgctgctcagaggggctggagggatagagcc

SEQ ID NO: 6874493 - DNA, 116 bp, Homo sapiens
tgaagatagtgtgatgctatttaaagtagctttgtaggtacagttagttgagtaaacaagctgccttatgtctattagtatattttgtcaagatagtatcacatttcccctcttca

SEQ ID NO: 6874494 - DNA, 83 bp, Homo sapiens
ggcttcttctttatgtcatatgccagctgttaagggtggattctgataatgctgctgacaggtgataaggaagaaaagtggcc

SEQ ID NO: 6874495 - DNA, 57 bp, Homo sapiens
gcagctttttagaatctagggcaaaaggtttgctggactgggttcaagagagaatgc

SEQ ID NO: 6874496 - DNA, 59 bp, Homo sapiens
caggcctttctggggaagtgagaggaaatacaagattcttatgggtcccaagaggcctg

SEQ ID NO: 6874497 - DNA, 84 bp, Homo sapiens
tacgaatgtaattcttattatagtaaaacagtactagggattatttgatgtgctgttgtactttagacagaaaaagcagctgta

SEQ ID NO: 6874498 - DNA, 101 bp, Homo sapiens
ccaagggcctgttttcttaccgttggggtacttgtatcaaagcacagatatgaccggtttgtgcggatcggtgtcctccaaagatcaacagcggctcttgg

SEQ ID NO: 6874499 - DNA, 79 bp, Homo sapiens
gagtctgagttttgaatttagcttttcagtgtgcctattttaaaggaatatactgtgtaaaatttgaaccttgaagctt

SEQ ID NO: 6874500 - DNA, 78 bp, Homo sapiens
gattattgaacagaaaccatcagagtgccttcttataaaataattgaccactcagatgcatggttctgtttagaaatc

SEQ ID NO: 6874501 - DNA, 64 bp, Homo sapiens
gcccactcgtagctccacccactcacagcacggccagctgcaagggtgacaggttgctctgggc

SEQ ID NO: 6874502 - DNA, 73 bp, Homo sapiens
gactgagctttgagattcttatggtagctcttaactcctgggaatgaggtgccaagggaagctaagagccgtc

SEQ ID NO: 6874503 - DNA, 63 bp, Homo sapiens
agtgtatggttgagttgtgttaagaacattcaccttgttgtgcaaccatcaccaccatccact

SEQ ID NO: 6874504 - DNA, 57 bp, Homo sapiens
gactcagccttgaagcataaagtaggacttaggtcctagagctattaatgtggagtt

SEQ ID NO: 6874505 - DNA, 72 bp, Homo sapiens
cctcccaaagtgctgggattacaggtgtgagccaccatgcccagccttattacctgcactttgaagaagagg

SEQ ID NO: 6874506 - DNA, 125 bp, Homo sapiens
catatccttgagcgctgctcccactctgtggtctgatatccttgtggcaatgtcccaggtggataaaacgtggcacgacaattggcaccaatgaattactcttggagtagcaattgctggatgtg

SEQ ID NO: 6874507 - DNA, 89 bp, Homo sapiens
tcattttgtgtgtggtttgtgcaccagcagcatcagcatcacctgggagctggttggaagtgcagactctcaggccccacccagaatga

SEQ ID NO: 6874508 - DNA, 64 bp, Homo sapiens
ttctgaagaatttagtgaccattgccagaaaagccagtctctggcaattcctgagctctgagaa

SEQ ID NO: 6874509 - DNA, 66 bp, Homo sapiens
cagaaaattttaggggaggccaggaagttttaggtgttcctggtgcaagttcccctcccctagctg

SEQ ID NO: 6874510 - DNA, 83 bp, Homo sapiens
cacatgcatcacgacttcctttgtctatcataaacgtctaccctcatggtttataaaatccaggaagtcggccaggtgcagtg

SEQ ID NO: 6874511 - DNA, 98 bp, Homo sapiens
agagcctgagcaggactaagacttggctgagccatgtgaaaccacagtcagcaaaaggctgttggctcactgtgctcagcccttgttttgtttgctct

SEQ ID NO: 6874512 - DNA, 56 bp, Homo sapiens
ggctctgtggtgtagctaagtacattttgaattagggtgagcaagctatggagacc

SEQ ID NO: 6874513 - DNA, 65 bp, Homo sapiens
aggttacatgatctgtgtgactttgctagggctgccgtaacaaagtaccatagattgggtggctt

SEQ ID NO: 6874514 - DNA, 98 bp, Homo sapiens
ttcttatttattatgtgtatgtaggtattttgtgtgtgtgaaaagtatattaatatttagaacagacaatagaaaagtatatagattgatagaaagaa

SEQ ID NO: 6874515 - DNA, 104 bp, Homo sapiens
gggaggcaggctaggagggccaccggccgagggaggtgctgaaggactataacggtttgcgagcaggcccttcgcggcctcccccggccctcctgccccctccc

SEQ ID NO: 6874516 - DNA, 60 bp, Homo sapiens
ccgcaggtgagtttccagctctcctccctccaagggcagggatgctgaggctcagtgtgg

SEQ ID NO: 6874517 - DNA, 103 bp, Homo sapiens
attttactaataggagcaccaaatccttcagggccaggaaagctctatttaaccatgaatttcctcccttggggtttcgttatgtttggttacaaagtaaaat

SEQ ID NO: 6874518 - DNA, 98 bp, Homo sapiens
gagtctcctgccatgtgtgtctttgtgtgtgtgtatacatatacatgtatatgtgtgtatgtatacacatagatacgtacatactggtactgatactc

SEQ ID NO: 6874519 - DNA, 56 bp, Homo sapiens
atttttggcaatgtgtgttgcttctacttccagaagataaagcacatagcaaaagt

SEQ ID NO: 6874520 - DNA, 67 bp, Homo sapiens
cagatctcaggtgcacattactgtgttggctgaacccaccacacagaggtgctgtacctgcaatttg

SEQ ID NO: 6874521 - DNA, 88 bp, Homo sapiens
gcttataacctgggaaggggaaagttgagcaaatattatggaagaaaaggaaatatagcactgcaatatttccctgacagctgtgagc

SEQ ID NO: 6874522 - DNA, 71 bp, Homo sapiens
ctcttcctccttcattaactattggaatgcagaggacacttaactgcaaattgtgaatgaaggaggaagag

SEQ ID NO: 6874523 - DNA, 86 bp, Homo sapiens
cataatgagcacgagcaagtattaatagcatttttatataagatggaaatgctacacttgttaatgacttgagagtggttattctg

SEQ ID NO: 6874524 - DNA, 82 bp, Homo sapiens
gccaggagcatcatgcagagtctgggcttcagcctataggcagtgagagccctggaagattttgccaagtgaatgctcaggt

SEQ ID NO: 6874525 - DNA, 76 bp, Homo sapiens
agatcctgggaagggtgttgtcttatcttctttatttgtactaaacaaaggttggaagacacttttctaaaaatct

SEQ ID NO: 6874526 - DNA, 74 bp, Homo sapiens
gatgcacggcttcccaagtaaatttgtattttggaccagataatgctttgctatgggagactggcctgtacatc

SEQ ID NO: 6874527 - DNA, 69 bp, Homo sapiens
gccgtataggtgagggacttgatcaggctctgccctgtctgacagaactcattctcaccaataataggc

SEQ ID NO: 6874528 - DNA, 64 bp, Homo sapiens
gtaactaagaggaagctagttagatgaatgaatggtctgtctgaaataggcttcttttggtgac

SEQ ID NO: 6874529 - DNA, 65 bp, Homo sapiens
tttgcaaacagctaccttctcactgtgccctaacatgggaaccaggaaatggagctgttatcaag

SEQ ID NO: 6874530 - DNA, 65 bp, Homo sapiens
tgtagtagcagtaacaaggtatatcagcccataacaaggcaatgtgccattgaggctgaggctca

SEQ ID NO: 6874531 - DNA, 88 bp, Homo sapiens
ttgccaaagaaatagctaagctttctagagtatggagtctgtccagataatcttggtatagtctccttttttggagggtgtgtggtag

SEQ ID NO: 6874532 - DNA, 72 bp, Homo sapiens
tcagtattcctggaaatacaagcttctagccaacagtttgcaaatcaaagttctgtgttttcggaagactga

SEQ ID NO: 6874533 - DNA, 69 bp, Homo sapiens
ataactactacatgctagactcagttaacaatctctattaacagagtaacaggtatgtaaaatggttgt

SEQ ID NO: 6874534 - DNA, 56 bp, Homo sapiens
agtggtgagacctggtgctttcctaatgtctaaggaccagtccctagtcttatcct

SEQ ID NO: 6874535 - DNA, 67 bp, Homo sapiens
ggctgatacttccagctcctctctaatgaacacaaacaccttattatccaaagagctgggagcaggc

SEQ ID NO: 6874536 - DNA, 55 bp, Homo sapiens
ctgtgggctgtactgagggcaggctgcagaaagatctgtcttcctcagcctaagg

SEQ ID NO: 6874537 - DNA, 64 bp, Homo sapiens
gccacaactttttgccccagttagtgtttgttgagttcaacacagctatggggtaggaaacggc

SEQ ID NO: 6874538 - DNA, 95 bp, Homo sapiens
gggttcccagccgcctcgcaagtcgctccggttactgggctcaaccgatgtgctcccccataaagtggctgagtgactgtgactccttggagccc

SEQ ID NO: 6874539 - DNA, 86 bp, Homo sapiens
caagtgacagagctgggatttgaagccacctttacccaacctttccatcctaggagcttacaatcatttcagtttagttgaccttg

SEQ ID NO: 6874540 - DNA, 68 bp, Homo sapiens
tgttgcccagggtggagtgcagtggcataatttcgtctcactgcaacctccgcctccgggttcaagca

SEQ ID NO: 6874541 - DNA, 109 bp, Homo sapiens
gcaacatcagtatcatttaggagttacttagagatgcagattctcaggtcctcaaaacagacctactgaatcagaatctctaaggtgggacctgggtgtctgtggttgc

SEQ ID NO: 6874542 - DNA, 86 bp, Homo sapiens
gccgcgggagtggggagagcgggaggtgccacagcgcggacctgcgaactgaggtgatggcccgttttccttaactctcctgcagc

SEQ ID NO: 6874543 - DNA, 90 bp, Homo sapiens
gcaggtctgttaggtggtgggatatgagcatctggattccatggtcaggttggcatacttcatagggactctcgcatctaggcattttgt

SEQ ID NO: 6874544 - DNA, 58 bp, Homo sapiens
ctgtaatccagtctgatgtccttatagggaaaggaaatctggacacagataggtacag

SEQ ID NO: 6874545 - DNA, 62 bp, Homo sapiens
agcagagcctgggctaggggtgcagtagggttgtcaacagacttgggagtttaggctctgct

SEQ ID NO: 6874546 - DNA, 69 bp, Homo sapiens
atactcagtttgccttggtaccaatgagctacaggtaaacactgtaagatcaaaggcaaaggtgggtgt

SEQ ID NO: 6874547 - DNA, 68 bp, Homo sapiens
tagttaaggtccctaatcatttcactttgacttaatcagagagagataaatctgggtgaaactgacta

SEQ ID NO: 6874548 - DNA, 72 bp, Homo sapiens
aaaagacatatagttctccccaagtgccctaagcaaagcaatccactttggttgagagctgttatgttggtt

SEQ ID NO: 6874549 - DNA, 58 bp, Homo sapiens
tgattcagtactttctctaactttattgcacaatagtagtgagtagagcactgagtca

SEQ ID NO: 6874550 - DNA, 64 bp, Homo sapiens
aaagaccactggggcaagtcttcaaagggggagcttctctgcagaaagtggctcagtgggattt

SEQ ID NO: 6874551 - DNA, 71 bp, Homo sapiens
cagggctctctcaccctggaaaagccaaaggcagaacaagcctttacatccaggaaggtgggagcaacttg

SEQ ID NO: 6874552 - DNA, 62 bp, Homo sapiens
gttgctctcagcttttaaaaacaagaagtatttgttgctttttgaaagaaagttggcgcaat

SEQ ID NO: 6874553 - DNA, 121 bp, Homo sapiens
catgctcagtttctttccatggataaacaaaatgtagatgagatattttttgttagcttgaatagaggaatttatttcatatacatactgcctgtctgtacagttgattgaaaatagcatg

SEQ ID NO: 6874554 - DNA, 127 bp, Homo sapiens
gtagaactcttttgtaataatggaatgcaccaaaaggaaaatggaccagagttgttaaactccttttgatggagtaacaaaagggcccattttccttgccttttccctaatttagaaatcgttttat

SEQ ID NO: 6874555 - DNA, 77 bp, Homo sapiens
taagagcatgtttgaaagctgtacatgtggtacaatgttcacatatgtgccttgtacagcattcaaacgtgttctta

SEQ ID NO: 6874556 - DNA, 55 bp, Homo sapiens
gtccagagggtcaagtttcttgggtcctttcccaagggagttgagtctcatgggc

SEQ ID NO: 6874557 - DNA, 83 bp, Homo sapiens
actactataatttataactttggatatgacaagagatgttttttagcaaagtttgcgactcttgagttaagaagtttagaagt

SEQ ID NO: 6874558 - DNA, 87 bp, Homo sapiens
ggagtctcgctctgttgccaggctggagtgcagtggtgtgatctcggctcactgcaagctccgcctcccggattcaagtgattctcc

SEQ ID NO: 6874559 - DNA, 123 bp, Homo sapiens
aggagtgcgcattgagttttaaccaaggaaagatattttcacacaaggtgataagttcagcacaggctgtaaggactctggaactcttggtaagagaatgttacaggtctcaggcccattctt

SEQ ID NO: 6874560 - DNA, 64 bp, Homo sapiens
ttgatattttaagagaacactccatttttactctgtctccttggaatgtctcctaaaaggtcag

SEQ ID NO: 6874561 - DNA, 55 bp, Homo sapiens
ggtgctgcctatagtctgaaacactgcccttctgtttcatgagctgtgaagcacc

SEQ ID NO: 6874562 - DNA, 64 bp, Homo sapiens
cagctgaacgacatcctctcatttattcatggggcgtgagaggagtgattgtaaaattcagatg

SEQ ID NO: 6874563 - DNA, 78 bp, Homo sapiens
gagttcatatgtttctgaatgatcatagcttgttaatataaacattttatttacagagcttaattcaggagcttgctc

SEQ ID NO: 6874564 - DNA, 66 bp, Homo sapiens
ggccctaggagcactggactctgttcagcttaaccagctgaacagagctgattcagctcatgggcc

SEQ ID NO: 6874565 - DNA, 83 bp, Homo sapiens
aagcactggatacttaatgtgaaaccgcacagaataacattagtgtttcactgtggtttccatggatttctgtatttgtcctt

SEQ ID NO: 6874566 - DNA, 63 bp, Homo sapiens
cttgaatgggccataagacggtccaattccctcatttactggattatggtgcttcattcagag

SEQ ID NO: 6874567 - DNA, 72 bp, Homo sapiens
gggttccctctgtggtggagtgggcatgagcagtactgagacgttcatcttggtcctggcacatgagttccc

SEQ ID NO: 6874568 - DNA, 60 bp, Homo sapiens
aatggattccagggggaccattcagtaggatattgcagtggtgctaggtggaatatagtt

SEQ ID NO: 6874569 - DNA, 100 bp, Homo sapiens
gttatttccagagatgggcattcactggctcgcattatattttgggaccattgtaattgttccaaacgggagccaaatgagcaaaactttgcgaaataat

SEQ ID NO: 6874570 - DNA, 100 bp, Homo sapiens
aaccatgcacggaaagacaaacatcacatgttctaatttgtatatgggagctaaaaaagtggatctcatgaagatagaatagtatagtagactgatggtt

SEQ ID NO: 6874571 - DNA, 99 bp, Homo sapiens
actaaatggtgaaaggctcatacagaaaatacaggcttccacaggagttaatacgaagtctattttctatagatgaattaactgcctaccataaatggt

SEQ ID NO: 6874572 - DNA, 69 bp, Homo sapiens
ctctgaatgatctagttttgtagacaatagagagaaaacaattgattgtaaaacagatcattatctgag

SEQ ID NO: 6874573 - DNA, 81 bp, Homo sapiens
gctggctcttttctgtgtgtccctcgacaggctcttggcctctctgagaggctggggtatgcagacaagcaagaagtgggc

SEQ ID NO: 6874574 - DNA, 58 bp, Homo sapiens
ggggctgctgaggccttccctgtcctcagcatactgaggaagatggcttcacacctcc

SEQ ID NO: 6874575 - DNA, 56 bp, Homo sapiens
atctgtggccaaaagactgttgaaaacctgattctaaggatcctttggtggcagat

SEQ ID NO: 6874576 - DNA, 56 bp, Homo sapiens
ggcctggagctcagtgccatctgattgtttcagtcagggcctgtgctctccaggtc

SEQ ID NO: 6874577 - DNA, 79 bp, Homo sapiens
tcagcaacattaaaccaataattgttaccatttggagaggtttggaggcagatgcatcttggtttaaactgatagctga

SEQ ID NO: 6874578 - DNA, 61 bp, Homo sapiens
tgacaactctagttaatgaattctgagtagtttcttgggctttcagagcaggagtgtgtca

SEQ ID NO: 6874579 - DNA, 63 bp, Homo sapiens
ggaagtcatgaggcacagtcctgagcctcagagggcttcccaggctgtgttctcatgggttcc

SEQ ID NO: 6874580 - DNA, 65 bp, Homo sapiens
tgtccactttgataatagaagcactggaacaagtatatcccagtgttccttcacagcagtggaca

SEQ ID NO: 6874581 - DNA, 108 bp, Homo sapiens
atgagcagtgcctgtcttgatgtaggggggacaaattagaccagggctcctggaatcactggccacccaggttcctcctcaggtctcaatttctcctgcctggctcat

SEQ ID NO: 6874582 - DNA, 57 bp, Homo sapiens
ttcttttggactcaaagagaactgtaaagcaatacagttctctttgggtccagagaa

SEQ ID NO: 6874583 - DNA, 96 bp, Homo sapiens
tcatcgcctctctcctcccctctacctttctccctggtttccatagagcagaaatctgggtcaaggtggagtgcattggatcaagagttgctatga

SEQ ID NO: 6874584 - DNA, 62 bp, Homo sapiens
gtcacatagcactcagaagctgggtctagtattctgctctctcaaagactggggctgtgtgc

SEQ ID NO: 6874585 - DNA, 71 bp, Homo sapiens
gggggacagcagtgggggatgggcagaagggggcgactcgggctgcccaggctcctcgcagccttcctgcc

SEQ ID NO: 6874586 - DNA, 106 bp, Homo sapiens
cctgtagtcactgaaatagagacattgtatacttgtgtgtttttacaagtgcaataggatttcacatacaagtgatataattgtttcaaactatagtagttagagg

SEQ ID NO: 6874587 - DNA, 59 bp, Homo sapiens
ttttcttccagctgtaggacctagggccagctctttgttagccatcagctggaggcaag

SEQ ID NO: 6874588 - DNA, 63 bp, Homo sapiens
aaattgctaaattgtaagagggagatcatgaataattgaaatactcagataattcagcaattt

SEQ ID NO: 6874589 - DNA, 56 bp, Homo sapiens
agaagtggaatgagatgcctgggtccgcccctgccttagcaagtctacccatttct

SEQ ID NO: 6874590 - DNA, 75 bp, Homo sapiens
gattctcataggagcgcaaaccctattgtgaacagagcatgtgaggtatataggttgctgctccttatgagaatc

SEQ ID NO: 6874591 - DNA, 56 bp, Homo sapiens
ttgtggtttctttatttggatctttaataaggaggatggatttaaacaggccacaa

SEQ ID NO: 6874592 - DNA, 55 bp, Homo sapiens
ccaggctggagtgcaatggcatgatctcagctcactgcaacctccgcctcctagg

SEQ ID NO: 6874593 - DNA, 65 bp, Homo sapiens
ccgtcacctctgctctatctccagcctactgttcagtctggagagctgagcagagttaggagtgg

SEQ ID NO: 6874594 - DNA, 88 bp, Homo sapiens
ttctactctgatggcctggggattcctgagcatcaaacgaaaatttgtatcacaatgtgagtgtcctagctaggttaatagactagaa

SEQ ID NO: 6874595 - DNA, 67 bp, Homo sapiens
gatatctgttctctccacatgtcagcacccattcatgtcatggtttggaaatggggagaacagattc

SEQ ID NO: 6874596 - DNA, 59 bp, Homo sapiens
gctgcagggcagaagggcatagatgcatgctatctcatctcatcttcatgcattgcagc

SEQ ID NO: 6874597 - DNA, 87 bp, Homo sapiens
ccttgacgtctttaagctaatggccgtttgcatctgtgtcttcaaacagatcctggttacagccattttgtgtgattcacttcgggg

SEQ ID NO: 6874598 - DNA, 122 bp, Homo sapiens
tattaatagcattgttgaacaactaaataaaagtcttacataatagtttggatagtcctttatgctaactgctattatgtgagttttgcttttctggctcttttgatatcatgttacgagtg

SEQ ID NO: 6874599 - DNA, 78 bp, Homo sapiens
gtcatctggcagtccctgattgagtgcaaaaatacagattgctgctgctgctcaaatcagtcaggagatgccagagat

SEQ ID NO: 6874600 - DNA, 59 bp, Homo sapiens
gtttagccgcctgcgtcccctttcccggactggggtagggtgacttaggctggcaaagc

SEQ ID NO: 6874601 - DNA, 117 bp, Homo sapiens
tcaaatgtctactagttctgttgatactgaaaaagaagtgttgaagtctccaactatgattttgaatttgtctatttctgttttcagttttgtgaatttttgcttaatctaatttga

SEQ ID NO: 6874602 - DNA, 95 bp, Homo sapiens
ctgggggtaggtgaaggcactgagccagccgtctctgctagactgtgagcagtgagctcggtgatgctcacacctgtctgccactcgatccccag

SEQ ID NO: 6874603 - DNA, 85 bp, Homo sapiens
gactggtggaagccctgtcggaactgcgacctctggaggccccccgggctctgcacgttctggcgtcctggtcctcccacctgtc

SEQ ID NO: 6874604 - DNA, 57 bp, Homo sapiens
agtagagggctcaaagccagtactacctttctcaagtacatttgagtatcatctact

SEQ ID NO: 6874605 - DNA, 106 bp, Homo sapiens
gaccacaagacatataaggcatttgacagtgttggggcaggctgaggaggtgaggcttgtcagtcactcaagtcacgttaaagaatttaaagtttatcctgaggtc

SEQ ID NO: 6874606 - DNA, 74 bp, Homo sapiens
catgttagaagggccagttgtttctcaaaaggtgatagtctacagtgaggaagcagctgtgcttgggtgaggtg

SEQ ID NO: 6874607 - DNA, 94 bp, Homo sapiens
cgtatctgtctatctggcagtttacagagttctgaatttttaatatatattttgtctttaggcactttgtagcatggtgccactgatggatatg

SEQ ID NO: 6874608 - DNA, 91 bp, Homo sapiens
cccagagggtttattgttaatgctgattcctgggctccacctcagcaattctggggtaggctcaggaatctgcatttaccaacactctggg

SEQ ID NO: 6874609 - DNA, 91 bp, Homo sapiens
aacagcatcctagagggacagcctggaaccaggagttacacgagttgggcaccagctcgtgaccttgttctagttccacctatactctgtt

SEQ ID NO: 6874610 - DNA, 69 bp, Homo sapiens
tgcccttgaagacactaaggcccagggaggggacaggcctcccccaggtcactcagcgtcaagagggca

SEQ ID NO: 6874611 - DNA, 65 bp, Homo sapiens
ggtacctgcctttccagtcaccactagatcaggcttctgagcctgttggctgtcagggctggact

SEQ ID NO: 6874612 - DNA, 100 bp, Homo sapiens
ctttgggactatctcttggcacatccacagaatctggactcctctaagcatttgtgactgcttcccgattcagtggctgtgccaagagatagcctcaaag

SEQ ID NO: 6874613 - DNA, 60 bp, Homo sapiens
cagttgtcatcctgaattttccaacagggaattcctttcctgtgtttagatatgatgctg

SEQ ID NO: 6874614 - DNA, 58 bp, Homo sapiens
agaaatttgtttgtgcgaccactgccactatcactcaggaacaaacaggcagatttct

SEQ ID NO: 6874615 - DNA, 67 bp, Homo sapiens
ggtttgaataaacctgtgtttaccgccatctgtttccttggtggtttcacagatggtgttcatatcc

SEQ ID NO: 6874616 - DNA, 85 bp, Homo sapiens
gtctagctctttagcgggggccaggcccgagatggccagctccgtttcccctgcgtggcctggcagcccctccaggagctggcac

SEQ ID NO: 6874617 - DNA, 57 bp, Homo sapiens
tcctcagacttccctttgtgtagagcctcaaggtcagccagaggtgagagtttaggg

SEQ ID NO: 6874618 - DNA, 75 bp, Homo sapiens
gctgctttgacatccattcagtgcaaatcacattgagtcactcctctctgtgaactttggatggttctgagcagc

SEQ ID NO: 6874619 - DNA, 55 bp, Homo sapiens
agagatggcgtctcagagcctgctctgctctgtaggggctgtggaaaccaactct

SEQ ID NO: 6874620 - DNA, 91 bp, Homo sapiens
ttcatgtgatgatagtggatgccggctcttagcttccaacactgattgctattcagggactgggattctggatctgctccaatcatgtgga

SEQ ID NO: 6874621 - DNA, 62 bp, Homo sapiens
tatctacagttaatatgtcatctgtagtctattatttacagttaatatgttacctgtaggta

SEQ ID NO: 6874622 - DNA, 62 bp, Homo sapiens
ctggaggccagaaaaagacagctccagtgtccttctaggctgggggtggttcttgcctccag

SEQ ID NO: 6874623 - DNA, 79 bp, Homo sapiens
gagacataatttccaagtgccttttgaattgttttcatttccctagaaataaacattgagtgcctttggtattggtctc

SEQ ID NO: 6874624 - DNA, 61 bp, Homo sapiens
gcagtctctcaggatttaagctcgactctcttcccacacagttcctgtctgaggaggctgc

SEQ ID NO: 6874625 - DNA, 62 bp, Homo sapiens
actctcccagctatatgtggtgaaaaggaattgcttaactatgtaaactggcgtgggagagt

SEQ ID NO: 6874626 - DNA, 73 bp, Homo sapiens
cctacttgatgtttatgcaaacatgtgagttaggcgtcagtaacaactcaaggtatgcatgaggtcaccgagg

SEQ ID NO: 6874627 - DNA, 76 bp, Homo sapiens
ggattactaacactttgttgcctatgaacgtacattcttcctgttgcgtatgaaggcagaaagtcagttacaatct

SEQ ID NO: 6874628 - DNA, 77 bp, Homo sapiens
ggtattcagcagttacccaggaaagaaatggtatgtccctagcaatggcatttaatctgggtaatttgtaggtctcc

SEQ ID NO: 6874629 - DNA, 60 bp, Homo sapiens
ttagatagtcttcactgtgaatttgttcttgcagcaagtggaagaatgcagtgtgtctaa

SEQ ID NO: 6874630 - DNA, 66 bp, Homo sapiens
ggagttaaggaagacagggcaaggtggttataaaccaagccccatcttgtctgtcttttttcttcc

SEQ ID NO: 6874631 - DNA, 63 bp, Homo sapiens
ggaaggatggatgtcagtacagagaggaaacaccctgttcctcagtggggcattcattattct

SEQ ID NO: 6874632 - DNA, 58 bp, Homo sapiens
gcggccttgtggcggagcaggctctgcggagccgagtaggacttgccgcacaggtcgc

SEQ ID NO: 6874633 - DNA, 113 bp, Homo sapiens
aagagagtcgtctgtctggtttcttctgaccttttgtcattggcaaattaaaacccaaagtagctgatggcacaggaatttagatgcaggagccagtgaacataatatctctt

SEQ ID NO: 6874634 - DNA, 61 bp, Homo sapiens
tcgcatgcagaaaatgaacaacgaagtggtggacaaggttggtgttttattctgcctggga

SEQ ID NO: 6874635 - DNA, 57 bp, Homo sapiens
cccagttccagtgctcacatccattcttggtggaggccagaggtactgggacatggg

SEQ ID NO: 6874636 - DNA, 115 bp, Homo sapiens
atttgttgccttttgatgtgccaaagaagagtgggaatgttctaagaattctttttggcttaatctttgttgaattgaaaatatgtataactcttctgctgaaagtgtagcaagt

SEQ ID NO: 6874637 - DNA, 79 bp, Homo sapiens
agtatcctgattccttagagtcctctggcccagcctgcagtctgcagggcctctggcctggagcctctgggtggatgct

SEQ ID NO: 6874638 - DNA, 127 bp, Homo sapiens
gaaaatgatgcagatctttgggatggaggaaagcattctcttatccctgtaaggaacatgtgtttttgtgccattaataaggagttgcttttgctcttctttttcaaagcatcctcagacaattttc

SEQ ID NO: 6874639 - DNA, 56 bp, Homo sapiens
tatgcctttacggtgttacagtcggactttttactgccagcctcagtgaaggcata

SEQ ID NO: 6874640 - DNA, 130 bp, Homo sapiens
gggatgcgggtgagtgtctggctctgggcaggacacagatgcaaggccaggggaatggacagggggctctcactcagcctgtggtctttgccctgggattttgcctctagattctccccaacggctgccc

SEQ ID NO: 6874641 - DNA, 68 bp, Homo sapiens
ttgagaacagccactatgacagatttagagcccttttgccctaaacttcatatgttgctttaattcaa

SEQ ID NO: 6874642 - DNA, 85 bp, Homo sapiens
gctggagagactggaatgggctgtggcattggttgactgtgaggttggtttgtgtggcagatcctctctttgtttctctctaagc

SEQ ID NO: 6874643 - DNA, 130 bp, Homo sapiens
actgagattggaagaagtagagttaaaagtttttactacctttgagaagcctgcgggcatgttcacagtcgtcccatgccagccaggttctgaggctaactgcttgtgcccctgctgcttcacatggcat

SEQ ID NO: 6874644 - DNA, 80 bp, Homo sapiens
ggtgatagaaggtggtttaatatgtcttactgagctgctaagcagcagctgcatgtcttattgagctgctaattgatact

SEQ ID NO: 6874645 - DNA, 86 bp, Homo sapiens
tccaagtctttgctattgtgaatagtgccgcaataaacatacgtgtgcatgtgtctttatagcagcatgatttatagtcctttggg

SEQ ID NO: 6874646 - DNA, 74 bp, Homo sapiens
ggaggacgatggctgcctcctgcggtcctccccctgcctcgggggacggcccttggcagaccgtcccggactcc

SEQ ID NO: 6874647 - DNA, 78 bp, Homo sapiens
gacacagggccctggggtctgtccatggaattcatttttttcaatttatttagtgccttagccctcaggggccttgtt

SEQ ID NO: 6874648 - DNA, 99 bp, Homo sapiens
cccttgacagggacaatttctgggagggactcagcctttagcaaccagtatccaaccttcctggcagctggaagaatgagtgcctcgttcctggaaggg

SEQ ID NO: 6874649 - DNA, 55 bp, Homo sapiens
cgtagcagtgcaggcaaaccatggccaaccccagcattgtctcagttctgctatg

SEQ ID NO: 6874650 - DNA, 83 bp, Homo sapiens
tacataatttctaccagggccatattagcagtgaaacattttaaactgcagaaattgtggttttggttcagaaacaagttgta

SEQ ID NO: 6874651 - DNA, 94 bp, Homo sapiens
aggattggtgttgatttgtgtagctaaaaccaagaaaaacagtctattcttgtccttgaatagtttcctggtcctgttacggattgcttatcct

SEQ ID NO: 6874652 - DNA, 89 bp, Homo sapiens
tcagacctctaaaccaccagcaccagctctgtgcctgttatatggcaggctttcgatgaacgcttgctgaactggatctgggggtttga

SEQ ID NO: 6874653 - DNA, 57 bp, Homo sapiens
tagcagggaagcctccagaaccttagacatgaaggcacacacttgaggcccttgata

SEQ ID NO: 6874654 - DNA, 85 bp, Homo sapiens
cagcactggagctcagcccaggttccagctcaattgaagaatctcctccttccactggaaacctccttggctgggttccaaattg

SEQ ID NO: 6874655 - DNA, 106 bp, Homo sapiens
ccactggggctggggctaggggatctggcaggcggcagagcccaggctgagcagactctgagcagctcccgtcagtcagagctgacctgccaatcagcttcagtgg

SEQ ID NO: 6874656 - DNA, 75 bp, Homo sapiens
ccataaggaccgaggcctcctcgccgccaccgccgccggggtggggcctgggcctggggccgcgagtctcgttgg

SEQ ID NO: 6874657 - DNA, 55 bp, Homo sapiens
agctacacttaaccacatagcaagtagttttgttgttggcttttaagttgtagct

SEQ ID NO: 6874658 - DNA, 72 bp, Homo sapiens
cctggcagccaccctggagggcagacagatgccttcacaagccattttgtctttctccagcttggtgccagg

SEQ ID NO: 6874659 - DNA, 77 bp, Homo sapiens
ggcagaagaagatgatggggcactcaagtgtggcagcgaagttgaagccggcatgggcgtccccctcactggctgcc

SEQ ID NO: 6874660 - DNA, 56 bp, Homo sapiens
atgagagtctcagagtctcttcctgctggaggtttccgtggctctgggtgtcacat

SEQ ID NO: 6874661 - DNA, 55 bp, Homo sapiens
caagggcagcagcctcaagcgggacacgctgctcggggagaaggagctgcccctg

SEQ ID NO: 6874662 - DNA, 80 bp, Homo sapiens
cctgggcctggaaataggtactgcattgcttctgctgtattgtattggccaaagcagttacgggcctatctaggttctgg

SEQ ID NO: 6874663 - DNA, 67 bp, Homo sapiens
gtgaccaggtaatgtaaagcagggtaaaatcccatcaaatggctgtgctgattcattccctgctcat

SEQ ID NO: 6874664 - DNA, 65 bp, Homo sapiens
tccctaagaggccactctctccagctgaggtgataaagacctgggaaaaggagtggccatgggga

SEQ ID NO: 6874665 - DNA, 72 bp, Homo sapiens
gtcaaagccaggtttctttagctgtcatggaaagaagagagcttagtggcagttggaaaaacggtttgtaac

SEQ ID NO: 6874666 - DNA, 55 bp, Homo sapiens
tagaggctcctgtgtgtaggttctttgcacagactataccaacttttagcctcta

SEQ ID NO: 6874667 - DNA, 104 bp, Homo sapiens
actttttagatgcacacttcattatgaatggagtttgaggttctgctcatctgtagcacttctatttactatcatagtggtttcaaaagtaatgtataaagagt

SEQ ID NO: 6874668 - DNA, 61 bp, Homo sapiens
acttggaatgttgtcatttacattatttctaaagaagcagtgtgtttggataacacacagt

SEQ ID NO: 6874669 - DNA, 55 bp, Homo sapiens
tccctctgttctgttccaagtgtgtttttgattgctcgtggtacaggctgaggga

SEQ ID NO: 6874670 - DNA, 71 bp, Homo sapiens
atgtgtcttacataattacatgtgtgagttgagaggtccaggctggagatgtgaatgtgagacctaagcgt

SEQ ID NO: 6874671 - DNA, 113 bp, Homo sapiens
ttggagttttgatttactgtcctatttatttttactgcacaaaggaaacacttattccttcctgttttgcatttcagaagaaaattcgggatggtccaaatgacagactccaa

SEQ ID NO: 6874672 - DNA, 65 bp, Homo sapiens
gtttctaagggagagctgccagctggttaaacctgtctccggtaactagctttctctgtggaggc

SEQ ID NO: 6874673 - DNA, 84 bp, Homo sapiens
cttcctttgacttgttgtagacgcgaagtgactgaattgaaattgaattaagtagagtcatgtgtatagaagctcagatggaag

SEQ ID NO: 6874674 - DNA, 64 bp, Homo sapiens
ctttgtagttaggtaaagcagaaaacactccttcattcctgtgatctgccttggatctgcaaag

SEQ ID NO: 6874675 - DNA, 80 bp, Homo sapiens
gcggaagggccggccaggaggtggcaggacttgccttactactgagtcgccggcatccccgcctcttccggcctctccgc

SEQ ID NO: 6874676 - DNA, 87 bp, Homo sapiens
aaaggccttcaggtgttagaagaaatttcaaactataaactctgcctttgggggatgacattcctttgagcatctgaggaatacttt

SEQ ID NO: 6874677 - DNA, 129 bp, Homo sapiens
aggcactgcgccaggcaccttgtttttgttatttcaatgaactctcccagtgtttctgagaggtggaacgtgattcccattttgcagatgaagaaactgaagcttagagaaataacatgcctggatcct

SEQ ID NO: 6874678 - DNA, 63 bp, Homo sapiens
gtgcctgcctcatcaacttgtcgtgtggattaaacgtgataatccttgtggggcgtttagcac

SEQ ID NO: 6874679 - DNA, 69 bp, Homo sapiens
tctgtgagtatccagtaaacagctctccacagttcatggaaagtgttcgtgctggttacaccaccaagg

SEQ ID NO: 6874680 - DNA, 75 bp, Homo sapiens
cataaaagcctcaatggtcacctgaaatagactcaaggcccgttggtgccgacatgagcaggtgctgcttttatg

SEQ ID NO: 6874681 - DNA, 74 bp, Homo sapiens
ttacgtctttaaagttcctatatccaaatacagttccattctgaggtactgaggattaggacttcaagatatga

SEQ ID NO: 6874682 - DNA, 64 bp, Homo sapiens
actcctgttgtttgctagtgtactctcattaagcaatgagggtataaagagcaagcagaagagt

SEQ ID NO: 6874683 - DNA, 68 bp, Homo sapiens
agactcagagcccctcccaggagccgggtggtgaggtcagcctggctcaaggcgaggactccaagttt

SEQ ID NO: 6874684 - DNA, 60 bp, Homo sapiens
tttttgcactttaaaaaatggtgatgcccactggtgtcattagagttagtagtgtgaggg

SEQ ID NO: 6874685 - DNA, 64 bp, Homo sapiens
tctcctggtttgttaaataattcttgattgagtacctgccattatatttgatgaattagagaga

SEQ ID NO: 6874686 - DNA, 69 bp, Homo sapiens
gctcttctgcctggctcatggcagtgaggagacccacgctcaccttcgctgcctgggtcaagtagctgc

SEQ ID NO: 6874687 - DNA, 55 bp, Homo sapiens
agaaggccccatgaacactgcaaagacagtttgcttgttgtaaatggaggtttct

SEQ ID NO: 6874688 - DNA, 96 bp, Homo sapiens
ttcctcctgcctacctaagagattggtctagtttcagtctgctagtgcagctgttcagctggccagattccttagtttacagatgggcatttggaa

SEQ ID NO: 6874689 - DNA, 71 bp, Homo sapiens
gtctatgtcctaatctctgaaacctgtgccaatgttctattacatggcagaggagaattaagattacagat

SEQ ID NO: 6874690 - DNA, 69 bp, Homo sapiens
cttcaccaggaggcgtcttcagtttgttctttagttagcagcaatacttgagtgcctttcttactgaag

SEQ ID NO: 6874691 - DNA, 57 bp, Homo sapiens
ggcctgagcttgggcagcgtattctgtgcaaagcatgtggggcaccaaactcaggtc

SEQ ID NO: 6874692 - DNA, 81 bp, Homo sapiens
tatctagcctcccttctctgcacaagtggctgggaaaatatgcctttcttctgtgacttacaagaagggactggggagata

SEQ ID NO: 6874693 - DNA, 76 bp, Homo sapiens
taaattatgctttggtagagagttgtggaacttagtgccataaaatgcataacttttttaccaagagcaaaattta

SEQ ID NO: 6874694 - DNA, 65 bp, Homo sapiens
ttttaatttcttcagtgatatagaaagaaggtttttccttttacatttgttgaagagtattgagg

SEQ ID NO: 6874695 - DNA, 76 bp, Homo sapiens
gtgagtcttggccagggggtcagcaggcacttggctccagccaacttttgtccgatctcctggaatccagacttac

SEQ ID NO: 6874696 - DNA, 55 bp, Homo sapiens
gagacagtgctccgtgggtccagataggtactctggagtctgtggatgctgtttc

SEQ ID NO: 6874697 - DNA, 63 bp, Homo sapiens
acatgaacattatatcagcaagtcatttaatttctttttgtcttgtagataagaagttgatgt

SEQ ID NO: 6874698 - DNA, 72 bp, Homo sapiens
gcttatgaaacatgctttgtggatgacacctgggcagcagcccaactcagctatgaggtggtggttctaggt

SEQ ID NO: 6874699 - DNA, 80 bp, Homo sapiens
tcctacttccttgataataatccatttatgaaatgttcaaaatcacattctgagtagaaattattcttcgagggtaagga

SEQ ID NO: 6874700 - DNA, 70 bp, Homo sapiens
ttctgactttgcagtgtgggacacccgggggaatcctctagttcattctcatgcatgcataagtctagaa

SEQ ID NO: 6874701 - DNA, 62 bp, Homo sapiens
gatgttaaaggttggtaagtcattctacacctgcatgtaacttcttgcttgtctttaacatt

SEQ ID NO: 6874702 - DNA, 63 bp, Homo sapiens
ggtacacggcagagttgattcagataaacaatttgctttgttgaagtcagcatgcatgtgact

SEQ ID NO: 6874703 - DNA, 60 bp, Homo sapiens
gacattcctggcacagggcttggtcgctcattcaggctgatggccgccctttgccctgtc

SEQ ID NO: 6874704 - DNA, 86 bp, Homo sapiens
ccagcacaggtaggataaagcaggtaggagaagatggaaaagcagacttgcttagtcttctggcctttatctttctcctgtgctgg

SEQ ID NO: 6874705 - DNA, 62 bp, Homo sapiens
tatttggagtgatggaaatgttctatatcttgattctagtgataattccatgactctatgtg

SEQ ID NO: 6874706 - DNA, 77 bp, Homo sapiens
cttttctaggatatgggtcatggtcatgtgtagacaatacttttgatacagtcagctcacaattgtccctagaaaag

SEQ ID NO: 6874707 - DNA, 60 bp, Homo sapiens
gggagtccctggaaaagagctggtgagtgacagcagtcatctctcgtgtctgggacaccc

SEQ ID NO: 6874708 - DNA, 104 bp, Homo sapiens
gcagagctgacttctgtcctctagccacccagacatgtggtcccagatgaatcagtacatgtgtaacatgatctggtggccccaaggctcagagtcatcactgc

SEQ ID NO: 6874709 - DNA, 60 bp, Homo sapiens
tttttatctctacctgttggcctcaacctaagggttaaagggccactctagagaaagaaa

SEQ ID NO: 6874710 - DNA, 58 bp, Homo sapiens
tccagtccttgaaaatccaacatttaatagatggggagtataatgtttaggaactgga

SEQ ID NO: 6874711 - DNA, 74 bp, Homo sapiens
ctctgcaccttgtaggaggcaactgcggcagcaacagaaacagcagtgtacattgcaaccaccaggtggcagag

SEQ ID NO: 6874712 - DNA, 84 bp, Homo sapiens
aaagcctttctggccggtatttgcctctgggggctgcatcatcgtctacccagagttcttaaatactgagcaacttaaggtttt

SEQ ID NO: 6874713 - DNA, 58 bp, Homo sapiens
tccagaatgcttggaacctgaagttcttcaacagagaacaaataggcaagcatcagga

SEQ ID NO: 6874714 - DNA, 56 bp, Homo sapiens
tcttcacaggagcctgcctgcctttggtgggtactgagtcagtgttcttttgaaga

SEQ ID NO: 6874715 - DNA, 61 bp, Homo sapiens
caaagctataaattcagacagaaggataccaagctctgggttattctgaatttatactttg

SEQ ID NO: 6874716 - DNA, 60 bp, Homo sapiens
taaaagattatatatgtgtacgagtttatgcttttcctttcttgcacatgtgttctttta

SEQ ID NO: 6874717 - DNA, 63 bp, Homo sapiens
aggacagactgtgatgcttttgatgacttattctcagaagttacatactgtcacttctgtcct

SEQ ID NO: 6874718 - DNA, 85 bp, Homo sapiens
tgtttttactcctaactccatctctgtgtctgcttcctaaagaacctgagtgaccagcacaaggaggtagtgtagggtagaggca

SEQ ID NO: 6874719 - DNA, 67 bp, Homo sapiens
gctttgccacattcttcacatttgtagggtttctctccactataaattctctgatgtatagtaaggt

SEQ ID NO: 6874720 - DNA, 59 bp, Homo sapiens
cctctttctggtttgtggatggctgccttctagctatagcctcacagggcagagagggg

SEQ ID NO: 6874721 - DNA, 89 bp, Homo sapiens
cagcttctcaggtgattacaaaaaatctatgatgctgccagttattaagcagcttcaaagtctatctgtaattactcccttaggggctg

SEQ ID NO: 6874722 - DNA, 88 bp, Homo sapiens
ggagtcccatgaggtagaagagccaggacagatccagcttcacactcagacttgggctgtttcctcctgatgctctacagcctcctcc

SEQ ID NO: 6874723 - DNA, 71 bp, Homo sapiens
gaaatctcagcccttattttagaatttaacccacaagatgttggggtattatctggaattgctgagatttt

SEQ ID NO: 6874724 - DNA, 89 bp, Homo sapiens
aatttttaaattttttttcatgttaggaagacaggctttgtaggtataacctttgtaacattttcttggcatcatgaaaaattaaaatt

SEQ ID NO: 6874725 - DNA, 61 bp, Homo sapiens
cagatgttattaacggctgtagtttatccaacccttttttaaaacgcagctgcagcatttg

SEQ ID NO: 6874726 - DNA, 85 bp, Homo sapiens
acaaccaagcatatacaaactcatatacatacttaaattggtacggtggtgtatgtgtgcgtgcgtgtgtgtgtgtatgtgttgt

SEQ ID NO: 6874727 - DNA, 122 bp, Homo sapiens
gctggttgctgcagattgtgggacagagttctgtttttgcatattgattttctcctcagggaaacacattttaggaaaatctagtgtagggcggaagtcaatgtaccatgagcaggaccagc

SEQ ID NO: 6874728 - DNA, 86 bp, Homo sapiens
atgagttaagacaactgcttcacttggcatttggatccatctattactactccagggctcgggtgcttagtcatttcttagctcat

SEQ ID NO: 6874729 - DNA, 60 bp, Homo sapiens
gaaatgctctggtgtgtctcatccatattccctagagtatagatgaaatcagagtatttc

SEQ ID NO: 6874730 - DNA, 70 bp, Homo sapiens
atgtgaacatacattttcatatctcttaggagtagaattactgggtcatatggctgttgtgtgttaacat

SEQ ID NO: 6874731 - DNA, 63 bp, Homo sapiens
cctgatcaaaaatgtattgttgaaaattaaatacagagaatcaataatcaatatttgattagg

SEQ ID NO: 6874732 - DNA, 58 bp, Homo sapiens
agtctagaggatgggtccagatgggggatgggcttccatcttggaagcatctctgact

SEQ ID NO: 6874733 - DNA, 60 bp, Homo sapiens
cctttattttctgtagcttttctaaactccacaaggagaaataggcactggaattaaggg

SEQ ID NO: 6874734 - DNA, 79 bp, Homo sapiens
gctttataaacatctgcagcttgaatccataaatggcttctcagtgattcagaatgtggagagctgccctttatgcagc

SEQ ID NO: 6874735 - DNA, 55 bp, Homo sapiens
gcagcaggcaccagggctcgtcctggcacgatgaaggaggaacccgtggctgggc

SEQ ID NO: 6874736 - DNA, 67 bp, Homo sapiens
gttgtgttgcaatctgttgtgagctgaattactaacactagttcacatgctaaaggttgtaaacaat

SEQ ID NO: 6874737 - DNA, 68 bp, Homo sapiens
gaggtaggttcttgattgctggtcctaccccttattagctgggtggccttggacaagtaacctacttc

SEQ ID NO: 6874738 - DNA, 71 bp, Homo sapiens
cagtgtttgcattgcagtgttgcctggggcctttaacaaatgctcaaggtaacactgcagttgtcaagctg

SEQ ID NO: 6874739 - DNA, 68 bp, Homo sapiens
caatgcaggccgaggaagcattcctaggaggtggcgcagcctctttgatcctcctcggcaccggcttg

SEQ ID NO: 6874740 - DNA, 56 bp, Homo sapiens
gtgcatattttgcacacagatgtgttgcacatttgtgcatgtgcaaacgtgtgcac

SEQ ID NO: 6874741 - DNA, 64 bp, Homo sapiens
actttatgtgcttgctctttccttgataacatgaacattgttatagagtgcagtatgtagaagt

SEQ ID NO: 6874742 - DNA, 91 bp, Homo sapiens
aaggtggttatttctgtactgtggcctttaagaaacaggaatgatgcctggaataactttagtagctacagttagaaggtagcagagcctt

SEQ ID NO: 6874743 - DNA, 81 bp, Homo sapiens
ccattttacagaggttctgacagttctctgcttatttttagaatcaatgatttaggaagcttccagaacttaagtaattgg

SEQ ID NO: 6874744 - DNA, 72 bp, Homo sapiens
tatccggagtcatttttttaattattgttgagaagcagaatctagttacagagaaatgatttgatgcggatg

SEQ ID NO: 6874745 - DNA, 124 bp, Homo sapiens
ttgatatatactgatccatttttttaggggctatgcagattcaaatgaaatgcaacacaatgaaaatatgtagttcattgtcaatgaatgcatggtatttgcatgtgggtttgtatattgttaa

SEQ ID NO: 6874746 - DNA, 77 bp, Homo sapiens
gttccaaagagaggggtttgccatcctatgagtcactgattgctggtgcatagcctggaagccctctcccctggaac

SEQ ID NO: 6874747 - DNA, 59 bp, Homo sapiens
agcgactccggaaggccttggagctccatgtatgttgcctggctcttcgggagtttgtt

SEQ ID NO: 6874748 - DNA, 80 bp, Homo sapiens
gatttttctctcagttttcccagaatatcttccaagtgtgacatacgcacttcatgttcttggtgaaaggccataaagtc

SEQ ID NO: 6874749 - DNA, 102 bp, Homo sapiens
ggccaagaatcaagtgtttatgtctggcatgttgtaattaattaaaccatttttatgcaataattgcagggtgtcagaatacaatgcatttggtgacaagct

SEQ ID NO: 6874750 - DNA, 62 bp, Homo sapiens
agtttaagatttctgtaggtacctcaaggggaaatcctgggttatcagaggaatctttcatt

SEQ ID NO: 6874751 - DNA, 66 bp, Homo sapiens
gtttgaacaacctggccccagattccccatctgtgaaggggcactgaggctaggtcgtacttgggc

SEQ ID NO: 6874752 - DNA, 81 bp, Homo sapiens
taaggcccttcacagagtctcagggatgaaagcatggagttggtgctatcattattaccgtgaggccctcgtattgctttg

SEQ ID NO: 6874753 - DNA, 55 bp, Homo sapiens
aagccctcctgagctttccaagttaaatttaggtatcgctcatttggatgggctt

SEQ ID NO: 6874754 - DNA, 121 bp, Homo sapiens
caagagttgcttgagacagcatggtgggagaggatcagggtagtggttatgtgcaaaagctctgaagtcagcttccagagttcaaagcctgctgggatcccttaccagctgtgtgaccttg

SEQ ID NO: 6874755 - DNA, 57 bp, Homo sapiens
gcaaattcttaactggactgtggaagccagggtttggcagctggtctcagagcttgc

SEQ ID NO: 6874756 - DNA, 84 bp, Homo sapiens
catgatcattggattttgtagtgcttttgtagttcatgggaaacccatgaaacagctatcagtagactgcagttcaaatttatg

SEQ ID NO: 6874757 - DNA, 81 bp, Homo sapiens
cattgtctaggacctgtctgcatgatctaaaaccatcatatttattggcttagcctattcagcacagctttcctagtggtg

SEQ ID NO: 6874758 - DNA, 74 bp, Homo sapiens
gcaaatgttacctttgatgtgttaccctattagttctcatgcttaagggatgctaataaatcaaagacatttgc

SEQ ID NO: 6874759 - DNA, 69 bp, Homo sapiens
gagagagcaggctggcagggccagggacagtcttcagaggcccctggctcaggcagctttgtttctgtc

SEQ ID NO: 6874760 - DNA, 59 bp, Homo sapiens
cacctgcgtcgtgtgggcagtgacctggacactcagggtcacccctcgatgacagggtg

SEQ ID NO: 6874761 - DNA, 61 bp, Homo sapiens
agagcaatttcttctccaagttggttttattatacctgatttttaaaaaaggaattgctct

SEQ ID NO: 6874762 - DNA, 84 bp, Homo sapiens
tagagctacatgtggtagggagggcagtggtctataggaaatccgttgagaagatccactccctaacaccatgttcctgctttg

SEQ ID NO: 6874763 - DNA, 79 bp, Homo sapiens
acctcagagttggaatcacatttttaagctgcatattccagttttaaacacatcagattggttccttgctttgaaaggt

SEQ ID NO: 6874764 - DNA, 67 bp, Homo sapiens
ggttcctgtgttactgcctggagcggagctgcctgtcctgcaacaggctgtgacatggaagagaacc

SEQ ID NO: 6874765 - DNA, 60 bp, Homo sapiens
gtgtcctctgtttccatctgacttccactccaggtgggggttcttatgtgcacagggcat

SEQ ID NO: 6874766 - DNA, 76 bp, Homo sapiens
tatgcaaattgtctttaatcaggtcatgttagacaaacttaaaaagatgtgactctacttaagattaagctgcgta

SEQ ID NO: 6874767 - DNA, 69 bp, Homo sapiens
tgaacagactgacctctgaccttgccttccatgacatggttgctggcttcttagagatcatctgcttca

SEQ ID NO: 6874768 - DNA, 61 bp, Homo sapiens
atgagattttatagtgtcttgaagcctggggactctcctcccccaaatactgttgtcttat

SEQ ID NO: 6874769 - DNA, 58 bp, Homo sapiens
ggagggacctggagccccagcctctgtagatggggcctcctggactttaggttcttcc

SEQ ID NO: 6874770 - DNA, 55 bp, Homo sapiens
cagagtgttcgtggggacttggccacgtacatgtggctgaccataaatcacactg

SEQ ID NO: 6874771 - DNA, 90 bp, Homo sapiens
ctttgagggttgttggtacttattaggtatccaggtatttcgttacctgcaaatttttgaaaccagtttgtaccaagatccttcccaaag

SEQ ID NO: 6874772 - DNA, 62 bp, Homo sapiens
cagtgtctgtttctatctctgtgtttcccccccagcacctcagatagttgggcatgcagctg

SEQ ID NO: 6874773 - DNA, 78 bp, Homo sapiens
gcaagaatacattcaaggccttctgacacaatttctagattagtctttgttacagaaagtttatgaatggttatttgc

SEQ ID NO: 6874774 - DNA, 57 bp, Homo sapiens
gcctgtgatgcccccataagtatccctggacactaacaaaatgggaggcacagaggc

SEQ ID NO: 6874775 - DNA, 76 bp, Homo sapiens
atgaggctctgaggacaaactgcatgctgctttagattactcagttctttttagcaacagtttttttcagcctggt

SEQ ID NO: 6874776 - DNA, 104 bp, Homo sapiens
cttgtggaagctagcaccgtggcagccactgcttctggaggaatttggccaagtgtttggtgaacctggggctgttgctggtaggcagtgctggcagtcacaag

SEQ ID NO: 6874777 - DNA, 56 bp, Homo sapiens
gtgtgcatacatgtgcatgtgtgagtatgtatgcttgtatgtgcatgtgtgcatat

SEQ ID NO: 6874778 - DNA, 59 bp, Homo sapiens
acctttctccctggtgccatgtgagccacttacccatcagtagtgtcaaggaggagggt

SEQ ID NO: 6874779 - DNA, 57 bp, Homo sapiens
agagactttaaaaaacattaagagctgtttaaatgctcttgaaaagttagattctct

SEQ ID NO: 6874780 - DNA, 57 bp, Homo sapiens
taggcatcactccatctttcttccttcctgaggaccaaaatgtgagcgtgatgctta

SEQ ID NO: 6874781 - DNA, 66 bp, Homo sapiens
agccctcatcactgagccctgtagattcagtttccacttcacaggaaacacagggatcagagggtt

SEQ ID NO: 6874782 - DNA, 69 bp, Homo sapiens
gcccagaccaagctctaaggcggtgaggagcacatttctgccctgccaggccagtgagcttcctggtgc

SEQ ID NO: 6874783 - DNA, 67 bp, Homo sapiens
gttttgattcacaggacattagtcttgttgggatgacttcttacagcaactctcctgtgctcaaaat

SEQ ID NO: 6874784 - DNA, 58 bp, Homo sapiens
cagacagccaactggggagggcatgccaggggatgcagcctcctctcttggcttaatg

SEQ ID NO: 6874785 - DNA, 67 bp, Homo sapiens
gcctaatgctcaccctgcatcaggcttgggctgactcagccaaatggaatccaggtgacgcatttgt

SEQ ID NO: 6874786 - DNA, 56 bp, Homo sapiens
gttctctgagtcctggcaaaattctttacctgtggatacttgtgaggaaagagaac

SEQ ID NO: 6874787 - DNA, 97 bp, Homo sapiens
gataggtttctgagtgtgcagcatctgttggatggataagttgtttgtgcccaacgtgttcatagaggggtgatccaacactggtgtcagggccatc

SEQ ID NO: 6874788 - DNA, 57 bp, Homo sapiens
tgatcttcccatcactagaattcaaacaacctctgcgtgtgggatgaggggagatta

SEQ ID NO: 6874789 - DNA, 91 bp, Homo sapiens
acagcttttagccctatctggcctccactgtgggtggctgatatctactaccacagtggaggccatatggtcctggttaagagtaagctgt

SEQ ID NO: 6874790 - DNA, 55 bp, Homo sapiens
ctggctaagtagttgagttagtttctaaaaccaggcctttgaactgctgagtcag

SEQ ID NO: 6874791 - DNA, 61 bp, Homo sapiens
gtggggtgtgctcagagcagggggcctgaagaatggctcctctgtttacaacacacccaac

SEQ ID NO: 6874792 - DNA, 63 bp, Homo sapiens
tctacaccacaagcatcatctctgtctacagaaccctgtagaaactgatagtcttgtgctagg

SEQ ID NO: 6874793 - DNA, 105 bp, Homo sapiens
tgcatggctctgtgcacttttagtgccaagaagcatgagaagattttataacgagagtaattgtaataggatttaatcatggtgtcggcagcaaaagggccagca

SEQ ID NO: 6874794 - DNA, 77 bp, Homo sapiens
gttctgcctgaagaaatttatctgcttcagagaacagagttctctagggaatagtagagtttcttagggtttataac

SEQ ID NO: 6874795 - DNA, 77 bp, Homo sapiens
ttggattccgctcttcaggaggtcattggtaaccatggaggaggaaatttcagtggtgtcgtgggagtggaagccag

SEQ ID NO: 6874796 - DNA, 85 bp, Homo sapiens
aataggtgtgtggtgagatctcacttattttgatgtgcatttttctaatgacatatgatattgaggatctcatcctatgcttatt

SEQ ID NO: 6874797 - DNA, 81 bp, Homo sapiens
taggtttgtgttattttaacttctcagtaattcccaagtatgtatgatgattgcagagaaattagagctaatcataactta

SEQ ID NO: 6874798 - DNA, 126 bp, Homo sapiens
tagctgtggattacatgtgtttcaaatgtatagctaggaattgaaaagtggtctgagcttcaaaaagtcttactatattttaatacttccatatgaatttgacttaattatgtaaggaaatagtta

SEQ ID NO: 6874799 - DNA, 101 bp, Homo sapiens
aggagatgagaggggggacattcatttaggccaggctcccagcctcgggcctccaggccaagcctgcctggcagtgtaattcctgtcaagttttatctttt

SEQ ID NO: 6874800 - DNA, 68 bp, Homo sapiens
gttgatgttatgatctcactatgactagatctttttccctgtagtcgtcttatgagcatagtgtcagc

SEQ ID NO: 6874801 - DNA, 56 bp, Homo sapiens
ggcagcagcaagaaggttggactagaaaggagttttacacatttcttgtagcagcc

SEQ ID NO: 6874802 - DNA, 62 bp, Homo sapiens
cccctggcttcatcactcgggctgccatctttatgacagtggcaggtgggaaggccacgggg

SEQ ID NO: 6874803 - DNA, 55 bp, Homo sapiens
cccacagaatctgtgactccaagaaaacgtttctttggtcccactagatttgggg

SEQ ID NO: 6874804 - DNA, 57 bp, Homo sapiens
gccagggactttgcattgtttatgattatatacttaatacccaaaagagttcctggc

SEQ ID NO: 6874805 - DNA, 100 bp, Homo sapiens
gcaataaagtgtaattaaataatagttggggtgcagttacattttaagtcagaaacttgaaatgtagtcctgccttcactgtgttttgcaaaattattgc

SEQ ID NO: 6874806 - DNA, 90 bp, Homo sapiens
ctttatgatatgtttcatctctccccagtgtctttatagtgtataatgttaatgaatatgtgagggagggtgagatggtctattgtgaag

SEQ ID NO: 6874807 - DNA, 68 bp, Homo sapiens
gtaacacatgatgggttccagttttgcaagtctgacaaaaacaagctacattgacctatccgtgttgt

SEQ ID NO: 6874808 - DNA, 55 bp, Homo sapiens
caggttcagagagggacagaaagagagggagtttgaggtcggctctctgagcctg

SEQ ID NO: 6874809 - DNA, 62 bp, Homo sapiens
ttggtatattgtgctactttatgtccacttctccgtggacttggagagaatatatataccaa

SEQ ID NO: 6874810 - DNA, 64 bp, Homo sapiens
aaagttggggtgggaataccaggtttctgttcaagaaacctttcaattatcctcatcttacttt

SEQ ID NO: 6874811 - DNA, 60 bp, Homo sapiens
gggcaagcttatgaggctctggtataagctatgttgggtttcaggctggtgggctttccc

SEQ ID NO: 6874812 - DNA, 79 bp, Homo sapiens
acggggtcactttgagaaactgcacacgatgtgcctgatgcacggtaggtgctcagtacgtgggcagttccttccccgt

SEQ ID NO: 6874813 - DNA, 81 bp, Homo sapiens
ggcaaggcatttagtattctgctcacatgtcccggacgcctacaatgtgccgggcactgtgttcagagtgcagctgctgcc

SEQ ID NO: 6874814 - DNA, 80 bp, Homo sapiens
gcacagtgggtttggttctgagagttggcagcttgaagggtgctaggtccttgctggttcttaagatgcctccctggtgc

SEQ ID NO: 6874815 - DNA, 92 bp, Homo sapiens
agaactgtacattggctacaattgagaggcagagaggctttctgggtcatatttatatctcctgcctcacagttgaagttttaggcaattct

SEQ ID NO: 6874816 - DNA, 68 bp, Homo sapiens
gcaatgtcagtcaagcagcaaatgtgtgagtacttcttatggattaagcagcattgacttggcattgt

SEQ ID NO: 6874817 - DNA, 61 bp, Homo sapiens
gcttcccacagagattacattgaaagaatctctttcctgtgtgtgatctcttgtggatggc

SEQ ID NO: 6874818 - DNA, 82 bp, Homo sapiens
acagcattgacaactaactttttgattcttggggaacatattgctgttctgtttccatctcatgaggaatttgtcaagttgt

SEQ ID NO: 6874819 - DNA, 63 bp, Homo sapiens
agaaattccctgttcaaagtcacatagctagagcttggcagtgactcagagcagggatcttct

SEQ ID NO: 6874820 - DNA, 58 bp, Homo sapiens
gtttgaaacctatgtgtgctgacatcaccactgggctgggacactgtagatttcaaac

SEQ ID NO: 6874821 - DNA, 59 bp, Homo sapiens
ttcctgagaaatttgtacctggaatttctctgtacttctggtatgaagattatcaggaa

SEQ ID NO: 6874822 - DNA, 61 bp, Homo sapiens
gctgagtacatatgatgcatcaggaaccatgcttgttgccttgcttgtgtgtacactcagt

SEQ ID NO: 6874823 - DNA, 65 bp, Homo sapiens
catccttcccaaggacagggcatctaaccagagaacagaaggagatggcccagtggggcagggtg

SEQ ID NO: 6874824 - DNA, 76 bp, Homo sapiens
tgtgtgtgtgtgtgtgtgtgtgtgtgtgctcagtgtctttctattgtgtatgcagaaacatgcaaagaactctaca

SEQ ID NO: 6874825 - DNA, 80 bp, Homo sapiens
gcttcttcatgaaggattatttagagctctaatgcctgtgaaaggaatagttttacttaattcttggtcatgcagggagt

SEQ ID NO: 6874826 - DNA, 69 bp, Homo sapiens
gcagagatgatgataagcctgcagcaggtgacaacgagtggactcacctccaagctcttcattttttgc

SEQ ID NO: 6874827 - DNA, 59 bp, Homo sapiens
tacaatctatttcttggtctaacactgacaggcggtacaatgccaggaagaggaatgtg

SEQ ID NO: 6874828 - DNA, 75 bp, Homo sapiens
cctctgctaaagtccttgtatacagaatcaatgaagagttcatttgtgtatcatcaaggaatttagcacaagagg

SEQ ID NO: 6874829 - DNA, 65 bp, Homo sapiens
gcgcagcttgggggcgctggcctcagagacaccctcacttgaccccgagctcaccacagctgagc

SEQ ID NO: 6874830 - DNA, 99 bp, Homo sapiens
aataatttaatcggtgaagcataactgaaggatttagaaaaagtgcctaaactattaaaagattcttcagctgctgcttaatgttgatatcaagttatt

SEQ ID NO: 6874831 - DNA, 57 bp, Homo sapiens
ttatctgtggttaacccacacacgcaggcactttggttgctgaagaatcacagatgg

SEQ ID NO: 6874832 - DNA, 55 bp, Homo sapiens
cctttaggccatctgttccacctggctatgaaggttggcctgaatggtcaagagg

SEQ ID NO: 6874833 - DNA, 58 bp, Homo sapiens
gatggtgtgaggcaattgtagctttgaattaggttagagtggcctactcacactcatt

SEQ ID NO: 6874834 - DNA, 77 bp, Homo sapiens
tactgccctaaggtaatttgctagaaatggagtggtcaagatgtattgattaacgttttaggcatacttctgtagta

SEQ ID NO: 6874835 - DNA, 130 bp, Homo sapiens
ctcacccccgaagcttaattaaaatgaagatgaagtactctccatgacgggtcacactcagtggcagccaccgtgccagggaccctgtcggccctctgatgccgagaattcttctccagcttctactctg

SEQ ID NO: 6874836 - DNA, 75 bp, Homo sapiens
gcagaaattaacctgagggagattaggcctgagctttgaagttcacggttttgttttccttcagcccagttctgc

SEQ ID NO: 6874837 - DNA, 89 bp, Homo sapiens
actccccaaacagtaaacagcagtgattcattagcataagggcgtagaaaaacagaactgtgtgaatggattattctattgctgggagt

SEQ ID NO: 6874838 - DNA, 92 bp, Homo sapiens
tggtttttggggatagttaagcccaggccttaagacagtttgatattcagttttgttatttaggtctgggttagggataccgccagagagca

SEQ ID NO: 6874839 - DNA, 62 bp, Homo sapiens
ttctcctgggaggggttgcccaaagtcttatcaccggagtgggtcagctgcctccaggacaa

SEQ ID NO: 6874840 - DNA, 68 bp, Homo sapiens
gattgggaggcaaagttctctgtctgccccagtttctttctacagagagagaagggactcttccagtc

SEQ ID NO: 6874841 - DNA, 55 bp, Homo sapiens
gcagaatactgagagctgattgaaccaggaagaacaagaagcctcagtggcctgc

SEQ ID NO: 6874842 - DNA, 121 bp, Homo sapiens
gagaggccaaatacagaaaatttaaggagtcactcactctcagggtcttgcaagagagtaggatggcatttgcagactctgagagtgagtgccaccttaaattctgtactaaatgcttctc

SEQ ID NO: 6874843 - DNA, 61 bp, Homo sapiens
gagctcattcattcattgcctgtttagaaaatgcttactatgtgcagtgaagaaagagctt

SEQ ID NO: 6874844 - DNA, 69 bp, Homo sapiens
tctcacagcagcggtctgcattggtagccccactatgtttgatcattggccatgagcagccctgtggga

SEQ ID NO: 6874845 - DNA, 91 bp, Homo sapiens
atactgaatttagaattacaggcttcattaactcagagttttgcttatttaaagcaattttttaatgaggccatttcttcaaagccagtgt

SEQ ID NO: 6874846 - DNA, 55 bp, Homo sapiens
agagcagaggcatggccgtggggaggagggtccatggaacccgggcgtctgctct

SEQ ID NO: 6874847 - DNA, 87 bp, Homo sapiens
gatacctgaataatccatgtctagagtaaagctatgtcaagtaaaaaggatgactctttttattaaggatgtgggacttcaggtatt

SEQ ID NO: 6874848 - DNA, 77 bp, Homo sapiens
gcacattgattttaggaatctctgcattattgatctgataggatgaaatgcaatggggatccatttaaaccaagggc

SEQ ID NO: 6874849 - DNA, 103 bp, Homo sapiens
gcagcagcatcacctgggattttgaaagaaatgcagaatctcagcccttgacctagggaatcagagtctacattttcacaaggtctccaaatgatgcatctgc

SEQ ID NO: 6874850 - DNA, 74 bp, Homo sapiens
cacgtttgcagtcccagctgctcagaaggctcagtgagaggatccctcaagcccaggagttggaggctgcagtg

SEQ ID NO: 6874851 - DNA, 130 bp, Homo sapiens
atttcgttcatatgtatttaataggtttgtgagtaacaatactattttcagtatcctaggtaagtctaagtgattctttaaagtggtatttattcactcagtttgaaatgagtaaaatgtttaatgggat

SEQ ID NO: 6874852 - DNA, 81 bp, Homo sapiens
ggctgcctgtgtggggactgaagctgggcgctggctgctgcgcgagatgagggggccaggtccagcttccaaagggcagct

SEQ ID NO: 6874853 - DNA, 55 bp, Homo sapiens
catatgcattgggatatttctgaacaattctaacagaatctttccccatgcaatg

SEQ ID NO: 6874854 - DNA, 69 bp, Homo sapiens
ggtttcagtaatccataggttttgattattaatcagttaattcttggttgggacctatggactggtttc

SEQ ID NO: 6874855 - DNA, 81 bp, Homo sapiens
aacagctgttctgcagagaagcaattgggaagttctggtctctgccaatattttctaagtgtgtttcataggacactagtt

SEQ ID NO: 6874856 - DNA, 61 bp, Homo sapiens
agcccagcctgattctacaccctgagatgacatatgggaggggtggggaccatgcagggct

SEQ ID NO: 6874857 - DNA, 72 bp, Homo sapiens
tcggccaattctggctcaatttgtactgctgtgggagctacccacagagactgggagcaagaggcaggcgga

SEQ ID NO: 6874858 - DNA, 77 bp, Homo sapiens
ctccttccgcggtctttcttacgcatacctagtatatagagaaatttgaaccttttgctaagaagttatggaggggg

SEQ ID NO: 6874859 - DNA, 76 bp, Homo sapiens
tggcttgaatttttcatgtttgatgcataaggccagtggcattcaaacaggaagaaatcatttctacagtaagcca

SEQ ID NO: 6874860 - DNA, 57 bp, Homo sapiens
cagacaggggtaaccttcctcatttctctgtgttgtatgtaggaaggaccctgtctg

SEQ ID NO: 6874861 - DNA, 74 bp, Homo sapiens
gagagccctcctccagctgagtaagaacactatgctttggttatggtttcatgagaggccgggggagccttgtc

SEQ ID NO: 6874862 - DNA, 89 bp, Homo sapiens
gtgaaacatcgggattggtggtggttgccaaatgtaggaaatacgttgatgatacgtggacagataggaaatcgctattaacctaacac

SEQ ID NO: 6874863 - DNA, 107 bp, Homo sapiens
gaactgtgagaaatactaagttggtgcaaacgtaattgtggtttttgcatcaacctaataaaaaactgcaattatgtttgcagaaacctaatatatttctgttgttt

SEQ ID NO: 6874864 - DNA, 62 bp, Homo sapiens
ccagctaaagggagttagtgatgtggtctctgtaagagggttccacatgctgctccctctgg

SEQ ID NO: 6874865 - DNA, 60 bp, Homo sapiens
cctgccagagcttggtttttatttagcattctcccctaaaaagaaccaaagctctgtggg

SEQ ID NO: 6874866 - DNA, 89 bp, Homo sapiens
gaatactgccgtgatgaaagtgtttactcacctccagtggagtttggcctaattagatggtaatcacatttatctggtacacagtgttc

SEQ ID NO: 6874867 - DNA, 108 bp, Homo sapiens
tttattaatagcttgattgttactaggattttgaaaacgtgggctctgtggcagggagacatgcacacacagttctaattaacaccaatcacaaacgctaatggtaga

SEQ ID NO: 6874868 - DNA, 60 bp, Homo sapiens
cctcgcctgcctgtgtctctccccaaacccctttagatggggagggaagaagaggagagg

SEQ ID NO: 6874869 - DNA, 61 bp, Homo sapiens
tgtagctgtcagcaatcaagtggttaccagcaaagtgaaaacgatggtcattgcagcaaca

SEQ ID NO: 6874870 - DNA, 87 bp, Homo sapiens
agatggattaatttagtggagtattccagtctgatgggtactttctcaatccgtttattttgaagattccactgatttctgacctct

SEQ ID NO: 6874871 - DNA, 60 bp, Homo sapiens
ggccggggaggctgtcccggggccgagtgcttggcagcagggctgtctccctacaaggcc

SEQ ID NO: 6874872 - DNA, 69 bp, Homo sapiens
gttccatagcaccaacagaaaggcagagacccagcctctccaggatgccagactctggggtgctagaac

SEQ ID NO: 6874873 - DNA, 127 bp, Homo sapiens
cagaatcacctgggaaagtgaatttaaaatctagatttctgggctccaaccccagtgaactctgatgcagtagttctggggtggagcttgggaatctgtaattcagcatgttctccagaggggcctg

SEQ ID NO: 6874874 - DNA, 67 bp, Homo sapiens
tcccctctcccagctcatccctgccagcagggtcagggagaaggtttagctgtgagggtcctcggga

SEQ ID NO: 6874875 - DNA, 114 bp, Homo sapiens
ttctttacttgcatctgcagccctgattagaatgacagaaatgaggccaaaggccgttttcaactttgcattctattatttagcctggcgtagtataagtgcttagtaaaagaa

SEQ ID NO: 6874876 - DNA, 99 bp, Homo sapiens
gaggtgtcagactgcagaagttgattccaggcttgtatttgtgtctgttaattttggttttacaggtacatacttgggatccacacagcacttagcctc

SEQ ID NO: 6874877 - DNA, 112 bp, Homo sapiens
atccttgagatgaaagtttttgctaccatgtaccagcaactggaagtcagatccattggactgattggggtccctgctgtgtcatggcataaaatggtttcatatcattgat

SEQ ID NO: 6874878 - DNA, 97 bp, Homo sapiens
tatttctgttttcatcaagtactttccatttcaagtaacagattgcttcattccccctttaagcaagaagggagagtattttaagggtacagagata

SEQ ID NO: 6874879 - DNA, 121 bp, Homo sapiens
ggctccagcctcaaagtgctgctgaccctgtgcttgggccttccagccccccatggtgtgtaaaaggacagggctggacatctaaggtagctgtcagcgagtttgcacaggggttgctgcc

SEQ ID NO: 6874880 - DNA, 78 bp, Homo sapiens
caaaaggcagttcatgcccagagcagtaaattagggtttgtctttcctaggttattgggtttgggtttgggtcttttg

SEQ ID NO: 6874881 - DNA, 78 bp, Homo sapiens
ccctgtatttactccagaggttctcatctgggactgattcttccccactccctccatgagatgtctggcaatgttggg

SEQ ID NO: 6874882 - DNA, 58 bp, Homo sapiens
gggtaaacacctgttaaattcagaacattgcaagttatctgggtgctagtgtttgctt

SEQ ID NO: 6874883 - DNA, 57 bp, Homo sapiens
gtgtgaaatggttctctttgttgttaataacaaatcataggagtcccatattcccac

SEQ ID NO: 6874884 - DNA, 96 bp, Homo sapiens
gggagacattgctattcttgctgatcatgtagctttggcatcacaagatagatgtggaagtaaagcagtatgatggaaggatcctaatgtgcttcc

SEQ ID NO: 6874885 - DNA, 80 bp, Homo sapiens
gtgctgcactctgccacatctcgtttgccgccatatcacagaattggcacactgcggtgatgtgagtcagtgtgtggcac

SEQ ID NO: 6874886 - DNA, 72 bp, Homo sapiens
acagttaagcagtatgatcacaccgaaccctatgcttagaagggatccatacttgatttattgctccactgt

SEQ ID NO: 6874887 - DNA, 67 bp, Homo sapiens
gaggcgggcagatcacctgaggttggaattcgagaccagcctggccaacatggtgaaacctcgtctc

SEQ ID NO: 6874888 - DNA, 88 bp, Homo sapiens
atgcatgaatttgggcgaggagggaggcatggttcaacctacaacaaactttaaaccagtgtttcccaaatttcagccatttatgtat

SEQ ID NO: 6874889 - DNA, 128 bp, Homo sapiens
aaatttggtaaatttgtataaacactgtagcatatggttaggtgagatgatattataatcacatactcatcactctgatagataagctaactatattagtcttttgtacaaaatacactactgagttt

SEQ ID NO: 6874890 - DNA, 86 bp, Homo sapiens
ccctttgaggcaacagcgtctttccagctgttctgttggaaaacagcaggaacagctgctagagatctgtgagagctgcttttggg

SEQ ID NO: 6874891 - DNA, 62 bp, Homo sapiens
acctcccagcacgtctgctgtttctgttagtcacatagaggaacggggatggtgtgggaggt

SEQ ID NO: 6874892 - DNA, 64 bp, Homo sapiens
tgccttttccatctcaggcagccaagtctctgcttctgactccactgaagagactggaggggca

SEQ ID NO: 6874893 - DNA, 56 bp, Homo sapiens
aaagggcagtagtgatcttgttagggtttggcatctgaatgatctggttgcctttt

SEQ ID NO: 6874894 - DNA, 84 bp, Homo sapiens
ggccccactttgtaatgtgttatgttccagactctccacactaatcctttactgagtctttagcaaatcattcatgagtgagtc

SEQ ID NO: 6874895 - DNA, 65 bp, Homo sapiens
tgctgagtgcttgctatttgttaggttttggtctaggtcctagggatacagcagagtacaaagta

SEQ ID NO: 6874896 - DNA, 117 bp, Homo sapiens
gggtttataggcacgagaccctgcacccaacctagagttgccttttttaagcaaagcagtttctagttaatgtagcatcttggactttggggcgtcattcttaagcttgttgtgccc

SEQ ID NO: 6874897 - DNA, 58 bp, Homo sapiens
tgacaagtgcaaatgtaaagtgcagtgccatcttccattgcagtgtcctcacttgtca

SEQ ID NO: 6874898 - DNA, 62 bp, Homo sapiens
cagagcagactggagcctctacggggcatctccccatattggagaattcagtctttgttttg

SEQ ID NO: 6874899 - DNA, 94 bp, Homo sapiens
ggacgttagtaccttggaatgccttggctcaggccaccttgtcttccaaagcacacaagatgtgtctcatcagggtgtcaaggtgccagcgttc

SEQ ID NO: 6874900 - DNA, 71 bp, Homo sapiens
tcaactgagatccataagtgatagaaatttagcttccagaagcatttcatttattccatggacaaagttga

SEQ ID NO: 6874901 - DNA, 61 bp, Homo sapiens
tccatgacagcgtgagagtttgcagccaaagactagtatggcgggtccatggtgtcaagga

SEQ ID NO: 6874902 - DNA, 58 bp, Homo sapiens
gctgcaaatacagtcaggaatgtggcaggaaattatttctgaaaacacactttgcagc

SEQ ID NO: 6874903 - DNA, 57 bp, Homo sapiens
gataggctggccttgggcaaaattgttaagtaggcaaagttcccagttccatttatc

SEQ ID NO: 6874904 - DNA, 130 bp, Homo sapiens
tatcagcggtccttagacatctgcgtatatcaaaatcacctggagaacttggtaaagctggggcttctaggagctttattaactctccaggtgattctcgtaaacatcatagttgagaactgcttctcta

SEQ ID NO: 6874905 - DNA, 129 bp, Homo sapiens
ctttaaaaccatctaaggagaccatgttcttttcttttgctcatatttgcatgtgtttacaaaattactgttattaaacaaaggtgcaagtgtgcaaagaaatggaaggttctgaagatgacagtaaag

SEQ ID NO: 6874906 - DNA, 56 bp, Homo sapiens
tcatgagagtgctcttaaacaaactcgcaagcccgagaattttgttcactccatgg

SEQ ID NO: 6874907 - DNA, 70 bp, Homo sapiens
cttcccttaaactgcaatgatgtatttgtcctgtcccaagatgagacaatatcctttgtaaccagggaag

SEQ ID NO: 6874908 - DNA, 57 bp, Homo sapiens
tgggcagtagagcaattttacctaagctgaaatgcactataattgcttgtactccca

SEQ ID NO: 6874909 - DNA, 68 bp, Homo sapiens
ctacacaggatgtgttcaatcaccaaaggtatttattgaatgccagctatgaatcatgtactgcgtag

SEQ ID NO: 6874910 - DNA, 82 bp, Homo sapiens
tgtgtgtgtgtataaatgtgtgtatgtacatatatatgtatacatatatgtatgtatatgtatttatttgtatatgcatata

SEQ ID NO: 6874911 - DNA, 82 bp, Homo sapiens
ataagagcagcgattcattaggtggggatctctaaatatttgctatcagtattacgtaactacttaaattgcttctacttat

SEQ ID NO: 6874912 - DNA, 57 bp, Homo sapiens
agcaggtgttagggatccaatgaggtctgttggacaaatgattcataaatatctgtt

SEQ ID NO: 6874913 - DNA, 92 bp, Homo sapiens
tccttacaaattatcttgcagtgaaacaaaatggtaatgttgctcaagaagctgggtcttgagtcacacatttcttcatacaatatagaggg

SEQ ID NO: 6874914 - DNA, 61 bp, Homo sapiens
gaggagaactgaactggagactaacaccgagtagtcttctttgaccaaacagttttccctc

SEQ ID NO: 6874915 - DNA, 92 bp, Homo sapiens
gtattttacatttaatagcttgcctaatcctcatgatcctgaaaaattagcagtattatcaccccgtgttggtcaagttcagtgtaagaaac

SEQ ID NO: 6874916 - DNA, 56 bp, Homo sapiens
gtcccagccccagggggccagggtaaggccagggcctatgttcctgggctagggat

SEQ ID NO: 6874917 - DNA, 68 bp, Homo sapiens
cattttctcaagatccaatgcactcactcatctgttttttgaaagagtctttgtattttgaaagagtg

SEQ ID NO: 6874918 - DNA, 88 bp, Homo sapiens
taagagaaagtgacttgaggcaaggctgaatgaaggcataaatcaagcgatgcaggcctcattggtcttgctggggatttttgtcttg

SEQ ID NO: 6874919 - DNA, 67 bp, Homo sapiens
gctgcctcctctttgccaaggtcatgggtgactattggctggatatcaggcaagggggcaggagtgc

SEQ ID NO: 6874920 - DNA, 107 bp, Homo sapiens
cagcttgttttataagtcagcagcttggattttggcacgtgttttctcataggaacactgttttgaatagtggtcaggtttccaagctagcccacaaaagcatactg

SEQ ID NO: 6874921 - DNA, 58 bp, Homo sapiens
tagaagtggggcaggaaagattgcataggctcactccagtcccctgtccttacttcta

SEQ ID NO: 6874922 - DNA, 71 bp, Homo sapiens
tttgtccctgaggttggtttcttgggctgtgttatctggacaaggtatatgaggccactaataggggcaga

SEQ ID NO: 6874923 - DNA, 78 bp, Homo sapiens
ctgttttcagggtcaatagtttaaacaagaagcttaagagtgaagctcttgaaataatggctaatgctcaggaaacag

SEQ ID NO: 6874924 - DNA, 59 bp, Homo sapiens
tccagaggcagctgcggtcaggggcagggactgccgccagatgtgcctgcctttctggg

SEQ ID NO: 6874925 - DNA, 76 bp, Homo sapiens
gttggttcttatcctttctatctatgaatgtctctctgtatgtctctcgtgggtagagtggagggataagagatac

SEQ ID NO: 6874926 - DNA, 56 bp, Homo sapiens
ctgtgttttgcctgcgatgaaggcggggcaggtgttcaggcagtgcaaatacatgg

SEQ ID NO: 6874927 - DNA, 90 bp, Homo sapiens
ttagtaatgttggtatctagtatatgacagaaatgaaaaataacgtattttgtatttatgcaagaaattatctgtaccgatcaaaactga

SEQ ID NO: 6874928 - DNA, 59 bp, Homo sapiens
ccaggaagtgatggagagagtatctgggctgctctgggtaaatcccatcctttctctgg

SEQ ID NO: 6874929 - DNA, 84 bp, Homo sapiens
agatcagagctgttaagagggagtgacaggtggtgtatgcatccccaggccctgactcactaaattctaaatggcacttactct

SEQ ID NO: 6874930 - DNA, 62 bp, Homo sapiens
gcatccctgggatctcctgctcatcctcaaggtaaaatatggaaggtaggagccaggaatgt

SEQ ID NO: 6874931 - DNA, 55 bp, Homo sapiens
gtagagacagggtttcaccatgttggccaggctggtcttgaactcctgtccctgc

SEQ ID NO: 6874932 - DNA, 77 bp, Homo sapiens
ccccttcccctcctagggcagttgacctggtggcctcatctctcagcatccagcagcctgccttgggagcttagggg

SEQ ID NO: 6874933 - DNA, 61 bp, Homo sapiens
ggacgcagcgagggaagcagcctcatgagcaggcctgagtctctgcggtctcactgtgtcc

SEQ ID NO: 6874934 - DNA, 69 bp, Homo sapiens
gcgatattttcacaattgtgagaatagtttaattccactaggagtatcttttcacaatgaacatgtctc

SEQ ID NO: 6874935 - DNA, 59 bp, Homo sapiens
aggggatgggagagcatttagagatagctcttatctcttacttctcttctccctcccct

SEQ ID NO: 6874936 - DNA, 68 bp, Homo sapiens
ttgatgaagacacatacaagggaatgaacatggggccagctgtgacattttctgtgtgccttaatgag

SEQ ID NO: 6874937 - DNA, 59 bp, Homo sapiens
agaaatctatgttttggttagatgtattttttcatcttttatagaatataggtcattct

SEQ ID NO: 6874938 - DNA, 55 bp, Homo sapiens
gacacagttccctatgaggtaaaggatgagaagtgctgagtaggcaacctgtgtc

SEQ ID NO: 6874939 - DNA, 58 bp, Homo sapiens
ctgggtcaggcatttaggatgagttccgctaggcggatcttctgcttgtcttgcctgg

SEQ ID NO: 6874940 - DNA, 63 bp, Homo sapiens
gccactttgagccttactgtttctcagtctgctgaatccatttaacagggggctgcagagggc

SEQ ID NO: 6874941 - DNA, 101 bp, Homo sapiens
gctctgggttctgaaaaggtggtgggaaaaaaacttagaacagagaaaattctgtccatgcttttctctcaccatttttgccttctaacccttagttgagc

SEQ ID NO: 6874942 - DNA, 90 bp, Homo sapiens
gccctgcggcttcaggcatctgctgcccttctggaacctgtgacctccaggacagcggcaggcagatcttcagccccagaggtccagggc

SEQ ID NO: 6874943 - DNA, 96 bp, Homo sapiens
ccagtctaaggtagaaacgaagaagctctcagggcaaatgttctatccaggacattggctggagcattccttgtcttgtatcatattgtggattgg

SEQ ID NO: 6874944 - DNA, 69 bp, Homo sapiens
gtctaagaggctcctccttacatttacctgttgtcactcaggaaaagtagcagggggatcttcttgcgc

SEQ ID NO: 6874945 - DNA, 70 bp, Homo sapiens
gggaggggcagaggtagagaacaagaatacagaggaaaggccctcgcacttgctgcctcctgttcctccc

SEQ ID NO: 6874946 - DNA, 86 bp, Homo sapiens
aaattccttttagtctcttgagtaatgcaagcctttgtattacatgttaattaaagagtttattacttgtaagactagttgtgttt

SEQ ID NO: 6874947 - DNA, 63 bp, Homo sapiens
gtgggtcgctgggtgtattttaatctgtgacattccacactttgtgtactcaccagcacatac

SEQ ID NO: 6874948 - DNA, 55 bp, Homo sapiens
gtatttccattagtgtgtgcaccttgggcagcctgctggcaccatgtggaagtac

SEQ ID NO: 6874949 - DNA, 71 bp, Homo sapiens
ttcattcccttatattagcattgctacttttagataaactattcctgaaatgattagtgtaggaggatgag

SEQ ID NO: 6874950 - DNA, 104 bp, Homo sapiens
tctcttggaaggcatttagggcacccaatttgaacctgcatctttttctttagagaagtgttagggtaaagttggtaggatgtgctattgccctttcaatcaga

SEQ ID NO: 6874951 - DNA, 86 bp, Homo sapiens
agctgctaggagaaataaattctatgagtgagagtgacgtcaatcaagatcatgtggcttatagaatttgtttaccctctgcagct

SEQ ID NO: 6874952 - DNA, 61 bp, Homo sapiens
aaggcctccctctttcatgggaccctaactaaggtctttgaggtgtggagggaaggctctt

SEQ ID NO: 6874953 - DNA, 74 bp, Homo sapiens
cggggcacgtgtctggggtgctggacatcatatctgtgcaagtgcacctcctcccagctcctgattgtgcctcg

SEQ ID NO: 6874954 - DNA, 64 bp, Homo sapiens
tctctgccctggccatatccaccagatggattatgtcttatttctcttggatttggctgcagga

SEQ ID NO: 6874955 - DNA, 64 bp, Homo sapiens
atcttgctgagactggcaagtttgatgctttccagctgttccaaatgcctccttctagcaggat

SEQ ID NO: 6874956 - DNA, 81 bp, Homo sapiens
actcaaggcagagatattcttgatctctgtgggaataatcacaatttaaccaaagtagcaaagagtaattttgttttgtgt

SEQ ID NO: 6874957 - DNA, 58 bp, Homo sapiens
aggctgagaaagtgggaagatggacatgtctgaggttttcttgaactttcttcagcct

SEQ ID NO: 6874958 - DNA, 59 bp, Homo sapiens
atgagatactacaaatgagtttccggtttccggatccaatcacctttgttggtattcat

SEQ ID NO: 6874959 - DNA, 93 bp, Homo sapiens
ggaggcatttggtaaatactgttgaatgaagtaagaaatgaatgaagattaccagactcatacaagcgttcaatagatgttagctatccttcc

SEQ ID NO: 6874960 - DNA, 77 bp, Homo sapiens
aatatattttctcttcaaagattattgaaaacaaactgaaaaccaggttgttgtcattttgaagggtggtttatgtt

SEQ ID NO: 6874961 - DNA, 57 bp, Homo sapiens
gctcacactttctgattttaaaacttactacaaagctacgttaatcagaagtgtggc

SEQ ID NO: 6874962 - DNA, 67 bp, Homo sapiens
cagcctggcctgggactgctgaagatgaagtataggagaatttctgctgcattctcagtacaggctg

SEQ ID NO: 6874963 - DNA, 73 bp, Homo sapiens
tcagggaagatttcattgagtataggggtatacttaatgaaagtattcttatactcagtgagctattcctaga

SEQ ID NO: 6874964 - DNA, 69 bp, Homo sapiens
gtctgctaaagtggcgaagctgagttttaaaccttaggctttagaattcaaatttgttgacttgtaccc

SEQ ID NO: 6874965 - DNA, 62 bp, Homo sapiens
ggaatgagatgcttctcactgatttcatgaaacaccatcttctcaaagacaagctctcatcc

SEQ ID NO: 6874966 - DNA, 57 bp, Homo sapiens
tgcctacattccttgcttatgggctcttcctccatcttctaagctagcagtgtagca

SEQ ID NO: 6874967 - DNA, 129 bp, Homo sapiens
attagcaagcaagccacactagactttaaaattgaactgagggccctgctgaagcacagcttctattgttctgtaatgagtgttttgcagagtcctttcaaaagtaaactgtattgttcccttgctagt

SEQ ID NO: 6874968 - DNA, 71 bp, Homo sapiens
ccctagttcaatgtacttttccagaaggcttaagttccttgtctatgtcataagattcattgtaattaggg

SEQ ID NO: 6874969 - DNA, 85 bp, Homo sapiens
agggtacaagtagctcaggttttctggcatttctgaaagaatcttggttatgatgtaataggaggcttaaagctgctcagaccct

SEQ ID NO: 6874970 - DNA, 55 bp, Homo sapiens
ggtggggtatttggtacttgtactgtgaacagaagagtaccttttgtatgttacc

SEQ ID NO: 6874971 - DNA, 109 bp, Homo sapiens
gagtgtggttcaatttattgtacatggcatttatagacgagacctttaatgttcccaagacagggaagtgtctccgtttttaaaggttccatgacattcctttacattc

SEQ ID NO: 6874972 - DNA, 58 bp, Homo sapiens
gccaaagaaacgtcatgttatggatgcacatgtgcctttacaatgcattttctttggc

SEQ ID NO: 6874973 - DNA, 69 bp, Homo sapiens
ggctggcagctcactgattagcaattattttcccagaaagttggtagaagcggtggtgtctgctgagcc

SEQ ID NO: 6874974 - DNA, 81 bp, Homo sapiens
gggttcgtatgtagttcccgggcagcacagagtggtggaaacaccatgtgcattggggccagggaggcaggcatggagcct

SEQ ID NO: 6874975 - DNA, 96 bp, Homo sapiens
ggaggaggaggaggaaggaggaaagcttaaaatgggatggaacttccacttgacaataaactgagcttttttagcctttaatccaattctttcttc

SEQ ID NO: 6874976 - DNA, 90 bp, Homo sapiens
ctgcttgtgtctcttttttcatcaggtctttgatgatacaacaaccacagtacatcaatagggtttgaaagcaagagctacaagatacag

SEQ ID NO: 6874977 - DNA, 55 bp, Homo sapiens
actgaatgctccaaggctgcttcttcacgaagtcccagggccttggggcctcagt

SEQ ID NO: 6874978 - DNA, 66 bp, Homo sapiens
gtccatctgcctgtccctctctatccctgcaagttcggggaagaagggtcattggcagcccggggc

SEQ ID NO: 6874979 - DNA, 72 bp, Homo sapiens
actcagcacagtgcatggccaataaaaagcactcagtcagctgttgttaccattgttatcattgtgctgtgt

SEQ ID NO: 6874980 - DNA, 73 bp, Homo sapiens
gtgcctaattatcctctggatagtcatttacttgaaaccattaaaggaataggctgagaggaagatttaggac

SEQ ID NO: 6874981 - DNA, 109 bp, Homo sapiens
ctggtccatgagctgggtctgcagcagtaactgcctgtgctgcgcctccttctcagaggtcagctgctgataggcagccacgtactgctgcaggtgacccagggactgg

SEQ ID NO: 6874982 - DNA, 56 bp, Homo sapiens
tcctggcagtgcttgttttggagagattccagggatggtaatgagcagtggtagga

SEQ ID NO: 6874983 - DNA, 55 bp, Homo sapiens
tatgcagtgtatgcactgagatctacatgcctcagtctcagtgtagatctgtgta

SEQ ID NO: 6874984 - DNA, 70 bp, Homo sapiens
tactttttgatgttcctgtacaatctgatgattcacctttctcagtgagcacagggaatattttcaagta

SEQ ID NO: 6874985 - DNA, 64 bp, Homo sapiens
tgcacttgatttcctatctttatggtagatgtgcctctaccagaaagataggaaatcaagtgca

SEQ ID NO: 6874986 - DNA, 79 bp, Homo sapiens
gcttctttatccacctgcagctttctctggtttagtatcagagtggcaaaaaaagcagcagcacgtggaagagatcagc

SEQ ID NO: 6874987 - DNA, 66 bp, Homo sapiens
ctttataaaggcagtaaaatctaccttgcagagttgttgtaaggattagaattactgtatatgaag

SEQ ID NO: 6874988 - DNA, 56 bp, Homo sapiens
caaatactgggtaagttaatttcaaatggctttggagtccaacaaacctgtgtttg

SEQ ID NO: 6874989 - DNA, 61 bp, Homo sapiens
cagctgagcaggcattttccccaaagcctctcttgaccgggctccagtctctgctcagttg

SEQ ID NO: 6874990 - DNA, 56 bp, Homo sapiens
gctctgagataaacgttgccctcaccatgaattaggcaggacaaagttctcagagc

SEQ ID NO: 6874991 - DNA, 55 bp, Homo sapiens
cctgaaactgagagtcgggcatggaaacaggtgagattatgagttcggtttgggg

SEQ ID NO: 6874992 - DNA, 129 bp, Homo sapiens
cttaagactttctcaagatgttggagctgagtgggaccctggggaccatctagcccaacccaagagaagggagttgggctagatgatccccagggtcccattcagctccaacatcttgagaaagtctag

SEQ ID NO: 6874993 - DNA, 61 bp, Homo sapiens
cccagacgggaaggcacctgggacctggctggccccaacatttctcggtgctctgtgtggg

SEQ ID NO: 6874994 - DNA, 60 bp, Homo sapiens
aactgcctcaggtcatatatcaactttgtcatttatgagctgcatgaccttgggcaagtt

SEQ ID NO: 6874995 - DNA, 67 bp, Homo sapiens
ggcaagctggccctggtgagaagctccctttagcaaccaattttaggagattccacaatagtttgtc

SEQ ID NO: 6874996 - DNA, 65 bp, Homo sapiens
tcagccaaggaggaggatagtaagaagtacagataatgatctctggccttccttttccaagctga

SEQ ID NO: 6874997 - DNA, 71 bp, Homo sapiens
tgtctgggttgcttcgttgctcacttgctgattggaatcccaggagacagaaacagaggtagtccagcaca

SEQ ID NO: 6874998 - DNA, 69 bp, Homo sapiens
tgtgctcttagaacatacttagtgtgatttcagttcttttaaacatactgagatttgttttatggtcca

SEQ ID NO: 6874999 - DNA, 62 bp, Homo sapiens
caccaattggcttttcatgacaactcagcgatagattgcaattgctatggagagcgtgtgtg

SEQ ID NO: 6875000 - DNA, 62 bp, Homo sapiens
tcccttgggagtggtgaccacagctcagggcctgggttggatcctggtggctgccctaggga

SEQ ID NO: 6875001 - DNA, 126 bp, Homo sapiens
taacaatatcaacaacagcgagttgtttgtggattaaataaggtgatttatgcataacacattagcacagttgtttgttcataagaagccctcaataaatattagttgttgttgttgttactgtta

SEQ ID NO: 6875002 - DNA, 79 bp, Homo sapiens
ggtttttggttctgttcagttgattagacagagtgatgtaattattgtattcgtagattgaacagtaccttaaaaaact

SEQ ID NO: 6875003 - DNA, 83 bp, Homo sapiens
tttccctcttatacctctcgggcagatgctacgtagaaatgtcaggaactaagcctccctgggaacaaaggatgagaggggga

SEQ ID NO: 6875004 - DNA, 63 bp, Homo sapiens
gactgggtcctctgcttatggtctcaaaaggctacaatcgagctgtcatcagggactgcagtc

SEQ ID NO: 6875005 - DNA, 63 bp, Homo sapiens
cgtgcctaggcttggcacggaggcaaatgggaagaagagtggctgtggacaggctggggcatg

SEQ ID NO: 6875006 - DNA, 75 bp, Homo sapiens
gcctgccccagcctggaggtctgcccatctccggacaagtccaaggtggctacagccctgcatctctgagcaggc

SEQ ID NO: 6875007 - DNA, 114 bp, Homo sapiens
gtagtttgcagagtatctgctcccacccttggctttccagatcagagtgagtcaggaggcttctagggttgaggccacagggagggggttctggaaaactcctatgcattctat

SEQ ID NO: 6875008 - DNA, 57 bp, Homo sapiens
ttccccagtagtgacaatcaaaactgtgtccagacgttgccagtgtccactggggga

SEQ ID NO: 6875009 - DNA, 68 bp, Homo sapiens
catcagctgcccagcaataaaccagaagagctagaaaataatgtagatcagactggctgggcgcgatg

SEQ ID NO: 6875010 - DNA, 104 bp, Homo sapiens
gaaatatttcaggcatttttgtgagggaggaagttaggatacattggtgaacattagtgaccaaatggaatgatgatttccttttcctggcatttgaatgtttc

SEQ ID NO: 6875011 - DNA, 60 bp, Homo sapiens
gcacccatgagtagggaactgtagacttttcgttgtcttctttataaatcaatgggatgt

SEQ ID NO: 6875012 - DNA, 75 bp, Homo sapiens
tccactgggagacgcagctggggatccctcccaggactttttcacttgagggcccccagttctgatcccaaagga

SEQ ID NO: 6875013 - DNA, 57 bp, Homo sapiens
ctatacagtaaccacagtgatttggattgacatcatgcctgctgggtaactgtatgg

SEQ ID NO: 6875014 - DNA, 66 bp, Homo sapiens
gcccacatccaggcaccacaaccagctctgtgggaggagtggcaggtgtgggcttgggggatgggc

SEQ ID NO: 6875015 - DNA, 56 bp, Homo sapiens
gccggtattccatatcctgggagatgcctctgatccttggatgtgcatggccgtgc

SEQ ID NO: 6875016 - DNA, 62 bp, Homo sapiens
gaagattctttgaggattttacttgagtcagaaaacctcagtaaaaggaacaaagagttttc

SEQ ID NO: 6875017 - DNA, 88 bp, Homo sapiens
tactaaatataataaagatgatttctatataaacttaaattcagtataaagaatttatataaagagatctttgggttgtccagtggtg

SEQ ID NO: 6875018 - DNA, 62 bp, Homo sapiens
ggaggcagtggcagagcttggtctaaagctggatgtctttagcagtctatgtccctgcctct

SEQ ID NO: 6875019 - DNA, 70 bp, Homo sapiens
ctctggggctaggttataatctcctgagttaggtagccttaggtttcttggcggagattcctcccctggg

SEQ ID NO: 6875020 - DNA, 61 bp, Homo sapiens
attctggagaacagaggagagctgggtttgatagctacttcagctcctttgtgtccaggat

SEQ ID NO: 6875021 - DNA, 65 bp, Homo sapiens
gtgctttctggggatttaaaaaaatagtttcataaatattttagcagaatttctctagaaggtat

SEQ ID NO: 6875022 - DNA, 82 bp, Homo sapiens
gctattttttatcccttttttcattaaagcaaggttgtttatgtgcatttttgttcacctcaaggatgggagagagaagagc

SEQ ID NO: 6875023 - DNA, 59 bp, Homo sapiens
agcagtgggtgacagagctgagaattgaaccctatttttatccctccagagccactgct

SEQ ID NO: 6875024 - DNA, 55 bp, Homo sapiens
atttccgggattttatcaagtagtccatagacattttggcagtttcccaggaaat

SEQ ID NO: 6875025 - DNA, 70 bp, Homo sapiens
ttcctcctgggggtttatttttggactgctgagcaatgccttgactttagaagagccctttaagggggaa

SEQ ID NO: 6875026 - DNA, 57 bp, Homo sapiens
gtggtgaggaggtgactggaagggtggagtgcacttgaccagcccatagtccatcac

SEQ ID NO: 6875027 - DNA, 78 bp, Homo sapiens
aaggccaggatggagagttgttggttgaccactgcactcctgtgatcaccgcacccctgcactctcctcctcggcttt

SEQ ID NO: 6875028 - DNA, 56 bp, Homo sapiens
cctgaccctggctgccgcggtctgggctcggccgaccgtccggctgtcggggcagg

SEQ ID NO: 6875029 - DNA, 62 bp, Homo sapiens
aaatggagggcctggtcatctcaggatctgatttgtccttgaaagatttggcctctgtgttt

SEQ ID NO: 6875030 - DNA, 82 bp, Homo sapiens
atgagttctcaactatagatcaaatgagtttactgaagaattcagaagattaaaaaacatgtgactgtatgataggatttat

SEQ ID NO: 6875031 - DNA, 81 bp, Homo sapiens
gaaggtaagcaagatgcattatttcttatctgaattacatttagtaaatgaaagtgatatttgcatattgtttttaccttt

SEQ ID NO: 6875032 - DNA, 89 bp, Homo sapiens
ggagatgtgggatgcattgggagagattagggcaatgtctctaggaatggctgctccattctctagccagtgctccctccacgtcgtct

SEQ ID NO: 6875033 - DNA, 84 bp, Homo sapiens
tgggcatgatgaagggcaagaggcatttggttttgtgactttccttcacataaatggtaatgtctttctgtttttatgatgaca

SEQ ID NO: 6875034 - DNA, 56 bp, Homo sapiens
tggggaagggcaccctggagactggtggaagcccagcagatgccctgaaatcctca

SEQ ID NO: 6875035 - DNA, 61 bp, Homo sapiens
gtccagtgcttatagaatcagtgcttgtgccaaaacattttgtttcatgaagcacttggac

SEQ ID NO: 6875036 - DNA, 84 bp, Homo sapiens
aggggggcagctgaggatggtgagcaggacccagtggactgaccccactgctgtcccagcctcctcacatacagttggtctctt

SEQ ID NO: 6875037 - DNA, 58 bp, Homo sapiens
tgcctcagagtgggcttgctatccctgaggccaggcgaggcgagctgggctctgtgca

SEQ ID NO: 6875038 - DNA, 76 bp, Homo sapiens
ggatggctccagaaagcagggttccccgaggggctggccctcaccccatttcaccctctttctcagaaacccattc

SEQ ID NO: 6875039 - DNA, 103 bp, Homo sapiens
gacattttgtattgttttgatgtgttttttgagtgtgtctaagacagaaaacttacataaccctttggaccagctcctcgggagacgagaaaccttaaatgtc

SEQ ID NO: 6875040 - DNA, 60 bp, Homo sapiens
aaatggatgggtttctagatgtgataataaatgctaacgtttagagaatactcactattt

SEQ ID NO: 6875041 - DNA, 64 bp, Homo sapiens
cttagtgtcctctattatgactttatatagcttgagtatttaaagctcattggaggactttaag

SEQ ID NO: 6875042 - DNA, 56 bp, Homo sapiens
gtctataagcaggggaaaacttcatagtgtcagaagaaacttgtctgcttctaggc

SEQ ID NO: 6875043 - DNA, 66 bp, Homo sapiens
ccatttttaaaagatggaataagctggaagatcttctgtagcattatttcctctttttgttagtgg

SEQ ID NO: 6875044 - DNA, 88 bp, Homo sapiens
ttcattttgaaatggaatttctggtatgtatatgcttttattaacatttttattgcaaagaaatacatgcttaccatagaaaaatgag

SEQ ID NO: 6875045 - DNA, 89 bp, Homo sapiens
cgcggtggccgagtgcgggagtgcgccgagctctcccggcagtacagccaggttgttctggaggcattcccagcagcagcggccctgcg

SEQ ID NO: 6875046 - DNA, 92 bp, Homo sapiens
ttattattactcattccataataacaatgccagatgcctatcagccgcaaactatgagatatgcactgttgttattggataagttgtgataa

SEQ ID NO: 6875047 - DNA, 99 bp, Homo sapiens
atagctctttacaaatattagcatatggcagaccaattagaagcaaaaaagtccgtattggtggttgtgatgtggctgttatagaagtatttgtgctgt

SEQ ID NO: 6875048 - DNA, 69 bp, Homo sapiens
cctgagacatgaaccaggctcccaagtgaagctccaaatttcaaagcaaagcatgggtcagttattagg

SEQ ID NO: 6875049 - DNA, 108 bp, Homo sapiens
gatctgaagccagaagacgggccccaggagtaagccctggattctgatgcagaagttcctatttacctcctttgggacactcactgtcttctgagtgaattcagtatt

SEQ ID NO: 6875050 - DNA, 69 bp, Homo sapiens
gcactggtgcatgcccatgaagctggtcctggtggtcatggaccagcctcactggcatcacctaggagc

SEQ ID NO: 6875051 - DNA, 61 bp, Homo sapiens
gtgctctggagggaggcgtcttctgcaggagggacgggagagccagctcactccagggccc

SEQ ID NO: 6875052 - DNA, 83 bp, Homo sapiens
atgaagtgtgtgaatttctgcttaagcaagaaagcagcaagttgttgctgctgaggctaaagtataggaaaatccatctaaat

SEQ ID NO: 6875053 - DNA, 76 bp, Homo sapiens
ataaatacaaagaaatggcttcatctgagtaactgatacttccaagacttggccattgcagtcttttgtagattat

SEQ ID NO: 6875054 - DNA, 84 bp, Homo sapiens
tcctggatgaaattgttttgatactttaaaggataaaccttaaactgtctttaaaaaggttactcagaataacttcctcttgga

SEQ ID NO: 6875055 - DNA, 63 bp, Homo sapiens
aactggatcagttgagggaggcatctgttttactcagtcctttccttctaaaccgatctggtt

SEQ ID NO: 6875056 - DNA, 59 bp, Homo sapiens
actaaaactgcggcatttagggcagcacactaaactgcactaaactctgcagatttagt

SEQ ID NO: 6875057 - DNA, 63 bp, Homo sapiens
taagagcaaaaggtctgtattagagtttcatccttatatgaaattttgcagatcttgtttttg

SEQ ID NO: 6875058 - DNA, 56 bp, Homo sapiens
tctttctagggctcttgtcttctgctgggaggcagagcatctctagcccaggaaga

SEQ ID NO: 6875059 - DNA, 59 bp, Homo sapiens
cagcaaggtagaatccagaggctgtgcttgctggcggagtcctggactccatctcactg

SEQ ID NO: 6875060 - DNA, 62 bp, Homo sapiens
ccacctacccttagatcacaagggtcctctctgaggccaccctttggaggaagggctagtgg

SEQ ID NO: 6875061 - DNA, 79 bp, Homo sapiens
tggtgctcaattgttttacagttccatgcaaagcgtctttccccagatgttggtacaaattgtgaaatgctattcacca

SEQ ID NO: 6875062 - DNA, 78 bp, Homo sapiens
tgtgtcctgaccacgtggctctctggtcccctgccagaagtggcctgacaaagtagccactgaacctgtcagttcaca

SEQ ID NO: 6875063 - DNA, 61 bp, Homo sapiens
ggctctccagcaacttcctaaagatgatcagccatctatgctgaggcaggtgctggaagtc

SEQ ID NO: 6875064 - DNA, 103 bp, Homo sapiens
ttttgtaaaatttggcatgagaaaatttaactttgacacccccctctactcctataaggagagattctgagaagttaagtccaatgccaaattgtagacagag

SEQ ID NO: 6875065 - DNA, 57 bp, Homo sapiens
tcccatagatttttcagggttagttattactggtttttacctgagagatttggggga

SEQ ID NO: 6875066 - DNA, 64 bp, Homo sapiens
tcccctaaaggctttttcactggtgactcagaaggtctgtatttgttagcaagaaagtgggggg

SEQ ID NO: 6875067 - DNA, 72 bp, Homo sapiens
ggcatagtcatcagtgtgtcaaaagcacaaagatccccaggtgtttggctcagctcacagatcccttttgtt

SEQ ID NO: 6875068 - DNA, 80 bp, Homo sapiens
ctcttcgactggggcagagtagctggggtgtggaaaaggaacaccttcatacaacttccagctttcagccccttggagag

SEQ ID NO: 6875069 - DNA, 108 bp, Homo sapiens
cggccgctcctcagcctgtcccctccctcctgtgggctctcaaagtgcggcttggtttctccatctcgaccctgaggcctggaggtggggacgggactgtgggcgccg

SEQ ID NO: 6875070 - DNA, 65 bp, Homo sapiens
gctgcttctgtgggataaactggtcatcagatagcaccagccagggaatcaggcagaagtcaagc

SEQ ID NO: 6875071 - DNA, 61 bp, Homo sapiens
aatgtcctgttttgtggtatacattccaagagaatgctaattccatgagcacagggacatt

SEQ ID NO: 6875072 - DNA, 73 bp, Homo sapiens
ccggcgtcctggtcctgcctccccatgcactggagggcagccgcataggacagcaggtccggggtcaagccgg

SEQ ID NO: 6875073 - DNA, 113 bp, Homo sapiens
ctccatttctttttaaatggcaacagtgcaaaagcttccttgcatgctagaaagattgatttcccagagtcaaaatttttcagaatcattgcttttgacacttgtctatggag

SEQ ID NO: 6875074 - DNA, 85 bp, Homo sapiens
ggtataatttcaagttgaacagtattttttatctttagcatcattgtatgagatgcagagtttgctgtggacttgggcctatact

SEQ ID NO: 6875075 - DNA, 68 bp, Homo sapiens
tcacagcagaggctgtgtaggcagactgcctgggattgagccccagctgtgccactgcctcactgtga

SEQ ID NO: 6875076 - DNA, 61 bp, Homo sapiens
cctgcagggccactgtagatgaggagcttcctgtcgctcagcaggacaatggctttagagg

SEQ ID NO: 6875077 - DNA, 88 bp, Homo sapiens
agtctccaaaatcctctcctttgagttgcttttattgacttgtattttaatgtctcaccgtaaatgtaactttagggcaagggagcct

SEQ ID NO: 6875078 - DNA, 70 bp, Homo sapiens
ctgtgggttgcagggtaggtgacaggtagtcaggatattgactcctgcctctctacttctgtggccccag

SEQ ID NO: 6875079 - DNA, 95 bp, Homo sapiens
cttctctagaccacattcatgcacataaggcattgatctgtatgcattaagggaaaccattgaggtgtacatcagtcatggtttggtcagagaag

SEQ ID NO: 6875080 - DNA, 65 bp, Homo sapiens
ccatttatgtaacagtgccgccatggataaagtggacgtaatacctggatgctgcacgtagatgg

SEQ ID NO: 6875081 - DNA, 59 bp, Homo sapiens
gggtgtccacaaaatggctttgcttcaggcaccaaaaagtaaccaggataaggatacct

SEQ ID NO: 6875082 - DNA, 81 bp, Homo sapiens
acagctctgccctccggaggcttggcagacactgagcagctgctcctggggccaggcacctctggctgtgccagcagctgt

SEQ ID NO: 6875083 - DNA, 73 bp, Homo sapiens
gatgaaagttgggctggccagtgccatgcaggtggaaggactgctgggtggcactgtcaccaatgctgtcatc

SEQ ID NO: 6875084 - DNA, 67 bp, Homo sapiens
ccactggattctcttacacagatgccaataagaacaaaggcattacctggggagaggataccgatgg

SEQ ID NO: 6875085 - DNA, 66 bp, Homo sapiens
gaaatggctggcgtcattgtgtgggtggctgactgctgagtcgcttaaaatggtgttaactatttt

SEQ ID NO: 6875086 - DNA, 56 bp, Homo sapiens
cccactgctgctctccatggcaaagaggtggccctggaggtcgtagtacagtgagg

SEQ ID NO: 6875087 - DNA, 60 bp, Homo sapiens
gcaggtgtcagtccccaaggtggccatcatagcaatggagaccattggaatgacaagtgc

SEQ ID NO: 6875088 - DNA, 97 bp, Homo sapiens
ttctggcaaatgtaagtcaccaggaaggccaagtgcagcaccctgtacataataggattatgcagaggcatgctcactctgtctgtgactgctagag

SEQ ID NO: 6875089 - DNA, 91 bp, Homo sapiens
ggagtattcacagagagtatgcagagaagctgtgtttcctgactgcaggtccaatcattgatttctctgtagttgcctggtggaggattcc

SEQ ID NO: 6875090 - DNA, 88 bp, Homo sapiens
tggtcctggaggggagcctggacacaaacatctcctctggccaagaccagaggcaggtgtcctttgttctttcttgtctccaggtcta

SEQ ID NO: 6875091 - DNA, 86 bp, Homo sapiens
caggtggcccagtgtgaaaggtcatttatctgaaaggaaacattcctgaagtgactgatgagtgtgcctttcagctggcatatttg

SEQ ID NO: 6875092 - DNA, 92 bp, Homo sapiens
gttatgtagttgcttgtctcagcagaggcagtattcagtagtggctaagagcataggctaattctgtttctgccacttagtagctatgtaac

SEQ ID NO: 6875093 - DNA, 67 bp, Homo sapiens
cttatagtgtattggacctgatgtagtgtacataaagttcctagcagaagttccaatgcatattaag

SEQ ID NO: 6875094 - DNA, 105 bp, Homo sapiens
ctgacggtatctgacacatagcaagtgtgtaattactgggagctctggtttttattattacagtgcttagagatttttacacagtaagtgttagatatcggtcgg

SEQ ID NO: 6875095 - DNA, 89 bp, Homo sapiens
gcccagcctgaattgcttacccttaaacatgtttatttttactgccaggccttaatgagtcagtaatggatatgtcattttagctgagt

SEQ ID NO: 6875096 - DNA, 84 bp, Homo sapiens
ttttaatgtatatgcagattttcatcatcgtttctatcttgcaataaatgaagctgcgagtaattggaaatttgctatttagaa

SEQ ID NO: 6875097 - DNA, 124 bp, Homo sapiens
aagcccaccattcattatactgctctttctttttctcactgaggcatcccattactgcttgttttcatcagtaagattcttctgaaaaattacaaggaaaggtagccagtgacatttatggctt

SEQ ID NO: 6875098 - DNA, 63 bp, Homo sapiens
gaggcttttagtatggggactgtgtcattattaactttggcacttcttacatgtaaaagcctc

SEQ ID NO: 6875099 - DNA, 128 bp, Homo sapiens
gcctgtattatgtagttcctcctatttctccatggtcagttgagcagaagggaagatgcactatattctgccttctgtctcattgcttcggtccaagatgaggagttaaagatagcatgaacgcaggc

SEQ ID NO: 6875100 - DNA, 55 bp, Homo sapiens
ttgaagcaaattctgtgcagtactaatatgtgagaagcatggaattgtgctttag

SEQ ID NO: 6875101 - DNA, 56 bp, Homo sapiens
ggaagggaactgggatgggtgtagatatagaatagcagccacctcatttccctacc

SEQ ID NO: 6875102 - DNA, 99 bp, Homo sapiens
tggtttctttttctgtctctcactgagcatgtcaccggagtgctgtgtatagagtaaggccttaataaatatgtgttcagttgacaggagcaggagcca

SEQ ID NO: 6875103 - DNA, 68 bp, Homo sapiens
cagctgattcttcagtgactccacttctactgacagaggtaaaagaaaatgctgaagttgtcagtctg

SEQ ID NO: 6875104 - DNA, 58 bp, Homo sapiens
tctctgtaaaatgtggatgatacctgactcccaggcattttgccaggattacatggga

SEQ ID NO: 6875105 - DNA, 95 bp, Homo sapiens
ccttgcctagcagcacatttttcttgagtatcttctgttgtacctgtgctggtacacaaagataagtcagaaagtcacagttcctgccttcaagg

SEQ ID NO: 6875106 - DNA, 64 bp, Homo sapiens
caccatcagcagcaggtgtcaacccccaggactggagttgtcacatcactgctggtgatatgtg

SEQ ID NO: 6875107 - DNA, 57 bp, Homo sapiens
ttgttgtgttgattatctagacttatggaagtgctagagaaaatgttaatacagtaa

SEQ ID NO: 6875108 - DNA, 70 bp, Homo sapiens
gtagatggaggtggcaatttaatgcagtcttagctgtttaggatttagaactatgttacttttaatttac

SEQ ID NO: 6875109 - DNA, 91 bp, Homo sapiens
tgactgagttgtatagttatttttgccttcactttgaaagtaaaatctctgcaggttttggaggcagtcaaatgactgacaacttcggtta

SEQ ID NO: 6875110 - DNA, 61 bp, Homo sapiens
cctgactctcggttcatatggtttgagcagggcaacccagtcctctggagtgagggtgagg

SEQ ID NO: 6875111 - DNA, 69 bp, Homo sapiens
ctgcataatttgtggtagtgggggactgcgttcgcgctttcccctgccttactggaagttgaaaggtag

SEQ ID NO: 6875112 - DNA, 90 bp, Homo sapiens
gcattgtaggcagaacttaatgatttcatgcatgttgcatcattttatcatttcaacaaggtaagaaacattggcttcattttataatgt

SEQ ID NO: 6875113 - DNA, 55 bp, Homo sapiens
cttcctagcttcagagtctgttttgtcctaactttctctgactcagagttggaag

SEQ ID NO: 6875114 - DNA, 61 bp, Homo sapiens
cagattagttaccttggtgatgtcacttttatgttacatcttcataaaggaactgcatttg

SEQ ID NO: 6875115 - DNA, 56 bp, Homo sapiens
taagatgaaggctcacctagaactcaagtgaccattcagaggttagcatcatctta

SEQ ID NO: 6875116 - DNA, 59 bp, Homo sapiens
atttattgacttcagtgagtcttgggttacagatttccaaacagagctgagtaatagat

SEQ ID NO: 6875117 - DNA, 60 bp, Homo sapiens
gagttctgaactgtgaaatgcagcagttgggaagtgggctgtcactcaccgtttaggctt

SEQ ID NO: 6875118 - DNA, 62 bp, Homo sapiens
ccttttctaatcttaagaatgtctttagaaggttactgaaagtttcttgtacttggagaagg

SEQ ID NO: 6875119 - DNA, 70 bp, Homo sapiens
gcattacaggaaaatatgggctgggtatgagctggtgctctccagcacagctgcatgatggtccagatgc

SEQ ID NO: 6875120 - DNA, 69 bp, Homo sapiens
gtgtaaagtacatacatgaactcattcacttgacaaatattgtgagtcgtgcacttgtatacttggcac

SEQ ID NO: 6875121 - DNA, 84 bp, Homo sapiens
ggtaaagaaacagtggtctctggcttgagcttcgaccagtataattactgggattcagtcttcagaagacccttcgtctgtgcc

SEQ ID NO: 6875122 - DNA, 57 bp, Homo sapiens
aacagtgtttttcttcagcactaagataaatacaatgtttctgtgagaaacactgtt

SEQ ID NO: 6875123 - DNA, 64 bp, Homo sapiens
tcttattgtctagattgagatggggaataaaaaagagaccctcatgtctatgtatgaagtggga

SEQ ID NO: 6875124 - DNA, 82 bp, Homo sapiens
cacattcctatttgatcatttttctggtaaaattgttctcaaggtccaagcgtagccaggggaattccaggaaagatttgtg

SEQ ID NO: 6875125 - DNA, 96 bp, Homo sapiens
tcataaagcagccaccaccccttctcataatagcatttctcaccaggggaatttttggtagctgttgggggagggatttgagtaggttgtggatga

SEQ ID NO: 6875126 - DNA, 81 bp, Homo sapiens
gtgaggcaggggcagaagcgggtgccagaagggactgggccgccctccccagggtccctgcttccatgcttcctgcctcat

SEQ ID NO: 6875127 - DNA, 58 bp, Homo sapiens
gtgactggcacagtgagtcataagcaagtggaggtttgcagctcctggaccaggtcac

SEQ ID NO: 6875128 - DNA, 107 bp, Homo sapiens
agacttggaaatataaattagattaaaacacgatgtactgatttacaatgaaaattataactcgtacggatcagaattcttgtgtgtttcatgctgttctcaagtct

SEQ ID NO: 6875129 - DNA, 59 bp, Homo sapiens
cactccacaggccaagggagaatggggactctacccccatctccccttccttgtaggtg

SEQ ID NO: 6875130 - DNA, 56 bp, Homo sapiens
tcaagagcatgtatctccctaaattggattgtaatttggggattccctgtttttgg

SEQ ID NO: 6875131 - DNA, 88 bp, Homo sapiens
gagtatgcatattaagtttaagctatacattgttagagttgtctaacaactctgctaaatgtaagttggtaaatgtaagtaaatactt

SEQ ID NO: 6875132 - DNA, 73 bp, Homo sapiens
gactgttaataagtagtagttattgttattttacttagtggcaggaagttaactagatttatttatcacagtc

SEQ ID NO: 6875133 - DNA, 62 bp, Homo sapiens
tgagctgcaagaaaatttcagttcctcctgtgttctagctgaagtcaggttctgcagcctca

SEQ ID NO: 6875134 - DNA, 129 bp, Homo sapiens
gagagcgagtcaaagtcataattgctagcatttattggatgtttaccacatgccgagcactgttctaagtgctttacacagatgaatatttcccaaacagtgtaaagtaggtactgtgattatgctcac

SEQ ID NO: 6875135 - DNA, 81 bp, Homo sapiens
ggagggcttttttacatctgacctaattttgctagtttataaaatgtaaagattagattacatgaattttaaggtcccttc

SEQ ID NO: 6875136 - DNA, 93 bp, Homo sapiens
aatgagtgatttcagatgccttttaaaagagaaggtaaaaggagaattggattgcactttattataaatttgagaggcactttgacatttatt

SEQ ID NO: 6875137 - DNA, 67 bp, Homo sapiens
tgtgcttgaattaaggtaatgcttgatatgatttaaatgatgtctgtgtgatcttggataaggtaca

SEQ ID NO: 6875138 - DNA, 55 bp, Homo sapiens
cttaatagtgccatgtactgccctctcttgactgtaaacctggcgctgttcaaag

SEQ ID NO: 6875139 - DNA, 56 bp, Homo sapiens
gaatacacgaaggcaagagtcccttattcatggacatctgtgtatgtgtgtgtgtc

SEQ ID NO: 6875140 - DNA, 76 bp, Homo sapiens
ctcactaagtgctcaattcatattggtctattttaatcatcattatgttacagttgagtaaattaaacttggagag

SEQ ID NO: 6875141 - DNA, 65 bp, Homo sapiens
ctttcagtccttaaggaaacatttgttttcagctctagagaccaatttttcctgaagggcatagg

SEQ ID NO: 6875142 - DNA, 64 bp, Homo sapiens
cggaaagatgcagagttgcttaagcatccaagcaaaattgtatgttgtcatctgcattccactg

SEQ ID NO: 6875143 - DNA, 59 bp, Homo sapiens
gggctgtatgtgttgcctctggccaatgtatttagagcaaaggtgacatgtgacagcct

SEQ ID NO: 6875144 - DNA, 65 bp, Homo sapiens
gcccctcagcctgagtcaaggattctccatatctgtgtagagtcttccaggcagcctgaggaggc

SEQ ID NO: 6875145 - DNA, 55 bp, Homo sapiens
ctctgagcagcggtgccgaagtccagctgggcaatgtgtgtgctgactgccagag

SEQ ID NO: 6875146 - DNA, 74 bp, Homo sapiens
ctttctccaagctcagtcacattgtggtttgatttcccaaattttagctgtccagtggattggaataaggaaag

SEQ ID NO: 6875147 - DNA, 64 bp, Homo sapiens
tttcttaccagccttttaacatgggcctccactgggtgcatgtgagaaagactgggatcagaga

SEQ ID NO: 6875148 - DNA, 65 bp, Homo sapiens
atgcctagactatagactctgcagaggatgctgctacacaagggtctgtggatgcatctggggat

SEQ ID NO: 6875149 - DNA, 76 bp, Homo sapiens
gactgtgccgggcctgcaaacgcggtgaggaaaaatccatttgaatgcttactgctgaatggtgctgggcattgtc

SEQ ID NO: 6875150 - DNA, 69 bp, Homo sapiens
tcccttgggcacatcagtaagtggcaccggccagttctcgctgtgggctagatttggtgacccaggggg

SEQ ID NO: 6875151 - DNA, 95 bp, Homo sapiens
atgttttccaagggaacagatctctaatgtggcatttactaaaaaatattgagaaaatgtctttcaatagagaaatctgctttgcaggaaaacat

SEQ ID NO: 6875152 - DNA, 56 bp, Homo sapiens
ccccaccctccaggcccgcgaatcttggatctccggcagcatctggagggatgggg

SEQ ID NO: 6875153 - DNA, 81 bp, Homo sapiens
taggttggtgctgaatctgttattttctggtggtatgataacaatattcaactagatttatacaattccatatcttgctta

SEQ ID NO: 6875154 - DNA, 58 bp, Homo sapiens
tcccagtggcttcataaggcagagtttatttcttcctttcatgaagtccactgaagga

SEQ ID NO: 6875155 - DNA, 81 bp, Homo sapiens
atagctggcaatctttctaaatactaaataggcagtaaacaatgactttctttcaaggtagttgggaagaattgcagtcat

SEQ ID NO: 6875156 - DNA, 74 bp, Homo sapiens
agggaacttgaaggattattctagacctaatctccatagtcccctgtggtaggcagaataattcctccttccct

SEQ ID NO: 6875157 - DNA, 79 bp, Homo sapiens
ggtgcttaaagaatggctgtccgtagtatggtctctatatttatgatgattaatatcggacaaccattgttttagtatc

SEQ ID NO: 6875158 - DNA, 60 bp, Homo sapiens
ggtcatctggaaataaaattatagttgatagttcataatcagaaaatatttccagatgcc

SEQ ID NO: 6875159 - DNA, 78 bp, Homo sapiens
gggtgtggtgaagggaagggggatacaggggcacaatggaccattgtgtgctctggagttgccttcacttctggactc

SEQ ID NO: 6875160 - DNA, 74 bp, Homo sapiens
ggcacacagcaatggcaggcggagagtgacactgcaggtttctagtcccaatgtccatgctgctaatgactgcc

SEQ ID NO: 6875161 - DNA, 87 bp, Homo sapiens
ggtgcggacactggacactgaactccctgttttgggattcatttggcagggtctctcatagtgtccccagtgtgtccggcaagcacc

SEQ ID NO: 6875162 - DNA, 79 bp, Homo sapiens
agttgtatagtttctgctatatccatattatgaaataccatgtggccattaacaagaatatagtagatctatatgtact

SEQ ID NO: 6875163 - DNA, 93 bp, Homo sapiens
gatgaaaacagtaatcttgccagtctccaaatcagtctgaatggtatcatttaccttgatgaggggatcaaggtagcggatgctgtgagcatc

SEQ ID NO: 6875164 - DNA, 79 bp, Homo sapiens
gacattccatctaaccagtcgtttttggatctctagctgctgatctgtccaaaacacatggttggtcaatgaatatgtc

SEQ ID NO: 6875165 - DNA, 61 bp, Homo sapiens
cattcccacttgagaacttctagaggcttagtgatggagaggagtgttcagcgtggggatg

SEQ ID NO: 6875166 - DNA, 75 bp, Homo sapiens
ctcttctgaaacatttatggctgagatttaaaactactggaattgagacattcagaggtaagggtctcagaacag

SEQ ID NO: 6875167 - DNA, 57 bp, Homo sapiens
tgagatggagtctcgctctgttgcgaggctggaatagagtggtgcgatttcggctca

SEQ ID NO: 6875168 - DNA, 89 bp, Homo sapiens
tctgtgctctgcgggagccaaagcagctttcggccctcggggctggtggcgccctgggaagctgcttggctcaggggaaggagcaggga

SEQ ID NO: 6875169 - DNA, 55 bp, Homo sapiens
tccagctccacagcctccctgtccttaataaatgagcaacagaggcaggagtgga

SEQ ID NO: 6875170 - DNA, 121 bp, Homo sapiens
tggtggccacctctctcttgccttctctgccagagggcactgggctgcctggtcccagggtggggctgcagagctggtgccctggcctggccgatgggtggctggagtgttggagccacca

SEQ ID NO: 6875171 - DNA, 125 bp, Homo sapiens
atatgcaaatatgccctagtgaggtttttctgaaatgcatcattttaaaattatgtagcatggcattagtgttcaaaatactgaattgtaagatgatgcctgaatagcttactaacatatcatat

SEQ ID NO: 6875172 - DNA, 80 bp, Homo sapiens
aaagtactgcctttatatgcttttaacctgtaactgaaactttcagttttgttgcatttcaagtatgagaggtacacttt

SEQ ID NO: 6875173 - DNA, 100 bp, Homo sapiens
tgcatcactgtagaagactgcatttgacagagaaaagtgtgacttataaatttctgaaagttgtcatcttttctgttgatggtatttattcacaaatgca

SEQ ID NO: 6875174 - DNA, 56 bp, Homo sapiens
ggcccaaaccagctgggcaggaggctcaggccactctgcctaaaggggtttgtacc

SEQ ID NO: 6875175 - DNA, 59 bp, Homo sapiens
ctgcatctcaaccagactgctctctgcaacgattccagagatgcagttatgagatgcag

SEQ ID NO: 6875176 - DNA, 62 bp, Homo sapiens
caggaagttgtgtgttcgaggcacccagcacatcagaattgcctcccacaaataccttcctg

SEQ ID NO: 6875177 - DNA, 55 bp, Homo sapiens
gggcctgggcctccccaggggtagcccttctgctgcctgtggagcccaagggccc

SEQ ID NO: 6875178 - DNA, 66 bp, Homo sapiens
gtgtccatcagcagccactgtggaacctattatgaacctagcacagtgcttggctctgaggggcat

SEQ ID NO: 6875179 - DNA, 65 bp, Homo sapiens
cagatttctgggcaccaccacagactttctgactcagtaagtctgtagaggggcctgaaagtttg

SEQ ID NO: 6875180 - DNA, 63 bp, Homo sapiens
tggggcctgctccgtggttactgcagagctccaatctgctttagccgcgtcagcagttcccca

SEQ ID NO: 6875181 - DNA, 57 bp, Homo sapiens
ttcctggcctaaggtaggtgaccatggagagtgatcattattccgaaaggtcaggag

SEQ ID NO: 6875182 - DNA, 85 bp, Homo sapiens
gtctgatttcaatgtccaaacctcacggcggctgtacgtctgagaataggctgtgcgggcagccgtgggaggaaggagagcagac

SEQ ID NO: 6875183 - DNA, 69 bp, Homo sapiens
gattgactggatgctgggatgagcgaaaaggagaaggtgatgattcctggctttccagctcgagcaatt

SEQ ID NO: 6875184 - DNA, 57 bp, Homo sapiens
gcctctgtcggcgggggaacaacgggggcgcatctgaaggtttctcccaggcggggc

SEQ ID NO: 6875185 - DNA, 87 bp, Homo sapiens
tctgttagtagaatgctatcggctctaagcatgatccaatttcagattttgtgagtaagcttggtaaaagtcattctttgtaataga

SEQ ID NO: 6875186 - DNA, 81 bp, Homo sapiens
atgtgtcagctaggaaatgatagggtctgccccctgtagggcaaagggaacctgtacgttgtccttgaaggactgacatat

SEQ ID NO: 6875187 - DNA, 81 bp, Homo sapiens
agcttttcctatgaaagtcaatccccaagtgtcccctaaaacatgaggacaggggaatttactgtcattaagcagagagct

SEQ ID NO: 6875188 - DNA, 71 bp, Homo sapiens
tgtctggccccagaagggctgtagatcatttgcactcacagattgctggatgagctcttggatgccagaca

SEQ ID NO: 6875189 - DNA, 69 bp, Homo sapiens
ggattttactaggccacgaaggagatgatagaaaccattccagactctttgggtgtgccagaggaatcc

SEQ ID NO: 6875190 - DNA, 83 bp, Homo sapiens
gggttaggtaactggggaccagtgtctgtttgttcagtgggtttgcctatggatttcagaaagaaggattccctcaccttccc

SEQ ID NO: 6875191 - DNA, 116 bp, Homo sapiens
gaacagttagacccattcccagtcttacatgagattagtcacaggatatttcattttaagtccagtggaatgttttcctaaatcagacaagactctttcagtgtttatggctgttt

SEQ ID NO: 6875192 - DNA, 75 bp, Homo sapiens
aggaaaaagcatgtggattcatgagtgaaacagcagataccccactgccaattaccaaatcccgtgcacattcct

SEQ ID NO: 6875193 - DNA, 62 bp, Homo sapiens
tctgcagctgcctgcaacacaagcttggaccacccaggccgaagtggatgggcatctggaga

SEQ ID NO: 6875194 - DNA, 74 bp, Homo sapiens
gcaggcctgggagtcatcttgtctcagacttgttcacatatcatttagtcttgtacattgattttaggccatgc

SEQ ID NO: 6875195 - DNA, 55 bp, Homo sapiens
gattctttacatctctgctgacagatttcatcactggtgctgagtgcagggagtc

SEQ ID NO: 6875196 - DNA, 73 bp, Homo sapiens
gctggcttgtgtctggcttatgggaactgggtattaaatagccagtcattttgcaagccggttgcaagccggt

SEQ ID NO: 6875197 - DNA, 70 bp, Homo sapiens
ggtcctgtctcctcatactgtcatattgagagttaggcttttatcatatgaattttgaggggacacaacc

SEQ ID NO: 6875198 - DNA, 87 bp, Homo sapiens
gtaaatcaaggttgctctgaactgaacttagggtctcaaccagctgcagaccagttacatcttagcaagcagggctttgagtggtgc

SEQ ID NO: 6875199 - DNA, 84 bp, Homo sapiens
gggtcaaagggtgcatgtatttaaagttgcaatcaatattgctgttatattgcactccaaataagttgcaccaccttttggccc

SEQ ID NO: 6875200 - DNA, 87 bp, Homo sapiens
actagaagtgaggtggatgaacattaagagagacttcttccttcccctctgttaccaaaatcttgtatatccatttcaaggatcagt

SEQ ID NO: 6875201 - DNA, 84 bp, Homo sapiens
gcttgcttcctgagacaacattgagtacttggtttattgttatgatcattatagctctggttctcttagagtagtggagcaggc

SEQ ID NO: 6875202 - DNA, 73 bp, Homo sapiens
tcacctggctttaggttggagagctgatgaatccttcctgggatcccagctttctaccttaggcagtgggtga

SEQ ID NO: 6875203 - DNA, 60 bp, Homo sapiens
tcacctctcaggtcttcctcatatgcagaatgttcctcatgtgcaaactggagatggtga

SEQ ID NO: 6875204 - DNA, 60 bp, Homo sapiens
tcaccctgggtagggtgatatcccacatgaataaaatgtatcactatttatccaggctga

SEQ ID NO: 6875205 - DNA, 60 bp, Homo sapiens
taatgcctttctctgtagaaagaagcccatagggaatgtttctttgtaaggaaagcgtta

SEQ ID NO: 6875206 - DNA, 129 bp, Homo sapiens
tgtagatttattgaacatattttataaatatcaaataatgttagtatgtaatcttatcagggatgcaaatataatcatgatatatagagctagatgttaaagtgatatttgttaaaaataagtcctaca

SEQ ID NO: 6875207 - DNA, 83 bp, Homo sapiens
agagaggggaaataaagtgagctggaagggaagaaaacaaagattgactttctgaaagacattttaactcattttcactctct

SEQ ID NO: 6875208 - DNA, 57 bp, Homo sapiens
gggggccagtcatctcccaagaacattagctgtcctcttgcaattgattggcacccc

SEQ ID NO: 6875209 - DNA, 59 bp, Homo sapiens
ctgccaggttggcgctcgctctcagacttactgtgaggccttcagcccacacttgccag

SEQ ID NO: 6875210 - DNA, 100 bp, Homo sapiens
ccctcccagtgctgatcctgcctgcctgccaagaaccgtgttgccctcgggggacaacagtggtttcaggttccctccaggaagcatgcctggggagagg

SEQ ID NO: 6875211 - DNA, 70 bp, Homo sapiens
gaaactgtaattctctagttcggagttgatagcataaattaaactcaccgatcactgagattgctttttc

SEQ ID NO: 6875212 - DNA, 63 bp, Homo sapiens
ctgtggaatcgggaaaagacagaaaattcctgagtagaggagttcttaacttagactccatag

SEQ ID NO: 6875213 - DNA, 62 bp, Homo sapiens
cagagtctttctgggcttgttctttgatcaccctcatctgaagaggaagcaggaaagaactg

SEQ ID NO: 6875214 - DNA, 59 bp, Homo sapiens
gacagtgctgcttgtcaaagagctccttaccagttcctgttctcacaagcaacattgtt

SEQ ID NO: 6875215 - DNA, 68 bp, Homo sapiens
gaggcacagggcattacttcaggtccttcccctggtccagtgagggagtcctgagtggtgacctcctt

SEQ ID NO: 6875216 - DNA, 65 bp, Homo sapiens
gtcacacagcagtttagaggacagccaagtctgggctgcctggctgcctccagctgctgcctgat

SEQ ID NO: 6875217 - DNA, 87 bp, Homo sapiens
ccagccccttggtttagagagtgtggttaccaggcaactgttgttctcttctcagcctttgtgacctctttctgagcctacggtagg

SEQ ID NO: 6875218 - DNA, 84 bp, Homo sapiens
gagaatgtaatttaaatgtttaaaactcgtgactggctaccagcagttacggtctcttgacatttagacaacgcttactttctt

SEQ ID NO: 6875219 - DNA, 61 bp, Homo sapiens
gaaggtcaattgttccaactaatgcgattggggtttgcattccaggaaatacttggctttc

SEQ ID NO: 6875220 - DNA, 60 bp, Homo sapiens
gtggcaaggcatggcatggggcagatgtgggatcacatcccagccttcctgcttacccgc

SEQ ID NO: 6875221 - DNA, 85 bp, Homo sapiens
ctgaggttgtgcagacagctgaaggatgattcagggagcagatcccagctcattctcaattctcctatcagctggccagcttggg

SEQ ID NO: 6875222 - DNA, 109 bp, Homo sapiens
tgggcttttctcgcactccacctctgaaggtttctgttactgtcttttcaagagaatctagtttcagactttgagttctgtggctgtgggcaaaaaccaaaaagaccca

SEQ ID NO: 6875223 - DNA, 83 bp, Homo sapiens
ctgtatccattgaaaacagcgtagattcacagctaaaactaaataaaaatgtgttgttgttgttgttgttattcagggtctag

SEQ ID NO: 6875224 - DNA, 124 bp, Homo sapiens
gcggaaagtcggtagcaggcggaagtgcggccctcgaggcggtcgcggcctgtcggggcttggagcgaatggctccaaggccgcaggctgggcctgggccgcagccgtgggaagccgacgatgc

SEQ ID NO: 6875225 - DNA, 59 bp, Homo sapiens
cttcagtccttaagccaagcaacccaaaaggagggcaagtgctggatgtggggctgggg

SEQ ID NO: 6875226 - DNA, 71 bp, Homo sapiens
ccaatagcagctgcctattcagggcttggtgagtccttgtgcttagccctttctggccgttgcttcattgg

SEQ ID NO: 6875227 - DNA, 67 bp, Homo sapiens
tgtttcctttgcgctccctcttgcagtcacctcaatttactgatttcattaggagataagggggaca

SEQ ID NO: 6875228 - DNA, 66 bp, Homo sapiens
tttttgttgattactgtgttgctgacattagttatggaagcactttaagcaacagatcaacagaaa

SEQ ID NO: 6875229 - DNA, 80 bp, Homo sapiens
caattatcaccttggttgactgtcttgcaactccaccactcacacgcaggaataggcagccattaccaagggcatggttg

SEQ ID NO: 6875230 - DNA, 102 bp, Homo sapiens
ggtaaaaagtaacatgtttatgggctggctcatatagtatgaatgaaagaattatgtgtcttctaagccaagcctgttttggcatataaaataatttttacc

SEQ ID NO: 6875231 - DNA, 85 bp, Homo sapiens
tgttgatgtacccaagcaatcagtggacagaggtccacattatcaggccatgtctttccactgaagctactgggtaataaaaaca

SEQ ID NO: 6875232 - DNA, 76 bp, Homo sapiens
ggctttgacggcctctggccctacagatggctctttggagaggaaaaaattaagccaggcctgaggccacagatcc

SEQ ID NO: 6875233 - DNA, 68 bp, Homo sapiens
ctgattaaaaacaggttctgagaaatatctgcaaaacagatggtatatttaaatctgtttacagtcag

SEQ ID NO: 6875234 - DNA, 111 bp, Homo sapiens
tattgacgaaagaagagaaacagagacacggaagctaaagagttgggaatcctaaaggtcaaaggatgtttctcagttactctgatgtcctgtgttttctttcagttggta

SEQ ID NO: 6875235 - DNA, 65 bp, Homo sapiens
tctgttctgaaggttctgcactttattatataggtggtagaaagcgttaaatctacagaatatga

SEQ ID NO: 6875236 - DNA, 64 bp, Homo sapiens
aaggaatatagagatttctgtggtttagttggggtagcagctatagaaagtaatcactatcctt

SEQ ID NO: 6875237 - DNA, 69 bp, Homo sapiens
tggtctaatggctaaacctgaactggtctattgaataagaaaagggtatgttcaggtttgctttatcca

SEQ ID NO: 6875238 - DNA, 70 bp, Homo sapiens
aaagcggtgtcttttgtgagatatcttccaacaagtttcatggaactggcttacaaagaggcatcgcttt

SEQ ID NO: 6875239 - DNA, 72 bp, Homo sapiens
tgtcacccagttagaagaatatattgagtatttctgaatgagtctcaaaatggttaattttaataagtgaca

SEQ ID NO: 6875240 - DNA, 95 bp, Homo sapiens
atggctagcagcaaaacaatgttcctatattagagacacatacatctataaatttctatgcaggaagtaatgtcatatatgctgctataacccat

SEQ ID NO: 6875241 - DNA, 59 bp, Homo sapiens
gggaagacacaatgtagcccagcacgtgggccacgaggagctgcccgtgtgtctgctcc

SEQ ID NO: 6875242 - DNA, 67 bp, Homo sapiens
agcagacataagggggaactcagttcagaagaaagatcccacctacttctgactcttccttcctgtt

SEQ ID NO: 6875243 - DNA, 81 bp, Homo sapiens
gtgtttgatggaagaggagtaacagctactagcccttaaatgaataagacataagccagtcactcactatgccatagacac

SEQ ID NO: 6875244 - DNA, 70 bp, Homo sapiens
ctgtggccaggcattcagataagacacagcagggatgatatgtctgcactctgaatgtctaagccctcag

SEQ ID NO: 6875245 - DNA, 57 bp, Homo sapiens
ttcaggtgagtatagttaaattcttagaatagtaagagtgactctgaaccacttgaa

SEQ ID NO: 6875246 - DNA, 79 bp, Homo sapiens
agtctaaaacttcatttgtggttatttacaatgggagcctcatttctaaacagataatgctataaatggtggttagatt

SEQ ID NO: 6875247 - DNA, 59 bp, Homo sapiens
ttcaggaccacagtgcataagaaaggtgttggtaagcattatgaattctggtccctggg

SEQ ID NO: 6875248 - DNA, 60 bp, Homo sapiens
tgtttcctgagccagcacactcttcacactacactttgagtagcatggctctatggaaca

SEQ ID NO: 6875249 - DNA, 76 bp, Homo sapiens
gtgacagggatttgaaatggccttattaagtgtttgggcattattctagaaatgaggttttttaaagccagagagc

SEQ ID NO: 6875250 - DNA, 69 bp, Homo sapiens
gagacaagccaattactgtgccaggttagagaagaaaggagacaggccacaggcacagaggcttgcatc

SEQ ID NO: 6875251 - DNA, 56 bp, Homo sapiens
tgtatatgtttgtatgtacacatgttcatgtatacatgtgtgtactaacatatata

SEQ ID NO: 6875252 - DNA, 70 bp, Homo sapiens
atacaggcataaatctattggacatgtgtgtgcatatgtgtacgtgtgtgtgtgggttgtgtgtgtgtgt

SEQ ID NO: 6875253 - DNA, 92 bp, Homo sapiens
gcatgagcagaatgtgggctttggagtcaggaagacccagacccaaattttgcattttgtttcctggctctgtggccttgtctagttcatgc

SEQ ID NO: 6875254 - DNA, 57 bp, Homo sapiens
attctggcttcctcaggggctgaacttgtctacctcagcctgagctattgccaggat

SEQ ID NO: 6875255 - DNA, 80 bp, Homo sapiens
gaggtggaaaatgcaaatggtgaacagtgggtggatttgagagcaattctgatatttgaagaccattagtttttcatctc

SEQ ID NO: 6875256 - DNA, 85 bp, Homo sapiens
cccaactcacgaggccatctccttctggagaagaccttaatcagatccccatggaaggatgatggaagttgcttgttgagatggg

SEQ ID NO: 6875257 - DNA, 65 bp, Homo sapiens
ctggctgatctcctgaatgtctttgctgcaacctcagctccgtgcttctcggggaggttagccag

SEQ ID NO: 6875258 - DNA, 93 bp, Homo sapiens
gtagggctggcagctgtgtgaagaactgaggtgaccagcatcatcttcctacacattattgtattcacccatctttcagtttgtcagtcttat

SEQ ID NO: 6875259 - DNA, 58 bp, Homo sapiens
gttagtttacttttcatggagcatattaagggatcatgttccagaaacagtgatgaac

SEQ ID NO: 6875260 - DNA, 69 bp, Homo sapiens
attggtgtgccagagctgacatgtaaaggcttgcaagagccaattgtgtacatctcttctcacattggt

SEQ ID NO: 6875261 - DNA, 73 bp, Homo sapiens
ctacagcatccttcaatgggaagttttagggctgctctgtccagcttctaaagtgtgaagccaagatgtgtgg

SEQ ID NO: 6875262 - DNA, 63 bp, Homo sapiens
tgagctgggaagagcagccagagggtgtctccttatttctggtccactattctttttacttca

SEQ ID NO: 6875263 - DNA, 56 bp, Homo sapiens
gcagcagattgttttttcacctgcagagcatatgggtgtggggacaggggtgttgt

SEQ ID NO: 6875264 - DNA, 85 bp, Homo sapiens
ccagcagacaccttgttaaaatgaggattctgattcagtaggtctgggcagggcctaggagtctgcatttctaacaagctgttgg

SEQ ID NO: 6875265 - DNA, 87 bp, Homo sapiens
tctgtccatgctataaatcagggtggggaacctctggcccacagcccagatctggccctcagcttgattcatctggcatgtggggga

SEQ ID NO: 6875266 - DNA, 63 bp, Homo sapiens
tgctgatgctttcccgttcacatgggctacactaagcctttgtttattggttagtgacagaca

SEQ ID NO: 6875267 - DNA, 68 bp, Homo sapiens
gggacactctttttgtatagaaatgaactaatgtgcactaacttggtggaaatgggataagaggtcct

SEQ ID NO: 6875268 - DNA, 67 bp, Homo sapiens
cctctcagcgtgtgccattttccacttcagtttgtggcaaaggggaccatgttgaaataatttgagg

SEQ ID NO: 6875269 - DNA, 80 bp, Homo sapiens
ctggctctgcatctctgtgccagagggcactcagttcctgagccaagaaaggccactctggtcacagaaaggcaggctgg

SEQ ID NO: 6875270 - DNA, 89 bp, Homo sapiens
tgtatcttgccctcagttatagatacttttaccaatgcagaaagttggcatggagctagaaatgtctaaagcttggccatgagcctaca

SEQ ID NO: 6875271 - DNA, 70 bp, Homo sapiens
ggcagaggccaggcgagacacccggctgcggcctaagaggccaggctgggtgggcttggctgcagccgcc

SEQ ID NO: 6875272 - DNA, 73 bp, Homo sapiens
gcaggcttccccttgtgctgccagcgtggctcccgagccgtaagagccagtgatcagacagggaggagctggt

SEQ ID NO: 6875273 - DNA, 77 bp, Homo sapiens
tacagtcagcttgtctctagggttgttaaatctttattgttcggacataattaaccttgaagactgagctgaccgtg

SEQ ID NO: 6875274 - DNA, 55 bp, Homo sapiens
tagtaacaacaactagcattttgggggtgttttctaaatgccagttcctgttcta

SEQ ID NO: 6875275 - DNA, 62 bp, Homo sapiens
gttggggagactggccgagatcctgctgggatggcgcctggtcagtgatgctatcccccgac

SEQ ID NO: 6875276 - DNA, 55 bp, Homo sapiens
ttgagagcctaccatatgccaggcactgtgtgctggcagtggtaccggctctcag

SEQ ID NO: 6875277 - DNA, 61 bp, Homo sapiens
gtccaaaagttttcccccagtggttttaagtaatcttctggatctgagggggaagatggat

SEQ ID NO: 6875278 - DNA, 70 bp, Homo sapiens
ggaggtagagagtgcggactgtgtcttacaagcaggcaaagccgaggcaaggccgcacgtctcagccttc

SEQ ID NO: 6875279 - DNA, 64 bp, Homo sapiens
cagcctagtgcactggcagggctcattgtctgggaagacaccgaggtctaggcagctgggactg

SEQ ID NO: 6875280 - DNA, 79 bp, Homo sapiens
aaattatcatgttggtggtttcggtaagtgtgtaatattttaaacattacatgtatagaggccaccaacatgaaaattt

SEQ ID NO: 6875281 - DNA, 78 bp, Homo sapiens
tagtgacgtcaatcaattggaagtaggagtttatcaatgaattgcttgacatccatcatttcctgttgacatgagcta

SEQ ID NO: 6875282 - DNA, 92 bp, Homo sapiens
tcactctcagagcccactctgagctttgcagcccctgggcaacagaaggttacaggaggattatcaaaggattagggggctctgctgagtga

SEQ ID NO: 6875283 - DNA, 73 bp, Homo sapiens
ttctgaaaagtttggattagcagttagagcctaagaggcttttgctgtgaataattctgactgatactcagaa

SEQ ID NO: 6875284 - DNA, 71 bp, Homo sapiens
cctggggaggcccagaggcccaggacgtgggggcccatgtgaccgggtgaggcctctgctgtctgccctgg

SEQ ID NO: 6875285 - DNA, 73 bp, Homo sapiens
cgagaagtcgatcacctcgtcctccgtgccgtggatgatgagcacgggcgacgtgatctaggacaccttctcg

SEQ ID NO: 6875286 - DNA, 58 bp, Homo sapiens
agcatattatggcctattgctggaaattacaagtaccagcattagagtactatatgct

SEQ ID NO: 6875287 - DNA, 112 bp, Homo sapiens
gcagctgacttgaggtcagagaagtctatgaggatgttagtggactggaggtgatgagtaggaaacctctgctgagatgcccatggttatcactgggcctctgataagctgc

SEQ ID NO: 6875288 - DNA, 120 bp, Homo sapiens
tgaagatatttaaagttactcttttaaaaaataacatcatgtggcttatgtgggccgaaaacaagatcctattcaagctagatgacgttattttttcaggggcaatttttaatttcttta

SEQ ID NO: 6875289 - DNA, 57 bp, Homo sapiens
ttttcctccattgttactttttgtttattacttgcaccttggacacatgggggaaaa

SEQ ID NO: 6875290 - DNA, 89 bp, Homo sapiens
tggttctcaacctcagctacacattataatcatctgtaatttcaaaagctttctaggtgattctaatgtgcagtcaggactgagaatca

SEQ ID NO: 6875291 - DNA, 67 bp, Homo sapiens
gctttaggacatgggaaggaaagttgctgagaattagcactgcttattttatcctattcactattgc

SEQ ID NO: 6875292 - DNA, 115 bp, Homo sapiens
ttctgcttctgtttcttcactgtgctgtagaggaaatctcacaagccggtatgggtcagtgatgcactggcctaagattgtgttttcctgacagtcagtggttaaatatgcagaa

SEQ ID NO: 6875293 - DNA, 70 bp, Homo sapiens
gttaataatgtaagccctggagttaggttgcttggtattgtatctactactccaccacttaccagttggc

SEQ ID NO: 6875294 - DNA, 113 bp, Homo sapiens
gtttgaagtgtatttttaggaatgtagattatttttaggaatgtagaggtaaggaggcagcatccacatttcatccattaagagtactctccatttttaaagatgtttcaagc

SEQ ID NO: 6875295 - DNA, 56 bp, Homo sapiens
ccagggcttcccacgtgccctggctgaccttgcctggggatgtcggcaggtcctgg

SEQ ID NO: 6875296 - DNA, 63 bp, Homo sapiens
aacccaacattagcttattgtaaggtgaaacctgagcaaaggtcctggggctagtggtgggtt

SEQ ID NO: 6875297 - DNA, 64 bp, Homo sapiens
tgggccattctgcttggttcttggtatgactgcttcctgtcactacctccacggtagtggtcca

SEQ ID NO: 6875298 - DNA, 56 bp, Homo sapiens
agctcagtttttttaagagccatgctaattaaacagtatggtcttaagagactgct

SEQ ID NO: 6875299 - DNA, 85 bp, Homo sapiens
caggtggttttggggtcgagagctgactccctcctcctccgtcttaacccaggctcagagggtcagctccctccccagggctctg

SEQ ID NO: 6875300 - DNA, 61 bp, Homo sapiens
ggtgtgcatctcacccttccccgtcggctttttgaggatggtcctggttgaggtgggcccc

SEQ ID NO: 6875301 - DNA, 62 bp, Homo sapiens
cccttttgttctttctgagctgcagccagaaattgctggttagttcacaggaacaagcaggg

SEQ ID NO: 6875302 - DNA, 86 bp, Homo sapiens
tatctgaactgttgtaaagacactggttttaatcatttctcagatctattgaaatattgatgctcttggtgcttttaaggtagata

SEQ ID NO: 6875303 - DNA, 61 bp, Homo sapiens
acaactccagggggtcaatatttacattacagtctgtgtgaatggcatctcctggagttgt

SEQ ID NO: 6875304 - DNA, 92 bp, Homo sapiens
tgccagcagttaagtggtggaattgggatttgaatccaagctcactccgttccaaattctatgttctttccataatcccatgctgctgagta

SEQ ID NO: 6875305 - DNA, 78 bp, Homo sapiens
ccctgggttctgagtcctcctttgaaggccaccctgccagaaaggaagagcctgatggaggtttctggggactttggg

SEQ ID NO: 6875306 - DNA, 73 bp, Homo sapiens
gcagagatgtgaagaaagctgtgaaatggagaaaatggggaagctgaccattttgcacactatgcagctttgc

SEQ ID NO: 6875307 - DNA, 65 bp, Homo sapiens
aagtatacttaggcataatggtacaatgtaagagcagacaaaaaacacagcgcccaagtgtactt

SEQ ID NO: 6875308 - DNA, 55 bp, Homo sapiens
tcaagtcttgagggacagcattccagcaccactgagtgtcattcccaagctgtga

SEQ ID NO: 6875309 - DNA, 127 bp, Homo sapiens
ggcaaatgtgacctgagttcattttggatcctttgagaacctagcacaatgctgtatccgtaataggtactctgctgataggtcctcagatatgtgatttaaatgcatgaatatattggacactgtc

SEQ ID NO: 6875310 - DNA, 62 bp, Homo sapiens
ggcttactgacaggcagtgatttcctctggtaaacacctggaagcaattgccttcagctgct

SEQ ID NO: 6875311 - DNA, 81 bp, Homo sapiens
aagatctcggctctccatttttgtttgacttcccacacattgctgttaactgttccccaaacacagatggaagccaggctt

SEQ ID NO: 6875312 - DNA, 68 bp, Homo sapiens
gtcaggttttgcaaatgagctaatgaatatgctcttttgcatttcttttcctcctcttgttggcctgc

SEQ ID NO: 6875313 - DNA, 85 bp, Homo sapiens
tctcaagctgtgactgcaaagggaagccctttctgttgtctgaaagaagagaaagcgcttccctttgctggattacggtttgaga

SEQ ID NO: 6875314 - DNA, 78 bp, Homo sapiens
tcatcttcagagcttgttaaaactgtgctttccgatgtatttcctcaaggacagtcactagcagttgttctgaaatga

SEQ ID NO: 6875315 - DNA, 57 bp, Homo sapiens
gccatcaaaatggcaaaagaaagtgcagttttgctctttttgtgccattcttggggc

SEQ ID NO: 6875316 - DNA, 77 bp, Homo sapiens
tctaaagatcaagtgggccttggatcgctaagctggctgtgatgctatttatgcaagttagggtctatgtatttaga

SEQ ID NO: 6875317 - DNA, 57 bp, Homo sapiens
cacaatggcacctgtagggcgttgctctggggcatccctgcagagagtgcttttgtg

SEQ ID NO: 6875318 - DNA, 63 bp, Homo sapiens
tgtcctgttcatggctctggacaccctcacagtcccagtgccctcatctatgaaatcgggata

SEQ ID NO: 6875319 - DNA, 63 bp, Homo sapiens
ccatggagggagaaagtactgcttccgaagtccaagcttggagcaggcatctttctctcttgg

SEQ ID NO: 6875320 - DNA, 55 bp, Homo sapiens
aatgacatgtgtacctattgttgcttgtccttgatgatgagtacacttgtacatt

SEQ ID NO: 6875321 - DNA, 72 bp, Homo sapiens
ggagaggtgacattaaatttcatagtgattaaaattagatttttagttcatagcaatttagtttaccattcc

SEQ ID NO: 6875322 - DNA, 88 bp, Homo sapiens
ggactggtacctgcttagggctgcagaacaatggcctctgacaaactggggcctgtgtcctctccagcttgactcggtttgcctctcc

SEQ ID NO: 6875323 - DNA, 77 bp, Homo sapiens
gatgccagtagaggccaggcctccctggcagagctaagtagcatggctcagggaggccctgggacccttgccagctc

SEQ ID NO: 6875324 - DNA, 61 bp, Homo sapiens
gctggcacagaataagcaggcaccacgtgtttgttctcatttatttgtttatgtagccagc

SEQ ID NO: 6875325 - DNA, 66 bp, Homo sapiens
cctttgcatgtggtagaaggttccttttcagatacatttgtgtagaacctatgccacatgtttagg

SEQ ID NO: 6875326 - DNA, 71 bp, Homo sapiens
tagttggtagaaagagtatagctttaggattgaaatcttagttttgacctagttttatatatcactaacta

SEQ ID NO: 6875327 - DNA, 99 bp, Homo sapiens
gaccaatgaatgcacattaagtttattttcttccttagctgcttgttaatccctaattgctagcagacaggtaggaggataaattttacagctattgtc

SEQ ID NO: 6875328 - DNA, 79 bp, Homo sapiens
gttctttgggccaaagatgtccttgttaacctatgggaagatctttcctctactaacaagagactctgttccagaaaac

SEQ ID NO: 6875329 - DNA, 69 bp, Homo sapiens
tccccctaaatgtctcagagggagacaaatcagcggactaccttgcttcctttgatgacttggaaagga

SEQ ID NO: 6875330 - DNA, 72 bp, Homo sapiens
tgagcccttgctccctgtgccccactgtactctgaaagtacaatgagctgagccagaggcagcatgggctca

SEQ ID NO: 6875331 - DNA, 74 bp, Homo sapiens
tggtggcagttgggaagtatccccaaagttggtgaatttcaagccatgggactctttttcccaatggccagcca

SEQ ID NO: 6875332 - DNA, 64 bp, Homo sapiens
ggatggtggatggatcgatggatggatctgtcttccctgaagatctgtcttccaccacacatcc

SEQ ID NO: 6875333 - DNA, 115 bp, Homo sapiens
acagagttctgcatcaattctatttctacttttcatttttgtagatgcaagcacagaaaagccttgtttgaagactactgggagtgaaagaagtttaattacggcagttttatgt

SEQ ID NO: 6875334 - DNA, 76 bp, Homo sapiens
ggtcgaggcaggtggatcacctgaggccaggagttcaagaacagcctggccaagatggtgaaaccccgtctctact

SEQ ID NO: 6875335 - DNA, 61 bp, Homo sapiens
ggatgttggaggctggttttctgttcagttaacatgaaatgcagcctgtaaccttaattcc

SEQ ID NO: 6875336 - DNA, 88 bp, Homo sapiens
gtttccttaatttgatagattctttactcagattttgttattgcagattatggaatattaaagtaaaagtaaacaaaaagagagaagc

SEQ ID NO: 6875337 - DNA, 65 bp, Homo sapiens
gtatcttctatccctggtttaggcaagaggtgttgagagtccgagctagggcaaatatgagatac

SEQ ID NO: 6875338 - DNA, 58 bp, Homo sapiens
tggtcgtatttgtctttgaaaaatcatgtttgaatggtagttcacttacagatagcca

SEQ ID NO: 6875339 - DNA, 69 bp, Homo sapiens
tagggtgctaagatggtggccagagtggaaaggacacctttttgtcaccctggtcaccatggtatgctg

SEQ ID NO: 6875340 - DNA, 87 bp, Homo sapiens
ggagttgctgcagggcctgaggttgtgcctcctactctgaaagagttctgggcctggacacctgaggtcttacctgcctgcaattcc

SEQ ID NO: 6875341 - DNA, 67 bp, Homo sapiens
tgttttgggtgtgctaagagcactttcaatgattctaaattgagatgagcttcagacacacaagaca

SEQ ID NO: 6875342 - DNA, 61 bp, Homo sapiens
tccagtgcctcactgaggattcagctctgctcaagtctgcctgtttcctggggatactgga

SEQ ID NO: 6875343 - DNA, 61 bp, Homo sapiens
cgcacatgggcacctgagggtctgggaggcagcccggggctctggaaggtgcaccatggtg

SEQ ID NO: 6875344 - DNA, 57 bp, Homo sapiens
tttgacagagctcttagtctctaacaccaactggagaacaggcaagcatctggcaga

SEQ ID NO: 6875345 - DNA, 88 bp, Homo sapiens
ggttcagtgactgtgcttttctctgctcctggacactgcagctcgcaagctgctttccctcggaacagaaaagtcacagctatgagct

SEQ ID NO: 6875346 - DNA, 72 bp, Homo sapiens
ggccaccggagctaataaaggattggattttcaggcctaattctccagcttgttccttagactctgaaagcc

SEQ ID NO: 6875347 - DNA, 72 bp, Homo sapiens
cctttcaggaatctatagctggtttacagattataaggaataatttgagagttttcaatagattggggaggg

SEQ ID NO: 6875348 - DNA, 61 bp, Homo sapiens
ttcattgagctcttcctgtgtgccaggtttcaacctgggtaggtgctggggattcagtgga

SEQ ID NO: 6875349 - DNA, 64 bp, Homo sapiens
tcacagcatttttagaaagattaaatggtttaattgttatgccttccttttagggatgttgtga

SEQ ID NO: 6875350 - DNA, 84 bp, Homo sapiens
gcattttatataagcctgattcacttgtcattttcaacatgtaggtgactgtggtgacaggatagtcagctttgtaaaaaatgc

SEQ ID NO: 6875351 - DNA, 71 bp, Homo sapiens
gcagctactgtgggacatccctccctatgctttggctccagcataggtgctctgtcctcagtattagctgt

SEQ ID NO: 6875352 - DNA, 68 bp, Homo sapiens
gttgctttcctggaagcacaacgcatttatttgacaagagtatttgatacagtcttctaggaggcggc

SEQ ID NO: 6875353 - DNA, 59 bp, Homo sapiens
tcctgtgatggcttgcgatgtgtaaaattttcctacaacgtgttgcagaaatcactgga

SEQ ID NO: 6875354 - DNA, 84 bp, Homo sapiens
gctttgttgacctataatctatgtgccatcccatgtgcccatttaacatgtacaattcaatggtttttaggatattcacagagt

SEQ ID NO: 6875355 - DNA, 55 bp, Homo sapiens
tcagctgcttcatgttctgaattctaatgaatttgaaactatactgagcaggtga

SEQ ID NO: 6875356 - DNA, 67 bp, Homo sapiens
ttgcattttctcaggtgcttatctaagtcatgttaaccagtggcatagagaacctgtgaaaaagcag

SEQ ID NO: 6875357 - DNA, 130 bp, Homo sapiens
taaaatgaggccagaagatgggagatgtaacaagtggctttggcccagactcggggactgaccttggaggatccatcctcagctctgatctggatcctcaagctttgtttctcctactggcagccccagg

SEQ ID NO: 6875358 - DNA, 57 bp, Homo sapiens
ccgtcggacgcccgtgggcctctgctccgtgcgcgcccaccctcagcgtcctcacgg

SEQ ID NO: 6875359 - DNA, 63 bp, Homo sapiens
catgtgggctaggagaaggcccccaggtgtccgagcccagggcctctgtgttctgcccacatg

SEQ ID NO: 6875360 - DNA, 110 bp, Homo sapiens
gtaatctgcatagagcaaggcaaacaaataatgatctttattttaatttgcagtttcattactttagcaattattaagggttgatgtctttgctttctgatgctagtaac

SEQ ID NO: 6875361 - DNA, 83 bp, Homo sapiens
gagaggtgaataatttcagtagaaaatcttgattctagtctcaagagatgaagttaagattgtttttaacctgaaggcctctt

SEQ ID NO: 6875362 - DNA, 59 bp, Homo sapiens
tctcttcaatgccaacagccagcattcttcaaggtgagggcatgagggcagtgagcaga

SEQ ID NO: 6875363 - DNA, 82 bp, Homo sapiens
tcaggttaattttgaccatagaatggattgacaagattttaatatacgaaatttttcatttttctctggagaaatttcttga

SEQ ID NO: 6875364 - DNA, 55 bp, Homo sapiens
tcagaatctaaataggctccaggcgctggtgacttttaaagctctgtgattctga

SEQ ID NO: 6875365 - DNA, 95 bp, Homo sapiens
gcaaccaagatgtacttaccttctcttggagaactcacttaacagcttaagtgagttctccaagagaaggtatgtctgcaacgcatttaagttgc

SEQ ID NO: 6875366 - DNA, 101 bp, Homo sapiens
tgagacggagtctcactctgtcgcccaggctggagtgcagtgacgtgacctcagctcactgcgacctccacctcccgggttctagcgattctcctgtctca

SEQ ID NO: 6875367 - DNA, 83 bp, Homo sapiens
tattaggttggtgccaaagtaattgctgttttgccattaaaaataattgcaaaaactgcaattactttggcaccaacctaata

SEQ ID NO: 6875368 - DNA, 56 bp, Homo sapiens
tccagccgtatgttattggacattcagatgcctggggtgcatggtgtatgactgga

SEQ ID NO: 6875369 - DNA, 55 bp, Homo sapiens
tttacacccgggaccagccgtgggctgacctccttggctgagccaggtgtgtgga

SEQ ID NO: 6875370 - DNA, 88 bp, Homo sapiens
gacatcaggtagcagtaatgaggagaatagaatttagtttaatattgctatttttaaattccagcctcataatagctctctttgtgtc

SEQ ID NO: 6875371 - DNA, 58 bp, Homo sapiens
ctgctttagacggctttcgctgacctcggacaggaagacggcgaagcgcttggagtag

SEQ ID NO: 6875372 - DNA, 68 bp, Homo sapiens
tttcagtatccacaaatgctcaaaacattttctatactttgatgtttgggaacaatgaggatctgaaa

SEQ ID NO: 6875373 - DNA, 101 bp, Homo sapiens
ctggcagggttggccagggcgcccggtgcagtggagggcttgaggcacgaccacgtgcagcaccgtcccactggctacgggcccctctggacaccagccag

SEQ ID NO: 6875374 - DNA, 113 bp, Homo sapiens
gcccccttctctgcagctcctgagtctccacgccccgtccaccccttctgcgtacccacccctcccaagcactggatggtgaggcgaggactaggccctgcagcttgtggggc

SEQ ID NO: 6875375 - DNA, 64 bp, Homo sapiens
tgtattggacttgtgttaacaaggtgctgtagctttcacagcaagagcacagtttccacatgca

SEQ ID NO: 6875376 - DNA, 78 bp, Homo sapiens
gttcatcaggcaagaagtcatgctgcacaggtctgctaaaaaccagcaccctggctttgaccttgctgttttatgagc

SEQ ID NO: 6875377 - DNA, 81 bp, Homo sapiens
cttgtaggagatcagttgctctcatcagaaggtggaggcttctcatgaggggctttatgtgagtagcactgtccctgggag

SEQ ID NO: 6875378 - DNA, 84 bp, Homo sapiens
gcaacttcttgtggcttagggacaaactcaacccattctctacattcacagtttggggttcttaagaccacaataaaaagttgt

SEQ ID NO: 6875379 - DNA, 70 bp, Homo sapiens
cataaggcagtttatgtataaggactttcttgataagtgttggtcaaatatacataaaaacttgcagatg

SEQ ID NO: 6875380 - DNA, 78 bp, Homo sapiens
ggctgggaaaagacagggtcatggcacctgcacggctggcatcagtggtacagtgctcatgttctctcctcctcagcc

SEQ ID NO: 6875381 - DNA, 70 bp, Homo sapiens
cagtctttcaactcatgctaaaggaaggagcattcagccctgactgagaactcatgagttagaaaaactg

SEQ ID NO: 6875382 - DNA, 105 bp, Homo sapiens
tctgctgaatggtaaataacagtcatttgcccagtacttggggggttctaagtgtacggctgcccactgcctgccttccaggtactgagtgacctagaaagcaga

SEQ ID NO: 6875383 - DNA, 71 bp, Homo sapiens
tcatgctaccattattgatcttaggcttttggggataacaacctaagctcagaggtagataatgttgcaga

SEQ ID NO: 6875384 - DNA, 95 bp, Homo sapiens
tcattgaccttacaacacttgctgattttgcctactgatccacctgcaggtggggagtaaagaagaatcagggaaagtctgttaaggagagatgg

SEQ ID NO: 6875385 - DNA, 61 bp, Homo sapiens
ttgctggggaagcatttttcccttatgatttgttcagggccataaaatgttcccccattaa

SEQ ID NO: 6875386 - DNA, 74 bp, Homo sapiens
atgaagggatgttaaatattatcaaaagctttttcagtgcacattgaaatgattatatggtgtttgccctttat

SEQ ID NO: 6875387 - DNA, 68 bp, Homo sapiens
tctttgtttttgtgaggcagcccatggaacaaatgttccatggcatctcaacttacaaaagtcttaga

SEQ ID NO: 6875388 - DNA, 65 bp, Homo sapiens
agcactgaagtgcagcatgtcagccaacacaacagcaaggctgcacactgcaaactcagacagct

SEQ ID NO: 6875389 - DNA, 90 bp, Homo sapiens
agattctgatctcattggtagcagaatatggttggctaccagctcatcaggtagtcctaaaattcagctatatatgagaaccatggatct

SEQ ID NO: 6875390 - DNA, 107 bp, Homo sapiens
gcagatgtctacaactccaaggacacatgcattggtctattatgtgaaaaagtaatccatttctattacattaagccaatggattcttgagtttgatttattactgc

SEQ ID NO: 6875391 - DNA, 83 bp, Homo sapiens
tgagaagagctacttgtgaatggacaattaaatctagatgtatttagatctgatacaattcatctgtagccaaccttttttta

SEQ ID NO: 6875392 - DNA, 70 bp, Homo sapiens
gctacatgcttctgcctcttccactttgctcctctatagcagacctattgggagaggcagaaaatacagc

SEQ ID NO: 6875393 - DNA, 70 bp, Homo sapiens
gcgttcttcagcattagaagtcatgcacaaattaaattttaataaaaaatgctctgatgctgttaaatgt

SEQ ID NO: 6875394 - DNA, 60 bp, Homo sapiens
atacttcctgttgctctgtctcatgctctgtttatgctgagacactcattcatggagtat

SEQ ID NO: 6875395 - DNA, 66 bp, Homo sapiens
gacccccagggccacagggtaggcccagccgtggcttggtactccctgtgggcctcaacaagggtc

SEQ ID NO: 6875396 - DNA, 56 bp, Homo sapiens
tctgccccacagtccttatgaaaatattaaaaatgctcaaaataggtgtgggcgga

SEQ ID NO: 6875397 - DNA, 62 bp, Homo sapiens
atgctggagccctgaatgggcaggaagcattgcggtttccatttcattcagagctctttcat

SEQ ID NO: 6875398 - DNA, 60 bp, Homo sapiens
gggatgctctcttctgacttatgtaggccagtgtcctgcagattcagtgagaagcccccc

SEQ ID NO: 6875399 - DNA, 59 bp, Homo sapiens
ttggagatgtaaaattcagagagaatcagggctgagtctctgagccatagcagtcccaa

SEQ ID NO: 6875400 - DNA, 85 bp, Homo sapiens
ttgatggaactagtgggtggtcgctccttcactttcacaagctgctactgaggcttgagggggccggtgaccacccaactatcag

SEQ ID NO: 6875401 - DNA, 55 bp, Homo sapiens
gagggggaaagtccctggagtcaggctgtggcctttctcccccagcttccccctt

SEQ ID NO: 6875402 - DNA, 61 bp, Homo sapiens
ggggcttttcaggggtgcagaggccaggcttcaggtgggtctctgtgagtggaaggcaccc

SEQ ID NO: 6875403 - DNA, 63 bp, Homo sapiens
aaaatattattgcttaaggggagctggggggatttattctttctctttgtggcaatgtatttt

SEQ ID NO: 6875404 - DNA, 114 bp, Homo sapiens
tgtgattgcgatatttcaaggtgagtagtgagagaataaagcaaataattcacctgccagaatttccagtactattttctgctatagcttctcttgaacttctctgttttcata

SEQ ID NO: 6875405 - DNA, 102 bp, Homo sapiens
tgtatatagaatacacagggaaagtttgagaagtgaaggactgacccctccaactgccgttctgtctattttatactcaaatcttctatatattatcataca

SEQ ID NO: 6875406 - DNA, 55 bp, Homo sapiens
tctgagctgtaagtagacaaggtctaaagactggagggtttgagagcagctgaga

SEQ ID NO: 6875407 - DNA, 60 bp, Homo sapiens
ttcgatctgatcaccctggctgttctgtggagaacagacttggaggagtgatcagaggag

SEQ ID NO: 6875408 - DNA, 115 bp, Homo sapiens
gggctcagaacagtgctggcacatagtgtgtgttcaataaatttaagttaaaagactaaatgaataatgtcttcttaaaaaagctgttgaatgactgccttagctgacagggtcc

SEQ ID NO: 6875409 - DNA, 85 bp, Homo sapiens
tggctggtgcctgtaatccccgctacttgggaggccaaggtgggagaatcgcttgaacctgggaggcggaggttgcagtgagcca

SEQ ID NO: 6875410 - DNA, 56 bp, Homo sapiens
ggtgggtgagccctgggagctgagtctgcggcccggctctgcgcagctcacctgcc

SEQ ID NO: 6875411 - DNA, 56 bp, Homo sapiens
ggattctgtgtccaatggccttagcaggaagattgcttcggaatttggcacgaacc

SEQ ID NO: 6875412 - DNA, 55 bp, Homo sapiens
gggctgcttctcctgccaatcccccctcagggctggggttggagaagagcggccc

SEQ ID NO: 6875413 - DNA, 61 bp, Homo sapiens
ttcacctgggagattgaagggatgagccagattgctctcataccttggagttccaggtgga

SEQ ID NO: 6875414 - DNA, 58 bp, Homo sapiens
tgagatggagtctcactctgtcacccagtctggagtgcagtggtgcgatttcggctca

SEQ ID NO: 6875415 - DNA, 57 bp, Homo sapiens
gccagcctgtgggggctctgtgagactcaggttcctgtgtgggcctgcacggctggc

SEQ ID NO: 6875416 - DNA, 72 bp, Homo sapiens
agcagtccgcttaaggcagatgtggaatcaatttgggcaaatgcaagttgccagcgtctgtacttttctgct

SEQ ID NO: 6875417 - DNA, 61 bp, Homo sapiens
gagaaggctagagacttgcccaagcttgcccaggaggcttgagtgagaacctggccttctt

SEQ ID NO: 6875418 - DNA, 75 bp, Homo sapiens
ccccgtctccctggtgactcccaaagctgggccttcaacctacagctgcgtagcggggaaccagggagctgaggg

SEQ ID NO: 6875419 - DNA, 68 bp, Homo sapiens
tgtgagccacaaataaccactggtctgcttcccatcatgacactttggtgctttgtggttacattaca

SEQ ID NO: 6875420 - DNA, 78 bp, Homo sapiens
acctgaatttccaaagccttctggttacttccactttaatatgtggaagacataatgagaagactttgaggctcacgt

SEQ ID NO: 6875421 - DNA, 56 bp, Homo sapiens
ccagctgcctaagcaatccataagggcctgttctgcgtggatgatcagtgtagtgg

SEQ ID NO: 6875422 - DNA, 89 bp, Homo sapiens
gatgtaatcttggtgtctaaaatgcagagagagattttggtgtataatggcactggtttgtctattgtcattcagacacaagctgcatc

SEQ ID NO: 6875423 - DNA, 56 bp, Homo sapiens
agtatactccccatcctagaaactgaaaagttttgaggatgctcttgggatatact

SEQ ID NO: 6875424 - DNA, 127 bp, Homo sapiens
agcgagaagcatttagtacagaatttaaggtggcactcactctcagagtctgcaaatgccatcctactctcttgcaagaccctgagagtgagtgactccttaaattttctgtatttggcctctcact

SEQ ID NO: 6875425 - DNA, 57 bp, Homo sapiens
gctccttctgccatgtgaggacacagcaaatggccatctatgaacatggagaagggc

SEQ ID NO: 6875426 - DNA, 85 bp, Homo sapiens
ccaaccagatgaaaagataagcagcaataaaggatatgagaactaaattcttttactgtttaaaggcttcctttctgtctgttgg

SEQ ID NO: 6875427 - DNA, 86 bp, Homo sapiens
ttcttaagaaccttgtgagtctcccatgcgtgtcatgtatattcatgtcatccaacaagaggctcttggcaggtctttcctaggga

SEQ ID NO: 6875428 - DNA, 80 bp, Homo sapiens
cttattttgttatcagagccttaaaagacagcgtatcagaccatgtggttgtatagttaaggttcagtgtttcaaataag

SEQ ID NO: 6875429 - DNA, 93 bp, Homo sapiens
agaatgctgtagaatcccccagttctggagtttcattctttagcagccatgaggagaaggggcttcagagccaggcttctgggttcagattct

SEQ ID NO: 6875430 - DNA, 60 bp, Homo sapiens
ggtaaatatgtgtcatggtggtttgttgcacagatcagcccatcactcacgtattaagcc

SEQ ID NO: 6875431 - DNA, 55 bp, Homo sapiens
caccagggccccaggctgtgccagtctccggctgaactggccggcggcccaggtg

SEQ ID NO: 6875432 - DNA, 61 bp, Homo sapiens
gaggtcaggcttgcagcagggtcggctggctgtgtttgggtgtgctgtgagccgtggcctc

SEQ ID NO: 6875433 - DNA, 66 bp, Homo sapiens
acaatgcacaacagacgaatggaagaaactgagtactactttcagggttttctctgtatgcgttgt

SEQ ID NO: 6875434 - DNA, 67 bp, Homo sapiens
catcttttttcccacccttctaggacaaactcatgcaaagtgaggggagctgtggtgaaaagaggtg

SEQ ID NO: 6875435 - DNA, 90 bp, Homo sapiens
gcttgttttgctctcagaagcttccagtatggattgtagcatgtgttgtggccccatttgggaatcttccatggaaggagcaaagcaggc

SEQ ID NO: 6875436 - DNA, 67 bp, Homo sapiens
actctccctttgtactctgcacaattcttctggaatatagtctttgtgttcagtcaaggatcagagt

SEQ ID NO: 6875437 - DNA, 68 bp, Homo sapiens
ttatcttttggtatcagctcaatcttaccttacacatttcttaagacacgggctgatctaaagaatag

SEQ ID NO: 6875438 - DNA, 62 bp, Homo sapiens
ggagaggttaatcaggagctggaggaacgcactgcccactcagctctgtggtttgagtctcc

SEQ ID NO: 6875439 - DNA, 76 bp, Homo sapiens
ttcatagcacaatgacttgggtatcattgaattgtggacatgatttggaagatacccaattatttgctcacaggaa

SEQ ID NO: 6875440 - DNA, 78 bp, Homo sapiens
tttcatcttctattaggtcagcgtacaatgcactcacaaaatcaaagtttattgtcacgtcttaattctaggatggaa

SEQ ID NO: 6875441 - DNA, 82 bp, Homo sapiens
tctctgggcttgggaagtgtttaaagctgacttgttctcatctgtatcctgtggggttttaggacattcccatcaccagaga

SEQ ID NO: 6875442 - DNA, 76 bp, Homo sapiens
accacactggaaagttggatttcatcctcatgggactcttcagacgatccaaacatccagctctacttagtgtggt

SEQ ID NO: 6875443 - DNA, 81 bp, Homo sapiens
agattttctttatttcttcagctccctgttcagtacttgcattttgagcgttgaaatgtggagctgaagtagacaagatct

SEQ ID NO: 6875444 - DNA, 68 bp, Homo sapiens
gaatatgtgttcctggacaagagggtcctaggaaggaccagggtatcttgtgcaggcagcatatattt

SEQ ID NO: 6875445 - DNA, 61 bp, Homo sapiens
tgtggacaccaagccagcttaccaaaaccagaggcagaaagctgagggttcggtgtccaca

SEQ ID NO: 6875446 - DNA, 82 bp, Homo sapiens
gcctttgctattgtgagtagtgccgcaataaacatacgtgtgcatgtgtctttatagcagcatgatttataatcctttgggt

SEQ ID NO: 6875447 - DNA, 79 bp, Homo sapiens
gtttaaatatgcttttttccaggaagccactggaatctctaaagtgttcctggctaactgggaaaaaattgcagggaac

SEQ ID NO: 6875448 - DNA, 62 bp, Homo sapiens
tatgcctcctcaatactttcgttgaaatcctatcccttaaggtgatggtattaggaggtgtg

SEQ ID NO: 6875449 - DNA, 69 bp, Homo sapiens
gccaggagtgtcaataattgatagatattggccatattatttccactttctatcaagtattgggttggt

SEQ ID NO: 6875450 - DNA, 63 bp, Homo sapiens
gtgttgttactttctaattgtctccagtgtttggaaagactggaggaccgaggaagaaaacgc

SEQ ID NO: 6875451 - DNA, 71 bp, Homo sapiens
gggggcccctgtctgacaaccaaatgctcgtgaaaatatgagtatgcacctcactgtcaggcctggctctc

SEQ ID NO: 6875452 - DNA, 67 bp, Homo sapiens
catttactggccaacatctggggcacatttccttcccggaaaagtcacgaagttggtcagagaagtg

SEQ ID NO: 6875453 - DNA, 74 bp, Homo sapiens
atgacattattcaattctagtggagagagtttatggagctccggttccataaactctctcccctagaatttcat

SEQ ID NO: 6875454 - DNA, 69 bp, Homo sapiens
gctaagtaacaggtgcttagtttattcagtgaataaatgaataaatggaagacatctgatatctatagc

SEQ ID NO: 6875455 - DNA, 60 bp, Homo sapiens
agctcagtggctcagtgggtattcatcattcagcagatgcttactccgcagcattgtgct

SEQ ID NO: 6875456 - DNA, 56 bp, Homo sapiens
gcagaccagcccctggagctgctgacgctgcagcagcacccagcaggcaggtgtgt

SEQ ID NO: 6875457 - DNA, 83 bp, Homo sapiens
aagcctgactcttgttgagtgagtctgtggaccgggcactgtgatgggcagtgtgcgtgcacaacgtcacttaatccttgctt

SEQ ID NO: 6875458 - DNA, 75 bp, Homo sapiens
tggagaataacaatgaaccaaatttaccaattagggaaccatttcaggaattgttggatggtgaatttttcttca

SEQ ID NO: 6875459 - DNA, 61 bp, Homo sapiens
atatgtacagggatagaacttgaccagattagaaactggtgaatttttgacctgtatttat

SEQ ID NO: 6875460 - DNA, 71 bp, Homo sapiens
ggagccagtcccgagccgctgtcatggccgcgaccaccaggcggggcccccggccgagctctcgcggctcc

SEQ ID NO: 6875461 - DNA, 57 bp, Homo sapiens
gcacacactctttctcttttgaaggaattcataagttctgataaaggaggaagatgc

SEQ ID NO: 6875462 - DNA, 89 bp, Homo sapiens
ctcaaaggtaggaaccttgtgttatcttttttgttcatactgtctgagcacagtgcaggagacataatagggactccaaaaatgttgag

SEQ ID NO: 6875463 - DNA, 86 bp, Homo sapiens
caccagctgttgtccagtcagtgatggagagagtgcagcatcgtaggattctccagtcactgacttcgagattctattagtcggtg

SEQ ID NO: 6875464 - DNA, 96 bp, Homo sapiens
gtgcgaaagttcagtcaaatggttgcacagattacttgggactgcgcctgtgattcagctgtgcagtgatttgtacaattagaacagctttctcgc

SEQ ID NO: 6875465 - DNA, 102 bp, Homo sapiens
tgctatttaataatttgcaaatgttatactgccagttgatattttataactaccaaatttaagtgcagtaaatgggcattatgcttgtttaaatgtctggca

SEQ ID NO: 6875466 - DNA, 56 bp, Homo sapiens
gccagcagggcggagccatctaccacaaaaatggctgccatggctcacctgtgggc

SEQ ID NO: 6875467 - DNA, 57 bp, Homo sapiens
gtgttgcgtgagtggagtcacatagcagtactcctgtctgacttcctcacttagcat

SEQ ID NO: 6875468 - DNA, 69 bp, Homo sapiens
ggtcacaagggagcctgggcgcaagatgggtggacagcttcgtgccatctcagcttcctgctgtgttcc

SEQ ID NO: 6875469 - DNA, 86 bp, Homo sapiens
ttgtatcagtgctgctttagcagtgccctgtggaataagacacctcctgctcaatgttccctgtactgcttttaaggtgtgaacag

SEQ ID NO: 6875470 - DNA, 61 bp, Homo sapiens
tttagcctttggtccagattgctggtctgtaaggacctcactgattggaccagattctaaa

SEQ ID NO: 6875471 - DNA, 80 bp, Homo sapiens
ggcacgttaattcatgtgatcacagattgtaatataattagctccttcattaatatctgctatcagatgatggacaggcc

SEQ ID NO: 6875472 - DNA, 66 bp, Homo sapiens
aatggaaagtcaccccacactcttgggacagtgggtgtttttgtcagagcaaagggtgcctccgtt

SEQ ID NO: 6875473 - DNA, 82 bp, Homo sapiens
tcacagcctatttgcctttatatccctgatatctagtatgttgttagctaggtaatggataatgaagtgagtgagtgaatga

SEQ ID NO: 6875474 - DNA, 64 bp, Homo sapiens
gatggcatattctgttccatgcagtgtcagatggaatagttccagtgaggatagagtattcatt

SEQ ID NO: 6875475 - DNA, 68 bp, Homo sapiens
tcttgctttggatctatttgctgagctagaaatttctggactcagccttggaaatgaatcctgcagga

SEQ ID NO: 6875476 - DNA, 78 bp, Homo sapiens
gtgtggtctgaggaccaagagcagaggcatcatctgtgagcaggttagaaacccagactcttaggtcccaacccagat

SEQ ID NO: 6875477 - DNA, 80 bp, Homo sapiens
ttgttttcctgagcttcagtttcttcatctggtgatgttaacactggcttcatggggagtttgaggatcacaagagataa

SEQ ID NO: 6875478 - DNA, 57 bp, Homo sapiens
gccgatgaaaagaccaaagactctcctttatggccagtttaagggattttcaatggt

SEQ ID NO: 6875479 - DNA, 72 bp, Homo sapiens
ggatctatatagtccaggatgtgccatgtgattcaagaatgctaaaatgcacatctggagctctgtggaact

SEQ ID NO: 6875480 - DNA, 103 bp, Homo sapiens
tgaggcaggagaatcgcttgaaccccggaggcagaggttgcagtgagctgagatcacacgccactgcactccagcctgggcaacagagcgagactccgtctca

SEQ ID NO: 6875481 - DNA, 62 bp, Homo sapiens
tttcaagaagcaaattaaagtccacatgtttagtgaacttctcagtgtttgtcttcttggga

SEQ ID NO: 6875482 - DNA, 69 bp, Homo sapiens
gcagctgtcatttacaacagggatccccagccagtcacttggagccaccctgctgtgaggggcagctgc

SEQ ID NO: 6875483 - DNA, 59 bp, Homo sapiens
gagaaggtggacctgaaggagcgggtagagaaactagagcttcaattcatccacctctc

SEQ ID NO: 6875484 - DNA, 64 bp, Homo sapiens
aaagcccctctcggaatctatccagccagatggttctcttgtgttagtccagtaggggggcttt

SEQ ID NO: 6875485 - DNA, 75 bp, Homo sapiens
aaggaggaattctgagttcatgccaatctgatgttttactggtttattctagctcagaatagttaattcctcttt

SEQ ID NO: 6875486 - DNA, 119 bp, Homo sapiens
tggtggtagtatgatgtcatagaaagagccttaggcatagactgacgggcagcgtttgagtcccatctccactattttctagctctttggtctttggcagttcactaagcaagccacca

SEQ ID NO: 6875487 - DNA, 80 bp, Homo sapiens
gggactccttcatttgcatttggataattgtgcagttatatgatttgttacatggagaccagatggaagtaagagagctc

SEQ ID NO: 6875488 - DNA, 79 bp, Homo sapiens
gtgtgcacatgacagtaagtagagcagagcaggagcaacaatatagaagctgaagtgttctgaagctgcagatgcagat

SEQ ID NO: 6875489 - DNA, 73 bp, Homo sapiens
gagcctcaaagtaggggtaagccaggctccggaaggcccgggaggtcaggttacgcacctctttgtccgcatc

SEQ ID NO: 6875490 - DNA, 85 bp, Homo sapiens
gctgaacattaggtgaagtgcatcactactcattacagtattttttgacaatctatatttaagagtttagtgccacctggtcagt

SEQ ID NO: 6875491 - DNA, 56 bp, Homo sapiens
ctttgtattttatcatagttttatatgtaccataaaactgtgaagcaagtacaagg

SEQ ID NO: 6875492 - DNA, 125 bp, Homo sapiens
cctgccaggagagtctccatgcctatcttctttcctctgctgccattgccccaggggagaatgagggcctgtggggccagtagagcaggccggaggaactgggggtcagtagagcatcctggagg

SEQ ID NO: 6875493 - DNA, 55 bp, Homo sapiens
agctcatggttcgctgcagaggcgtcgtcccagaccagctctgcagtgcatggct

SEQ ID NO: 6875494 - DNA, 71 bp, Homo sapiens
atgacagatttagtctcccttatcaaggaatttacttgaaactctttgatacgagggactgaatattttat

SEQ ID NO: 6875495 - DNA, 62 bp, Homo sapiens
gacaacagctagtggtctagactttgaaatgagatattaaacagttttcctagctgtctgtc

SEQ ID NO: 6875496 - DNA, 64 bp, Homo sapiens
gatggctagaaagctactacaggaggactcaaatcactttcttatttagtagcttctggaaatc

SEQ ID NO: 6875497 - DNA, 88 bp, Homo sapiens
ggggctgtgtctccctcagagtggggctccctgaggcagggctgtgtctcccctcagactggggctccctgtggacagaaccggcccc

SEQ ID NO: 6875498 - DNA, 59 bp, Homo sapiens
gggttttccttctgcattggagtgctttagaaagaaggaagccagtgcaaggaaagccc

SEQ ID NO: 6875499 - DNA, 70 bp, Homo sapiens
agccttggccgtaaggtatgctccctaatacagaataaagggcaggatgccacagtgcggccagcaggct

SEQ ID NO: 6875500 - DNA, 116 bp, Homo sapiens
atttagcttctgtcttcccttgggaggtacaaaaggagaaagataaatgacatcagacttcctggaaaaatatacctcattctttgagtgctttttaggtgagaagttagttgaat

SEQ ID NO: 6875501 - DNA, 69 bp, Homo sapiens
caccagattctggtaatttcaagggcaggtcaattactggctgcctatagaattattagtacaaaggtg

SEQ ID NO: 6875502 - DNA, 66 bp, Homo sapiens
gtgcattaatatcctgctggctaaatattctgcttatgtgtttatacagtgcatggtgttaggcat

SEQ ID NO: 6875503 - DNA, 61 bp, Homo sapiens
gtctagtatgaatctctttattctgctgcagagcagatttgttgacttcatgaatctggat

SEQ ID NO: 6875504 - DNA, 75 bp, Homo sapiens
cctacagtctggcaggaatgttatatcattagccatatttaaactcagaaataacagccatgaagattgtaaagg

SEQ ID NO: 6875505 - DNA, 65 bp, Homo sapiens
ttgggatcaaattttaaagctaaaaatactaaactacattttttagtctggggaagggatcccag

SEQ ID NO: 6875506 - DNA, 103 bp, Homo sapiens
ggtggaagaggggacaggaaggaaatttagcttctttattttcattacatccaatgtgattctcaaaggtagactgggtctgattcttcccccatcttctgct

SEQ ID NO: 6875507 - DNA, 75 bp, Homo sapiens
gatattaacatttctggaactgtgaatagtttgtaccctctgaatagtacatacagtaccagaaatgctaagatc

SEQ ID NO: 6875508 - DNA, 62 bp, Homo sapiens
ggggagcctgcaagactggagggaggagcagggacccattcctccttttgcttgtgcttccc

SEQ ID NO: 6875509 - DNA, 92 bp, Homo sapiens
cagtccacagtgcggggaatcatggctgggcagtttgtcctctgcggcgtctttgccttgcgctgctcagcttgcctccccactgtgtgctg

SEQ ID NO: 6875510 - DNA, 78 bp, Homo sapiens
cattgtgaattctttatgactgagttgtcaattgctttctttaggcaatgagccaatgtttatgaagtagctacaatg

SEQ ID NO: 6875511 - DNA, 80 bp, Homo sapiens
tgcttcccatctccctcccacctccactcaaggtacttggaagagggctttttcgaggtgtgaggaatgaatggggagca

SEQ ID NO: 6875512 - DNA, 70 bp, Homo sapiens
ctcttgccaatggtacaaacgattctcaacaatctcagaatgagagtctttggggataattggtggagag

SEQ ID NO: 6875513 - DNA, 62 bp, Homo sapiens
ctgctcttgagggactgcggtctccggctctgcggagaactttgcgcagttcccgggggcgg

SEQ ID NO: 6875514 - DNA, 102 bp, Homo sapiens
gggctgtgggaactcagaggaaggagagatcccttctgcctggggaaatcgagaggaattcccagaggaggtggttagaactttgcgttcaagcatgggccc

SEQ ID NO: 6875515 - DNA, 57 bp, Homo sapiens
gggagacccacctgaggctcagccctagccctcagcccaccttcaggggagtttcct

SEQ ID NO: 6875516 - DNA, 76 bp, Homo sapiens
tgaaagataaagggtgctgaagtggaattaggctgggaaagctttcacactgtgatgtacgtttgctcttctttca

SEQ ID NO: 6875517 - DNA, 64 bp, Homo sapiens
aggaaattaacccaggcagcaggagctaaaggacaccaaaccagctgccaagcctgggtttcct

SEQ ID NO: 6875518 - DNA, 62 bp, Homo sapiens
agggtcgggaaatgtcctgggccacctgcaagtgtctgctgggtcctggcatcttcctccct

SEQ ID NO: 6875519 - DNA, 75 bp, Homo sapiens
cagtcttaattgggagaaagttgtttgttattttagtaaaaatctgccatgctgcaactttctcccattggactg

SEQ ID NO: 6875520 - DNA, 109 bp, Homo sapiens
acagctgttggttcaggattgtgaagcttcaatgagataattgtttagcatgtttttattccatcatgaacaccatttgtattgtgttttacagtttacaaagtgctgt

SEQ ID NO: 6875521 - DNA, 85 bp, Homo sapiens
atgtccttcatatgagtattgtgcagatgacacgagatcacggctgcagcataggcctggcactgacagggtgctcaagggatat

SEQ ID NO: 6875522 - DNA, 62 bp, Homo sapiens
aatgcaaatgaacatgttgctagttccataaatctggtacaagaatattttatatttgcatt

SEQ ID NO: 6875523 - DNA, 115 bp, Homo sapiens
gctaccctatggaaaatgaacagacatgcccctgttgagaaaggtaagaacccacaggtgttacagcctgggggagaggctgtttctgcaaagcagggaagtctgtctagggagc

SEQ ID NO: 6875524 - DNA, 78 bp, Homo sapiens
tctgccaggctgtggctccaggaaggccctctgccaggctgtggctgagagtggcctggcctggggcatggctgcaga

SEQ ID NO: 6875525 - DNA, 57 bp, Homo sapiens
cccacctcctctttagccccagctggagtccagccctccaggggttaagggggcggg

SEQ ID NO: 6875526 - DNA, 56 bp, Homo sapiens
ctagtaaagctatgattctgcctttaacaaaaaatgtgaaattgttgctttactag

SEQ ID NO: 6875527 - DNA, 91 bp, Homo sapiens
gccaggatggtctcgatcccccgaccttgtgatccacccaccttggcctcccaaagtgttgggattacaggtgtgagccaccgtgcctggc

SEQ ID NO: 6875528 - DNA, 61 bp, Homo sapiens
gagcaactttggatagttgcaggcacttctgggtggtgctttcagcagctacagggtgctc

SEQ ID NO: 6875529 - DNA, 57 bp, Homo sapiens
aactctagctcactggggattggagaacaccaagtctcagttttgctagctggagtt

SEQ ID NO: 6875530 - DNA, 62 bp, Homo sapiens
gcaatgggcaatttgcctacacacttcatgaatcaacatttattgggtgcagtgcccacagc

SEQ ID NO: 6875531 - DNA, 90 bp, Homo sapiens
ttgtgtaggagcttgttggaaatgtagattctcagatcacatccctgacctactgtatcagaatctgcatttaacaaaatctttggataa

SEQ ID NO: 6875532 - DNA, 124 bp, Homo sapiens
aaagaattttcgtgcagtaaaaaagggagatttataccaaagcacatactgtttggtttcatttatcaaactaatgcttactttaggtctgagtattttttgtttactgggttttgtgtttttt

SEQ ID NO: 6875533 - DNA, 60 bp, Homo sapiens
gtccacatagtgaggctgatacaggccgtctggtgacaggaggctgtctggcgtgtggat

SEQ ID NO: 6875534 - DNA, 81 bp, Homo sapiens
aatctactgaacagcgtggctgcagtcatttacacaccaggaagaaatagagtccctgagccactgcttgttcagtgtgtt

SEQ ID NO: 6875535 - DNA, 75 bp, Homo sapiens
agtaaatcttcacaaagccgtgctgttatttctttgctttcaccttgacagcactggagtttagtgggatttatt

SEQ ID NO: 6875536 - DNA, 91 bp, Homo sapiens
tgggttgggccactagtgactacagggactcccgcagagatatcaaatatttcctcatggagctctgtgctccctctgaaggctcttttca

SEQ ID NO: 6875537 - DNA, 102 bp, Homo sapiens
aaattaatgaataagtacaattcagctcttaacacagcttgtattagctaagtgctagaaaatataaactgaagatatggaatggcttaaacgtaatagttt

SEQ ID NO: 6875538 - DNA, 99 bp, Homo sapiens
gaggcagaagaatcgcttgaacccgggaggtgaaggttgcagtgagccgagattgcgtcactgcactccagcctgggcggcatagcgagactcagtctc

SEQ ID NO: 6875539 - DNA, 60 bp, Homo sapiens
tcaaaattttattcctgtatgttttacactcagtttgagctttaagggataaaatgatga

SEQ ID NO: 6875540 - DNA, 63 bp, Homo sapiens
ggaggactgaacagatgtggaggtaccttgtacacagcaggcactcagagttagttctcctcc

SEQ ID NO: 6875541 - DNA, 73 bp, Homo sapiens
gtgcttagattctacttcagcctgaactccttttgaaaggaaagggagaaagctgtagtggaatgtgattcac

SEQ ID NO: 6875542 - DNA, 89 bp, Homo sapiens
gctgggaaacttcccttctgcagatctttggtcttatctctaagggcaagatccaaccggtttgcaaagggagggacttagttcccagt

SEQ ID NO: 6875543 - DNA, 70 bp, Homo sapiens
gtgaggcatccaggaaacatctccgcctaaggacaaacacctgctggagaagctcctgggactggttcac

SEQ ID NO: 6875544 - DNA, 68 bp, Homo sapiens
agttagtgtgctctggttgccatgctgtgaacggttaagtgcagtgaggtattaccagggccaggact

SEQ ID NO: 6875545 - DNA, 57 bp, Homo sapiens
ctcaggaggaggaagttcattggctgaccaggagccaattagggtctctctcttgag

SEQ ID NO: 6875546 - DNA, 74 bp, Homo sapiens
attaaaagtatattttttgaagcatatatgtattaaacacattgcttggtgtgcttaatgaaatgttttttaat

SEQ ID NO: 6875547 - DNA, 58 bp, Homo sapiens
gtaggagtcaggaccaaatggaaattcccttggatttattttcctcctgacttcatgc

SEQ ID NO: 6875548 - DNA, 92 bp, Homo sapiens
tgcagctctgcttgacaacctgtctcttcttatggccgtggctgaggggttgcccctcacggacctaagaggaagattttccgggtgctgca

SEQ ID NO: 6875549 - DNA, 91 bp, Homo sapiens
ccccagcaaggtttctcaccgtgggagtggtgggtgctcagggatggctctgcagggctgagactgtaccacttcctccaacctcgtgggg

SEQ ID NO: 6875550 - DNA, 72 bp, Homo sapiens
gtagaggcagggtttcaccatgttggtcaggctggtcttgaactcctgatctcgtgatctacccgcctcagc

SEQ ID NO: 6875551 - DNA, 121 bp, Homo sapiens
aataagagcaaacaataaaattggacctgaatagtttgaatttatcagatgtcaatgaataatttcacttaatagcactggtgaaagtttaattgttcctttctagcctttggcttttatt

SEQ ID NO: 6875552 - DNA, 57 bp, Homo sapiens
agggctctttaggccgaggccaggctcctgtctgctggcctcaagtctgagggcctt

SEQ ID NO: 6875553 - DNA, 58 bp, Homo sapiens
tagtacagaattaataattgtgtctgtttgctggcacagttttatggttattgtacta

SEQ ID NO: 6875554 - DNA, 55 bp, Homo sapiens
tggcagagtaggatggccctgtagctgagagtggcaggataatccccctcagcca

SEQ ID NO: 6875555 - DNA, 56 bp, Homo sapiens
aagtcttcaggtttttcatatgagatccattttaatttctaaagaatctgaagctt

SEQ ID NO: 6875556 - DNA, 57 bp, Homo sapiens
tgggcctgttgcctgagtccatcctcaaaagggtgacagcaccaggcaacacgccca

SEQ ID NO: 6875557 - DNA, 76 bp, Homo sapiens
gatcctgccttgctcattccgtgagaagatccttgtaccttaagaaagcagagatacgggaagagcaaggtggctc

SEQ ID NO: 6875558 - DNA, 78 bp, Homo sapiens
aggagttgaagcttgaggtgggccttgaaaaatggtgagtacatttgttattctctgcctacaagtctacaacctcct

SEQ ID NO: 6875559 - DNA, 64 bp, Homo sapiens
gttcagatacagctagctccgtggcttggctctcccggccttgagcccgctgtggtctgtgagc

SEQ ID NO: 6875560 - DNA, 68 bp, Homo sapiens
gagaaatcttgcactcctttctcctagttcatcagctaactgaatgcagagaaaccagtggaggactc

SEQ ID NO: 6875561 - DNA, 129 bp, Homo sapiens
gactaaagggccttacatggaagagcaatgtgggagatggcatttttagacagtccttttggctacgatgtgagaatacacagaaggatgaagggcctcttctgtaaagcaaacaggtggagccttgtc

SEQ ID NO: 6875562 - DNA, 77 bp, Homo sapiens
gcagcatagctgagtagtcagggatcagagccagttcatttagattctaattttgactcttgtctcttgttagctgt

SEQ ID NO: 6875563 - DNA, 67 bp, Homo sapiens
tgatagctgtacacattttgcgggtacatgtgatatttttatacatgtatacaatgtgtaatgatca

SEQ ID NO: 6875564 - DNA, 55 bp, Homo sapiens
tctttcttcctggagcccaacacctcggaggagaatgggaaacccagaagaagga

SEQ ID NO: 6875565 - DNA, 76 bp, Homo sapiens
ggtcaaggcaggcagttcacttgaggtcaggagttcgagaccaggctgaccaacatagtgaaagcctgtctttact

SEQ ID NO: 6875566 - DNA, 57 bp, Homo sapiens
gcccatggtggcgttcggtgcatcttagagtcctctgatgttctagcggcaccaggc

SEQ ID NO: 6875567 - DNA, 56 bp, Homo sapiens
tttcctcaagtctgaaacaaaagctcagagtgtcttctatgtttcacttggggaaa

SEQ ID NO: 6875568 - DNA, 120 bp, Homo sapiens
gtttagcaaaaacctgaatgttttatagagaagtcttcattttgaagaggcagaaaccaactggatttagcttaaatggagaaagaggagatttatttttaggacatagggatgtctaac

SEQ ID NO: 6875569 - DNA, 80 bp, Homo sapiens
tagttggccaccttgaggttcctgacggtgaggaagaggtgcagcccttccaggagcatccaggtgaagcaagccaggta

SEQ ID NO: 6875570 - DNA, 76 bp, Homo sapiens
gggaagtgtagtcttgagcccccaagattccttttctgttctatggagtgggcccgcgcaaaggactccatttccc

SEQ ID NO: 6875571 - DNA, 63 bp, Homo sapiens
tgtcttgggtgttttaaaactagattctttactagaactgttgcaaaaaaaagcccagtgaca

SEQ ID NO: 6875572 - DNA, 63 bp, Homo sapiens
gagtctgttggagcctaggatgacagcaaactgaaaggctgacagatcttggcccaacaattt

SEQ ID NO: 6875573 - DNA, 64 bp, Homo sapiens
ctctgtcaacaccaaagcctcccagaagtggtgatacccctgaggataactggtgctgacagag

SEQ ID NO: 6875574 - DNA, 61 bp, Homo sapiens
gtgagactctggggctgcagaatgacttgataatgtcaattctgagaagggtgggtctggc

SEQ ID NO: 6875575 - DNA, 79 bp, Homo sapiens
gggacgagagagacataggagtttttattctggtaatttatgtttaacagaagcattgactccttgctcttcttcttcc

SEQ ID NO: 6875576 - DNA, 77 bp, Homo sapiens
atggtgggaaagtagccttaagtgtgccttgacacaagctatcttggtcatttggggctgctataacaaaacaccat

SEQ ID NO: 6875577 - DNA, 60 bp, Homo sapiens
ctctctcatctggaaagcagaagaaaaattaagcaagtctgttctgcactcctgagagag

SEQ ID NO: 6875578 - DNA, 130 bp, Homo sapiens
gcccggagccgagcatggagcccggccgaggcctgtctcggaagtatcctctgtggccctccctgtgcccgagcagagtgagccgaggctgctctccagcggctgcacctcagtgctgtggctccgtggc

SEQ ID NO: 6875579 - DNA, 67 bp, Homo sapiens
gcattgtggaaaatacagtcttgaacaagggcatttgtggaccaagatttatattttcacacaatgc

SEQ ID NO: 6875580 - DNA, 55 bp, Homo sapiens
acctagagtagtcaaattcatagaaacagaaagtggaacagtgattgcttggggt

SEQ ID NO: 6875581 - DNA, 89 bp, Homo sapiens
gatgttcgatgccaagaacatgatggccatgtgcaacccgcgacatggccgctacctgaccatggccaccgtgttccgggccgcatgtc

SEQ ID NO: 6875582 - DNA, 83 bp, Homo sapiens
agttgatgactgcttgtctagaatatcccagcctttcctggataactcctccctgttattcaagacaaaggcagtcatcatct

SEQ ID NO: 6875583 - DNA, 74 bp, Homo sapiens
gggaaccacagagttgatgcaataagacaaatgtgagagcttccaatcttgttgtaacagcctctaatgttccc

SEQ ID NO: 6875584 - DNA, 83 bp, Homo sapiens
aagctatagatgtttattaaaactgttggctctgtggtttaaagcagaccttgggggattgttttaatgaataggcaaggctt

SEQ ID NO: 6875585 - DNA, 56 bp, Homo sapiens
tgggacacagaaaaggcaggttataatactgcttggaaccttgccgtttgtgctta

SEQ ID NO: 6875586 - DNA, 78 bp, Homo sapiens
agtccttggttggacctgacagcacgctccagtcttacctttcactggtagcacagcagcgtctaaccgatagggact

SEQ ID NO: 6875587 - DNA, 55 bp, Homo sapiens
gcagaggctgggtgtcccagtcatcctagttggcctggaccaccctcctctttgc

SEQ ID NO: 6875588 - DNA, 66 bp, Homo sapiens
gttaacgaatgcctgcctgtcacatgtggggcctttattttgtgttcagcaggcaccttctttgat

SEQ ID NO: 6875589 - DNA, 95 bp, Homo sapiens
gtcctaaagtacacctaccttctcactacatttgaactgtgttgggcaggatacatgcagtggcaatgggagtggagacagggaggaaactggat

SEQ ID NO: 6875590 - DNA, 73 bp, Homo sapiens
tttttcctgaatggcgagttagttagttagaataacttctctcagattaaactattgctattttaagggagaa

SEQ ID NO: 6875591 - DNA, 63 bp, Homo sapiens
ctgggcatgctatgaacacaggcttgtcagggactctgaaaacctgtgccaaagtgtgttagg

SEQ ID NO: 6875592 - DNA, 63 bp, Homo sapiens
tgctactacttgtcaacggtcacaatacaccaaatttaggactttaagtggcaagtgctagta

SEQ ID NO: 6875593 - DNA, 67 bp, Homo sapiens
tcttctgctggcattgcataggcagtttgttaagaaggctaactccccaagttctgctgtcagaaga

SEQ ID NO: 6875594 - DNA, 79 bp, Homo sapiens
aggcttaagtgcagtggtacaatcacagctcactgtagcctcaacctactgggctcaagtgattgtcctgccttagcct

SEQ ID NO: 6875595 - DNA, 56 bp, Homo sapiens
tcctgagggctgcagtcataggggaccctacacttctatgagtattactttcagga

SEQ ID NO: 6875596 - DNA, 64 bp, Homo sapiens
gtgaaagaagtcttgtctaaggtctctaaagtcacattttaacctagtcagggctttgaatcac

SEQ ID NO: 6875597 - DNA, 59 bp, Homo sapiens
ctcctgggctggggagggcacgctgcagcctgcactttgtctccagaaagcaccaggag

SEQ ID NO: 6875598 - DNA, 68 bp, Homo sapiens
ctgtaatcccagctgcttggagggctgaagtaggagaattgcttaatcctgggaggcggaggttgcag

SEQ ID NO: 6875599 - DNA, 62 bp, Homo sapiens
ggttcttcctttactagcctccacatgaaagagttacctatgtctcagaggcaggaagagcc

SEQ ID NO: 6875600 - DNA, 81 bp, Homo sapiens
tggcaggcatccagcaggacgtccaagtgctatcttccaaactctagactagtcttccacttctatgcgagtgtcgtgtca

SEQ ID NO: 6875601 - DNA, 64 bp, Homo sapiens
ctgcgtggagacatgcatgaatgcaggtctctcaaacgagggtccacatggtatgtcagcgcag

SEQ ID NO: 6875602 - DNA, 82 bp, Homo sapiens
gagtttttgttaggaaatttcatttgaggtctgaaaatccatctctagacctacattctggattttcacataattaaaactt

SEQ ID NO: 6875603 - DNA, 68 bp, Homo sapiens
cattgctctatgtactaaaactgtgtgcatttaatgggcacaattttgttgtcatggaggttacaatg

SEQ ID NO: 6875604 - DNA, 65 bp, Homo sapiens
tgtggcatcattttggataaacattgaaaatatctaaagtgtaatctattcaggatgatggcaca

SEQ ID NO: 6875605 - DNA, 69 bp, Homo sapiens
gattaatgcttgcctaggttacagtgaaggtactcatgtttcactgtgctctctagataggcattaatc

SEQ ID NO: 6875606 - DNA, 80 bp, Homo sapiens
tcccctgggagagttgggtgggtcaggactcggagtaggtggcgccttttaaaagtccccccacgtgttcccaggaagga

SEQ ID NO: 6875607 - DNA, 80 bp, Homo sapiens
tttcagcttgaatttcatttgtttcctaccatttctcttcatattattagtggtggtaaaagttaataaaatagctgaaa

SEQ ID NO: 6875608 - DNA, 56 bp, Homo sapiens
gggcccatcacaaccaagggcagccagctgctgttcctctggcttgtgctgtgccc

SEQ ID NO: 6875609 - DNA, 56 bp, Homo sapiens
ggcatagcttccagaatttaatgtcaaaatattttggcttcctggaagaatgtgct

SEQ ID NO: 6875610 - DNA, 58 bp, Homo sapiens
gccatggaaatgctttgcgtctctgccaaagaaaagttttgaccagagttttccatgc

SEQ ID NO: 6875611 - DNA, 73 bp, Homo sapiens
caggctgttggaaggccagcaccttgagtcctttatggaggaccccacgggcttctttcaacttcaacccctg

SEQ ID NO: 6875612 - DNA, 86 bp, Homo sapiens
aagctttagggtacatgtacacaacgtgcaggtttgttacatatgtatacatgtgccatgttggtgtgctgcacccattaacgctt

SEQ ID NO: 6875613 - DNA, 63 bp, Homo sapiens
gcccaagatcacactggaaatcctgaccatcggctagtcctgaactcagatgtgatttggtgc

SEQ ID NO: 6875614 - DNA, 65 bp, Homo sapiens
ttagtaatcgtggtggttaattccatgtgtcaacttcactgggttaagaatgttacgatagctgg

SEQ ID NO: 6875615 - DNA, 70 bp, Homo sapiens
gggaggtatctacaaagactgcagctttttttggctctgagcactgggcagtcggtgagggtatattctc

SEQ ID NO: 6875616 - DNA, 71 bp, Homo sapiens
caattttgttgctctattaccattctagattcaccagctgtttcttgattggttgtatagctactagattg

SEQ ID NO: 6875617 - DNA, 93 bp, Homo sapiens
ctggttacaaatgcttctgtgttacacatcagtctttagaggtttgcaggtatctgttgcctgcagagattgaacaagaaggaaaactgccag

SEQ ID NO: 6875618 - DNA, 83 bp, Homo sapiens
gtactggtagtgcactgagctgatttcaggtgccgcaacttaaagagaatgtgaggaaattggagtggttcagggaccagtat

SEQ ID NO: 6875619 - DNA, 64 bp, Homo sapiens
accaggcagtatggtgctgcaaaaggtgcttcaggcgctgcatgcagacaccaatttcctgagt

SEQ ID NO: 6875620 - DNA, 61 bp, Homo sapiens
cctaggggaggggatcatgtgctgcacaaaccatgtgtgtatattgttctgtctcttcagg

SEQ ID NO: 6875621 - DNA, 99 bp, Homo sapiens
gtagggacagggttttgccatgttgccaaggctggtatcgaactcctgagctcaaccaatgagaccagcctggccaacatggcaaaaccctgtctctac

SEQ ID NO: 6875622 - DNA, 59 bp, Homo sapiens
ccttctatggagatctcctttggggtctaggcaaatccctggagtaaattcttggaagg

SEQ ID NO: 6875623 - DNA, 66 bp, Homo sapiens
tgagggcacctgggattaatggcaaaggcaatcctcagagcacctctctccagatcccagtcctta

SEQ ID NO: 6875624 - DNA, 65 bp, Homo sapiens
aggggacctttgtctcatgtcacattaaatgtcttgcttggtggtccatcatgcagagctcccct

SEQ ID NO: 6875625 - DNA, 85 bp, Homo sapiens
gggagacaaagccccatccacccgcagtgcattcattcatggaggaataaatgtgtgttggctggagagggcttttatattactc

SEQ ID NO: 6875626 - DNA, 55 bp, Homo sapiens
gattatattggtggcttcaatgtagataatgctaggtttagctccaaatatgatc

SEQ ID NO: 6875627 - DNA, 82 bp, Homo sapiens
caggttccccaagggcatttggctcaacctaagtaagagaatatgaatttgagggagaaagccgaggtgtctggggagtgtg

SEQ ID NO: 6875628 - DNA, 60 bp, Homo sapiens
gtagctgtgtgactttgggcatgtcattgatcctctctgagcctcagtcacatggcctac

SEQ ID NO: 6875629 - DNA, 56 bp, Homo sapiens
atacaagtggccacttgaattctcaaaaagtccattgtgaattcagttatttgtgt

SEQ ID NO: 6875630 - DNA, 112 bp, Homo sapiens
tgtctttctctaacaataccgtctgaaaattttccagctttggaaaacctgctttctagggtattgcagaattcgctggaacatatgcctcaaattattgctgagacagata

SEQ ID NO: 6875631 - DNA, 60 bp, Homo sapiens
ggagagggacaggcaatactgagggagtagtgttcttgagtaagttccaggttgctcttc

SEQ ID NO: 6875632 - DNA, 56 bp, Homo sapiens
ggcatttagtggctgtaatcacctttgggggaaaggaaaattgcccactggacacc

SEQ ID NO: 6875633 - DNA, 67 bp, Homo sapiens
ttctttccttgcctcagtgaagttttacagtcaatgcggggttccatatttaaggcagggggtagaa

SEQ ID NO: 6875634 - DNA, 66 bp, Homo sapiens
gtgggaggatgcgtaagtgtttggagacgctttctgctctggctttgctcatgcatccatttctgc

SEQ ID NO: 6875635 - DNA, 63 bp, Homo sapiens
tttctaggtcttccatactgccatactgcccccacttccaggcagacgtagggaaaccagaag

SEQ ID NO: 6875636 - DNA, 61 bp, Homo sapiens
gtggcctcatttggaaatagggcctttacaaagaaaggcaatcaatttaaaatgaggtcat

SEQ ID NO: 6875637 - DNA, 79 bp, Homo sapiens
tccctgcacagagttcaaatctgtatcaatttgtactctgcttatctgagtacaaattgatacaggttttctgtgggga

SEQ ID NO: 6875638 - DNA, 84 bp, Homo sapiens
ggaaccaaaagtgtccagattatgaagaaatactgttttaataagttatctctcttcagtatttggataacattttgagggccc

SEQ ID NO: 6875639 - DNA, 74 bp, Homo sapiens
ttcagaacttttctttcagctttaccattccatgattctaacatcgttggttggtaactgagaggggatgtgaa

SEQ ID NO: 6875640 - DNA, 79 bp, Homo sapiens
gagtaatgcgagagtggaaaggaagcctttctaaagtgagagaaactgtaatctaggtttcttttgcaccttgcagctc

SEQ ID NO: 6875641 - DNA, 67 bp, Homo sapiens
aagcaggagatagaattgaggaagttcctggctagttccttctccttgctcagtctgtctccagctt

SEQ ID NO: 6875642 - DNA, 58 bp, Homo sapiens
gaaactgcctcctgggcaactaagctaagaaagctgttgctctcatctggctggtttc

SEQ ID NO: 6875643 - DNA, 101 bp, Homo sapiens
ctgctgaagtcccatgggggcagctcccttagtccttgccgggagataacaggtgtttccagttgcatgagggtgctgaggcccccagtgagaaccagggg

SEQ ID NO: 6875644 - DNA, 70 bp, Homo sapiens
ggtagggactcttctgggaagctgacatgtatccagtagggtagtttagcaattccaggtaagttatgct

SEQ ID NO: 6875645 - DNA, 120 bp, Homo sapiens
tgttgtttaagctacccagtttgtcatactttgtcacagaagccctcgcaaactactacataagtggtccatgtccattctgtcctagcaaataggcaaacttcttttgttttgatgaca

SEQ ID NO: 6875646 - DNA, 65 bp, Homo sapiens
tctccatgaaggaatagaatgggttctccttgaaaaaggtcaacccatctctcctgtcatgcaga

SEQ ID NO: 6875647 - DNA, 60 bp, Homo sapiens
ccagctgcccatcctgggaaatgtatggatggtggcaaatatacccactggggtagctgg

SEQ ID NO: 6875648 - DNA, 91 bp, Homo sapiens
gtggcctgaaggcctttggcagcctctgctattgacagtaagttctgtagattttgtgaactggttgtgaaaggtttttctgaggagttac

SEQ ID NO: 6875649 - DNA, 74 bp, Homo sapiens
tctcccattatgtcaggactcttcttggaatgctgactgtgttttgtagagtgcagccctaggaagatgggaga

SEQ ID NO: 6875650 - DNA, 71 bp, Homo sapiens
tttgtaataagcttttaaagctactttgatatcttaaatagaggcaaggttaaagagcttataaatacaaa

SEQ ID NO: 6875651 - DNA, 89 bp, Homo sapiens
ctggctaaattggcagattctgaacaaagcctggccctgacaagtcttcagaaaaaccggttttcacctccagaatgtgccccaggcag

SEQ ID NO: 6875652 - DNA, 125 bp, Homo sapiens
tgcaggttcttaaacacttattttatgagtcttttaaagatttagggccagtttacattcctgaggatgtttctgtctttgagtttgaatgagatgctctgatttatggtttggtttatcctcca

SEQ ID NO: 6875653 - DNA, 66 bp, Homo sapiens
ttctggtgtcatggacctggtgccttgagccaacctgggatgggcaatgtctgtggccactaagaa

SEQ ID NO: 6875654 - DNA, 112 bp, Homo sapiens
ggcaggtggatccgtctgcaggcaggaaagagctgatgcatttcaaccgcatcctgtgtaatgaaggccagctctttatcagcctgcctggccctggatttttatctctgcc

SEQ ID NO: 6875655 - DNA, 59 bp, Homo sapiens
caactgcttggaggaatactgctgcatatatcttttgtgttttccttctgagtatgttg

SEQ ID NO: 6875656 - DNA, 95 bp, Homo sapiens
cccatcatccaaccctgtttccaaatgatttgttcttagtatgcattgtttttctcaaaaacaattttatttggagcagaaacagtgataatggg

SEQ ID NO: 6875657 - DNA, 103 bp, Homo sapiens
gagctgcaggctgaagtgggggtaatgagaacagggaccctggaaagcacacatgtatgtcgtccaccagttcaccttgtagcatttcccccaccaaccgttc

SEQ ID NO: 6875658 - DNA, 69 bp, Homo sapiens
acagcgatgcccttctctttgctggatactggctttcccagcatccctggcagctaagggtggtcatgt

SEQ ID NO: 6875659 - DNA, 57 bp, Homo sapiens
tggtggacctcatcagaaccggacattgctgtcacggatttgactgaggtcctgcca

SEQ ID NO: 6875660 - DNA, 118 bp, Homo sapiens
cctggaaggccaccataacttctggatcctgcatggctgcaagaacctctggatcactaagaatttcattgaatccaggcattccagccattccagacatgccccctcccattccagg

SEQ ID NO: 6875661 - DNA, 62 bp, Homo sapiens
gggactggccggcgctgaggcccgcgggccggcgcagcgtggccttcggagccggtcggctc

SEQ ID NO: 6875662 - DNA, 94 bp, Homo sapiens
actgcatcctcttcaggctagaagcctccacgatagggttttagtactcactggagctcagcgggtggtttctggctgtcaggataaaggcagt

SEQ ID NO: 6875663 - DNA, 95 bp, Homo sapiens
aatttactcattcacattgtgcagattatggtcgctcttctctcacaattattttgcaaccttgtttagcatatgtgactgatagtgggtgaatt

SEQ ID NO: 6875664 - DNA, 61 bp, Homo sapiens
tcatggagaggtgtgttcttgaagttttcccaagggaaagaatctatatatcaccaccaga

SEQ ID NO: 6875665 - DNA, 83 bp, Homo sapiens
acagttgagaagatgaggttgacattttgtgctaagtatgagacataatagctgaatgtgaccttaaagattttcagatctgt

SEQ ID NO: 6875666 - DNA, 84 bp, Homo sapiens
ctgaatagtaagtgctgaataacagtagaaatttaatccactagctttaggatagggtttctgttatctgcattagcttttcag

SEQ ID NO: 6875667 - DNA, 85 bp, Homo sapiens
ggaggagcatttctaaggaatgcagtatgactttggtgggctcacggttctcagtgtttacatgcatccttgaatgtgctgcttt

SEQ ID NO: 6875668 - DNA, 130 bp, Homo sapiens
aagagatgaagagtgaggagcatcgccaaggggcatctttctgggttacaagaagcaaaaacaaatgcaatgcctatttcttaagcatttgtcttgtgccaagtgctccacttggctcctctcatttcat

SEQ ID NO: 6875669 - DNA, 70 bp, Homo sapiens
ttggacagggaagtccatgggggcggtggggcacaggttccatggccgactggtttaccactgtattcaa

SEQ ID NO: 6875670 - DNA, 105 bp, Homo sapiens
ctcttaattatattaaagctaaacacttactatgtttttctcgggttaataagaaaaactatttttgcaactcttgaaaagcattggatttgaaaggatagagag

SEQ ID NO: 6875671 - DNA, 55 bp, Homo sapiens
ggaccttatagattctctgtagctgcttggcaacagaaatcatttgtaaggtacc

SEQ ID NO: 6875672 - DNA, 81 bp, Homo sapiens
tcgtttatcagaatgttattgtgtttgttcagggcaaagttgcttttagatgggcaggatagtgttgaatttggtagagga

SEQ ID NO: 6875673 - DNA, 87 bp, Homo sapiens
tattaccgttctgacagatatgttgggttcttgtttgtagtctctacaacaataggacctttatgttctacaaagaaattggtaata

SEQ ID NO: 6875674 - DNA, 55 bp, Homo sapiens
ggccctcattcctgatgtggcgccctccagacatggctgcccaggaaggacggcc

SEQ ID NO: 6875675 - DNA, 58 bp, Homo sapiens
tgagatggagtcttgctctgttgcccaggctggagtgtaatggcgtgatctctgctca

SEQ ID NO: 6875676 - DNA, 55 bp, Homo sapiens
ggttctgtgtgaatggtatttaaaacagaagcagataccatttgccaaaaggatc

SEQ ID NO: 6875677 - DNA, 65 bp, Homo sapiens
ctgtttagttttcttcctgcaattggcatttaaaagaaatgagcaattaggaagaaaacaagcag

SEQ ID NO: 6875678 - DNA, 63 bp, Homo sapiens
tccatggggcaagagaggaagcagtccacctgatgtgggcagggatctcttttgcaagtgtga

SEQ ID NO: 6875679 - DNA, 56 bp, Homo sapiens
gggtcagcgatttcaggggcagtccctttcactgcttaatccaacctggctgactt

SEQ ID NO: 6875680 - DNA, 88 bp, Homo sapiens
gccactaatccaattaagaaagttcagcttcccaggtcactgaaggaaaatgtctctcaggagaggtttggacatgatagattaaggc

SEQ ID NO: 6875681 - DNA, 66 bp, Homo sapiens
accccgccaactggtacccacaggtcaggatgaggggggcatgtgggaagaggccagctggcaggt

SEQ ID NO: 6875682 - DNA, 78 bp, Homo sapiens
gttcagaacaggctcacatctgcgctctgcctcatatgagctgtgtgacttagggcaggtgagatggcctctctgaac

SEQ ID NO: 6875683 - DNA, 61 bp, Homo sapiens
ggctccattaatgagcaaagacagttatactgaccagtcttgaaattctgttaaaggagcc

SEQ ID NO: 6875684 - DNA, 55 bp, Homo sapiens
tctcctgggagagtttgattcattaggtctataatttaacagactccccaggtga

SEQ ID NO: 6875685 - DNA, 79 bp, Homo sapiens
gttgcctaagtgtttaacggtgattgagcggggacgttgacggtacaaacactgattgaatttaccactggagggcaac

SEQ ID NO: 6875686 - DNA, 79 bp, Homo sapiens
aaggaagggtcagtggtatttgagagaatggataacttgaagttgtccaaattccacagatttctctatttccattctt

SEQ ID NO: 6875687 - DNA, 80 bp, Homo sapiens
tgggcctccctagtctctctctctgtatgtcttaatctcctcttcttataaggacactcatcagattagattagggccca

SEQ ID NO: 6875688 - DNA, 72 bp, Homo sapiens
cttggtgactgttttgagcatgtgggggtgagctgggtgactcgtcccccaggctctgacacaggagctggg

SEQ ID NO: 6875689 - DNA, 57 bp, Homo sapiens
ccaggtagccaaggggtctgggagagggataacttcatccagcaccatggcatctgg

SEQ ID NO: 6875690 - DNA, 77 bp, Homo sapiens
ggttttttgtccttgtgatagtttgctgagaatgatggtttccagcttcatccatgtcactacaaaggacatgaact

SEQ ID NO: 6875691 - DNA, 57 bp, Homo sapiens
atattacttgcatttattgaatgtacttcatgtggcaggcattgatgcgagttctgt

SEQ ID NO: 6875692 - DNA, 75 bp, Homo sapiens
cagaccactatttctattgcatgtgatagaggcaggagataactcctgtaaaggtgacaggcaaagaatgggatg

SEQ ID NO: 6875693 - DNA, 57 bp, Homo sapiens
gcagtacaaactaaatctcctgctggtaaacactaggatgtttggcgtttgaattgc

SEQ ID NO: 6875694 - DNA, 55 bp, Homo sapiens
tcctgctggaaacttcctcttgccaagatccacttgggaaatttccattccagga

SEQ ID NO: 6875695 - DNA, 58 bp, Homo sapiens
aggatgctgggcatagtctgattctggcttgtagaagcacggttttgtctagcacact

SEQ ID NO: 6875696 - DNA, 76 bp, Homo sapiens
gcatcaccatctctgtgaccttcacctgtgcataattgggatgaggtgaaggtggaacgcagagcatgggatatgc

SEQ ID NO: 6875697 - DNA, 71 bp, Homo sapiens
gcttttcatgcagaggaaggctagtttcctcaaatcttggagagcaagctacttccactgataagagaagc

SEQ ID NO: 6875698 - DNA, 62 bp, Homo sapiens
ccagataataatatgacttcactgctgaggttgagggggtgttagaaatattatagtcctgg

SEQ ID NO: 6875699 - DNA, 61 bp, Homo sapiens
gtcatggtgctcatcattggtggcttcatccctttcctcctctctgtgtgggttccatgac

SEQ ID NO: 6875700 - DNA, 101 bp, Homo sapiens
gagagaggctggtaggaggagagctgtcgtccaggtggggtcatcattcatatggatgctccccctggcaggctggcctctcagctccctcaccctctgtc

SEQ ID NO: 6875701 - DNA, 62 bp, Homo sapiens
tgttgagcagtcagccatgttcctgggattatccttcctttggagcatctgtctgctgtgca

SEQ ID NO: 6875702 - DNA, 82 bp, Homo sapiens
ctgctggaaggagcggagcctgctttcctggctgtggaatgacggggtcaaagcgagttcaggctttgctttaattgagtag

SEQ ID NO: 6875703 - DNA, 89 bp, Homo sapiens
ccccgccagccggacctgagggattcctttgatggcgggctctctttgtgtgagcggaacaaggagccctctgtttgggctgagcgggg

SEQ ID NO: 6875704 - DNA, 70 bp, Homo sapiens
tctggacaaccaagaacagagggaaagaggcagagcactctttggagaaaagttcttgggcttgtccaga

SEQ ID NO: 6875705 - DNA, 71 bp, Homo sapiens
agtcggtgttgttttcagccattaaatttgcggtaatttgttacagcagcagtaggaaataacacaggatt

SEQ ID NO: 6875706 - DNA, 74 bp, Homo sapiens
tttttctatcttgttttggcctccagggcgattgattagatttcctctgtagctgaaccaactcgatggagaag

SEQ ID NO: 6875707 - DNA, 129 bp, Homo sapiens
aagtagcttagaacagcagatatttgttgtcttacagttctggaggctccacatctgagatcaagatgtctgtagggttggttccttctgagggctgtgggagagaatcgcttttgtgcttttgctctt

SEQ ID NO: 6875708 - DNA, 108 bp, Homo sapiens
gctgaggtgttcttataacttgttctagcgagggacctagggatttctgagtctcttttttgcattcaccccaaattcccagtggaataggttactggaaaccatagc

SEQ ID NO: 6875709 - DNA, 65 bp, Homo sapiens
gtgcattagtttcctattgctgctgtgacaaattaccacaagcttagtggcttaaaacaatgcat

SEQ ID NO: 6875710 - DNA, 59 bp, Homo sapiens
gccactgtcatttcctgaatgctgagtcaaaactactctgtacgcaagagatggagggc

SEQ ID NO: 6875711 - DNA, 129 bp, Homo sapiens
acatgtggttatttgtaaaagtgcactgactttggagtcagctagacctgtgttcaggaccctctaagtctgaccctgagctcaatgtcctgagtctattgttttgcatttgaatcataactccactgt

SEQ ID NO: 6875712 - DNA, 57 bp, Homo sapiens
tccttgctgtgaattctgtcagttctatggagaaagtgcagagcctcactgcaaggg

SEQ ID NO: 6875713 - DNA, 59 bp, Homo sapiens
cactgcactccagcgtgggcgacagagcaaaactccatctaatcaggctgggtgcagtg

SEQ ID NO: 6875714 - DNA, 80 bp, Homo sapiens
ctcggtggtggcactgacacctggctgaggtcaccagtagctgagagactccttagctagtgctcagctgtcacactggg

SEQ ID NO: 6875715 - DNA, 103 bp, Homo sapiens
gagagagaggggagcaacagctgggtgctgctcagagcccctaactgaaatggatagacaggctcatctgggaagatctagtttttgttcatttctttttctc

SEQ ID NO: 6875716 - DNA, 56 bp, Homo sapiens
tgcacaagctttgtgatagtagagatctccttctattctgggttcaaagctttgta

SEQ ID NO: 6875717 - DNA, 75 bp, Homo sapiens
gagtgtgagttcatctccctcctggatacctggtgtgcctcaggccttgggagagggtagattttatcacagctc

SEQ ID NO: 6875718 - DNA, 58 bp, Homo sapiens
agtcacaggcaagagggctccagatttaggtctttggttctcagccctgccgtgtact

SEQ ID NO: 6875719 - DNA, 129 bp, Homo sapiens
agcctaacatacatcacctgactgcttaatttatacatttattattcaactatgtattgagctacaactatgtatcaggcactggctgagtgatggggatagagcagtcaacaaaatgagacaacagct

SEQ ID NO: 6875720 - DNA, 66 bp, Homo sapiens
ctggcacaagttgtctccatgcagtgaatgcactattagtttaaacactgtgggacatcttactag

SEQ ID NO: 6875721 - DNA, 96 bp, Homo sapiens
aaatttatgtatcacacatggttaacagttttgagttttgcttcaaataggtcacccgaagagatggaagaattgtaaacttgatattttaaattt

SEQ ID NO: 6875722 - DNA, 74 bp, Homo sapiens
caacacaggcttgaaagagtattcatgaggacctaaaagccctaagttctaggtagtgctctttccctgagttg

SEQ ID NO: 6875723 - DNA, 80 bp, Homo sapiens
catcagagtgctaagagagataatctgaaatgaaatgagatggattattctagaacagaggtttctaaagtgttttcatg

SEQ ID NO: 6875724 - DNA, 75 bp, Homo sapiens
tgtgggacaagccactgagtaatcgttctggaaaaaaaccataatgaactcttctggttatttttctgttcggca

SEQ ID NO: 6875725 - DNA, 75 bp, Homo sapiens
gcatattgttgtggttttaatattcagtctagatatcttttccttttatttagagtattttaagccattatatgt

SEQ ID NO: 6875726 - DNA, 58 bp, Homo sapiens
ggcttctgtctcaagcaccagcataatctggtgccatgtactgagatatgaaactgct

SEQ ID NO: 6875727 - DNA, 67 bp, Homo sapiens
ggctgcaagcacagactccctctgagtgtgaatgttatctctcaccagatgagggatgtgctcagcc

SEQ ID NO: 6875728 - DNA, 55 bp, Homo sapiens
tgcagaacaatgagagctgagagccactgctttaaaacagacactctgctctgca

SEQ ID NO: 6875729 - DNA, 126 bp, Homo sapiens
actttgcaaataagaaactctgtagtcaaaatcttggcaagaaaatactatttaatttctaaagtgaaatttgggagctgtcatcagtgttgtcatgccatgattttgttagctacttgagtgagt

SEQ ID NO: 6875730 - DNA, 63 bp, Homo sapiens
acaggtgagacatcttgggaagtgatgtgagagcaattattctttttaaaatgttttgtctgt

SEQ ID NO: 6875731 - DNA, 75 bp, Homo sapiens
atacgtgggctcatggagacttggctccaccttgatgacagctaggatggtaccatttcccaggagtgtgagtgt

SEQ ID NO: 6875732 - DNA, 63 bp, Homo sapiens
gccacactgcttctttgagcctgtggcccggcaaggtagtcaggctcatgggattaggttggc

SEQ ID NO: 6875733 - DNA, 68 bp, Homo sapiens
gcagctagtccagttatgtggcttcagtgctttaagcaccaggatttgaacatagctggctacactgt

SEQ ID NO: 6875734 - DNA, 69 bp, Homo sapiens
ttgtcttttattttctatgaagtgcaattaactgtcagatacatttgttgccattcatggagaaggcag

SEQ ID NO: 6875735 - DNA, 62 bp, Homo sapiens
gtgcactttgggagtctcagtggtacccagtggcgggggccgtggggcttggccaaggtgac

SEQ ID NO: 6875736 - DNA, 81 bp, Homo sapiens
tttctaccttgctgagtccatgtaagatagattaccttcatggctgtttccagttacgtggataaagggaggagatagaaa

SEQ ID NO: 6875737 - DNA, 104 bp, Homo sapiens
ggaaatcactggtcactgtacctggcacagagtgagcattcaactcatttattcaacaaaaattgattgagtacttactatgtgcaggtaccgatccatgttcc

SEQ ID NO: 6875738 - DNA, 59 bp, Homo sapiens
gttggaagaagactgtaaattatgctaattataaagcccgtgaatgatcatcttccagc

SEQ ID NO: 6875739 - DNA, 59 bp, Homo sapiens
agaggccacggaagggagctgtgtgctcagaccttgtacatcaacctcctgtgggctct

SEQ ID NO: 6875740 - DNA, 62 bp, Homo sapiens
tatccttcttaaagtcgcatttggcctttcactaggaagggtgcaactaagaagaggtgata

SEQ ID NO: 6875741 - DNA, 63 bp, Homo sapiens
cagtcctctctgtgtctgcaccctatgaccagtgtgggccatgccagctcagagttaggactg

SEQ ID NO: 6875742 - DNA, 57 bp, Homo sapiens
acagccagagcttcggctgaatcctaagcctgctgcagggaccccgaggctctctgt

SEQ ID NO: 6875743 - DNA, 103 bp, Homo sapiens
tgaggcaggagaatcgcttgaaccccagaggcggaggtttgcagtgagccgagaccgtgtcattgcactccagcctgggcaacaagagcgaaactccgtctca

SEQ ID NO: 6875744 - DNA, 58 bp, Homo sapiens
ctgtctgttcagattcattactctatacctggcctctagagcagggtctggcagacag

SEQ ID NO: 6875745 - DNA, 76 bp, Homo sapiens
ttgctctgtcacccaggctggagtgcaatggcacgatctcagctcagtgcaacctccgcctactgggctcaagcaa

SEQ ID NO: 6875746 - DNA, 90 bp, Homo sapiens
tcaagtaactgattcacaatagctatgtaacctgaagaggcagcattgtgtagcgtctaaggacattggctttggagtcaggctgcctga

SEQ ID NO: 6875747 - DNA, 81 bp, Homo sapiens
tgaacttgcagaaggccttggttctgagcaataagagtgactatgtctgctaagacccaggtgctaaatcaggtgagttca

SEQ ID NO: 6875748 - DNA, 56 bp, Homo sapiens
tctatgcactggattacaaagcaagtaccaaaaagctctgcatttgtgtgtatgga

SEQ ID NO: 6875749 - DNA, 129 bp, Homo sapiens
gaataggggaggcaacagagcagagatgactggatggcccagactcagactggtggactaccagtctaccatggtatcctgagtgactgcacaggccaatgatttgactgctaagagggtttcctgttc

SEQ ID NO: 6875750 - DNA, 55 bp, Homo sapiens
tgctcttcaccattacatcatgttaacttctttgcttgggatgtttggtagagca

SEQ ID NO: 6875751 - DNA, 64 bp, Homo sapiens
ggactgaaatctttccatgtcagtgccccatgtaggagtatttaatggagtagaattgcagttt

SEQ ID NO: 6875752 - DNA, 76 bp, Homo sapiens
tgtgagagatgcactcccaggggagtcatctgctttctccaggaattaggtacccctgggaggagtagtctctcca

SEQ ID NO: 6875753 - DNA, 80 bp, Homo sapiens
tggctaagcctggcgcccagtgaatcagccaaggatgcagtcaaccagctctttggccctggggccagcttcgaggcaca

SEQ ID NO: 6875754 - DNA, 87 bp, Homo sapiens
gggctggagggctgctggtctgggcccaggccaagaaaatatctgaaggccagattccaggcctggggccaagttctcaaagtgccc

SEQ ID NO: 6875755 - DNA, 63 bp, Homo sapiens
ccttcactctcagcataatgaatgtgacactgcctacatccatcctgtgggagagttaaaagg

SEQ ID NO: 6875756 - DNA, 78 bp, Homo sapiens
tagccacttgtgtcctggagcccccagttcaaatctttccattggactggaggcttgtgggaggctgggaggtggctg

SEQ ID NO: 6875757 - DNA, 57 bp, Homo sapiens
caaatgcacaaaacttacgccaagccaaggggtcttgcagagacttgtgtgcatttg

SEQ ID NO: 6875758 - DNA, 130 bp, Homo sapiens
tggaactttgaaagtgtgagaaaaatctcaaatcactttgacagcattttaattatagttgatttgtttgccgctaatagtgaaaatgctgtcagcatgatttgagatgtttcttccactcaaaatgtta

SEQ ID NO: 6875759 - DNA, 55 bp, Homo sapiens
gggcaggtgggctggggtggtgccatcactggcagcatgtgtggtccgctggccc

SEQ ID NO: 6875760 - DNA, 83 bp, Homo sapiens
ccagcttatgtgatcttgggcaagtccctgccctccctggaacgaagggccagggggctggactttcccacacaacttgctgg

SEQ ID NO: 6875761 - DNA, 85 bp, Homo sapiens
acagctgtgcctttgccgtggggcctgctgtggtttgctcttggggagtggacccggaacagaggcccctgcaggcctcagaagt

SEQ ID NO: 6875762 - DNA, 63 bp, Homo sapiens
tctgccacttacctccatgtacatgtatactctattatggaatgcatggaggaaagttataga

SEQ ID NO: 6875763 - DNA, 65 bp, Homo sapiens
tgctgagagtcactgtctgcatttcctaacctttgttaggactctgtggcctcagtgacacagta

SEQ ID NO: 6875764 - DNA, 90 bp, Homo sapiens
gaattataagaaacagatgtaagttgtttaaaaggacacatagcctgaatgtggtccatttatcacaaatttgcagaaggacttagattc

SEQ ID NO: 6875765 - DNA, 64 bp, Homo sapiens
ggagatgccagaattgcaaattttctctgctgatttgtgtcctactgattctggctcgctttcc

SEQ ID NO: 6875766 - DNA, 71 bp, Homo sapiens
taccagatggcgcccgtgagcagtgccgcccttccctatggcttttatttccactcttcgggcgctaggta

SEQ ID NO: 6875767 - DNA, 64 bp, Homo sapiens
aatgtctgcctgaactttatattctgaggatttcttctcctctgtaaatcgcaggttagatgtt

SEQ ID NO: 6875768 - DNA, 65 bp, Homo sapiens
gctgagtgtgggggtgctgaggacacggcgtctgcacactggtgtccaggcggccctcgctcagc

SEQ ID NO: 6875769 - DNA, 56 bp, Homo sapiens
tagcattaattgcattttcccttcctttttgctgaagggcagatgtttttatgttg

SEQ ID NO: 6875770 - DNA, 73 bp, Homo sapiens
ctaacttctgttctgagtaactgaaggtatggcaagggtttggtggtgtcaggggacttaggagagaagttag

SEQ ID NO: 6875771 - DNA, 60 bp, Homo sapiens
tcataaagcttgcctgcagtgtagctctggacaacagaaaactcctggtaacttttgtga

SEQ ID NO: 6875772 - DNA, 115 bp, Homo sapiens
ttcctaaaaggttctcattctggttaaggtagagggagcacactcacagtttagattcaaagtcggctcaaatcttggaagtgtccactggtgtagccagaaagagccctaggaa

SEQ ID NO: 6875773 - DNA, 83 bp, Homo sapiens
ggattcggggcctctagcagggccaggctgggaaccgaggacacttggtctccctccctgggcctgcaacaggcctgaaattc

SEQ ID NO: 6875774 - DNA, 97 bp, Homo sapiens
atgtctcctctgaaccagagttaatactgagtttattaaccagagtatattaaccagagttaataacagagtatcaactctggttcagaggacacat

SEQ ID NO: 6875775 - DNA, 99 bp, Homo sapiens
cttcatgctctggcagacagcggtcctgggcatgatgctgcgaggctgggagccccagcatccgttctcaggactgaacatcaaacggcggcggtggag

SEQ ID NO: 6875776 - DNA, 89 bp, Homo sapiens
gtgtcccttagagcttaggctagccattcagtcttttccttttctaggtaactaacagtggctggactatggctttgaatatgggtcac

SEQ ID NO: 6875777 - DNA, 63 bp, Homo sapiens
gaggggcttcagagacagcaaccaggacaggccgccttgccaactatgctgtgctctgccctc

SEQ ID NO: 6875778 - DNA, 59 bp, Homo sapiens
agtttggggcaagaggacagatggacgccacaggccatctgtctaaatatttccaaatt

SEQ ID NO: 6875779 - DNA, 62 bp, Homo sapiens
tgtttatagcttttcttggcactggtattctatgaaacatttgcagaggaaagctatgttta

SEQ ID NO: 6875780 - DNA, 77 bp, Homo sapiens
gcagtgggtcctggaaggcgacaggttttaaatgagtgttttcattcctcgcctgcggtttggcgggacagcgctgc

SEQ ID NO: 6875781 - DNA, 68 bp, Homo sapiens
ggttaaagctgtgaattttatgctagtgtaaaatagaaattacataataaaatgcatagctgcatacc

SEQ ID NO: 6875782 - DNA, 71 bp, Homo sapiens
ttccatttctatctgggagttccccattatctcttaatcagatgtgatgctccctctggtggacaatggag

SEQ ID NO: 6875783 - DNA, 67 bp, Homo sapiens
agctagaactagggagtgaatattaaaggcagttggcatttgaatttaccttgcctatattttagtt

SEQ ID NO: 6875784 - DNA, 84 bp, Homo sapiens
ttcaaatttcagtcctctcactcaggcctttaaagcaaatacatgcagaaaatctgagaatgagagcactagctggaagctgaa

SEQ ID NO: 6875785 - DNA, 93 bp, Homo sapiens
taaatatgaagtgaagcattggaaagtcagaaatcatctagtgtattgacgtaatccatgtactagtatttctactttttttccttctttttg

SEQ ID NO: 6875786 - DNA, 103 bp, Homo sapiens
cccctttttaagaatcagcaccctgggtatgaggcaagtttggaaactgaatggtttggaaacatctctgcctttattcatggagttggggagtgaggagggg

SEQ ID NO: 6875787 - DNA, 74 bp, Homo sapiens
tttgggcattaagatagctcgatctttcatttggcttaattttcaaagttatctggctttcttaatgacttaaa

SEQ ID NO: 6875788 - DNA, 58 bp, Homo sapiens
atcaagcagcattgtggcttttttctacaatcagaaacatagcagctttgtgcttgat

SEQ ID NO: 6875789 - DNA, 70 bp, Homo sapiens
gcattccattgtgtaaggatatcggaggatgcaagtccccaagacctccccgacactgctggtggagtgc

SEQ ID NO: 6875790 - DNA, 79 bp, Homo sapiens
ggcaatggcacctagggcatccctgccccagcagcccttggcgtgggagctggggcaggagtgctgggggcacggggcc

SEQ ID NO: 6875791 - DNA, 65 bp, Homo sapiens
gcatgtgtctccccagtggagggtgggagcttagaggtctatggctactgtgagacacaaagtgc

SEQ ID NO: 6875792 - DNA, 76 bp, Homo sapiens
gactcctggggtcactgtctagtcatactgtctttcttagtgtcagagtcagcttatgacacagtctcaaggagtc

SEQ ID NO: 6875793 - DNA, 60 bp, Homo sapiens
atctctccctaggttagcggtcaggcagaccttgctctgaacgaacctcctgggagagat

SEQ ID NO: 6875794 - DNA, 74 bp, Homo sapiens
tccttcagggccctcaacacgatcttctctggacacgagtctggggatagccgggtgttgtgggctccaaaggg

SEQ ID NO: 6875795 - DNA, 77 bp, Homo sapiens
tgagaatgatgagaatgagaagggagagcatatttattaagcatatattatgtactaactttcattctaggttttta

SEQ ID NO: 6875796 - DNA, 57 bp, Homo sapiens
ggcaggtgagggtgtctgaatagacaaatggtgatctattttcattcttacattgtc

SEQ ID NO: 6875797 - DNA, 99 bp, Homo sapiens
agctcaagtagataataaatttgagtaatttgggctaccaaaataacccacatattcctggcagcattaattattcaggttaatgttttactttgagct

SEQ ID NO: 6875798 - DNA, 63 bp, Homo sapiens
ggcctgtgtcggccccgggttctgcctgggaccagatgttctgaccaaagggctggcactgcc

SEQ ID NO: 6875799 - DNA, 59 bp, Homo sapiens
ggagcctgcagggaagggctaggatggtcaggatctcttcagtgcatgccctcaggccc

SEQ ID NO: 6875800 - DNA, 76 bp, Homo sapiens
ttcaggatgctgccatactataaggctgtcaagtggtgagactagaccaagtttctgggtaaggaagtaatctgag

SEQ ID NO: 6875801 - DNA, 70 bp, Homo sapiens
cgtagaagcagaccacagaagccttgatagggcttaaattgtccttgtaagtaatttgtggactattacg

SEQ ID NO: 6875802 - DNA, 58 bp, Homo sapiens
gcacttgttggtggtgaaatcacggatgaccttgacgttggtgactgccccaaaaggc

SEQ ID NO: 6875803 - DNA, 57 bp, Homo sapiens
tgaaattgatgagctgaatttcaacaagatgttgatttgaactcagctatcatttta

SEQ ID NO: 6875804 - DNA, 76 bp, Homo sapiens
tactgagggttagtggaccgtgttacatacgtcacagataaagcgtacgctatacggtctactatctctccaagta

SEQ ID NO: 6875805 - DNA, 69 bp, Homo sapiens
gactttctggaaaatacaaatgtgcttcctgtgtgtgtgttcacatacattgtattatccgtgattgtt

SEQ ID NO: 6875806 - DNA, 58 bp, Homo sapiens
cttgaattgggggaagatcactcttcatgcccatttgaggatgtttactgagatcaag

SEQ ID NO: 6875807 - DNA, 130 bp, Homo sapiens
gaaaaatcaggataaatgcctcaacagctgtcaatgttaaataatcccttaaagctgtgaaagccttcatttgctttcaggagttgtgacatatggtcaaaaatagcttgaagatttattatgtcatatc

SEQ ID NO: 6875808 - DNA, 75 bp, Homo sapiens
ggtcttttccagctgtgttttttccatctaaacagtaaagttgagtgcaggggaaagccagtttctggaagtacc

SEQ ID NO: 6875809 - DNA, 63 bp, Homo sapiens
ccaaggaaacttgcatggtcatcaccattctcagaataccggaggcttagcaatttcctatgg

SEQ ID NO: 6875810 - DNA, 57 bp, Homo sapiens
tatagacttggcatgcatgttctcattcacctcacaggcatgctggtaagatctgta

SEQ ID NO: 6875811 - DNA, 105 bp, Homo sapiens
ggctcatcatgctgttcttctggggttccgggttggaagcgggggcgggataagctgagctttgctggaagcctggggacttcccgcgaagggtgcggtggagcc

SEQ ID NO: 6875812 - DNA, 57 bp, Homo sapiens
acccccaactcttacactgccaaggcaacttcctggcagccatctgagggtgggggt

SEQ ID NO: 6875813 - DNA, 57 bp, Homo sapiens
tggaagtgattttgcttctgcctatttctatttgctagaagctagtcactaaatcca

SEQ ID NO: 6875814 - DNA, 88 bp, Homo sapiens
tttatttaacttttaagctagtgtagagatgttgcttatttatattaatgaaggtcatggtaatatttttgctaaaagagtaaatgga

SEQ ID NO: 6875815 - DNA, 88 bp, Homo sapiens
gttgtattatgaggcactgaatacttgagggtatagtacatagcctattttactcttttgcttattctaagtgtatcaaggatacaac

SEQ ID NO: 6875816 - DNA, 59 bp, Homo sapiens
gagggagtgccagagggccagcaagaggttgggtggctggctgactcagggactccttc

SEQ ID NO: 6875817 - DNA, 61 bp, Homo sapiens
tcctttatcagactatgaaatgaatattactgccacatttcatagttatggagattaagga

SEQ ID NO: 6875818 - DNA, 67 bp, Homo sapiens
aggagtccatgagcagctagagcaggtctctcatccatcatcctgccacggagttccttgggctctt

SEQ ID NO: 6875819 - DNA, 81 bp, Homo sapiens
acactacctagtgacaacattgagttatgtgcagcttagttatgtgtgatatgtgtgattctgtgttgctgatggtggtgt

SEQ ID NO: 6875820 - DNA, 81 bp, Homo sapiens
gtagtttggaagaagggaaggccattgatcttccagtcctggtgtggcaggcagtgcagagtcctcttcttccagcactgc

SEQ ID NO: 6875821 - DNA, 58 bp, Homo sapiens
cagaaatgtgatgtacacacacccacattacttggaggttatattacattacattctg

SEQ ID NO: 6875822 - DNA, 63 bp, Homo sapiens
gctgcaagtgcatgttgcaacttcgcgtgatgttcccagggcggttctgcggcaacttgcggc

SEQ ID NO: 6875823 - DNA, 130 bp, Homo sapiens
cacaggcctggaggcccaggaggaaaaagtggttttgtggatggggcccagggtccccatgctctgtgcatcctagggccttggtgctctgtgttgcagccactccagccacggctgaaacgggccagtg

SEQ ID NO: 6875824 - DNA, 73 bp, Homo sapiens
gtggcctataccatttttgaatgaatgaatgaaaaatagaaagtcatgatagtcagttcctaagggaggccgc

SEQ ID NO: 6875825 - DNA, 86 bp, Homo sapiens
atggctgattatgacagacagctccttttggtgcatatcagagatgaatatgcaaagagggctgtagcatttacatatttacccat

SEQ ID NO: 6875826 - DNA, 75 bp, Homo sapiens
gtctggcaaataatgtcttcttttaatttggcatttggagtgccaggctggtgcaaggatattctcatgtcagac

SEQ ID NO: 6875827 - DNA, 63 bp, Homo sapiens
gtgaaaggcaggcagggtgtccatcggtggatacatatggagatcaagatgcctgacttccat

SEQ ID NO: 6875828 - DNA, 78 bp, Homo sapiens
catgatgtggtacatccatacagtggaatattatttggctataaaaagcaatgaagttactgtacgtgctatgccatg

SEQ ID NO: 6875829 - DNA, 76 bp, Homo sapiens
ttgggactttgggggtcactggtccgctgccccctctgctttagaggtggggaaaccagcgatcccagaggcccgg

SEQ ID NO: 6875830 - DNA, 67 bp, Homo sapiens
gggcccatgtgtgcaccaaccctatgtgacttacagaacaagggaaactgatgcaaacattaagccc

SEQ ID NO: 6875831 - DNA, 92 bp, Homo sapiens
ctccaatattcaggtagacatacagtgcagtacatatgtcagcaggccgtgtggctgtttcatgtgtttttcagtgattgaagaagttggag

SEQ ID NO: 6875832 - DNA, 58 bp, Homo sapiens
gttttaaaggctagagcagttggggcaatatttattcatctgtaacagcctatgaaat

SEQ ID NO: 6875833 - DNA, 60 bp, Homo sapiens
ggatgtctttagggcaaaatatttccaccacaagagaaatgtgattgtcataaggcttcc

SEQ ID NO: 6875834 - DNA, 55 bp, Homo sapiens
taggtgctctttctcagacaagatcctgccagaacttggagagaaagggcatgtg

SEQ ID NO: 6875835 - DNA, 58 bp, Homo sapiens
tgcatcacatcatggagaattatgggaaccctatcggttttgttagagtgatgtggca

SEQ ID NO: 6875836 - DNA, 60 bp, Homo sapiens
cacgcagctggtgggcctccagggtctccacggtgatgttggggtcccacaggctgcctg

SEQ ID NO: 6875837 - DNA, 107 bp, Homo sapiens
tggctgattgtgttttcattagaatggagagcttggatgtcttttgttcatacctcgtggcaatttcctgtccaggtatcttggtctagtacatcttatttcagcta

SEQ ID NO: 6875838 - DNA, 67 bp, Homo sapiens
caaatcataattgtatacattcatggggcaccatgttatgttttatgtatctatacaatatgaagtg

SEQ ID NO: 6875839 - DNA, 130 bp, Homo sapiens
gtgatgtgtgcaaagctagtgagagaggcagtgtatgagagcttagggatttgaaatgtcacaacatatggcaggcccaggtgttcattataagttacaaactctcgtcctgcttggaccattcgtatgc

SEQ ID NO: 6875840 - DNA, 77 bp, Homo sapiens
cagataggaggcaatgggctatagcattgcaccagggagtgactgtgtccgggagcaaagcgtcctgcctccatttg

SEQ ID NO: 6875841 - DNA, 56 bp, Homo sapiens
accctggacatcttgtcatagcagacaacaaagacgctattacaggctactagggt

SEQ ID NO: 6875842 - DNA, 129 bp, Homo sapiens
ttctttttgtcagaaaagcttttgcttaattggaagcctcattcagatttgtgcctgtgtatcttcattagcatattgcagggacagtctggataaaaaccagttgacaaagaattgacatttaaagaa

SEQ ID NO: 6875843 - DNA, 57 bp, Homo sapiens
gcatccaaatgtttcatttcttttggaatctgtccatgtcgagatacatctggatgt

SEQ ID NO: 6875844 - DNA, 76 bp, Homo sapiens
tgtctttgtgtatactgtcttgtttcacagtggactgaaaaccacttggaaagatgcaacacagtaaaacagaaca

SEQ ID NO: 6875845 - DNA, 56 bp, Homo sapiens
catgggtatcatccccagagctttatgctttttaagttcttaggttgatactaatg

SEQ ID NO: 6875846 - DNA, 56 bp, Homo sapiens
aagttgatagcatgttaagctctcaagtgcctttgggttttatgtgctttcaattt

SEQ ID NO: 6875847 - DNA, 79 bp, Homo sapiens
tggaaggagagcagcggcatttggtttggtggtgggcagattttcttttacgactgctaaatgcctgcctttctcccca

SEQ ID NO: 6875848 - DNA, 76 bp, Homo sapiens
cagacagcgaggggcctgggccagcagggccgttctcctccgtgccagctcagtgccaggcccctctggctgcctg

SEQ ID NO: 6875849 - DNA, 77 bp, Homo sapiens
gaagttcagggtcttataaggccaatttttctctttaagataagatggcattagagcacccaataccaatgaaattc

SEQ ID NO: 6875850 - DNA, 79 bp, Homo sapiens
tcctcattattcaccttgttgttactttaatctttgttcagtttgacaaatgagaatgtagacagagggttaaagagga

SEQ ID NO: 6875851 - DNA, 70 bp, Homo sapiens
agttgatgacaatattgtagagaaaatagacactcaagctgttgaaaaattttacaggttgacatcaatt

SEQ ID NO: 6875852 - DNA, 87 bp, Homo sapiens
ttgggttaactagattcagctgggaagttctcgcttggggactttttgtgactgcaagttgaagtcccagttgggctgtttttctaa

SEQ ID NO: 6875853 - DNA, 58 bp, Homo sapiens
tggacatattatgtagtcaacaacagtatagcctgttgtcaggtacaaaatatattca

SEQ ID NO: 6875854 - DNA, 70 bp, Homo sapiens
acaccaagtctgtttcccacatttctggagaccaaggaattcaagatcaaggtggcagcagatttggtgt

SEQ ID NO: 6875855 - DNA, 55 bp, Homo sapiens
agcattacagtggtacccaggggcctaagctagggcccaaggtgccagtaatgtt

SEQ ID NO: 6875856 - DNA, 109 bp, Homo sapiens
agcttacctttcactttgactaaaacaaacaagattgctttctttagccaactagttagggatgacagtacagtcttagattttattttggtcaacttgtgggtaatct

SEQ ID NO: 6875857 - DNA, 60 bp, Homo sapiens
tctggagagtcacagtgccagaggaagcggagcagagggactggcagtgtggcttccaga

SEQ ID NO: 6875858 - DNA, 73 bp, Homo sapiens
gatgaaaaatttgaggggaggaaggaggggcaggagaggggccccttagatgtcttcctccggattttttgtt

SEQ ID NO: 6875859 - DNA, 67 bp, Homo sapiens
aggaaaaggggttcccaactcctcctgcagaaataattttcatgggacctggggactccttgttcct

SEQ ID NO: 6875860 - DNA, 81 bp, Homo sapiens
gggcggaggcacttcatgctgacccgaaaacagacccaaatcgccctttctgtgcctggggggcatgaacctccacggccc

SEQ ID NO: 6875861 - DNA, 91 bp, Homo sapiens
ttctattcttcctccttagaattttgaatttctgtatttgtggagaaaaattgttcacatccattaagttagaattaggtgggggagagaa

SEQ ID NO: 6875862 - DNA, 55 bp, Homo sapiens
aagtcttttgttcaggctggcactgccaaagtgggaaatcagccaaagaagactt

SEQ ID NO: 6875863 - DNA, 66 bp, Homo sapiens
taggcagctctccagttgctttctttttccctacgtgcaggggactcttcagctgtgagagcctta

SEQ ID NO: 6875864 - DNA, 100 bp, Homo sapiens
ggcgcctctcccctccccgcgcgagttccctggcccgcacgtagcgcagcacctgctcgccgctgtgcaccctgcctgcctgcgggtcctcgggggcgcc

SEQ ID NO: 6875865 - DNA, 85 bp, Homo sapiens
gctaatgtgttggaaaaatttgcttttactatgttaaaacactgagattttaggattagagtagcaagtatttaccttcattagt

SEQ ID NO: 6875866 - DNA, 72 bp, Homo sapiens
tgttaattaacaaatatttcccatgcccagcacgtttggatgtttggagggctggatgtttgatgacgaata

SEQ ID NO: 6875867 - DNA, 72 bp, Homo sapiens
ggggcaccataatgtctgtttgctgagcccggcaggctctggagccgctggtgagcgcacagacacagcccc

SEQ ID NO: 6875868 - DNA, 55 bp, Homo sapiens
tgcttcagatcttttttacaattgaaataaacattgtagataaggttgtggagta

SEQ ID NO: 6875869 - DNA, 74 bp, Homo sapiens
gctattttgtttgttcagaagtttaaagaattgcttttcagtatttcaactgtgctctgaataaattaagttgc

SEQ ID NO: 6875870 - DNA, 82 bp, Homo sapiens
cagccatgcttttctctacattttaataagctgcttacaaaattggtgattgatgagtaagaatgaggaggatgcagggctg

SEQ ID NO: 6875871 - DNA, 79 bp, Homo sapiens
ggatggctgggaaagagctggagatgcaggtttcgggccacagtgagccccaaatgcctcagctccaaatgaagcctcc

SEQ ID NO: 6875872 - DNA, 55 bp, Homo sapiens
gagatctgggtccaagttctgagcaggtcacttctagttttggggcctcagtttc

SEQ ID NO: 6875873 - DNA, 58 bp, Homo sapiens
ctctgtaccttaaaagggctttcagtctttccaagggccctttgctctttggttagag

SEQ ID NO: 6875874 - DNA, 76 bp, Homo sapiens
gattttccatgattaatctgttcatcagttcgtacatatttactaaatgagaggtgtcagggtagtcatgatgaac

SEQ ID NO: 6875875 - DNA, 105 bp, Homo sapiens
ggcatccacatctgttggagtttgtggagagttagttgagcagtctgagctttgtttctgaggcgtctccctgagctcactctcctgccagagctgtgtcctgcc

SEQ ID NO: 6875876 - DNA, 71 bp, Homo sapiens
ggaaagttttcaaagtgatacaggatggtgataaatgcacacatgtttacaattcagtattacagctctcc

SEQ ID NO: 6875877 - DNA, 59 bp, Homo sapiens
gtgttgtgtttcccttgcatattcccattcttaaggaggggtttttgggagcataacac

SEQ ID NO: 6875878 - DNA, 85 bp, Homo sapiens
ttgatgcaaattagattggttttatcctacccacacagccctccaaaattaggaagagggggataagagagtatttatgcattaa

SEQ ID NO: 6875879 - DNA, 66 bp, Homo sapiens
ccgccattccctaatgagagcaatcaatccctttaatgatttctctccccaagtggaattgtcagg

SEQ ID NO: 6875880 - DNA, 66 bp, Homo sapiens
gattctgagcctgacacacaaattcttgtgcaagtgattcactgagggggtggtttcaggagaatc

SEQ ID NO: 6875881 - DNA, 92 bp, Homo sapiens
tgctcagggactctctgggggaaacaaggcagggctgtactcaaattggagttttccttgggctcctgccgtcttttctgagtccctgtgca

SEQ ID NO: 6875882 - DNA, 75 bp, Homo sapiens
agggatatggtgaaaggtgaggaatcagaatagggcccctaacattcctgtgatgctcttcctcatctcttcctt

SEQ ID NO: 6875883 - DNA, 58 bp, Homo sapiens
cttttcaggctacattatgggatcacgtgaagaaaattccatgaaggagactgagaag

SEQ ID NO: 6875884 - DNA, 58 bp, Homo sapiens
agagcagctcgctacctctctaacataatgtgtaacaaggtggagagccagctgctct

SEQ ID NO: 6875885 - DNA, 65 bp, Homo sapiens
cctagtgacagcatgatcaaggagcccagtcatttgggaggccccatcattgctgccagcctggg

SEQ ID NO: 6875886 - DNA, 55 bp, Homo sapiens
ggaggggcagaggggccgggagggaggtgcttctcctggctccagcagctcttcc

SEQ ID NO: 6875887 - DNA, 63 bp, Homo sapiens
ggctgctttggctggggccctactttcttgctgaaggctggcttccctcaggtctgagcagtc

SEQ ID NO: 6875888 - DNA, 64 bp, Homo sapiens
gctaatctcccagttgctctgttccttgtcactggaagtggtcagagctgttgcggggcttggc

SEQ ID NO: 6875889 - DNA, 76 bp, Homo sapiens
agtcatcatttttagcatatgggaatacatattacgataaagaaagaagtgttctctggtctgaccaatgatggct

SEQ ID NO: 6875890 - DNA, 55 bp, Homo sapiens
gtgagaatctacttccgagctcacaaatgtggttgttggcagttaagaatcttac

SEQ ID NO: 6875891 - DNA, 72 bp, Homo sapiens
gaccagcaagcacctgcaccggtcgcctttggtccttcgacaaggtttcgggagcgggtctggaagggggtc

SEQ ID NO: 6875892 - DNA, 87 bp, Homo sapiens
acaggcccttgactctttctggtgactcaggaggataaagctgcatttcagtctgatggctccttcattatgggtcagatggcctgt

SEQ ID NO: 6875893 - DNA, 79 bp, Homo sapiens
tcctgtcctgaggatccctaactaaattttgttagaaaatcttgcagtttgcttttaatgggagatctttctggcagga

SEQ ID NO: 6875894 - DNA, 74 bp, Homo sapiens
ggccaagacagtgtgcaagtgactttgtttcccatccatgaactaaatggaaagacatgtccttcattatggcc

SEQ ID NO: 6875895 - DNA, 62 bp, Homo sapiens
tgttttgttagcaaggataattatgattcagatgctgtaattttaaccttgactaacatgca

SEQ ID NO: 6875896 - DNA, 94 bp, Homo sapiens
ggtcacatagattgggaagaggaggagccaggctttgaacacagacctgcttgaccccaaagcctgggttcctcactatcatattctattgacc

SEQ ID NO: 6875897 - DNA, 86 bp, Homo sapiens
gcaggattgcatactgagaaaagtatgagctctggggccaggttgctggactcatcaccttttctcatttccttaagcagtgctgt

SEQ ID NO: 6875898 - DNA, 110 bp, Homo sapiens
ttatttgtttacctttatatatcttgatttgttccacaaagaatttggagtggcttgtaagaattgttagctcaacagtgggatagattgatggatagagatataaataa

SEQ ID NO: 6875899 - DNA, 64 bp, Homo sapiens
gcagtaaggaggggaagggttttctgccacgtctgtggtctcttcattcttctcttcctgctgt

SEQ ID NO: 6875900 - DNA, 78 bp, Homo sapiens
tgttaggctggtgcaaaagtaattgtggttttgccattaaatgacaaaaaccacaattacttttgcaccaatctaata

SEQ ID NO: 6875901 - DNA, 59 bp, Homo sapiens
ttctgggtggccttgttctaaattaggcagaaaggataagttgaagaaggaatctagaa

SEQ ID NO: 6875902 - DNA, 86 bp, Homo sapiens
ggatgccaagtgacacaggggaaggagtctggacactgtcaagtaatgcccaggattctcctcttgtgtgggcttggctggaaacc

SEQ ID NO: 6875903 - DNA, 56 bp, Homo sapiens
cagagcttcgaaactagaataagggtcacttactctgatgtctctggaagctcatg

SEQ ID NO: 6875904 - DNA, 79 bp, Homo sapiens
tttgtgaatttcagagatgacttattggctgctcagaaggaaattctgtctcagcaggaagtcatcatgaagttaagga

SEQ ID NO: 6875905 - DNA, 69 bp, Homo sapiens
tcttctctatagtacacttaggtacttcaagctaatgttagcttaactgccatgtattgcttagggaga

SEQ ID NO: 6875906 - DNA, 117 bp, Homo sapiens
aagagatttgtggagaaggagaaatttatggtgttagcaaggaaagaaattacaaaattataataagctctggctaagctgataaatttacagatttaccttttaagggttgctctt

SEQ ID NO: 6875907 - DNA, 63 bp, Homo sapiens
agaatgtctttctgttctatgagatttaggctttgctccctagtcttatacagaaaacatttt

SEQ ID NO: 6875908 - DNA, 77 bp, Homo sapiens
ttgcttgaacctggaaggcagaggttgcagtgagctgagatcgtgccactgcacttcagcctgggcgacaagagcaa

SEQ ID NO: 6875909 - DNA, 74 bp, Homo sapiens
gcacatggactaatagagtaacacaaacgaattggcataattccttctcctgctattgttactagttcaagtgt

SEQ ID NO: 6875910 - DNA, 56 bp, Homo sapiens
ttttcctgctcatttgcagtttttacatataattcactgccaggagagtaggggga

SEQ ID NO: 6875911 - DNA, 72 bp, Homo sapiens
gtcttgccttcactgcacttgaggattttccacagccatgcatggggatgttctcgtgtaagagggtcagac

SEQ ID NO: 6875912 - DNA, 72 bp, Homo sapiens
cacaattgctacttcgtgtataaggcaggctatgataatgatataattgaaacatatacaaagtggtgtgtg

SEQ ID NO: 6875913 - DNA, 55 bp, Homo sapiens
accaaacttctgggctcctttgatgtgaattcatcaattgtgctctaagtatggt

SEQ ID NO: 6875914 - DNA, 84 bp, Homo sapiens
tgggcttcaaaaatgcattctcatcgaccttcagatatttaaggatatttggagaaaagttgagaccatgttttttgccaccta

SEQ ID NO: 6875915 - DNA, 78 bp, Homo sapiens
gagttaaaagccctctcagcagcagataaatatagctatgtttggtccaggttacagttgctgagggaactataactt

SEQ ID NO: 6875916 - DNA, 89 bp, Homo sapiens
gggggagtctcccctgggaccagcagctgcaaagcctgggtgctctcttggaccaacaccctagcagctgctgcccctggggctcctcc

SEQ ID NO: 6875917 - DNA, 76 bp, Homo sapiens
ttcaaaggtattttctaatgtatacttcagatgcaaacagtgttactttctagtatacatagagatggctgttgaa

SEQ ID NO: 6875918 - DNA, 101 bp, Homo sapiens
tgtgtgcccatgtgtgcatgtgtgcatgcatatgtatttttgtgcatgtaatgagtgtgtgtgtgtgtgtgtgtgtgtgtgtgtgtgtgcgtgtgtacata

SEQ ID NO: 6875919 - DNA, 83 bp, Homo sapiens
tcactcagatggtaggtggcaggactgaaattaatactcctttctgctgtgttcaaatcactctgcctccatattactagtga

SEQ ID NO: 6875920 - DNA, 83 bp, Homo sapiens
tgttagggcagatattgggaaagaaactgactaattgacccaggctttcatttcaggctcagtttggtttccattgcctaaca

SEQ ID NO: 6875921 - DNA, 58 bp, Homo sapiens
gtggtcagtgacatggctccttgaacccccttccagtccagaggcctctcttggccac

SEQ ID NO: 6875922 - DNA, 77 bp, Homo sapiens
catttattgctgcaaaattgttctttgctccagcatttagccatagttgtgagcatattagtattgcactctaaatg

SEQ ID NO: 6875923 - DNA, 66 bp, Homo sapiens
cggttctgggtgcaggcgtgtgtgttagcgcgaggggcgttttcacatcccgcgcgcccttaatcg

SEQ ID NO: 6875924 - DNA, 72 bp, Homo sapiens
gctgttgagattctatctcatgactagattagtaatatgctattttagctaagacatagattcttgtaaggc

SEQ ID NO: 6875925 - DNA, 63 bp, Homo sapiens
cagtacttttctggctttctactctggtaggaaaaacagccctactagtcagaggagtatctg

SEQ ID NO: 6875926 - DNA, 85 bp, Homo sapiens
attacgttggtgcaaaagtaattgcgggttttttggccagtggaagtaatggcaggaactgcaattacttttgcaccaatttaat

SEQ ID NO: 6875927 - DNA, 105 bp, Homo sapiens
gggggtagaaggaggggttggggagggttgtgtgtgtgtgcatgtgtatgtgtgtgtgtatctgacagctaagctcccacaacctgtagcatgctcattacctcc

SEQ ID NO: 6875928 - DNA, 95 bp, Homo sapiens
atttgtctgcttttagtcttttaggaatttatcacagactggatttattttatttatttttggtacaaattccatgggacttttggaagggaagt

SEQ ID NO: 6875929 - DNA, 73 bp, Homo sapiens
gaaagttagagatctggtgctagtctctgcaacatctttgctaattgtaccagatttctcttgccaaattttc

SEQ ID NO: 6875930 - DNA, 90 bp, Homo sapiens
ggcttagcaggacaggagcagggctggggcacgagccaggtctcttctctggctcacagctgccagtccttcctttgccacctgaagacc

SEQ ID NO: 6875931 - DNA, 56 bp, Homo sapiens
tgtgtgctcgatggccctgcagccctcctcagtggggcacgcaggtggggcgcgca

SEQ ID NO: 6875932 - DNA, 80 bp, Homo sapiens
aagagcacacatggcctatgctgggttttttgccttgtgcagaaatatctttctctgttgcaagcccagtgtatgctctt

SEQ ID NO: 6875933 - DNA, 89 bp, Homo sapiens
ggagactcacttgaaccctgggaggcggaggttgcagtgagtggagattgcgccactgcactccagcctgggtgacagagtgagactcc

SEQ ID NO: 6875934 - DNA, 68 bp, Homo sapiens
taggctctggattaacctgatgtaggaataaggaatatttcctaccaaatcatttggctagcctcctg

SEQ ID NO: 6875935 - DNA, 91 bp, Homo sapiens
gaatttcctagatactcagagtcattgcccttctatcagttcaccatgctagaaggcctagagtaagacatttggccgtatctggaagttc

SEQ ID NO: 6875936 - DNA, 80 bp, Homo sapiens
gctttgacattctatgaaaactaggcaatatacatttaatcaacattcgtctattgactgttcatagaatgatgccaggc

SEQ ID NO: 6875937 - DNA, 91 bp, Homo sapiens
atgagctctgctcaccattgcccacatatcttcatgagattagcctctggatattgttggtgagtgtcaatggttagagtaataggcttat

SEQ ID NO: 6875938 - DNA, 69 bp, Homo sapiens
gaaggtgagacagcagattagcaatgattccacaccaagtgtcactgtactaactgctctttcacactc

SEQ ID NO: 6875939 - DNA, 93 bp, Homo sapiens
aactattcttagctcataggacaaactaaaacatggatgagctagatttggcttgtgcatcatagtttgccaattcctgttctaaagtatgtt

SEQ ID NO: 6875940 - DNA, 58 bp, Homo sapiens
gcatgctccagtgtgatgcttcattgagtgcacagtcaaaagagcccttggagcaggc

SEQ ID NO: 6875941 - DNA, 60 bp, Homo sapiens
ggggtgaagctaaacccacagtgaacgtgaagcaatctgtggttaaagttgtgtcatccc

SEQ ID NO: 6875942 - DNA, 60 bp, Homo sapiens
cagctcaatagcctaccttaatctggtgattaaattccaaggatgggtgatcttgagctg

SEQ ID NO: 6875943 - DNA, 87 bp, Homo sapiens
tccatgagtttgcaatgaagttctagtgagaaatgctctattcataaagcagggggtttacgtggaccttctagtgttgcttatggg

SEQ ID NO: 6875944 - DNA, 65 bp, Homo sapiens
cacagctatggggctgtagcctctctgagcagagccaagtgaggctccagtctcctctggcagtg

SEQ ID NO: 6875945 - DNA, 74 bp, Homo sapiens
ggggaagccggcctctggttcacagggaggatgccactgggcttttcctcctctatcagacagtgccctccccc

SEQ ID NO: 6875946 - DNA, 56 bp, Homo sapiens
tgggagtgatacagtatggaattttctatttggtacaatttagaatgtagctccca

SEQ ID NO: 6875947 - DNA, 59 bp, Homo sapiens
ggttctctcctcctgcactgcaagcttgagatttctttcagggtggagagagggagacc

SEQ ID NO: 6875948 - DNA, 68 bp, Homo sapiens
ctaggccatattttgagaactgctaacagggaatgtaaccttaaaatagattttaagaatgtgcctgg

SEQ ID NO: 6875949 - DNA, 75 bp, Homo sapiens
ctccctgaggtggtggtggaggcatagctgactcatccagatttgttctgctggcctcatcactgacttctggag

SEQ ID NO: 6875950 - DNA, 55 bp, Homo sapiens
agtttcagtttgaaggaaaggccaaagttttgttgggtccttcaaagctgggtct

SEQ ID NO: 6875951 - DNA, 113 bp, Homo sapiens
gggagggcacatgagctggcaggaggtctcttgtgagccgtttcctttcttctctaataataggaatgctggcttacaggcagttttaccccctgggatggcaaagccctctc

SEQ ID NO: 6875952 - DNA, 63 bp, Homo sapiens
ggccctgagccacacagagcaggtgcatctggctttgatgactggaggtggggttctggggcc

SEQ ID NO: 6875953 - DNA, 84 bp, Homo sapiens
ctttggacagtcctgtacaggccatatctccaagtactccatctgctcctgaaggatacgacctgaaaataggactttctttgg

SEQ ID NO: 6875954 - DNA, 87 bp, Homo sapiens
gaaatgcaatagcaaagttatcaaattaatgttacaacaaaatcaatacatattaatggggttttctttgtttttccttgcatcttc

SEQ ID NO: 6875955 - DNA, 114 bp, Homo sapiens
agattagtgaacatatatttgccccctctactactgcaggagcttcttgtttgccaggacagggctatattcctcagagctgaggaggagttgaatcatgtggtcatttattct

SEQ ID NO: 6875956 - DNA, 78 bp, Homo sapiens
tgacttgcgtttagctctttgtagctatttctagtcactgattctatggaaagtcgctaaggagttagtcgcttgtta

SEQ ID NO: 6875957 - DNA, 125 bp, Homo sapiens
tgagctgagcaagtgctggtcacattttggagactgagctgagcaagtgctggtcacattttggagacagaactgagcaagtgctgctcacgtttcagaggactgagctgagcaagtgctggtca

SEQ ID NO: 6875958 - DNA, 62 bp, Homo sapiens
gcactgagggctccacctagggacactggcagcaagaccaactccagtggtgagtccaaggc

SEQ ID NO: 6875959 - DNA, 88 bp, Homo sapiens
atttttggaaaggtggaccaaggtggaagataaaaattgtgaagacaagcacatgattttgtttctagcttgcactgtccctaaaaat

SEQ ID NO: 6875960 - DNA, 60 bp, Homo sapiens
tctgatttctcagttctaggaagcaggcttatctgatttcctagtttctggcagattaga

SEQ ID NO: 6875961 - DNA, 62 bp, Homo sapiens
gcctcgccccgggccgccgacctgacacctgctgggcagcctgcgcggcctggggcgaaggc

SEQ ID NO: 6875962 - DNA, 96 bp, Homo sapiens
gatgttggaagcaaggtagtagcaaaagacattagaatcagcctgttctgagatcagctggaacaagtgtctgaactcctctgaacttccatattc

SEQ ID NO: 6875963 - DNA, 74 bp, Homo sapiens
aatgatgctttcttacaaagaccattgtcctgagtgcttcagggattaatgtctctttgaaagagccaattgtt

SEQ ID NO: 6875964 - DNA, 89 bp, Homo sapiens
atgtaataattgttgcagactcaagaaaataaatggattagtcataaaatcccctgccatttgtgcacttctgtagctgcctattacat

SEQ ID NO: 6875965 - DNA, 78 bp, Homo sapiens
ttctgcttattctgtagcctttatttttaacatgttaaaagaatgattaggctggcagaacctgataaatgaacagaa

SEQ ID NO: 6875966 - DNA, 56 bp, Homo sapiens
gccctggtaatagtggaattttctccagcagtggggagacagcccagtgccagggc

SEQ ID NO: 6875967 - DNA, 72 bp, Homo sapiens
ggagagccagggatggcagtgcccagcaagagccaggactagcatggagtttattcatccctagggctcacc

SEQ ID NO: 6875968 - DNA, 104 bp, Homo sapiens
gatgtacagaaggggaattggggttgatgccttgaatagaatggctggaaaattctaaaagtatactttcaaaggagacaaccctcaaatctcttccctaaatc

SEQ ID NO: 6875969 - DNA, 55 bp, Homo sapiens
atgttcttctatctttattaaactgtttctaaaggaacaagagaaagaaggatgt

SEQ ID NO: 6875970 - DNA, 73 bp, Homo sapiens
cccaaaataacttcagtggaaacaattgtaacgtccactctgccggcattgtttcagtccactgtagtatggg

SEQ ID NO: 6875971 - DNA, 79 bp, Homo sapiens
agtttggggccatgcatccttgccccttgtctttgggagacctccacgtaaaggctggcaaggcagatgtgtggaaatt

SEQ ID NO: 6875972 - DNA, 62 bp, Homo sapiens
tagggatggcagcatgtagctttttattaggctcacctgaaaatacacagttgcttttctta

SEQ ID NO: 6875973 - DNA, 61 bp, Homo sapiens
tctgttggcttgagatttaatttgctaagagaaaagcaactgaagttactaaggtaataga

SEQ ID NO: 6875974 - DNA, 57 bp, Homo sapiens
tacacataggagggtaataaaaagcaaccgaggcttatttaacactcactgtgtgtg

SEQ ID NO: 6875975 - DNA, 65 bp, Homo sapiens
cacagcacctatagaagttgtgttcacagagcactcaacaatttctaggcttgaataatgctgtg

SEQ ID NO: 6875976 - DNA, 59 bp, Homo sapiens
cagtgatggatatggagaagtcagcaggacttccaaactgtttcgtatttatgctactg

SEQ ID NO: 6875977 - DNA, 90 bp, Homo sapiens
gcctctttcttgttccccagggaagctcctgcgctgtggggggcctgaatccaaaggcaggagcccctggggaaaatccaaatttttggc

SEQ ID NO: 6875978 - DNA, 72 bp, Homo sapiens
ccatccatccagaggctgacttcaaactctcccataaaaggaaagattaggattcagattctgcccagatgg

SEQ ID NO: 6875979 - DNA, 72 bp, Homo sapiens
gagcatcttttttgctctttgatgttaatatgcaattaatgcacattagtttctcagatcatttaagtgctc

SEQ ID NO: 6875980 - DNA, 65 bp, Homo sapiens
aggggcatgtggcagcatggtgggatgctttggtaatgagttcaccactgaggccacgtggcttt

SEQ ID NO: 6875981 - DNA, 78 bp, Homo sapiens
gattagatagacttgatgttaaaggggatgagggttattctgtattaattctttctctactagcagagctgtcaaatc

SEQ ID NO: 6875982 - DNA, 82 bp, Homo sapiens
ggtctgggggtggaccaggggatggttggcactgtgggattagggctgagtgccttccccatgctttgggattccccagtcc

SEQ ID NO: 6875983 - DNA, 91 bp, Homo sapiens
gaaagtattatgttttttactgttacttaactcagtgtaatgtttcaaatagcaatagcacagcagtggcataaacaatagcaatatagtc

SEQ ID NO: 6875984 - DNA, 56 bp, Homo sapiens
tcagcactgatgtttcagaagaaattaagttaaagttttttgcctatcagtggtgg

SEQ ID NO: 6875985 - DNA, 79 bp, Homo sapiens
ataggttggtgctaaaataactgagtttttgccattactttcagtggcacaaactgcaattacttttgcaaaatcctat

SEQ ID NO: 6875986 - DNA, 113 bp, Homo sapiens
catgtgtgggagagagattgggcatatgtatggcatatctgggagactctattggtatggagtagagaatctagaatgtttataccaaagccagcatctaaaaatccactatg

SEQ ID NO: 6875987 - DNA, 55 bp, Homo sapiens
tgaatagtccttggaataactgcttctatcttggtgtgttaccttggacaattca

SEQ ID NO: 6875988 - DNA, 111 bp, Homo sapiens
gactcttgatgaatgtcatagcagggtgttttaatttaatagatccagaataacatctggttctaatattttaaaagccaatttatatggaaatttatttaatacacagtc

SEQ ID NO: 6875989 - DNA, 58 bp, Homo sapiens
gggtctaaggcagacagaatatttggaatcatttaattgctttctgcattagtcaccc

SEQ ID NO: 6875990 - DNA, 70 bp, Homo sapiens
gcagagccacctctgagcccaaaccctgtgctacatgagacgcaggttgtgtgtgcaaggcctggcctgc

SEQ ID NO: 6875991 - DNA, 78 bp, Homo sapiens
gccactcacgcctcaccacctgctccttgagctgctcctggtccttgttctggtgcacgtggctgcagtcgatgtggc

SEQ ID NO: 6875992 - DNA, 79 bp, Homo sapiens
ctagcctatagagttgagttttagaagaagcctttcggatactgaaaacaaggcactgaacttaaattctgcagactgg

SEQ ID NO: 6875993 - DNA, 112 bp, Homo sapiens
taatttttactaatatgtagatataaaaggttaaggtgttcaagaaatgatgtttagcattgttttacattgaatccttgatcatcataattatatatttcagggaaaatta

SEQ ID NO: 6875994 - DNA, 79 bp, Homo sapiens
ttagctcaagtattatgggggtttaatccactctagagaaaatggagtaaaggaagaattctctgtgatggtggggtaa

SEQ ID NO: 6875995 - DNA, 69 bp, Homo sapiens
atttgcattcatatggaaggaaactatggtattagagggttttgtggtccttgctatagagtgataaat

SEQ ID NO: 6875996 - DNA, 60 bp, Homo sapiens
tctaaaacctgaacccatgattccatttccttggatatatgcctgggttggggatttgga

SEQ ID NO: 6875997 - DNA, 72 bp, Homo sapiens
atgatatctgccaggccattttgttacttgtggtattttaggtatcttctggttagtggtctgttatatcat

SEQ ID NO: 6875998 - DNA, 60 bp, Homo sapiens
ggaatgctgctttaaaaagtgctgattgcaaattaatcaacattatttacaagcagttcc

SEQ ID NO: 6875999 - DNA, 72 bp, Homo sapiens
tcctggaggggccatccacagtcttctgggtggcaatgatgctgtggactgtggtcatgagtccctccctga

SEQ ID NO: 6876000 - DNA, 82 bp, Homo sapiens
cacacctgtagtcacagctacttgggagactgaggtgggaggattgcttgagcccaggagttggtggctgcagagaggtgtg

SEQ ID NO: 6876001 - DNA, 70 bp, Homo sapiens
ggaggcagtgcctggaccccagctgcccaggagaggtgaggggctagatggggcctgaggacactgtgcc

SEQ ID NO: 6876002 - DNA, 55 bp, Homo sapiens
atcagggcttctaagggtcactgattcattattggagactcaaggaagctctgat

SEQ ID NO: 6876003 - DNA, 71 bp, Homo sapiens
ctgccctgcagctccacggactcgtcttctcgggtcatcccgagtccccccctctgtggagctcagagtag

SEQ ID NO: 6876004 - DNA, 83 bp, Homo sapiens
ttcagctttgggaaagcagatacttattacagtgaaatgactttttacaacagacaggaataagatttgcttaagaagctgaa

SEQ ID NO: 6876005 - DNA, 70 bp, Homo sapiens
ctgcatgcctgggaaagtgaggtcattatttcagtcctaaaaataacttctactatttgcagaaatgcag

SEQ ID NO: 6876006 - DNA, 59 bp, Homo sapiens
ctttagtccttcagcgtgaacagaggttatcagaaacacatcacaactgggggttgagg

SEQ ID NO: 6876007 - DNA, 68 bp, Homo sapiens
tgtgtcctttcttaagagtgagaaactctttctcataagttctcctcactctccagaactgggtcata

SEQ ID NO: 6876008 - DNA, 113 bp, Homo sapiens
ggggctattgttccattgtggtgatgtacatgcaagcacttagagggaggaagtcctttggcagagtgtgggcatttgatgagtacattgagctggttggagtgctcagcccc

SEQ ID NO: 6876009 - DNA, 80 bp, Homo sapiens
catttgagaagctatttctttcattagtttctggaaagccaaggtgaatagttatattatgaaagtggcttgattaaatg

SEQ ID NO: 6876010 - DNA, 71 bp, Homo sapiens
ggaaagaaacactgtttctcccataagtgatttggactccactggttacatggaagaaatataatttttcc

SEQ ID NO: 6876011 - DNA, 93 bp, Homo sapiens
ggattttaatgtgggaatttattttctggaattgtccaatgtacaaatagataaaataatttcagaggtagagattctaaagtaattgaaccc

SEQ ID NO: 6876012 - DNA, 87 bp, Homo sapiens
gtttagaagccagagagaaatggatttgagtcccaaaccccttatttactaatcatgggaacttaatcattctctctgctttcaaat

SEQ ID NO: 6876013 - DNA, 55 bp, Homo sapiens
gttgacacttgagcccaatgctgctgagagaaagtttaggtgtttaagtgccagc

SEQ ID NO: 6876014 - DNA, 62 bp, Homo sapiens
gcagacctcaggacatcattagccaactccacggggagctaaaatggcccgtccgagtctgc

SEQ ID NO: 6876015 - DNA, 83 bp, Homo sapiens
gaggacagataagtcatcctcagagaacgaacacaatgaaggaaattccagcctattcatgttctcctctcaggctgtacctc

SEQ ID NO: 6876016 - DNA, 63 bp, Homo sapiens
ttatggctaggatatgtgtgtatgtgtgttgagtaacacttttaaatatattcctttccatag

SEQ ID NO: 6876017 - DNA, 59 bp, Homo sapiens
tcaaggcttttggttttccataaccctgaatcctgggactagaatcccaaatgttttga

SEQ ID NO: 6876018 - DNA, 80 bp, Homo sapiens
cctcagtctcccaagtagctagaaatacaggcacgtgccaccactcctggctaatttttgtatttttagtagagacgggg

SEQ ID NO: 6876019 - DNA, 60 bp, Homo sapiens
catttgaacctggatgttcttagcatggaagagcttaactggtaactctaggattaaatg

SEQ ID NO: 6876020 - DNA, 77 bp, Homo sapiens
cagaaacctggcaaacaggcttttaagtcaataggttttatttgaggacagcagcagtctgcgtgtgcaggtttttg

SEQ ID NO: 6876021 - DNA, 76 bp, Homo sapiens
gtacaaacagaaagagcttttaaatgtgcaaagccctttattttcagggggctgaaggaactttttccatgtgtac

SEQ ID NO: 6876022 - DNA, 70 bp, Homo sapiens
ctggctctgggcatagaaggaagctttcagctggggttccctgcttcctattctctactgccaggcccag

SEQ ID NO: 6876023 - DNA, 56 bp, Homo sapiens
gaaagaaagcttttcctttggtggcatttgcttagtgtgaggaaacattttctttc

SEQ ID NO: 6876024 - DNA, 86 bp, Homo sapiens
gatcgacttccgctattggggagagtctgaggagtccgttctcccacggggcctcgtcactctttgcgaagggcgcctggcaggtc

SEQ ID NO: 6876025 - DNA, 81 bp, Homo sapiens
ccgcctcagcctcccaaatagctgggactacaggcgcccgccaccatgcccggctaattttggtatttttagtagagacgg

SEQ ID NO: 6876026 - DNA, 89 bp, Homo sapiens
caggaaggggttgtctaaacacgtctctttgaatatattcaacaaataaatgcttgtatctaaaggcctgttgagaaactactttcttg

SEQ ID NO: 6876027 - DNA, 80 bp, Homo sapiens
ctttgtaaactgagcacttttcaaagagagctccaaattcctacagagctgtctttaagtgagctttgatctttgcagag

SEQ ID NO: 6876028 - DNA, 81 bp, Homo sapiens
cccaagctaagtgctgagcaggtgatgtgagtctggaacagcctttgttctgggatttaggcactttctcatgagcttggg

SEQ ID NO: 6876029 - DNA, 64 bp, Homo sapiens
caaaggagtcttccagagcctgacaagatgctccccttgaccaaattctaggcaggctcttttg

SEQ ID NO: 6876030 - DNA, 69 bp, Homo sapiens
tcgcctttctgagatgtgaatctgtcaaatgtaaaacattagaagaaaagcacttagagatttggatga

SEQ ID NO: 6876031 - DNA, 64 bp, Homo sapiens
cagttctgactttcataatgtctagcatcagaggctagtttcttcttgaagtgtctgagaactg

SEQ ID NO: 6876032 - DNA, 61 bp, Homo sapiens
ctggagccagccagggccctctgtgcaggggcctactgcaagagcccaacgctgtgcccag

SEQ ID NO: 6876033 - DNA, 73 bp, Homo sapiens
gggcgagtcttcctccttgtcctagttactgcctatggaggcagtgtttagatcaagaaggcctctcttgctc

SEQ ID NO: 6876034 - DNA, 59 bp, Homo sapiens
cccaggatgtgtacaagtagctccatgattacagtggggccacagtgggaaatcctggg

SEQ ID NO: 6876035 - DNA, 55 bp, Homo sapiens
ggatgctttgggcgtctctcctggtttggttttggaaggattgttggaagcatcc

SEQ ID NO: 6876036 - DNA, 90 bp, Homo sapiens
tggggtaagcacaagactgtggcctgctgtatgggctcagcctgtagttggggccccaggaaggtcaggccgctcctgcagctaacccca

SEQ ID NO: 6876037 - DNA, 79 bp, Homo sapiens
gacatctaaggaactctagagccttgaacttgctttgacaatatggcttctggttctaatttggggctccttagagatc

SEQ ID NO: 6876038 - DNA, 111 bp, Homo sapiens
gtcaatttacagtaataattgaaagcacaaagaacaagtttttgcttaattactatgtgacagactgtattttgtactttcgtgtatatgtgatactgtagtgcttttgac

SEQ ID NO: 6876039 - DNA, 55 bp, Homo sapiens
agcaacagcaacgacatttctctaaaaggtagcagagatctctgaagctgctgct

SEQ ID NO: 6876040 - DNA, 81 bp, Homo sapiens
cccatggaataagtctcacttaggtcttcaagggctttaagagggtgcattgttaagtcctgggtgagaactgtcccaggg

SEQ ID NO: 6876041 - DNA, 87 bp, Homo sapiens
gttgatctaggagaagagatgggaaggcagacttcaagagccactaacatttcgtgaatgttttctgattttgatttttggggtgac

SEQ ID NO: 6876042 - DNA, 61 bp, Homo sapiens
gccaggagagcattgcacagaggcccgtgtcttttttgttcattgctttccccatcatggc

SEQ ID NO: 6876043 - DNA, 130 bp, Homo sapiens
tgtgcagatttgatcctatcatcatgttgttatttggctgttatgtagacttcattgtttacttgctttatagtgtcaatggtctatgtactcgagtatatttttgtgatggccagtattggtctgtaca

SEQ ID NO: 6876044 - DNA, 86 bp, Homo sapiens
tgagggaggcctcctgcacagagctggactccgcggggccacttcctgcaaaggcaagcgctgtgcagatgaggaccctctcctca

SEQ ID NO: 6876045 - DNA, 130 bp, Homo sapiens
gagaacttctggcggctggtgcgggagcagcaggtccgcatcatcatcatgccgaccatcagcatggagaacgggagggtgagtgcgccttgcaggctcctagaaaggccaccaggtggcgcacgttctc

SEQ ID NO: 6876046 - DNA, 60 bp, Homo sapiens
atgtaaggctgcctatgacactggctttcccttgagcttcttcatgtggagtccttgcat

SEQ ID NO: 6876047 - DNA, 100 bp, Homo sapiens
ttacagttcttttatggccatgatggccaattggaaacacatgatttaaagtgtttcaccatttctagctttatggcacatattacggagttttctgtaa

SEQ ID NO: 6876048 - DNA, 57 bp, Homo sapiens
ccataggagccctggtccctgatctctctgaggtcagtctggccactgttcctgtgg

SEQ ID NO: 6876049 - DNA, 106 bp, Homo sapiens
gggcacagtgtgctgtgcacctgcagcccaggggttctgagcagcagctctggtgccgtgctgcctacgcttgagccctgggttgacatttgcgagctgtgtgccc

SEQ ID NO: 6876050 - DNA, 68 bp, Homo sapiens
ggagctgcagtcacatggtgtggagctacacaaaagctgtgttaatcagaactgtgtgaattagctcc

SEQ ID NO: 6876051 - DNA, 60 bp, Homo sapiens
ttattcagcttcaatgtcttcacctagttactacaaaggtgggatgaaggagtagagtaa

SEQ ID NO: 6876052 - DNA, 71 bp, Homo sapiens
ttgcactcagggtaattcacagatttgtcagtgacttcattgcagctgtgagctttacacgaaccttgcaa

SEQ ID NO: 6876053 - DNA, 61 bp, Homo sapiens
ctgctggcctcggccatgcctggaattggacctgccaggcatcctgcccatggcacagcgg

SEQ ID NO: 6876054 - DNA, 60 bp, Homo sapiens
caggtcgctgagctagcatctgcagaatgcttcgcactgtgtattagctgcagtcacctg

SEQ ID NO: 6876055 - DNA, 59 bp, Homo sapiens
gcttactagaaagtttccagagttataacattgatataatggttggagactttctaagc

SEQ ID NO: 6876056 - DNA, 59 bp, Homo sapiens
ggcttcaggggcccagtcagcactctggaatctggtggtgagactgggtgcctagagcc

SEQ ID NO: 6876057 - DNA, 64 bp, Homo sapiens
ttggccaggtctgggtagcagaggatgggttcccagtccaggtggaggccttagacttggaagg

SEQ ID NO: 6876058 - DNA, 57 bp, Homo sapiens
gagctctttcctgcccatactgggaacggtcttttagtgatggtgagtgagaagctc

SEQ ID NO: 6876059 - DNA, 65 bp, Homo sapiens
gagcctgttcagtaacctataaaacacatttaatattgatgtttttccatgtgcagaacaagctc

SEQ ID NO: 6876060 - DNA, 78 bp, Homo sapiens
gctccttcaataggttccctctctagctttccccaactgttgccttccagtgcagctgtgaaagggaaccaagagagc

SEQ ID NO: 6876061 - DNA, 66 bp, Homo sapiens
gcctctgctacaccggaatagtgacatttgcccttcagtgttcctgtactgctgtggctttcaggc

SEQ ID NO: 6876062 - DNA, 68 bp, Homo sapiens
tgctgtgggggagagtgcaagcatgaaagactgacatcggcaaattcattcattcgttcactcacaca

SEQ ID NO: 6876063 - DNA, 91 bp, Homo sapiens
gttggaacatgatttctctgatggataattagctgttttcaggactcctcctattcagctgaatgttctcagaccagaagtctgatctggc

SEQ ID NO: 6876064 - DNA, 89 bp, Homo sapiens
gcacttaggtcatctcaggggttccttctagagggtaaaaccatccctcattaaaggaaatcacctgcataaagcccatgccagagtgc

SEQ ID NO: 6876065 - DNA, 55 bp, Homo sapiens
agagtgagtaaaatggagtatgtaaaagtcatatatactacatttctctgacttt

SEQ ID NO: 6876066 - DNA, 75 bp, Homo sapiens
gctttggctgttagatttggctgtagtaactggatcaggaaccctgtattagagttagttagatcaagtcaaggt

SEQ ID NO: 6876067 - DNA, 72 bp, Homo sapiens
ctggcttccctggctgtgttcaggtgcgtggactgggtgtgtggcatggaccccagacaagccagggtccag

SEQ ID NO: 6876068 - DNA, 85 bp, Homo sapiens
gtccacaattagcaggcacttctgctgcttgtctttctcaggtcaggagatgggccacaggagaggctgtcagctggaggtgggc

SEQ ID NO: 6876069 - DNA, 78 bp, Homo sapiens
cagaggtggcaaagtgacaaccatttattaagtacctactgtgtgctagagcctgtgttgtgcactgtacgcactttg

SEQ ID NO: 6876070 - DNA, 63 bp, Homo sapiens
tgcagctgtgtaatgagcccacatctgttaccaccacatgttgctcagcgctacgcagatgta

SEQ ID NO: 6876071 - DNA, 120 bp, Homo sapiens
agagagatgaggcaagtgtggaagggaagccccagaaggggaaagcctggttaaggggcccttcacccccctctccaaggcacattcccctttctgtccctttgtcgtttcattcactct

SEQ ID NO: 6876072 - DNA, 88 bp, Homo sapiens
ggctcaccccactcgtttaggtagctttggcgtttcttggctgttggacccaagtagaacagagctaccttgcccatgggatggagcc

SEQ ID NO: 6876073 - DNA, 76 bp, Homo sapiens
ggatgatctgcccatctgtcctgcttcacgggcaccaagaacccgtggctcagatccaggactcgtgtgcagctcc

SEQ ID NO: 6876074 - DNA, 78 bp, Homo sapiens
cataagatataatgctgtacatcacaatttgctgtaaaacattttatagtatttgtatgagcaggtaattgttttatg

SEQ ID NO: 6876075 - DNA, 82 bp, Homo sapiens
gctggcacttctctgcatttgactcctggttattgcagctgtgcccatgccaggcatttgttaggtgctgggatgtgcctgc

SEQ ID NO: 6876076 - DNA, 83 bp, Homo sapiens
agatgccttctttccagcaggaattactctgacagcggggctggtgtcatcaagagtaatttctgctgaaaaggttccaatct

SEQ ID NO: 6876077 - DNA, 130 bp, Homo sapiens
atcactgggaatttttttttttttttttaatactgatgtctgagccccaacggccactaaaggttcttgattcatgtggtctgaggcacggcatcaatgtttttaaagtcccacaaaccagtctttagat

SEQ ID NO: 6876078 - DNA, 65 bp, Homo sapiens
gaatcacaaggctttcatctggcataagcagaattggcatatgccaatataatactttgagattc

SEQ ID NO: 6876079 - DNA, 68 bp, Homo sapiens
ctaggaacagttcaacagtttaactcgcttcaacagcctgattctataagcacttgaagtgttcctgg

SEQ ID NO: 6876080 - DNA, 66 bp, Homo sapiens
gcggaatctcaacctcaactttgaatattgttattcaagaactggaaattgatatgagattactgc

SEQ ID NO: 6876081 - DNA, 78 bp, Homo sapiens
actgactctgtctcaggtctcagcttcagtttaaagttctggtaaagaaggctagatctgatatcagacaatgtgggt

SEQ ID NO: 6876082 - DNA, 71 bp, Homo sapiens
tatcttacttattagcataagtgttcggtgcactttttgttgctgtggaaatttatgttagttgtagggta

SEQ ID NO: 6876083 - DNA, 69 bp, Homo sapiens
acaagctcacagttttttcctgttaatagttgggaggattattgaccaaagggtactgattgactttgt

SEQ ID NO: 6876084 - DNA, 67 bp, Homo sapiens
tcttttataagggcactgattccattcatgaaggttgtgccctcatgacctaatcactgtccaaaga

SEQ ID NO: 6876085 - DNA, 58 bp, Homo sapiens
ccccaggccaggagcatggcattggtggtgcccaccaaataggcttcctgggttgggg

SEQ ID NO: 6876086 - DNA, 62 bp, Homo sapiens
gctaatctattccccagtcctgggaggtttgtgctctcacccagggactgtgatggaaaagc

SEQ ID NO: 6876087 - DNA, 77 bp, Homo sapiens
ttctgattgtggggtttaccagggctctctctgctggactctacctgggagtcttgggttgcctgatattgtcagag

SEQ ID NO: 6876088 - DNA, 73 bp, Homo sapiens
cctctctcaggcacctgaggtggccagcctggcgccaggcacaggactggagggtcagctgcttgagacaagg

SEQ ID NO: 6876089 - DNA, 127 bp, Homo sapiens
tttgccaatgtttggccatagagggcaaattctcaatcttagacaagggctccttaaaaggtaaattatcagaaaatagacactgagcacctgttataggttaggaattatgctaagcattgggaaa

SEQ ID NO: 6876090 - DNA, 76 bp, Homo sapiens
tctttttgtctactgagaagctatgcaaggaggatagcagtttattgtagtctagctactagatagacatggaaga

SEQ ID NO: 6876091 - DNA, 56 bp, Homo sapiens
gaatcctggaatcatctgagatcaaaatagcaggtctggaagaagcagcaggattc

SEQ ID NO: 6876092 - DNA, 79 bp, Homo sapiens
gggataaaattgggggtgacgatggcagctggtatttaatattgcctttgttttcttccccccatggcaatattattcc

SEQ ID NO: 6876093 - DNA, 103 bp, Homo sapiens
gaatttcattggtttgctttctccgagagtcaattttattggtccaaatacatagtaaggcagctgtggctaatgaaacaggagatggtgccaaaaagcattc

SEQ ID NO: 6876094 - DNA, 70 bp, Homo sapiens
tgtgatttgtttacttggactcaaaatgtatttctaaactgaaaaattgaatacaagtagagaagacaca

SEQ ID NO: 6876095 - DNA, 129 bp, Homo sapiens
ctacattttatatcagttttttggagcagcccatttgtaatttggggaattcagttagaatagaaacctttcctgaattgaactcagttaattgtgtggctttgcctgtttcctgatatgtaaagtatg

SEQ ID NO: 6876096 - DNA, 62 bp, Homo sapiens
cagacaggacccatcagccaggcactgtgagagcacagagcagggaggttgggtcctgcctg

SEQ ID NO: 6876097 - DNA, 85 bp, Homo sapiens
ggagtggggaacacttggagggagagtgggacatggcaccgaaatccagtcttgcctactttagagtgttgcaggggccaactcc

SEQ ID NO: 6876098 - DNA, 68 bp, Homo sapiens
tgctattgggcagacttctatagtagcttgttccagcaacacttatacaaagaatgtctgttctagca

SEQ ID NO: 6876099 - DNA, 99 bp, Homo sapiens
gtgacctgggtggccctgtccctggccgtctgtccacagacactgggtgtgcttcatttgactggccacgggcgggcaaggacagcctcccaaggtcac

SEQ ID NO: 6876100 - DNA, 68 bp, Homo sapiens
gggagaggggtgggaaataatgtcattgaaatagtcatgaccaaggcatgaactccaagcttccttcc

SEQ ID NO: 6876101 - DNA, 76 bp, Homo sapiens
gtggcattgccttctgcaggaagccctccccgagctgcaaaaccctctccgctctcactgcactaggtaatgccac

SEQ ID NO: 6876102 - DNA, 105 bp, Homo sapiens
aggagtaatttctttagctgaaatgtaagcatagaggttggggtctgtgtgctaacctgtgttgtgtttgcagttgtaatttagattcgagaagtggtttatcct

SEQ ID NO: 6876103 - DNA, 71 bp, Homo sapiens
cacgacttaaactgtttggtgtgtgtgtgcacacacagctgtgcgggtgcgcatgcagaggggtgggtgtg

SEQ ID NO: 6876104 - DNA, 80 bp, Homo sapiens
tctctcaaatgttctgtaaaagtgtggatgtgggagcataaactcagcaaagcagccacactgttacagaatgagtaaga

SEQ ID NO: 6876105 - DNA, 130 bp, Homo sapiens
cttggccaagttgcttgaactctctgtggctcagtatcctcacctatacaatggaggtgataatagtactcatctctcatggttattgtggggattagctgaaatagtgagtggcaagctcttgcacagg

SEQ ID NO: 6876106 - DNA, 63 bp, Homo sapiens
aagaaatgcagaaatgtgctggaagacaattctctgtgggactctagtatttctgcatgtctt

SEQ ID NO: 6876107 - DNA, 60 bp, Homo sapiens
actggcagagaccctgatggccaaggagtccacccagggccaccggagttatttgctggt

SEQ ID NO: 6876108 - DNA, 72 bp, Homo sapiens
ggcacaaaacttcagcagtagagggggcacagtcgcagctgcaccctggcccctccactgctccgcgttgcc

SEQ ID NO: 6876109 - DNA, 70 bp, Homo sapiens
gctggttccctgccatacctgaaggcacagaactcattccattgcttgctgtggttggctggtaactagc

SEQ ID NO: 6876110 - DNA, 59 bp, Homo sapiens
ggggtttgagctgcagtggaggataccaaagcaccggtcttctgagagttcacagcccc

SEQ ID NO: 6876111 - DNA, 102 bp, Homo sapiens
atcttagttattgggaataaagttggagtgaacatgagattgtcgatgtctgtttgatgtaccaattttcaattccttcagatatatacccaaaactgagat

SEQ ID NO: 6876112 - DNA, 68 bp, Homo sapiens
tctttggggcatgattagattatgagggtggagccctcatgaataggcttaatgcccttataaaaaga

SEQ ID NO: 6876113 - DNA, 107 bp, Homo sapiens
actgaatgatttatttgcaacttgttatctggtatagtggggaagagccacttatgtctctttaagccaagatatatttaagataacaataaagataaaatatcagt

SEQ ID NO: 6876114 - DNA, 82 bp, Homo sapiens
gggagaacaactcaaaggagaaatggtagatgtgcagcatgggagctcatatcttttcttatttctttctttcctttctctc

SEQ ID NO: 6876115 - DNA, 63 bp, Homo sapiens
tcaaggttaagccagggcctcagattcttccctggaaaatgagggtcttagcttggtctctga

SEQ ID NO: 6876116 - DNA, 55 bp, Homo sapiens
ttctctctcttgaagtattagctagagacatttgtgcagaaaaagagagagagga

SEQ ID NO: 6876117 - DNA, 64 bp, Homo sapiens
ggtggagactagaccagaggtgagtgatctttggggatatctttggccttgtctggtcttctcc

SEQ ID NO: 6876118 - DNA, 71 bp, Homo sapiens
gcccaggacctgccccagccccacctgccacctgacctgaggctcccagagggcagaggggcctcctgggt

SEQ ID NO: 6876119 - DNA, 99 bp, Homo sapiens
tcagaaaatgtttattgaatatgctctatgtgccaaacaattgtgttacggctgaatatatgaatgtttggctagatagatggatgaatgaacaaatga

SEQ ID NO: 6876120 - DNA, 61 bp, Homo sapiens
gagatggttgcaatagtttaaacgtcagtttgtctgcgtttatccaactctgtaatctctc

SEQ ID NO: 6876121 - DNA, 64 bp, Homo sapiens
tgaggagaccagggcttacagcagtagctaacttagtagctttgtgaccatggcctaggcctca

SEQ ID NO: 6876122 - DNA, 69 bp, Homo sapiens
aggacagcccaatttctcagtttaattccaactcacggggaggatttgaattgttgaaatgatagtctt

SEQ ID NO: 6876123 - DNA, 108 bp, Homo sapiens
catcaaggccctctatcacaggcctccagtgtgtgtccagctgctgtcagctacaccctgctactcatagctggagatctactgtgggttttgcccgcctgctttatg

SEQ ID NO: 6876124 - DNA, 69 bp, Homo sapiens
gtgtacaggatgtgtaaacttgggcaagtacttaacctctttgtgcatccgagtccacacctgtaaaac

SEQ ID NO: 6876125 - DNA, 75 bp, Homo sapiens
gcggtattaagtgctgtcgtggaactgggctgctgtcctactgcagtactgtcttcctgatggcaaggataccgc

SEQ ID NO: 6876126 - DNA, 77 bp, Homo sapiens
cgccagcggcgcggagctggcttttggccgagaaggcgcggagcacctccagggcctggccggctcagcgctaggcg

SEQ ID NO: 6876127 - DNA, 74 bp, Homo sapiens
tttatttaaggatatctacaatgttgaaacctcaaagtagggtttaacttagaagagatatcctccctgatgaa

SEQ ID NO: 6876128 - DNA, 60 bp, Homo sapiens
tcctctcaaatgtaatttgaggttcatttttgaccctcatttagcgttttagattctgga

SEQ ID NO: 6876129 - DNA, 77 bp, Homo sapiens
gaagagtgggtctcatatatctggctcgggccaactgaatgcccctgctcagatccagtgtgaaggaaccacttttc

SEQ ID NO: 6876130 - DNA, 97 bp, Homo sapiens
ggttcaggtctgttccatgcatggtcatgctgggactaattcggatatgcttatcatgacagcagttcgccagtgtgcatgcaggagggcatgagcc

SEQ ID NO: 6876131 - DNA, 57 bp, Homo sapiens
ggagcatcatcacacacacccatgccagaccaggccacatggcaagatgatgcattc

SEQ ID NO: 6876132 - DNA, 62 bp, Homo sapiens
ggtagccagcaataaggtgctgttgcagctcagccctgcttgcagtcactcggttggctacc

SEQ ID NO: 6876133 - DNA, 68 bp, Homo sapiens
gatggcttcccagttgccaaactccaaccatccccaagtctttggagtcattggcctgggtgactttc

SEQ ID NO: 6876134 - DNA, 63 bp, Homo sapiens
gccccagggctgctgcctgggctggacagcactgccccagccacagcttccagctcctgtcgc

SEQ ID NO: 6876135 - DNA, 78 bp, Homo sapiens
agagattacattgggatagtttcttttgaccaaaggtcctggctcctttcagaagtaaggttctcccaagctctctct

SEQ ID NO: 6876136 - DNA, 72 bp, Homo sapiens
catgaacaatttgctcactgatttatattctgttatttagtgtgaaatagctcaggtggcagagtgtttatg

SEQ ID NO: 6876137 - DNA, 67 bp, Homo sapiens
gtgtaaaaattccagagctttgttcctcactggccacaagggaggttaggcactggatttcttatat

SEQ ID NO: 6876138 - DNA, 76 bp, Homo sapiens
ggagttggcaaatttctgattgctgatgaggcccacggtgcggtggatccaggccagcagctcagccgccagctcc

SEQ ID NO: 6876139 - DNA, 64 bp, Homo sapiens
gaggcaaaggccactggggcgatggcgagaaaccctctccccattctccaagggtcttttcttc

SEQ ID NO: 6876140 - DNA, 84 bp, Homo sapiens
ttttgaagatcattagcaagtcactattttatgttacaaccaagctgtacctaatagaaagtcttgctgattcgatgattaaga

SEQ ID NO: 6876141 - DNA, 72 bp, Homo sapiens
gcagtccatcctgtgagggagcatagttatttttctttctttaagtcaatgactctctttgatggtggctgc

SEQ ID NO: 6876142 - DNA, 58 bp, Homo sapiens
gaagtagcaggaagggtcctccccgagcctggggagggagcatccccttgctgacttc

SEQ ID NO: 6876143 - DNA, 111 bp, Homo sapiens
agtggtgatatggcagtgccaagcagtggcatcgccagagtatctgtttggttagcaaatgagcagtcattttaggtcatgcagattgctgatatctgcccagtagccact

SEQ ID NO: 6876144 - DNA, 87 bp, Homo sapiens
gcttcaagttaggagagtaaagtggtatttataagaacacctgttccttgggttgcatcatgtactattttcactgttaacttgagt

SEQ ID NO: 6876145 - DNA, 57 bp, Homo sapiens
atactctgggctgttaggagctgtcttgtcatagatgttctagcagctccagggagt

SEQ ID NO: 6876146 - DNA, 66 bp, Homo sapiens
cagatgtatgtatgctgtgcttgcacatacacactgtgaattgtgagacacacgtatgtatacctg

SEQ ID NO: 6876147 - DNA, 93 bp, Homo sapiens
gggtttggcacacctggttagggctctgagtgggaaagagggtcctgaaaccaggctgagcccccagccagagccagagccaatgctggagcc

SEQ ID NO: 6876148 - DNA, 72 bp, Homo sapiens
tagctgatatacagtgtagaatcctgtacttagaaatgaagatctgagttgaactccactgtgtattaattg

SEQ ID NO: 6876149 - DNA, 63 bp, Homo sapiens
ttctacacaagctcttaaaggctgaaaggaaaatgttctttgtaacctttgggaactatagaa

SEQ ID NO: 6876150 - DNA, 56 bp, Homo sapiens
attctaggcaggccttcaggaaattgtgcctgtcatctcctgaaaacttctggaat

SEQ ID NO: 6876151 - DNA, 72 bp, Homo sapiens
gttttgttaataagctgacggaaggatttttggcatcgattttaaattcccatagtctgcttctagcgaagc

SEQ ID NO: 6876152 - DNA, 85 bp, Homo sapiens
cgggtccgagcagcttgaggctggattccaagtgacacttccctcaggcagcttgggatgcagcttggaggactgagtgggctcg

SEQ ID NO: 6876153 - DNA, 69 bp, Homo sapiens
ggaggagaggaggagtatatattagaatcacccagagggattttcagttatgccctctcttgttcttcc

SEQ ID NO: 6876154 - DNA, 86 bp, Homo sapiens
tggttcctgaagagatggtagactatggaacgtaggcgttatgatttctgacctatgtaacatggtccactaactctcagtatcca

SEQ ID NO: 6876155 - DNA, 88 bp, Homo sapiens
ttcttgtcctacagggaaaagcctgcacatactaaagttatctaggttatcttggaaagttttagctgtccagttcccaggacaagaa

SEQ ID NO: 6876156 - DNA, 92 bp, Homo sapiens
ttgaatttcggagctgccagtgtatgaattcttccagactctccctgacagaaaccatctttatatatctgctaagcagttctattttttaa

SEQ ID NO: 6876157 - DNA, 80 bp, Homo sapiens
gcaaattgcagaatgtacatgtaagttggttttattgaagttattgccaataaggccaagttcatatacaacttgcttgc

SEQ ID NO: 6876158 - DNA, 74 bp, Homo sapiens
gaggaggaacaggaggagcagctgtgtgcccaggctcagcctgcagagggacagcagctctcattcccctcatc

SEQ ID NO: 6876159 - DNA, 99 bp, Homo sapiens
gcgtggggtcacagttcttaggaacaaggccagtgcctgctgctcagggccctggtgggctgtgtgtcctccgtgcgctgggttccctgggctctatgc

SEQ ID NO: 6876160 - DNA, 106 bp, Homo sapiens
gccactgccaagtctagctgtcaggttggtctcagagctctgtcttgatccccaccaggtcgcccagcctgcgatcccacctggcctgctctatctttctgtgtgc

SEQ ID NO: 6876161 - DNA, 56 bp, Homo sapiens
ttacatattgcctctggctgctttcacagtatgacagcacagtagagtagttgtaa

SEQ ID NO: 6876162 - DNA, 98 bp, Homo sapiens
tgttgtgtcacttgagcttggccagctctggaaagtggtagattcttcctgaaggccagcgcttgtggagctggcaggggtcagtgttgtgtgtagcg

SEQ ID NO: 6876163 - DNA, 64 bp, Homo sapiens
tattttgtgacctagagcaatttattcaggttctctgagccacagttttctgagttataaaata

SEQ ID NO: 6876164 - DNA, 67 bp, Homo sapiens
gcctgcctggtctcaggcatggggacagcccagccctccccagatcccctgaggcaggcgtatcggt

SEQ ID NO: 6876165 - DNA, 69 bp, Homo sapiens
ctctaactcctgaccttacctggaaagcatgtaaatctgcctgcagggccagactgggttggacttgag

SEQ ID NO: 6876166 - DNA, 71 bp, Homo sapiens
tagaaaaccatgaaggtcctttttgttctgtgggctcctcatagaacagggcactgtcatgatgtattctg

SEQ ID NO: 6876167 - DNA, 91 bp, Homo sapiens
gccgggatggtcttgatctcctcaccttgtgatctccctgccttggcctcccaaagtgctgggattacaggcgtgagccaccgtgcccggc

SEQ ID NO: 6876168 - DNA, 101 bp, Homo sapiens
gtctgataatatttctgtttgtgaatgggtggagagagaagcacagggtctaagcccatgtgcctctgcctcatgccctgtcacttaggaaaatcgaaggc

SEQ ID NO: 6876169 - DNA, 76 bp, Homo sapiens
tcacttgaacccaggaggtggagttcacagtgaacgaagatcgtgccactgccctccagcctgggtgacagagtga

SEQ ID NO: 6876170 - DNA, 73 bp, Homo sapiens
ttttgtgggaggaaccatccaatgcagtgaaaatgataaaactcacaatgcataattggtcctccacattaag

SEQ ID NO: 6876171 - DNA, 66 bp, Homo sapiens
actaaccagcagtactctaatgcacagctccagtgccacggctgaagtttgaaatgattggttggt

SEQ ID NO: 6876172 - DNA, 57 bp, Homo sapiens
gctttcattgcagagtctgtgtgctgacctccggcagggccatctgcaatggcgagt

SEQ ID NO: 6876173 - DNA, 76 bp, Homo sapiens
tgctatggccttgggtccttagcatcagctgggaaatgctctttgtgatgggaagtgactcaggtccatcacagca

SEQ ID NO: 6876174 - DNA, 56 bp, Homo sapiens
gatttgtggtgtgaggaagagcgatgccctaagatgcagactcacgccttcagatt

SEQ ID NO: 6876175 - DNA, 70 bp, Homo sapiens
attgtaattagtttttgatctggtagttttgtaagaactttaaccatatgcaaagaaatctgattgcaat

SEQ ID NO: 6876176 - DNA, 130 bp, Homo sapiens
tatgattatttttctcgataaattatttttgctctccaagagtgattctagttagggaatatgacatcaattcccagagtaggcattaactcatggtagattggaaggctgaagatcataatatttcata

SEQ ID NO: 6876177 - DNA, 76 bp, Homo sapiens
tatatgaccaatgtggcattttttgatatcttagtcagtaatttgaaggtctagaaatgccatacgtgcctatgta

SEQ ID NO: 6876178 - DNA, 89 bp, Homo sapiens
acacactatatgtatctgcatctgcatgtgtattgtttatgcttgtctgtatactcatgtatgcatagtgagtaaatgtgtgtgtgtgt

SEQ ID NO: 6876179 - DNA, 109 bp, Homo sapiens
tttgtgagatagaacaagaatagtgtaaatttgtacttgtaaataatgtactttctatagagatttatagttgtacaaattgttcacatatgtcatttcatttcacgaa

SEQ ID NO: 6876180 - DNA, 81 bp, Homo sapiens
ctgtaatagcatatggagggtaagagggtggatataagtgcctaactacctgagttaaaattccatctctgcctcttacgg

SEQ ID NO: 6876181 - DNA, 68 bp, Homo sapiens
ctcagcttctctggtcttctgccaagctcctgttgaagagggagttggaggaggctccagacagtgag

SEQ ID NO: 6876182 - DNA, 57 bp, Homo sapiens
gtgcagggtacattgggatgggatggtgagaatggtcatttcaaaactaccctccat

SEQ ID NO: 6876183 - DNA, 99 bp, Homo sapiens
gggagttacaaccataaatacgtgggatggtaggtaggtaataaggctgattattcacaaatatgttggttcttatgcacccacatggatgtgattcct

SEQ ID NO: 6876184 - DNA, 55 bp, Homo sapiens
gttagctagtgatgaggtcagggtccatggttgggatttgaatccagctggtaac

SEQ ID NO: 6876185 - DNA, 74 bp, Homo sapiens
agagaaatgaagtctgcacatgcatgtgttttgtaccatatataccacagtgaagcatgcagacatctttcttt

SEQ ID NO: 6876186 - DNA, 104 bp, Homo sapiens
gagtcccctttccttctgtgtccatcctgggaagtggtgagggcctgaggaggcaacgggacagcttcctcgaccacctgctctgagggcaccatgggggactc

SEQ ID NO: 6876187 - DNA, 63 bp, Homo sapiens
gaagttatgaaatttggacagcttggaatcagcatttccaagctgtccaaatttcataacttt

SEQ ID NO: 6876188 - DNA, 78 bp, Homo sapiens
cgggacctatgagcatcgctgagatcccagaccttgaaagatgaggactgtggggaagcagatgccaccaaagccccg

SEQ ID NO: 6876189 - DNA, 85 bp, Homo sapiens
tggtggtggggtgaaggaagattctgttggaatctttataagctcaaatatctggcacttatagaattttcctacttggctacca

SEQ ID NO: 6876190 - DNA, 73 bp, Homo sapiens
gctgaagtcacttcttaggaaaggagtcaataaagtttgaattgttcccagtcaaacgaaggacttccttagt

SEQ ID NO: 6876191 - DNA, 65 bp, Homo sapiens
tgaagtctggtaggctgtctgtgcctttgctactgctgggatacagaggtctgccagaatcctca

SEQ ID NO: 6876192 - DNA, 60 bp, Homo sapiens
gcaggctaactcataggctgtgcacccaaagtcagctaagtatgggctgttggcaactgt

SEQ ID NO: 6876193 - DNA, 60 bp, Homo sapiens
ccacattcactcatttcattgttcaagagttgcttttccactctgccggggtgagtgtgg

SEQ ID NO: 6876194 - DNA, 66 bp, Homo sapiens
ggaagcagtctgccagccaactctgcaaaacaaagagaagagaactggctgcaagcagctgcctcc

SEQ ID NO: 6876195 - DNA, 64 bp, Homo sapiens
gcaaaggatctttctttttaccattttaatagcctgtgcaatgggattaagaaagatcttgggt

SEQ ID NO: 6876196 - DNA, 55 bp, Homo sapiens
catatatatttagatttcactgtctctgagagttcagttattcttgatgtgtgtg

SEQ ID NO: 6876197 - DNA, 69 bp, Homo sapiens
catttgcatggggaaggagtatttggagaaagggtatccccgtatttcatctcctttctgctgttgatg

SEQ ID NO: 6876198 - DNA, 59 bp, Homo sapiens
tgtctgtactggctgcatcgatggctgcaggaaggagagttgagcttttagtacagaca

SEQ ID NO: 6876199 - DNA, 94 bp, Homo sapiens
gcctggtcttggatcttgttcctcacagctggttcattcaggaggttagtgctctgctgaggaggctggaggcagagctccatcttggcctggc

SEQ ID NO: 6876200 - DNA, 63 bp, Homo sapiens
taaagaatcaggtgttattttttggttgcactctcaaagcctagcacagttcctgactctttg

SEQ ID NO: 6876201 - DNA, 76 bp, Homo sapiens
catatcatatggttttcatgggaaaaaaatatttggagctgatcttcatatttccatgttagaactaagtgtattg

SEQ ID NO: 6876202 - DNA, 57 bp, Homo sapiens
cattccacagtgtgtggtgaggactcgctgtcccagcacagggcagatgtgagaatg

SEQ ID NO: 6876203 - DNA, 79 bp, Homo sapiens
tcagctacttaaaaagatgtcatacacattaagagggacagaacttgctttagatgctgtatgttatttctgtaaatga

SEQ ID NO: 6876204 - DNA, 71 bp, Homo sapiens
tggaagatggctgtcctggagacacaaggtggttgaccgttgaccagctcttctgctctagttgccttcca

SEQ ID NO: 6876205 - DNA, 76 bp, Homo sapiens
gtacagtgtctcctggtacccagttctcctgcctggatatatcaggtcccatgctctgtggcaggaggtcttgtgc

SEQ ID NO: 6876206 - DNA, 55 bp, Homo sapiens
actacttggccaacctaggatgtgcctaaggcaaatgctctccttggtcaggagt

SEQ ID NO: 6876207 - DNA, 66 bp, Homo sapiens
aggagatggaggagctataggcaatatcattgcaagagcactgctgaagagcttctgccctttctt

SEQ ID NO: 6876208 - DNA, 61 bp, Homo sapiens
gagttaaaggaaaataactttaagaatcactcatactgtgaaagttgttttgcttcagctt

SEQ ID NO: 6876209 - DNA, 56 bp, Homo sapiens
gctgtctggcatggcgtggctggtgctctgttctggccacctcgtctcggagcagc

SEQ ID NO: 6876210 - DNA, 67 bp, Homo sapiens
tcagtgccaaggagaaggacagccttgtgtatttaattactttagcttattttgtcctctggcatga

SEQ ID NO: 6876211 - DNA, 104 bp, Homo sapiens
ttgatgcactactatgttttattttattcaacaatgaaagctaaggaatctgtatggttaaactttcagctttggttgttatgaaactctggatttgctttcag

SEQ ID NO: 6876212 - DNA, 83 bp, Homo sapiens
acattgctcttttgtgctctttatgctgtgcatttggacagaggtcagaactgcagcaggtaagagcatttggcatttcatgt

SEQ ID NO: 6876213 - DNA, 83 bp, Homo sapiens
gggtgtcctgtggggacctggctgccaccctccttaacaacagctccagggtgggagtctggccctcaaagatcagggcagct

SEQ ID NO: 6876214 - DNA, 56 bp, Homo sapiens
gagaaggagcagaaggaggaggggctgtctgagatcttttctctgtgcaccttttc

SEQ ID NO: 6876215 - DNA, 77 bp, Homo sapiens
ggaaaaatttggcaaattcttggtagtattttttgagcatgtagataaaactatgaatgaattttctaagttactcc

SEQ ID NO: 6876216 - DNA, 66 bp, Homo sapiens
tcctagacgaaagcactgggtggccttcttcacaaattggtccacactggctgagcttctctaggg

SEQ ID NO: 6876217 - DNA, 58 bp, Homo sapiens
atatccagcagcaggtgagtatacaaaaagctgagtatgaactgcattgctggtgtgt

SEQ ID NO: 6876218 - DNA, 63 bp, Homo sapiens
cccaaattgcattttaaaggtagatgcctctcatgagacatttgcatcagtgagcgatgtggg

SEQ ID NO: 6876219 - DNA, 56 bp, Homo sapiens
gctctctgttattaagatctttagaaaagtcataaggatagaaaagacaagagagc

SEQ ID NO: 6876220 - DNA, 74 bp, Homo sapiens
ttggcagtgcctcctgcttcagctgggaagccaaaaatgtgctggctcggatttgaacaggaaaggcctaacaa

SEQ ID NO: 6876221 - DNA, 92 bp, Homo sapiens
gagtagctatgacaatgaggagttttaagagtgagaaaacacaatgtctatgagaacatggacttctcttttagaggctccatgagctactc

SEQ ID NO: 6876222 - DNA, 64 bp, Homo sapiens
gcttggggagctcagtgtccttgcagaattgggactggctgctttggacctgggccccccaagc

SEQ ID NO: 6876223 - DNA, 63 bp, Homo sapiens
gggctgcacgtattctgctcacagctcacattccaatgaagtgtgactagggagtgtgggtcc

SEQ ID NO: 6876224 - DNA, 85 bp, Homo sapiens
ggctctgtgggtgcactttctgatgactttagaagtcaggtgaggctgatggcttccttacaggttacagaaagcaattcaagct

SEQ ID NO: 6876225 - DNA, 72 bp, Homo sapiens
aagatgtggcatagaatgatggttaagagctcagatgctgaagccagagtgtatattctgtgttcgctcctt

SEQ ID NO: 6876226 - DNA, 129 bp, Homo sapiens
tgacttttatgttgaaagggcaaatatcattgagagctttagcgcacatcacagggggaactaggagaatttggaactctttccacctgtgctgtggttgtctccctacctctatgtccattggctgca

SEQ ID NO: 6876227 - DNA, 129 bp, Homo sapiens
tgagttaggctgtaaaacataagttaaacgcagagtgtcctatattgaattagaccctaaaatgtgctatattttcgggtctaattcaagtaacaagtgctataatcacctttccataggctaacagaa

SEQ ID NO: 6876228 - DNA, 59 bp, Homo sapiens
ggagttggaggctccagggaactccagaaatcccagagagattccgggccaccaactcc

SEQ ID NO: 6876229 - DNA, 78 bp, Homo sapiens
gcctctgcaggtgcggttatccctggaggcgcttccattaagtccagtcagcctccctcttacccattttgcacaggc

SEQ ID NO: 6876230 - DNA, 69 bp, Homo sapiens
gctataagccaggaagagagccttcaccagaaaccaaattggttcgcatcttgatcatggacttctagc

SEQ ID NO: 6876231 - DNA, 81 bp, Homo sapiens
ataacaacaaaatcctaagcagaggaatttactatccttgggctaataaaggtaagttcctcctgttgggtcttgttttat

SEQ ID NO: 6876232 - DNA, 60 bp, Homo sapiens
caggtctgagtcacatgttcatctcagaatcagatggtacgttcaattagactcagactg

SEQ ID NO: 6876233 - DNA, 69 bp, Homo sapiens
gcaggccactgtctcctctggggaggctggctctctttggcccacccagctctaggagtggtggcaggt

SEQ ID NO: 6876234 - DNA, 61 bp, Homo sapiens
actaattccatggaaacagaaagtttgagggctacggaaggagtgtttccaaggaggaagt

SEQ ID NO: 6876235 - DNA, 64 bp, Homo sapiens
atgccagtaaaaatgttgtcaaggcatgagatgaatgcaagatattatctttgctgctatgcat

SEQ ID NO: 6876236 - DNA, 58 bp, Homo sapiens
tgtccagggatggggtcagggacgggtttggctgttgcctagatgctgccctgggaca

SEQ ID NO: 6876237 - DNA, 63 bp, Homo sapiens
cttggagttgtttatgtccctgtctgtcttctttaccagggggtggattcctacaggtccaag

SEQ ID NO: 6876238 - DNA, 75 bp, Homo sapiens
ttaggtacttaagatctcagctatgcaatgagggtcagcaacactaaatgttagcagggatacaaggtcgcctaa

SEQ ID NO: 6876239 - DNA, 65 bp, Homo sapiens
ttttaggtgaggaagtgtttgtcaaattaaattaaagaattcggctttcactttctcattgaaaa

SEQ ID NO: 6876240 - DNA, 123 bp, Homo sapiens
tgaaacaccaactacaactactttctattatacttcgtttttgttatggtctgcatctatgttcctccgtgtacataaagccctggtacagtatagtggctaaacaatgtagtgggagtttca

SEQ ID NO: 6876241 - DNA, 58 bp, Homo sapiens
tccttccaggtgcaggcaagcctgaggcgtcagggcagcaggcggccgccaggaagga

SEQ ID NO: 6876242 - DNA, 77 bp, Homo sapiens
gatatttttgtatacattatcctgtttcacttaacacagagcttagggctggaacagagagaatgtgcaggattgtc

SEQ ID NO: 6876243 - DNA, 59 bp, Homo sapiens
cagctgtttcagtagcgttactgggttgaaagcccaatgacagtgagctgagggagttg

SEQ ID NO: 6876244 - DNA, 72 bp, Homo sapiens
gaatttgcttggcaggcttccagtctatgccaatgtgagagcaagatcttccagccctgcctaagccctttc

SEQ ID NO: 6876245 - DNA, 130 bp, Homo sapiens
tttgggaatggtggagtctcagttttcctgggaaacaagtttgtagactagccataaaaacagcaaacccttctgcaggtgtctgttcatacaaacattattgttttccagaaggaagtggaaccctctg

SEQ ID NO: 6876246 - DNA, 76 bp, Homo sapiens
gatgcattggactgtaagtgccttgagtacagggatatgtctgctttgctcactctattcacagtgccagtgcatt

SEQ ID NO: 6876247 - DNA, 59 bp, Homo sapiens
cattctctcctgtgtctcaccttctgccttcctggcagtgctgggcagaggagagcgtg

SEQ ID NO: 6876248 - DNA, 71 bp, Homo sapiens
gctgagcaaaataccacgacttgttttagccggacaggcattaaaatatccagtgttattttgacctcagc

SEQ ID NO: 6876249 - DNA, 89 bp, Homo sapiens
agggtatgacatgttttgctttctggataagcagggtctctcttaaatatgaagatggctccagtgtccagagggagactaaaatctct

SEQ ID NO: 6876250 - DNA, 73 bp, Homo sapiens
gtagaactttcaggagtttcctttagtttctggggccttggttcttgaacaaagagattccattatcttctac

SEQ ID NO: 6876251 - DNA, 62 bp, Homo sapiens
ggctgggtctgtgcccagggacctcctctgagaggacagcctgagagggcagggacttggct

SEQ ID NO: 6876252 - DNA, 68 bp, Homo sapiens
tgacaaagcccagggaatggtcgggagagactggtagatccagcactcctattccttgaggctggtca

SEQ ID NO: 6876253 - DNA, 72 bp, Homo sapiens
gctggcaggataacttctaagctccttgacttctgtcaccattccttgccttggactttgtctctagccagc

SEQ ID NO: 6876254 - DNA, 66 bp, Homo sapiens
tgattttagaagccagagtttttgagaactttttgggaagattctacaaactctggtaaaaaatca

SEQ ID NO: 6876255 - DNA, 67 bp, Homo sapiens
aggagctgtgcagtgggagttcggtgcaggttagccggccattgcactctggctggaacgggctcct

SEQ ID NO: 6876256 - DNA, 79 bp, Homo sapiens
caaatgaaggttcagtgcctggaacagggtaggagtccagctatggccgcctctatgccaggcactgggcaagcgcttg

SEQ ID NO: 6876257 - DNA, 55 bp, Homo sapiens
ctgatggatttgctgaatgaacctctgtgctctggtttgattcacaaggcatcgg

SEQ ID NO: 6876258 - DNA, 58 bp, Homo sapiens
ggggaacagtgactgtgagggacctgtgtccagccctgctctctagtcctgcctcccc

SEQ ID NO: 6876259 - DNA, 60 bp, Homo sapiens
cagcacctgctcttagacacggagatcaaatgacaaacccttgggttaggagcagggctg

SEQ ID NO: 6876260 - DNA, 87 bp, Homo sapiens
ttttaatatagtgctataatagtcacagggtgctactgatatgcaggagtagctgcctagtagattgattgggagtgttaggtagag

SEQ ID NO: 6876261 - DNA, 55 bp, Homo sapiens
tggagggatacaaagatgaaaaagactggttttctctctttatagatctcctcca

SEQ ID NO: 6876262 - DNA, 56 bp, Homo sapiens
ttaagtggtaggcaattcgactgaggtggctgtagtccctgaattcctacttttaa

SEQ ID NO: 6876263 - DNA, 71 bp, Homo sapiens
gagtccagcttgtattgaagctatacctaagctcaactgctatggtagcttggtttgatataaatggattc

SEQ ID NO: 6876264 - DNA, 76 bp, Homo sapiens
gggcatgtccggttgcacatcccagaagtatatatcttccccattctgtggcatggttgcaaggacaacattgaac

SEQ ID NO: 6876265 - DNA, 80 bp, Homo sapiens
caaagaatagcatggcatttgttttccaaatggccatttcaattatttaatggttaatttaaattccatgcaattctttg

SEQ ID NO: 6876266 - DNA, 81 bp, Homo sapiens
tacatcccacactcgatgctggaatgacagctgctgcctgtacaccagcttctgtctaccggcgtgaaactggaagatgta

SEQ ID NO: 6876267 - DNA, 74 bp, Homo sapiens
gcataattattgcaagtggcataaaatttagaccagtgagtaactgagcaaatgttctactttgataattatgt

SEQ ID NO: 6876268 - DNA, 58 bp, Homo sapiens
caaccacccaaggtgagggtgtcctgtggtccatagtcaagctgcctgagggtggttg

SEQ ID NO: 6876269 - DNA, 55 bp, Homo sapiens
gggtgagagacttgggccaggtgccttacatccgggagcctcagtttcctcacct

SEQ ID NO: 6876270 - DNA, 55 bp, Homo sapiens
gtagctaagagctccaggattttgtaattaatgagactttatagtttttggctat

SEQ ID NO: 6876271 - DNA, 90 bp, Homo sapiens
gtgcagataagtaattgagtttggaagaatttggtctgttttcattttgtaaacattcactatgtccaaactctgtgctacgtactgtac

SEQ ID NO: 6876272 - DNA, 64 bp, Homo sapiens
gtaccttcctggactccgtcctagattaatgactcaaatctctggagtataaccagggatctgc

SEQ ID NO: 6876273 - DNA, 101 bp, Homo sapiens
cataaaatattagcatattagacaagatcagatgtattatatgtaattaatgttatcatataatgattttctggtgagtgatgacagttaatagctttctg

SEQ ID NO: 6876274 - DNA, 125 bp, Homo sapiens
ggttaactagtgcagaaatttctagccatgagatcaaagccatgagagatttgttaataaaacgtagagaataatataatctttggctctggtccattggtcctcggcatactgcctctctaact

SEQ ID NO: 6876275 - DNA, 56 bp, Homo sapiens
gtgctccggatctctatgcctctagttaatgtcagggcaattaggcttctgagtat

SEQ ID NO: 6876276 - DNA, 61 bp, Homo sapiens
actgaattgtttcaaactctagagtcacctgtgacatgtggcctggagagaaaagatgagt

SEQ ID NO: 6876277 - DNA, 66 bp, Homo sapiens
gagggagcttcaacttactaaaagatagaagaaattctcttgcttgggaattggagatactctctc

SEQ ID NO: 6876278 - DNA, 67 bp, Homo sapiens
tggggtatgtgctgtttctttgtgcccaggtagccccctgtacttccccaatgacagcactattcca

SEQ ID NO: 6876279 - DNA, 57 bp, Homo sapiens
tctctggagctgcagatccaggtgttcgttaccgcccggatgtggcagctctagtga

SEQ ID NO: 6876280 - DNA, 60 bp, Homo sapiens
tccatagacgtgaatgccagttatagcagtaacctgctcattggcacaccttttattgga

SEQ ID NO: 6876281 - DNA, 127 bp, Homo sapiens
gtgcggtaggcagaggcaagaggggagtcctgtgggtgggctggccagaaatcacaggcccttaaggcaggaggaacctggcacagccagaccctcggacaatctccctaggccagcacaaccacat

SEQ ID NO: 6876282 - DNA, 67 bp, Homo sapiens
cagatgggctacagccattgattggttagtcttgctttcaacatttatgaagctgtggcccaatttg

SEQ ID NO: 6876283 - DNA, 106 bp, Homo sapiens
gagccaagtttctactcattcattcattgatctgttcattcaacatgtttattgagcacctactatgtaacaggcacgggtggatacagagaaaggaagtaggctc

SEQ ID NO: 6876284 - DNA, 56 bp, Homo sapiens
tagatcatatttgtggagaaaactaaaagacgttttagctaatagatgctggtcta

SEQ ID NO: 6876285 - DNA, 72 bp, Homo sapiens
ttagccctattctaagtcctgtaagataaaatttatataatgtacaagaggctagggtgagtgcagggctga

SEQ ID NO: 6876286 - DNA, 129 bp, Homo sapiens
catgaaagcatggctttattcagtaggtgcagagtcactgcccttgaagacagaccaaggagaatgaataagtctttccctctgttttcagtggatgctcaccttatgaatggagccatatttaaggag

SEQ ID NO: 6876287 - DNA, 77 bp, Homo sapiens
gctagtagcagagccaggtctctctgtagatccatgggctccagagctgggtctgtgctcaccacattgcaactagc

SEQ ID NO: 6876288 - DNA, 91 bp, Homo sapiens
ccaggcagcttttgactgtaatctctttggccagaaaatgttttggattcgccaaaattttaaaatcaggggatgtcaaaccacagtctgg

SEQ ID NO: 6876289 - DNA, 69 bp, Homo sapiens
tactgaggctgaattcttagcagagcagattacatggaactgtgctaagttgagaataaagcttcagtg

SEQ ID NO: 6876290 - DNA, 78 bp, Homo sapiens
aggccgagtcagcgttgctcgaggtccccaccggctcaggcctctgcgcctcctctgcctcgggaatgggcttcgcct

SEQ ID NO: 6876291 - DNA, 68 bp, Homo sapiens
ttcagccttgtgtaagggccaactttgatattcaacatcacaagtttctcttgcatgcggcagatgaa

SEQ ID NO: 6876292 - DNA, 70 bp, Homo sapiens
acttttacctttggaagggacccttagtgaaggtcttgtcttttcatctgtagcatcttccaataaaagt

SEQ ID NO: 6876293 - DNA, 80 bp, Homo sapiens
agcaaattgaatccagtaataaatgaaaaagataatacatgatgattatatggggtttgttataggaattcaagtttgct

SEQ ID NO: 6876294 - DNA, 61 bp, Homo sapiens
cgcgctgcagacagcggaggcctgggccatattccaggagcagaccgtagtcctgcaggtg

SEQ ID NO: 6876295 - DNA, 78 bp, Homo sapiens
gctaggctaactcccttccagaggcttcagggaagaagctgtttccttcccccttttcagcttctagaagctgcctgc

SEQ ID NO: 6876296 - DNA, 91 bp, Homo sapiens
gaggcaggagaatcgcctgagctgaggaagctgcactgagctatgattatgccactgcactccaggctgggtgacagagtgagcctgtctc

SEQ ID NO: 6876297 - DNA, 78 bp, Homo sapiens
ccctacctcctttgggtctgcccactactctccattcccaaggattgttggctgagagtgggacagtgggagggaggg

SEQ ID NO: 6876298 - DNA, 84 bp, Homo sapiens
tgtcctcttacattgctgatggagggaatgctcaaaatatgttaattctctggcacttccgtctgccttgtgcattggaggaca

SEQ ID NO: 6876299 - DNA, 72 bp, Homo sapiens
atgaatgtgatgattctgttacagccctggaattgcacaagacgaaagcttaaggagagtcatgatatttat

SEQ ID NO: 6876300 - DNA, 70 bp, Homo sapiens
ggaacccttacgcattgctggtgggaatgcagaatagtgcagcctctgtagaaagcagtgtgttggttcc

SEQ ID NO: 6876301 - DNA, 55 bp, Homo sapiens
gatgtctttctgtgtgcctagagcctggaacaatgcctggcacgtagaagccatt

SEQ ID NO: 6876302 - DNA, 79 bp, Homo sapiens
agagccagaggaagaagcaaaccagctaatctcctggggtggcctgcatcccctttatgctggtttcttcctgggcttt

SEQ ID NO: 6876303 - DNA, 63 bp, Homo sapiens
cacagctgcacttgaagcaggttgaataaaaaccggactcagcccctttaagtccggctgatg

SEQ ID NO: 6876304 - DNA, 62 bp, Homo sapiens
caggcagtggctcacagcaacccatgtgattccgtgatacttgcaaggagccactctgcctg

SEQ ID NO: 6876305 - DNA, 69 bp, Homo sapiens
aattcacaaaaccagattgctttatcagtttatttcaagataagcacacagttctggtattgtagagtt

SEQ ID NO: 6876306 - DNA, 79 bp, Homo sapiens
gctgccatcctgggcagttttgagtgctaagaactggaaatctacccaaagcagtcaatttgctgccatgggaggcagt

SEQ ID NO: 6876307 - DNA, 56 bp, Homo sapiens
gacactgcacttggggcccacagacactgagggcttgcttgaaaagtgcaagagtc

SEQ ID NO: 6876308 - DNA, 55 bp, Homo sapiens
gtttctttagggatcatacagggcccatttctgggccctggactcctgagcaaac

SEQ ID NO: 6876309 - DNA, 80 bp, Homo sapiens
gaaaggttggggtattactagtatatgtcaagcaactttcacgcagagatgttccacaaatattggtgccccattctctc

SEQ ID NO: 6876310 - DNA, 58 bp, Homo sapiens
gcccaggctggagtgcagtggtgcagtcatagctcactgcagtcttgatctcctgggc

SEQ ID NO: 6876311 - DNA, 86 bp, Homo sapiens
gctggagagcagagaacagagttgaaacaaggctggaaggtaggccagtctggaccaagcagccttctttcaactatgtttccagt

SEQ ID NO: 6876312 - DNA, 78 bp, Homo sapiens
atctcaacctctgaggacagaagggggctctcaaatccgcccatgcattgagatcttcgctcttcacagaggtgggat

SEQ ID NO: 6876313 - DNA, 67 bp, Homo sapiens
tctgccttagcagcaattatcaatctcattaacctatagacatgtttgttggatagttgttggcaga

SEQ ID NO: 6876314 - DNA, 99 bp, Homo sapiens
gcagtcagaaggataggctgcactgtgtaacagataactcgatgatctcagtggctttgtacatcagtgcatattttttgcttatgctttctgtctagt

SEQ ID NO: 6876315 - DNA, 76 bp, Homo sapiens
agaagattagggtatcacatcacaggttgagctagataaactagagtatcttcaattcatgaagtccatgtcttct

SEQ ID NO: 6876316 - DNA, 114 bp, Homo sapiens
aaaaaatggtcgtgggctatatttcatgtccagtccaacatgttgtgtgtgcacagctgttcggggctggcatgtggtagcataataaaaggaagattaccatttccaattttt

SEQ ID NO: 6876317 - DNA, 85 bp, Homo sapiens
gagtctcgctctctcaccaggctggagtgcagtggcgcgatctctgctcactgcaacctctgtcttctgggttcaagtgattctc

SEQ ID NO: 6876318 - DNA, 56 bp, Homo sapiens
tttgtactagtcagtaaatagtagtattgtgactacaaatgactatttggtacagg

SEQ ID NO: 6876319 - DNA, 56 bp, Homo sapiens
agcaggagcatttccatgattcttaattaaatccagtagtttttggaaatcctgct

SEQ ID NO: 6876320 - DNA, 99 bp, Homo sapiens
cttccatagtcattccacaaagatgtgtttccaagtctctcaacacccagaaaacgtcaaggggttggatgccttggaaattgtgagattgttaggagg

SEQ ID NO: 6876321 - DNA, 102 bp, Homo sapiens
tgaggcaggagaatcacttgaacccgggaggcggaggttgtggtgagccgagatcacaccactgcactccagcctgggcaacaatagtgaaactccgtctca

SEQ ID NO: 6876322 - DNA, 95 bp, Homo sapiens
ttagactgcgattaactctctttgtaatcattcccttggttcgatgatgttgtggagctgaggaataataacaaggttggttggtttgtttttaa

SEQ ID NO: 6876323 - DNA, 70 bp, Homo sapiens
gcctcctctcttaaatcatattactatcctgtacatcagcagagtcagtattgaattgaaatagggaggc

SEQ ID NO: 6876324 - DNA, 55 bp, Homo sapiens
gggaacagagtgccagactgacagaaatttttgcacctcctggcatcctgttccc

SEQ ID NO: 6876325 - DNA, 76 bp, Homo sapiens
tttttattggaaattacgggttttttaatttaatagtatgcttttaaaagggatgttatctgtaagtccatgaaaa

SEQ ID NO: 6876326 - DNA, 82 bp, Homo sapiens
ctgccccctctctgttttgtgagctccttggaggtagggatcgaagcttttccctccctctgggctccagcacggagctcag

SEQ ID NO: 6876327 - DNA, 70 bp, Homo sapiens
ggtgtgagagaagctgccatggaggagagcctagaatcctgaaagtcatctaggatagtgatctcatgct

SEQ ID NO: 6876328 - DNA, 63 bp, Homo sapiens
tctggctgccatttgccccagcactgtctccatggaggtcaatgtactgtaatggctatcaga

SEQ ID NO: 6876329 - DNA, 61 bp, Homo sapiens
tcctttttaatataatttgattctggtcaacaccaaccagcttgcactatattaaggaggg

SEQ ID NO: 6876330 - DNA, 75 bp, Homo sapiens
ggtttgtactgggaaactgctcatatgccctttgggacagataatgtctttgtgtagtctgttcccactgtaccc

SEQ ID NO: 6876331 - DNA, 69 bp, Homo sapiens
actgtatgccttctgtgctccaggcaatatgctcgggttttggagacacagagcaacaaaatatacagt

SEQ ID NO: 6876332 - DNA, 73 bp, Homo sapiens
ccagacagccggcctgagccaagagtcagaatctggctatgaaagccaggtgactggctggggctggagatgg

SEQ ID NO: 6876333 - DNA, 77 bp, Homo sapiens
gtgactttgcaggtcaataaatgctatttagcttcatgtgcaaagtttattaattgacttgtgcagaagaaagtcac

SEQ ID NO: 6876334 - DNA, 78 bp, Homo sapiens
gcatagaacatccaggctgcgggtctcaagtcggcactgctgacgtttgggacattagtcgtggggactgtcctgtgc

SEQ ID NO: 6876335 - DNA, 65 bp, Homo sapiens
taaagagatcttaatatgaatgctatgtaagatgttatatgagtgtcatgtatgagatatttttg

SEQ ID NO: 6876336 - DNA, 63 bp, Homo sapiens
ctacagaatctacctcaagccattgcttaccaaatctttgttaatggattggagactctgtag

SEQ ID NO: 6876337 - DNA, 72 bp, Homo sapiens
atggatatctacattcttgtatcttctttcagcaaatatttacagaaagagagagagagtgtgtgtgtgtgt

SEQ ID NO: 6876338 - DNA, 68 bp, Homo sapiens
tagcttgtcagtgaatagctgtagaagccacataataatgaggggcatggctgactcactgtacgcta

SEQ ID NO: 6876339 - DNA, 77 bp, Homo sapiens
caggggctaggctgctctgcgaagtcagctgcctgtgtattcctgaaacaagcacctccccgggagcagcctccttg

SEQ ID NO: 6876340 - DNA, 85 bp, Homo sapiens
ccagggctgcccaaggcctggcctgcctgccggttgtcggtggccccgatgggccagggcaggaggcctgctgtggagggcctgg

SEQ ID NO: 6876341 - DNA, 70 bp, Homo sapiens
tttctttattatttcacccccaaggagagggcaaaaaaaattaagttatggggtgtgagaagtagaggga

SEQ ID NO: 6876342 - DNA, 101 bp, Homo sapiens
tcagtgagttttctatttgtgtccaggaggtgaggggaccaaatgcctcagaggctggcatttgagacccataacctctccggtggcagatgggacactga

SEQ ID NO: 6876343 - DNA, 67 bp, Homo sapiens
ctgaggggatacggtacacattgtggggtaaataagacgttgcagtattagttctggtctcttctag

SEQ ID NO: 6876344 - DNA, 64 bp, Homo sapiens
cgtcatctttcttcagccctgtaagatcacccatgaaggatgattgggagaagatgagataatg

SEQ ID NO: 6876345 - DNA, 61 bp, Homo sapiens
gctaatgctatttttctctgttaaatggctccataacaactgaggaagaggcagaataggc

SEQ ID NO: 6876346 - DNA, 63 bp, Homo sapiens
gagtgggcagtctctatgttcctgcaatatgtagatacatgggcttggaaagagactggactc

SEQ ID NO: 6876347 - DNA, 56 bp, Homo sapiens
ttccacaggactaaatgtcatcatagagtttgtgattgcactttcccctgtgagaa

SEQ ID NO: 6876348 - DNA, 83 bp, Homo sapiens
ggatgatgaggtctggcactcatgcagcaggaaaaggagctctctcttgaacctgttggagtgtaggtacttccagggcatcc

SEQ ID NO: 6876349 - DNA, 77 bp, Homo sapiens
ggtctattgtggccactgtttcttttcctctggattccttttaggtgggaggtaggagaaacagggccacagttgcc

SEQ ID NO: 6876350 - DNA, 59 bp, Homo sapiens
ggcccagcctcagacattccctggcacctccccagcagggcacagtctaaagttgggcc

SEQ ID NO: 6876351 - DNA, 84 bp, Homo sapiens
tgcctcgcgaggtgtgcctctgcaccagtactgtgcccggcctggcctacggcatctgcgcggcgcagaggatccagcaaggca

SEQ ID NO: 6876352 - DNA, 93 bp, Homo sapiens
tctagataaacccattgttaaattgaaaatattgtagaccataaatgcacatatggtgtatgatgttttcaatttatgatgggtttatttgga

SEQ ID NO: 6876353 - DNA, 59 bp, Homo sapiens
cctgatgttatctttatgagtgtctgtacttgtgggacaatcatacaaaacatgtcagg

SEQ ID NO: 6876354 - DNA, 57 bp, Homo sapiens
cagacagggagggagcgcggctgggccagaaggctgatcaccgcctgccccctgctg

SEQ ID NO: 6876355 - DNA, 89 bp, Homo sapiens
aagactagcttttacaggtggcagaagcatttactctggcattcctaggattaagtacagtgctcagtaatctaatagaagcttatctt

SEQ ID NO: 6876356 - DNA, 57 bp, Homo sapiens
attctgattgggattttatgaaataaaacacttgtccatttgatccctcatcaggat

SEQ ID NO: 6876357 - DNA, 81 bp, Homo sapiens
acacagcaatgcctagggtggatttgtgcagagtgattagagccttagtctggaataaaactacttacaacgtgaatgtgt

SEQ ID NO: 6876358 - DNA, 64 bp, Homo sapiens
ctagttgctgccactgggagcaaatgtgcttagtcattgtgcaccaccttgtggcagcgtttag

SEQ ID NO: 6876359 - DNA, 59 bp, Homo sapiens
gcaaagaacagcctgagagtggagctggctgcagcctggctcctaaggactggctttgc

SEQ ID NO: 6876360 - DNA, 82 bp, Homo sapiens
gctttggagaagcaggtttagcagacaacctcttggatcttttctgtggtttgtccttcatgttggatttatctcctttagc

SEQ ID NO: 6876361 - DNA, 121 bp, Homo sapiens
gcagttaagggagaaggcttatttctctttgtgcgttttagtaggttacattagtcgggaatgcttactttgatgatcaatgagcgatatcagagcctggagacccaatttttaaaactgc

SEQ ID NO: 6876362 - DNA, 60 bp, Homo sapiens
gacattgaagtctcccacctggccatggccatgggtcatcctggtggcagattttaggtc

SEQ ID NO: 6876363 - DNA, 62 bp, Homo sapiens
ggttgttactaaaataatgcacattgttcgcttcaaaagtgccttctattttagtgacagtc

SEQ ID NO: 6876364 - DNA, 111 bp, Homo sapiens
tttcttgctttagaagtgctactgtcatttacattctctagtaatccaattgtgaattttatggatatatatgagcatgtgaggacagggtgccagtggaaagctaagaaa

SEQ ID NO: 6876365 - DNA, 69 bp, Homo sapiens
gggcttctgaagtgtttgatgattgagtaagtgaatgtccagccctcaaaccacttccaggatttgccc

SEQ ID NO: 6876366 - DNA, 55 bp, Homo sapiens
gttgtgttcatgttcagagattctagctaatcagtgtctctggcatagactcaat

SEQ ID NO: 6876367 - DNA, 70 bp, Homo sapiens
ggagaggactgaggcctttattgagacagcttcacagtctagcttctctctgcctaggtctgctttctcc

SEQ ID NO: 6876368 - DNA, 62 bp, Homo sapiens
gaatcacagaggcaaattctgaaaagatgggtgaaatccaatcagatagcactttatgattt

SEQ ID NO: 6876369 - DNA, 57 bp, Homo sapiens
tcacatgaggcatccccgggcagcccctcacctggctccaggggccagctcgtgtga

SEQ ID NO: 6876370 - DNA, 99 bp, Homo sapiens
gccgccaagggccgaggaaagtttgttccatcagcagaagcccaggaaatgggaggctcctggtgcaaagtttcttcaggaagccctggggctgttggc

SEQ ID NO: 6876371 - DNA, 73 bp, Homo sapiens
caggtcacaggctgtgcgtgtgcatgccgaacacccacatgcacacagttggtggctcagtctgatgtacctg

SEQ ID NO: 6876372 - DNA, 56 bp, Homo sapiens
tttctgtggttagttccactatctgtatttgatagctatggaaattgaaacagaaa

SEQ ID NO: 6876373 - DNA, 108 bp, Homo sapiens
tgattatgggttcgttggtgaatgtactcaagaatttggataagaaatgtttttctctacgatgttgcctgtttagtttctttaaagcattctcacaatctataatta

SEQ ID NO: 6876374 - DNA, 87 bp, Homo sapiens
accctgggcagggtgacatgcatggtgctggtgggtggagccagccacatctgcatttaatgtataatacttcaccgggtgtagggt

SEQ ID NO: 6876375 - DNA, 60 bp, Homo sapiens
agttgcccaggtgattccattttatgccaccaggtttggaaaacaatgatttgggcaact

SEQ ID NO: 6876376 - DNA, 56 bp, Homo sapiens
tgccattgtgggaggactcctgctccaatacacagcagtctctcccagaatgagca

SEQ ID NO: 6876377 - DNA, 60 bp, Homo sapiens
tccatgtgacggtggcagtttttgggtgaaaatattttgtcagcggctctaacatatgga

SEQ ID NO: 6876378 - DNA, 55 bp, Homo sapiens
tggagttctgttgagcaaaattttcatgacagttgctgtgataagcagaattcca

SEQ ID NO: 6876379 - DNA, 66 bp, Homo sapiens
tgtcctgaacacaatgtgatgggtgttttttattataaaaatgcttagaggtgttcaaattggata

SEQ ID NO: 6876380 - DNA, 84 bp, Homo sapiens
gggcccccctgagaaaggctgcatctcgcctcagactgggacccccctgaggatggggctgtgtctcccctcagactggggctc

SEQ ID NO: 6876381 - DNA, 58 bp, Homo sapiens
gtggatagaataagtgactgcttctctgaggtttgggaggcaataaagttttgtctac

SEQ ID NO: 6876382 - DNA, 59 bp, Homo sapiens
tgatctatgaaaggatttggagttgttccacagagcattcagaagctttttattaatca

SEQ ID NO: 6876383 - DNA, 85 bp, Homo sapiens
aagaagtgggagggtggggtgcatggcttagaaactatcagacaccagagattaagttctaactccacttcccactcccaatctt

SEQ ID NO: 6876384 - DNA, 78 bp, Homo sapiens
gatgagctggaagtgagaagtttcctcagaaagggctgaaagggttggctgagaattttttttcatttcatcctcatc

SEQ ID NO: 6876385 - DNA, 72 bp, Homo sapiens
aggcagagggacagtgaggaatttgcccagggaggaccaagagaactggttcctcatgagtaccccttaact

SEQ ID NO: 6876386 - DNA, 61 bp, Homo sapiens
gtccctgcagtgcctgccactgagcctgattaccacagcctgcagaggtgctgctagctac

SEQ ID NO: 6876387 - DNA, 76 bp, Homo sapiens
ctgtgaactcacaaggcgctggtcacagaaagcagacagcctccgtgaacttcatcagcttcctctgtggttccag

SEQ ID NO: 6876388 - DNA, 114 bp, Homo sapiens
ggagtcgggatcttctgggctgggggcttggcccggtctggttttttgctccccttaatggtgctgatgagctgggtttaggaaccacttgcccgagtctcagattttggctcc

SEQ ID NO: 6876389 - DNA, 73 bp, Homo sapiens
gtcacatgattcagcccaatttttctaccccttcccctggcaacggtggttgaacttgggctggtcatatgac

SEQ ID NO: 6876390 - DNA, 84 bp, Homo sapiens
atgaatcatggctggcatgtgcataacgggctattaagggaaatagggttgttcagaatgcattgctagccttgtgtgtttcat

SEQ ID NO: 6876391 - DNA, 76 bp, Homo sapiens
atctttctggacagatttgttcttttgggctaatgaaaaattgatggttatgggtggagaacaggaccagatgggt

SEQ ID NO: 6876392 - DNA, 82 bp, Homo sapiens
accttgcaattttcttgttctttagaggcagcagttgttatttttcctccattgttcctgtgtggaaaagggcctgtttggt

SEQ ID NO: 6876393 - DNA, 65 bp, Homo sapiens
tccacatctctcgccaaccaatttactgcatccttgtgaagaaggttagaggagagatgtgtgga

SEQ ID NO: 6876394 - DNA, 57 bp, Homo sapiens
aggccatgtccttctcattgttccgtgtttgctacaaagatgattggaacatggctt

SEQ ID NO: 6876395 - DNA, 58 bp, Homo sapiens
atgcatgtgcctggtaagggggaagaggacctgttcactcctgtttctaagccagcat

SEQ ID NO: 6876396 - DNA, 56 bp, Homo sapiens
gggcgtgatttggagtctgctagccaggaggccacaggagaaacacaggtcagccc

SEQ ID NO: 6876397 - DNA, 125 bp, Homo sapiens
ctgggagtgagagatgggaaatagcctgggaaggcaggttggtgagaagactgcagatgcccttaaactgtagactggagcagtagctttgtatcttccctgctctccttcctctcaaggctcag

SEQ ID NO: 6876398 - DNA, 55 bp, Homo sapiens
tgagtgagacatcctgtcttaacagctagaatgttctgggcaaattgtcttctta

SEQ ID NO: 6876399 - DNA, 63 bp, Homo sapiens
gcacataaattcagttctgcctcttggtaaatacagcaccaagagcagggaatatttatttgc

SEQ ID NO: 6876400 - DNA, 130 bp, Homo sapiens
gggcagaatatgcaaccatttgtgaagtgattttgcctccattctcttgctctgccctctctgagacatcatgaagcagacagagaatgggtttgtcatccccactttacagatgagaatgctgaggccc

SEQ ID NO: 6876401 - DNA, 127 bp, Homo sapiens
caggaggctgagcccgaggacaggtcagtgagttcccttactttctggtttccagctggcctcagcctatggcagcccagcagagtctaggaaggagggaacgatgggtccagggctttgttccctg

SEQ ID NO: 6876402 - DNA, 80 bp, Homo sapiens
aggccttaagtgagcactttaaaatattcccaaggtttcccatgcagggtatagttaaagagcattccacttgagatcct

SEQ ID NO: 6876403 - DNA, 65 bp, Homo sapiens
tgttgcccaggctggagtgcagtggtgtgatctcgactcactgcaacctccacctcccgggttca

SEQ ID NO: 6876404 - DNA, 57 bp, Homo sapiens
cctgggatgagaacccagaattggggctctgatctccattcaccaaatcatcccagg

SEQ ID NO: 6876405 - DNA, 67 bp, Homo sapiens
cctagattatatcaaatgcaagcacagccttcaatcagctcaagcaagtgtttggtgtaaataaagg

SEQ ID NO: 6876406 - DNA, 80 bp, Homo sapiens
tgaataacttaaaatgatggtactcatgtttagcattattaacttatagttagacatgtttgctaaaatgattgaattca

SEQ ID NO: 6876407 - DNA, 116 bp, Homo sapiens
gaagagttcagaatatccttgaaatatttaacttctgcagaaaagtgcatgctgtatcagtttaaaatactatgtaatattgatgtagagtttttccagttatgactagactcttc

SEQ ID NO: 6876408 - DNA, 83 bp, Homo sapiens
ttgctgcagaatttgaggggaagttttcctgattccttaaaggaggttctcaggaagaaattctgtatctttcctctgtacaa

SEQ ID NO: 6876409 - DNA, 91 bp, Homo sapiens
cctcatggaccacggagcccagcagaaagtccagcctctggcacagctccccaaggttggccaagctgctggccctgtgagcaccatcagg

SEQ ID NO: 6876410 - DNA, 67 bp, Homo sapiens
gacccaagtccaggctggcgtagagtcgctgctgggtcaggagcgttcttgtggcaggatttgcgtc

SEQ ID NO: 6876411 - DNA, 65 bp, Homo sapiens
ggggaagaatgctctctagagaattctctttgtcctctgaagtaaatagagatcatgtcttcccc

SEQ ID NO: 6876412 - DNA, 69 bp, Homo sapiens
aagtgcaccagaggttaagcgggagatctggagccagcgatcctggatttaaccctggctctgccactt

SEQ ID NO: 6876413 - DNA, 76 bp, Homo sapiens
ctatgttgtccttggccagtttctggtgctgaggaaagatgaagacctgttccgggaatggccaaaggactcgtgg

SEQ ID NO: 6876414 - DNA, 65 bp, Homo sapiens
cttctccttgccaaagctttctctttgagtccctataaactactagtactttggcaggagggagg

SEQ ID NO: 6876415 - DNA, 129 bp, Homo sapiens
agcgaaccccggcagcacagaattcgaaccgccgcgggagccgttgggacgcgcctacccggtcactgccccgccccggcgcagactgcgtgaggcgccgccgaaggcgcggggcttgccggggatcgt

SEQ ID NO: 6876416 - DNA, 108 bp, Homo sapiens
gcagatctgcgcgtcgtggattgcagctgcaggctgtgcaggaagaagcagcaccgccacttcctcgtcccggcctcgcgcttcacgctgctccagggcgcagaaagc

SEQ ID NO: 6876417 - DNA, 77 bp, Homo sapiens
ggcatgactgaaggcacagggaggccctggtgtggagtcccacagactttgacgccagcattcccagcccagcggcc

SEQ ID NO: 6876418 - DNA, 58 bp, Homo sapiens
cgccctctgtcaccttgcagacggctttctctccgaatgtctgcaagtgtcagaggcg

SEQ ID NO: 6876419 - DNA, 86 bp, Homo sapiens
cctccaggtttctgtcttgggtggctgggtggacagtcgtgccatcactgatccagagacccaaggacagaagtgactttgggagg

SEQ ID NO: 6876420 - DNA, 57 bp, Homo sapiens
gtaggtggagctttagggactgggacagtcagtttccagcctcttgctctcacatgc

SEQ ID NO: 6876421 - DNA, 63 bp, Homo sapiens
gatggaatttggactggaagtcctttagtggccctggtataggactcaagtaccgaattgatc

SEQ ID NO: 6876422 - DNA, 63 bp, Homo sapiens
ggccaggaacataagagttggaatggtctgggatgacagccagactattgtgtgtcttgggcc

SEQ ID NO: 6876423 - DNA, 83 bp, Homo sapiens
tcggaatgagctagactggacctgacccaagcctggccacggaatatgtatggcagggtggagaggctaagtccagtgactga

SEQ ID NO: 6876424 - DNA, 64 bp, Homo sapiens
gggcttcttgagctgccggccctggggcattgagcctcaggaggccctcgggctcaaggggccc

SEQ ID NO: 6876425 - DNA, 56 bp, Homo sapiens
atgtactaagtgtgttggatatttattgatgtgtaacaatctacacttaggcacat

SEQ ID NO: 6876426 - DNA, 78 bp, Homo sapiens
actacagagatttattgctaaggctcatgcttttgcctccatttgcccaccgttgttttgtcagtcaatgtctgtagt

SEQ ID NO: 6876427 - DNA, 68 bp, Homo sapiens
gtggaggacctggcatattcattggcacatgcttgctgcgtaataaatgccagttctattatattcac

SEQ ID NO: 6876428 - DNA, 65 bp, Homo sapiens
gagccctgcagtttcctgcctgctctgtatgccttttgcaggccagcacgacagccgcaggcctc

SEQ ID NO: 6876429 - DNA, 86 bp, Homo sapiens
ggacataaaatttctggatgaaagggctatatatttttaaggtttttggatagctactgcaaaaatgccctacattttttatgtcc

SEQ ID NO: 6876430 - DNA, 57 bp, Homo sapiens
agcatcagcagactctcagctaaaagataccatttaagttgaaagtaatatgatgct

SEQ ID NO: 6876431 - DNA, 77 bp, Homo sapiens
tctgaagcagtaacctcacaccctaccagtgctacaagtgcttccttggatattggtcaagttgaggacccttcagg

SEQ ID NO: 6876432 - DNA, 78 bp, Homo sapiens
tctggcagcccttggttctcagtgatctgtgattcgcgaagcatcctaagcatcagtatcacctgggaacttgttaga

SEQ ID NO: 6876433 - DNA, 71 bp, Homo sapiens
atactcaaatcaggactgtgccaaacctatcagtgtaatgattctgggtgtcatcaaagtcttgggagtat

SEQ ID NO: 6876434 - DNA, 116 bp, Homo sapiens
cctgggactcagagcatctgctatgctgtccctgcccttcaccccaatacaaacacctacgtatggtaggggaggtggcaggagaaggggcttggctgggaggctgggttgccagg

SEQ ID NO: 6876435 - DNA, 65 bp, Homo sapiens
gccaggccctaccattttgaggatggagagactcttgtcactcagcttcaaggtgtaggccaagc

SEQ ID NO: 6876436 - DNA, 77 bp, Homo sapiens
tagaattggctgtcaggtctacaaaaatgctgctggttctatctctcatcagctttgtggccttgacctcgttacta

SEQ ID NO: 6876437 - DNA, 55 bp, Homo sapiens
gctttgtcctgctgaggatgtgtgactggtcccacatgctctccaaggacagagc

SEQ ID NO: 6876438 - DNA, 66 bp, Homo sapiens
gtgtatgtagatttttctggggagagggtctagtttcttcatgacccataaaaatttaataaatac

SEQ ID NO: 6876439 - DNA, 62 bp, Homo sapiens
gggtgactcaggaggaaagactccacctaaaatagtcgtggtatgcagtctctgagtcactt

SEQ ID NO: 6876440 - DNA, 75 bp, Homo sapiens
gagctttctcagggcgcagtgaggcagtcaaggtaacatccctgtagctgcgatcacagctcctgctgcaggctc

SEQ ID NO: 6876441 - DNA, 83 bp, Homo sapiens
ctttttgatccctttggtttctcatcctctggaagaatgatcaggcattgttcatacagtgaaggctacaagagatcaagaag

SEQ ID NO: 6876442 - DNA, 77 bp, Homo sapiens
tgcaatctccttgttgttggagggtgccatgcacagggctgggctcctccagtctgcacatcccccaaagtattgca

SEQ ID NO: 6876443 - DNA, 68 bp, Homo sapiens
gtgagattttttgttcctttcttattagagtcacagagagtcagaagggaactcagagatgattttac

SEQ ID NO: 6876444 - DNA, 75 bp, Homo sapiens
aggcggtggacggcgtgagtcctgctctgggcagggtgaggggccagcctgcctgcagggctgctgtccctgtct

SEQ ID NO: 6876445 - DNA, 55 bp, Homo sapiens
agaattgtgattatggaattaggctgaaacagtgtctacattccacacaatctct

SEQ ID NO: 6876446 - DNA, 108 bp, Homo sapiens
gggggcctctttatcttcaaaagaaaataatgctgtcttttctacttcataaagtattgtgagctttggagaagataacgtaaatgctttggaacctgtgaagccctc

SEQ ID NO: 6876447 - DNA, 66 bp, Homo sapiens
attagcttagtgtttccgtaatggcccaaaacagactgaggtcttctgcaaacactgatggctagt

SEQ ID NO: 6876448 - DNA, 86 bp, Homo sapiens
tttcctaagctggtgatggctatagtcccagtgggcttctgttttgcttccagggctctgtgactatcactgcctctagtaggaga

SEQ ID NO: 6876449 - DNA, 61 bp, Homo sapiens
gggatttctgccaaatacctgttgtattttagaattaaccagcaggcaaaggtgaagtctt

SEQ ID NO: 6876450 - DNA, 81 bp, Homo sapiens
cagaatacgctccatgtgcacactgaggctgggggagaaggtggctcccacctccctgggttatcggggcaggggcgtctg

SEQ ID NO: 6876451 - DNA, 125 bp, Homo sapiens
gaggtgttagagaagataatatgataataatcagttactatagttttgttaggagaacctccctcattttttaactgtacctagataacgaactttgtcagtttatttattttttttaatttctt

SEQ ID NO: 6876452 - DNA, 76 bp, Homo sapiens
gtgatggcacaacagttaggtgggctaatctgtttgtgcaaatgacctttgctgcagacgaagcccatgccaacac

SEQ ID NO: 6876453 - DNA, 101 bp, Homo sapiens
ccttcttccctcaaagaaagggttgtgtcttaagctggttccctcaggggaacacccggagacatagatttaagagcaattagttaattgggaggtgaagg

SEQ ID NO: 6876454 - DNA, 69 bp, Homo sapiens
gggaactggagtaaatgtcactgttgctgtgctttagcaaagagactggtggcattttgcccctgtcct

SEQ ID NO: 6876455 - DNA, 55 bp, Homo sapiens
gggcttgctgtcttgcatttctgccattgccacgagaaaaacacgatataagccc

SEQ ID NO: 6876456 - DNA, 92 bp, Homo sapiens
ggtttggtttttggaaattggatgcaaagttctggggatcgcagaatccccagatcgctaaattgaccaaattatttttaaaatattaagcc

SEQ ID NO: 6876457 - DNA, 60 bp, Homo sapiens
ggacggttctggatcaccacttctgcctcgctgtggtgagaagggtgggaatctatgtcc

SEQ ID NO: 6876458 - DNA, 64 bp, Homo sapiens
ggaaggctgtgaggggcccgcatgccagccctgtgcggcagcccaggtctctctcactccttct

SEQ ID NO: 6876459 - DNA, 56 bp, Homo sapiens
tatgccaaaatgttacatttctttcggaaaatgggaagaggaagcattatggcata

SEQ ID NO: 6876460 - DNA, 62 bp, Homo sapiens
tgtggcctagttaaggacgcctttccataaatacatagaaacggatgttattctagagccca

SEQ ID NO: 6876461 - DNA, 68 bp, Homo sapiens
aaaagtggaattgatttttggaggacgaagtctacaaatgatattgtccagagtcacttccaactttt

SEQ ID NO: 6876462 - DNA, 58 bp, Homo sapiens
gaagtatgacatttaagacaattgtgccttgagctaattggacttgctgtcaaacttc

SEQ ID NO: 6876463 - DNA, 95 bp, Homo sapiens
actctgtgacccctaatgcagctgattaacttcattgtagttcatcggaagaaataaagactaatgatttgatcttctttaggggtttcatgagt

SEQ ID NO: 6876464 - DNA, 72 bp, Homo sapiens
gggaagttgaaattccaggagagttaaaatacccctttatacgggtgttttatgcttatggagttttatccc

SEQ ID NO: 6876465 - DNA, 58 bp, Homo sapiens
ctccctgggcccatttaatgcaccacctatccctgtgctgggtcccaagcctggggag

SEQ ID NO: 6876466 - DNA, 77 bp, Homo sapiens
aaaatacagagtttcaggcttgtcccttggagattttgatttagtaagttggaaaggctatgaggcatctgtatttt

SEQ ID NO: 6876467 - DNA, 97 bp, Homo sapiens
ttagaagcctgtcaagagctcttactggatgtggtaatgactttgaacttgctttcttctgtgttatttctgaatccatgttatgacaggcgtctaa

SEQ ID NO: 6876468 - DNA, 63 bp, Homo sapiens
actcaaattgtcttttgaaagttgataaacttcagatcacatgtcaagaagataatttgcagt

SEQ ID NO: 6876469 - DNA, 73 bp, Homo sapiens
ctcttaaccagaaaatgcacttgtctggaagactattcaacatgaagacagtgtggttgtttctggttatcag

SEQ ID NO: 6876470 - DNA, 84 bp, Homo sapiens
agaatgggctcctgtctgtagagggagcgggattccgaggggcagaggttatggtggagtgctccgtcttggacagggcattct

SEQ ID NO: 6876471 - DNA, 80 bp, Homo sapiens
ggggggaattcctgctgggcctgagcaatgagccattgcttctggtggctcattgctcagcctcagcagaaatacccctt

SEQ ID NO: 6876472 - DNA, 62 bp, Homo sapiens
gttcttgagtatctgcacagtgcccagcagagtgcctggcatacagtaggtgctcaatgaat

SEQ ID NO: 6876473 - DNA, 96 bp, Homo sapiens
gagaagttccagtgacatgatgagaatgtctgtacaacatgtagcccagtacttgctgtgtggtgttctcagaacatgcttggtcttaaactcctc

SEQ ID NO: 6876474 - DNA, 75 bp, Homo sapiens
ggaaatgtggccagggcccacaggatgaacgtgactctagcccaccttcaggctgtgggcactggccatatttcc

SEQ ID NO: 6876475 - DNA, 55 bp, Homo sapiens
tgcctgccagtctaaagagggcttttcattaagtgtaaagcagacatggcaggta

SEQ ID NO: 6876476 - DNA, 78 bp, Homo sapiens
ccagctggtgccaataggaagagaaagatgggcgtaagcattgaagaagctacatctacttacattggttgaagttgg

SEQ ID NO: 6876477 - DNA, 107 bp, Homo sapiens
cgtaaagttttctcatttctaacactaaaattatgcaagaacatgaagcagaatcatcaaaatttaaacccatgaactgcatgtattttagtggggagagtcttatg

SEQ ID NO: 6876478 - DNA, 91 bp, Homo sapiens
ttatcttattatgcaaagcatgttgggtccctctttctttgacctcacacttcaaaaagaggttctcccacagccttgtatcccaagatga

SEQ ID NO: 6876479 - DNA, 57 bp, Homo sapiens
gcatttgtaaggattatctgcgttatggattacttggttagtaaggcttgcagatgc

SEQ ID NO: 6876480 - DNA, 78 bp, Homo sapiens
tcaaaattcatgtaaatgaggtgaaattgcattaaagcggccaacataacagtttcacacaacatttgcatgatttga

SEQ ID NO: 6876481 - DNA, 65 bp, Homo sapiens
gggcagtatgcatacctcagtcctaccaaccaagaactgaagtaggaagctgtgtccatgctcct

SEQ ID NO: 6876482 - DNA, 72 bp, Homo sapiens
gttgtgtaaaacctgtgatcttttcttctatagcatttcatgagaattaaaggtcttaaggttaagcaggac

SEQ ID NO: 6876483 - DNA, 74 bp, Homo sapiens
ctttttagagaagacgtttgtctctggtccacagggctgtggacagagactaaatgttgtttgtctctagaaag

SEQ ID NO: 6876484 - DNA, 129 bp, Homo sapiens
cacttcagccttctgactagctgggactacaggcatgtatcactacacctggctaattaaaaacgattttttgaaggccgggcatggtggctcacgcctgtaatcccagcactttgggaggccgaggtg

SEQ ID NO: 6876485 - DNA, 114 bp, Homo sapiens
gtgttgtaggtccaaagttgtattggagaccagctgtatacaagtcgtgtaaactttattgtctgaggacttcatcacctgtataaaggccctcacagtacggactgccaacac

SEQ ID NO: 6876486 - DNA, 84 bp, Homo sapiens
gtgtgagaggatactctgttgtctggccttcctgtctgcctatggccagtcctgcccaggctgacagaatcatctgcctcacat

SEQ ID NO: 6876487 - DNA, 55 bp, Homo sapiens
ggaagatgaagagacctgcccaaggtcgcacagctaacaggcctcttgatcttcc

SEQ ID NO: 6876488 - DNA, 61 bp, Homo sapiens
ggtaaattttatgtgatgaaactaggtacctcctagaagtgttcccatataactgtttacc

SEQ ID NO: 6876489 - DNA, 57 bp, Homo sapiens
caagtttgtggggcaacagcaggtgaagagccagcttctctctgtggtcccattttg

SEQ ID NO: 6876490 - DNA, 63 bp, Homo sapiens
tcccctaagcagatgctgtctgcacaaacttattttggaagacagtgcatctgctgacatgga

SEQ ID NO: 6876491 - DNA, 102 bp, Homo sapiens
tgaggcatgagaatcgcttgaactggggaggcggaggttgcagtgagttgagatcgtgccattgcactccagcctgggcaacaagagcgaaactcagtctca

SEQ ID NO: 6876492 - DNA, 85 bp, Homo sapiens
gagaactgccccctagtggtcctggcaaccatggtgatcatgtgacatggccataggtgactggacctgagaggacgtgtgactc

SEQ ID NO: 6876493 - DNA, 85 bp, Homo sapiens
cccatgaccagtcattaagaacccttactccactctcttctgggcatatggcaagtgagattctgactttaatggctgggatggg

SEQ ID NO: 6876494 - DNA, 67 bp, Homo sapiens
gtcttcgtcaggtgtgggtgtttggtgcctgcatgggtggccttgcacagagcagttaggggaagat

SEQ ID NO: 6876495 - DNA, 60 bp, Homo sapiens
cagtacttagttctcatggtttcttgaacattgtgaatgagagaactttggaaagtgctg

SEQ ID NO: 6876496 - DNA, 56 bp, Homo sapiens
ctccgtcttcctcactcactcccatttggctaggctttttgagtagggaagaggag

SEQ ID NO: 6876497 - DNA, 81 bp, Homo sapiens
gcctctgagagagcccatttattatcagggtcacggccaagaccgtgggcttggtttctaggtaggtggactttgaggggc

SEQ ID NO: 6876498 - DNA, 99 bp, Homo sapiens
gcaccagaatgcacagggcactctgcaggaacagaactcactcccaagtatgggaggtgaaaggttgctgcagagaacaggtacctggcaactgactgc

SEQ ID NO: 6876499 - DNA, 58 bp, Homo sapiens
ggtctttggactctctctccttcctttgcagatggaaaggcagagaggaccagagact

SEQ ID NO: 6876500 - DNA, 93 bp, Homo sapiens
taattaaagttcatttgagataattaaatcaaaacctctagtctgggttggagggtgataaagttatctggcgaaatatatgaacttctgtta

SEQ ID NO: 6876501 - DNA, 85 bp, Homo sapiens
ggagtctaaattgataaacttagaaagaatgttgtggttctatagctaaagcaagatttttcaggttagtatagagctagacttt

SEQ ID NO: 6876502 - DNA, 66 bp, Homo sapiens
tgtgattcagtgtggcccatgaagaggataaagttaaatgcctttgatacggtgacacgaaataca

SEQ ID NO: 6876503 - DNA, 103 bp, Homo sapiens
gagcagatggaaattctatctagagctcagggtggatcagagtcagcccacagcttggctcccacctccagcctgagttccaggtgcttgtgtccagctgctc

SEQ ID NO: 6876504 - DNA, 68 bp, Homo sapiens
gtgaggggtggctgagcagtttgcatatattaggtcaattccccaagctgctggcctcattcattcac

SEQ ID NO: 6876505 - DNA, 64 bp, Homo sapiens
cagtggccagaagactgcaatgctctgattggccagccctgagtcttgtggtcttctgtccctg

SEQ ID NO: 6876506 - DNA, 65 bp, Homo sapiens
ctgggtctctgtcctggctgccctggactctaacctgagttctggggtcctgggatgggatccag

SEQ ID NO: 6876507 - DNA, 64 bp, Homo sapiens
ttttggctactgtacagaaagccatgtaaccccagaagcataggttcgagtgaggtagccagaa

SEQ ID NO: 6876508 - DNA, 72 bp, Homo sapiens
tggagttagaagcaggcctgccacctcggggttcccagcgccattgggaccatccccaggccactgaagcca

SEQ ID NO: 6876509 - DNA, 86 bp, Homo sapiens
tatctttgtgtaggtacatggggtgtgtgcacgtctatctccacatgtatatatgtgtgtgcacatctgtgtgtgccttgaaggta

SEQ ID NO: 6876510 - DNA, 107 bp, Homo sapiens
tttgctgcttgtttttcaagtgtgagtctactgatgctatacttctcagattttggaaaatgtctgtagctagtatcagcatggtaataatgagaaagaccagcaag

SEQ ID NO: 6876511 - DNA, 75 bp, Homo sapiens
ttcaggctcttgggatgtaacctttgttccgtgacagcctttaatggggcctaaggactactctcagaccatgag

SEQ ID NO: 6876512 - DNA, 59 bp, Homo sapiens
atacaggcagagaactcatccgtgacattgtctagcatttcacagtctactgcctttat

SEQ ID NO: 6876513 - DNA, 69 bp, Homo sapiens
ctgagtaaactgcattaaagcatcagtctttcttgtctagagtagaactggtggtgatcagttattcag

SEQ ID NO: 6876514 - DNA, 71 bp, Homo sapiens
aagcatatgaactctggagtctgagtgcttgggtttaaattctaccacttacttaagagttgtatgagctt

SEQ ID NO: 6876515 - DNA, 83 bp, Homo sapiens
gtaactgcagtacagcacagagcatcgcacagaacccaggaatggaatgtagccaagtctgtgaaattgtatactgcagcaac

SEQ ID NO: 6876516 - DNA, 72 bp, Homo sapiens
tagggtagtacagagagtgtcctaaagggccaagcacacaggtgagattatgacactcctgtgcgcaccctg

SEQ ID NO: 6876517 - DNA, 57 bp, Homo sapiens
atgtatgtgtgtgtacttatgtcatttaaatgtttgtatatgtgtacgtgtatacat

SEQ ID NO: 6876518 - DNA, 87 bp, Homo sapiens
ttggtaagtcactgaactaaatgatattttggtttcctcaactctaacatggggaagataatcatatcttttttaatgggttatcag

SEQ ID NO: 6876519 - DNA, 60 bp, Homo sapiens
tactgtacaacctctgcccctgtacggtcatgctaccacaccagagaagttgttacagtg

SEQ ID NO: 6876520 - DNA, 96 bp, Homo sapiens
aatactgatggatgttttttactggtttacccaagatttgctgagttcttataatgaattcggaaaagctctgtgaacaggaagacaatcagtgtt

SEQ ID NO: 6876521 - DNA, 58 bp, Homo sapiens
aacaagcagatgcaatgcactttggaactcatgaattcctgctttgcatctgattgtt

SEQ ID NO: 6876522 - DNA, 86 bp, Homo sapiens
gtgcattgcccacctcactccagtcctggtcctgccctagagaaacccagctcctggatctggggtagagcagtgggccaaggcat

SEQ ID NO: 6876523 - DNA, 66 bp, Homo sapiens
aacacttctcatcactgcaagccatagctttaaatggcggtgaggtctgcagttgtagaagatgtt

SEQ ID NO: 6876524 - DNA, 77 bp, Homo sapiens
attctgagtcactgtccacctgcatacagaacagagagccatctcagtagcaggatttgggattattgattctgaat

SEQ ID NO: 6876525 - DNA, 70 bp, Homo sapiens
tggacagagctgacagtatatatctgcagccaaatattgccatttagaactatggtgttagtgctgtccg

SEQ ID NO: 6876526 - DNA, 73 bp, Homo sapiens
gctggctacaaaatttttagacaaggctttgcctccttaaacaatcgcaagtttaaaaatctttgaatccagc

SEQ ID NO: 6876527 - DNA, 92 bp, Homo sapiens
gccacctggtagcatcttggggtttcctgggcgtggcctgtaaatttgtatcatcacaaggggccagtgaccagtaaccagtgaccagtggc

SEQ ID NO: 6876528 - DNA, 94 bp, Homo sapiens
gctatgtttcacagagtgcataatatacatgcttgatcctgactctaaaagccttaggagaagagactgcatgttatctttgtgcctacagggc

SEQ ID NO: 6876529 - DNA, 55 bp, Homo sapiens
gggcagttgggtgacaccatcagcttcttgaggctgcttctcactcatttgcacc

SEQ ID NO: 6876530 - DNA, 100 bp, Homo sapiens
gctagtaagactgccttatgaggaaagagactgctttatattgtactcattgagtgggatgggaggccttttcaaggtctttgggccattcttactttgc

SEQ ID NO: 6876531 - DNA, 70 bp, Homo sapiens
tcatcatttcctccggaagctttatatcaacctttgacccaaagcagaaaagttctggagaaaataatga

SEQ ID NO: 6876532 - DNA, 66 bp, Homo sapiens
gagatagtgctggcaggatagaagtctaatcatgaaaatgacatacctttgcttttgccatatctt

SEQ ID NO: 6876533 - DNA, 60 bp, Homo sapiens
gaggataagtgcttttaaagcaaacaaacctgaggcgtgttgttaaaggacacttgcttt

SEQ ID NO: 6876534 - DNA, 93 bp, Homo sapiens
gtgtctccagagcttaaaacagtgtgtacacatcataggcgctcagatgtctgtgcatgaatgaataaactggctttgacaggtttggggagc

SEQ ID NO: 6876535 - DNA, 77 bp, Homo sapiens
ggcctatgtcattgactggatcagacctgatctggtggctcatatctaatcaggtgtggtccaatcagcagtgggcc

SEQ ID NO: 6876536 - DNA, 104 bp, Homo sapiens
ctggtttcagaagatctcttgtcctcagatatgtctactctcattaaaacaaagcatgaagagttccatggctggggatacaggcagagaaaccttgattacag

SEQ ID NO: 6876537 - DNA, 66 bp, Homo sapiens
gttaagtcatagtctaacccagccaggagtgtgttcagcctggaaaaaggtggacggtgactgcac

SEQ ID NO: 6876538 - DNA, 68 bp, Homo sapiens
agtacatggataaaatatttgatggacgtgcagccacccatgctatgaaacacatttagttcatgtct

SEQ ID NO: 6876539 - DNA, 60 bp, Homo sapiens
tacccttagctggagtggtggaatgacttatctagtcttctgttactgttagctgaagta

SEQ ID NO: 6876540 - DNA, 74 bp, Homo sapiens
agaaatgtgaaacgcaatgggatcatctggaaatatgaaactgaactatgatgaaaaccttttttctcatttct

SEQ ID NO: 6876541 - DNA, 62 bp, Homo sapiens
ggcaggaagctcatgtggactgattctagccattggctccagcttagcatgggcttcctgtt

SEQ ID NO: 6876542 - DNA, 73 bp, Homo sapiens
cctgacctcttgcctcagtccaaacctggcttccttgatctcagctttatttgttctgaagcaagtagggagg

SEQ ID NO: 6876543 - DNA, 82 bp, Homo sapiens
ggactggagcctggccaggcttgggacagacacatcctgatagggcctgactgcgcaggccatggtacggctcctgtggtct

SEQ ID NO: 6876544 - DNA, 55 bp, Homo sapiens
ggggaccaggactcttctgagctgagggtgacgtgttcagggcagtccggtcccc

SEQ ID NO: 6876545 - DNA, 89 bp, Homo sapiens
tgtttttttctacttggatgccctttaatttcactgttattcaatctatgattttgtatttagaggtagacaaagcagaggaaaagaca

SEQ ID NO: 6876546 - DNA, 82 bp, Homo sapiens
gacaggggaaatggtgaagagcacttttcttatctgcaggcatcacgcctgcaagtgctgtcttctgctacttctcatggtt

SEQ ID NO: 6876547 - DNA, 64 bp, Homo sapiens
gcacgcctgtccccaggagagtccggcgcttcacctgttccctccattccaggacgggctctgc

SEQ ID NO: 6876548 - DNA, 65 bp, Homo sapiens
cagctacagtctgattggttcagaggagagcagattctagccatgaacgaatggggctgtggttg

SEQ ID NO: 6876549 - DNA, 87 bp, Homo sapiens
ggtaaagctgaaggtttttgtttgtgaaatgttacactaagataggagcttgtgacagatctttaaataatgcttttaaaatgtgcc

SEQ ID NO: 6876550 - DNA, 68 bp, Homo sapiens
tgaaagctggctctgcagagtgccttaaaaatgactttaattaggaaattctgagttgtcagtcttca

SEQ ID NO: 6876551 - DNA, 88 bp, Homo sapiens
gtggaggtcccaccacaatgtcctggagggcggccgctggctcagtgagaagcgacaccgcctgcaggccatccaggatgggctccac

SEQ ID NO: 6876552 - DNA, 95 bp, Homo sapiens
gttctaatggttcaagcagggtcctgaggtgagtcagtggcaggccttggaaccgggacgtctggctgacctgaggagtcctgtggattagcagc

SEQ ID NO: 6876553 - DNA, 101 bp, Homo sapiens
tgattgactaattttcaaaccagttcacatccatcacaagtttgttcatctatttacttggaaagaatagatggaaactgaagcttgaaaaaaagtaatca

SEQ ID NO: 6876554 - DNA, 63 bp, Homo sapiens
cagtatttgagaggtccaggtgtgactggcttcaggcacccacatttaaccctcaggtttctg

SEQ ID NO: 6876555 - DNA, 65 bp, Homo sapiens
acttctgctctgtcaagaaaagatgccctcccccgctgggaggtcagtgctggcgtgagagaagt

SEQ ID NO: 6876556 - DNA, 89 bp, Homo sapiens
tgccctggaagttaaatacctgaaactgtatggccatggcatccttgcttgggcaagcagcattcagaagcagattggctttcagagca

SEQ ID NO: 6876557 - DNA, 101 bp, Homo sapiens
ctctagggctcaggctgtttgatgaatagacaccaaagagttggcagtgggcaagatgctttcaccccgaggtttgggtctatcccagatagagctctgag

SEQ ID NO: 6876558 - DNA, 78 bp, Homo sapiens
gtcacccaggctggagttcagtggtgtgatcttggctcactacaaccttacaacctctgcctcccaagttcaagtgat

SEQ ID NO: 6876559 - DNA, 129 bp, Homo sapiens
gtattcaaagtatcaataaccttggaaaatacaatgcttttatttaatatcttgcatgtaattccctatgtggaagaaagtgtgtatgtttaatagaatgcattggtttggaaagaatactttgagtat

SEQ ID NO: 6876560 - DNA, 61 bp, Homo sapiens
cctgttttagctgtggtggaaggagtggcgatagatccttccacaatgaaaataaagcagg

SEQ ID NO: 6876561 - DNA, 56 bp, Homo sapiens
tggcactgtcaagaacttaataaatcagagataagtgagttaaaatgtcagtgcca

SEQ ID NO: 6876562 - DNA, 65 bp, Homo sapiens
gtgtctgctcagcttgctagaactttttacctccctatcctctagctgctggggagggcagacac

SEQ ID NO: 6876563 - DNA, 129 bp, Homo sapiens
gtgaccctcagtcagtgcctagcaggtttcttgggctctctcccagcacagaggaaggcaacatctcacttctaggtggctctttctgtctgggatcctgatttctctagtcttgactgcttgggcagc

SEQ ID NO: 6876564 - DNA, 69 bp, Homo sapiens
taatagttccatcattttgtatccaaggggaaaggattttcctcccagagaaaaactgaagagctgtta

SEQ ID NO: 6876565 - DNA, 59 bp, Homo sapiens
gggtcagggtggggtggggtggggcattctaatcccatggtcacccaggctgctggctc

SEQ ID NO: 6876566 - DNA, 63 bp, Homo sapiens
ctggggaaccggaatcccccaccggcccaatcatgttgctgctggggtctctccggtgcccag

SEQ ID NO: 6876567 - DNA, 73 bp, Homo sapiens
tgtaaaatccgagaaaccagaagttgcctttgctactcactcagtggctgcttgctgtttcttggattagata

SEQ ID NO: 6876568 - DNA, 130 bp, Homo sapiens
aggctggggtcctcctgggggacagcacagtcagtggagagagccaggggctggaggtggggcccaccccagcctctggtcccagctctgctgctcacttgctgtgtggcctcaagcaggtcactggcct

SEQ ID NO: 6876569 - DNA, 76 bp, Homo sapiens
ggatgaggccaaggagcctgatttaggattctagactcttgtgttggaattttgtattagctttgaggtcttgtct

SEQ ID NO: 6876570 - DNA, 62 bp, Homo sapiens
gagaaacactgttagtttattatcttatgaatctgtgacttctgcaactgattgtgtttctc

SEQ ID NO: 6876571 - DNA, 74 bp, Homo sapiens
tgttacggtaacttctctgctatcataggataagtgaggcatatgatcttttgaaaagcagatgttaagtggca

SEQ ID NO: 6876572 - DNA, 56 bp, Homo sapiens
aaatgagcaacttgagctcagcatggaagtttgcagagctctctacttgcacattt

SEQ ID NO: 6876573 - DNA, 58 bp, Homo sapiens
gctgctctctggcccattgtcagtggtcatctgccagtgacaatgggccagaggtggc

SEQ ID NO: 6876574 - DNA, 79 bp, Homo sapiens
ggtggtaagaggggctgtgtgtggagtttctgtacatgtgtttctgctatggttcctacagccctgaatctctatcacc

SEQ ID NO: 6876575 - DNA, 128 bp, Homo sapiens
tgatcctaactggagcatattttccttgaatttaaagtcaacttatacgaccttcatgctggactacacagtgagtatcacaggctatgtgggttttgtttctgatttttcaagctctaagtagttca

SEQ ID NO: 6876576 - DNA, 66 bp, Homo sapiens
gctttgacacagatcaatattcaacttagcaagaatgagatgaaaggaattgatttgtgttcaagc

SEQ ID NO: 6876577 - DNA, 72 bp, Homo sapiens
gatgaggcgagcacgttgtttgaagaaagccaacatcaatgcaactgaggccagacaaagcgcttgcctgtc

SEQ ID NO: 6876578 - DNA, 79 bp, Homo sapiens
gttgggtttaatctttgtagcgttagcagtgtggagcctaattgtttcagaggtcatgcctgatgctgcacaacccggc

SEQ ID NO: 6876579 - DNA, 84 bp, Homo sapiens
ctccatgtgatagatgaggtgccatgagtttgagtgactgagcctcagtcctctgactcccatggcccgcatagcagcaaggag

SEQ ID NO: 6876580 - DNA, 73 bp, Homo sapiens
ttggagcctctgtgggaacctgcactttgtgcttttccagaagcagaggagcaagttgctacagtggtcccag

SEQ ID NO: 6876581 - DNA, 89 bp, Homo sapiens
tgttggcttgaaaagctggtcagattggtctactcaacagcagagacatctctgtgcagatgtagaccagtttcagaatggggcccata

SEQ ID NO: 6876582 - DNA, 55 bp, Homo sapiens
actgggagagtttgcttataatgcattctcacaataggctgagcttctcctttgt

SEQ ID NO: 6876583 - DNA, 94 bp, Homo sapiens
atagaaaaatacttattttaggaacttaggtttatggattttatcatgagattcatagtgttcccttagttcctattaatagatttttatctat

SEQ ID NO: 6876584 - DNA, 90 bp, Homo sapiens
gtcactgaaaactttttctaaaatagattttatggtgcaatctttaagttattttgcattaggaaggttatctgttttagttcaggtgac

SEQ ID NO: 6876585 - DNA, 76 bp, Homo sapiens
tgatgggtatgttcatttgcttgatagtaatcagttcattatgtctatcaagataagtcagtatatcaaaacatca

SEQ ID NO: 6876586 - DNA, 94 bp, Homo sapiens
gacacatcattaacaccctgagcccatagttgacattaggttcactcttggtgttttacattctatgggtttgaaaaatgtataatgacatgtt

SEQ ID NO: 6876587 - DNA, 81 bp, Homo sapiens
gcactggtggtcactagggcaggttggcatcccgggcaggggtttgatcctggctgggcccccctgctgtgtcaccagggc

SEQ ID NO: 6876588 - DNA, 60 bp, Homo sapiens
ggggcagggtctgggggctgcttctgcagcttcagcgcagaaaacccagagctcagtccc

SEQ ID NO: 6876589 - DNA, 62 bp, Homo sapiens
cactgcagccacatagatgacgttccctttgttggaattgcaaagttttgtggctagtagtg

SEQ ID NO: 6876590 - DNA, 103 bp, Homo sapiens
ttgaggcagagtctcgctctgtcacccaggctggagtgcaatgacgccatctcggctccctgcaacctccgcctcccaggttcaagtgattctcctgcctcag

SEQ ID NO: 6876591 - DNA, 114 bp, Homo sapiens
tcctgggggggtcttcccagcaagctctacagaagcagcgcggctcttctctcgtgggtgtggatcttgagatgggcgcgctgctctgatgcggtgctgcgtctcccttcagga

SEQ ID NO: 6876592 - DNA, 98 bp, Homo sapiens
tcccgtcccctcgaggcagtcgtggaaaggctgggtttgggatgtgatgggggtagccctggggtcctctcagtcccacggaggccacggggaaggga

SEQ ID NO: 6876593 - DNA, 64 bp, Homo sapiens
ggtactactttcccccacatatttgcagtcgttatcctgcaaaaaatgggggatgggtgttatc

SEQ ID NO: 6876594 - DNA, 71 bp, Homo sapiens
catgatccagcccagacaccatcattctagggctttaccattatccctgaagagctgggcaatggactatg

SEQ ID NO: 6876595 - DNA, 61 bp, Homo sapiens
tgctttctttgtggcacaaattgcttttctcaaaagaagaaatttgctaagcaaaggagca

SEQ ID NO: 6876596 - DNA, 88 bp, Homo sapiens
taaagaaggcaagttggtcgcaattagtcacatgtttttataattaccatgtagaaattagtaagatcaactatggcacactacttta

SEQ ID NO: 6876597 - DNA, 64 bp, Homo sapiens
caggtggcagtgcctgcattctgaatgtcctgcgctgacacaggtaggttattgctgctacctg

SEQ ID NO: 6876598 - DNA, 69 bp, Homo sapiens
ggtcccactaagttcttttctatgtaatatgatcgttttaatgagggataggacatggatgagggcacc

SEQ ID NO: 6876599 - DNA, 79 bp, Homo sapiens
ctccccctcttcctcctgggcacactcaccacgtggagggtgctggcccttgatgctggagtggctggaggagcaggag

SEQ ID NO: 6876600 - DNA, 59 bp, Homo sapiens
gcaaggatttagtacaaaagagtagtgggacaagccaaagctagtgtctagattgttgt

SEQ ID NO: 6876601 - DNA, 60 bp, Homo sapiens
tgtcaggtttggaggggcagaagcaaaatttaaaaaattgtttatacctgcaacctgtca

SEQ ID NO: 6876602 - DNA, 79 bp, Homo sapiens
gttgcctatttgaaagggaaacagccatatgaaccgttttgtggttccaggtgttgctgtcttcctaaatagtagcaac

SEQ ID NO: 6876603 - DNA, 59 bp, Homo sapiens
gggcactgggagccagagtcacctagagagagtcctgtctgaaacttggtcctatgcct

SEQ ID NO: 6876604 - DNA, 74 bp, Homo sapiens
tctggggtgattcagttgctggtgttggctgtgaaacagtacggtatgcttcagagaacttgatcgctgccagg

SEQ ID NO: 6876605 - DNA, 94 bp, Homo sapiens
gtgcccctcttaagagcttttgtaggtgatatagtctctcacttccaaacatgagttcttcacattacctacggtggcactgggggtggagcac

SEQ ID NO: 6876606 - DNA, 70 bp, Homo sapiens
gaggtaggccgaggaagctgagtcagtgattcttttaaatctcaaattcccttttcctcctgcttgcctt

SEQ ID NO: 6876607 - DNA, 58 bp, Homo sapiens
tggagttagtagcatttcatgacatggcttcaaccagctgtatttgctactgacccca

SEQ ID NO: 6876608 - DNA, 99 bp, Homo sapiens
gctgatgtccttagttctgtagattatcaaggtgccaattttcagtgaacagagccctcttctgaaaggcaggttgtttgcaagcttggtctcatctgc

SEQ ID NO: 6876609 - DNA, 62 bp, Homo sapiens
cttgcattgataagactatatttggagcactgtgtctgcttcagatattaatatcaattagg

SEQ ID NO: 6876610 - DNA, 76 bp, Homo sapiens
gcatataagatgacagtgaatctccgtgatgtcatatgtcaaagaatgacacagagatgtacagttacttatctgc

SEQ ID NO: 6876611 - DNA, 71 bp, Homo sapiens
cttcacatgagtttccctgcactgttgttcttactattgtgtctagtggaacacatctaaggaagcagaag

SEQ ID NO: 6876612 - DNA, 55 bp, Homo sapiens
ttccttccccctcaagagaacttaatttactcaaagtcctccctgggtagaggag

SEQ ID NO: 6876613 - DNA, 89 bp, Homo sapiens
ggatggtaagaatgttgtgtttgatttttgtttgtttatttctttgaagtacatgaacaataaaatagatcacaggaaaattattatct

SEQ ID NO: 6876614 - DNA, 56 bp, Homo sapiens
gtatggatggatgaagcatcttaggacatctaaagaaagagatcactcctccatac

SEQ ID NO: 6876615 - DNA, 71 bp, Homo sapiens
ctggaattatgaccaaaggtcccttctccagatataagtgaagcagccttccctgtggttatctattccag

SEQ ID NO: 6876616 - DNA, 89 bp, Homo sapiens
tgtaggtagaacttgctggacatccatcctgtagaacaccagagaaagttgttcaaggggagatgtttcactgcaaacactctactaca

SEQ ID NO: 6876617 - DNA, 63 bp, Homo sapiens
ctaagaggaagtactctgttatgccgttcccaaagcactttgttcagaggcactttctcttag

SEQ ID NO: 6876618 - DNA, 71 bp, Homo sapiens
gcaaactgcaaacttgtgagctaaataaatggtcattattattttaagtgtctaagttttgggtggtttgt

SEQ ID NO: 6876619 - DNA, 79 bp, Homo sapiens
gcagagcggctccgcggcgggagctgagcggaaggcgcgggctgcgatctgctctctgttcccctggatccgcctatgc

SEQ ID NO: 6876620 - DNA, 130 bp, Homo sapiens
ttacacaaagttgtttatttatttttggtcctaagagttttgcactgtgaatgcatttaaagtattttgaaatttgagaattagtgtaatgacatttagacgaacttaaaatttttaactttccttgtag

SEQ ID NO: 6876621 - DNA, 66 bp, Homo sapiens
tgagaaggatgggcaagatttccccatgtgagaatcctttatgtgcattatctagttcatttctta

SEQ ID NO: 6876622 - DNA, 65 bp, Homo sapiens
aggagataggcactggatgaccgaagaggacagttttcttgcctctttacccagagctctctcct

SEQ ID NO: 6876623 - DNA, 61 bp, Homo sapiens
gctcacccacctcactggattattgtaaagagggaaaagataaatgtgagcagggctgggc

SEQ ID NO: 6876624 - DNA, 64 bp, Homo sapiens
tgggacagttaccatatcttcactgtcaactataacatgacatgaagaaaatatgattacccca

SEQ ID NO: 6876625 - DNA, 56 bp, Homo sapiens
ccaggctccggcggatacctaatgcccctggtgggcacatctgctggcaggtctgg

SEQ ID NO: 6876626 - DNA, 59 bp, Homo sapiens
gatttcagggtgtcttccagctgaaatctcaatgttcacagcatgaaaaacctgaaatc

SEQ ID NO: 6876627 - DNA, 55 bp, Homo sapiens
tcaggcaggacaattatttaggactgaagcattgcaggataattatccttcctga

SEQ ID NO: 6876628 - DNA, 94 bp, Homo sapiens
agggaggatggagaaggaggtgagtcatgtccaggttatggctcccatgcttggtcgttggcctgggcatgaagcatcgtgtgccatcctctct

SEQ ID NO: 6876629 - DNA, 72 bp, Homo sapiens
agggaagacgtatctcttttaaagaactgagaaatgctccttagaaggctttgagagatacttgacttccct

SEQ ID NO: 6876630 - DNA, 60 bp, Homo sapiens
tatgatggactaaaagggaaaccagaagcctatttcttaagcccaactggatccatcata

SEQ ID NO: 6876631 - DNA, 71 bp, Homo sapiens
tgatgtgtggaagctgatattaatttagtactttgagtgtcaatgtgcaatgtataagatttcacacatta

SEQ ID NO: 6876632 - DNA, 86 bp, Homo sapiens
gcatgtgaactgggagggtcttgaagagggtacccagcctcggggtcccggcacctccttaactctcccggctcttttccacgtgt

SEQ ID NO: 6876633 - DNA, 71 bp, Homo sapiens
tgtccttcttatatctttatcctggactacccatcaagtgaatatttcagaaaggataattggaaggtata

SEQ ID NO: 6876634 - DNA, 87 bp, Homo sapiens
gtccagcgttacaaatgccaaagctgagagagaggacaactgaaaattcacaggaatttctgagttttgctattacctgtactggac

SEQ ID NO: 6876635 - DNA, 67 bp, Homo sapiens
cgtgctccctccagaagctctaggggagaattcattccttgcctcttccagcttctggtggctgctg

SEQ ID NO: 6876636 - DNA, 85 bp, Homo sapiens
gcatcccaagtacagctgggaatcagctggggagtgctgtcaagaattctccctatcaattgattccaggccagtttgtgattgc

SEQ ID NO: 6876637 - DNA, 57 bp, Homo sapiens
cagggcttgatctgcatcctgctagtccgtgccctcccatatgcaaatgaagccctg

SEQ ID NO: 6876638 - DNA, 63 bp, Homo sapiens
ctatggaagagttttcattgacttctctgattctaaaccgaagttctgattgtttttccatag

SEQ ID NO: 6876639 - DNA, 79 bp, Homo sapiens
gcaggctaagagcacagttttgtcttggtttccagtttgtgctccactacttatcagctgtgtgatcttggccaagtgc

SEQ ID NO: 6876640 - DNA, 59 bp, Homo sapiens
agaagataagaaagtttgtgataatacttatgcaggtatgagtggtctttctgtcttct

SEQ ID NO: 6876641 - DNA, 70 bp, Homo sapiens
catctatcccttaacaaaagtttacttagtgccttctctatgctaggcactgtgttacatgttgaagatg

SEQ ID NO: 6876642 - DNA, 61 bp, Homo sapiens
gtgtcaggcattactcagagtttcttactatgtaagaccctctgccagatgctttagatac

SEQ ID NO: 6876643 - DNA, 109 bp, Homo sapiens
catggcttggggatatggggctcagttcccttggggctctttgccaggcccagataagggctgttcagggcactcatgggctgatggagttctttcatccccaggtctg

SEQ ID NO: 6876644 - DNA, 59 bp, Homo sapiens
gttgagtgttccagaaactggccctgtgtgcaccagggctggaggctggcacgttgggc

SEQ ID NO: 6876645 - DNA, 78 bp, Homo sapiens
gggagcgtctaagagtgtgttgtaggctcaaatggtttttccaaaagccaagcctaaaaacaggcttcaggggtgcct

SEQ ID NO: 6876646 - DNA, 80 bp, Homo sapiens
gagagccgggagtccagagggctgcaggatgctgccaagctccagccccaccaccgagcagccactggaaccacggcctc

SEQ ID NO: 6876647 - DNA, 65 bp, Homo sapiens
ttgaagaaccatctgtgccactggcatattgacacagcgtcatccagatacagtggtttctttag

SEQ ID NO: 6876648 - DNA, 62 bp, Homo sapiens
gagcatggatagaaggtgggatagagaattgggatcacttttgcaatccatctaccatgttt

SEQ ID NO: 6876649 - DNA, 67 bp, Homo sapiens
aattgtaagctccatgaggacagggtctacattttgtttgttttgtttctcagagtctattacagtt

SEQ ID NO: 6876650 - DNA, 66 bp, Homo sapiens
cagatgcaaatgggaaacccagcagtaaatcaatagaccctgagcttctgatcccagttgcaactg

SEQ ID NO: 6876651 - DNA, 71 bp, Homo sapiens
ttacaataattgcaagtggttaatagaaacatccttttacagcttctatttaccaaatgtagttcctgtgg

SEQ ID NO: 6876652 - DNA, 79 bp, Homo sapiens
gtcttctgtaatgactgtctttccattgtatattgtgtgtgtgtatgcatgtgtgcatgttagagagagttcaggtaac

SEQ ID NO: 6876653 - DNA, 92 bp, Homo sapiens
cttctgccttctctaagagccagaacgcatcgccaaggctgaaatcagagatgaggctgatggctgtgagttctgcctgtgagctgcagagg

SEQ ID NO: 6876654 - DNA, 59 bp, Homo sapiens
gactgaagtgtaggtgttttcctactgggtttctcttcctgggaaaacagacactagtt

SEQ ID NO: 6876655 - DNA, 89 bp, Homo sapiens
gccttggaccttatagtgcacttcaactcactgtatccctgcatctctaagatcctgcaggagttaagtgctctcctggttcccatggc

SEQ ID NO: 6876656 - DNA, 90 bp, Homo sapiens
tggatttaatactcaaaaggcagagattagcagaatgattaaaaagtcatccagctatattttgcctgtaagagacatctattggattca

SEQ ID NO: 6876657 - DNA, 61 bp, Homo sapiens
ggtgcagtcagccatagcctctcctggctgccagccagtgcaggctgagggtgattgtgtc

SEQ ID NO: 6876658 - DNA, 105 bp, Homo sapiens
tttttcaacaaatgcttccaatgcttctatcacattgtaagtggtctgtatgacattaagtcagatcccgtgtatagtaagctggatgttcaagttgtagaagaa

SEQ ID NO: 6876659 - DNA, 78 bp, Homo sapiens
tgctcagtttcctggataagatgagaaaaaacattgggcctcttgggcagtgttccacacatctggggaagctgagta

SEQ ID NO: 6876660 - DNA, 68 bp, Homo sapiens
ggggtttgtgtttctaaatgtttttctcgaaccaatgttcttcaacagttttagaacactgttactcc

SEQ ID NO: 6876661 - DNA, 59 bp, Homo sapiens
gttctgtcattttcttccaatataaggtttcactatgattggcatgagaatggcttagc

SEQ ID NO: 6876662 - DNA, 55 bp, Homo sapiens
agctaatgggagaccctttcactgcattagttttgacagaggtcttttaatagct

SEQ ID NO: 6876663 - DNA, 84 bp, Homo sapiens
gagggcctgaggccttggagagggaactgggaggcctggcttctagcccggctctgcctctgaccctctggcctcagtgtcctc

SEQ ID NO: 6876664 - DNA, 86 bp, Homo sapiens
ttttctggttatctgagtttgttttacatggattatcattatcgtttttcaaaatataagagaatatgattcagaccattagaaga

SEQ ID NO: 6876665 - DNA, 130 bp, Homo sapiens
gagccttgcagactttcatttggagtttgaacctgttttggttgcatttcatttttggggaacttcattaatgtgagattggcaatgcaaatgcaggtgcagttttctgttaatgttaattctgttgttt

SEQ ID NO: 6876666 - DNA, 62 bp, Homo sapiens
atccagaagaacttcctaatatattttcacatgcaggttgtatgtggagggaagggatggat

SEQ ID NO: 6876667 - DNA, 75 bp, Homo sapiens
gataggcccggggagctgcctctctgcaccccactaagaactgaaggctgaagaccccagctccccaggcccttc

SEQ ID NO: 6876668 - DNA, 61 bp, Homo sapiens
tatgtggctcattgtttgcttacggagactgatgtcatagggtaagctctatgggtacata

SEQ ID NO: 6876669 - DNA, 56 bp, Homo sapiens
gcccccgaggaggtgatgtcgctcagggcgatcacatctcccacttccttgggggt

SEQ ID NO: 6876670 - DNA, 68 bp, Homo sapiens
accttttggccatcttctcgcagagtgctccctgctaacggggacaggtaaagatggtggcaggaggt

SEQ ID NO: 6876671 - DNA, 94 bp, Homo sapiens
ttagtgactttttgattgtccttggatgaagctgggatctgtgtgaaaaatgaaatgtactatccctattcctagggataatcactatcactaa

SEQ ID NO: 6876672 - DNA, 65 bp, Homo sapiens
cagccaaagaagagtaacttttaactttacgtggctacaagtatgttcctagtgctcttcggttg

SEQ ID NO: 6876673 - DNA, 73 bp, Homo sapiens
cccaatttttggagttttcaagagaagccagaaatctgttgtatatttttgtgaaatctccagacatttcagg

SEQ ID NO: 6876674 - DNA, 69 bp, Homo sapiens
gtcggggcctgaggaggttgacggcactgtgaataattcatccgcctgtaatgattttctagcccttgc

SEQ ID NO: 6876675 - DNA, 63 bp, Homo sapiens
cccacttcagaggggactcaaagtcagcatctatagtctgatcctgatcctctgaggcaaggg

SEQ ID NO: 6876676 - DNA, 67 bp, Homo sapiens
ctgacacccagcagaactgggagcctccttgctctgctccctccaggcagctgggtactgtggtcag

SEQ ID NO: 6876677 - DNA, 78 bp, Homo sapiens
tgctttccctgggtgctgatttcacaggtcttggtaacaccatgaaatgaaatagcaccaaggtttaacttggaggca

SEQ ID NO: 6876678 - DNA, 124 bp, Homo sapiens
tcagggaccaccctagccaggccctccaggagacacccttgtgtgtactcaagagcatgccatttacataggctgtcacatacatggtgctttcttggtgtgccgcgcagtgtgtcaaccctga

SEQ ID NO: 6876679 - DNA, 60 bp, Homo sapiens
gcattgtgaaatttaaaccatgtcagcaaaaactgacatagttagcacacttacaactgc

SEQ ID NO: 6876680 - DNA, 81 bp, Homo sapiens
tgggtcggttagaatcacatgccagaacttgtaccaatcactgaagctagagaaatggagtactgtgctgtaattgaccca

SEQ ID NO: 6876681 - DNA, 83 bp, Homo sapiens
taaggtaggctatttggaacttataataagttttctggtagaaacaatatccaaagagttccatgagtttcaggctcccttta

SEQ ID NO: 6876682 - DNA, 60 bp, Homo sapiens
gccgtcctggactgggtgaggcacatgtgcaggtatgtgcagctagtcctggacttgggc

SEQ ID NO: 6876683 - DNA, 74 bp, Homo sapiens
tctgtcttagatgcagagagctgcttcatctggaggtcacatcctttccagggcagctctcatctgatgactga

SEQ ID NO: 6876684 - DNA, 57 bp, Homo sapiens
ttctttactcccaggatgtgcctgcaaacttggcccaggatggtgtgagtgtgagga

SEQ ID NO: 6876685 - DNA, 90 bp, Homo sapiens
ggagagagggctgaaactgtccttgaaaaaatggatttctcagtgtgatgtgtatacagtgtccctttttcagacatggcaccttcgtcc

SEQ ID NO: 6876686 - DNA, 66 bp, Homo sapiens
atgccaagtgccaaggggtagacaacctggctgtttaatctgcattctacacttggcacctggcat

SEQ ID NO: 6876687 - DNA, 65 bp, Homo sapiens
tgtgtgtgtgtgtatgtgtgtgtatatatttatatgtgtgtctatacatgtgcacacacatcaca

SEQ ID NO: 6876688 - DNA, 76 bp, Homo sapiens
ttactggttattgtttttgctgctttcttctggggattgcttctagaacaggaataagggaaatatgaatcagtaa

SEQ ID NO: 6876689 - DNA, 93 bp, Homo sapiens
tgtctatttcctgggcggtgggcgttcttcattctgtgagccacttggcttttacagtggacctgccattctgtggtcccaatgaggtggata

SEQ ID NO: 6876690 - DNA, 60 bp, Homo sapiens
taggaatcaacaactgttttttgcataaaagaatgcatgactagaagttggtgatttcta

SEQ ID NO: 6876691 - DNA, 72 bp, Homo sapiens
ctggatgatattttgcaaattcttgtctagcctttgaaagaaagcaggctattgatttggaagtttccccag

SEQ ID NO: 6876692 - DNA, 59 bp, Homo sapiens
gggaaaatgcagttgaatttgggtatgacacctgtcaacagcaaaggaaacatgcaccc

SEQ ID NO: 6876693 - DNA, 80 bp, Homo sapiens
caaggatgtccatagacaggtgttggcatagaacctgccttacaaaggcctctgccccagccacacctggactctccttg

SEQ ID NO: 6876694 - DNA, 70 bp, Homo sapiens
agaagaaaggaagctgccaccctcttgccatacactctgggggcctctgttctgcattcctccttcttct

SEQ ID NO: 6876695 - DNA, 84 bp, Homo sapiens
atactatctggtttgtgctcttcattctcccaaataggaaattttcctgagcaaggagagtcaagaggatggcctcagatgtat

SEQ ID NO: 6876696 - DNA, 64 bp, Homo sapiens
tccagaaataaagtggacagagtagttaactgggctacttcttctcattcacttcattttttga

SEQ ID NO: 6876697 - DNA, 79 bp, Homo sapiens
tgcacatgggcctctgagataccttaaagaagctcagctacttttatggctcctggcaggtgtttcaaggaatgtgaca

SEQ ID NO: 6876698 - DNA, 70 bp, Homo sapiens
ggtggaacaattatatttagaatgatacagtgaaaaaattaatgtattttctgaagataatcaagtcact

SEQ ID NO: 6876699 - DNA, 69 bp, Homo sapiens
aagggtcagggaataaaattgtaaattgtagcaatagcagagaaatacaattttgtcccagcttccctt

SEQ ID NO: 6876700 - DNA, 59 bp, Homo sapiens
ggttggatttgaagttattactgcaggagattaggtcagagtatgctacaaagccagcc

SEQ ID NO: 6876701 - DNA, 112 bp, Homo sapiens
cacacgcccggggagggcgagactgtctggtttgggcgctggagcaaggctcggacctccggctccttgctctcccaagcccgcagacagtggctccttccccagggctgtg

SEQ ID NO: 6876702 - DNA, 79 bp, Homo sapiens
tatgtacttctgtgtttttttctcctttaaatatgatatagtgtatgaatgggaaaaggaaacgaagttaagaaacatg

SEQ ID NO: 6876703 - DNA, 59 bp, Homo sapiens
atttggcagtataaattctggctatattttttgttgttagatttatttggctgttaagt

SEQ ID NO: 6876704 - DNA, 126 bp, Homo sapiens
agaggaatgcaggatcctgttctttcagagggccactccagttgcttgctatccagatcagtcagcacattgacggaaggtctcagcggtacttgaggttgaccccagggctctgcgtcatcctct

SEQ ID NO: 6876705 - DNA, 72 bp, Homo sapiens
gccccagaccctttgacttgtgacattactggtttgcagacataataactacactcagaggaccatggaggc

SEQ ID NO: 6876706 - DNA, 101 bp, Homo sapiens
ccagttcttatctcaaggttttgcttgtaagggaacccaaatcaaacaggatgatacaggagttcactttaggggcatcaaacctagtggtaagggcctgg

SEQ ID NO: 6876707 - DNA, 116 bp, Homo sapiens
gctggatggctcaaacagaatttggagattagccatggactgaattgactgctgttaagtcacaattagcataggctgtctgtcttttcaattggtctggataatgcagaaccggc

SEQ ID NO: 6876708 - DNA, 85 bp, Homo sapiens
ttaaccatcatatggtttctctccaagttgtcctcagaggcctctggctggagatagtaggatccataaatgtttaaatggttaa

SEQ ID NO: 6876709 - DNA, 128 bp, Homo sapiens
ttatcacacaccttcacagttttaccagtgtcagaaggaggcctgttttctcctggaatgctacattctttggggatgaagtgttttgagtctttagcactgcattggagtgtctctggagtgtttag

SEQ ID NO: 6876710 - DNA, 55 bp, Homo sapiens
aggacagtgtggaagagggtgcccatgggagggacaatctcaggcaggctgttct

SEQ ID NO: 6876711 - DNA, 55 bp, Homo sapiens
cctgaacagtctgaaaggagacacaatgttaaagtccttgagcaggctgcccagg

SEQ ID NO: 6876712 - DNA, 79 bp, Homo sapiens
agacaagagctgaggacatattctagcccccaagaagtgctggagtattcccactcctcagcaatttttacttttgtct

SEQ ID NO: 6876713 - DNA, 126 bp, Homo sapiens
ctgcattttaggccacccagtctaagacagagaggtaaaatatatagtgcttgggccactcgtttgttattaaattcactatgtattcagcttcacttatatccttagaaaagtttgcgaatgcag

SEQ ID NO: 6876714 - DNA, 97 bp, Homo sapiens
tctgtatgcacacacatataccactgtaaatgactttttctgtacctgtgtgcttgcctctttcaattgcatgtgtgtgtgtctgtgtgtgtacaga

SEQ ID NO: 6876715 - DNA, 56 bp, Homo sapiens
ggctcactggaattcaagatactgaggctgtccctcccctctgcattccagcagcc

SEQ ID NO: 6876716 - DNA, 111 bp, Homo sapiens
ttagaaataaccacaataaagaaccttgaaaccacatcttagaaagtcagtcaggccccctggatgttttctaggtgtgttttcaaagttctttattatggctatttctaa

SEQ ID NO: 6876717 - DNA, 61 bp, Homo sapiens
gtttagctctttattaaggcccagatgctagggtttgctggctatctgtaaggaattgagc

SEQ ID NO: 6876718 - DNA, 59 bp, Homo sapiens
tcacttctaaataactgttcatctgtaacctctaacagagacaggtcagggagaggtga

SEQ ID NO: 6876719 - DNA, 72 bp, Homo sapiens
agtgaaggcttgccacttgttagtctatgagaaggatttaagtatagaggacacggtggtctgcaaaacatt

SEQ ID NO: 6876720 - DNA, 78 bp, Homo sapiens
gcacaacattctggagctggcagggccctggacgatcctttgtgtacagcccgggctctgcggctcccatctttgtgc

SEQ ID NO: 6876721 - DNA, 118 bp, Homo sapiens
tagactgatagctcctggagagcaaggatctcgtgcttttcctgcttgtcacttgtactgtaaagcacagtggtgaaagcatgggtctgttctgttcacgcttttggctgtcagtcta

SEQ ID NO: 6876722 - DNA, 73 bp, Homo sapiens
gtgaagagagttgtatgtttctaaaaatgatgatagctagtagttttagaaaccctataattcactgcttcac

SEQ ID NO: 6876723 - DNA, 56 bp, Homo sapiens
gtcctggttttcacagacctttccaattaaatggcgttgttcttgaaaagcaggac

SEQ ID NO: 6876724 - DNA, 130 bp, Homo sapiens
gattcaggatgtattcagagtgtggagaagggtttctctgggaacataaatgaagtgggagccagaatgaatattttctgcttcaaatgtcttcttgagtgatcctgccactgaagttcattctgtgaac

SEQ ID NO: 6876725 - DNA, 130 bp, Homo sapiens
tgccttttcctaacacttgtcttattatttcgaaggtctttgcctagggagcactagctgccttgcacaagttgaggctctactgtgcccttggacatgagagctaaggcatttgttggttcagaaagca

SEQ ID NO: 6876726 - DNA, 67 bp, Homo sapiens
gtgctccctccagaggctccaaagggagattccattccttgggtcttccagcttctggtggctccac

SEQ ID NO: 6876727 - DNA, 62 bp, Homo sapiens
tttgcggatgtccacgtcacacttcatgatggagttgaaggtggtcttgtggatgccgcagg

SEQ ID NO: 6876728 - DNA, 68 bp, Homo sapiens
ccaagcaaaggttggaaatgtttaccaaagtagtgatttcttgggcgtcttcagctttttaagtttgg

SEQ ID NO: 6876729 - DNA, 58 bp, Homo sapiens
tcatggaccaacattcactggcatacttgtgacctatgccttgaaatgtggtcacaga

SEQ ID NO: 6876730 - DNA, 90 bp, Homo sapiens
gaggctttacattcttgctgattttgatgtacctaccgagtgtggccaaaggtggctcttggtaagacattagaggttacagaattcctc

SEQ ID NO: 6876731 - DNA, 84 bp, Homo sapiens
gaaagtgtatgggaaagcccttgagtagtacagtttaggccagaggtagccccagaattcacagggctttccgcatggactttt

SEQ ID NO: 6876732 - DNA, 59 bp, Homo sapiens
tggagtatgcttggccctgcagtcacccccaggatgatttccacagtcaggggtgccca

SEQ ID NO: 6876733 - DNA, 65 bp, Homo sapiens
aaggtaacacagcttctgagtgaggatttaagtaaagtaaatctgatacaaagtctgtatacctt

SEQ ID NO: 6876734 - DNA, 56 bp, Homo sapiens
gagacattagatcagggaccataatgaagtgaagttatgattcatgatgatgtctc

SEQ ID NO: 6876735 - DNA, 75 bp, Homo sapiens
acccatctgctacctttgtcggtgactgacttggaacttttccatccagctctgaagaaaggtgtctaggagggt

SEQ ID NO: 6876736 - DNA, 61 bp, Homo sapiens
acttggctgcttttgtgcacatttcaaatgtttttgatcaaatgcgtatgcagtccaatgt

SEQ ID NO: 6876737 - DNA, 64 bp, Homo sapiens
acaaggtagtaaagttcttgatcctgacatgttaacacagtgaaaggctatttgctcgccttgt

SEQ ID NO: 6876738 - DNA, 87 bp, Homo sapiens
tctaaaaattggaaatccctgttttaagttgatattgaaaaacagaactgtttcagggacttgaatatagggagttttaaaactaga

SEQ ID NO: 6876739 - DNA, 104 bp, Homo sapiens
gggctgaaaggactgtctgaggatcttctgaaattttgtgtacttacatttttctaggaaaagggtacaaagatttcataagatttataaggaggtctatgccc

SEQ ID NO: 6876740 - DNA, 75 bp, Homo sapiens
gtggtacacgtaaacactctgtgaggcatgtaatggagccagcatgttatgtggagtgccgtgtaaccaacccac

SEQ ID NO: 6876741 - DNA, 56 bp, Homo sapiens
agaggtaaagagaggggaaattggcaggagtgattgcttgccttctctctgcctct

SEQ ID NO: 6876742 - DNA, 59 bp, Homo sapiens
tcccagtctagagccggattggcgagttagacgcttgtagatccaaggttggattgggg

SEQ ID NO: 6876743 - DNA, 83 bp, Homo sapiens
cctctctgtccctttctggcagtgaagtcatgaggtacaataagcaaaagctgccatcgtgcacattacctgccatagagagg

SEQ ID NO: 6876744 - DNA, 56 bp, Homo sapiens
atgaaggaattccagtgagaactgctgacagcaatatctgtactggagacctttat

SEQ ID NO: 6876745 - DNA, 66 bp, Homo sapiens
atagtgtatggaaggtcctacagagcgcattatactgatgcgttccagtgcccatccagtcactat

SEQ ID NO: 6876746 - DNA, 56 bp, Homo sapiens
ggcatctttatctccagagcggtacccagaagaatactgaaaggagtcgggatgtc

SEQ ID NO: 6876747 - DNA, 69 bp, Homo sapiens
ttcagttgtttagttattgttacagtatgagtgtttgatatttagtttgttattttaactacaattgag

SEQ ID NO: 6876748 - DNA, 74 bp, Homo sapiens
ctgacaagctcagcctctgcgctctgtgctgtcaagtgctgcccacccatcagtgtgcagaggcagcctgtggg

SEQ ID NO: 6876749 - DNA, 57 bp, Homo sapiens
ggccaggctatgccccccattggaaagagaacctccagtgacccagggttcctggct

SEQ ID NO: 6876750 - DNA, 78 bp, Homo sapiens
cagctcagatactagtttcttgacgatgttttccatggaccttatctgaatacaccaaggaatcagaattttgaactg

SEQ ID NO: 6876751 - DNA, 72 bp, Homo sapiens
gccactacttttcacttcctccgcaagcaagagttcctaaaacagctgctaagctgaggaagatgagagggc

SEQ ID NO: 6876752 - DNA, 61 bp, Homo sapiens
tgatctcactcactgcactttgaaatgtgggggtaattaggccctcagctgcagtgaatca

SEQ ID NO: 6876753 - DNA, 71 bp, Homo sapiens
ggagcatttaattgccagtgcagttccctccagagtatgtttccctttggcttgatgactggcagtgtttc

SEQ ID NO: 6876754 - DNA, 129 bp, Homo sapiens
tgatttaaacaatctttcttaaaaaaattctttccctgccagcattgtcattagaacattagcagtaattaaaaccataagtagaagttctagatgactgagcagctgagaaagagcaattaaacatca

SEQ ID NO: 6876755 - DNA, 63 bp, Homo sapiens
tttcccttgtaccttgtggaatcactggcaaattgtgttggaggtctgaggagcagtgggaaa

SEQ ID NO: 6876756 - DNA, 60 bp, Homo sapiens
acattttaaaaacagtacctggaggtgactaagtgactactgcactgtgatttaaaatgt

SEQ ID NO: 6876757 - DNA, 56 bp, Homo sapiens
agaggcacaaactggaaaggacaaagtctgttggtccttggttttttgtgccctct

SEQ ID NO: 6876758 - DNA, 57 bp, Homo sapiens
tgggaggaagtgctaatgggaggaaacaggcagagtcccggtcccagctttctccca

SEQ ID NO: 6876759 - DNA, 57 bp, Homo sapiens
tgctctctggttccagtcaggaaccacgcattggtggttcctgatgcaagagagaca

SEQ ID NO: 6876760 - DNA, 118 bp, Homo sapiens
cctgactcctggcatgcagggaagggttgtgggcaggcaggggggcggcaaccacagtgggcaaggactactgcccttcttcctgctgcagcctccacccttggcagccactctcagg

SEQ ID NO: 6876761 - DNA, 63 bp, Homo sapiens
cactgggaggcagtctctctagaagaggtcaaccttctgaggaggtcagcagtctcatcagtg

SEQ ID NO: 6876762 - DNA, 81 bp, Homo sapiens
ccttttcatttggttgcgtcaggagcctcatagcagcatgctactgacaggtgattgtgaactaagtgttatagcagaagg

SEQ ID NO: 6876763 - DNA, 64 bp, Homo sapiens
ttcgctctgcagcccagtagggaagaattattgatccctctactgagagcagcagatatgtgaa

SEQ ID NO: 6876764 - DNA, 122 bp, Homo sapiens
tgtgaggtgagaacaaaaataggaatatgaaaactagaggagatgaaatctgacctagatatcttttctggtacacattatgcttctctaaaattttgaattcttgattgaaacagcctcca

SEQ ID NO: 6876765 - DNA, 72 bp, Homo sapiens
tctgcccctgctcatggctgtcccctgcaatcagccccttcactgtgggacggccacccacgcagggtctga

SEQ ID NO: 6876766 - DNA, 70 bp, Homo sapiens
gagccagggcatgtctgcggcccaggccagggcgcagtgtgtgccctgggggcccaggcctgcatggctc

SEQ ID NO: 6876767 - DNA, 57 bp, Homo sapiens
ctgaccttgtgatccgcctgccttggcctcccaaagtgctgggattacaggcgtcag

SEQ ID NO: 6876768 - DNA, 102 bp, Homo sapiens
gagcagctgggcgccgccttggaatcagctgggggagcacctctccttgggacgggatgacagggcttcccaggcggtccccacaagcccgcgccccagctc

SEQ ID NO: 6876769 - DNA, 60 bp, Homo sapiens
gcctgaggaggtcacctgaggtgggaggagccaggcctgtcatctccagactcccagtgc

SEQ ID NO: 6876770 - DNA, 78 bp, Homo sapiens
tctttggatagtagctctggcattctttccaaaagtttactttttaaaaatgaaatgttagaaagctattgttttgga

SEQ ID NO: 6876771 - DNA, 66 bp, Homo sapiens
aaccaggaaaaacacattgaagagggggaatcataatcatcccacttcaacagttatttcttagtt

SEQ ID NO: 6876772 - DNA, 87 bp, Homo sapiens
agctgagggcctcagaggggatgcttggagaagctgaaaaatccacaagctgttctctgaaatttcctcccctggggcagcctcact

SEQ ID NO: 6876773 - DNA, 60 bp, Homo sapiens
ggggcctgggggctgggctctgccacacagtcacctaccagagctggcctgccaggccct

SEQ ID NO: 6876774 - DNA, 65 bp, Homo sapiens
cctgccctccccagccgtgaaggagaggaggagcccctccgcctggtgcaggctggggaggcagg

SEQ ID NO: 6876775 - DNA, 69 bp, Homo sapiens
gtgaccagccttcagcagacacagggcctgggtgccctctggaaatctgtgtgtgccgagggtggccac

SEQ ID NO: 6876776 - DNA, 74 bp, Homo sapiens
gtcccgggagcccggggaatactccgtccaggggtccttgaccctctggttcagggctccctggctcccaaggc

SEQ ID NO: 6876777 - DNA, 70 bp, Homo sapiens
cccttgctttttccatgcctagaacaggattctcagcccagagaaccagaggaaatggaaaaggggaggg

SEQ ID NO: 6876778 - DNA, 63 bp, Homo sapiens
tttggcagaaatgtggctgggagcttcattgctgattttttcagttttaatattgctgtggaa

SEQ ID NO: 6876779 - DNA, 89 bp, Homo sapiens
tgtgtgtgctgaaacctgggcctcagagatggtcagtgagaaggactaggtcattcattgcctctctgggccctcttagctaccacaca

SEQ ID NO: 6876780 - DNA, 106 bp, Homo sapiens
ctccactgagcggctccactgggctgttttatcacagaataagaagtcattaagacaagtcacttaaaacctatgagaaacagatatggccagctgatctaaggag

SEQ ID NO: 6876781 - DNA, 76 bp, Homo sapiens
tgcatcagaatcagaatctctgggagtggatcaagcacctacattgttaccaagctcttggggttcacctgatgca

SEQ ID NO: 6876782 - DNA, 65 bp, Homo sapiens
cccccaaggttcctctctccacccagccctctctgggcttggctgggatgaggtgacccaggggg

SEQ ID NO: 6876783 - DNA, 114 bp, Homo sapiens
acttgcttctcaccaatagaatagggcaatggtggcaggatgtatgtgattatacatacatgtttacattacataagattgtaacctagtcttgctagctttgagaaagcaagt

SEQ ID NO: 6876784 - DNA, 79 bp, Homo sapiens
ctttgtaaacagggcccagctctattgaattacaggtcgcaggtctgtgatcaacctgcagggctggacctgtacagag

SEQ ID NO: 6876785 - DNA, 55 bp, Homo sapiens
cagcatgactcactgtggtcaccctgtgacctacttccactgtgagttttggctg

SEQ ID NO: 6876786 - DNA, 76 bp, Homo sapiens
tcacccatctatgaagccttcccaacttttgacagagctggctcttgaaaggagattggaggcacagtggatgtga

SEQ ID NO: 6876787 - DNA, 99 bp, Homo sapiens
gcctattatctactcaaaacagattggagagagttaaagcactgattttgttgttgcctggtttattgctttcaatctaattgagagacgttaaatggc

SEQ ID NO: 6876788 - DNA, 80 bp, Homo sapiens
atccatttatgtttttcttactgtatttgttttgtttattttggtgccaaagcagacgcagtaagggtagataattggat

SEQ ID NO: 6876789 - DNA, 126 bp, Homo sapiens
ataaataacaaaatgtgcctctgcatctgctaactcatgctttttgacaacaagctgtgctgaaagacagtcagttgatattgcagacaagcactgtgggctgagcagttgcaatttgtttattgt

SEQ ID NO: 6876790 - DNA, 64 bp, Homo sapiens
ggttttgacctctccaaatcctaaacatttgcaatgtgtagaggtatttttgatggtcattact

SEQ ID NO: 6876791 - DNA, 70 bp, Homo sapiens
tgggtgagaaaaatgagtatgattttgaggaagaactggtatgcccataattttgcacttttctcatcta

SEQ ID NO: 6876792 - DNA, 71 bp, Homo sapiens
ccagcacttcctggagtaagttaagatgttcctgctttggccctcagggaattggacactccaggtgttgg

SEQ ID NO: 6876793 - DNA, 62 bp, Homo sapiens
tgtatcttattcatcactgaatcccagcacatgtaggtgttcaggaaatgaatacagacaca

SEQ ID NO: 6876794 - DNA, 55 bp, Homo sapiens
acggaatgtcctattgtaggcggttggagacacctgtgttttaatgatattctgt

SEQ ID NO: 6876795 - DNA, 62 bp, Homo sapiens
cagctgtgtcatcctggaaaatgaaggacagtgatttattttgtagtgtgtagacacaggtg

SEQ ID NO: 6876796 - DNA, 82 bp, Homo sapiens
ttggggaggaggctggcgccgcctgccggaagcctaaggaaactcagggctcgagggaagccggcttccagccgccccccag

SEQ ID NO: 6876797 - DNA, 107 bp, Homo sapiens
tgtatcatttctgtaattcaagctgtttgaactgaataacatagtgttaggatcactgtttaattgttctagttttgatagatacaatgctttatgtaagtgaaata

SEQ ID NO: 6876798 - DNA, 98 bp, Homo sapiens
gggggagagtgtcaggtgcttgctgtaacaagcccttggcaagtatagaaacagtttaagtgttaaggggatatagcagggccctgacagcatctgct

SEQ ID NO: 6876799 - DNA, 67 bp, Homo sapiens
tggcatcattttcagctggccaaataagaaagaaaagtggttagttcgtaagtatgaagagatgcca

SEQ ID NO: 6876800 - DNA, 75 bp, Homo sapiens
attgcttgagcccaggaggtcaaggctgcagtgggttatgactgtgccactgcactccaacctgggcaatgcagt

SEQ ID NO: 6876801 - DNA, 61 bp, Homo sapiens
cctctgtgtcctggtcattgaatgggcacttgagtcacccagggccattggaacaaagagg

SEQ ID NO: 6876802 - DNA, 62 bp, Homo sapiens
ctcaacacgtcctcgagaagcgcctactacctgtcaggccagagcctttgggcgttgttggg

SEQ ID NO: 6876803 - DNA, 87 bp, Homo sapiens
tccctccctcaggtgaaaggaaaaattttggaaaagtaaaacactgaagagtcatagtattctcctgtaacttggaactggagagga

SEQ ID NO: 6876804 - DNA, 67 bp, Homo sapiens
gtcacatggttatatttgtaaagctctaactgaacttaaaggagttcaacattagaaccatgaaggc

SEQ ID NO: 6876805 - DNA, 80 bp, Homo sapiens
cattttagttgggagaggcctgggagaactgtttttgcctttaggcagacacacagatcctgaggtggcccagcctgatg

SEQ ID NO: 6876806 - DNA, 74 bp, Homo sapiens
ctgtattaaatgcctatctcatagagatgtcattatgttgaaatgatacaatcatgagagaggacattgcatag

SEQ ID NO: 6876807 - DNA, 94 bp, Homo sapiens
gtcagcgtgcacagctcccagctcctgagctctcagggacagactatgtgagtgagcattctgttaccagagccagtggaaactgtacacctac

SEQ ID NO: 6876808 - DNA, 66 bp, Homo sapiens
gagagacatgtccagagtgtcctggaaagtctggaaagtccttgccttccctcggaatgtgctctc

SEQ ID NO: 6876809 - DNA, 56 bp, Homo sapiens
gggagacaccacacacagaacagaggccgagttttcttatgtgtacctgtgctccc

SEQ ID NO: 6876810 - DNA, 81 bp, Homo sapiens
gtgtcttgcacacattctttaaatgtctgttaactaatgaatgaattgacaagaaagcagcattaagggaactgcagatac

SEQ ID NO: 6876811 - DNA, 64 bp, Homo sapiens
gcagggtcgctctaggagatcagcacaaagctgggtttgtttcagtggggctacttgaccctgc

SEQ ID NO: 6876812 - DNA, 81 bp, Homo sapiens
caaaagggtggagggaggttagattcaagctccgtgtctgactgcttgagctaggacatcaatcttcttctgccttcagtg

SEQ ID NO: 6876813 - DNA, 80 bp, Homo sapiens
ccacttggagaatgaagctgtttaaatgacttacttttggcttgaggtctgaaattagttatctggatggttatttgtgg

SEQ ID NO: 6876814 - DNA, 66 bp, Homo sapiens
gttaggcaatacctcttacaccaaagtgggcacaccttcggatcatgtaggcagcgattgtttagc

SEQ ID NO: 6876815 - DNA, 115 bp, Homo sapiens
ggtggccagaagccaccttgcttgggtggatgaaagttgttttcggaccttgcttcctggtttcagcaactctcattccgcttttagttatttttagatgtggctctttgccacc

SEQ ID NO: 6876816 - DNA, 66 bp, Homo sapiens
ctggctctgtcaccctttctcctgcattctaaatctggcttgagagagaggagagagagaggacag

SEQ ID NO: 6876817 - DNA, 64 bp, Homo sapiens
ttacctccagagtccctcagaacccaaagttgctattttgagaggtttgtacactccgaggtga

SEQ ID NO: 6876818 - DNA, 83 bp, Homo sapiens
tggactttctacaaggttgtcttatggcatgtccactggcttcccctggaagtaagtgatccaagagagaacaagagaatcca

SEQ ID NO: 6876819 - DNA, 57 bp, Homo sapiens
tttgcatttataagttggtggaatatacacatttttgctaacttagatgatagtaaa

SEQ ID NO: 6876820 - DNA, 57 bp, Homo sapiens
ccgccattcctactgcctgatgtcctctcaggagggctctgaggatggagctggtgg

SEQ ID NO: 6876821 - DNA, 68 bp, Homo sapiens
tcctgagctcagcttcctctccatgctgctagcccacctggcaggtaggaggggaggtgggtgatgga

SEQ ID NO: 6876822 - DNA, 68 bp, Homo sapiens
gagcctcatgtgattacactaagaaggtggcatttgattgccaagtcatggaagtatcatggaggttt

SEQ ID NO: 6876823 - DNA, 58 bp, Homo sapiens
cctgttttgaagttagagtcctgtgaaaagttactatctcttctaacttcagatgagg

SEQ ID NO: 6876824 - DNA, 68 bp, Homo sapiens
tcttgggctgagtggcagccagagtcaagccctctgcagactctgcagagctattcagcttatacaga

SEQ ID NO: 6876825 - DNA, 65 bp, Homo sapiens
ccctcgggcgctgggcctgaggcgtagcagggactgcacagagcaggcaccagcggcctcgaggg

SEQ ID NO: 6876826 - DNA, 59 bp, Homo sapiens
ccttttgtctatgaagttctttatcccatagaaggggtgacaggctaggaggctgaagg

SEQ ID NO: 6876827 - DNA, 82 bp, Homo sapiens
aattatcgcctcttgtttaatgcctcatacatctttactaccattaaagatggcgtgcaggctagacaaaggggacagaatt

SEQ ID NO: 6876828 - DNA, 78 bp, Homo sapiens
aagaaaagaagcagggagatttattaaactgttacatataagttatgttagtaaataaagtctactttcttctggctt

SEQ ID NO: 6876829 - DNA, 103 bp, Homo sapiens
ggaatttcatcagggatggatggagactggtgaggatgttccctggggcctcctagaaagattaggggaaatctctcgccatctggccccatgctgatgctcc

SEQ ID NO: 6876830 - DNA, 87 bp, Homo sapiens
ccccttggaaattgtatgggatgagtctggagtccacgatgttttcataaccgtgcttttcaaccattctcaatttcacattatggg

SEQ ID NO: 6876831 - DNA, 81 bp, Homo sapiens
tgagggtgagagctggaatcagacctcaggtgtcccgacttctgacgcaggcctgattgtctcttgcagcactcacaatta

SEQ ID NO: 6876832 - DNA, 68 bp, Homo sapiens
tcggctttgaggggttttgaatcgggggaaggaaacccgatcgctagaccaaacccactcagcgctga

SEQ ID NO: 6876833 - DNA, 77 bp, Homo sapiens
ggcagagtggagaaagcatttagtgatggaagactcataactctaattaactactgcttactccatgatctctgacc

SEQ ID NO: 6876834 - DNA, 66 bp, Homo sapiens
catggcaactagctggattagtgttttccacatggaagggctttgggtcagagctatgtagctatg

SEQ ID NO: 6876835 - DNA, 63 bp, Homo sapiens
gtgtcctaccatgaattcactccatgctagccacattggcctgtatggctattccttggacac

SEQ ID NO: 6876836 - DNA, 57 bp, Homo sapiens
tcaaactattatatctcttttctaacttctggtaggaaataaggatagatggtttgg

SEQ ID NO: 6876837 - DNA, 98 bp, Homo sapiens
gtaggtgccagcctaggggagcttccaaggaggggaaggcaaagccctggcccctgcctgtgtccccttcttggcatgttccacatgctcggtcctgc

SEQ ID NO: 6876838 - DNA, 56 bp, Homo sapiens
ggtcaagtgtggtgtcaggctgtctcacaggtagtgcaaagatataccacatggct

SEQ ID NO: 6876839 - DNA, 60 bp, Homo sapiens
aaaatgtagctccatgccttccactgagtataatttcttagtgaggccagctggcatttt

SEQ ID NO: 6876840 - DNA, 80 bp, Homo sapiens
catttaaccttcccaagctttagttattttcatctgtaagatggaaataatatctgcttgagtactaaaggaggtaagtg

SEQ ID NO: 6876841 - DNA, 78 bp, Homo sapiens
gtctgtgtgttgaaggccaggcagggagctgtgaactgtaggatgtttagcagcatccctggcctgtacccattagat

SEQ ID NO: 6876842 - DNA, 66 bp, Homo sapiens
gagtaatgctgttccatcttggcattccctctcaaatgctgtaaacaatgatgcacagctttattt

SEQ ID NO: 6876843 - DNA, 74 bp, Homo sapiens
tacttagctgttagagagctttaggatttggaaacttccagtgcatattttagcagttctctaatttcaaggta

SEQ ID NO: 6876844 - DNA, 61 bp, Homo sapiens
tgccaagaaagcagacagcttgggcttttagtctcagctccatccctgcttttgctgtgca

SEQ ID NO: 6876845 - DNA, 71 bp, Homo sapiens
atgtctggacattgacaatcatggctagacatccccttcctgactgaacataatcaccaatgactagacat

SEQ ID NO: 6876846 - DNA, 78 bp, Homo sapiens
ccagcaatggaaaaataataggaacgagtggcccttcagcaagaacccatgaagaccagcctatgttttccattttgg

SEQ ID NO: 6876847 - DNA, 121 bp, Homo sapiens
agaaaattttaaataacattgcatttacttttatatgctttgatggttgtcaccaagtatagtacagctgttactctgagtaaatggcaaagtaaattagtaatatttattgaaacttttt

SEQ ID NO: 6876848 - DNA, 67 bp, Homo sapiens
agcatcttagttactactgtgggactagcatcttgttgggctaacagaaaagaactgagtttgtgct

SEQ ID NO: 6876849 - DNA, 99 bp, Homo sapiens
gctccctttttgtgattatataggcgaggccatgcatgctgaggactgcgaaggacgctggtgtcttctgcatcatggtctccctgaagcagagttagt

SEQ ID NO: 6876850 - DNA, 120 bp, Homo sapiens
ggctgaggaaaaagggtaacaccgtgagtcatgagctgctgggagcctgtcgtcttggatatggcaggacagtcccagttcaaacattctggcctttttaccgtttggttcactcagacc

SEQ ID NO: 6876851 - DNA, 63 bp, Homo sapiens
ttgcctctgttccttgtgaccaacctgtgtattacccacatggtaatagggagcagaaggtag

SEQ ID NO: 6876852 - DNA, 74 bp, Homo sapiens
agaatgtggatttctgaagtgggtctgtagtggaggcctatagagttttcactggacctgctttgatcctgtct

SEQ ID NO: 6876853 - DNA, 86 bp, Homo sapiens
cagtgctgtatctgtgatgttggcaagttattcagcctctcaaagcccctggtttggaataaaaacaactcacagagacagggctg

SEQ ID NO: 6876854 - DNA, 65 bp, Homo sapiens
gggatctgtctttagtacaaaaaatgtcatgtttataataatacagacatttaaattcagatctc

SEQ ID NO: 6876855 - DNA, 97 bp, Homo sapiens
gatcagactgggggagtgtgaggattgctctggagaatttttcatgcatgctctgaataatcactccagcgtaattcactcctccttcagctagatc

SEQ ID NO: 6876856 - DNA, 58 bp, Homo sapiens
ctcctggctatgactacatttctgaggatgcaagaagaaaagagtcctgtgtgaggag

SEQ ID NO: 6876857 - DNA, 66 bp, Homo sapiens
gcttgggcaggggaaacagctgcccaccaggttttcctggacagcagtgcccacctgcctactagc

SEQ ID NO: 6876858 - DNA, 78 bp, Homo sapiens
ggactatgccttctctctgcggccttagcgggggctgagggctccaaggaacctgcagctgtaggagaaggcgcgtcc

SEQ ID NO: 6876859 - DNA, 70 bp, Homo sapiens
agctgcaggcgccggggccgatccgacttcccgcttccgtccggcttgcggcccctcgccttgcccggct

SEQ ID NO: 6876860 - DNA, 77 bp, Homo sapiens
ggtagccccggtccgcgctgtcgcggtgccgcacctgcgcccggccggtggcccgcagcacgcgcaccatggctgcc

SEQ ID NO: 6876861 - DNA, 62 bp, Homo sapiens
gtggtgcccctggcaaatttccctgaggccctcctgttccaggggactctcggggccaccgc

SEQ ID NO: 6876862 - DNA, 64 bp, Homo sapiens
agggaagggcacaggctggcaggatctggcttcaaatccaggacctgtcccctggcccactcct

SEQ ID NO: 6876863 - DNA, 73 bp, Homo sapiens
gaaataaagcccagaatcaagtctactgtttcccaattggtgtgaccatgggctgaattctgcgcttcttttt

SEQ ID NO: 6876864 - DNA, 64 bp, Homo sapiens
tgtcaacaagttcagttgtacgtctttcccccaggacagctgcacactgaacttggtatggaca

SEQ ID NO: 6876865 - DNA, 76 bp, Homo sapiens
ttgtaagcatctgtctcttctgcacttttcagtgaggctggaaagatggagatgttgaaggactggagctttgcag

SEQ ID NO: 6876866 - DNA, 121 bp, Homo sapiens
ataattcgaaaattaaatctgctcaaatgcttttgtggattgataagagacaagtgattatggatcaagtcattaatattcatcaatgtaaagaataagttggggaattatatagaattgt

SEQ ID NO: 6876867 - DNA, 76 bp, Homo sapiens
cctggacagttgtctactttttaatcttggcagacaggtgatcacccctagccagatttaaagagagactaccagg

SEQ ID NO: 6876868 - DNA, 104 bp, Homo sapiens
ggaacatggatcggtacctgcacatagtaagtactcaatcaatttttgttgaataaatgagttgaatgctcactctgtgccaggtacagtgaccagtgatttcc

SEQ ID NO: 6876869 - DNA, 101 bp, Homo sapiens
tgagagtggtggttttatttattttgaacttgcctttgttgtgacaccatccattaaaatgcacagtaaaaagccttagaatttcagacccgtaactctca

SEQ ID NO: 6876870 - DNA, 66 bp, Homo sapiens
tcatagaaatgtggccagaaacagtttcctgagaaatggatgtggtttggcctagattttagatga

SEQ ID NO: 6876871 - DNA, 61 bp, Homo sapiens
agaggtctgactcagcagattaatttaggacccagaaatctacattttgagcaggacctct

SEQ ID NO: 6876872 - DNA, 61 bp, Homo sapiens
ccgaaacatctggaggccccgtttgtccgtgggataagaatgggcttgagcatggctgtgg

SEQ ID NO: 6876873 - DNA, 65 bp, Homo sapiens
gggagactgctggtaaagatgggaggtggcctttgccgctttccatcttctcactgcagtttctt

SEQ ID NO: 6876874 - DNA, 93 bp, Homo sapiens
ggccaggctggtcttgagctcctgaccttgtgatccgcccactttggcctcccaaagtgctgggattacaggcgcgagctaccgcgcctggcc

SEQ ID NO: 6876875 - DNA, 55 bp, Homo sapiens
tgagcccagtctgtctgacatgcaaccttgcccttcacaggtcagcctggcctca

SEQ ID NO: 6876876 - DNA, 66 bp, Homo sapiens
gctgtttccccaaccccacaagtatgtcacaagcagtttgtttatttgggggctgggggacatggt

SEQ ID NO: 6876877 - DNA, 130 bp, Homo sapiens
tacattggcatcacttgggagaactttaaaacatactggtgccaggctcccagctcaggcattgtagtttatggtgtggcctgagggagcactggcacttaaaatttgattcccgaatgattctaatatg

SEQ ID NO: 6876878 - DNA, 81 bp, Homo sapiens
tgtctttggggaatgcttgatctgtgggctcattccagaactgggggagccatgttttcagcatgattctaaccatagaca

SEQ ID NO: 6876879 - DNA, 58 bp, Homo sapiens
accactgtctacacattgactccctctctgctagagggtaatgatgggatgatatggt

SEQ ID NO: 6876880 - DNA, 62 bp, Homo sapiens
gttgcttgcatagctctgtcctgtttcagagtatgaatgataacaacagtaggtgcaacaat

SEQ ID NO: 6876881 - DNA, 109 bp, Homo sapiens
ttaagtactggctgaatagggtagtctgtgtgccgtttgtgagaatgtttcctaacaggaggaagtctgcaacgcactgcaaaacctaacctgatcatacagtatttga

SEQ ID NO: 6876882 - DNA, 124 bp, Homo sapiens
aatgagataacaggtatcattgctttgtaaattgtagagctattcatgacatttaaacattgatgtcaatatttattgagtgctaagaataatctgcaaagtgtgctacatggagcatcttatt

SEQ ID NO: 6876883 - DNA, 82 bp, Homo sapiens
cctagcagccatcctgtgccctcttatggacaccctttcatcagcctgtccagaggacagggctttgagcatggggctgtgg

SEQ ID NO: 6876884 - DNA, 56 bp, Homo sapiens
attctacggtagaacgtggggtactgtgtgtgcacatagacacacttacgtggaat

SEQ ID NO: 6876885 - DNA, 63 bp, Homo sapiens
gttgagtgctttgaatgttctgggcactgggctggatgctaggaatacacagagcaataagac

SEQ ID NO: 6876886 - DNA, 67 bp, Homo sapiens
tccctctggcctgcccgtgtctgtgattgccagcatcctggtggggcaatttcatgggaagatggga

SEQ ID NO: 6876887 - DNA, 55 bp, Homo sapiens
gtaagcataagatacatgagacagtcctcatctattgtcttattccagtgtttac

SEQ ID NO: 6876888 - DNA, 73 bp, Homo sapiens
caccaccatgcctggctaatttttgtatccttagtagagacggggtttcaccatgttggccaggctggtcttg

SEQ ID NO: 6876889 - DNA, 79 bp, Homo sapiens
ttcagcttctgcctgtgcatgcagtcagaacttcttgtgtcactgcaaatctttttgattcatcacacgctgaactgga

SEQ ID NO: 6876890 - DNA, 129 bp, Homo sapiens
catttaggtttatttcctggcatctgtgggcatttgagtgtgggttgcttatacttcgttagttcagtttgcccattcattcaacaaatatgggtgcctacagggtcccagacaccatagctgaccctg

SEQ ID NO: 6876891 - DNA, 55 bp, Homo sapiens
gtcccttctgcaatctgacctcaatcttttgtgctgcagtttgtccagaggggac

SEQ ID NO: 6876892 - DNA, 75 bp, Homo sapiens
gggagcttattaaccatgcatgtctctagtttcacagacctgttagattggaagctgcattttaacaagcatctc

SEQ ID NO: 6876893 - DNA, 119 bp, Homo sapiens
gccatcatggagcctggtgcttgtgaatctctgggttgaattggataaacagatggacagatgggtgaatgatctgattacctgctaacctgagattgcccacaaggttccatcttggt

SEQ ID NO: 6876894 - DNA, 61 bp, Homo sapiens
tgtggccattctatgatctgcaggccagagttgcttctctactgcagggttagaggctcca

SEQ ID NO: 6876895 - DNA, 57 bp, Homo sapiens
ttctgtcagtgatttttcccccacgtggtaatgatggaaaggtcttaacttacagag

SEQ ID NO: 6876896 - DNA, 70 bp, Homo sapiens
ttgctcgagcccaggagtttgatgctgcagtgagttatgatcacagcactgcactatatcctggtgacaa

SEQ ID NO: 6876897 - DNA, 94 bp, Homo sapiens
tggaaggaaggagggagaaaacagggaaggaggtggaaggccagggctatgctggggcttccctaaacctttccactttccttcttctcttcta

SEQ ID NO: 6876898 - DNA, 67 bp, Homo sapiens
caccatttagtagcaagagctcagagattgcatcttgttctccagtgcttctagaaaatacctggtg

SEQ ID NO: 6876899 - DNA, 130 bp, Homo sapiens
gcttatggtgcattgtttcctaatagctttctggtctgagaactactgaggataaggatttcattttgctcatctatttgttctcagcattttagtacagtacctgtcatagaaaattcgtattcaaagt

SEQ ID NO: 6876900 - DNA, 65 bp, Homo sapiens
gaggaggcctgctctggccccagtggccccttgtaagcaggaaaggcagctggctagacctcttc

SEQ ID NO: 6876901 - DNA, 84 bp, Homo sapiens
gcaaagacagtgcatgctggcttggaaggaaagcgcagctggagctctccatggtgcttccccaagccacagcctgttctgtgc

SEQ ID NO: 6876902 - DNA, 79 bp, Homo sapiens
ggtcctaatggaggacaatgtcaccttcagatggtgtgtgcatctctggaggacgtgtccaccatgaaagatttggact

SEQ ID NO: 6876903 - DNA, 59 bp, Homo sapiens
gacccacaaaagcgaatatgtttagctcttcgcagatattattctagctcttgtgtgtc

SEQ ID NO: 6876904 - DNA, 89 bp, Homo sapiens
ctttccgcacctgctccagcttgaagatgtgctggttgaagtaatactgcagctgctcattggcgtagttgatgcagaactgctcaaag

SEQ ID NO: 6876905 - DNA, 60 bp, Homo sapiens
ttgtggaacacctagaatgggtaatctaagagaactatccagtacctgggtatttcatgg

SEQ ID NO: 6876906 - DNA, 92 bp, Homo sapiens
tcctgagcccattttcctttgagccctgacctagcctggccttacctcattaaggtttggttaaagcagtggaaaggaggaggaggcagggg

SEQ ID NO: 6876907 - DNA, 75 bp, Homo sapiens
ggggtgaaggggcagtaattctcagtcaccaggaaagatccccgcccactgggtggctgcctccttctcaccacc

SEQ ID NO: 6876908 - DNA, 84 bp, Homo sapiens
cttgaaatgtcgctagctttgtccattgtcttgcttgttcactaagactgtaataaatgcttgaggtttgtgattgatttttag

SEQ ID NO: 6876909 - DNA, 78 bp, Homo sapiens
tgtagagcaactgtattggaaatatagcaaaatgcttgcctttgctgtgaatccattactgtcacctcctgttcccca

SEQ ID NO: 6876910 - DNA, 81 bp, Homo sapiens
gcagggctgcactgcttctggaggctttaaaggagaatcaatttccttgcgttttacagcttctagaggctagccacctgc

SEQ ID NO: 6876911 - DNA, 56 bp, Homo sapiens
caggactatgttcaacagatagccgctgagacatgcatgcactctggcatatcctg

SEQ ID NO: 6876912 - DNA, 65 bp, Homo sapiens
cagcagtccacatagtcattaatttctgctgctgacatcaggaaagaggattatgtgtgtgtctg

SEQ ID NO: 6876913 - DNA, 101 bp, Homo sapiens
gactcatctctcacttgggctcaggagtttgaggctgccgtgagctatgattgcaccactgcacctcagcactccagcctggacaacagagcaatccagtc

SEQ ID NO: 6876914 - DNA, 88 bp, Homo sapiens
tgagactgggaaggagggcaggaactggcaggcagggcaggggcctggcctggcctgctcggctcttaagtcctggcttcaccactca

SEQ ID NO: 6876915 - DNA, 82 bp, Homo sapiens
ttaatatagatcttgctatttaaggaagtcttagaccatttcataagtaaatagtcttttagtaaagcgagatcttcattga

SEQ ID NO: 6876916 - DNA, 83 bp, Homo sapiens
ggcaaacgggtggtttctctgcagagccccaaggatctcatctctttctggttatgtatagagatcttgccaactctgttgcc

SEQ ID NO: 6876917 - DNA, 55 bp, Homo sapiens
ttaaacaccaagtgcaaaccactgttctaggcactgggtaccggaaggtgtttaa

SEQ ID NO: 6876918 - DNA, 63 bp, Homo sapiens
ctttccaggaatcctcacagccttcctgaaacctgagccctgtgcagctggcttcctggaagg

SEQ ID NO: 6876919 - DNA, 64 bp, Homo sapiens
tcctcatgtatctaaggtacagtgctgtttagttgaacagctttgcttctggagacaatgggga

SEQ ID NO: 6876920 - DNA, 65 bp, Homo sapiens
ggtgaaaattctaggaatcattgtttacagggacatccttgaattccaaatcctggaattaagct

SEQ ID NO: 6876921 - DNA, 55 bp, Homo sapiens
gatataggctcttgttaaccttttattttgagaggttcttttgagaggttatctc

SEQ ID NO: 6876922 - DNA, 61 bp, Homo sapiens
gcggagcctgcaggcctcggcctcatggcggcctgaggcaggggcctggaggctggtccgc

SEQ ID NO: 6876923 - DNA, 107 bp, Homo sapiens
cgtggctccccgccaggcacggcctttcacagagatttaaaaagaataaactgttggtgtcagtgtttttaagtttaggaggggagtatttaggggaaggagccatg

SEQ ID NO: 6876924 - DNA, 77 bp, Homo sapiens
tctgggaaactcagttttaagatgtcttctgcctcaactgtgaggcagatgtgtcttctaaaataataaatcttaga

SEQ ID NO: 6876925 - DNA, 55 bp, Homo sapiens
gctccctttaggctgggtatggtgtctctcagcactttgcgaggccaaggcgggc

SEQ ID NO: 6876926 - DNA, 63 bp, Homo sapiens
tacttttctttgtcatgcatctttctgttggagaaactgaccactgcatacagaggggaagta

SEQ ID NO: 6876927 - DNA, 60 bp, Homo sapiens
ggagtggtgtgtaggggcactgccagagatcttccctggcagaggcctatcacagactcc

SEQ ID NO: 6876928 - DNA, 76 bp, Homo sapiens
ggctgcaaactgatctatttacaggaaccaacaggtcacgtgaatgcctgaagtaggtctgtgggagcttgtagct

SEQ ID NO: 6876929 - DNA, 89 bp, Homo sapiens
gagaacgtctggtggtgatttagccctgcgctcacgttctgcagcgtgatgcagtcacactgcgggcagcgctggcccaccacgtcctc

SEQ ID NO: 6876930 - DNA, 61 bp, Homo sapiens
cacaattcacactggtctccagtcagtagaccatgttgctgagtgggattcctgtgctgtg

SEQ ID NO: 6876931 - DNA, 130 bp, Homo sapiens
ctcacttgccttctgggacaccttcttgattagaagagaagggtgtggtgttactgtcatgatgagcactgtgcatatccacaccttatctctgcccagggatgtcagcaatcaaggagggacggatggg

SEQ ID NO: 6876932 - DNA, 109 bp, Homo sapiens
agctgattatcatagataaatgtgtctaattagtctcatttgctgacacacaagcctttaattgcaagttgaataattagacatatctgcatatgtaaatgatacagtt

SEQ ID NO: 6876933 - DNA, 67 bp, Homo sapiens
ttcccaacaatgcactatcgtaagtggtgttgcataaacatctcatacttcgctgtgcatgtgggag

SEQ ID NO: 6876934 - DNA, 80 bp, Homo sapiens
gcttttataaatttcctgttgtgttagagtcaattccagtttgtgaaattgagtctcacagagggaggtcagtaattggt

SEQ ID NO: 6876935 - DNA, 98 bp, Homo sapiens
gcgtggtggctcacttctgtaatcccagctactcaggaggctgaggcaggagaattgcttgaaccagggaggcaggggttgcagtgagccaagatcgt

SEQ ID NO: 6876936 - DNA, 104 bp, Homo sapiens
tggaagggcgctcagctcagccaggacagggaaactagtgcataaaggtggggcatttgcacagttcccgtcttgcacagctactgcctgccagtgcctctcca

SEQ ID NO: 6876937 - DNA, 58 bp, Homo sapiens
gccgagctgtggctgcagcacagcctgcagtaccactgcctctcagcccagctccggc

SEQ ID NO: 6876938 - DNA, 58 bp, Homo sapiens
gtgactgtgcacttttgttctcagtgaactccagagcccaggatggtgtatggctcac

SEQ ID NO: 6876939 - DNA, 55 bp, Homo sapiens
agctgatggtggtagttgactcacagggtgtagtcctggtctgccactcacagtt

SEQ ID NO: 6876940 - DNA, 98 bp, Homo sapiens
ctcccaagccacatcgatgctagggcagtctgctcagccctgagtcctccggggagcaggggggcagagctgagcggctgcccggagcttggcgggag

SEQ ID NO: 6876941 - DNA, 55 bp, Homo sapiens
aagctgttttggccttagttgagttgatgaaacttcagaacgttaagacaggctt

SEQ ID NO: 6876942 - DNA, 69 bp, Homo sapiens
cttatattgtcaggaagtgatcaagtatgcaattattttgtgtaatccttgcattcctgttagtataag

SEQ ID NO: 6876943 - DNA, 92 bp, Homo sapiens
tttgaatatatgtgcagttgagagattttgaagcctggcatgaaaagttaattttatgtgcttcataatcttctcattatacatattttaaa

SEQ ID NO: 6876944 - DNA, 105 bp, Homo sapiens
gtaaggccaatgctcagctttccctggtgggtgagaacctggcttctgctacttgtgagaatttatagaagcttaaccacctgggacagatgatcattgttttat

SEQ ID NO: 6876945 - DNA, 128 bp, Homo sapiens
gttgcggaaatccgacggagctggagcccggaggtgtaattttccatctccacaccagggggcagcctggcaccttccacgacagatggaaaattttccgggccttggcccatccgagcatccgcagc

SEQ ID NO: 6876946 - DNA, 60 bp, Homo sapiens
ctgcgcggctccgcgggccccaccggaaatcccggcccggggtggcctcggagcgcgcgg

SEQ ID NO: 6876947 - DNA, 91 bp, Homo sapiens
atatttgaaacatgctcaacttttttaacctatagaaactgcagtcaaaaagatttggaggttatttaggaaggtagagcagggcagttat

SEQ ID NO: 6876948 - DNA, 71 bp, Homo sapiens
gagctgcattcaacatattctgagtaaaataggccaatggccattttaaagacattatatgtgaatcactc

SEQ ID NO: 6876949 - DNA, 64 bp, Homo sapiens
tgtgagtttgtgcaatggtgtcacctacggtatgaatactggaggaacaattgataaactcaca

SEQ ID NO: 6876950 - DNA, 97 bp, Homo sapiens
ggttggctggggtggggttggtgggacttgtgtggcagtatttgcacaatcctgagagatcctccacctgcaagaattcccccaatacccagtgact

SEQ ID NO: 6876951 - DNA, 99 bp, Homo sapiens
ctggcggggccgggcttctggcagctcctggggccagcacgtcccttccagagcgtctgaagccctgggcggctgctggagcatctcgagtctttccag

SEQ ID NO: 6876952 - DNA, 81 bp, Homo sapiens
gcgtggagggtgcacagagcccagggccgcgtctctcgagcactcagcctgggatgcgcccagggcagcgcccccacacgc

SEQ ID NO: 6876953 - DNA, 77 bp, Homo sapiens
gtgaagaaagtcattggtagcttgatagggatggcattgaatctctaaattactttgggcagtatggccattttcac

SEQ ID NO: 6876954 - DNA, 77 bp, Homo sapiens
tagactagccttgtttctcaaactcctgtgtgcggcagaagcacccagagggcttgctgaacacgtggctggggctg

SEQ ID NO: 6876955 - DNA, 100 bp, Homo sapiens
tgaggaatgccacttgagagatgctgagtgtgaagtatagtggtctccaggccacttgacattttcattaagaaacctcttgccagtggtaattacctta

SEQ ID NO: 6876956 - DNA, 67 bp, Homo sapiens
tactgtttattgagcaatctgccagacccctagggttggagtctggtggattgatcaataaatagta

SEQ ID NO: 6876957 - DNA, 73 bp, Homo sapiens
actaaagggcagttcagccacaggctctggattcaaatccagcaccttctcatgttagctgtgtgactttagt

SEQ ID NO: 6876958 - DNA, 84 bp, Homo sapiens
gtttggatggtgctgggtagaattggagccattttggacctggagccaggtcccctggcacctagtcctactccactgccaagc

SEQ ID NO: 6876959 - DNA, 60 bp, Homo sapiens
gatcctatcactatttttggtttttgaatctcaaaaagtaaacatatttgtggtgggatt

SEQ ID NO: 6876960 - DNA, 114 bp, Homo sapiens
attttaggaaagaaagaggcctagagtgttcccggcagaggaatatagccctgcgcagagataaaaagacagggcatgtgttgggaacagcatgaggtttaatttggctgaaat

SEQ ID NO: 6876961 - DNA, 77 bp, Homo sapiens
gtcacaagcttgtctgtctaatgcagtgattctcaaaggagggcatttggcaatgctagagaagtttttggtgtgac

SEQ ID NO: 6876962 - DNA, 65 bp, Homo sapiens
tgctctactggtgggtgctggaataggaggtggtagcccctgatctcagcttacccatctaagca

SEQ ID NO: 6876963 - DNA, 58 bp, Homo sapiens
tcctggatggcctgcaggcggtgtcgcttctcactgagccagcggccgccctccagga

SEQ ID NO: 6876964 - DNA, 98 bp, Homo sapiens
tcagattcaaccagggagctaccacatgctactcaatgcagggcaggatatgagtcctcccatccctgcaagagagcaaaggggttaattggttgtga

SEQ ID NO: 6876965 - DNA, 65 bp, Homo sapiens
cttggctagcctctgtggacttgatagtcacttcagtgtgtcaagagccagagagtgcgctcaag

SEQ ID NO: 6876966 - DNA, 67 bp, Homo sapiens
gagagatgaacacattggaagccaagaatggtttatggattatatttgctaaatgtgtgcaatcctc

SEQ ID NO: 6876967 - DNA, 67 bp, Homo sapiens
ggaagagacctggacaattcttgggatgaagtggtgttctaatagtttgaatgtttctgtctcttct

SEQ ID NO: 6876968 - DNA, 103 bp, Homo sapiens
cagaagtaacgtgcttgctaaagagaaatggctttgacaacttgccttaaataatctggcaagtgaatctcctttctttattcattagggatatttgcacctg

SEQ ID NO: 6876969 - DNA, 67 bp, Homo sapiens
acaataactttttcctgatataattaaagtttgtccattgatttcagttcacagggaaggttattgt

SEQ ID NO: 6876970 - DNA, 76 bp, Homo sapiens
acaagattctcatgtgattcccgtgcatgttaaagcttgacaagttctgtgccatgggaacagttgttaatcctgt

SEQ ID NO: 6876971 - DNA, 81 bp, Homo sapiens
ctaggggcaacaatttgtgggcaggcaaataactggcagataaaggccagttagtaaagcttgttcatgtggagtccttgg

SEQ ID NO: 6876972 - DNA, 91 bp, Homo sapiens
gaagagctcccttagtgtttctaatgggcatccaagcaaagaagattttgctggcagaaggctcgtggaaccctactgaggccgcatcttc

SEQ ID NO: 6876973 - DNA, 129 bp, Homo sapiens
caggcgcagccccttacctggctgggctcctgggcagctgggcggtggcgtgaaggtggctgggtgctcagatctgctctccatcggctgccctgccctggcccagcccagcctctgggagtgacctgg

SEQ ID NO: 6876974 - DNA, 66 bp, Homo sapiens
gcccatggccctttattccttcttccctcggtccacgaacaggaagaggctgaggccatgctgggc

SEQ ID NO: 6876975 - DNA, 61 bp, Homo sapiens
gttaatgttttctcacagggagagtccctaatgtttctactttttgtgcagcaacattaat

SEQ ID NO: 6876976 - DNA, 74 bp, Homo sapiens
agaaccaaagaaacccaagctcagggcatcagccccacccaatctctgcccgagcctcggtttcttttctttct

SEQ ID NO: 6876977 - DNA, 103 bp, Homo sapiens
tggacatacagctcatactgtttactcagctcattgaagcctgcctcccatgagatttgagaagcaggctctggttggcaagtaaaggagagcagttggccca

SEQ ID NO: 6876978 - DNA, 68 bp, Homo sapiens
ggctgtgcgtcatccggctgcagattaccaacaaatgtgccagccagtcaggcatgaccgcatacgtc

SEQ ID NO: 6876979 - DNA, 61 bp, Homo sapiens
tggaaccttcctgccattaaggtgaggtgacttttctctcctgtctggtgagggggttgca

SEQ ID NO: 6876980 - DNA, 63 bp, Homo sapiens
atcatagtccagtagcaccaggttaccccagcttaattgctggcctggctttgcatctgtgat

SEQ ID NO: 6876981 - DNA, 66 bp, Homo sapiens
ggcctgggcactgcagcaggcatcagtcttatcgttgagacttggtagctagggcatggctaggcc

SEQ ID NO: 6876982 - DNA, 67 bp, Homo sapiens
atgagacagaattgaagctgagtaaatatacattagtgtgttttctttatgtaattctgaatcttat

SEQ ID NO: 6876983 - DNA, 85 bp, Homo sapiens
ttagagaaacagcaggtggtaggcagtcagcagctctgccactagcttgttgtgtgacttccagctggttccctgccctctctga

SEQ ID NO: 6876984 - DNA, 79 bp, Homo sapiens
aggctggggtgcaatggcatgatcccagtttaccgcatcctccacttcctgggttcaagcaattctcctgcctcagcct

SEQ ID NO: 6876985 - DNA, 92 bp, Homo sapiens
tgttggattaattgaaagttacagttatgaaactcacaagaacagcccgaccaatttttctgtgggctttagagatggtgacttttctaata

SEQ ID NO: 6876986 - DNA, 62 bp, Homo sapiens
aatgtttgcgtcccacacccagagtttctaattaaattggtctggattgaggtgcaggcatt

SEQ ID NO: 6876987 - DNA, 68 bp, Homo sapiens
tgtcagcctgagggatctgtggaatagcctacccaagagctcatagaaacccttcagaaatcatgaca

SEQ ID NO: 6876988 - DNA, 60 bp, Homo sapiens
aggagaagccacacattgggtgtctggtcaacatcaaatacccatccttggttcactcct

SEQ ID NO: 6876989 - DNA, 97 bp, Homo sapiens
cctccaaaggactctgataggccaaggttagaccaattgctgtgtccagaatggggcactttggctaacctgggttatcagcctaccctgtggcagg

SEQ ID NO: 6876990 - DNA, 61 bp, Homo sapiens
accgggctcagccagcccattcttcctttactgggagaagccgagtcagctgagccatggt

SEQ ID NO: 6876991 - DNA, 56 bp, Homo sapiens
ctctaccttcctgtccactgaattagcaagccctttctgtgggagggaaggcaggg

SEQ ID NO: 6876992 - DNA, 55 bp, Homo sapiens
ttctcaggaactcagtgtcagctatcacaataggctggcagtggcttcctgagaa

SEQ ID NO: 6876993 - DNA, 69 bp, Homo sapiens
ggacagctgcatcctcagacacaaaacccctgacggcccgtgtgtaccacagagggtgacggtatgtcc

SEQ ID NO: 6876994 - DNA, 57 bp, Homo sapiens
gtcattgactagaattccaaagctcaaggtacacttatggaagttgaagtcagtgac

SEQ ID NO: 6876995 - DNA, 71 bp, Homo sapiens
gagcaaacaaaactgatgtgactgtgctgtgaaagttcttaagtaccgtgtgcatctgttgtagtttgttc

SEQ ID NO: 6876996 - DNA, 83 bp, Homo sapiens
catgtgtagaggctgctgttctgactgtgaggagaaggggtatctgggaaggtccttctggtgggactcaggctttcacgctg

SEQ ID NO: 6876997 - DNA, 55 bp, Homo sapiens
ctaatcattttaacttgcatgcagtgtgagcactaactagcagtaaaatggttag

SEQ ID NO: 6876998 - DNA, 59 bp, Homo sapiens
tgtgattcagaatatgaatggtatttaatttctttgaaatcattaattgctgagtgaca

SEQ ID NO: 6876999 - DNA, 70 bp, Homo sapiens
tcttaagagcctctcatgagcattcctaagggaaagatttttctcttggaacctctcatgagtccttaga

SEQ ID NO: 6877000 - DNA, 65 bp, Homo sapiens
gtgtcctgtgcctctgtttgtgtcagcagctccacatagcgacccgcacaagcaggggcaaacac

SEQ ID NO: 6877001 - DNA, 62 bp, Homo sapiens
tgcagggaggaagttgaagaagctcttggagtgccccagctctgttactgattttcctgaca

SEQ ID NO: 6877002 - DNA, 60 bp, Homo sapiens
aagaagggctgccagggggtgccagggattcccccaaggctctgcctgtagacctagctt

SEQ ID NO: 6877003 - DNA, 74 bp, Homo sapiens
gtgtgcatcttttctgcttgattttctgtttatggtgacacctaagtaagcttttaagtgactaagttgcacac

SEQ ID NO: 6877004 - DNA, 97 bp, Homo sapiens
ttcttaaaatggtaattatgtccaaatgaactaagagtcattagtgtaggaaattttcttccacaataatgtttttaggttatttagtatcaaagaa

SEQ ID NO: 6877005 - DNA, 67 bp, Homo sapiens
cgttttggtcaggttggtctcgaactcctgacctcaggtgattcaaccatcttggcctcccaaaatg

SEQ ID NO: 6877006 - DNA, 73 bp, Homo sapiens
tgactatgaggatacaagtctcagaatgctggaatacaccagaagtgttctagagaatatcaatccatagtca

SEQ ID NO: 6877007 - DNA, 71 bp, Homo sapiens
gctgcaatgactttccttgcacattggtttccactcgtgtgggtataaatgccggagaaattcttggcagt

SEQ ID NO: 6877008 - DNA, 104 bp, Homo sapiens
gggactggttgatgggaagtggcagtggcgggactcagggctccccgcagtcagctccacaatctgtgccctgagttctccttgcccagcttggcgttagtccc

SEQ ID NO: 6877009 - DNA, 85 bp, Homo sapiens
gaagaaagaagagggaagagccagtgggaaagtcttggactccggaggcaaactcacctggctcaaatcctggttttatttcttc

SEQ ID NO: 6877010 - DNA, 68 bp, Homo sapiens
tggattttcatcctcactgatttcctttgcaaaatgcccttgaatgtcaggtgtgggcagagaaacca

SEQ ID NO: 6877011 - DNA, 58 bp, Homo sapiens
ctggcactttggggtatgacaagttttcttcaaggcaagaaaggtctcccgaaaccag

SEQ ID NO: 6877012 - DNA, 59 bp, Homo sapiens
tcaaacagctcgtggctgcccttgtgcccagcgctgtgggcatgagcgagctgctttga

SEQ ID NO: 6877013 - DNA, 56 bp, Homo sapiens
ccaaaggggcttaggatgaaggaaaaagagaaagctttcatctaaggaacctctgg

SEQ ID NO: 6877014 - DNA, 75 bp, Homo sapiens
gctcccactgttctggcaccatctgttgttttcagatgtcctgatagctcaagaatgtgttttaacatgggaagt

SEQ ID NO: 6877015 - DNA, 76 bp, Homo sapiens
tggattccacacataagtgagatcgtgcagtatttgtccttctgtgcctagcttattttacttagtgtaatgtcca

SEQ ID NO: 6877016 - DNA, 61 bp, Homo sapiens
catggtgttagaatgtgttgggtgcatggttacccagttagaactacatttcccagccatg

SEQ ID NO: 6877017 - DNA, 82 bp, Homo sapiens
ggctctgaccctttagaatacagactttctatacccttttgtttaggattttttggattctggattggaaaatttcagagct

SEQ ID NO: 6877018 - DNA, 69 bp, Homo sapiens
gctgtgtcctcatcatccttttttgaagagtttggcaaactgttgagggaagcagatgaaatggacagc

SEQ ID NO: 6877019 - DNA, 59 bp, Homo sapiens
aaaagatgccatggatgagtagcttacaattaaaattaagtctcagacatgcttctttt

SEQ ID NO: 6877020 - DNA, 73 bp, Homo sapiens
atcatttctcgtatgtgacttaatttagtggatcataaaaagtccttgagccatttggtcactgataagtgat

SEQ ID NO: 6877021 - DNA, 61 bp, Homo sapiens
cccagtgtctcttgtgcctttctctgagaatggacccggagtgaggttgtaagatactggg

SEQ ID NO: 6877022 - DNA, 113 bp, Homo sapiens
tgaccttgaacttgagcactgttgaaatctcatgatgcctatgcagggttgtggtcatcaggattggcaagatagcatatgaggaactcagcaaagcagctggttcactgtca

SEQ ID NO: 6877023 - DNA, 66 bp, Homo sapiens
gtgaatggataaatacttggtggtatattcacacagtggaatactacatactatgtaaacatttac

SEQ ID NO: 6877024 - DNA, 58 bp, Homo sapiens
agctgcccaatcctgcagggcgagaactgaggaccttcatctctgctaatgggcagct

SEQ ID NO: 6877025 - DNA, 88 bp, Homo sapiens
actctaatacctgacaatagctccatggagaattcacagccagcaaacctctactgtgttgtcttcagctgtagtcattgttcacagt

SEQ ID NO: 6877026 - DNA, 57 bp, Homo sapiens
cccaatctttgcggatggttgtgatactgcaatagtgtttcaatcctaggggttggg

SEQ ID NO: 6877027 - DNA, 56 bp, Homo sapiens
ctgtggctctgcagtcccaacagttgcagctgttctaggacaccgcaggggcatag

SEQ ID NO: 6877028 - DNA, 81 bp, Homo sapiens
gggatctgggaaggggatttgtgacaactgggttatttaaatggaattttccaaatatacagaatctcctcctcagatccc

SEQ ID NO: 6877029 - DNA, 73 bp, Homo sapiens
accgacctggaggagcgctgaccagctggctgaaccctgccagcgactctggaagggccgctcctccctcggt

SEQ ID NO: 6877030 - DNA, 70 bp, Homo sapiens
cctcagccctttccatgaactgtctcaattcccgcaataatcatacattgcacagtttcggaaactgagg

SEQ ID NO: 6877031 - DNA, 98 bp, Homo sapiens
acagtgttggaggctgaaaatccaagatcaaggtatcagcagatttggtttcttcaaagacttctctccttgacttgcagatggcaccttctcactgt

SEQ ID NO: 6877032 - DNA, 87 bp, Homo sapiens
atttctatacctattgaggaccagcaacatgttgcaggccagcacttgcctgtggacagctctttgagtgctctaggttataggaat

SEQ ID NO: 6877033 - DNA, 68 bp, Homo sapiens
tcaaagatttgaaagacttctcctgtgaaaacattagaacctaataatgctttggagaagctctttga

SEQ ID NO: 6877034 - DNA, 58 bp, Homo sapiens
gagaaaacttggccgcatccaccggggccctgcctccagtcggccgctgccgagtctc

SEQ ID NO: 6877035 - DNA, 71 bp, Homo sapiens
tgatcagggtgtcaataaatagcggtgtggtattcagtattccacaagtttgttgattgaaaccttttaca

SEQ ID NO: 6877036 - DNA, 92 bp, Homo sapiens
acagcagttattttccattccatttgcctgctgagtgagcttccagggactaatgcctacttcagcaaggcagaagggaggtaagctgctgt

SEQ ID NO: 6877037 - DNA, 95 bp, Homo sapiens
gtgcagtaaaggaaaaattataggctgagcttgtagatcgtaacaagctaatgataggactatcagccagttcagagtattccctaaaactgtac

SEQ ID NO: 6877038 - DNA, 86 bp, Homo sapiens
gattgagtgtccagtctgctgtggtaggaagatcctggtagccccagtcagaaggtgcttcctaacaaggcagctgtttctctttc

SEQ ID NO: 6877039 - DNA, 86 bp, Homo sapiens
ctgagcttcctagcaagtctctgatgtgtgttaggtgttactgttaccatttcatggatgagcagactgtggctggaggagaccag

SEQ ID NO: 6877040 - DNA, 95 bp, Homo sapiens
gtaccaggtataggagttttggactgacagaactttacactaaacaagatgtaaaagttttagttgtacataaatttaaaatgaacctgccttac

SEQ ID NO: 6877041 - DNA, 118 bp, Homo sapiens
ggtcgataccacctgggcccctcctccagcttgagcccgaatctgcagcatcctggtctcccatcctggagggctgcagcgaggctgctgcagagggaagcagaaggttctgttgacc

SEQ ID NO: 6877042 - DNA, 72 bp, Homo sapiens
tttggtgtcctaaatatagtgattcatgtaactggacaggtccaaaggcattggctcctgtgggacatgaaa

SEQ ID NO: 6877043 - DNA, 75 bp, Homo sapiens
gtcatatttaggcctttaattcattagaagtccacctttgattgcagttataggtttaaattcagttctaatgac

SEQ ID NO: 6877044 - DNA, 55 bp, Homo sapiens
caaatgtttggtggcattttgttcacaaaaggatagagtgtgtgcatcatatttg

SEQ ID NO: 6877045 - DNA, 66 bp, Homo sapiens
tccaatatcctgtccatcctcccactggctgaacctgccagaggccagtggacaagggcccgtgga

SEQ ID NO: 6877046 - DNA, 59 bp, Homo sapiens
cccacatcccattggctaaggcaaatcacatggccatgcccacatcaatgggatatggg

SEQ ID NO: 6877047 - DNA, 120 bp, Homo sapiens
gttattatattgtgaaaaacctggccttggtcacaatgcaaacaaaagtacagatgaaagtgctttttggacagtttgcaaattgtgttaaagctacggattttttttaaagtgttcagc

SEQ ID NO: 6877048 - DNA, 57 bp, Homo sapiens
ggggccacggaaggaccagtgggtagccctctccccaccgtgccttgctgtcgcccc

SEQ ID NO: 6877049 - DNA, 61 bp, Homo sapiens
ctggaggctgcaccgtttcctgctgcccacgatgaacaaagcaggaaactgtcttttccag

SEQ ID NO: 6877050 - DNA, 80 bp, Homo sapiens
caggagagaatgttccaggcttgagaggttgatttgcagttgcacttctcacacgggcaagttgatggagcactttcctg

SEQ ID NO: 6877051 - DNA, 58 bp, Homo sapiens
ggtcagagttccaaattaatcaacttaaagctactgtgttgtgtttggaaattctgcc

SEQ ID NO: 6877052 - DNA, 121 bp, Homo sapiens
ccctgtcggcatggcaacttcaaggctgtacctcttgttagtgactgcctggatggaagaaaagccacctttcaccagggctccagccagcctacagccgaggttagacccagccacaggg

SEQ ID NO: 6877053 - DNA, 58 bp, Homo sapiens
ctctgctgcaggaaggcgtgcacttctagctggagcccactccccctctgcagcagag

SEQ ID NO: 6877054 - DNA, 55 bp, Homo sapiens
tgggaggctccttagcccatgcaaaataaattttgcaaggcttttgtgtttccca

SEQ ID NO: 6877055 - DNA, 76 bp, Homo sapiens
agtggggggttgggctgaggagggcgtggcctgtgattgacagccgtcgctccctccctcggccacctcccccact

SEQ ID NO: 6877056 - DNA, 83 bp, Homo sapiens
gttatccacagtgttatttctgagtaatggataatttggttaaaataatatgaaactattatttaggaaacattgtgttcaac

SEQ ID NO: 6877057 - DNA, 55 bp, Homo sapiens
ggtaaggtagcaaggggccacagtcttcctttgatctgggcctctcatatctgcc

SEQ ID NO: 6877058 - DNA, 70 bp, Homo sapiens
ttaagcctcacaggttttgatttgccagaatataaaccgtgtactctggccccaggatctgtgttcttga

SEQ ID NO: 6877059 - DNA, 61 bp, Homo sapiens
cgcctcctcgtacagcagactgaagtcctggggacaggcgcacagggtgttgatgtgggtg

SEQ ID NO: 6877060 - DNA, 68 bp, Homo sapiens
ggaataaaagaatggtgtgtgaagtttagtgccaatacagtctaatatgcatgctatgtttttatttc

SEQ ID NO: 6877061 - DNA, 87 bp, Homo sapiens
gctgaagaaaattcacatgtgcttcttatcactgaaatttaatattgtttggggttgattatttgcatttgtcaattttcattctgc

SEQ ID NO: 6877062 - DNA, 77 bp, Homo sapiens
gattactgtttacttcaattatatgccagttatatatactcctgactggttttcttgattgaacatagaccttggtc

SEQ ID NO: 6877063 - DNA, 61 bp, Homo sapiens
gagaagatgagctttcctggttggtgaaccaaactcctcagcaaggctgcattctcatctc

SEQ ID NO: 6877064 - DNA, 67 bp, Homo sapiens
aatagcacctgaggtagtttgtagactctggttctgtctaataaattggcttcttcaggtgtctatt

SEQ ID NO: 6877065 - DNA, 67 bp, Homo sapiens
ggggccagtctgggccacggtcgggacccagtggagggccggactggtcagggttcaggcgggatcc

SEQ ID NO: 6877066 - DNA, 59 bp, Homo sapiens
catgtgtgacaaactgcctgcataagtcacagtgccagtggcagagatttgtaaccatg

SEQ ID NO: 6877067 - DNA, 83 bp, Homo sapiens
acagccaccatcaccccccttctacaggcaggaagtagggtccctgagagacccagcagtttgcttagagtgataggatctgt

SEQ ID NO: 6877068 - DNA, 111 bp, Homo sapiens
cctctagtacaatgttgaatcaaacagtgagagcagacatccttgtcttgttcctgatctttgggataaagcatctagtctgtcactgttaagtatgacattaactgtggg

SEQ ID NO: 6877069 - DNA, 82 bp, Homo sapiens
gatcagttgattttgagataggggacttgttctgaataactcctttcgagacttttctgctgtctatgcaagtcctttgatc

SEQ ID NO: 6877070 - DNA, 59 bp, Homo sapiens
cttagggcctccagaaggaaacctgtacaaccttggtagcttctggaggttaccctgag

SEQ ID NO: 6877071 - DNA, 64 bp, Homo sapiens
tacctatggataatttaaattgagtaacacagaaagacttactctccggagtgagctgtgggta

SEQ ID NO: 6877072 - DNA, 74 bp, Homo sapiens
cactcatccaaaatagatgttaacctggaaatggtctgaattctctaagactgacaactatttggggatgtgtg

SEQ ID NO: 6877073 - DNA, 76 bp, Homo sapiens
gtagaattaatattctgtgatgaacatcagtctaattgttgatgaaatatagtcgctcatggaatattatatctgc

SEQ ID NO: 6877074 - DNA, 70 bp, Homo sapiens
tcttttaatacgaatcctgtggatgaatgtctgagccctttaagattatcagacaacctagggtaaaaga

SEQ ID NO: 6877075 - DNA, 69 bp, Homo sapiens
ctgctgtccagagtctcctgttgttgttcttcagatcaccagactggaccctttggatactgacagcag

SEQ ID NO: 6877076 - DNA, 57 bp, Homo sapiens
ctgcagatgcataggtacactccgttgagatcagcagagcatggcttacatcagcag

SEQ ID NO: 6877077 - DNA, 96 bp, Homo sapiens
ccccgccctctggctcggtggaaggcctccgccaatggcagagctcccatcgcagagcctgcgggttaggttgtgaggcccgggccgggggcgggg

SEQ ID NO: 6877078 - DNA, 88 bp, Homo sapiens
acaaggctgtagatggaactcatcaacatcgtgacagagaaggtcaataatctgattgatgagttatccatttgactctcggtcttgt

SEQ ID NO: 6877079 - DNA, 55 bp, Homo sapiens
caaggagagtcttctcatggtatccccaaggatctctgagttgtactttcccttg

SEQ ID NO: 6877080 - DNA, 92 bp, Homo sapiens
acctgtaatttatctgggtttgacctcgttctctttgtggcaatggcaatggccacaaagagaacgaggtcaaatctagataaattataggt

SEQ ID NO: 6877081 - DNA, 94 bp, Homo sapiens
ctttgtaactatagcatctctcatatttgaatggcaagcatgttcaatctgttgctgcatgttaagaaaatattgaggatatatatgaataaag

SEQ ID NO: 6877082 - DNA, 129 bp, Homo sapiens
atgcagaggtcacagtgtgaggggaaagaatgaggtaggagggatattagcccagacataatctttataagagatatgtgctgaagtctttacaccccatgataattctgacactgggatatctaatat

SEQ ID NO: 6877083 - DNA, 71 bp, Homo sapiens
ttttacatgcagataattatattgtgtttgaaatgtcaaagacaacttacctgatgtatgtgtatgtagga

SEQ ID NO: 6877084 - DNA, 57 bp, Homo sapiens
acatgccaatttggttagttcaagttcataacaattgactgagccacattggtgtgt

SEQ ID NO: 6877085 - DNA, 58 bp, Homo sapiens
gggctcaggcctggcctctcactgtccttatgcagagggggggtcccagcttgagccc

SEQ ID NO: 6877086 - DNA, 98 bp, Homo sapiens
ttaactcccattcatttcctcaaatatttacttactgagtgtgttttaaccaccaggctctgagttaggtgttagagagacaagataaatgagattag

SEQ ID NO: 6877087 - DNA, 122 bp, Homo sapiens
gctccatatgacaggctggtttgacaaacatattgaatacctactctgtgtcagggactgtcctaggtgctgagagtttattatgatagtaagtgcacaatcagtattgttgactattgagt

SEQ ID NO: 6877088 - DNA, 58 bp, Homo sapiens
tgacccagctaaccaggtggggagggctcaggcatccagggtagggttagctgggtca

SEQ ID NO: 6877089 - DNA, 60 bp, Homo sapiens
cacccaggccaggtgctctagaatcagacaatctctgtttgggtgcttcctggcccagtg

SEQ ID NO: 6877090 - DNA, 87 bp, Homo sapiens
tttcttttcttgcacctggctggagaaatgaaattctgtagaaccaatttaccctgcggatgtatcctagccatgtaataaaagggg

SEQ ID NO: 6877091 - DNA, 56 bp, Homo sapiens
gctctgcccaaagctgtggctggttatctgctggactaagagctgtgggcattggc

SEQ ID NO: 6877092 - DNA, 79 bp, Homo sapiens
ataaaattgctccagtgcattctctaattacaggtaacccattattcagtacccaggaatgtcgcgagagtagatttgt

SEQ ID NO: 6877093 - DNA, 77 bp, Homo sapiens
cctgccgtacccactgctgcactctgctcctttatgggcagcaatgctggtggcagctgtgttgcagttttggcagg

SEQ ID NO: 6877094 - DNA, 76 bp, Homo sapiens
gatacatgggaagtgctggcccatagctgctggctgaacaaggctagtctctggaggtcagggctgccactgtgtc

SEQ ID NO: 6877095 - DNA, 89 bp, Homo sapiens
cttgccaccctgtgctctgcttggcctattctgggtggttccaggagtgaaatgaggcccaggcaaagctgtccagtcagggaggtaag

SEQ ID NO: 6877096 - DNA, 83 bp, Homo sapiens
ttaagaaaaaggtcacttcattcactgtcaggtaatgagccctagaggtagaggctgcccaatggtagtgtcttttttcttga

SEQ ID NO: 6877097 - DNA, 66 bp, Homo sapiens
cctgatgggcagcacagctggccaatcctgggactcagagggtaggtcggctggctgaccactagg

SEQ ID NO: 6877098 - DNA, 57 bp, Homo sapiens
agcttgctttcccctcagtcagagcttccagttgacaatgggtggacaagataggct

SEQ ID NO: 6877099 - DNA, 78 bp, Homo sapiens
gtgcagtcttttctatgtctttttctcactatagtacaggactatgggataagagaaaggcaaagctaatgacagtac

SEQ ID NO: 6877100 - DNA, 78 bp, Homo sapiens
ggagggaggaggaggtgaggagaaggagctaccaagactgaatgtggctaataaagcctctttagttcctggcccttt

SEQ ID NO: 6877101 - DNA, 69 bp, Homo sapiens
gagagagcattttcatcgtggcagaaatcctatttgcaacattgccctggacaatgaatgtgttctctt

SEQ ID NO: 6877102 - DNA, 82 bp, Homo sapiens
gagaccagctggggttgcacacattttgagggtgagaaaatgggtgggcctccaagattgaactcaaccctgctctggtatc

SEQ ID NO: 6877103 - DNA, 67 bp, Homo sapiens
aaatgtaatatgcttttagtgctacctctgcaagaattttgtgagcattgaaccagatgttacattt

SEQ ID NO: 6877104 - DNA, 59 bp, Homo sapiens
atttcattattcagcaaacgcagaaacttaagattttctgctgtttgtagtaatgtagt

SEQ ID NO: 6877105 - DNA, 59 bp, Homo sapiens
ctgcaaatgggctttaggtggcttagtctgatgagtaagccatgactgaccccatgcag

SEQ ID NO: 6877106 - DNA, 82 bp, Homo sapiens
cctctgcccagtttactctggccttcctgatttctttacctctcttgccctgggttagaataaggccagtgtaaatgtgagg

SEQ ID NO: 6877107 - DNA, 60 bp, Homo sapiens
tttgttcttagtcctgtttttgccctgatttttcagatgggcgccctggactgaggcaaa

SEQ ID NO: 6877108 - DNA, 58 bp, Homo sapiens
agactggagttttaaaggaacttgtatcagcctgaatatagttgctggactctagtct

SEQ ID NO: 6877109 - DNA, 65 bp, Homo sapiens
gtgtgagctggtggattatgctgtacaggaatttgtcaaagcctgaatcacatagacaaacacac

SEQ ID NO: 6877110 - DNA, 65 bp, Homo sapiens
tggacgtcgcacgtccctcctgtcacgaaacacacaaagaggacagagggcgaaggcggggtccg

SEQ ID NO: 6877111 - DNA, 90 bp, Homo sapiens
ggaatgcccgcctggaaggtggcggctgccaggtcctgggctttgagcgcgtgacatggtttgccgtccctgaccaagacgggcacggcc

SEQ ID NO: 6877112 - DNA, 82 bp, Homo sapiens
ttcagtttttccaggactttaagcttcagagggatgccacaaaatcatcttcagagaagtttatggtgcttgtaaggctgag

SEQ ID NO: 6877113 - DNA, 56 bp, Homo sapiens
agtgtaatacctgcatatacacagaaggatggaagtgtatggcaggccgaggcact

SEQ ID NO: 6877114 - DNA, 113 bp, Homo sapiens
ggcaatgatattcttttaaacatctcttacagtcttatggttaaatagatgctctttgaacaactctacagatggtaccatgggtaggacatgcatgctggagtgttactgtc

SEQ ID NO: 6877115 - DNA, 81 bp, Homo sapiens
aatgtacacatagttaggcatgagtgtgtattaaggaataatatgtccttgagagcaaaattgtgtttaggtaggtatatt

SEQ ID NO: 6877116 - DNA, 80 bp, Homo sapiens
cactgtgtcaaatatctttgcagttctgattaaatagccaacattatctgttcttcagtaagctgcaagtgaagtcagtg

SEQ ID NO: 6877117 - DNA, 69 bp, Homo sapiens
cctggctgtgcattgccggcccagccctcttctgaagaatcccagcagccaggccagcagtgtaccagg

SEQ ID NO: 6877118 - DNA, 88 bp, Homo sapiens
gctgcctgaggaatgggtaggtggtctgctatgtaaaaaagagaactgggtttacagctagacatacctgagttcaaatctcagcagc

SEQ ID NO: 6877119 - DNA, 63 bp, Homo sapiens
gcctcccttggccatagccagcctaggtggttgagatgaagatgggctggaggccaagggggc

SEQ ID NO: 6877120 - DNA, 83 bp, Homo sapiens
gagatacattttcaaacctatctaagaaatagccctgatattgaaatggcttctgtggaataggtttgacagatgtaagtctt

SEQ ID NO: 6877121 - DNA, 122 bp, Homo sapiens
cagccctatctccctgtccctggtggcctctgctgaatgggttccttggtcaacagatagcagcccctctaggccagtggaggacccatggagaggccagcagggactggcggaagtggctg

SEQ ID NO: 6877122 - DNA, 58 bp, Homo sapiens
tactttgagtaatggtagagatgacagatctgctgcataggagccaccatacagagta

SEQ ID NO: 6877123 - DNA, 79 bp, Homo sapiens
gcatttatttccatattgtccatggctgctttggtctaacagcagacttgagtagcagagacaagaccaaatgaattgc

SEQ ID NO: 6877124 - DNA, 80 bp, Homo sapiens
gcgctggtgagcggcgccgagcttggccaggccgccacgtcggcgagcgcgggcaaacccaggctggacgccgccagtgc

SEQ ID NO: 6877125 - DNA, 74 bp, Homo sapiens
tgtattgaggaattgtgttgtagtggagagctttttgattttgctctctcttgaattcatagtttcctggagca

SEQ ID NO: 6877126 - DNA, 69 bp, Homo sapiens
actccagcaacctgacaagactatgagtagttctccttcatcctatttatgtggtacaggttgtgaagt

SEQ ID NO: 6877127 - DNA, 63 bp, Homo sapiens
acttaaaatgccattgctctaaaaattgataatggaaagaatagtggcaaaagcattttgggt

SEQ ID NO: 6877128 - DNA, 58 bp, Homo sapiens
tctttggaataatttcctggagtattcaaatcaaagtgctaggggaacatttcagaga

SEQ ID NO: 6877129 - DNA, 57 bp, Homo sapiens
tgcctgggtccaggccaagcctctcatctcctccaagcaggccatctgccccaggca

SEQ ID NO: 6877130 - DNA, 96 bp, Homo sapiens
aagaaattgagcacagagcagagtaggagaactgtttatgcttggaagactccagagagtaaacattttccgggaactttcggcttaaatttactt

SEQ ID NO: 6877131 - DNA, 126 bp, Homo sapiens
gtggctccccaatagtctcgacctgttcttgcttaggaactctgacaaggctcatttctttggttctcaggccaactggccttggacagagcgctcctggcttgagctccactagtgggattccac

SEQ ID NO: 6877132 - DNA, 61 bp, Homo sapiens
ggtattcttattaaatagccagaagtatattttcagagcttctagcttggattagagtccc

SEQ ID NO: 6877133 - DNA, 82 bp, Homo sapiens
agttttatatgtcatgctgagagggtttgtactatattatgaaggaagtaaagacttaatagaagcatgacatagccaaatt

SEQ ID NO: 6877134 - DNA, 79 bp, Homo sapiens
gtgctcgggagtgtgtctcagcaccgctgcgcgtgcgggggcacatccctgtgtgcaggtgctgggtacctacgtgcat

SEQ ID NO: 6877135 - DNA, 60 bp, Homo sapiens
ctgactcctggtgctttccttgactgagggctgcttccctttaaggaagccaccggtcag

SEQ ID NO: 6877136 - DNA, 58 bp, Homo sapiens
acctaaatctacctcatgttttggtcaaagcagaggccaaagcatcccggattcaggt

SEQ ID NO: 6877137 - DNA, 66 bp, Homo sapiens
tgctacatcaaggcctgagtggctttgccacggctcttcttgtgactgcaggccttggtgccagca

SEQ ID NO: 6877138 - DNA, 61 bp, Homo sapiens
gcctcacctctggcctaattgccaaacagccatggagtgggcaggccagaggtttgatggc

SEQ ID NO: 6877139 - DNA, 100 bp, Homo sapiens
tcactgtgttgtccgttctcacaatatctctgtgagccaggtcctagtgctgccccactttatagattaggaggctacagaggggcgaggtgatctgtgg

SEQ ID NO: 6877140 - DNA, 57 bp, Homo sapiens
ttcagaggtagagaggatcttgaagataatctacataatcctttcactttttaagaa

SEQ ID NO: 6877141 - DNA, 57 bp, Homo sapiens
gcttcgggtggcccaggtcttggccttggccaggaaggctccctggtcaccctgagt

SEQ ID NO: 6877142 - DNA, 74 bp, Homo sapiens
ttccatgaaatatgctacctgtcttccctctgctgcagtgcttcagtgaggaaagggcatttgtgctcatggaa

SEQ ID NO: 6877143 - DNA, 57 bp, Homo sapiens
attctactttctgtttctctggagttgactactttagatactgcatataggtggaat

SEQ ID NO: 6877144 - DNA, 56 bp, Homo sapiens
ggcctcctgcttcacgggcaccgccacctccatggggcctcccggaccgcagcgcc

SEQ ID NO: 6877145 - DNA, 115 bp, Homo sapiens
ttagcagagtgcttatgaagatagtttcttctaaatgtgcttattaatataatatatatactattaatgaaaggcagtttggaactgggatcattaaacatttccactctgctaa

SEQ ID NO: 6877146 - DNA, 55 bp, Homo sapiens
tagctgttacccataaaagccaaatttgaggtttggtatgcatgattgacagttg

SEQ ID NO: 6877147 - DNA, 57 bp, Homo sapiens
acagtttccagaacatgagctagttgtgtttcagaagtttatgtgtaagacagctgt

SEQ ID NO: 6877148 - DNA, 76 bp, Homo sapiens
gttccagctctatgtcttgatctttaccaaagattctcaacacaactggcagattttgaagacagagaggaagaac

SEQ ID NO: 6877149 - DNA, 60 bp, Homo sapiens
ctgctcacaaaaaaccctaactgaaaattccccagtgcacagggttcccttgttcagcag

SEQ ID NO: 6877150 - DNA, 56 bp, Homo sapiens
ctgtcggataaggtgaccccgagtgtcgccccactctgggtccgatgtcctgacag

SEQ ID NO: 6877151 - DNA, 70 bp, Homo sapiens
tatagatgtaggctgaagatgaagtggagctaaaaaccattagttatatattaaagttagccatactgta

SEQ ID NO: 6877152 - DNA, 80 bp, Homo sapiens
ggggatcctctcatttctgtttgcactgatttcagcacctgtcacctgcaaggcgctgagtaggcaaggagggaatcccc

SEQ ID NO: 6877153 - DNA, 60 bp, Homo sapiens
attgtctgattccatttatgtgaaatgtccacaataggcacatctatggagacagagagt

SEQ ID NO: 6877154 - DNA, 110 bp, Homo sapiens
gcagggagggatgggtcatgttactgtattggctgtgtccgaatatttttactttatgttaaagttgatgaggcacaactattgcagagtccatttttccgagtctctgc

SEQ ID NO: 6877155 - DNA, 57 bp, Homo sapiens
gttgagttgtgttcaataatggtgtgctatgagccaccagttaaaatataaatcagc

SEQ ID NO: 6877156 - DNA, 116 bp, Homo sapiens
gtcttgcctgtgttgagcgggggtcatttgggctgctggtggaatggtaggcctgaatacagaagcccaccactggttattagctccttttagacttgcagacaaccaggcatggc

SEQ ID NO: 6877157 - DNA, 75 bp, Homo sapiens
cttgtgccatctgaatttgccttagtttcatctggaaagaggaggtattgatgggctttcagaatccaggacaag

SEQ ID NO: 6877158 - DNA, 84 bp, Homo sapiens
ttctgtttatcatgaagttttacctaatgtaggctttctcttaaatttcctatatagagtaattatttggtgttcatggcggaa

SEQ ID NO: 6877159 - DNA, 68 bp, Homo sapiens
gccaccagggggtgcaaggtccagcatcctaaatcatgtcctcaactttgcaggccttttcttgtggt

SEQ ID NO: 6877160 - DNA, 74 bp, Homo sapiens
ctcttctctaaactctgcaatttacggtgcagccgcaccagggagaaggcagggattagtctttgttggaagag

SEQ ID NO: 6877161 - DNA, 87 bp, Homo sapiens
gctccatgtcttcctccctctccctgggatgtgtggtcctttaagaaaggggccacattgaagggtgggtacagaagagatggtagt

SEQ ID NO: 6877162 - DNA, 61 bp, Homo sapiens
gtgccctggtccccagcatataaaatgacgattgtacaattccagtgttgagggactgtac

SEQ ID NO: 6877163 - DNA, 65 bp, Homo sapiens
tgtattgcattgtttcaagctgttacctagagaaaatcagattacagtgtttggcaatgcatgca

SEQ ID NO: 6877164 - DNA, 55 bp, Homo sapiens
ttttcccagttggccgtatatttttcaacttggtttatacagtcttttgggaaaa

SEQ ID NO: 6877165 - DNA, 63 bp, Homo sapiens
tgacactgaataattgagagttgattgtgtttaggaagatcaacaatcccatggttcagttca

SEQ ID NO: 6877166 - DNA, 130 bp, Homo sapiens
tacattttgacaaacaatacaaagagcatagatggtggatagttaagggtttagagacaaatgtctttcaaacatctaaactacccactttagaagcatctttaacatattgttgatgtgaatatttgtg

SEQ ID NO: 6877167 - DNA, 59 bp, Homo sapiens
ggttgaagctactttctggatgcctagttactgctgatgtctagacattagcttcagct

SEQ ID NO: 6877168 - DNA, 64 bp, Homo sapiens
agaaagatttagcaggatgattagtcctacagaaaatcctcacctagcattctgtaatctttct

SEQ ID NO: 6877169 - DNA, 67 bp, Homo sapiens
tactttactttgcaatgggcagaacccagctccatccaggctgggtctattttgtagcaaatgagta

SEQ ID NO: 6877170 - DNA, 66 bp, Homo sapiens
tggaacaactccctcggagcctccaagaggaaccaaccccactgatgctttgatttgggatttccg

SEQ ID NO: 6877171 - DNA, 57 bp, Homo sapiens
gtgtaaggttaccaggttttgagaaggacacagagcctgtctcccggtcaccttcac

SEQ ID NO: 6877172 - DNA, 130 bp, Homo sapiens
cttgaaattttgtggaatcaactataaccacgtccaaaaatgctagtgatgagaatatatttgaatagaaattcaagaatttttaatgtgactgatgttaagtgactggtaataaagaattctatttaag

SEQ ID NO: 6877173 - DNA, 57 bp, Homo sapiens
ctaatcatctttctcttaaagcatttgaaattgggtagaaggagagggagggattgg

SEQ ID NO: 6877174 - DNA, 99 bp, Homo sapiens
tgaagatataccaaatgtagcagtttatcctcataatggaattatagacttaaaatatttcccatattatggggaaaaactgcatgtggggtatctaca

SEQ ID NO: 6877175 - DNA, 84 bp, Homo sapiens
taagtttaggaagtgaagagattagaaatcaagcatatgtaggtttgaattctggccctctcacttattgactacataaacttg

SEQ ID NO: 6877176 - DNA, 61 bp, Homo sapiens
ctggttgcctaggggagctgacttgggctcttctcagtctcctttcctctagacatgacag

SEQ ID NO: 6877177 - DNA, 79 bp, Homo sapiens
tttatgaagacaaacgacgttgcaaatgtgggccaatctaactccattggggttgacaatgtcctttgaatttcacaaa

SEQ ID NO: 6877178 - DNA, 84 bp, Homo sapiens
atcttgaattcgtcacaaatattttaacagtaggagcctgcccataaaaattccgatttggggcttcttttgaaatatcaggat

SEQ ID NO: 6877179 - DNA, 58 bp, Homo sapiens
gtccagctctgagaagaaacatctgaagaattaagatgattgcctctgagagcaggat

SEQ ID NO: 6877180 - DNA, 75 bp, Homo sapiens
ttccaatttggagagtaattccaatataaatcactgttatggagtgctaggttgtggattactacccttttggaa

SEQ ID NO: 6877181 - DNA, 72 bp, Homo sapiens
tctttaaagaggagtagaacagatagtcaagaatcaccagattctctggggactgtctctattcatgaaaga

SEQ ID NO: 6877182 - DNA, 67 bp, Homo sapiens
gttttgatggagtgtgttaaatataaaagtaatccaatgcaatactatttagcacattgtacaaaac

SEQ ID NO: 6877183 - DNA, 63 bp, Homo sapiens
caaagatcagcagtcagagagctccgctgtgaagtccagcttctttcaggctggctatctttg

SEQ ID NO: 6877184 - DNA, 59 bp, Homo sapiens
tcagacctcttgcaccctggctcttgcccagtggcccagagtgtcagcaagaggtttgg

SEQ ID NO: 6877185 - DNA, 86 bp, Homo sapiens
atgtagctcagcagtgcaacagattcgagaagcaattagattcaactgcttcagtatgatttttgtgcatcattaagaagttacat

SEQ ID NO: 6877186 - DNA, 62 bp, Homo sapiens
aagagctgttgatttaaacctattccttagtgatggtgtaggccaggaatcagcaagctttt

SEQ ID NO: 6877187 - DNA, 72 bp, Homo sapiens
gcatgtgcactcctgggagccaaggaaggctgttcatcgtgtccttggaagagcattcccagggtgcttggt

SEQ ID NO: 6877188 - DNA, 56 bp, Homo sapiens
gtgttatttgagtgggagcgtgtcgtctttccgtagccctcgcctcttaggaacgc

SEQ ID NO: 6877189 - DNA, 101 bp, Homo sapiens
tgcatttataatttttaacaatttttggaagaaattctttctagagtagctgattttgtctgttggatggtttccaaaagatttttaagattatatgtgta

SEQ ID NO: 6877190 - DNA, 74 bp, Homo sapiens
agcaattctattggtatttgaaacataaagttttggtaattgttgattttgtagttttggttgccagcattgct

SEQ ID NO: 6877191 - DNA, 61 bp, Homo sapiens
gagaaggggtgatgtgggtaatttacaacactcctttgtactttctctattatgtcttctc

SEQ ID NO: 6877192 - DNA, 76 bp, Homo sapiens
ctggatacaaaactagagaaaatttgactgccgaggactcttcagggcatgtatgtttctttaattttactcacag

SEQ ID NO: 6877193 - DNA, 72 bp, Homo sapiens
catggatggctcttgaattgatactctgtaaagcctgaggacataatatcacattgtaagggcaattctgtg

SEQ ID NO: 6877194 - DNA, 84 bp, Homo sapiens
ggcatagtagagatacagttggctgcaggctgtacacaataatctgaagcctggctgtaaaccttctcttcacattaatctgcc

SEQ ID NO: 6877195 - DNA, 114 bp, Homo sapiens
agtcaaaaaaaggattagagggagggagaaaaaagaattaagcagtaccaaagctgaactagatgcttgtgtctgaactagttgctctctctctcctttctccttccagggatt

SEQ ID NO: 6877196 - DNA, 67 bp, Homo sapiens
agagagacaagccaacagcacagctggacgccccactcgcaatttgttcagctcagtttgattctct

SEQ ID NO: 6877197 - DNA, 95 bp, Homo sapiens
ctttctggcctgcgtcttctgcctccctttctcatctaaagcaatttgggtccccattgcttcagagaggaggaggtggaaggtttaggagagag

SEQ ID NO: 6877198 - DNA, 58 bp, Homo sapiens
agggagtctggccgtcggctggctcagggcgggccggttggctgtacccaggctccct

SEQ ID NO: 6877199 - DNA, 55 bp, Homo sapiens
cctgtgtgcagggccatccacacctccgagactggtgcacagtcctgcacacagg

SEQ ID NO: 6877200 - DNA, 58 bp, Homo sapiens
ctttacaattcaagggaactctcaatattggtttgagtcacctgggaattttgtaaag

SEQ ID NO: 6877201 - DNA, 78 bp, Homo sapiens
gaagcttacacaactgtctttatatatttggaaaatttcagctgaaagagagagggagtagagattgtgtctggcttt

SEQ ID NO: 6877202 - DNA, 60 bp, Homo sapiens
aggtaatgttttagattactgctgggttcttctgggcctggcaacataaagaacaaatct

SEQ ID NO: 6877203 - DNA, 57 bp, Homo sapiens
cagaagatctcttagtggagggtaaggtccaaccctcagctcccatgagatctgctg

SEQ ID NO: 6877204 - DNA, 70 bp, Homo sapiens
tgtatcttggatcttgatgctccaagagtgaaactgtttctttcaactatggagttcagatcttgagcca

SEQ ID NO: 6877205 - DNA, 59 bp, Homo sapiens
gtgctcaggggcaatcctgggaaatttctttttgggttggcatgcccctgactggacac

SEQ ID NO: 6877206 - DNA, 64 bp, Homo sapiens
atgagatttgggagggggcaggggcacaatgatatggttggctgtgtccccacccaaatctcat

SEQ ID NO: 6877207 - DNA, 78 bp, Homo sapiens
tagctagttattcatagagctgtggctggaattaggtttcttgactgattctgtaaacatgtctttagtgctatgcta

SEQ ID NO: 6877208 - DNA, 55 bp, Homo sapiens
ttcatggggggaggtggtatttatgatctttcagaaattacttgacccctctgaa

SEQ ID NO: 6877209 - DNA, 121 bp, Homo sapiens
ggcctctgacccatttttctagcggactcattacctcttatttagccttgaagactctggtggctgattggcagagaagctttcacagctgggaagagatatgggatctgggtcagctgcc

SEQ ID NO: 6877210 - DNA, 83 bp, Homo sapiens
gcctctgctgagctgagaacacttgggctagtccttggtttccacatttccctgggtcattgtttttgtttctcactagatgc

SEQ ID NO: 6877211 - DNA, 62 bp, Homo sapiens
gcctcggtggcctccaaggcttaatgggcctgagtctatttgtctaagaggctgacagaggc

SEQ ID NO: 6877212 - DNA, 61 bp, Homo sapiens
gctggttatctcggccacagagagctgttcgtgataggctttctcggcagagatgatgggc

SEQ ID NO: 6877213 - DNA, 71 bp, Homo sapiens
ctagttgtttaatctcaagaaattttttttacaatgtgtaagtgattattgttttcaggttaaatgattgg

SEQ ID NO: 6877214 - DNA, 65 bp, Homo sapiens
cgctctgctcccttcctccttgatgtttctgtaaagagcatttggattttgaagagagtattgtg

SEQ ID NO: 6877215 - DNA, 62 bp, Homo sapiens
ctgggtctttttcttccattgacaaaggagggttgacaagtctgggaagaaaaggaactcag

SEQ ID NO: 6877216 - DNA, 66 bp, Homo sapiens
gccaggcacaatgagcgccatcttttcctgctgcaagaatgaggtttgggttcattgctggctggt

SEQ ID NO: 6877217 - DNA, 82 bp, Homo sapiens
tgctgatacaatttacagaggtgtcctgcattgacatcagtccagtccagtccaatcctcaatgtaccttgtccatcatgta

SEQ ID NO: 6877218 - DNA, 80 bp, Homo sapiens
ttggtgcaaaagtaattgtggcttttgctgtaattattttctgcaagtaatggcaagaaccacaattacttttgcagcaa

SEQ ID NO: 6877219 - DNA, 60 bp, Homo sapiens
atgtttcagggtgatagaaggttatgccaatcaaacgagccttcattactctgacaacat

SEQ ID NO: 6877220 - DNA, 129 bp, Homo sapiens
gcgcccgggcggaagtgcgccgccggccgggtcccgcgcggccgctctaggatgcgagggaggtccgcgctcggtggcgcccgcgcgggacctggctctgggcgcgcttccgggctccccccgggccgc

SEQ ID NO: 6877221 - DNA, 58 bp, Homo sapiens
tcaggccgccctgggctgtggtcatcctcgctgtgacagcaagccaaatgtggcccga

SEQ ID NO: 6877222 - DNA, 83 bp, Homo sapiens
ccaggatcttggggtcatgggtttagcattcattcattcagtcagtcagtaggtgcctccatcagtgcctccaaggtgcctgg

SEQ ID NO: 6877223 - DNA, 60 bp, Homo sapiens
tttatcttgtagaaagatcattctggctgctaagcagagaatggcttatacagaagtaag

SEQ ID NO: 6877224 - DNA, 68 bp, Homo sapiens
gcatgttgaagacctttagtgctatgtgggcctaaacccagtatgacccacttgtcttccacaccagc

SEQ ID NO: 6877225 - DNA, 69 bp, Homo sapiens
gggggaagagctcctgcattcttccctggccaccttggctccagggctccccagagagcctcttccctc

SEQ ID NO: 6877226 - DNA, 82 bp, Homo sapiens
atcattaagtattggctttatgtaagtccaaaggcagggagctgtcttcacttccttatataatgcctggtacataataggt

SEQ ID NO: 6877227 - DNA, 57 bp, Homo sapiens
tatacagggcaagcgaaggcagagctcatgctccacagctttgcaaagccctgtgta

SEQ ID NO: 6877228 - DNA, 77 bp, Homo sapiens
ggaacggcagcctggcgggggccgcgcgggggaagcgcgccgcttcttgtaaacggttccccgaagggcgctgggcc

SEQ ID NO: 6877229 - DNA, 68 bp, Homo sapiens
gtggagagcggagctagtttttgtcctccatagatccccacttctgaggcttgatcagcttcctccac

SEQ ID NO: 6877230 - DNA, 58 bp, Homo sapiens
gttagcatttgtttaatatcagacattgtttacttgttatttttgagtgaatgctagc

SEQ ID NO: 6877231 - DNA, 105 bp, Homo sapiens
actacctctcagcagtcctctgtttgttttgtgaagttatgaaaggtataagctctcccgtattcactcaggacacatagagaccatatgaaggaagtaggtagt

SEQ ID NO: 6877232 - DNA, 79 bp, Homo sapiens
gggcttggccttgattctcaaacaactgtccaggaaaatcagcacacagattgatcttgagaattatgtctaaaagctc

SEQ ID NO: 6877233 - DNA, 55 bp, Homo sapiens
agagagctcccagtctcctctccatggctccttgcctggttgctggggtgccttt

SEQ ID NO: 6877234 - DNA, 59 bp, Homo sapiens
acagctggaggggctgcagagggagcagatcccttagtggaggcagccccagcagctgt

SEQ ID NO: 6877235 - DNA, 97 bp, Homo sapiens
ctcattttataggagttcgaatttgccattgtttcctgctgagctgctatgaggagtagcagcaaggaagcgaggatgggactctgtgggagatgag

SEQ ID NO: 6877236 - DNA, 65 bp, Homo sapiens
cacaaccttttctgggagccacaggcaaagacttttgcccagtggtttgcagaaccaagggcgtg

SEQ ID NO: 6877237 - DNA, 82 bp, Homo sapiens
agtagtaaatatttcaaaaggaaacacagtttattacctaggaaaatattctggttgtgttttcttatggcataaaattatt

SEQ ID NO: 6877238 - DNA, 84 bp, Homo sapiens
cttctatgtactcatactcggatgtcaagtcagacatgttagtgaaacatttgaaatgccatgtgaggagtgctacaatagaag

SEQ ID NO: 6877239 - DNA, 55 bp, Homo sapiens
gagctaagagagcccagtgtcaattagacattgacaagacaatggctcttagctc

SEQ ID NO: 6877240 - DNA, 56 bp, Homo sapiens
acaaaaactggatggaatagagtgcatttttgctttgtttcatgctattttcttgt

SEQ ID NO: 6877241 - DNA, 69 bp, Homo sapiens
atatgaatttggggaggacacagttcagtctataacattctgctctctctggcctcccagaattcatgt

SEQ ID NO: 6877242 - DNA, 70 bp, Homo sapiens
gtgatcttataaaaatgatgtcgaaaagtaagctctgtgttctagagtttgttttcattataaagattac

SEQ ID NO: 6877243 - DNA, 60 bp, Homo sapiens
ggaaggtttttctcctggtgggttgggctttctccaagcggaaaatgagaaaggcattcc

SEQ ID NO: 6877244 - DNA, 78 bp, Homo sapiens
gcacagtgaggtccagtaacttgtccaaggtccgagagacaggactggatccaggtggtctgacctcccaacctgtgc

SEQ ID NO: 6877245 - DNA, 73 bp, Homo sapiens
ggggcccttcttggcaaaagatggagaagccctacttcagtacagtctgaagcttcatctgatgccgaactcc

SEQ ID NO: 6877246 - DNA, 55 bp, Homo sapiens
gcaacgtcttctctccaagtaaattcaccgacaggccgaagggaggaggtgttgc

SEQ ID NO: 6877247 - DNA, 123 bp, Homo sapiens
gctggcgaagaggatgtacaggagccagaggcccaggaagagcgcggtggtggcgagcttgggtccgcgcgggccgcccagctcgccgccgatgtgcggccggcgccggtacagcagcacggc

SEQ ID NO: 6877248 - DNA, 60 bp, Homo sapiens
gacacagagggcaccagatatgggaaagtttctctctgagaccatgtttgcttctgtttc

SEQ ID NO: 6877249 - DNA, 57 bp, Homo sapiens
cagaaaacaaacctatcctgagacccaagctgtgtcctaggatgaaagtggtttctg

SEQ ID NO: 6877250 - DNA, 57 bp, Homo sapiens
ttctttttgtttcttatagcgacactgatgtcagctaatgtgatagagcagaaagag

SEQ ID NO: 6877251 - DNA, 80 bp, Homo sapiens
gggcctgctgggtgcggggcgctgggcagaacaaggcagcatggcctggccctgtgtcctgctgccagtgaagcaggccc

SEQ ID NO: 6877252 - DNA, 82 bp, Homo sapiens
ttgaaagactcttgagggccatctacactccccaaaacatctactgtgttcatgtggatcagaaggccccagtcactttcaa

SEQ ID NO: 6877253 - DNA, 99 bp, Homo sapiens
tagtttcatttcagaaccataaatgaggacatgatacttgtgttcttggcagagctgggtactgatgtcttcagttgctgttctctggaagtgagacta

SEQ ID NO: 6877254 - DNA, 57 bp, Homo sapiens
tgaagcagcttagaaaaatgaaattggggttgccttcttcattttcagagttgagca

SEQ ID NO: 6877255 - DNA, 85 bp, Homo sapiens
tttttatatgaatcataatagtttaattaatcagccttctgattcacagtttaagctggttataggcaaggtccttctgtaaaga

SEQ ID NO: 6877256 - DNA, 57 bp, Homo sapiens
tgatacgctgtctcaatgtgggttactcaaagtatgcccatcttctagcagctgtta

SEQ ID NO: 6877257 - DNA, 67 bp, Homo sapiens
agttttattggaagagagccacagttaattatttacacattggcagtgttttctgttccataacact

SEQ ID NO: 6877258 - DNA, 61 bp, Homo sapiens
ggagtatctggcacatccagctgtgctctagcctggagctggctggcatagccattgctcc

SEQ ID NO: 6877259 - DNA, 77 bp, Homo sapiens
gtgcatttatggaagaaaacttggaaggcattaaaggctacattttgagccttgcatgatttcattcatttatgcat

SEQ ID NO: 6877260 - DNA, 120 bp, Homo sapiens
gtgagtcttgcacgaactgcaggaagagaaccagaggaaagtatttctggaagcaggtagatctcctgtttctgctaatcttttactgagtttgtggctgcctagtcagtgcaggttcac

SEQ ID NO: 6877261 - DNA, 71 bp, Homo sapiens
ggccaatttgtcccagtgatgactaattctctgatgttccagatatccagagatcacactgggcaggggtc

SEQ ID NO: 6877262 - DNA, 82 bp, Homo sapiens
actagtcttttgaaaaatccactttgcttgtattctgaataactagttggagtgcagcaagaccggatatgtcgagacaagt

SEQ ID NO: 6877263 - DNA, 70 bp, Homo sapiens
cccttcaattgactagaggtaatgagaaagaacccaccctcctttctttatatctgctagtgggttgggg

SEQ ID NO: 6877264 - DNA, 99 bp, Homo sapiens
ccatctgcccaggccctggagccaagcactcaactcctggagccttctctagctctaggtaggctgtgtgtggaaacagggcagggccacctcgggtgg

SEQ ID NO: 6877265 - DNA, 70 bp, Homo sapiens
tctcaagcttcagctttctctgatttccctttttgtcacccgttggaggaagctctctgcttttaagaga

SEQ ID NO: 6877266 - DNA, 71 bp, Homo sapiens
ggttactgagcctgtttcttccagagtggctcccagttggatccacactgtctaacaaggcatacgtagcc

SEQ ID NO: 6877267 - DNA, 118 bp, Homo sapiens
atctaaataagtttatgtcttgtagggaaggcactttgtcatgcttctttgtacctaagcatatgctttgcaaatcataaacaatagtgttgattttatttgatataaaaacttggat

SEQ ID NO: 6877268 - DNA, 64 bp, Homo sapiens
tgggcttatccgtccttacatcacctcctcttgttcaaagactgaagggtaatgtgggagccca

SEQ ID NO: 6877269 - DNA, 103 bp, Homo sapiens
tcctagagggcatagcaggtatagaagggagtgatccaggaggacactggtcacaagaatgtcctcctggatcactcccttctatacctaccataccctagga

SEQ ID NO: 6877270 - DNA, 56 bp, Homo sapiens
gcctctgtggccttggaccagcttctgggaaagagcccctgcctggctacaggcgc

SEQ ID NO: 6877271 - DNA, 55 bp, Homo sapiens
gctgaaatgaaaacacaggtcggtagattccaactctaagacctttcacttcagc

SEQ ID NO: 6877272 - DNA, 100 bp, Homo sapiens
cctaggcagccagattctgaatgcctgcagagccagagaaataatgtttctctgggcacattttccaggacatttttagaatgccatatgactgccaagg

SEQ ID NO: 6877273 - DNA, 57 bp, Homo sapiens
taccaggcatttgtaatgctgtgccagtatgtctggttcttagcacagtgcctggta

SEQ ID NO: 6877274 - DNA, 75 bp, Homo sapiens
actcttggcagcttttggaggagccagactattaatacttagcccagggcttgggaagctgtttgcacttagagt

SEQ ID NO: 6877275 - DNA, 130 bp, Homo sapiens
actatttagcttgtgttccattaagactaccgagtcaactttgatctcagttcctcagaggtagtgctcattctccaccttggaactgaagtgtttttgttgtgatggtgatggtggcagttgaattttt

SEQ ID NO: 6877276 - DNA, 86 bp, Homo sapiens
gctgtcacatgcccaggcaataaagggttggttgggaggcacacctgctaccctttcttttatcgctgggagcaaacaatgccagt

SEQ ID NO: 6877277 - DNA, 68 bp, Homo sapiens
gagggtaaagaagggccagctggacacctgggtccctctatctgcttctgaggcccatctgcatcttc

SEQ ID NO: 6877278 - DNA, 87 bp, Homo sapiens
gaagcaatgtagtttctaaactgaactgtcataaaagaggatatgggcttccaactggcatgtcagtagtaattaaaatattgtttc

SEQ ID NO: 6877279 - DNA, 63 bp, Homo sapiens
ggaaccatgcaggtctggagcttggggagaaactcccctaccctagagcctgacttgctatcc

SEQ ID NO: 6877280 - DNA, 75 bp, Homo sapiens
agggctggccctgggtgggactctgcattaggcagttttccctgccagtttttcccctcaggcagccagtgccct

SEQ ID NO: 6877281 - DNA, 58 bp, Homo sapiens
gcatttgcttcctgggtcttgaatttccaccattaaatttcagtctagtggcgggtgc

SEQ ID NO: 6877282 - DNA, 55 bp, Homo sapiens
agggaagagtaactagcccatgtgcacctagacgcacagtgttaggtttttcctt

SEQ ID NO: 6877283 - DNA, 96 bp, Homo sapiens
tattaccgggtaccaccagtacagtgaaaagaatattagaataggcataaaaatggattctaattcttcattcatcactatgtgattttagtaata

SEQ ID NO: 6877284 - DNA, 96 bp, Homo sapiens
tttaagggtttgtacaaattttgacatctaggaaaggtacatgacgaaattgccaaaacattctgtgatgtcataagttaaggacttccatttaaa

SEQ ID NO: 6877285 - DNA, 55 bp, Homo sapiens
tgtgggaatcagccaggggggcccttaactgcccaaggctgatcattttcccata

SEQ ID NO: 6877286 - DNA, 72 bp, Homo sapiens
ttggtagcagaaactggagagctgccacagaagagtgatctcctgggcttgctcctccagctgaagacacag

SEQ ID NO: 6877287 - DNA, 83 bp, Homo sapiens
atctttgtcaatgctcatccccccatttgcaaaatgagggtcaaatggtgacctcaaagtagagggagatgaggaccagagat

SEQ ID NO: 6877288 - DNA, 63 bp, Homo sapiens
tactagatcagggatttgtaatatggcctctgagccaaatccaatctatcctctgattttgta

SEQ ID NO: 6877289 - DNA, 65 bp, Homo sapiens
ttaaagtcaatttcttttaatgtctggctttcagtagattgtagctagctttgggaggattttaa

SEQ ID NO: 6877290 - DNA, 83 bp, Homo sapiens
actagaaaagactttagagattgtctagtattgtggctcccaaccatgaagccatttctggaagtctttaagcaatgtttagt

SEQ ID NO: 6877291 - DNA, 61 bp, Homo sapiens
acccaccacagtggctggcacatagtagatgctcaattgatgatggtcatgttatttgggt

SEQ ID NO: 6877292 - DNA, 96 bp, Homo sapiens
aggagatgcaagagtgagaattttacaaaatacctccgatgttcctatttcataagcatttgggtttagatttgctgagattcgtcttgcaaacct

SEQ ID NO: 6877293 - DNA, 59 bp, Homo sapiens
tattctgagggttcttggtagttggaatgaaggtaattccaattctgagctctcaagta

SEQ ID NO: 6877294 - DNA, 76 bp, Homo sapiens
atttgtgtgaactcttcaagtatgagcgctggaaacccactacagccagtttaagcaggaggggtaatttgcagat

SEQ ID NO: 6877295 - DNA, 62 bp, Homo sapiens
gagcattagtaaaggaaggaccttggaagacttggttttaggtcttttgtttattcctgctc

SEQ ID NO: 6877296 - DNA, 62 bp, Homo sapiens
agcattctcgtctgaatctggaaggggtcttctttatccccagatttgccacgagagaggct

SEQ ID NO: 6877297 - DNA, 74 bp, Homo sapiens
ggcttcaagttgggcggcgggcagcgaacttgacagaacctcgaaactctgcagatccgccgcccaacccagcc

SEQ ID NO: 6877298 - DNA, 57 bp, Homo sapiens
ctgaccttgtgatccgcccactttggtctcccaaagtgctaggattacaggtgtgag

SEQ ID NO: 6877299 - DNA, 79 bp, Homo sapiens
ctcttaagtatatccatttgactggatcataaatcagtacactgccagtgagatagtggtatatgcttatttgtaagag

SEQ ID NO: 6877300 - DNA, 66 bp, Homo sapiens
ccccagagcctagcacttaggaactgccatcgatcatttagccaggccctgcactaggccctgggg

SEQ ID NO: 6877301 - DNA, 102 bp, Homo sapiens
atttatgttccgaggctcttcccatcttgcattgatcaaagtttgggctctgtgggctaacctttgttcaatgtaagatgggaacagcctaggaacataaat

SEQ ID NO: 6877302 - DNA, 55 bp, Homo sapiens
gtgtgggccccttgtactctggatctaatccttagagtcaccaaagggccaacat

SEQ ID NO: 6877303 - DNA, 56 bp, Homo sapiens
ttggtataatacagtaagtgttgtacagtttacaacagtttatagtgttatcttga

SEQ ID NO: 6877304 - DNA, 65 bp, Homo sapiens
ccaattcactccacttctgtgtctggctgccaaaagaacagacaggcttcagaaagagtaattgg

SEQ ID NO: 6877305 - DNA, 77 bp, Homo sapiens
gtgacaattatgtttatataatagtttcataaaggcttgtttgagcctatgtgaatctcttattactacgctgtcac

SEQ ID NO: 6877306 - DNA, 55 bp, Homo sapiens
gtgagtgaagaagagcataggtattcctgatatttggcatgttaacttcacttac

SEQ ID NO: 6877307 - DNA, 56 bp, Homo sapiens
tacattatctcatttgagcctcacagtgactctgtgtgactcagagagggtaagta

SEQ ID NO: 6877308 - DNA, 69 bp, Homo sapiens
tggtagttgttagtgtgccatggccttgccaggtttgcccatggacactggtcttactcagctaagcca

SEQ ID NO: 6877309 - DNA, 102 bp, Homo sapiens
cctttgaatttaaggcaatagtattaagaggtgggccctttggaagtgattaagtcacaagggctccatccttataaatggggtttatgcttttatcaaagg

SEQ ID NO: 6877310 - DNA, 74 bp, Homo sapiens
gtgtgtgagtgattgcttgcttaaggacacctcccctctccatcttgtatgtctctgtgggcaatcctgcaggc

SEQ ID NO: 6877311 - DNA, 71 bp, Homo sapiens
ggtcgatgctgccctgtttggacagcccggtcttccggggccgcacgttgtccagctgggcatcgtccacc

SEQ ID NO: 6877312 - DNA, 62 bp, Homo sapiens
ccctcttgtttcttctaagcagcagccagagatcactggttggtttacaggaataagcaggg

SEQ ID NO: 6877313 - DNA, 72 bp, Homo sapiens
gatgagtgcctgacagtgtacactgacagctcactaaagggttgtcattattactattgtcattgttttctc

SEQ ID NO: 6877314 - DNA, 72 bp, Homo sapiens
tatgtagttagaagattcaaacagatttctctagaaaaagcagtagggttatggaaacttctagcttacgta

SEQ ID NO: 6877315 - DNA, 55 bp, Homo sapiens
tcatgtcaaaatctaatgccagcccatttttccttgatattaggttttgtcatga

SEQ ID NO: 6877316 - DNA, 72 bp, Homo sapiens
tcagctggagttgtgggtttactaaatgtgttactagacaaaaatcattagtgaatcttaactcctgcctga

SEQ ID NO: 6877317 - DNA, 69 bp, Homo sapiens
gaggcgctgtctggggtcgcggccccgtctgggttgctgggggtgctgcgtgcccggggtttcgccctc

SEQ ID NO: 6877318 - DNA, 78 bp, Homo sapiens
aaagaagagggtatgggaggggtgcctggatgaggagagatcagaattctcagctggtgtttcttctccttctttttt

SEQ ID NO: 6877319 - DNA, 56 bp, Homo sapiens
ccatttaatatctcacacttccatgcctggattgtcaggtaggtgataatgagtgg

SEQ ID NO: 6877320 - DNA, 62 bp, Homo sapiens
actatcaagtgcttaaaagggtggtctattaggaagttgataaccagggagagcatggtagt

SEQ ID NO: 6877321 - DNA, 72 bp, Homo sapiens
acttttcaattgtttaaaatgaacgatgaagcacaaaatccagcctcattatgcaaagaacacttgagaagt

SEQ ID NO: 6877322 - DNA, 70 bp, Homo sapiens
ttgaatagtagtctttgatgtcacacaagagaatactgttggctaacagtctggaggctgcttcatttga

SEQ ID NO: 6877323 - DNA, 71 bp, Homo sapiens
cattgaaaataataattatggagcagctcagagtggaagcatgttgagctacttctgatattggcaaagtg

SEQ ID NO: 6877324 - DNA, 65 bp, Homo sapiens
tcttcaaccttgttactatagctactatggttgtgaatatattgggcagtgacaggagttggaga

SEQ ID NO: 6877325 - DNA, 56 bp, Homo sapiens
gcataacagcagtcctcttctcatgcatctgctgagcccattgggtgctgttatgt

SEQ ID NO: 6877326 - DNA, 63 bp, Homo sapiens
gctattttcagttagcatgtgaaagatgacactgtctggctttcacatttactgttagatggc

SEQ ID NO: 6877327 - DNA, 65 bp, Homo sapiens
gggaggaacccaagctcaccgtcaggtttaccaggcttgaaacacgggaggcttgtgtttccacc

SEQ ID NO: 6877328 - DNA, 56 bp, Homo sapiens
tgggaggtgcacacaaggtcttgttggctgcccctgcaggtccctgtcacctctca

SEQ ID NO: 6877329 - DNA, 125 bp, Homo sapiens
gagatctgactgatagagacttttcagatgttttgccctttaggagaacgtggatccttggggatcttcaaattgttttgtctaatagggcaggttgtgtgttacactgtgtcatgccaggtttc

SEQ ID NO: 6877330 - DNA, 88 bp, Homo sapiens
tacatattagtcatttaaacactcacttcatagccattattgtcaaaacaacatgtgtgctttgggtgtgggtgtgtacaggtatgta

SEQ ID NO: 6877331 - DNA, 57 bp, Homo sapiens
gcaatttctgaggctgtccttccttgaaggacactttttattccctcggcagaatgt

SEQ ID NO: 6877332 - DNA, 79 bp, Homo sapiens
gagttgcctgtcaaaggctggagggcaggaggagggcctgggtttgggttctttcctcccagcctttggatggtgcctt

SEQ ID NO: 6877333 - DNA, 76 bp, Homo sapiens
ttctgtgaccttaaaagaatttaagcatttattctatcattgatggaataaaatgtcagttcttaaggatttagaa

SEQ ID NO: 6877334 - DNA, 73 bp, Homo sapiens
agggctgtttttccatctgtgcatgttgaagctctcttttgactacagaataacagatgtgatatgcagtctt

SEQ ID NO: 6877335 - DNA, 58 bp, Homo sapiens
gccaaatacagtagtcattgccattgccattttgagcatctactgcgctgtgttgggc

SEQ ID NO: 6877336 - DNA, 72 bp, Homo sapiens
ggtgctggatagaagaaaagtgacagcttcaggaccacacacctgaaatggtattctttttcaatacacacc

SEQ ID NO: 6877337 - DNA, 57 bp, Homo sapiens
gcaacagttggattccagaggagctctttcatcttcttaagagaatcaactgtttgc

SEQ ID NO: 6877338 - DNA, 75 bp, Homo sapiens
tctataagagaattggtaagcaagatggcaataccattatgtctccatttagcttgcctgtttaactcttgtaga

SEQ ID NO: 6877339 - DNA, 55 bp, Homo sapiens
cactggctaaagataagctcaatagatctgtgggagcacagctttaagccatgtg

SEQ ID NO: 6877340 - DNA, 83 bp, Homo sapiens
gaacctgggtaatgaaactggcatttgactgggactgccactcagaacccaagttaaaattcagtgctcactacagcagcttc

SEQ ID NO: 6877341 - DNA, 61 bp, Homo sapiens
gctgagcattggatcaaatgacttgcccaaggtcacagggcaggaatgaaccaaagccagc

SEQ ID NO: 6877342 - DNA, 66 bp, Homo sapiens
ttcctcacctatcctgaggtttgtaatatagtccctgcccccaaggactatacagcctctgaggaa

SEQ ID NO: 6877343 - DNA, 130 bp, Homo sapiens
atgtggtaggagctggcctggggatgatttatcaggctctcttcagtggtcctccggcccaaataggacccttcatagaggagaagctgtaggtgccttttgacccaggcttggaaatagccctttgcgt

SEQ ID NO: 6877344 - DNA, 60 bp, Homo sapiens
ccctcctctgcgtctctccacactgagcagaggcctcggggaggagcgggcagaagaggg

SEQ ID NO: 6877345 - DNA, 84 bp, Homo sapiens
atgaaaatgttcctcaaaaattctagtccacagtcttctctctctgtttcgaacatctgtggcatttagaggttgcgtttgtat

SEQ ID NO: 6877346 - DNA, 68 bp, Homo sapiens
catagacgcggccgctgatgcagcacttgttgaaggtcaagatgttctgcgtgagcgtgcccgtcttg

SEQ ID NO: 6877347 - DNA, 61 bp, Homo sapiens
ggtggcatgtgcctgtaatctcagctactcaggaggctgaggcaggagaatcacatgaacc

SEQ ID NO: 6877348 - DNA, 111 bp, Homo sapiens
aagagaacagaagtgtgtgctgtgctcagccctcctgtcctgtcccctcagggtaggtctgcctttctggacaagacagagggagtaagagccagacctctattagctctt

SEQ ID NO: 6877349 - DNA, 60 bp, Homo sapiens
ggccgtgcctgtcagggtggtggctaggtgtgtccattctgtccaccgcatgcagcggcc

SEQ ID NO: 6877350 - DNA, 69 bp, Homo sapiens
ttatacattaaacaggcttttggaaagttacatttaaatggaatttttgaaaagctgtaatatgtgtaa

SEQ ID NO: 6877351 - DNA, 91 bp, Homo sapiens
gggacaaacaggtacttgttaaaatattagctattatttggggagtaggtattgaatgatggttaatattttaagtgattcttttgtactc

SEQ ID NO: 6877352 - DNA, 90 bp, Homo sapiens
gtttgtaggcctttctggattaagtaaaatagaggaaggtgtagtccttccacctcttgcattggttagtttcgggaaagaactacagat

SEQ ID NO: 6877353 - DNA, 99 bp, Homo sapiens
gatgtgaattcttatgtctatttctgcaggatgctctggtggtgctgtgacatgccacctgcaccctcctccttcaggacagacgttctcattcccatc

SEQ ID NO: 6877354 - DNA, 70 bp, Homo sapiens
agtgtattgattggaacagcctctctcgggttgcccaagcccactgataatgggtgttccagtgagcact

SEQ ID NO: 6877355 - DNA, 80 bp, Homo sapiens
tttgcatgcttgtgatgtcctgtctacataactgtgtgaattagaaaagtctacacatccctgaggacagaagatgcaaa

SEQ ID NO: 6877356 - DNA, 65 bp, Homo sapiens
tgctgtggttactcagaaaccagcaactatgtcaggttcctggtttacagagtaaaccaatagca

SEQ ID NO: 6877357 - DNA, 77 bp, Homo sapiens
tttaatttcctcagatgctgaatattagcctcatgatcctttgtcaggggtaaatgtagtatacttgaggaattgaa

SEQ ID NO: 6877358 - DNA, 74 bp, Homo sapiens
gcaaatagaaataaaaggatttgtcatttgtagaaatcaaatacctaaaatgactaataagttttactgtttgc

SEQ ID NO: 6877359 - DNA, 84 bp, Homo sapiens
agtaaaacattgtttaattttatttgactttatgacgttgcttttcaacaagcaaatgttaaatgtgttaagacttgttgtact

SEQ ID NO: 6877360 - DNA, 81 bp, Homo sapiens
gtcacctctttataattctggcataggctgttgggcctgagctggcctcatggtcttttccctggattataggagggtggc

SEQ ID NO: 6877361 - DNA, 60 bp, Homo sapiens
cttctcagcactctgaactattaacttgggttagagaaaaccagtatagagtctgggaag

SEQ ID NO: 6877362 - DNA, 59 bp, Homo sapiens
aaatgtagatctcccttctggacctaatctaaggacttataggaaggaagaatgcattt

SEQ ID NO: 6877363 - DNA, 73 bp, Homo sapiens
ctgcaagccaggaagaaggtcacaccagacaccaaccatgctggcatctggaccttagacttccaggctccag

SEQ ID NO: 6877364 - DNA, 72 bp, Homo sapiens
ggggatgcacagggagggggccagctccattctgccttgagaggcctgtgctttcttccctcctgccacccc

SEQ ID NO: 6877365 - DNA, 68 bp, Homo sapiens
ggggttatctgttaaaacaagctttaaactattaatagagtgaaattacagcttcagcagctaacccc

SEQ ID NO: 6877366 - DNA, 129 bp, Homo sapiens
tgtactccatgttcagtgtgacactggggcagtatagtgccattcaagaggtagttcttacatggttgagaggtatctaggcagatggacctgagtttgcaccccagttccctgtggccttggtgtgga

SEQ ID NO: 6877367 - DNA, 69 bp, Homo sapiens
gtgagagaacaaagattacgtagtcctgcttcctagttaaggttattaaagtgtatttttgtgcctcat

SEQ ID NO: 6877368 - DNA, 97 bp, Homo sapiens
gtggtggtgtgagcctgtagtctcagctacttgggaagcttaggcaggaggatctcttgagcccaggaggtcgagactgcagtgaacacgccactgc

SEQ ID NO: 6877369 - DNA, 71 bp, Homo sapiens
tttatatcatacattcagcagatatttgagcacctacatgctttactttgcagatgtgtatgtcttatgaa

SEQ ID NO: 6877370 - DNA, 76 bp, Homo sapiens
gtgtgagacacatgcaagaaacagagacgctgagaaacttcaccaggctcagccaccatgtttcttacatctccat

SEQ ID NO: 6877371 - DNA, 75 bp, Homo sapiens
gggccctctgttagggagctccactgcctctcattctgtgcgcagaaagaccgtggttgtggagctagagggtcc

SEQ ID NO: 6877372 - DNA, 83 bp, Homo sapiens
caagcgtgattatatgtgggatagaatttattaatttgtatttaaaacgtatttttgcctctcagataaaataagtatgcttg

SEQ ID NO: 6877373 - DNA, 56 bp, Homo sapiens
ggccttgagcagggagaaaccagcactcttctcagctgggcctttctggcagggct

SEQ ID NO: 6877374 - DNA, 78 bp, Homo sapiens
tgtcagggagaggtctggcccagcaatttgctcacccaaggaagaggagtgtcagagcaaggccaggccagccacgca

SEQ ID NO: 6877375 - DNA, 73 bp, Homo sapiens
tttgtggcagatgtaatctgacagctggagtgaagttacgagattttctagtgtagtttgcaccttgagcaga

SEQ ID NO: 6877376 - DNA, 62 bp, Homo sapiens
gtttactacaattactcagctctgctgtttatactgcagacaaagagtgtggttgtgtgttc

SEQ ID NO: 6877377 - DNA, 65 bp, Homo sapiens
tctcctatgcattcaatggaatgcatagtttcatctcctatgcattcagcggaatgcttaggaga

SEQ ID NO: 6877378 - DNA, 63 bp, Homo sapiens
gtcccaccctggcctcgctctctgcagccacagcagctgttgggaagctctgccaggggagac

SEQ ID NO: 6877379 - DNA, 91 bp, Homo sapiens
cagtatgctgctcaatttttattccacttccactagtttctcttcaaagagggctctgtctggaagggaaccctgggttggtgcatttctg

SEQ ID NO: 6877380 - DNA, 65 bp, Homo sapiens
ggtagtttttgagctgtaatcttgtccagccttattttagagaagaatgcttctgaagagctgcc

SEQ ID NO: 6877381 - DNA, 58 bp, Homo sapiens
gcccaggaagttgaggctgccgtgagttgtgattgtggcactatgctccagcctgggt

SEQ ID NO: 6877382 - DNA, 71 bp, Homo sapiens
tctatttttataagagcagcagagttgtcttctcaaaacggctgccaagctctgcttcttgggaagatgga

SEQ ID NO: 6877383 - DNA, 72 bp, Homo sapiens
aggctgaacggtggctgagaggacgtcgggctcagagaccctggcccaccagaccctcggcattcccagcct

SEQ ID NO: 6877384 - DNA, 86 bp, Homo sapiens
gagaatggggcaacagacttttattctttaagaccataatattcaaagagtggtccagggatctttagagtctttgagacattttt

SEQ ID NO: 6877385 - DNA, 87 bp, Homo sapiens
tgctataaatgtataatcagcagacttactagaatgtaagctccagggagttggaaattttgtctgctcttttttatcatgatggta

SEQ ID NO: 6877386 - DNA, 56 bp, Homo sapiens
gtgaactaaggattcaaacttcagatttcaaagtccaaagtgaatgctttgttcac

SEQ ID NO: 6877387 - DNA, 63 bp, Homo sapiens
tagaggcttacttgtaccgcaacgtgactgttatatttcttttgttgctgaaggaagcctctg

SEQ ID NO: 6877388 - DNA, 59 bp, Homo sapiens
cagaccttctgttggaggcatttaggcaattctggaagcctttctggcagaagtgtatg

SEQ ID NO: 6877389 - DNA, 76 bp, Homo sapiens
gttcgcatttagtctggtgggattccaagtggccatgagccactgattattcagcagacactaaagacgtgtgagc

SEQ ID NO: 6877390 - DNA, 68 bp, Homo sapiens
tctccttcctccaaatggaccagaccagtatttgtaagtcaccaggtccatgataggaagttccgaga

SEQ ID NO: 6877391 - DNA, 63 bp, Homo sapiens
tctaaacttgaatatcaacgaccggtgttgagttagtcagcactgcctgtgttcagggtaaga

SEQ ID NO: 6877392 - DNA, 80 bp, Homo sapiens
gaaaggatggaccctgctgttttcttcacttcagagagagaatcccctggggtgactttaagacacaatgttcacctgtc

SEQ ID NO: 6877393 - DNA, 98 bp, Homo sapiens
tcctgctgagtatctctgctaagcatgaacaattaagaaacaaagccattagtcgtaattgaagaattcatgtttatatgtagcagtttttcacaggg

SEQ ID NO: 6877394 - DNA, 61 bp, Homo sapiens
tgacagggctagaggcaatgcagggaaccgaccaatgctgattcagctactggtgctgtca

SEQ ID NO: 6877395 - DNA, 59 bp, Homo sapiens
gagatgggattcgaacctggaacctgatgtatccaggacccagtttctttcccagcctc

SEQ ID NO: 6877396 - DNA, 91 bp, Homo sapiens
gttatttttatacatagtctaggtacgggtccaacttcactcttttgtaggtggatataaaattgtcccagcattattcattaaaaataac

SEQ ID NO: 6877397 - DNA, 77 bp, Homo sapiens
ccctttcatccaccaccagcagcagcaggtgttctaggcaaagggatatttactgctgtggtgaagggatggagtgg

SEQ ID NO: 6877398 - DNA, 60 bp, Homo sapiens
gctctaggaggtgtgcttagaacggaattcaagggtcatctgagagcacctccttggagc

SEQ ID NO: 6877399 - DNA, 72 bp, Homo sapiens
taatacctgatgatttcatttctagctgtaaactcaattgagttttagggctgagggaaattacagagatta

SEQ ID NO: 6877400 - DNA, 102 bp, Homo sapiens
tgagtgtgtagagagcaaaagaatgtggtgggaaataattaggattatcaggagacagacaagcctaaaactttgttattgtgtttttgttcttttaactca

SEQ ID NO: 6877401 - DNA, 63 bp, Homo sapiens
ggcacattagaggagctgggaccctgtcatctgatcttagttcagtgtccagagcccatggcc

SEQ ID NO: 6877402 - DNA, 70 bp, Homo sapiens
gacacagctgtgatggagggacattttctggccaaacgcagcagaagttgatcctgcgtttccaagtgtc

SEQ ID NO: 6877403 - DNA, 63 bp, Homo sapiens
ccagattaggaaagaaagtcagggcaagccttgggtttcagttgtcctgttaatagcatctgg

SEQ ID NO: 6877404 - DNA, 81 bp, Homo sapiens
acaatatctgcatatatgcaagtcctcagggcatttgtgcacacaactgctggcatgcatatacaaagctcttatatttgt

SEQ ID NO: 6877405 - DNA, 64 bp, Homo sapiens
cagacgtctgggctcgcggtgtcacagagtggcccttcctccggctctggagcacagacgtctg

SEQ ID NO: 6877406 - DNA, 97 bp, Homo sapiens
taggtttggtgacaagttctggagtacaggaatcttcccaagcactgtttcctctttggcaaaattctcttgtacttgacttctggttccattccta

SEQ ID NO: 6877407 - DNA, 57 bp, Homo sapiens
gagggctccattccccgtgcccggtgtttcctctggccggattggcatgcagccttc

SEQ ID NO: 6877408 - DNA, 78 bp, Homo sapiens
ggctactccgcccagctgagaagcgcggggccctgacgcgggcgcgctcctcgcattcttccgttgggctgggaggct

SEQ ID NO: 6877409 - DNA, 62 bp, Homo sapiens
gcaataaataggtccctgtagcatcattttaaatggctgtgtaggatcctgttgtattttgc

SEQ ID NO: 6877410 - DNA, 59 bp, Homo sapiens
acaagtgactcatactctggttgccttaatacccagagtcatccaggagagatgcttgt

SEQ ID NO: 6877411 - DNA, 101 bp, Homo sapiens
taggtaaaatatatattgagaatgaaccatagttagttacacatgggtagggaattaaattctcacattgagtgattatctgtttcgttcataataaccta

SEQ ID NO: 6877412 - DNA, 79 bp, Homo sapiens
actggtctgttttctcttctgtgggatggcagtaacataggctttctcctcccagggtggccaggagaaatggatgagt

SEQ ID NO: 6877413 - DNA, 73 bp, Homo sapiens
agaatatctagataccaagaagcacattctgatgagttgtcaggttctttgtagcttccttggtctctgctct

SEQ ID NO: 6877414 - DNA, 62 bp, Homo sapiens
caacctcatttgaacttaatttaggaccatgtaacttggttctggccagtagatgtgggttg

SEQ ID NO: 6877415 - DNA, 55 bp, Homo sapiens
agtggctcacacctgtaatcccagcactttgggaggctgaggcaggtgggtcact

SEQ ID NO: 6877416 - DNA, 79 bp, Homo sapiens
ctccagctcccccatatctcaaaagcagctttgtgggagtgccaattctccagcagagtctctgaggggggttttggag

SEQ ID NO: 6877417 - DNA, 70 bp, Homo sapiens
cctaaaccccctgttgggaatcacctttatttgctgttgcggttaaagtgatcttgtcaggttgtttagg

SEQ ID NO: 6877418 - DNA, 80 bp, Homo sapiens
ctgccattgtgttttaaagtgttgaagaaaatgttcatgctcatgggcatggaaaagatattataagacttggatgggag

SEQ ID NO: 6877419 - DNA, 60 bp, Homo sapiens
ctccctgtgtttcaccaaaagagtctaggatttgaggctccctgggaggagacagaggag

SEQ ID NO: 6877420 - DNA, 96 bp, Homo sapiens
tgaccctcggggatccatccacgtggcccacccaagtaatgcaccttttagaatatttgctgaaataactgccacctggtggcatcttctgggtca

SEQ ID NO: 6877421 - DNA, 56 bp, Homo sapiens
gagtataatgattttcattcacaaaggcaatctatgtgggtgaaatccattatctt

SEQ ID NO: 6877422 - DNA, 69 bp, Homo sapiens
ttgtgaagatcctgacgtgctgaccaattcgacactgacgggcagtagaactgtcatgatgttgtacaa

SEQ ID NO: 6877423 - DNA, 57 bp, Homo sapiens
gccccccaacacctgttgacctactggggaccagagcctgcatcaggcttggggggc

SEQ ID NO: 6877424 - DNA, 67 bp, Homo sapiens
catcttaatatgggatgtttggaaaagttacttaagctttctaaacttcaattctaaattgcagatg

SEQ ID NO: 6877425 - DNA, 56 bp, Homo sapiens
ggaggcttcaattccttacccagtgggcctttccactgggctgcttgagtgccttc

SEQ ID NO: 6877426 - DNA, 66 bp, Homo sapiens
atgggccaccggctgccagatggaggcagcgtcagcaacacctcctctcaggctggatggcgctat

SEQ ID NO: 6877427 - DNA, 66 bp, Homo sapiens
gacaaatccagtgaactccagtgggagatacatacttcctccctgctggacgcattggtatttttc

SEQ ID NO: 6877428 - DNA, 79 bp, Homo sapiens
taaagtccggactagcaatctgcctttgagttgagcttttctcttacaaggtaagttgttaagtcatgccttgatttta

SEQ ID NO: 6877429 - DNA, 83 bp, Homo sapiens
tgtaaacattagaagagaagaggtattgaggaaattttcttctattttttccacattatgtttctcctttcttgttctttgca

SEQ ID NO: 6877430 - DNA, 70 bp, Homo sapiens
ctccacagtgtccgcggtttgcgttgtgggccggaggctccgcagcgggccaatccggaggcgtgtggag

SEQ ID NO: 6877431 - DNA, 70 bp, Homo sapiens
ctagatgtgggctttgagaaccagaacactgggaatggccaaaattctggtaatcggatttcacagctgg

SEQ ID NO: 6877432 - DNA, 73 bp, Homo sapiens
acccttgttaagttcatggaggtcaaggcttcttttgaagtgtgtgttctggggccttggtggcttgaagggt

SEQ ID NO: 6877433 - DNA, 92 bp, Homo sapiens
taggccagggaaaactagagatggcaggtggaatgagaggtcttctggacttgttttggatgtttccactgcatgtttttagtaccgcacta

SEQ ID NO: 6877434 - DNA, 59 bp, Homo sapiens
ggctggcacaaagctccaaatctaggctatgatactatttttgggttccatatgctgcc

SEQ ID NO: 6877435 - DNA, 88 bp, Homo sapiens
atccagctcatggctcagcgcctttctgtggtccttctgctatgaaatcagcagcgtcccatggagaggttgacccatcagcctgggt

SEQ ID NO: 6877436 - DNA, 82 bp, Homo sapiens
gcccgggactccccaacagcgacgtcctccccaacaggccccagcctcccttgacagtacctgctgggtggggccccgaggc

SEQ ID NO: 6877437 - DNA, 107 bp, Homo sapiens
tgtcctggagcccctgcacctgtctccaaatggtatccgctgtgccgccaggacgcgcttcactggcagcatgggtgcctttgtgaagattgtgaggcgctaggata

SEQ ID NO: 6877438 - DNA, 118 bp, Homo sapiens
gtaggaaagaggagggatccatctgggttggtctgtggatttttaatattttttaatggaacatgaaaacctccacagcaacatcgaaaccagggagaaagtgatccttgctccctgc

SEQ ID NO: 6877439 - DNA, 71 bp, Homo sapiens
gggaaacatttggctaccatgaggatgggcaggaacactgagagagctccattctcaaggtctagacaccc

SEQ ID NO: 6877440 - DNA, 74 bp, Homo sapiens
gcagaagggagcaggagcctgcctgccagctgtgtctcctaaggcagccctggctgggcttctctcccctctgc

SEQ ID NO: 6877441 - DNA, 58 bp, Homo sapiens
acctcaggtggcttggagggggacggagcagaccatcttcctctgggtcacctagggt

SEQ ID NO: 6877442 - DNA, 59 bp, Homo sapiens
attgcaaaattgtcctgtggaaacattcgtatcaatggtatctatgggctttttgtagt

SEQ ID NO: 6877443 - DNA, 102 bp, Homo sapiens
gctcttattcctctcataggttactgtagaaatagtggttgacaggactgatgtcagtccagctaactcatgatttattgcctcctatggagagagtaatgc

SEQ ID NO: 6877444 - DNA, 65 bp, Homo sapiens
ttaaatgctatcgcataaaacctggaacatgtattccataggttgctttgatgataagcagataa

SEQ ID NO: 6877445 - DNA, 70 bp, Homo sapiens
gcttgttgatgtggacgtctggaacttgaatagaagacatttcttatttcagatgcatccattagcaggt

SEQ ID NO: 6877446 - DNA, 66 bp, Homo sapiens
cattactgtatacacaagtggtgagatgattaactagaggacaatcatgactgtgtatacagaatg

SEQ ID NO: 6877447 - DNA, 61 bp, Homo sapiens
caagtccaggactcagagttcaggaaaatcaggagtctcctgaagtatgggtatggagttg

SEQ ID NO: 6877448 - DNA, 129 bp, Homo sapiens
gctcgggtggaatgttgtgatgaattattccttaaatgccctgagactgagcatgggttccaatctggatgtttccagctcagctgcaggaggagggagaatttagacagagacgttgtccgccaaagc

SEQ ID NO: 6877449 - DNA, 63 bp, Homo sapiens
tgtcttatgcttctcttttgatagatgacatgactgtcttttaatgggagcagtatttggaca

SEQ ID NO: 6877450 - DNA, 68 bp, Homo sapiens
gcccattaagcagcaggtgtgcttttaatgagaatctaaatcatttcttccttgcttgctgcttaggt

SEQ ID NO: 6877451 - DNA, 60 bp, Homo sapiens
tattctactctcctacaggtctactcacaaatgaagttgatttgcagaaggtgtagagtg

SEQ ID NO: 6877452 - DNA, 80 bp, Homo sapiens
cccgcgccgtttgtcctcccgaggagcctcagcgctctgggcaggggtcgcttggagaggcttcctgggaacggggcggg

SEQ ID NO: 6877453 - DNA, 80 bp, Homo sapiens
catgtctgcctgcaagaagtcctctctgggtggcagcctcagcctctcagttatgagggcttgttagcacacacaccatg

SEQ ID NO: 6877454 - DNA, 77 bp, Homo sapiens
tcaggggcctggcccgggagttttgaagagtcatctaacttgggaatgatgactgatttggctgggtcagcccctgg

SEQ ID NO: 6877455 - DNA, 62 bp, Homo sapiens
cttttgttgcccttgtcgcaggccgcaagctctgcaggccgtgaacagagagtgtccgagag

SEQ ID NO: 6877456 - DNA, 80 bp, Homo sapiens
gcccctcgcacaccgtgggtgatgtactggaggccaagatgcggcatggcttctctggcatccccatcactgagacgggc

SEQ ID NO: 6877457 - DNA, 74 bp, Homo sapiens
gatcctttattttaagatatttggcttgagaaacttgcttagctcacaggccaatttcttgtcatttagcgatt

SEQ ID NO: 6877458 - DNA, 65 bp, Homo sapiens
gggtcttacttaaatattcacacaattccttaagtcaatatggcttgtgaatgttttctggaccc

SEQ ID NO: 6877459 - DNA, 80 bp, Homo sapiens
ttctgaatttagcagtcctcctcacaatgattagattagtacattttgcatttggggatgattatttaaatttaacagaa

SEQ ID NO: 6877460 - DNA, 62 bp, Homo sapiens
tgaagctctcaaactctccccttcatccgtcccagatagaagtggaggggcttggagactca

SEQ ID NO: 6877461 - DNA, 64 bp, Homo sapiens
gcaggcaggggtgggataaggagcccccagccaagaacggggccatcctaaaacccctgtctgt

SEQ ID NO: 6877462 - DNA, 62 bp, Homo sapiens
aatttatattgttttccagagagaatgtacttcttgctgctctcagagtgacaatgagaatt

SEQ ID NO: 6877463 - DNA, 67 bp, Homo sapiens
ctgcagagcatgaggaggtctgatgatgagtaaaacgtcctggaaatagacctgttcagttaagtag

SEQ ID NO: 6877464 - DNA, 64 bp, Homo sapiens
aacataatctgccagcaagctaccctggcataaattcaattactgctacattgctggttatgtt

SEQ ID NO: 6877465 - DNA, 61 bp, Homo sapiens
gctacaagcacattaaggaacattgaagttgagtgtgctttatattcctaatgtcttgagc

SEQ ID NO: 6877466 - DNA, 66 bp, Homo sapiens
tttgagaaatgctgctcttggttaatttcttgaagagaagctgacagatgcagcaggtgttttgga

SEQ ID NO: 6877467 - DNA, 110 bp, Homo sapiens
gagacggagacggagtcttgctgtgtcaccaggctggagtgcaatggcgtgatctcagctcaatgcaacctccgcctcctggattcaagcgattctcctgcctcagcctc

SEQ ID NO: 6877468 - DNA, 58 bp, Homo sapiens
gtctcctatagctgcactgaatcattcttaacactgagagttgcagcaaatgggggac

SEQ ID NO: 6877469 - DNA, 67 bp, Homo sapiens
tggttttcattttttcaggttcctttaggatgatgtcctctggtcctgcagcagatctttggaacca

SEQ ID NO: 6877470 - DNA, 70 bp, Homo sapiens
tgtaaattcagtgagtgaatgaatgaatgttggcatttttgcacattcagttagatcatcctaatttata

SEQ ID NO: 6877471 - DNA, 86 bp, Homo sapiens
gtcaagcctgggctggggatgtgagtgctggtcgcattgttctataagggtcacaaggcacattccttgtccatgaggagcttgac

SEQ ID NO: 6877472 - DNA, 60 bp, Homo sapiens
cgctcagtacagtaatgatgggccagcctgggtccccgtccctgccagctgcgctgagcg

SEQ ID NO: 6877473 - DNA, 59 bp, Homo sapiens
agccttcctcttagacctgagaagtgatgaaatttggagtcatgcaggagaggaaggtt

SEQ ID NO: 6877474 - DNA, 80 bp, Homo sapiens
tgccattagttgtcatatctataatgctccctaaaagttaaagagggaaaacaaattaggttggcttatatctaatggta

SEQ ID NO: 6877475 - DNA, 78 bp, Homo sapiens
gtagtttactagttgagagtttggattctgagccagccacactggagtcagaattctagctcttcccttattagctat

SEQ ID NO: 6877476 - DNA, 55 bp, Homo sapiens
gccactggagacagtggggaaggactcgtgagcttgctccatgttctcccgtggc

SEQ ID NO: 6877477 - DNA, 58 bp, Homo sapiens
tctttacttgtgtattgtatatattccaactggaatacaagctttatgtaagcagaga

SEQ ID NO: 6877478 - DNA, 90 bp, Homo sapiens
gaatgggaagatatatgtgaaggagttatcagtggttatcagttgaatgatgacatatggtttgatttgttctttgatgtcctcctattt

SEQ ID NO: 6877479 - DNA, 65 bp, Homo sapiens
atccctggaacctgtgaatatgttctttatgtggcaaaaggaactttgcagaggtgattaaggat

SEQ ID NO: 6877480 - DNA, 63 bp, Homo sapiens
agccctgccttcttggcctttaaagactttgctttggctttgactttaggagggacaggagct

SEQ ID NO: 6877481 - DNA, 111 bp, Homo sapiens
ggcctggactccgagatgaactggcttggggcgccctcaggtggccacataaaaaaccacagtctgaggccagcctggggctcccagacctgggcgggatctttccaggcc

SEQ ID NO: 6877482 - DNA, 67 bp, Homo sapiens
agttgtcatggcatgttccatgttaagcctttaaatacggtttgacaaaggaccttgctatttaatt

SEQ ID NO: 6877483 - DNA, 64 bp, Homo sapiens
ggttcagtgtttttattgacaggttgactttcaacagtatgtgtcaatatgtaaagcctgaagc

SEQ ID NO: 6877484 - DNA, 91 bp, Homo sapiens
aaattttttgttagctacagttatatgtgataagtaatttctttgatgttaagagatggactgatctttatgtgtagatgataagatattt

SEQ ID NO: 6877485 - DNA, 111 bp, Homo sapiens
gaggtctgggaaggagcccggcgtggtggggcgggcctgtaatcccagctactcaggaggctgaggcaggaggattgcaggatcgctcttacccagtttctttctttcttt

SEQ ID NO: 6877486 - DNA, 58 bp, Homo sapiens
tggctgccctttctgaggtgtatcattgctgagatgaagctagcaggaagagcaggca

SEQ ID NO: 6877487 - DNA, 75 bp, Homo sapiens
ccctgcttgcccatggcaggatttctgaaggccacagtcagcctgggaagttaggatgccagggagttggcatgg

SEQ ID NO: 6877488 - DNA, 55 bp, Homo sapiens
aagatgcacaatgtggcaattaacaggatagtattgtttccaaattgtgcatttt

SEQ ID NO: 6877489 - DNA, 121 bp, Homo sapiens
gggtatgaggggtataagtggttaaatttcgccaaatattctgtgattctgtaccatatacaagtatttggtacttggaggcagaaaaatataaaggtgaagaaggcattaatacctgccc

SEQ ID NO: 6877490 - DNA, 97 bp, Homo sapiens
cttgattaagactcacaggtcaaatatcatctctcttttctgcatgctaattaaaagcaactctgttcttaggtatttgacagtcatttgaatcaag

SEQ ID NO: 6877491 - DNA, 72 bp, Homo sapiens
gggtaaatgtgcttcttttaacttaagttgagcacttgctcaaggtggaagagagacaggagcatagaactc

SEQ ID NO: 6877492 - DNA, 91 bp, Homo sapiens
catctttaaaatgcgcattatttatttgacagactgtaatggctgtttcagggatattatgggctgtcacgtgaatatgtattttagaatg

SEQ ID NO: 6877493 - DNA, 124 bp, Homo sapiens
gcttgatcgtcactgtcctttctaggctgaggttgatgccaggggaagctgctgtggcactgggcttctggtgtcagcgtaggagacagggatctaggacaacagggaccaggtggcgacatgc

SEQ ID NO: 6877494 - DNA, 61 bp, Homo sapiens
aaggatgtggcatttttcatatattcagtacaaaattaatatgatagtgaccgtcatcttt

SEQ ID NO: 6877495 - DNA, 64 bp, Homo sapiens
ttaggttttaaatatgggcaaattggctaatgcaagttgataaccatcatctttaaaatcctga

SEQ ID NO: 6877496 - DNA, 67 bp, Homo sapiens
cctcagctgcttccctggagccatccaagtaaaggccaagaataaataggaggagcaggctctgggg

SEQ ID NO: 6877497 - DNA, 85 bp, Homo sapiens
caggagacctgctggttggaggagaagtttggaagataccagatgtgtactccacctgtcatctgccaaacctgcaggtagcctg

SEQ ID NO: 6877498 - DNA, 75 bp, Homo sapiens
aggggataaagggggacttcctggtgctggctagaaagggtgatgctcttcagccaggcagccccctggtcctct

SEQ ID NO: 6877499 - DNA, 58 bp, Homo sapiens
ggaagaattcaaagaagagaacatggccctgccaacatcttgattttggacttcttcc

SEQ ID NO: 6877500 - DNA, 65 bp, Homo sapiens
tgggttctagggttcgagtataatccccttttttcagatgggaatactgaggcacctggaggtta

SEQ ID NO: 6877501 - DNA, 56 bp, Homo sapiens
cggtacggcgtgttggtcccagcggttcagctgaggtagggacgtgccgtaggccg

SEQ ID NO: 6877502 - DNA, 73 bp, Homo sapiens
ctttggctggcttctcgacttgtttcctatgcattacttcatgtgacgagtccagtaaggcacaagccataag

SEQ ID NO: 6877503 - DNA, 75 bp, Homo sapiens
gcatgagtggcttcaatgggttagtgagtcagagaagggtctgtatggtcactgacgtggggctacttgagatgt

SEQ ID NO: 6877504 - DNA, 75 bp, Homo sapiens
tgaagcctttgtttgggaagttttgcaggataaaggctagccagatctaaataaagcttttccatcagggtttca

SEQ ID NO: 6877505 - DNA, 60 bp, Homo sapiens
ttttattctcagctccagagagcacaacagttcactcactctcaggagctggatttgaga

SEQ ID NO: 6877506 - DNA, 112 bp, Homo sapiens
ggcctttcagcttacagcagccattctggagtcattggggctgatcgcatcctgccaggtgttccatcagatcctactgattgcttgctttgatgtatgttcaaaaaaggtc

SEQ ID NO: 6877507 - DNA, 55 bp, Homo sapiens
ccttctgtaaactgatttttcaccaagattgaggagaatctttccccacagaagg

SEQ ID NO: 6877508 - DNA, 56 bp, Homo sapiens
gcgggtggaacggctccacgtggctgtctacctgccgcgtgaggctctccaccagc

SEQ ID NO: 6877509 - DNA, 81 bp, Homo sapiens
tgtttctattcattcctaactccactagccttgggagcttgcgttcctgtgttacttgagttatgattgaacatggcgaca

SEQ ID NO: 6877510 - DNA, 57 bp, Homo sapiens
atctggcttacctagggtgcctctgctttcaaagaggctctggtgggaaggttagat

SEQ ID NO: 6877511 - DNA, 123 bp, Homo sapiens
tgtggttgccccgaagtggagcaggcaaggtaacacttgaagccatttttgcagagaattgcacaaacagcagcgggtgtcatagactcagtggttccacttcggatcgagaaaacacccaca

SEQ ID NO: 6877512 - DNA, 80 bp, Homo sapiens
gagttggtgccaagtggtttttggcttcctttgcttatcaaatccagcctacaaggacgtatttgtcaccatggatgctc

SEQ ID NO: 6877513 - DNA, 57 bp, Homo sapiens
ttctactataatggagttagtcataggtgagccaagtgttactctgctgaagtagaa

SEQ ID NO: 6877514 - DNA, 62 bp, Homo sapiens
cagggagaggctggtggagtaaggtccagcggtattcgggggtcctctgtcacctcgccctg

SEQ ID NO: 6877515 - DNA, 84 bp, Homo sapiens
tctctagtttcacaacttgttgtatggaaaactgaaatgggccctagaatcagcctatcatcttgttgtcatgcagcctggaga

SEQ ID NO: 6877516 - DNA, 58 bp, Homo sapiens
cagtttatagctctagcagcttctgctccagattatcagaggttggtcgctgtgactg

SEQ ID NO: 6877517 - DNA, 66 bp, Homo sapiens
aacatgaggctctcaggggagctgtattggtaaatgatggtctctccacaggggcatctcgttgtt

SEQ ID NO: 6877518 - DNA, 90 bp, Homo sapiens
atctgtatgtggaccattgcaaataaacaagtatacattgtatgttgagaaagtactgtgtatcaacatgttttttgtgttcatgcaggt

SEQ ID NO: 6877519 - DNA, 80 bp, Homo sapiens
gttccacaattcagattgttgccaggccagccttacttctattaagaatattggctgtggggggagcaggggttgggaat

SEQ ID NO: 6877520 - DNA, 61 bp, Homo sapiens
gcaggccagctgtgcagatgggctgtgaggaggcacctgcccaggtgagcagcaggtctgc

SEQ ID NO: 6877521 - DNA, 81 bp, Homo sapiens
tcttgtaaaatgttctacataatctggatttgtctgattacttcctcttgattagattcaggttaaacatttttggcaaga

SEQ ID NO: 6877522 - DNA, 72 bp, Homo sapiens
cataagtttcagctgttgtcatcatcactattattgttgctattgtgaaagaggacagcttagggcttcctg

SEQ ID NO: 6877523 - DNA, 60 bp, Homo sapiens
ggcctttcaggtgatccagggtgagcgtccccacagagccaccctgcatactggaaggct

SEQ ID NO: 6877524 - DNA, 72 bp, Homo sapiens
ccacaccagggagtgaatctttctggctaccaaaccagcaggagtcagaagcaaacatcactctaggcttgg

SEQ ID NO: 6877525 - DNA, 55 bp, Homo sapiens
aaggcccatctgtcccgtcctggcccaggctggtgcagggacagcagtgggtttt

SEQ ID NO: 6877526 - DNA, 67 bp, Homo sapiens
cctgtcacatatctattgatgctgctgatgtttgccaatatctgggtaaagtggtatatttggcagg

SEQ ID NO: 6877527 - DNA, 72 bp, Homo sapiens
attatattaaattaagtggctaatttatccaagtgaattatctgcatagatagccactggagcttaagtagt

SEQ ID NO: 6877528 - DNA, 84 bp, Homo sapiens
ccctttgtgagtgtttattcatggctaatgaaaaaaagagaaggactcttgggttttgtgttgccatgttaagcatggagaggg

SEQ ID NO: 6877529 - DNA, 59 bp, Homo sapiens
gaggaaggctaaggggcttagagtctggctaaggatttctgtccctctttgcttccctc

SEQ ID NO: 6877530 - DNA, 60 bp, Homo sapiens
tccttacctttaaggagatttgacaattcactttgtcttttagccttggggtagtcagga

SEQ ID NO: 6877531 - DNA, 126 bp, Homo sapiens
agacatcactttctgaatctgatttgattcataattcaactgatctattttgattttgcattttagaaaaacagcagagtgtagaaggagaaatggatcttaaatcaaagggtttcagatgaatct

SEQ ID NO: 6877532 - DNA, 95 bp, Homo sapiens
ctgagagcagaggtggtcggggaagcccggcctgcacatgggggccctcaggagccttccaggtgctggcctggcctctgaagcttgtggtccag

SEQ ID NO: 6877533 - DNA, 67 bp, Homo sapiens
gtgggaagaattgaggatgtttaccttggagaagcagaggctcagggtgtacatgctcagcttcagc

SEQ ID NO: 6877534 - DNA, 63 bp, Homo sapiens
gtgtgtgacagctgcttatgaaccaacggcacacctgctgctggctgcagtgctgtcaaatgc

SEQ ID NO: 6877535 - DNA, 81 bp, Homo sapiens
atcagctcgtacaatgcaggacagtcatgtggagcaggagaacaactggaatggcttctagcattgtcacaactagctggt

SEQ ID NO: 6877536 - DNA, 84 bp, Homo sapiens
gccttgctttcatggtttttcaaattcctaagctagctagtggaagatggctagtttgaagaaggatctatgaaataatagggt

SEQ ID NO: 6877537 - DNA, 91 bp, Homo sapiens
tttttgtgtttggaaagtctacatatctacatgtgtttctgtatgtgtatacagatacagatctagatacatgctttcatagacaagaaaa

SEQ ID NO: 6877538 - DNA, 59 bp, Homo sapiens
agtaaagtgaagatatactgttgtcctcataaggggaaatcaaagatctttactgtatt

SEQ ID NO: 6877539 - DNA, 62 bp, Homo sapiens
agtacaactccccaggcactgctagggcatggtatctgagccaagtgtctaggggagtgtct

SEQ ID NO: 6877540 - DNA, 59 bp, Homo sapiens
ctcaactaggcctgtgttctaaactggcagtgaatgattatccacaggtgtggtttgag

SEQ ID NO: 6877541 - DNA, 60 bp, Homo sapiens
gggccagttctccgcctcttttaactttactgccaaggcaggagaggggtggagtggcct

SEQ ID NO: 6877542 - DNA, 90 bp, Homo sapiens
ctcctaggattctttggtaaatgtcatgggaagtcactaggccaacaggatgatcagaactggtatttatcaaggagaaggctccagggg

SEQ ID NO: 6877543 - DNA, 85 bp, Homo sapiens
gagtaggagaaaggtatttagtgtgaaagctatgtaaaaagtctaacacatggttgttgctcaatacatgtccattctcctcctt

SEQ ID NO: 6877544 - DNA, 62 bp, Homo sapiens
ggtgctaggagggttatggcaagatctggcctcacagatgaagtcattatccttttggtttc

SEQ ID NO: 6877545 - DNA, 75 bp, Homo sapiens
gtttagtactaccatttcacagatgagaaaattgaggctttgaaagcctgaataatttgtgaaaagatacaaagc

SEQ ID NO: 6877546 - DNA, 79 bp, Homo sapiens
tagatgtgagaattcttagtacatagatgatggttgaatttcagaaaatgaaaagttagcctgtgtgtattaacatcta

SEQ ID NO: 6877547 - DNA, 55 bp, Homo sapiens
gtgccctgggaacacagatgccactgaaaaacttgtggtcaagttctcagagcat

SEQ ID NO: 6877548 - DNA, 69 bp, Homo sapiens
ctcctaagaattccatcgcagagtatttctggttttatacaaatattttgtgcagagtttgaattggag

SEQ ID NO: 6877549 - DNA, 58 bp, Homo sapiens
aagtattgtattgaacacatgtgagatgctaacatttaacatgtttagtgtagtgctt

SEQ ID NO: 6877550 - DNA, 60 bp, Homo sapiens
atctgtccaccttcccatttactgcagttgggagctgtgtgatttgggcatgtggcagat

SEQ ID NO: 6877551 - DNA, 70 bp, Homo sapiens
gttcttttctgtgagtcacactggcaaatgtgacatattatcagctggttttgaggcacatgataagaac

SEQ ID NO: 6877552 - DNA, 67 bp, Homo sapiens
tacttcagtaaccttgtgacaacacgaccctttattttgtgtgtttgagtcttataggattgaggtg

SEQ ID NO: 6877553 - DNA, 72 bp, Homo sapiens
gtgtcccactctggaggtgaagatccaagagcagggcggctctgcagggcgtggcctctgagggcaggacac

SEQ ID NO: 6877554 - DNA, 55 bp, Homo sapiens
aggcaactgtgacacctccctggggtccttttggtgccagggatttacagagcct

SEQ ID NO: 6877555 - DNA, 58 bp, Homo sapiens
ctctctggggttccagacgtgggtgctgctgtgcgcactctctccctactccggaggg

SEQ ID NO: 6877556 - DNA, 88 bp, Homo sapiens
gtttctttagccatgggtagagagtggatggagctgcgaagctgccaaaacagtattcaagtttccctcttggaacagctagaggagc

SEQ ID NO: 6877557 - DNA, 66 bp, Homo sapiens
cagtgttaaaggatctttgtcattaatatatttgtgtgaattaatgattcagctcttttctagctg

SEQ ID NO: 6877558 - DNA, 58 bp, Homo sapiens
tagggcagttataacattagtggaattataaatcccatgaatgttttcctctgttcta

SEQ ID NO: 6877559 - DNA, 74 bp, Homo sapiens
ctgacggcttcaaggcagctccgcaatcaatcaatatcttcttttgattgcatggagtaattgatgcttgttag

SEQ ID NO: 6877560 - DNA, 55 bp, Homo sapiens
tttaagcagagaaatgatgtatttgatatgcaggtacctctttcttctgtgtgag

SEQ ID NO: 6877561 - DNA, 57 bp, Homo sapiens
aacccattaatccttgcaagcacctctgtccatggtgctgattatgcaggttgggtt

SEQ ID NO: 6877562 - DNA, 71 bp, Homo sapiens
ggtagaaggttcatgtatatttatattgttaattcagatatactgtgttccatggaccatttctgtctacc

SEQ ID NO: 6877563 - DNA, 64 bp, Homo sapiens
gtatggcagcagtccattgcctcatccaggacacgctgcgtgagagccaggatctgctctatac

SEQ ID NO: 6877564 - DNA, 88 bp, Homo sapiens
gggggagaagttggacagtttgggaagggagagtggtctgctctgccacctcaatctttcctttctctggactgcagccacatccacc

SEQ ID NO: 6877565 - DNA, 129 bp, Homo sapiens
gggacgtggagcgaggagtggggctccaggctgctgaggctccggaccaagtgccccctgcactttcaacgccgtaggtctcccggcagccctggaaggacagtcttacccggacgccacggtggtctc

SEQ ID NO: 6877566 - DNA, 60 bp, Homo sapiens
ctcttccctactacaggatccaagcataggtcatgctggagctggtatagggacaaagag

SEQ ID NO: 6877567 - DNA, 125 bp, Homo sapiens
tatgcattttcagacacattcacttcagtgtcacattagattggtgcaaaaataattgtggcttttgccgttacttttgcaccaaactaatataacaccgaaggcaaattcctgagtttatcata

SEQ ID NO: 6877568 - DNA, 92 bp, Homo sapiens
agttgttcatctattcatggaagtggccatacagatagttatcctagagagatgataactagaatggctattttgaggaataagaagcatct

SEQ ID NO: 6877569 - DNA, 81 bp, Homo sapiens
cagggcaggactgggtgggcaagcgtggactgcatctgtcctgcatggggtcctgcgtctggctcgcccggtgccgtgctg

SEQ ID NO: 6877570 - DNA, 95 bp, Homo sapiens
aagtcctggcaggaaccagcagctgcgggccactgcccaggtactggcacgtggcgtaggtggctcccgctggcttgtttggctctgcagggctt

SEQ ID NO: 6877571 - DNA, 100 bp, Homo sapiens
ttggctgtttctccctagctaggctgggagcctgaggctaggggcttggtaccactggcaccagggtttccagccttgggtagctcaggagacggctcag

SEQ ID NO: 6877572 - DNA, 79 bp, Homo sapiens
gtgttcgtgtatgtctgataaaagtgacctttagccacttttatgtggtttatgtttttcagacgtcctacacagagac

SEQ ID NO: 6877573 - DNA, 64 bp, Homo sapiens
gagttacacagttggtaggggcagagccaggtgacaggcagtctgacccctgtgctgtggactc

SEQ ID NO: 6877574 - DNA, 56 bp, Homo sapiens
gtatgggctctcacccaactgtgtcggaactctgtgcactgaggtgcagctcatgc

SEQ ID NO: 6877575 - DNA, 55 bp, Homo sapiens
tacagagttttcctgccaagaattctggtgacagttgtcaggcaataaaattgta

SEQ ID NO: 6877576 - DNA, 58 bp, Homo sapiens
tcttaccaggagccctctgaggaactgtgtagaatgcacctcagaatattccctgaga

SEQ ID NO: 6877577 - DNA, 65 bp, Homo sapiens
cacttgcctacccttagaacgtgaattcgtctccacaaaagaacatggactgggagtggtaggtg

SEQ ID NO: 6877578 - DNA, 75 bp, Homo sapiens
atttctaacataattggccaaggaagtagcaacggacactttgccctgctttccttaggccgaacacctgggaat

SEQ ID NO: 6877579 - DNA, 64 bp, Homo sapiens
ggggcattgaatttgaaagagaataaaagagcctatacaatctttcaatccattcatatgtcct

SEQ ID NO: 6877580 - DNA, 87 bp, Homo sapiens
ccagctacatttgtgatactttcagtgctaagaaaatctatattctgtagctttgaagttatttaacagttaagtactatttgctgg

SEQ ID NO: 6877581 - DNA, 60 bp, Homo sapiens
aggactttatcttctagacctcatttagcatgaggatagagaaacacagataaatgtctt

SEQ ID NO: 6877582 - DNA, 74 bp, Homo sapiens
cagctcactggaccaaggaaactcttcaacacgtatctgataggtagaacatcttttttgggatccagaggctg

SEQ ID NO: 6877583 - DNA, 72 bp, Homo sapiens
tttgaaagagtgtgtgtgtgtgtgtgtgtgtgtgtgtgcgtgcatgcacagaataatatatgttcttataag

SEQ ID NO: 6877584 - DNA, 57 bp, Homo sapiens
tttgtgttttagctggtgaggctttaaacgttcaaccttgaaggctgtaagcacaga

SEQ ID NO: 6877585 - DNA, 78 bp, Homo sapiens
gggagcctgttgagagaagaacaatgtcattcaggattattttcctaatgagatacctcttgctgtcagaatgccctc

SEQ ID NO: 6877586 - DNA, 71 bp, Homo sapiens
agtggattaccaagaaatttcttaagaactaattttctatactggattagtgaagtttcttgtggtttatt

SEQ ID NO: 6877587 - DNA, 130 bp, Homo sapiens
atgcagccatacttctctagacagccccatgaatgaacatagagaggacattccagccacagtagggttgtgacttctttttgagttcaagaatgaatccatgcaagccaattagaaaaatggctcccat

SEQ ID NO: 6877588 - DNA, 56 bp, Homo sapiens
taatgcaggtgcccttgggtttcagagagaaatgcccccactggggctccacatta

SEQ ID NO: 6877589 - DNA, 70 bp, Homo sapiens
tctttggcatgcatatcctgaattgggttattgaatataaatctagccttgtacaatggatgccagatga

SEQ ID NO: 6877590 - DNA, 55 bp, Homo sapiens
cagagggcactcggagtgacattttctggggaagatcctcctggtgacttttctg

SEQ ID NO: 6877591 - DNA, 55 bp, Homo sapiens
gggccagccttctgagctgcctggaaggatctgtgggaattcagaaggctgttcc

SEQ ID NO: 6877592 - DNA, 99 bp, Homo sapiens
atgcctccatcttccccttccctttgttctgctgggacattacaatattcagtagtgacagcctcatgaggagcaaaagaatggagagattttttgtat

SEQ ID NO: 6877593 - DNA, 55 bp, Homo sapiens
tctgaggctaagagacagaggcctggaagaaggctctgtggtctctgttctcagg

SEQ ID NO: 6877594 - DNA, 58 bp, Homo sapiens
ctgcccccaggctgcatggctgggacagccgcactccacgcatcagccataggggcag

SEQ ID NO: 6877595 - DNA, 62 bp, Homo sapiens
gcctctgggatcagcagtagtgatgattttttacaaggtcagaaccagctggtgcccagggc

SEQ ID NO: 6877596 - DNA, 57 bp, Homo sapiens
cagctctgctgggaggatgcagaaataaatgatcagcgtcccggcgtgagagagctg

SEQ ID NO: 6877597 - DNA, 55 bp, Homo sapiens
gggtgcaagccaaagaagactgctgctgcattgcagtcccactgaggtatggccc

SEQ ID NO: 6877598 - DNA, 77 bp, Homo sapiens
ttctgtatcctcaacattcatatatagccacatccagtagaaataagtgtggctagtgatgaatattgtagattgaa

SEQ ID NO: 6877599 - DNA, 86 bp, Homo sapiens
ggagtcgcactctatcacccaggctggagtgcagtgacacgatctctgttcactgcaacctccgcctcccgggttcaagcgattcc

SEQ ID NO: 6877600 - DNA, 75 bp, Homo sapiens
tgagattctgctcaccctcagctgatgcctctgccaagctgggtggctcagctggtggagtgatacaaactctca

SEQ ID NO: 6877601 - DNA, 57 bp, Homo sapiens
ccacctcctggctcagtagatctggagtccctgggccttactgggccagcaggcagg

SEQ ID NO: 6877602 - DNA, 73 bp, Homo sapiens
ggtggcatctgtcaggcagaacccagaaggcacagctggccatgccctctcaggtgagcctgcagatggcatc

SEQ ID NO: 6877603 - DNA, 67 bp, Homo sapiens
tggtttatatgattcagttttggagttaaaagtaaattttctctgtcagcattgcgtcactgagcca

SEQ ID NO: 6877604 - DNA, 60 bp, Homo sapiens
atggatgagtccttgagacacagcttaaatggaaaagcattatgtcttgcattcatccat

SEQ ID NO: 6877605 - DNA, 79 bp, Homo sapiens
tttctgagtatgaagcagtaggagggacaactacctgaagcattaggagcttgatctgtttactgaaaccactttaaaa

SEQ ID NO: 6877606 - DNA, 81 bp, Homo sapiens
gtcaaaaggtcatgatagtttttaaattttgttttgcgcacctacgcttgataattttagtctgaaaattgtaattttgac

SEQ ID NO: 6877607 - DNA, 57 bp, Homo sapiens
gtcctgggtgtgatattcatagagggtaatggtgcctctggggaagacatctaggat

SEQ ID NO: 6877608 - DNA, 59 bp, Homo sapiens
ccttccaataaattgcttcttgaccaagctgagtcaaaatgagctttgttattgaaagg

SEQ ID NO: 6877609 - DNA, 86 bp, Homo sapiens
gtttgttaaagagatttccatattttgtaacagtgccccccttctcctgcccctgttatgataaattggctagtctctgtgaaggc

SEQ ID NO: 6877610 - DNA, 60 bp, Homo sapiens
caattcaaaccagtctgtctcttcttgtgcacaaggtgacagacagaaggctttgaattg

SEQ ID NO: 6877611 - DNA, 108 bp, Homo sapiens
ggggagatgatagagctgacagcccccagcccatcctgcctcagaggtgggagctacttccccagcctcctgctgaatggccaggagctgtgggggtcagctctcccc

SEQ ID NO: 6877612 - DNA, 56 bp, Homo sapiens
gctgcatgacagacaggcctggtcacagcaggttacgatgcactgtgtcatccggc

SEQ ID NO: 6877613 - DNA, 68 bp, Homo sapiens
agaccacaccagccactgacaacaagacacttactccttgcttcatggtgtcattggcgtggttggct

SEQ ID NO: 6877614 - DNA, 61 bp, Homo sapiens
agcggccaacgtcctgctgtctgagcactgcgaggtgaagctggtggactttggcatggct

SEQ ID NO: 6877615 - DNA, 57 bp, Homo sapiens
ccttttcccatgtttctggagccaagagcatatttactctaataatatggcaaaagg

SEQ ID NO: 6877616 - DNA, 73 bp, Homo sapiens
gctttggccagagcatgcactgcctgcagaatatagcctttaaaactgctggcagccatgccttggaatctgc

SEQ ID NO: 6877617 - DNA, 69 bp, Homo sapiens
gccacagagcaggcactcagcacacagagcagcagacatgctatgtgtttgacaccctgcaagactggc

SEQ ID NO: 6877618 - DNA, 85 bp, Homo sapiens
taggccaaagcttgggatatatatgacccatctgcatggtgctgtacatgtgcacatatactcatattccccattgctgggccta

SEQ ID NO: 6877619 - DNA, 86 bp, Homo sapiens
cctgagcaagagcaggatgagccgcgcaagctgacagccactgctgccgcccgcgcccaggctcggtctcgctcccagcgctcggg

SEQ ID NO: 6877620 - DNA, 55 bp, Homo sapiens
tggccctgactgatgtggagggagcacatgaaagcgactttcggatccaaggcca

SEQ ID NO: 6877621 - DNA, 62 bp, Homo sapiens
cagggctgtggaaaactggtgcttcctcaaaaagttaaatacagcatttccacgtggccctg

SEQ ID NO: 6877622 - DNA, 61 bp, Homo sapiens
cattttgcagtgaatatatcctgaaaatagaaaacagggtgaatgtaggcacatgcaaatg

SEQ ID NO: 6877623 - DNA, 100 bp, Homo sapiens
caggagaaatgtcctatcaaggccttctaccaaggctgggggcggtggctgacgactgcaatctcagcactttgggaggctgaggcgggacgatctcttg

SEQ ID NO: 6877624 - DNA, 113 bp, Homo sapiens
ggagtatgctggtttgaaactattgttttgaaggtcttcaacctgttagatcaattctccacctagcagcaaaatgaccttctaaatatataagtaggatcacagcacattcc

SEQ ID NO: 6877625 - DNA, 90 bp, Homo sapiens
ctcattaaaatgaaaattctcaggctcaccccggaactacccaatcaaaaactctctgggtagagcctagcagttttgaattttaacaag

SEQ ID NO: 6877626 - DNA, 68 bp, Homo sapiens
ggtagcttcctagagtcctgtgtgctctgtggtacggcaacccaggaattcagggctcaagggcagcc

SEQ ID NO: 6877627 - DNA, 56 bp, Homo sapiens
tttctagggcaatgactcaaagcgggcctcttgctagatggagtcagttcaagaga

SEQ ID NO: 6877628 - DNA, 64 bp, Homo sapiens
gaggagaccctggagcaataatccctggaaataacaggaatttcaggggcaaatccagatcctc

SEQ ID NO: 6877629 - DNA, 57 bp, Homo sapiens
tgttcatggatccagtggcttcatgtatatctggtagctacaacttttccatgagca

SEQ ID NO: 6877630 - DNA, 129 bp, Homo sapiens
aaattttaattaaggagaagtattgtaaaacagaacagaatagattatacttgaagcatttggtatttttggtgtataatttattgaatgggctgtaataatttagaatatttctgcccgtggtttttt

SEQ ID NO: 6877631 - DNA, 77 bp, Homo sapiens
tttcaaaggaaattttggaatcttgggaagctcagtgaggtggcaaattcctcagaatcagaaaaccaactttggaa

SEQ ID NO: 6877632 - DNA, 97 bp, Homo sapiens
ggagttctgttgtgtttgatgctgacacgcacccaggcataattctttctgctagactgccccctgctgtctgcaacagtactacaactagaattct

SEQ ID NO: 6877633 - DNA, 98 bp, Homo sapiens
gtactgattttctgccttagaagtgagtgtgtgaatgtttccctggcgttagcttctgagcatgcacatgactggcttaattagaggagaagaagtgc

SEQ ID NO: 6877634 - DNA, 57 bp, Homo sapiens
gtacgtgttgtggactgagtaaggaagaagcatccaggctgaagaagtagcatgtac

SEQ ID NO: 6877635 - DNA, 76 bp, Homo sapiens
ttgcttgagcccaggaggttgaggctgcagtgagccatgatcatgccactgcactccagcccgggcaacagagcaa

SEQ ID NO: 6877636 - DNA, 67 bp, Homo sapiens
tccaaagtattaaatcttagcaactgatgaagtaaaaagctatttttgctaaggtttaactattgga

SEQ ID NO: 6877637 - DNA, 65 bp, Homo sapiens
ttggtggcaattaagtttatcagaggttgtgagatcaagagcagccatatttacattgtcaccga

SEQ ID NO: 6877638 - DNA, 75 bp, Homo sapiens
tttgcagagcaaagtgtggtggaggaggaggctggcagggcctgtctccacagtcccacctcgctttcctgcaga

SEQ ID NO: 6877639 - DNA, 58 bp, Homo sapiens
ggatttctagtaagtcatgaaggcttaatgctgtgtctttgtgaaaggactgaagtct

SEQ ID NO: 6877640 - DNA, 70 bp, Homo sapiens
aacattaatcagagttatttgtgctgcttcgcaggtgtctagctgccttaaattactttgtgaaaatgtt

SEQ ID NO: 6877641 - DNA, 85 bp, Homo sapiens
tcttctaactttagggtgtttctgtctactcagccatttaaaactcttatgttggttagtgataggactttaaagcctttataga

SEQ ID NO: 6877642 - DNA, 55 bp, Homo sapiens
agggcaagttgagtgtgcgtgggcatgaaggattcactgtacgcatcccagccct

SEQ ID NO: 6877643 - DNA, 59 bp, Homo sapiens
atgtaactgtgttaattattacgatgcttactatatcgtggtcagtatttcagttacat

SEQ ID NO: 6877644 - DNA, 64 bp, Homo sapiens
ttattctgaactagactctcatcgctctcccatctcagaaaatgtccagtttacttcaggatga

SEQ ID NO: 6877645 - DNA, 60 bp, Homo sapiens
ggtacaattctggggtatgctctacacagtccctaagaacgtcctcaacaggattgcacc

SEQ ID NO: 6877646 - DNA, 63 bp, Homo sapiens
gactggtagttcctattggaatgaaaggatcataaatccattcatgccaaactgaacacagtt

SEQ ID NO: 6877647 - DNA, 55 bp, Homo sapiens
gggtaattggggccttgcagtgcagtgtctgccactgtgggagctttaggtactc

SEQ ID NO: 6877648 - DNA, 67 bp, Homo sapiens
ggcaggtggatcacttgaggtcagcagtttgagaccagcctgaccatcatggtgaaaccccatctct

SEQ ID NO: 6877649 - DNA, 69 bp, Homo sapiens
aggaatgcagattcctaggccacacccccagatataaatctggaacaaagcttaggaatttgcaatttt

SEQ ID NO: 6877650 - DNA, 69 bp, Homo sapiens
aagtgattcattgatgatgaggtgccattatttttgaaacctgcacttgagtcgacgtatgaattactt

SEQ ID NO: 6877651 - DNA, 68 bp, Homo sapiens
cctttccctaagcatttcaaacacagtactgggaactagtggcgagtgcagcagatgcagggacttgg

SEQ ID NO: 6877652 - DNA, 61 bp, Homo sapiens
aggagattagactggcagcttttgttcctaataataaaggaaattccatgtctaattccct

SEQ ID NO: 6877653 - DNA, 61 bp, Homo sapiens
gtgtcagtggttcagggccgggggtctccccaaccacggccccggcacctccgctgcacac

SEQ ID NO: 6877654 - DNA, 71 bp, Homo sapiens
gtcgcccaggctggagtgcaagcagcaagatcatagctcattgcagccttgacctccagtgctcaagtgat

SEQ ID NO: 6877655 - DNA, 55 bp, Homo sapiens
cttgccttcccactactggtgtccaggagtcactagtctgccagggagaggcagg

SEQ ID NO: 6877656 - DNA, 94 bp, Homo sapiens
ctgcatgcaaacctcaggtggggtgtgggagtgaagagtaacaggtgtaattaacctgcccacacttccttcccaagtctagctgttgcagcag

SEQ ID NO: 6877657 - DNA, 84 bp, Homo sapiens
tctgccttctattttcatgcctgggtctggggtctctgaggagggggaaggggacagaggatgtggcataagagtgaacacaga

SEQ ID NO: 6877658 - DNA, 58 bp, Homo sapiens
gctttccatgtggcttgggcttcctcacaacatggtggcctagggcaagtgggtgggc

SEQ ID NO: 6877659 - DNA, 58 bp, Homo sapiens
gccagggttgccaatgggggcagggccgcggaaggagctgtttgtgtggggccttggc

SEQ ID NO: 6877660 - DNA, 61 bp, Homo sapiens
gggaagccatgctcagaggtacatctctatgctctttctacctctagtaataaagtttccc

SEQ ID NO: 6877661 - DNA, 71 bp, Homo sapiens
gtgcccacctggggcctctgagtctccccagccaggtggccctgaggctccccatgaggccccagctgcat

SEQ ID NO: 6877662 - DNA, 63 bp, Homo sapiens
ctcatgagccactggcaaatgaaatgatgagttatttcaccatgtaaaccatgtggctgtgag

SEQ ID NO: 6877663 - DNA, 55 bp, Homo sapiens
gtctcctgctagcaagcaccacgtaggaatgaacccagggttgtaagcaggagat

SEQ ID NO: 6877664 - DNA, 55 bp, Homo sapiens
gccagaaatgcaaattccagggcccccttggaacttcagaatcagcatatctggc

SEQ ID NO: 6877665 - DNA, 56 bp, Homo sapiens
cagttctttcacttgttcagtcctttcgctagcggggaagagcagggaaagaattg

SEQ ID NO: 6877666 - DNA, 67 bp, Homo sapiens
gatatttcagatgaccaaatggaaaaaagcactaaagcaattttctagcaaatgtatctgaaatatt

SEQ ID NO: 6877667 - DNA, 57 bp, Homo sapiens
gggaccagctggtgaaaaccaattgttaaatagacaggaattttacaagctggttgc

SEQ ID NO: 6877668 - DNA, 127 bp, Homo sapiens
gagtatatgtggctggttttactttatgttctaaggctcagagtagttaattctggctttctctagttgcccaggattgtatacctaagtgttagaggtaggatttgaatccaggaatatttaactc

SEQ ID NO: 6877669 - DNA, 67 bp, Homo sapiens
tttactgaggtataattgacataacattcgcttgttttaggtgtgcagttaaattattttcagtaaa

SEQ ID NO: 6877670 - DNA, 71 bp, Homo sapiens
tgagtacctctctcttctttgcttctgccctttttttctggcaaagatattagaatagagtagaaacatca

SEQ ID NO: 6877671 - DNA, 112 bp, Homo sapiens
ccctgctatttattaattttcattggactttgtaggaaaaagtcacaagcaacatcagaatgttttgaactcttagcagaggaccgagtggaatgtgaagtaaactgaaggg

SEQ ID NO: 6877672 - DNA, 55 bp, Homo sapiens
cacagccctgcagcacctgcccttcccatggtgaggggtggagttgcggtctgtg

SEQ ID NO: 6877673 - DNA, 57 bp, Homo sapiens
aaattgctacaggtgtctagtagctactgtgttggatagcacagctgtagacagttt

SEQ ID NO: 6877674 - DNA, 60 bp, Homo sapiens
ctgtgccagagggtgaccaagggatgttcagggactgattggcacccacttttggctcag

SEQ ID NO: 6877675 - DNA, 64 bp, Homo sapiens
cagcaagtctctaagagttcataatgctattccgctgggaagtgacttactctagagaatgctg

SEQ ID NO: 6877676 - DNA, 84 bp, Homo sapiens
tcatgcaattgtctctttattcaggcaaatggtttcatttctctcttctttcctctccttagtgaaacagaggcaatttattga

SEQ ID NO: 6877677 - DNA, 69 bp, Homo sapiens
cccttaccctttcctggctggcagttgtggtgtggctgactaccacctaaggcgcccaggaaagaaggg

SEQ ID NO: 6877678 - DNA, 78 bp, Homo sapiens
atgggtggccaatgtgagctgtcatctaggacctcagataaggcctgtggccagaacagcctatagtggcctttccat

SEQ ID NO: 6877679 - DNA, 71 bp, Homo sapiens
tccacataatagggccaatcctcttgtgtaatctagttggtagaaaaaatgaggtggcccattatagtgga

SEQ ID NO: 6877680 - DNA, 101 bp, Homo sapiens
gccttccccaaggccctctgacgatctgagcatctagcttgcatcacgggggccaggcaggctgtgaggctcagatgggctgggggtcctgcggacaaggc

SEQ ID NO: 6877681 - DNA, 67 bp, Homo sapiens
ggactggccaggcagcagtagctttcccctgctggggatccgggccctgggctgccttgggcattcc

SEQ ID NO: 6877682 - DNA, 94 bp, Homo sapiens
aggtcacaggggaaggaagttgcagagtaagatttgaactgaagcaatcagccttcagtgtcccgtctcttaactctttctctctatttaacct

SEQ ID NO: 6877683 - DNA, 119 bp, Homo sapiens
gcagggccaagaccagagtgaggcaggagccagcctgcctttgtatgaccctgagagtgatgcctccttcaattttgcactgaggcacgtcacctgcctcaccctagtcccagccctgc

SEQ ID NO: 6877684 - DNA, 87 bp, Homo sapiens
gatgtttctccttatgtataaatgtgtgtgcacgtgtacatatatgagcatatgtatactaacacatgcagttgtgcaagaaatgtc

SEQ ID NO: 6877685 - DNA, 129 bp, Homo sapiens
gtcatcatcatcattttgccacatgctaaaataaatcatagcaatggtggtatttggagaactagttaaatgctaatttcataaatggtatccttgctgtgctgatatttctgcagttgacattgatac

SEQ ID NO: 6877686 - DNA, 57 bp, Homo sapiens
acaagtattggtgaggatgtaggatgtagagaaatcagagttcccaccattgcttgt

SEQ ID NO: 6877687 - DNA, 68 bp, Homo sapiens
ctgggcagcagcaaagccagactcgaggcacctagacctgagtttggagcactgttagctgaatccag

SEQ ID NO: 6877688 - DNA, 58 bp, Homo sapiens
ctggtggcttctaagggctccccacaactttaatgtggtggcttgtggtggccaccag

SEQ ID NO: 6877689 - DNA, 70 bp, Homo sapiens
gacttcaagtgtacatgaacacatgacagtagaacaaatctgtgtccgggtgttctgtgcacttttcgtc

SEQ ID NO: 6877690 - DNA, 80 bp, Homo sapiens
atggcatgggataactcagctgtctgcttagggcatggctttaaagtcagatatctgggttgaaatcctctttctgccat

SEQ ID NO: 6877691 - DNA, 61 bp, Homo sapiens
ttggcagcccagcttactagcagctcttctgtcttcagagtgcagtgaggggagctgtcag

SEQ ID NO: 6877692 - DNA, 57 bp, Homo sapiens
tggacatgtccggccagacaatgggacagaaggaaatgtgtcagctggacatgttca

SEQ ID NO: 6877693 - DNA, 80 bp, Homo sapiens
tgttttgcagtcacagtgacaggaacatgagcacacagcattaggtatgctcatgtccctattactgtgaccacataaca

SEQ ID NO: 6877694 - DNA, 71 bp, Homo sapiens
tgcaactcctaagatgtggggacagagcccagaacaaagtagggtagactgttatattctagggagctgca

SEQ ID NO: 6877695 - DNA, 57 bp, Homo sapiens
gcgtttcttgtctgccctgcaggcagaatgaactgtgagtgggttatcaggaaaggt

SEQ ID NO: 6877696 - DNA, 73 bp, Homo sapiens
gttgttttgcttaattaaatagacatacattagggcatgtatactatacatgctcagtctaaagaagaataac

SEQ ID NO: 6877697 - DNA, 58 bp, Homo sapiens
ctaccttggggttttgttgctctgtaggagctcgctggagtcactttcccgggagtgg

SEQ ID NO: 6877698 - DNA, 55 bp, Homo sapiens
cctgctggacaggggtgttcatcagctgacgcggggatgcttgtgaccaggcggg

SEQ ID NO: 6877699 - DNA, 65 bp, Homo sapiens
gcccactctgattttggctccactgaagagtagaagaatcagtcatggaggatgattcagagagc

SEQ ID NO: 6877700 - DNA, 58 bp, Homo sapiens
ggaggctggggcagctggcgtgcccagaggacgtgttcgaacagctctgcagacttcc

SEQ ID NO: 6877701 - DNA, 126 bp, Homo sapiens
cagcacactgaagtcctgagccctccgccacccgcaaggccttcctcggagacagggacctatccagagatgtctctgtcactgtcaggatgcgctgcaagtggacaaagggtttccttcgtgttg

SEQ ID NO: 6877702 - DNA, 67 bp, Homo sapiens
gcccagagaatgaaacccaccagactttttccatctacaaagaagctgaatgtaatgttctttgggt

SEQ ID NO: 6877703 - DNA, 70 bp, Homo sapiens
tcacaatgaacaagaaagactttgagctgtccttccacacggctctggagttcccttgatctgacggtga

SEQ ID NO: 6877704 - DNA, 87 bp, Homo sapiens
ctggaggtaggtctactatcagggacatttagacactgatggtctttactatctgtggatatgaccttcctggtggactttctcagg

SEQ ID NO: 6877705 - DNA, 123 bp, Homo sapiens
gaaaggggaatgatcgtgtacatttttataaaagcaagcagtgtggaattttagaataccacttttaatctttaaacttttccataactcttgagtgaacaatgtcataactcaaattctttc

SEQ ID NO: 6877706 - DNA, 71 bp, Homo sapiens
ggttatggggatgggatatggtaggtagaataatgccctcccaaaatgtgcatgttcgaatccccagaacc

SEQ ID NO: 6877707 - DNA, 58 bp, Homo sapiens
cagaggcccctggggttgtactggcttgggaggctggcagctgcaggcaggcttgctg

SEQ ID NO: 6877708 - DNA, 61 bp, Homo sapiens
gcttatttccactccagaactgaatatgcagagcattgccagtcctgctagtgtgaaaagc

SEQ ID NO: 6877709 - DNA, 75 bp, Homo sapiens
gtcccaggtcatcactgagagcagatcccacgcgcccgagctgccgcggtgaagatgcctcaggtgacccgagac

SEQ ID NO: 6877710 - DNA, 89 bp, Homo sapiens
acatcactgagctttagttttctcatctatctcacctaggaaatgggtgtaatcattgagaagatttgaagagagactgcatgtgaagt

SEQ ID NO: 6877711 - DNA, 92 bp, Homo sapiens
agtaaaactgtattacagaaacaggtggcaggctagatttagcccacaggccatagttttctgacccctgctctataatattacttttaact

SEQ ID NO: 6877712 - DNA, 70 bp, Homo sapiens
ggtagccgtacttcctggaagtggggcagatatggcctacattgtgataggaagtcacctccaggctacc

SEQ ID NO: 6877713 - DNA, 64 bp, Homo sapiens
ctgtaggtgattgctatgttatgtgctgcttcagtgcacttcagttcctggtagtcacttagag

SEQ ID NO: 6877714 - DNA, 63 bp, Homo sapiens
tggggtccatccccagggggctgctccttggatctggagctggccactggaggtggcacccca

SEQ ID NO: 6877715 - DNA, 65 bp, Homo sapiens
atgtgattttaagagatgcacctcttaaaattgtgtcttaagagatgcatctcttaaaattgcat

SEQ ID NO: 6877716 - DNA, 80 bp, Homo sapiens
tcctgacactcagtttccttgtttacctactggagtatatactacctattttagataggtgattaggaaaagcctcatga

SEQ ID NO: 6877717 - DNA, 66 bp, Homo sapiens
ttggagatggtctccagagcataattcacagccacttgtggcagcagccatggaaggcccttccaa

SEQ ID NO: 6877718 - DNA, 89 bp, Homo sapiens
gtgaaggtcagctggctggtcagtgcacaacggctgtgagacccacctctcattttctattgtgggctgagtcatgtcactaaagtcac

SEQ ID NO: 6877719 - DNA, 61 bp, Homo sapiens
atgagccctttgctattctaatatctcacaacaagacatctcaagaggaagcagggctcat

SEQ ID NO: 6877720 - DNA, 55 bp, Homo sapiens
cagggattgtgcttgcaatcgcagagtggttgcaaatgggcaaagcagatccctg

SEQ ID NO: 6877721 - DNA, 61 bp, Homo sapiens
gggtatctcagaggctcatctgccttgcaggttcattgcaggcaaatgagtatctgtgtcc

SEQ ID NO: 6877722 - DNA, 82 bp, Homo sapiens
tctggaaggaggtttaggattatagagctgtcattgctgcctgaaggacaccatgggagttgggtaaggatcattcttctga

SEQ ID NO: 6877723 - DNA, 65 bp, Homo sapiens
ctcttggagtcaataagatctagacatgagattaaacatgtagattgctaatattactttaaggg

SEQ ID NO: 6877724 - DNA, 65 bp, Homo sapiens
aatttacatttctagagctcacttttgggttgtttccaaaacagcttgtttcaggaaagtgaatt

SEQ ID NO: 6877725 - DNA, 60 bp, Homo sapiens
ggaggcaggcaagttcatatgaggaaggtaattaagttcccattgattgtgcctgtcttc

SEQ ID NO: 6877726 - DNA, 62 bp, Homo sapiens
cgtgatacttggcactgcaaccacagtcttgtgaacctgtgggagcagcaccaaggaccacg

SEQ ID NO: 6877727 - DNA, 55 bp, Homo sapiens
ctctgcagaggcccaaggctgagacatgcaagtttccttgctggccctgctggag

SEQ ID NO: 6877728 - DNA, 88 bp, Homo sapiens
ggttcttgcaataaggaaaattggagaaattggattcccgaaatgggttctgaagatttccaccaaatcacatttttttacaggaacc

SEQ ID NO: 6877729 - DNA, 86 bp, Homo sapiens
agtatgttaagaaacaaagccagggaagttatgggggccaggttatatggtgccttgatgctggcttctgttttgagtgagatatt

SEQ ID NO: 6877730 - DNA, 75 bp, Homo sapiens
gattataggtctgatctgtcagtcatgaaggtttataacaaatagtatagattgaagcagatcaagcatgaagtc

SEQ ID NO: 6877731 - DNA, 55 bp, Homo sapiens
gggggcatcatctgagctcggttgtccctcagcagcctgggccagagctgtcctc

SEQ ID NO: 6877732 - DNA, 83 bp, Homo sapiens
caaaatcaggatctacattgacctttgttaggttgaaatgatggctcaaatctaccaacatacggtcagtagtcttgatcttg

SEQ ID NO: 6877733 - DNA, 79 bp, Homo sapiens
catcttgcctgctattctgttgttcaccatactctcccccacacttaatggtgtctggtgcacagtagcagtgcaaatg

SEQ ID NO: 6877734 - DNA, 129 bp, Homo sapiens
caattcttataattatatgggtcacctggaccattttggtctgggcaaatccttctgatctgtagtcagctggtggtttggctggggctgggtgatctaggatggcctcactcatatgtctggtaattg

SEQ ID NO: 6877735 - DNA, 57 bp, Homo sapiens
gggtccgctcaagaagcaggaggtggattcagccccacagcttcccaaagtggacct

SEQ ID NO: 6877736 - DNA, 85 bp, Homo sapiens
cctgggcagcgacgggggatgtgtgaggtttagagctaagaggagtgctctcctttcactaaatattcttaagtctctgtccagg

SEQ ID NO: 6877737 - DNA, 59 bp, Homo sapiens
gcatgctggaatattttatttggtggctggatgtgctatgatgaaattttctatcatgt

SEQ ID NO: 6877738 - DNA, 62 bp, Homo sapiens
tggcagctccgggtaggggctgaattagggtggccagccctcctttacccagctggctgcca

SEQ ID NO: 6877739 - DNA, 55 bp, Homo sapiens
ggggtgtttcattgcatcgtgtccgtgctggctgactgatggaatttgacattcc

SEQ ID NO: 6877740 - DNA, 130 bp, Homo sapiens
gttttagtaaataatacttatcgtttatcaagtgcttactaagggctaggcacagggctgagtgtttcatggatattttaatctccagtccttgctatgaccctgagtgaagtgtgttattatctccaat

SEQ ID NO: 6877741 - DNA, 117 bp, Homo sapiens
tgtccactgcttttagggaagaggccttggcaagtggaatgctcttcctcccttggacttgatagggaggaggaatgttttgtgtagcaacttccctctctccctttggggtgggca

SEQ ID NO: 6877742 - DNA, 72 bp, Homo sapiens
gggatgcacgctgtggaagggacactggactggagtcacatctcagccctgccctttcccattgtgcgacct

SEQ ID NO: 6877743 - DNA, 77 bp, Homo sapiens
agtcttccttgcccaccatccaataaaatggacaaatgttcaccattttgctgcattgattggtggcgagtcaggtt

SEQ ID NO: 6877744 - DNA, 119 bp, Homo sapiens
actggggggtgcacatgtggcacctgcaatgcagggttcctccagttcctagagccataaacacctgagctattaggaaggtggaggcattcaggaccaaacatttcctccaccccagt

SEQ ID NO: 6877745 - DNA, 72 bp, Homo sapiens
aggcaaaataatggtcattggtggttattggatagtaattcattaatgcataatcaccattaataattgtct

SEQ ID NO: 6877746 - DNA, 81 bp, Homo sapiens
gaccctgggatcagccaggcccgttcccttctccagccagagaactggaggctggagaaggggagaggccttccccaggtc

SEQ ID NO: 6877747 - DNA, 74 bp, Homo sapiens
tcagcttagttgatagccaaaatttatcgctctgttcttaatgagcgactattggcttctcaggtttttgctga

SEQ ID NO: 6877748 - DNA, 82 bp, Homo sapiens
ctgagagtgagggttgtgtggactgattccagttcttgatgtagtcacataaaggcacggagttgttatggaaaccctccag

SEQ ID NO: 6877749 - DNA, 80 bp, Homo sapiens
aataattttactcaagtatgcatttatggttggaaatggttagctaattataaatgagctgctggagcattaaaactatt

SEQ ID NO: 6877750 - DNA, 55 bp, Homo sapiens
ggacaggcctggcacagtactgatttccctttaaacagcctgggcagccttgtct

SEQ ID NO: 6877751 - DNA, 98 bp, Homo sapiens
atcctttttgctctatttgaataattttgagagcctggaaaatctggacatattttctgaaggttaaggaattaggaaagcaaaagagaatctgggat

SEQ ID NO: 6877752 - DNA, 76 bp, Homo sapiens
gccaaggagctgaagtctctgcactctgccttctgtctggccactgggtgtcactcttcatctatgttcctttggt

SEQ ID NO: 6877753 - DNA, 59 bp, Homo sapiens
tgtgaatcactctggccactgctaaaggctagtgtcatagcctgctcaggtggttcaca

SEQ ID NO: 6877754 - DNA, 91 bp, Homo sapiens
ggagagctctgtgaagttggccaagggcatgctttgagaatgatagatttaacgtttgctttctttggcctggacgtttcccagagtctcc

SEQ ID NO: 6877755 - DNA, 58 bp, Homo sapiens
gtatgtacctagatgcaaatcctgaatatcatgtcgcaattagtgcatctggacatgc

SEQ ID NO: 6877756 - DNA, 122 bp, Homo sapiens
agtgaagggaaaaaggctctggaaccttggatgtcagttccacgagagataaatttatagttttaacaatctgtcttttataactgacatataaggtcccagaggtcttttttcctatcact

SEQ ID NO: 6877757 - DNA, 88 bp, Homo sapiens
tatgtgtgtgtgctgagcaggagaatatgggctactgtcttttaaaacagagtcatagtttaacttttgttatacacacacacacata

SEQ ID NO: 6877758 - DNA, 66 bp, Homo sapiens
cattagtgtacatattgagtctgctgacaatcttcggtgtcagggatgacagtatatgccttgatg

SEQ ID NO: 6877759 - DNA, 104 bp, Homo sapiens
cctgcacagggtgactcaccgccccgcttgccaggactaaagcgtccccaggatgttgggaaggccgcaggcacacctggatgtggtggtcacctgagcccagg

SEQ ID NO: 6877760 - DNA, 94 bp, Homo sapiens
gttacactggtgtgttgggtgtttcctgatgaatatctctgaagacaatggagaaatgacacacatgagacatttccagcagacctgagttaac

SEQ ID NO: 6877761 - DNA, 60 bp, Homo sapiens
gaggaacagcagccacatgtccactcacagactctctctggcacttggctgctgcttctc

SEQ ID NO: 6877762 - DNA, 68 bp, Homo sapiens
agtgaagccaggagagcaaaggtcactctggtttccaagtggtttgcccagcttttcggcttttcact

SEQ ID NO: 6877763 - DNA, 64 bp, Homo sapiens
gagagtttaggagacaggtagagaggaggaaattccagacccatttatctgtttcctgcttgtc

SEQ ID NO: 6877764 - DNA, 71 bp, Homo sapiens
attgtaagcagttactagttaaatgcatgttttggtcttttacatgctgtttgttagaattgttcatcaat

SEQ ID NO: 6877765 - DNA, 56 bp, Homo sapiens
aacaggacatttcagaagcaggtatgatggtcttggataactgaaaagtctctgtt

SEQ ID NO: 6877766 - DNA, 56 bp, Homo sapiens
cccgggaggaggaagttgcagtgagtgaagatcatgccactgcactccagcctggg

SEQ ID NO: 6877767 - DNA, 77 bp, Homo sapiens
ggataggatagtgggtaagaacatgggctatagagttaagtagacttgggttcaaattttggctgtactgcttattc

SEQ ID NO: 6877768 - DNA, 88 bp, Homo sapiens
tatgaaacttaaaatacatatggtaattcttgaaaagtgtttcacacagtgctttgcaaacgattaccacatgataaagtgtttcatg

SEQ ID NO: 6877769 - DNA, 64 bp, Homo sapiens
taggaaccttagtgattattagctgtgcttacaacttcgagtgggcaagctcattctcttccta

SEQ ID NO: 6877770 - DNA, 59 bp, Homo sapiens
aggaacatctcagtcaaacccagcactgtgaggtgttggcaggaaatgagaatgttcct

SEQ ID NO: 6877771 - DNA, 57 bp, Homo sapiens
ctgcagaatagaaatggcacagagacctgctgctgtgctggagagctagttctgcag

SEQ ID NO: 6877772 - DNA, 56 bp, Homo sapiens
ttctttgatggacagatgatggatttatgtcctatccagaatgctgtaatcaagaa

SEQ ID NO: 6877773 - DNA, 122 bp, Homo sapiens
tgggttaaatcttgtgtagaatgcatgtgctagtcaggttttatggactttctctgcatttgtattgttattcagagctgaaaaagctgacccgggactgcagactactaagttgtggccca

SEQ ID NO: 6877774 - DNA, 68 bp, Homo sapiens
gagatgaatatgtacacatctgtcaacgtctacctaagtgtagacctgaaatgtgtccatgttatttc

SEQ ID NO: 6877775 - DNA, 59 bp, Homo sapiens
cactgaactggtcttaggaggtgaatgttagagaaacatgtcttttgtctagctcagtg

SEQ ID NO: 6877776 - DNA, 59 bp, Homo sapiens
gttccagggaagggaaggcagagttgatcaaaagagaccctgttcctgtcccatgaagc

SEQ ID NO: 6877777 - DNA, 99 bp, Homo sapiens
gcctcctaaatgctttgacctggatatgcaccacatcacttctgctcacaacccattggtgagaaccagtcatgtgggcacacctggaggcaaaggggc

SEQ ID NO: 6877778 - DNA, 64 bp, Homo sapiens
atgcagcagccccttgaggtgctaatctttttttaatatcttggcgctccagtcgctggtgtgt

SEQ ID NO: 6877779 - DNA, 80 bp, Homo sapiens
ttcctagggcttaaagttttctagaataagtttttcatagcaaaggatttgtttgcccacaactattaagccacagagaa

SEQ ID NO: 6877780 - DNA, 111 bp, Homo sapiens
tagaggcttttcttaatgtattcacctggtgtgttcagttatttctgaagatatagaaatgtttgatgaaatgaatgaagatacagaatgtagattcagtatcaagctcta

SEQ ID NO: 6877781 - DNA, 83 bp, Homo sapiens
gtgactatctgaggcaggaagctatcagttgtgtaaataaccctttgcacctgattgatttcactgctccagatataggtcac

SEQ ID NO: 6877782 - DNA, 81 bp, Homo sapiens
gcagagtttaattgtggctggatttgagaagcattgggcagtccttaaagttttcctgtccaggcctcagcctaaacctgt

SEQ ID NO: 6877783 - DNA, 58 bp, Homo sapiens
cacacatatgagacgtttgtttgctttcaaagtgaaaaagtgaacattcatatgagtg

SEQ ID NO: 6877784 - DNA, 66 bp, Homo sapiens
gaaagtgtagagtgcctcaaaatacgcaattttccttgaatgttattatggagtacctgcattttt

SEQ ID NO: 6877785 - DNA, 73 bp, Homo sapiens
gccggcagacgggcccatggacacccaagtgccagcactgctgtcctccaggtctccggggcagtctgtgggc

SEQ ID NO: 6877786 - DNA, 62 bp, Homo sapiens
accaaatgtttttccagaaatggccaaagagtaaatatttctggttttatgggccatttggt

SEQ ID NO: 6877787 - DNA, 55 bp, Homo sapiens
gtgagtgatttagtgttccaattgttaaattaattgccaggatgctgaagcttac

SEQ ID NO: 6877788 - DNA, 58 bp, Homo sapiens
ccacttcacatacttatgataaataattgctgttcgtagccactaagttgtggagtgg

SEQ ID NO: 6877789 - DNA, 58 bp, Homo sapiens
ggtgtccgcgctgtagaaggtcagcatctgcttggtgatcagggatgggttggacacc

SEQ ID NO: 6877790 - DNA, 65 bp, Homo sapiens
ggcgaggaaatagacactttctatgaattaaaaatgggttcatgattctgtttttttcacttgcc

SEQ ID NO: 6877791 - DNA, 70 bp, Homo sapiens
tcaggccacacatgcataaggataattactggaaaacatctatgattatttttacagtatgaatttctgg

SEQ ID NO: 6877792 - DNA, 93 bp, Homo sapiens
caccccaggccccgcaggctgcagccaagaagagccactcaccccaggagggcctctgggaagggctgagcactgccaagggtcattgaggtg

SEQ ID NO: 6877793 - DNA, 58 bp, Homo sapiens
gttccaggcaaaggaagcagcttgtggaaaatcacaaaggcatgaaccagcttggcac

SEQ ID NO: 6877794 - DNA, 67 bp, Homo sapiens
ccccagcttcctgcatccgccttggtccaggcagcaatgcggaaggcggacgccagggggtcggagg

SEQ ID NO: 6877795 - DNA, 81 bp, Homo sapiens
cccaacacctattttactgatgatctggaggggctggcatggtagccattttgatctctgtcatgtgtaatagcctctggg

SEQ ID NO: 6877796 - DNA, 65 bp, Homo sapiens
agttgaagcttggtgggaaatggaactcctgtgtgaggaccattgaacccctctaggccacacct

SEQ ID NO: 6877797 - DNA, 59 bp, Homo sapiens
attgcctagttcagagtaatttctaggtcagtgaaccctaatgtttctgaacaggtagt

SEQ ID NO: 6877798 - DNA, 64 bp, Homo sapiens
acaactctcagttaaataaagagcaagattagaagagctaatttactgtttgcttgagagtagt

SEQ ID NO: 6877799 - DNA, 129 bp, Homo sapiens
tcaagacatctctggacctaccactttgggtaggcatggagggaaaggctggcgttttacaggtgccaaagatagcttcaggctttgggaatgccacttgtagaccaaggtggtggcagaatgtccaga

SEQ ID NO: 6877800 - DNA, 58 bp, Homo sapiens
ccctggcctgaggctcggcatgggtcagctgtggccgtggagcctcttggccgtaggg

SEQ ID NO: 6877801 - DNA, 81 bp, Homo sapiens
gtcgctgtagggcaggctgaaggggtagaggggtctgtaacgtgagtcctgccagagcagcttgtcctccaggaaggcgac

SEQ ID NO: 6877802 - DNA, 60 bp, Homo sapiens
aagctagggctccttcccactctgccaacattgtaggagtgctggagaagcttctggctt

SEQ ID NO: 6877803 - DNA, 77 bp, Homo sapiens
ttctcgtttatgtgatgcatcccagaaaaatgacatgaccataacatttttgagaattgtatcatataagatgggga

SEQ ID NO: 6877804 - DNA, 70 bp, Homo sapiens
ctaccctttggaggcagctgggctggtggtttgggctagccaggcttcccaagcagctgcaaaggggtgg

SEQ ID NO: 6877805 - DNA, 60 bp, Homo sapiens
gcaggattccgattggtgaagaggccacatggccttctttaaaggacgggatagagttgc

SEQ ID NO: 6877806 - DNA, 57 bp, Homo sapiens
tgctaaaccctcgtggttaacatcagctgcattgctggaatcacctgttggtttgca

SEQ ID NO: 6877807 - DNA, 105 bp, Homo sapiens
ggggcgcatgcttgtgtttggacttgtgcctgtgcccaccctgtgtgtgagtctgggtggatgtccccatgtcaggacaggctctggactgagctgctttgccct

SEQ ID NO: 6877808 - DNA, 63 bp, Homo sapiens
catgtgtagaccgtgacctcatccgctgctcacagcagccccatgaagcaagggtcacacgtg

SEQ ID NO: 6877809 - DNA, 75 bp, Homo sapiens
ttgtagccactcacggtttgcatcaagagtgttttttgtaactgcctctggacttgggacagtgagtaggatcaa

SEQ ID NO: 6877810 - DNA, 94 bp, Homo sapiens
tccgcctcttctctccaccttaagagtctttctgtgtttatacgtatataaaacatttaagatttttgttgtgcttagtgggaagaaaagggga

SEQ ID NO: 6877811 - DNA, 96 bp, Homo sapiens
ggtgcatcctgggaatatccaggtgaaagtgtgagatttacctagaatagcttctgggcctctggggttttcacgctgtctctggtgaaggtgtcc

SEQ ID NO: 6877812 - DNA, 59 bp, Homo sapiens
gtgatggctccagacagaaggggccaaaatcctatttttaactctgtcttgactgtcac

SEQ ID NO: 6877813 - DNA, 77 bp, Homo sapiens
cagggctggctcaggctccttcccagggatggtcaccacagggtctgccatccctgtgtgaggggcagccagttgtg

SEQ ID NO: 6877814 - DNA, 72 bp, Homo sapiens
gctagcagtatagtttgtactccatgccattattcacagatactatattgaagtttgaactgtgttgctggc

SEQ ID NO: 6877815 - DNA, 63 bp, Homo sapiens
ggtgcatgcaccagttcaaatgggaaataaaaagcacttacatcttgagcagtgcttagcacc

SEQ ID NO: 6877816 - DNA, 128 bp, Homo sapiens
tgcgaggccttccgagcaggggctgccttccttggcagcagacaaaaggccatttctgagttacagaaaatgtgttcctttgctacagagccgggtgagggctgcccgggccggtcctgggccaggcg

SEQ ID NO: 6877817 - DNA, 67 bp, Homo sapiens
cagtccacagagttgtaaacatttaccagtgcaccactgcatgttttctactttgtacaatgggctg

SEQ ID NO: 6877818 - DNA, 69 bp, Homo sapiens
cttctctgaacagcatggaatcattttttaaacttgtttacaacaatgagtttgatgtagtttgagaag

SEQ ID NO: 6877819 - DNA, 71 bp, Homo sapiens
atagatcaaattggtgggaaagctctcctctggctactctttggagggcctttcctagcctcaaaatttat

SEQ ID NO: 6877820 - DNA, 129 bp, Homo sapiens
cctttgatcatggaaaattcatataaggtgaataaataaccagtgggagtgcttacaaataattattctggtactcaaaatggtggttatgcgctttgtgggttttattttttactacttcaaaatagg

SEQ ID NO: 6877821 - DNA, 112 bp, Homo sapiens
gtaagcaaagatggtggaagtatttattattataaagtgcatgaccttagaggttatctgttgccaatgttatctacactttatataagactactgggcctaatttgtggac

SEQ ID NO: 6877822 - DNA, 55 bp, Homo sapiens
caggtgcattttcctgtccttgttcccaccatgggctcagacagtgagtgccttg

SEQ ID NO: 6877823 - DNA, 65 bp, Homo sapiens
tctggagcacaccgggagcttgcctactgtgatggaaggcgcctctcccttggtggggttagaga

SEQ ID NO: 6877824 - DNA, 59 bp, Homo sapiens
cctttcccgctttgagggcaagttcctgtctcaagtttttgtcctaacagtggtaaagg

SEQ ID NO: 6877825 - DNA, 62 bp, Homo sapiens
tcaacatcctctgtaatttttggagcagtcaagttaccatgagaatactaagagagatgtga

SEQ ID NO: 6877826 - DNA, 59 bp, Homo sapiens
cacaggaggcaatggtaagattggaattctgtattttgaactgccctgtccttcatgtg

SEQ ID NO: 6877827 - DNA, 76 bp, Homo sapiens
tttggaggctagaagtcagaggtcaagatgtctttatagctggcttcttgtgacacctttcttcttggcttgtaaa

SEQ ID NO: 6877828 - DNA, 66 bp, Homo sapiens
tctggggctctttctactctgccacatgcctttaagtaggcttatagagtggcaaagtgtccaaga

SEQ ID NO: 6877829 - DNA, 58 bp, Homo sapiens
aggaggccgctgatgggctccctgagactgcaggcgtgatatccccatcaaggcccct

SEQ ID NO: 6877830 - DNA, 82 bp, Homo sapiens
gtgggtgcaataaataggagaggtttcttttcatctttaattttcaatgactgagaaacttcagctattcttttgcttacat

SEQ ID NO: 6877831 - DNA, 81 bp, Homo sapiens
gttttccagagtggctccctgggtttggcattctgagcttatctacctggctttgtgacctaggggctggctcctggatgc

SEQ ID NO: 6877832 - DNA, 108 bp, Homo sapiens
ggaaatccacaggacgcctactggatccctattgggctctactgaagggaggctgacctgggcctccctttagcagagaccaattccgtgggtcctgtattaatttcc

SEQ ID NO: 6877833 - DNA, 61 bp, Homo sapiens
ttctctaggagttctgggatcattcctcacccagtgagggctttcctaagatttgtgagaa

SEQ ID NO: 6877834 - DNA, 111 bp, Homo sapiens
tagaagctttgattgcaggtaaatttaaggcaagatgttttataacccaccagcaaaccatattagcaatgattataaagcatttttgaaattatgagattaaagctctta

SEQ ID NO: 6877835 - DNA, 56 bp, Homo sapiens
cagtaaagcatgtatgtcttcagttcttactggagatgagccttcatgctttgatg

SEQ ID NO: 6877836 - DNA, 89 bp, Homo sapiens
ttgcagagccaagaggtggagagaaaccgagtccagatggtaccatttgaacccctggttcaggtttctctgaactttttattctgtga

SEQ ID NO: 6877837 - DNA, 61 bp, Homo sapiens
tgctggttataagactaagaggtacacataaccttttggaaatatttatgaccatttggca

SEQ ID NO: 6877838 - DNA, 56 bp, Homo sapiens
attatgtgtagagatgagtaggtcctgtttggataactcatttgtctgcatctaat

SEQ ID NO: 6877839 - DNA, 83 bp, Homo sapiens
gagcattgcctggggacatggagctccatggaggctgagctccaggctccctgggtgctcctgctcccagcccaggtgatttc

SEQ ID NO: 6877840 - DNA, 64 bp, Homo sapiens
ccctgtggtgacaggcctgtctgcacatgaggctgtgagggcacaggcctgtgtgcacacgagg

SEQ ID NO: 6877841 - DNA, 61 bp, Homo sapiens
atggccctcaattagacgtcaaaaagattaacgagattgtcttttatgtcattgaggtcat

SEQ ID NO: 6877842 - DNA, 84 bp, Homo sapiens
gaactgaaatgataccttcaggtgagtccagagtccaaatcctcaaaggagggatttaggaaaggattcgagaggatcaggttt

SEQ ID NO: 6877843 - DNA, 74 bp, Homo sapiens
gtgtacagagcaagtgacagaaacagggctagaatgcaggtctctcgtccctactctgccactttttctgtcac

SEQ ID NO: 6877844 - DNA, 99 bp, Homo sapiens
cccttatctacatagaatagtcagcaagatcatggactctggacccagaacacctgagtcctagacttttctgccacttaagagctatgtgatgctggg

SEQ ID NO: 6877845 - DNA, 110 bp, Homo sapiens
ggatgtatctgttgccactgcagggctgcacatccggggttcagatgctgtggtaatgagctaggtcctgtgtcagctacctcctctgcgtggtcctttcagactcatct

SEQ ID NO: 6877846 - DNA, 66 bp, Homo sapiens
tgatttctgaggtttaactgtaggataacaaggttggggtctttagttggagaacctctgaagtca

SEQ ID NO: 6877847 - DNA, 85 bp, Homo sapiens
ttcccccaacgaggcacacattttgtatgtgtttacaattaagaatttgtcatgtataagacactgtgttcaatgctagtgggaa

SEQ ID NO: 6877848 - DNA, 63 bp, Homo sapiens
gcccagggtcccctggggatcagctggaattgcagacacagttaggatttctccggggagggc

SEQ ID NO: 6877849 - DNA, 72 bp, Homo sapiens
tgggtttggaaaggtcagtggagccggaaagacctgggctggagtcccagctctgtgacctcaccaaaccca

SEQ ID NO: 6877850 - DNA, 98 bp, Homo sapiens
gtctgatttttaatgggccaaagctatttaaactgtacatgcattaacaattttcttagtggcatgtatacttgagtaggaggttataaagagtagac

SEQ ID NO: 6877851 - DNA, 72 bp, Homo sapiens
agttgtgagactgtgccatgtatttggggtcatctggctagatttatttcattgcacatggcagttcacgct

SEQ ID NO: 6877852 - DNA, 63 bp, Homo sapiens
cccagggcccaggacagcatcagggaccaccactcgggtaacccctgggacttgggctctggg

SEQ ID NO: 6877853 - DNA, 64 bp, Homo sapiens
tgagagttccaatggtaaaattgtgggcgttatttattttccatatatttcttaagaactttca

SEQ ID NO: 6877854 - DNA, 58 bp, Homo sapiens
ctctggagtctgagatctgaggagggggaagaggtttcctacttcaggagagactgag

SEQ ID NO: 6877855 - DNA, 56 bp, Homo sapiens
tatctccatctggagagcaaaataatcacttataattctgcattaaggtggagata

SEQ ID NO: 6877856 - DNA, 61 bp, Homo sapiens
ttcatgatgttttttgttagtctctgatggagaagagactagtacagttttggcacatgga

SEQ ID NO: 6877857 - DNA, 87 bp, Homo sapiens
gagtgctagttacagccaggccagctgtcttgagtttgccagtagaatcagggcccctggcctaaggcagtttttctttatgcactt

SEQ ID NO: 6877858 - DNA, 70 bp, Homo sapiens
ccatgtataggcagaaagcaaagactggatttgaacccagacttttgattcaatgtttatataaaaatgg

SEQ ID NO: 6877859 - DNA, 61 bp, Homo sapiens
acaggtaggttaaaatgtgtcaagatccaatgacagggaacactatttaaatctaacctgt

SEQ ID NO: 6877860 - DNA, 79 bp, Homo sapiens
gaccatttgtgctgaaatagaggaggtggctgtcaagaataggagtcggggtctctatttgcagtggtctcaactggtc

SEQ ID NO: 6877861 - DNA, 75 bp, Homo sapiens
ccactggacaagttgggtagggtttattgcagagcaggtggagttctggaagatacctctcctaatttcttgtgg

SEQ ID NO: 6877862 - DNA, 106 bp, Homo sapiens
catcttcacagacctgcccaacctcctgggttggcaactgggattttcttggtccttccagggatggcctagactagcttggagatgtagggggtccaggaagatg

SEQ ID NO: 6877863 - DNA, 75 bp, Homo sapiens
aggttgtgtggaggggcagcccaaagcgactgattctcttttgtcttatcagtctgggtccccgacacgctacct

SEQ ID NO: 6877864 - DNA, 81 bp, Homo sapiens
caatcaacatccagagactggggctgggatagggtgaggaatcctgtaatatcttagcccaggctctctgaaggtttattg

SEQ ID NO: 6877865 - DNA, 63 bp, Homo sapiens
cctgcacaatgccagcgggtggagcagggctttgctctgacatctgagggcttgtagcccagg

SEQ ID NO: 6877866 - DNA, 129 bp, Homo sapiens
ctgctcagagaagaccactgcccagtgtcctttagagcctggacatctcaggcccagttgagacaagcattgttccagggggtccaagctgataagaaggacacagaatcagggtagtttttagattag

SEQ ID NO: 6877867 - DNA, 67 bp, Homo sapiens
gcacctatataatgtgctccatgagacagttttccatcatgtaatcagtagtgcattgaataagtgc

SEQ ID NO: 6877868 - DNA, 113 bp, Homo sapiens
ggcctgccccttgggaggatgcagagtggatgaaattgggggctgatgagttcccctcatagacaatcccccatcctacctcatccctagtcctggatatctggggccaggcc

SEQ ID NO: 6877869 - DNA, 61 bp, Homo sapiens
gaaaaagagaaggagttcagtaatggtgatgccatcagtccacagagatcctctctttatc

SEQ ID NO: 6877870 - DNA, 61 bp, Homo sapiens
aggccaaaccggatggaaaaggaggaaattccaaagaaggagcctttctgttttgtggcct

SEQ ID NO: 6877871 - DNA, 82 bp, Homo sapiens
ttatttgagggctgtgagggcttctgaggcattggcgaaagctctgatgcaaagattagaaagtttcacagcatgcatttga

SEQ ID NO: 6877872 - DNA, 76 bp, Homo sapiens
ttgaaagtccaggactgtttcagctgaaccagagggcacacaatttgcatcactgaaactgtcctgggttagtcaa

SEQ ID NO: 6877873 - DNA, 58 bp, Homo sapiens
gttaggaggacagaaatttctcatcatgtggctgcagatgttattctgttcctccagc

SEQ ID NO: 6877874 - DNA, 59 bp, Homo sapiens
ggatcctccagttttaggatcctcgggccctgtctggagatccactgacctggggatcc

SEQ ID NO: 6877875 - DNA, 70 bp, Homo sapiens
ggcctgcagcccttggtattttccgatcccagctgctctgtgagggtggaaagtatttggggaccaggct

SEQ ID NO: 6877876 - DNA, 77 bp, Homo sapiens
gggcagttcaaggcttccactttgttgggtcagaatgaaagctgatgatgctctagtggagttttgggattttgctt

SEQ ID NO: 6877877 - DNA, 105 bp, Homo sapiens
tctgggcaggttaatatgatgtgtttcctctgcacagtctcgtggagctgtacagaggtgtacatatgataaatataagtaaaaaattgacagctgagacccaga

SEQ ID NO: 6877878 - DNA, 59 bp, Homo sapiens
gcagagccgtgaatggatttcaaggacaagactacatcaagactccccacaggctctgt

SEQ ID NO: 6877879 - DNA, 62 bp, Homo sapiens
ggaggggagattgctggattccaggtgggcacatccatttggcctcatgaatttcttgctcc

SEQ ID NO: 6877880 - DNA, 83 bp, Homo sapiens
aacttggaggcaagtattttcagagggtgcttaaagaattatttaaaaaaaaggccattctgaacaattcttgtcttttagtt

SEQ ID NO: 6877881 - DNA, 82 bp, Homo sapiens
agatggaatttaaaaagcatgtggttcgagtcatcattgggaaaacatgacaaagattatggaacacacatgaattccaact

SEQ ID NO: 6877882 - DNA, 67 bp, Homo sapiens
cctagaccccatccctgattttcactcgtcttggaggagcctgaatcagagggtgagaggtcagagg

SEQ ID NO: 6877883 - DNA, 78 bp, Homo sapiens
caaatctaggatgcatgtagtgcttaagaatatattgttcctggtacaagaatagcttgaaactcatgtttagatttg

SEQ ID NO: 6877884 - DNA, 84 bp, Homo sapiens
agctcaggaagggaggggagacagggaaatcagttagaggctgactaggattttgctttgtcttccgtctggattgcaggagct

SEQ ID NO: 6877885 - DNA, 78 bp, Homo sapiens
tgttatcccagttgctcagtcagtttttgtgagagattcagggatcttaataaaactgtgctgctactgctactaaca

SEQ ID NO: 6877886 - DNA, 56 bp, Homo sapiens
gtttaatattcttaaaaaccctgtcttggaaaggacagttagttaggaagttttac

SEQ ID NO: 6877887 - DNA, 82 bp, Homo sapiens
ggagaattgcttgagcccaggagagtgcagtgagtcgagatcatgccactgcacttcagcctgggtgacagtgtgagactct

SEQ ID NO: 6877888 - DNA, 59 bp, Homo sapiens
atgaatgcaaactagtttgtgttgggagttgtacttgacacagctgaatttgcctttgt

SEQ ID NO: 6877889 - DNA, 63 bp, Homo sapiens
cactgggtttcctggcactaccctccctgtggaacctggccggctgccaggagaagctcagtg

SEQ ID NO: 6877890 - DNA, 62 bp, Homo sapiens
cacatgggctgtgaacccaggctgtctgagtttgaattccagctgcggtcattagctgtgtg

SEQ ID NO: 6877891 - DNA, 68 bp, Homo sapiens
gaagaacttaacataataaggagagagcaggaaccttattccagtttcttgttgttttgggtggcttt

SEQ ID NO: 6877892 - DNA, 66 bp, Homo sapiens
gattttcttatgttactggtggtctgagttagtgattcaggtagacgcagcagaacattctagatc

SEQ ID NO: 6877893 - DNA, 75 bp, Homo sapiens
gacagtgtttatttctagccccatggcagattggaatcacaaaagtctggatggggcttggagaaatacatagtt

SEQ ID NO: 6877894 - DNA, 67 bp, Homo sapiens
gcattatttgtagagaactggggtatcattgatacagaatgctactgaggtactttacttataatgt

SEQ ID NO: 6877895 - DNA, 97 bp, Homo sapiens
tagaaaaggaaatgaaggcttacaatgattagctaacttgcccaaaggttatatagctaattatgtagcagaacaaggccttacatatctgactctg

SEQ ID NO: 6877896 - DNA, 56 bp, Homo sapiens
ggaggcagggacatccagggctttgggggtgactccaggtcctgttccttgtctcc

SEQ ID NO: 6877897 - DNA, 57 bp, Homo sapiens
acagtgcacatcctgagtgattttccaaattactgaatcatttacttgttccactgt

SEQ ID NO: 6877898 - DNA, 76 bp, Homo sapiens
gctgtgtaaacttgtacagtgcatccaatctccctgtgcctcgatcatttcactgtaaaacaggtttcatcatagt

SEQ ID NO: 6877899 - DNA, 89 bp, Homo sapiens
gctgattttatttgaaggcatacattttgaggttcagactcctacagagggatctttgttttaaagtggtgctttgaaatttatttagt

SEQ ID NO: 6877900 - DNA, 115 bp, Homo sapiens
gctcagtcttctgagtctcaagttccgtgtctagcagttgaaagtaatgcggtgctgacggcactgaggtttttagtgttaaatggatgagcactgggaagtgtttttgctgagt

SEQ ID NO: 6877901 - DNA, 89 bp, Homo sapiens
gagacgtgggatttatcccctcataggtcagacacgcataattcttgtgtgtgtctgacacctgtgagttatttatcatccccgtgctc

SEQ ID NO: 6877902 - DNA, 80 bp, Homo sapiens
gctgctggcttcaaaaccacacttagggaagcacagcgctagggcctgcttactccaactgtggtccttggaccagtggc

SEQ ID NO: 6877903 - DNA, 95 bp, Homo sapiens
tctgcatgggtctctcaagggccacaatcaaggctgcaggctggggctgaaattctcatctaagctcacaggcttgttggcagaattcatgcaga

SEQ ID NO: 6877904 - DNA, 75 bp, Homo sapiens
gaagaggtcctgtttgtatttgctggaacttgcctttctctcggcttctatggcatgctgcaaactatctacttc

SEQ ID NO: 6877905 - DNA, 73 bp, Homo sapiens
tatgagttctctccggggcatccaaaccaaggaagttgctattctctggtagtggctttggagggaggttcta

SEQ ID NO: 6877906 - DNA, 57 bp, Homo sapiens
gctctggagcactggaaacactagttatggcctcatgtgtctatccaggcacagagc

SEQ ID NO: 6877907 - DNA, 63 bp, Homo sapiens
tgcccatggccactaacacaggggagactaagaaatgtagctcttaccaggtggccatgcgca

SEQ ID NO: 6877908 - DNA, 66 bp, Homo sapiens
tcatcttccctcctcctccactgagcaaagcactgaaaggctcaaggttgccaggaaggaagagga

SEQ ID NO: 6877909 - DNA, 87 bp, Homo sapiens
atctttctttggttgtatgaaatgtcttttctaataaaagagccaaaaagtgagagacagcatttctagcaccaggcacagaagggt

SEQ ID NO: 6877910 - DNA, 112 bp, Homo sapiens
tgctgcttcctcaccactgtcccactgagggttaatgcctgcataggacttaatctggttcttttcccagcggagtttgatccagtgcttggaccaggagagtaagccagca

SEQ ID NO: 6877911 - DNA, 66 bp, Homo sapiens
gggtatctctgacagggccaggtggcagcaatagtgcctttggcagacattaggggtgaaaggccc

SEQ ID NO: 6877912 - DNA, 76 bp, Homo sapiens
ggctgaggcaggtggatcacctgaggtcaagaatttgagaccagtctgaccaacatggtgaaaccttgtctctact

SEQ ID NO: 6877913 - DNA, 55 bp, Homo sapiens
ggtcatgcagccttcaaaagagatggctttgtgttctctaaggaagtctgcaatc

SEQ ID NO: 6877914 - DNA, 62 bp, Homo sapiens
tttctctgggcactctccaaacctctcccctacacattgggttgaccagatgccctgaggag

SEQ ID NO: 6877915 - DNA, 76 bp, Homo sapiens
gagaaccagacaggctcaattggctcaactgggttctggaacttggctgggagagttgaagatcgtttggtttctt

SEQ ID NO: 6877916 - DNA, 61 bp, Homo sapiens
ggatccaggagggtttagacatgaacccaataggtaatcaggtccccaactcttctcaccc

SEQ ID NO: 6877917 - DNA, 88 bp, Homo sapiens
gtttacaattgccatcagaaagcactgtgagatcttgttgcagtagtaaggttttgtattgtttggacacatggctggcaaatggtgc

SEQ ID NO: 6877918 - DNA, 62 bp, Homo sapiens
gtggcacacaggagagagctcaaggcgcctgctgccagccgcactcacagctgtgtgaccgc

SEQ ID NO: 6877919 - DNA, 69 bp, Homo sapiens
agcacattttctcaaagctcattcatgcggctgtttgccacgtgcctactgcgtgttggacaatgtgct

SEQ ID NO: 6877920 - DNA, 95 bp, Homo sapiens
gcccaccctttttcctctacaaatatttgtgctgtgagctctccctctcccaggcctaatgggagaaagggagagccagcacacgagctctgggc

SEQ ID NO: 6877921 - DNA, 62 bp, Homo sapiens
atgcatatttcatgaatctttgaggtattcttgccatttgaggaattcctgaaatgagtcat

SEQ ID NO: 6877922 - DNA, 94 bp, Homo sapiens
gtcttctgtgtacttgcttccaaatgctttctttcatataaccatatatcaggttaagatataaagtgttttgtgagcagtctggatggaagat

SEQ ID NO: 6877923 - DNA, 67 bp, Homo sapiens
gtctagatgtttccttccatgtggaggaagttcattacctttgccaaaggaaagaaatattaatgac

SEQ ID NO: 6877924 - DNA, 80 bp, Homo sapiens
agattttgttggttatgttgaggaccggtacacaaacatttcaatttgtacacaattcttaacatacatatgaaaaatct

SEQ ID NO: 6877925 - DNA, 55 bp, Homo sapiens
aggccaagtggtggctatttataggaggctgtagaaaagcttggacacatggcct

SEQ ID NO: 6877926 - DNA, 68 bp, Homo sapiens
ttgtctgtcacaagtaactggcaatgccacagaagtggctgtcggtggctctgtgaaagtgctgacag

SEQ ID NO: 6877927 - DNA, 55 bp, Homo sapiens
tgaccctggtgtccaggtcctgccctggtgctggagggcagagcatcaagggtta

SEQ ID NO: 6877928 - DNA, 92 bp, Homo sapiens
agtgggattgttgcagcaaggccactgctcaggtttccgggatagaatcgggccccggggcctagctgggccttggacagagcatcttcatt

SEQ ID NO: 6877929 - DNA, 82 bp, Homo sapiens
gaatttctcagctgggttccttgaggggattcactataactgtgcatctcttcatagtgacacccatctcctctgggatgtc

SEQ ID NO: 6877930 - DNA, 76 bp, Homo sapiens
ggcttccggggtgaggggccgacttcagggcctttttcctaaaagaagcttcaaggccggcctcctctggcaggcc

SEQ ID NO: 6877931 - DNA, 91 bp, Homo sapiens
gtagatagtagctcagcaaactattgttcacaagacaagctggcctgccacctagttttgaaaataaagttttatttggatataatcatgc

SEQ ID NO: 6877932 - DNA, 81 bp, Homo sapiens
cagcaacattatacacagtatgcatctagaaattatgcctgggtataatcagttaaatattgagtacaaatgtgagtgctg

SEQ ID NO: 6877933 - DNA, 91 bp, Homo sapiens
gtatatgctccgtcctccctcagtgtgcagcagcatctgctatgaattcattttcgggctctactggtatactgcaaaggagagcatatgc

SEQ ID NO: 6877934 - DNA, 64 bp, Homo sapiens
ccctaggctgggctcttggctttattacccatgcacattgaaagttcagcgcaaaagtcaaggg

SEQ ID NO: 6877935 - DNA, 126 bp, Homo sapiens
ctctcccagttttctcaacataagactcacggagacgacatagaagagggaagagacattacaattcttattcattcatctggtgttagtcctcacgttagttagtattcagcaagaactggagag

SEQ ID NO: 6877936 - DNA, 79 bp, Homo sapiens
ggtgaatgctcagagtcttgttaacttgctaagcatctggtcagcagggtagttgagttccagcaaggctcttgacacc

SEQ ID NO: 6877937 - DNA, 60 bp, Homo sapiens
ggggctgttttgtaggtgagcaccttgtcagagggtgtagggtgaatgcaaaacagcctc

SEQ ID NO: 6877938 - DNA, 56 bp, Homo sapiens
tttcctggtctatttagaattgccccctgggaatgcaaggtctttcagaaaggaaa

SEQ ID NO: 6877939 - DNA, 61 bp, Homo sapiens
tgtactctgggattgtttctggtattccctgtgggagacacctgagctaattccagaggca

SEQ ID NO: 6877940 - DNA, 63 bp, Homo sapiens
agagtaatgtgactctgtttctgaaaacagtttttgttactaggaaaagagtttcacccatct

SEQ ID NO: 6877941 - DNA, 129 bp, Homo sapiens
cagttacatttgaatttcagataaataacaaatagtgatttagtgttaagtatgttccaaatattgcatgggacatagttatacttaaaacaaagtatttgttttcattctgaaattcaaatgtaactg

SEQ ID NO: 6877942 - DNA, 73 bp, Homo sapiens
ccagggtaatcagatatcacctgggggatggcaagaatttttttcagctattgagggtggtgagttattgagg

SEQ ID NO: 6877943 - DNA, 77 bp, Homo sapiens
agctgttcttactttgtccttcaaggtgtgtcattctttggcagatggccaggccggggacagaactgaagacagct

SEQ ID NO: 6877944 - DNA, 77 bp, Homo sapiens
gtgctgtgcttgcccagtgtctactgtcattgctgtggatactgcagtgtcagtgcctgggtggttccacacatcgc

SEQ ID NO: 6877945 - DNA, 72 bp, Homo sapiens
ggcgacccatcctccacttggcagcgcagggtgaagttctggcccaccggctgccaaggaggcaggggtgcc

SEQ ID NO: 6877946 - DNA, 77 bp, Homo sapiens
catgaacaagcacaggtgtacaatgcatgacagcacgtgtgaccgtgggttcgtgcacctgcgagttaatgcacatg

SEQ ID NO: 6877947 - DNA, 74 bp, Homo sapiens
gcttttatttatttattggaagagttgcagtggcattccaaactgtgaatatgatttccagtagattagatagc

SEQ ID NO: 6877948 - DNA, 65 bp, Homo sapiens
tgtcgcccaggctggagtgcagtggcgccatcttggctcactgcaagctccgcctcccggattca

SEQ ID NO: 6877949 - DNA, 95 bp, Homo sapiens
ggccaggcatggtggctcacacctgtaatccgaggactttaggaggctgagacgggcagatcacttgaagccaggagtttgagaccagcctggcc

SEQ ID NO: 6877950 - DNA, 81 bp, Homo sapiens
tagtgctttcattctttagttttaactgaaagctatctgggcaagagtggacttaaggaagcagatatatgaaggcggctg

SEQ ID NO: 6877951 - DNA, 70 bp, Homo sapiens
aaacagacactaaggggctagtttatagtaaagatatactgtgtgtgtgtattagcttctggtgctgttt

SEQ ID NO: 6877952 - DNA, 62 bp, Homo sapiens
ctaaagagcacgcttttctctctcattgctatacacagaggtcagagatgagtgttcttcag

SEQ ID NO: 6877953 - DNA, 92 bp, Homo sapiens
gagcctgctggctctcaggctggtccccagggtcacagtcactttccatgggcaaggctggagcctgcagagccacatcctgaggcaggttc

SEQ ID NO: 6877954 - DNA, 70 bp, Homo sapiens
tctgccttttcactgccactaagagaggggtagcattcaatgagcagatggcagtggctcagagtgcaga

SEQ ID NO: 6877955 - DNA, 102 bp, Homo sapiens
tgaggtgagagaatcacctgagccctgaaggttgaggctgcagtgagctgtgatcatgccactgcactccagccttggcaacagagtgagactcttatctca

SEQ ID NO: 6877956 - DNA, 59 bp, Homo sapiens
gttgtgctccaacaatttatattcttgaaagctttccctgggtactgctggagcacaac

SEQ ID NO: 6877957 - DNA, 63 bp, Homo sapiens
gccaagtgagcacattgaaaataggaagcaaatccctttcttcctgaaatgtctcaccagtgc

SEQ ID NO: 6877958 - DNA, 60 bp, Homo sapiens
caggaaattagtctctctgttggaagtgagagtatgggatagagagagatgatgccactg

SEQ ID NO: 6877959 - DNA, 110 bp, Homo sapiens
catgctacaatggcacacttgagtagcttcaataggaactgcatggcagagccttaggaattgaccgtctagccctgtgaggaacaattctgtgcccttgttctagtgtg

SEQ ID NO: 6877960 - DNA, 107 bp, Homo sapiens
tatggaacattctttggggtcagttttgaataatcactgggcattatcggatttctatcactattttttgcatgttcttgtgattattcaccagggaacattttata

SEQ ID NO: 6877961 - DNA, 82 bp, Homo sapiens
gagctggcttttcaactcagacaaaaccatgtcaactggtcctgatcagagaatcacagtgtctgagttggaaggccacctc

SEQ ID NO: 6877962 - DNA, 74 bp, Homo sapiens
ttgaaactacggattcctggaccctcgtatgttaagcttcagtctgggatgaggcccaggaatctgtattttga

SEQ ID NO: 6877963 - DNA, 76 bp, Homo sapiens
gacaagcaccattctcgtttctgtttctatgagtctattacagataattcgtataaggggaaaagtgcagtttgtc

SEQ ID NO: 6877964 - DNA, 80 bp, Homo sapiens
cctgtgagctggcttttcagatgctgcggagtaattccctctaacccacactgaagctccaggatctgaaagttcgcggg

SEQ ID NO: 6877965 - DNA, 77 bp, Homo sapiens
tagttcccataattataaacgcaagttcagaggccccccttaaaatgatctttactgctgtttataataggggagta

SEQ ID NO: 6877966 - DNA, 83 bp, Homo sapiens
gctatgagaagaggaaggaaagattctctctctagaatgggagaatccattcatggggatgctcttatcttctgactgatagt

SEQ ID NO: 6877967 - DNA, 58 bp, Homo sapiens
acacgtacaatggatccaacacagtgcacagcaaatagttgaatatccatgtatgtgt

SEQ ID NO: 6877968 - DNA, 61 bp, Homo sapiens
ccagggtgaggaggctcccacgctgccgagaggctgggaaggagacgcgtcctgccactgg

SEQ ID NO: 6877969 - DNA, 55 bp, Homo sapiens
gcttttggagtctttacagacaaaaatgagttttgtctgtaaagactccagaagc

SEQ ID NO: 6877970 - DNA, 67 bp, Homo sapiens
aaattgcattgccacctagtacttcggcaaacacttactgaggacctgccaggtgcaaagcacattt

SEQ ID NO: 6877971 - DNA, 82 bp, Homo sapiens
gagataattaaaagataacccatgagtaattatgacccaactaagcttgggtaacattcattgggtagttattgattaactt

SEQ ID NO: 6877972 - DNA, 87 bp, Homo sapiens
gatgtaatgaagcagctttgccttacgctttacccatggagccattgtttgctacaagtttctgaagcaggcctacttcattgattc

SEQ ID NO: 6877973 - DNA, 73 bp, Homo sapiens
tcaacagctccatggagagcagcctagagcctggagattgaaatcctggctctgctgcctcctagctgtgtga

SEQ ID NO: 6877974 - DNA, 60 bp, Homo sapiens
ggagaagggccaattccatgtattcaccaggtaaaaggacagcaggggatgcccttcacc

SEQ ID NO: 6877975 - DNA, 59 bp, Homo sapiens
ttctaatacttcctagtctgggcagtattctcccagatctaagtccaaagtacttagaa

SEQ ID NO: 6877976 - DNA, 63 bp, Homo sapiens
ctgtgagaaaggtgatggaggttctgacatcagagctgtgccagattcatcctctttccacag

SEQ ID NO: 6877977 - DNA, 58 bp, Homo sapiens
gagcagcaggtggggctggctttctaggggcgcagaaggggccccccgccggctggtc

SEQ ID NO: 6877978 - DNA, 57 bp, Homo sapiens
aaggcagtctggcttcttttttattccgttgcaggaccaggagtcaggaacttcctt

SEQ ID NO: 6877979 - DNA, 72 bp, Homo sapiens
ccttcagggcaggcgagcagctgcttgatgggaaaatatactaaacaccaagcagagcgcctgctcagaggg

SEQ ID NO: 6877980 - DNA, 58 bp, Homo sapiens
attatttgaagggccgtgaaagggaagagttagttcctaatcatgtctcacaggtgat

SEQ ID NO: 6877981 - DNA, 60 bp, Homo sapiens
ttcccataaggagatagtcaaagcttcttgggattaggatgtggacatatcttttgggag

SEQ ID NO: 6877982 - DNA, 66 bp, Homo sapiens
tagaaagaaggtttttgagacactgtgatgtgtgctttcatctcacagtgttaaacctttcttttg

SEQ ID NO: 6877983 - DNA, 55 bp, Homo sapiens
ggtggttcacgcctataatcccagcactttgggaggccaaggtgggtggatcact

SEQ ID NO: 6877984 - DNA, 81 bp, Homo sapiens
tcgctgcatttatcatgtgactccaatgtggacaatctgtggctgttctccatgatttgagcacatgccgagatgctgtga

SEQ ID NO: 6877985 - DNA, 57 bp, Homo sapiens
gctgtgctcaacgtgccttcctcctatatatttgaggaagaggcactttattacagt

SEQ ID NO: 6877986 - DNA, 66 bp, Homo sapiens
tgttactactgaggatatgagggtgcctctttctgacattcatgcctaaatctctcagaggtgaca

SEQ ID NO: 6877987 - DNA, 75 bp, Homo sapiens
gggggttgccttggagacaaagcttcctgtgggtaatccaagattatctagctctttgtcctacatgtgaccctt

SEQ ID NO: 6877988 - DNA, 76 bp, Homo sapiens
tgtctgaattagtttcctacttctaaagtgaaattagtaataactagtttctagacagtaagaatttaatgagata

SEQ ID NO: 6877989 - DNA, 89 bp, Homo sapiens
cctaggcagtgtatcgagtgtgtgacttcactttagcctcacagcagttctgagtgctactcagtgttgttaccattttgctgatgagg

SEQ ID NO: 6877990 - DNA, 101 bp, Homo sapiens
tgaggcaggagaatggcgtgaacccgggaggtggagcttgcagtgggctaagattgcgccactgcacatcggcctgggcaacagagccagactccgtctca

SEQ ID NO: 6877991 - DNA, 72 bp, Homo sapiens
gtgaaacaggcccagtgaggattaaggtaaacctgagcgggttgccctgtcttaagctggcaaatgtttcac

SEQ ID NO: 6877992 - DNA, 106 bp, Homo sapiens
gttgggtgggggcaggaaagtcggcgactctgagccaccagatccccaggatgccccgtggggaggtgcgcacagagcatcagcagccgcctgcccgccggccggc

SEQ ID NO: 6877993 - DNA, 77 bp, Homo sapiens
tctttcccgacttgaacccaaaaagatattgcttccttgtgggaggagcttgtctgataatggggccaacggaaaga

SEQ ID NO: 6877994 - DNA, 70 bp, Homo sapiens
gtgggactggctcagttcttggttttcagcttggatgccctgattgacccagaactggtcaaagttccac

SEQ ID NO: 6877995 - DNA, 57 bp, Homo sapiens
agtgcagctaagtggctctgtgaggttctcccaggtctccttctttagctgctcgct

SEQ ID NO: 6877996 - DNA, 100 bp, Homo sapiens
agaaaattgttttgttaagaggaaggcagttaatttggctagaatccaaaaactcattcagcatggctgttttcccttatttcaaatgaaaaacttttct

SEQ ID NO: 6877997 - DNA, 69 bp, Homo sapiens
tggaggatgggaagtccaaaatcgaggcaccagcaggattggtgtctgatggggattgctcttcttcca

SEQ ID NO: 6877998 - DNA, 86 bp, Homo sapiens
ggaggagcaggcacagtgtacagaggttgctggaggctccaggcagagactggtggccccagggccctgtctggcaccctctctcc

SEQ ID NO: 6877999 - DNA, 74 bp, Homo sapiens
acaactggtgtgatggcccagctgtctgttgtgtgtgacagtgtgtggctatggctgggtcaccatcagggtgt

SEQ ID NO: 6878000 - DNA, 55 bp, Homo sapiens
atagttgcttttacaagtaacaaaagaaatgaaagtatactttggaggcagctgt

SEQ ID NO: 6878001 - DNA, 65 bp, Homo sapiens
acacagctgtgcagttttttcaagctctgctcaggtgtaagaatggaggaagtggacagttgtgt

SEQ ID NO: 6878002 - DNA, 61 bp, Homo sapiens
ctcttgagtgctgccccggctcactggtgatgctgggggcctggcaaagcactaccgagag

SEQ ID NO: 6878003 - DNA, 68 bp, Homo sapiens
ggcctgagaataattctccatagccctcagcttcaccatctgggctctgggtttgttgttctttttcc

SEQ ID NO: 6878004 - DNA, 61 bp, Homo sapiens
ttgcaagtttatggcctccctttactgaatagccagtgggtggagccagttgactctgtga

SEQ ID NO: 6878005 - DNA, 63 bp, Homo sapiens
aagagccaccttccaaaataatcacaaagaagtctcactttgtattatgtgaggttggcactt

SEQ ID NO: 6878006 - DNA, 88 bp, Homo sapiens
cctgagtgcctgggagagggtcagagactgggcagagctttctaaatcactgtaaggactttggcttttattctaggtaatactgagg

SEQ ID NO: 6878007 - DNA, 79 bp, Homo sapiens
gggacctcacaattgagttccacaaaccacatgagaataattactgtagaatggaaccaattgtagtggctgagctctc

SEQ ID NO: 6878008 - DNA, 64 bp, Homo sapiens
tgccatcacaatagcaatgtggcttagaagttacttctcaagctacaaccatattcattgtgca

SEQ ID NO: 6878009 - DNA, 68 bp, Homo sapiens
tttgtctaacgtcacacagccaggatgaaaaacacaggtattctggctgtgtaatatgtgtagggaga

SEQ ID NO: 6878010 - DNA, 69 bp, Homo sapiens
ctgtttatgaagctgtggtttagatgtcctcaagactaggatgatacttccagcttcaagattgaacag

SEQ ID NO: 6878011 - DNA, 55 bp, Homo sapiens
ccctgaggggagtggtgaggtggactctgttgctcacccaaactgttcattaggg

SEQ ID NO: 6878012 - DNA, 128 bp, Homo sapiens
tgattgagggtggcttctggagcatgggtcacgcagcactctaagcctgccccgggcacgggccaagcatgctgctgaggctggaatatgttgcccatcagagagttgcaggaagccactgcatgtca

SEQ ID NO: 6878013 - DNA, 102 bp, Homo sapiens
cagaatgtgaatagtatttgccttcttgaatatggttctttgaaaatacagacaggcctcaaagacactggacagtgggagggataaagctatttcagtctg

SEQ ID NO: 6878014 - DNA, 80 bp, Homo sapiens
gatatgcagtaaacagaattcaggcaagatacctctaagctgttttgaaccctctgatattttgtatttatgtgtttgtc

SEQ ID NO: 6878015 - DNA, 83 bp, Homo sapiens
atctgtttggggataggtgcaataaataaatagattgttgtaattaataataatcaatgtgttattgtaattaacatttagat

SEQ ID NO: 6878016 - DNA, 110 bp, Homo sapiens
aagttcttgactgcattgtttggccttctggtgttcattttggcttatgaatgcaaccaatccttatcttggctaatgtgaatataagtgggctgtcttgttggggattt

SEQ ID NO: 6878017 - DNA, 85 bp, Homo sapiens
aaagagcagagagtatcgattatattatgtagttttgtcctatgctatagactgaataattttatagttgctgctgctgctgttt

SEQ ID NO: 6878018 - DNA, 75 bp, Homo sapiens
catacttagaggagacagacaaactttggaagccatgtattgactattaaggaacttgtctttctcttagagatg

SEQ ID NO: 6878019 - DNA, 101 bp, Homo sapiens
tcttattgtcagggactagccaacttagaaagagttttctcccctactaaggtgatttcattttttctgagtggaagcaatatttccctgattaagtaaga

SEQ ID NO: 6878020 - DNA, 76 bp, Homo sapiens
attctctttttattcagtatgttggacgttatgtgactgtagtacacatgctttgattattgttttagaggaggat

SEQ ID NO: 6878021 - DNA, 58 bp, Homo sapiens
cctcactttccccagtaaggggacccatgggtctttctgctgagtgggcaggtgcagg

SEQ ID NO: 6878022 - DNA, 62 bp, Homo sapiens
tcccatcaatgtctgcagaagacgtggcctccactaacacaagtcttactgaactgatggga

SEQ ID NO: 6878023 - DNA, 78 bp, Homo sapiens
atgttaacagtagtggcagtggggaaggggtacatgagaatgctctgtactgtatcattgcaacttttctgtaaatat

SEQ ID NO: 6878024 - DNA, 67 bp, Homo sapiens
gtacttccctgggaggcaagcacagcctttaggacgagctgatggtcttgtggcccccaaggaggac

SEQ ID NO: 6878025 - DNA, 59 bp, Homo sapiens
caggcacagagagaataccttttgtcttttcctccagaagttgagtttttgtgtgtctg

SEQ ID NO: 6878026 - DNA, 65 bp, Homo sapiens
ggccgccgtggcacctgctcgccctagccctgcaacaggcctagggtcaggggcctgcgtcggcc

SEQ ID NO: 6878027 - DNA, 61 bp, Homo sapiens
tctctgcccagggacccacagggagagagatggtgcttcctagtggtttcccaggcagtga

SEQ ID NO: 6878028 - DNA, 107 bp, Homo sapiens
aattacttagtctgtggtattttgttacagcagcagggacagactaagataccatgtgtattagtatcctgtggctgccataacaaattactacaaacttggtagtt

SEQ ID NO: 6878029 - DNA, 89 bp, Homo sapiens
ggcctcccacactgaccctctggccccacagccacaacaagcagagtgtgagccaggcccagtggggtcatctgtgggtcataaaggtc

SEQ ID NO: 6878030 - DNA, 81 bp, Homo sapiens
gaaccacgacagggattgatatgttatagcccaggacatgaacctagcaataaagatatcatttcgattgtctgtggcttc

SEQ ID NO: 6878031 - DNA, 114 bp, Homo sapiens
aacattaggaccacgtgggaacttgctagattctgaggctccctcccagactttctaaattagatactctgagggtgaggcccagaatctgtgttttaatgtgctcttgaggtt

SEQ ID NO: 6878032 - DNA, 57 bp, Homo sapiens
cactttgtgtcaagcccaggcccggagcagctccaggtggccggtagacacaaagtg

SEQ ID NO: 6878033 - DNA, 55 bp, Homo sapiens
ctgctggcacctccagggatggagtcctcccagacctctcctgtgggtgcagcag

SEQ ID NO: 6878034 - DNA, 105 bp, Homo sapiens
gggagctcaggctcaagtcctcccacctctttattgctactggtttgtcaccattctgctggcgagaatggtagtgagcagcagggaggaagccacagggtttcc

SEQ ID NO: 6878035 - DNA, 99 bp, Homo sapiens
tttattttatgggtgactagattaagatgccagttttgagaattaattgtaaatatctttaaagcccagtcttaattcttggtgcaactgtaaaataga

SEQ ID NO: 6878036 - DNA, 66 bp, Homo sapiens
atgttggctcaggctgctttcatgcttagaaattgagattctctgtgactgcagctttgcaaacat

SEQ ID NO: 6878037 - DNA, 123 bp, Homo sapiens
catgagtattaaatgtgatgtgtgatgcaggattttcttggactataaagagaattattgaatatataaatctcaataaagtctgtggattagattagctattgcaacaatattaataccgtg

SEQ ID NO: 6878038 - DNA, 69 bp, Homo sapiens
gcagtagcactactaaaaggaaatggtgtgaccatcaatttggtgcttaaaaaccattctttttactgc

SEQ ID NO: 6878039 - DNA, 71 bp, Homo sapiens
gggtgagaaatctgggagcagctcggccaggtacttctggctcacaatctcccatgaagttctcattgccc

SEQ ID NO: 6878040 - DNA, 65 bp, Homo sapiens
ccatccttaggtggtgcatcagggcatttatgtcccatatgcactgatgtgtccccaaagcctgg

SEQ ID NO: 6878041 - DNA, 64 bp, Homo sapiens
ccctctgctgcctggctgggtccacacacgtgcactcatgtacagacctgcggggtagcaaggg

SEQ ID NO: 6878042 - DNA, 86 bp, Homo sapiens
ggacagtggaatatggtcctggtcattgatgagctggattcattgctttagccaaataatatttcagaaccatcccaaacactgct

SEQ ID NO: 6878043 - DNA, 89 bp, Homo sapiens
tctatgagtgattgcagtggaagctggctgtgaagaactatacaatttctagctctacaagtttaattccacttaaattacatcatgga

SEQ ID NO: 6878044 - DNA, 130 bp, Homo sapiens
ccttgtggaggaaaggctggtgggaggaaagaaggcttgttgagtatctactgcacacccggccctggggctacggctggaagctggacaggccgggtccttgccctcctgagacctgccttctagtggg

SEQ ID NO: 6878045 - DNA, 72 bp, Homo sapiens
gggagatcttactcacttcagctggcgttgctcattagtgaatgtatgacagcaggatgtgaggggatgccc

SEQ ID NO: 6878046 - DNA, 61 bp, Homo sapiens
ctccttggttcccctagactccttgtcccatggctaaggcatggcaggaatagggccagag

SEQ ID NO: 6878047 - DNA, 56 bp, Homo sapiens
aggtaatacagatgagcttctgcctcccacaagagagcaaccacatctgttttcct

SEQ ID NO: 6878048 - DNA, 106 bp, Homo sapiens
tgaaatgagagatggtacctgactgattcagtgtcaaagctaagtatttatttgtacccatttgcctgttttcctactgtatcatcaaatacacatgattaattca

SEQ ID NO: 6878049 - DNA, 69 bp, Homo sapiens
tcctgcccgccgctgagcctctgcggcctgcagagcacctgggccgaagacgctgggcgtgggccaggg

SEQ ID NO: 6878050 - DNA, 66 bp, Homo sapiens
taaagtgggctttgtggaaaagttaaataaatcattttaatttaagaaacggcaggccctacttta

SEQ ID NO: 6878051 - DNA, 66 bp, Homo sapiens
tctctccccaggactaagttgcaatctgttggatttctttgagttttgttcttgtccagggaaaga

SEQ ID NO: 6878052 - DNA, 55 bp, Homo sapiens
cccacatgctggaatgcccacttacaggacaggtactgcataactggcatgtggg

SEQ ID NO: 6878053 - DNA, 97 bp, Homo sapiens
aattgaaatgattttccttgtggaagcaagctcctctgttcttttttatattatggaactacacctggaattggtttcaagggaaagtgaatcagtt

SEQ ID NO: 6878054 - DNA, 97 bp, Homo sapiens
aatattctgttttgatttgtgtggaaagcaaatatgaaatattgaaataatatttcaagttcccagttttgtggcacaaatagacatacagaatatt

SEQ ID NO: 6878055 - DNA, 67 bp, Homo sapiens
gcatgcatctcccaggttacatctgagcctggagtcgccaggcttcaaggacctgagggaagcttgt

SEQ ID NO: 6878056 - DNA, 74 bp, Homo sapiens
ctgccttactccatttgttttagctacatagacataactctgataccgctagaagcagatgtctgagtaggcag

SEQ ID NO: 6878057 - DNA, 72 bp, Homo sapiens
ggcagaggtcacttggagcaaagtttacaagccttttcttgattacattgtgcttaaagtgttaaccctgtt

SEQ ID NO: 6878058 - DNA, 77 bp, Homo sapiens
tccaaaattgagaaaagtacacagcccaaacatccgtggcagcagaagttttaagagtgtttttattcaattgggga

SEQ ID NO: 6878059 - DNA, 63 bp, Homo sapiens
gatgaaatgctgagcctgagttctctcccagtgtgggcaatacctgggactcagggtttcatc

SEQ ID NO: 6878060 - DNA, 81 bp, Homo sapiens
gttcaaatgtttatttcagattcgagaggaagtggagtggttcctttccatttcctcgtctctggaatctgcgagttgtat

SEQ ID NO: 6878061 - DNA, 106 bp, Homo sapiens
accagtcttccctgggcagaggtagagaaggagctccttggggtctgtctgcttctcatacagacttccaagcagtctttcattcctgtgtctaggggtgcctggt

SEQ ID NO: 6878062 - DNA, 70 bp, Homo sapiens
tatcttggctattctaataggtgtgggctgaagttagagaccagatagggatgagagtgctaccgagatg

SEQ ID NO: 6878063 - DNA, 84 bp, Homo sapiens
gagagccaaaggtttaggggttctatgtttaagtttcatccttttagcagagatcatagaacacctacctacctgtctgccctc

SEQ ID NO: 6878064 - DNA, 55 bp, Homo sapiens
atctggaatgtctcattgggaagaccaaacccccttctcgctgcagataccagat

SEQ ID NO: 6878065 - DNA, 130 bp, Homo sapiens
gtcaaaatctttttgtgtatatatgtttttttcagttgatacacaatggaacaatgttcatgaacctgacatttgctttgtagtgttaagagaatgtaatggcatctatattcagtgaaagcgttttgat

SEQ ID NO: 6878066 - DNA, 68 bp, Homo sapiens
acgccgggatgcgcctggctgcagccggcgaggctattgtctccccgccctgaagccagccccggcgt

SEQ ID NO: 6878067 - DNA, 82 bp, Homo sapiens
gaaggcgaaacttaagacacatttctcagacgggcctgggccactttcctgtgctgagtgatgtgacttacgatgtgtgttc

SEQ ID NO: 6878068 - DNA, 58 bp, Homo sapiens
gctggagcatagtactaaagtagtgcactataagtctattattatttctgtgtccagc

SEQ ID NO: 6878069 - DNA, 81 bp, Homo sapiens
cactttgtatttataaacagtaccacggtgcttaccataaagttggcacccctcagcttgtttactaaatgaatatgggtg

SEQ ID NO: 6878070 - DNA, 96 bp, Homo sapiens
tggagtttctaatccagtagctctggactggggcctgagaactgatatttctatcaatttctcaggtagtgctgatgctgctggtagggaactgca

SEQ ID NO: 6878071 - DNA, 79 bp, Homo sapiens
actaaaggtttgcagaagggcacagtgatcaattcctttggaaagattggttgtggcttttctgtaaacagacaggagt

SEQ ID NO: 6878072 - DNA, 71 bp, Homo sapiens
tgaggaaatatggtgaactcttttccaaactacagtgcaaatagttaggttttaagacgccaattttctca

SEQ ID NO: 6878073 - DNA, 107 bp, Homo sapiens
ggataagttctggtgaaggcactattccaggtttcttgttgtatcctcacatggaggaaagagggtgagggaactctgtgggatttcttttataaggacgctaatcc

SEQ ID NO: 6878074 - DNA, 64 bp, Homo sapiens
ttttgatgtgagatttgtatacagcgtatactatacatctgtttaaccagatctcatatcaaga

SEQ ID NO: 6878075 - DNA, 95 bp, Homo sapiens
cagacatcacagggaaggttggtttgttcaccatcaagcagttcaaagtcagcccctctgtttttgaaatgaacgaacttgcctctcaccgtctg

SEQ ID NO: 6878076 - DNA, 63 bp, Homo sapiens
ttttgtgtagagatggggtcttgctatattgtccaggctgagccacttcttttcaacacagga

SEQ ID NO: 6878077 - DNA, 61 bp, Homo sapiens
tggggtagcccacaatggggcggtggcccattgtgtggcttctgcttctggggcttctcca

SEQ ID NO: 6878078 - DNA, 101 bp, Homo sapiens
gcgcttgcgcaggaagtctgcggcaggagggcgtcctcttgactctaggagagctgggagggggagggaaagcttgatctgtctcggagcctgcgcagtgc

SEQ ID NO: 6878079 - DNA, 70 bp, Homo sapiens
aggttcacaatggcaaatgtaattttactgtgaatggcaaatgtaattttgctgtgaccattgaaaacct

SEQ ID NO: 6878080 - DNA, 62 bp, Homo sapiens
tctcttctgcaaccaggctggtcaggtgagcatggacatgccacctcctggtcagaaagagg

SEQ ID NO: 6878081 - DNA, 83 bp, Homo sapiens
gagaggcaggtttgaaatctgtcccactttagctgagccacttggggcaggttataggacagatttgttatactccagctctc

SEQ ID NO: 6878082 - DNA, 62 bp, Homo sapiens
cttagggacagggactacagaaggagagggtagtcctctctcttgtagtccctgcccctaag

SEQ ID NO: 6878083 - DNA, 83 bp, Homo sapiens
gtctgccatatagtcatgctttgttaatgtggcacatcttgccatgatggtgccctcatgaaacgaaggatgctgaagcagat

SEQ ID NO: 6878084 - DNA, 77 bp, Homo sapiens
tgtatttctttctggatatgcttggccatttcggttcctgatataataatggcttcatgtctgtggaaagcaaaaca

SEQ ID NO: 6878085 - DNA, 107 bp, Homo sapiens
agaattagattaagctatgtgttatgggagaaatgagtgattcacttttcatcaaatgaagaaatcatatcatttcttggttcaaaacattcagtgattcccattct

SEQ ID NO: 6878086 - DNA, 112 bp, Homo sapiens
ggccctggaagtggggggcagagatgtgggtcagaatcctacacagcccctcaaagtctccactgtactgattccccacactgccgatcactttctgtgtaactcaagggct

SEQ ID NO: 6878087 - DNA, 87 bp, Homo sapiens
gactccctcagcccagttaagaacctgttactcttgtttattagagtcccatgaacagtggtttttagtacagggaaagaggaagtt

SEQ ID NO: 6878088 - DNA, 130 bp, Homo sapiens
gaagcgctgggctgagaaaggccggtgggtgtgacagtggacatgactctcctgccttccctgcagttttgcctgagcgcatgtctttgttatgctcaccaactcatcagctaggagcagggcttggaat

SEQ ID NO: 6878089 - DNA, 83 bp, Homo sapiens
aagagcaggtggcccccatcaggaagcgtctggtattttgtgttcttaaaacccatcaaactgctgagaggctatttgctctt

SEQ ID NO: 6878090 - DNA, 60 bp, Homo sapiens
acagtggagaatcttcaagatgccaaggcacatacttgccagccagaatttctccactgt

SEQ ID NO: 6878091 - DNA, 63 bp, Homo sapiens
gaaattgacacatgcaccagtctttaaatgggttggagtttagagatttcatgtgtttatttt

SEQ ID NO: 6878092 - DNA, 58 bp, Homo sapiens
actcatagaaattatactaagaactaaagttgcctgttcttgtattggatctgtgtgt

SEQ ID NO: 6878093 - DNA, 71 bp, Homo sapiens
cagtgagaggctgctgttagccctgggcatgtggtcagccacggccacaggacccacaacagccctgcctg

SEQ ID NO: 6878094 - DNA, 64 bp, Homo sapiens
ctcctgtggctttctgatttcacaggcaccataggttgagtgcatgatgagtaggttacaggag

SEQ ID NO: 6878095 - DNA, 57 bp, Homo sapiens
gtaggaccttccccacagggctgtgtggtttaacagttaatgtgcatgaagtgctgc

SEQ ID NO: 6878096 - DNA, 74 bp, Homo sapiens
acctcctttctggtaacacttggctgcaacctggaataggcaaaaagttttattcccagcaaggtaatggaggt

SEQ ID NO: 6878097 - DNA, 130 bp, Homo sapiens
ttgaaggatgagatattttgcattggtaaaatgttgtgattaagttaagcttcaaatgctcaaagccttttaagcagcaagtgtaactgaatataattttaccattgcttgatgaactagggtcttttaa

SEQ ID NO: 6878098 - DNA, 108 bp, Homo sapiens
gacctcctggctccatgccctactcctgctgatcctgccagccagcagaaattgtgttgggggtggaggcaggggcaggacaggatagaaacagaggagtctggggtc

SEQ ID NO: 6878099 - DNA, 61 bp, Homo sapiens
ttctgtcaaaacttttttatgtggccacagagacactgtagcagagaaagtttgggcagaa

SEQ ID NO: 6878100 - DNA, 57 bp, Homo sapiens
cattgtggcctatttgactttggtttcctaatactgagcaaagtacctggcacagtg

SEQ ID NO: 6878101 - DNA, 76 bp, Homo sapiens
tctgaattttagtttactcatctataaaatggagataatactcacatttaaaggttgtgggtaaaagaaaatgaga

SEQ ID NO: 6878102 - DNA, 103 bp, Homo sapiens
cagctgatggataaggcagccagactgtggatacaattgctgcaggagtagctcaatgccatctggagtatgtccctggtgaatcatgccctatatgtagctg

SEQ ID NO: 6878103 - DNA, 130 bp, Homo sapiens
tgcgtccggcggccaccgggctccaggcgcaggcggcggtggtggcggccacttcagccctgggagccgctctcctgcgcccgccgcctccgccgccgcctggatctgcctcgggcggccgggcgcgtag

SEQ ID NO: 6878104 - DNA, 79 bp, Homo sapiens
cacttcacactccgctacctgctaattttgatggaaattgcttttgacatgtgcagttggtggccaggagcttggggtg

SEQ ID NO: 6878105 - DNA, 62 bp, Homo sapiens
gctaaacttaaattggatgagttaagttcagggttgagaactgctctgatccattaagtagt

SEQ ID NO: 6878106 - DNA, 80 bp, Homo sapiens
tctttgctattgtgaatagtgctgcaataaacatatgtgtgcatgtgtctttatagcagcatgatttatagtcctttagg

SEQ ID NO: 6878107 - DNA, 61 bp, Homo sapiens
gcataccatggtgaccagggtgacaaaaaggtgtcctttccactctggccaccatcttagc

SEQ ID NO: 6878108 - DNA, 76 bp, Homo sapiens
tttcaaaagcattttaacaggcgaatttactattcttcaacttaatggtagccacatggctgaaatccttttgaaa

SEQ ID NO: 6878109 - DNA, 81 bp, Homo sapiens
tctacatccccttgtggtttggaagtttgatgaggctatggattctatcagttttgttcactactatattcacagtgtaga

SEQ ID NO: 6878110 - DNA, 85 bp, Homo sapiens
tttagaggggaaaacaaattctctaaagaaaacatgaaggatctactcaatttcatgactatacagaatatgatctccatctgaa

SEQ ID NO: 6878111 - DNA, 83 bp, Homo sapiens
ccttcagaggaagaagagctgtgctgagctggaaaacaccgcttgtaaacttgagcagggcatcttcatcccaactgtgaagg

SEQ ID NO: 6878112 - DNA, 93 bp, Homo sapiens
tgttctgctcatttttgtccttgatgaatatgaaattgctataatgacatttacaattttattaactcattaaacagagatgtgtgaggaata

SEQ ID NO: 6878113 - DNA, 94 bp, Homo sapiens
gtgcacctcatagaagcttttaatagtctttatatttactaaagaataggactaactatggaactatgaagatgagctggaaatgacaggtgac

SEQ ID NO: 6878114 - DNA, 74 bp, Homo sapiens
gggggttggaggggaaggttcctttgaggcttttgacagcaccagctaagtggttttcttctcctcctattcct

SEQ ID NO: 6878115 - DNA, 81 bp, Homo sapiens
gtgtggctgggacacaggcagctgggtgggtgctgccccagctccatccccatgcccagagcctggtgccagcgcccacac

SEQ ID NO: 6878116 - DNA, 55 bp, Homo sapiens
ggaccccgattgtgccagtggttaaccctttagctgctgcagcacagggaggtcc

SEQ ID NO: 6878117 - DNA, 126 bp, Homo sapiens
agggcatactttgccacagaggacagtcttggacctcagttattctatcatagttcatgaccccattataatcagaatacactgggagtgctggctgtatcttttgtttgtggctttatttgcttt

SEQ ID NO: 6878118 - DNA, 128 bp, Homo sapiens
ggacggaggagtttccaggtagtagaactcagtgcaaatattgggacagtctagaaaattaggagagttatctcccctatggcaatgcccaatgttgtacagcgctaacaatctttttttttttttcc

SEQ ID NO: 6878119 - DNA, 87 bp, Homo sapiens
gcattcagagcctttcagcagagaaattacataatcatattcgtgattaaaaggatctttttggctgctgggtggagaataaactgc

SEQ ID NO: 6878120 - DNA, 84 bp, Homo sapiens
cctgtgttttaaatacatgaagagagaaagcaatatgatctgcatgctttattttcatgtgttcaagctattacatcacacagg

SEQ ID NO: 6878121 - DNA, 61 bp, Homo sapiens
ttcctaaaagctgagtagagaatttaaggtttatgccatttctctcctaagctctttggag

SEQ ID NO: 6878122 - DNA, 102 bp, Homo sapiens
gcctctttttctagaagagtcctcatgcttggcaccaaatccttgaattagtgtttagttggctgaaagccatgagaccgttgagaaaaaaaagtagaaggc

SEQ ID NO: 6878123 - DNA, 75 bp, Homo sapiens
gtcttgccctggtttctctagcctgtgttgagtgtgagctgaacactctggggtgggaggtactggggcaggggc

SEQ ID NO: 6878124 - DNA, 63 bp, Homo sapiens
acccatgagtgtatctttaaaaaactcttgaacttatttaagagaggaagcattacatggtgt

SEQ ID NO: 6878125 - DNA, 79 bp, Homo sapiens
caggcgaggcccaggtgggcaggcgaggcccaggtggtccatggcacgcctcccgtctcccgcctcatcccctcacctg

SEQ ID NO: 6878126 - DNA, 92 bp, Homo sapiens
cttgttatgcaccataagctaactgatacaggagggaagagaatggctattcttttcaaacgctgatgtcagttgcagccatgcatggcgag

SEQ ID NO: 6878127 - DNA, 56 bp, Homo sapiens
tcaaactcattctaagtataccaaagccaagattattggctttggggatgatttga

SEQ ID NO: 6878128 - DNA, 67 bp, Homo sapiens
gctgacagcgtttccagtgatgcctcaaaccttcctaatatgcaaggtaactttctatgctttcagc

SEQ ID NO: 6878129 - DNA, 77 bp, Homo sapiens
gtgtcttttattcaacaaatataacttttgagcacttactgcatgccaggtattatgctgctgaatgctggagatac

SEQ ID NO: 6878130 - DNA, 76 bp, Homo sapiens
ggggaaggagtagttcttattttggaactgaggcttcagtgcagttgtagctcaagggtaaggacacctcctcccc

SEQ ID NO: 6878131 - DNA, 58 bp, Homo sapiens
aggataacagtagccttatgtggtctccccaagactgataccatgttgctgttgacct

SEQ ID NO: 6878132 - DNA, 57 bp, Homo sapiens
ctttgccttaatttttaaagtgcagcagcatgagcactttaaagtttggtggcatag

SEQ ID NO: 6878133 - DNA, 107 bp, Homo sapiens
cgaggacaaaggactaagggatgagcagaatgttcagataaatggcttgggtgaacctagaagtgacatttaacatctgttcttctcctgcttcttgctttttcttg

SEQ ID NO: 6878134 - DNA, 67 bp, Homo sapiens
ggcccaggtaggtataatgcacttccggtccatgatgccacaggtgtccaatacctgcttcctggcc

SEQ ID NO: 6878135 - DNA, 61 bp, Homo sapiens
aatccattaaaaacaagcgcatgcaaatcgtcatttactgcagtgactgggagaatggatt

SEQ ID NO: 6878136 - DNA, 129 bp, Homo sapiens
ttccatgaatttccttagcccttgatcctaaactattgagaaagcttacatatccaaaatgagtctaacttttctaagcaatggtcttgggagatgtacatatttcactagggcttcctggagctggaa

SEQ ID NO: 6878137 - DNA, 63 bp, Homo sapiens
tgtactgggcattgctgtggacctgataccaccctccatcactctgtaggctgtccatgtgca

SEQ ID NO: 6878138 - DNA, 57 bp, Homo sapiens
gctggatcatatggtggttctatttttaattttttgaagaacctccataatgactgc

SEQ ID NO: 6878139 - DNA, 80 bp, Homo sapiens
gtattaggttggtgcaaaagtaattgcagtacttgccattaatggcaacaactgcaattacttttgcaccagcctaatac

SEQ ID NO: 6878140 - DNA, 64 bp, Homo sapiens
ggagtttctggagatctgcctatgggagggttatgcgaaatgctctgtgtctttggtagactct

SEQ ID NO: 6878141 - DNA, 61 bp, Homo sapiens
gtcagctgtactgtgccatagctcacagccacattgtgatttgggggagcgtatagttggc

SEQ ID NO: 6878142 - DNA, 61 bp, Homo sapiens
tttcctttccctctttcagcaaatatttttatgcgcctttatttgctggagaaaaaggaga

SEQ ID NO: 6878143 - DNA, 74 bp, Homo sapiens
ggcatcccactgggtctggaggccaagggtgggggtggcctcctccacgaaggtttcttggcttatctgggacc

SEQ ID NO: 6878144 - DNA, 57 bp, Homo sapiens
gggagaagcgtacagacatgatttctggaaaaataactgtctgctgagctgctgccc

SEQ ID NO: 6878145 - DNA, 62 bp, Homo sapiens
ttactttactacatccacagatggatttctaaagaatgtcgcctgtgagtatagtaaattaa

SEQ ID NO: 6878146 - DNA, 60 bp, Homo sapiens
cttcctgggctctacttggtgcttgtcaataccaggcacacagaagaagacccaaggaag

SEQ ID NO: 6878147 - DNA, 104 bp, Homo sapiens
ctggagcctgggttctctgcagtggagactctggtcagtgaattcctagtttcctaataggtagacttggtgaatatggtctccttccagagcttggggatcag

SEQ ID NO: 6878148 - DNA, 59 bp, Homo sapiens
ctttataatgttttccatggactgagctattttcagaacaattgggaaccattatgcag

SEQ ID NO: 6878149 - DNA, 112 bp, Homo sapiens
actgaagttgctggtaaacactcatgccacccctttcttcagtattcattgatttgaccaatatggaagctggcagtaaagggtttggcattaactgtgcagtggcttcggt

SEQ ID NO: 6878150 - DNA, 77 bp, Homo sapiens
aagtctgcttttaattagggaggacaaaggtacacatctcacattcaagttgcccattcttcctaatttgtaggctt

SEQ ID NO: 6878151 - DNA, 95 bp, Homo sapiens
tgagctcttcctgcagatggcactggtgttacttggataaagaacatttttgtgttcagcagcttttagtacattgtgcacactggaaaggctca

SEQ ID NO: 6878152 - DNA, 77 bp, Homo sapiens
gcttcatcaccaccctgagaggttgagtgtctgcactgggtgcgggtcctacagccttctcagactcactgggaagc

SEQ ID NO: 6878153 - DNA, 71 bp, Homo sapiens
gtggtgggaattcatagcaacaaagacccaactgtcaacactagatggttatgggctatggatcttattac

SEQ ID NO: 6878154 - DNA, 104 bp, Homo sapiens
cattttatacctgaagaaactgaatcttagaaagatgataggacttgcttaaggcctcttagccagtaagaatatgaatcaggatttattctaggtaggaaatg

SEQ ID NO: 6878155 - DNA, 71 bp, Homo sapiens
tctgtttcctgtagcacctagcagaaactctactgtatagaaggtattcagctagctgttcaatgactaga

SEQ ID NO: 6878156 - DNA, 62 bp, Homo sapiens
tgatagtaatttttacactctcagttccattcataattactgagaaccatgaaaagctgtca

SEQ ID NO: 6878157 - DNA, 77 bp, Homo sapiens
ttgcccctgggaacagtgggttggctcttatgtatcctgcagaggagatgtttcccacactgtttcccaaattgcaa

SEQ ID NO: 6878158 - DNA, 87 bp, Homo sapiens
agcgaaatatttgacaaatccttcagcaatggcctatcattcaacatatattagcacagtgctaggtatttgcagtggtattttgtt

SEQ ID NO: 6878159 - DNA, 71 bp, Homo sapiens
ggattggagacacagcaataactactgttgccatggaagggttaacagtgtaggagctggtttatcagtcc

SEQ ID NO: 6878160 - DNA, 72 bp, Homo sapiens
agccagagcaggggagaaaactgcaggtctaccacatggcaggccagcattctctctccaggccaacaggct

SEQ ID NO: 6878161 - DNA, 92 bp, Homo sapiens
gtggagagatgggcttcaccctgtctgcaagtgtcaattctctatgaggctttatggcactatggatgagactgatttcccatttttcttac

SEQ ID NO: 6878162 - DNA, 66 bp, Homo sapiens
accaatggacaggctgagcttcctcaagtgtcaggcctgggatgtgcgtttagcttgctgtttggt

SEQ ID NO: 6878163 - DNA, 62 bp, Homo sapiens
ttttccaggaagaaaacaggaatcaagtcccacagacggattcttcattatcttctagaaaa

SEQ ID NO: 6878164 - DNA, 125 bp, Homo sapiens
tgggctaaattttttgataaatatcgaagttttctttgatcctgataacccacaaatgttcagcatgagtgagttttcacggtcagcatgcagtggttttgatatttaacttaagctctagccca

SEQ ID NO: 6878165 - DNA, 106 bp, Homo sapiens
tgtgccttagtttttccatctgtaaaatgttgttagttttggcatttacctcatagggttggtgtgagaagggaatgtaaagcaaatggaaatagtagctggcata

SEQ ID NO: 6878166 - DNA, 71 bp, Homo sapiens
ctggagacaaggagcggggcagggccctgggtgagacaggaggcagctggcccctttccttgttaatccag

SEQ ID NO: 6878167 - DNA, 64 bp, Homo sapiens
gtcatgaaattctagagcttgaagggactttaacaaatctagcccagccctttgattttatgac

SEQ ID NO: 6878168 - DNA, 113 bp, Homo sapiens
atcctgccatttggtccagaaagccagtgcacaagtagaggaggggacatagcttagccacaaagtgatggagcttcctctgctagccctttgtgagccaatggtaaatgggt

SEQ ID NO: 6878169 - DNA, 60 bp, Homo sapiens
gtcaactatggataaagctgctgcaagtatttgtatacaggtcttgtccattgtgtgggc

SEQ ID NO: 6878170 - DNA, 61 bp, Homo sapiens
cagagattctcagaagtactaggaatgagtagatgggacttcctgggagtctgagatcctg

SEQ ID NO: 6878171 - DNA, 70 bp, Homo sapiens
tgaggctggaggatcacttgagcccaggagtttgaggccagtatgggctatatagtggtaccccatctca

SEQ ID NO: 6878172 - DNA, 57 bp, Homo sapiens
ggtagccctctccagcgaggtctgagagcagctctcagattctggcagatggctgcc

SEQ ID NO: 6878173 - DNA, 57 bp, Homo sapiens
agcagccagagaatgatgcagtatgattaactgttggagaagatctctctagctgct

SEQ ID NO: 6878174 - DNA, 80 bp, Homo sapiens
cagtttcctacaacttagtgtaatgcagtacagtatgtcaagagacctgggctgcaggcactaattggcaagtgacgctg

SEQ ID NO: 6878175 - DNA, 67 bp, Homo sapiens
tgttcttgcctggattcggttgttgtcattttccactgaatgtaatcacagggccatggtaataaca

SEQ ID NO: 6878176 - DNA, 99 bp, Homo sapiens
aatcagattagaccaggctttaccacttgctaaggacatgggtgaatttgtatgcagattgattcacagagtggttagtggtagtctggtatcgtggtt

SEQ ID NO: 6878177 - DNA, 81 bp, Homo sapiens
gtgctgctgcctttggcaataattgtaattcaatttatgcatccacaaaattatccaatcctgttgcctatgcagtgtcac

SEQ ID NO: 6878178 - DNA, 94 bp, Homo sapiens
ggtgatccaagggcctgggagctggcctcaggcacaggagggctgctccaacccagcctcaggtcaggccagctccttgaggccctggtacacc

SEQ ID NO: 6878179 - DNA, 65 bp, Homo sapiens
caggacctggggctccatcttgcagaacagctcgtggctcttccaggacctggggctccatcttg

SEQ ID NO: 6878180 - DNA, 96 bp, Homo sapiens
ttttctgatgtattgaatatgaggggtgggttggggaggtggacagggtatagaggactgaaccctaaggcacttcaatgtttagaaatcagaaag

SEQ ID NO: 6878181 - DNA, 63 bp, Homo sapiens
gcctatgtctttataaaaatgtttcctttagaagattagctgatgggtttctagagacgaggc

SEQ ID NO: 6878182 - DNA, 82 bp, Homo sapiens
cgggagggactgttaacctgggtctggccacagctgtgcggagcggctgggttcggctgcaggccacacaccctgtgacctg

SEQ ID NO: 6878183 - DNA, 87 bp, Homo sapiens
gagaattgcttgaaccctggaggtggaggttgcagtgagccgagattgcaccattgcactccaccctaggcaacaagagcaaaactc

SEQ ID NO: 6878184 - DNA, 57 bp, Homo sapiens
gcatttgttggtcagattgtagtcaacacagatgactcaagtagcccaattagatgc

SEQ ID NO: 6878185 - DNA, 62 bp, Homo sapiens
aggccttgggatgtggctgcagctgggtcagtcagccaggctgaagcccactccctgggtct

SEQ ID NO: 6878186 - DNA, 57 bp, Homo sapiens
tgctgctgactgtccagaattcctaggtggatacagtccccttggtagacagctgca

SEQ ID NO: 6878187 - DNA, 60 bp, Homo sapiens
gcgggtggagacagagggcataaaagataacattgattttaggcctcctttttcattcac

SEQ ID NO: 6878188 - DNA, 68 bp, Homo sapiens
cttaagttcactctttatgagaaagtgctgccaaatttagcattccttattcagggggagctacagag

SEQ ID NO: 6878189 - DNA, 55 bp, Homo sapiens
tgattgaagaggtgaggaagtttctcccttagctttaatcccctctgtctagtca

SEQ ID NO: 6878190 - DNA, 55 bp, Homo sapiens
tacagaaaaacatctggagccgtaaataagttgagcagcccggatacattctgta

SEQ ID NO: 6878191 - DNA, 129 bp, Homo sapiens
tcaataagaaggcaggtgtgtgttgtttattacctccaaacatttgggaccctctcttcactgcataggggccgtgagtactggagttccaaaaggagagtgggacacacatgaaacccattttaatga

SEQ ID NO: 6878192 - DNA, 106 bp, Homo sapiens
tcaggattctgcttggagcatgtgtcgtagggatgcagcagttcagaagtcaataaacctcagtgagctcatagctcttattatgtacaaaatctaacagccctga

SEQ ID NO: 6878193 - DNA, 102 bp, Homo sapiens
aggtaagcacagggggcatcaggaaaggaatgttcctgaacacaagatcaccttggagctgccatctgtgtgttcaggaagtcctggggctccctccttcct

SEQ ID NO: 6878194 - DNA, 95 bp, Homo sapiens
cctgatacacatttttctggattttagatttaagaataaggtatttgcacaagtatttatttcctttctgataagtaatctggagagataccagg

SEQ ID NO: 6878195 - DNA, 81 bp, Homo sapiens
ttcatctgtaaatggaagtgtctctgggacctgctcagctctgacctgctttgggtcctttttggacttcttcaggatgag

SEQ ID NO: 6878196 - DNA, 68 bp, Homo sapiens
ggatccagagctctgttactcagcctcttcttcaatccctgaggcagctaagcagaattctagggttc

SEQ ID NO: 6878197 - DNA, 79 bp, Homo sapiens
tcctaagtgtaataatgcatattctttttcggatgcttataatatggtgttggtaaatagcttagcaatgcacatagga

SEQ ID NO: 6878198 - DNA, 65 bp, Homo sapiens
aggagtttgcaagtttaacaagccacccaattatcctggtgcaggtggtccatttgggaacttct

SEQ ID NO: 6878199 - DNA, 91 bp, Homo sapiens
ggaagttaaaatgaaacagtgtgtatagcaaaaaccttgccttgtaaattgacttttgtgcctatacatgcgactggttttatgtaactct

SEQ ID NO: 6878200 - DNA, 64 bp, Homo sapiens
gctgagatgtctgtaattctaagcatgtgtcacatggatctttacttacagacacttccatagc

SEQ ID NO: 6878201 - DNA, 93 bp, Homo sapiens
gagtagctgggattacaggtatgcgccaccttgtccggctaatttttgtatttttaatagagatagggtttcgccatattgcccagactgctc

SEQ ID NO: 6878202 - DNA, 74 bp, Homo sapiens
tcaaatacaaggtttttggtttgtgtatctgaaagtgcttagtatatatgaggaaccacaaaccaagtgtatga

SEQ ID NO: 6878203 - DNA, 58 bp, Homo sapiens
gctgtgcccagccattctagatactgtccgggaggacaccttagaagcttaggacagc

SEQ ID NO: 6878204 - DNA, 92 bp, Homo sapiens
ctgtgtgactcaccatttgctcagacagacatttgagggtcacgcttttccattaaggtttgtggggagcaaaagatgggtagataaaatag

SEQ ID NO: 6878205 - DNA, 58 bp, Homo sapiens
gccagaagtgtctatcaagatgtcaaatataattgtacttttggtgatcatatttggt

SEQ ID NO: 6878206 - DNA, 88 bp, Homo sapiens
tccatttcgaagtgatggcagttttagaacttttcaatgcacttttgtggaggctcctgaagagtttaaaaagccatcaagtgaagga

SEQ ID NO: 6878207 - DNA, 77 bp, Homo sapiens
gtgcgagggtcccaggaggtgcttcctaggagccggccctgagggctcttctgggaagggcccctgaggcatgacac

SEQ ID NO: 6878208 - DNA, 67 bp, Homo sapiens
aagggatggcagcggagctggaaatgattacaaagtcagagaatgagtccatcaattgccacatctt

SEQ ID NO: 6878209 - DNA, 69 bp, Homo sapiens
atgagaaggacataaattatagaggtctaggaacagaatgcaatggactgaacatttgtgtccctccat

SEQ ID NO: 6878210 - DNA, 65 bp, Homo sapiens
ggggccactggcaggaccttggcactcctccccctccatgtgagccaagctgtcctgttggccct

SEQ ID NO: 6878211 - DNA, 60 bp, Homo sapiens
cagcaggaagtactagctttgaatccaggattcctgcctcccagactggtgctgctgctg

SEQ ID NO: 6878212 - DNA, 64 bp, Homo sapiens
agcgagtgagggccaacatccagcttcagcagggaggagaggctggccagggccctcgctggct

SEQ ID NO: 6878213 - DNA, 75 bp, Homo sapiens
ggtcacatgagatgctgccctctaccttgcagaatgggccatcgagaacccggcagccttctctcataggtgacc

SEQ ID NO: 6878214 - DNA, 58 bp, Homo sapiens
ggggagcgccagcatggacaggaagtagcacatgggctggtgcaggctggggttcctc

SEQ ID NO: 6878215 - DNA, 58 bp, Homo sapiens
tgttgggatggagattttataggttcagacaaatcttctagatctgcttcacccagca

SEQ ID NO: 6878216 - DNA, 91 bp, Homo sapiens
ggagggacagtatagtggtggggagcaaatcccttacagccgggctgcctggatttgcaatcctcgtcatgccactgcaagctgactcttc

SEQ ID NO: 6878217 - DNA, 80 bp, Homo sapiens
tttctaaactagttagtttgcattatttgtatagttaaaagataatgcttatgttatgcaatttgcttgtagtttagaaa

SEQ ID NO: 6878218 - DNA, 56 bp, Homo sapiens
ttcagacaataagagtcatctcagggcttctgctgggaaaactttccttgtctgaa

SEQ ID NO: 6878219 - DNA, 83 bp, Homo sapiens
gaaatgtcaagttgaacggctggaattagataacattttgaaataatagcaagatgtgcctaatcagacctagctatcatttc

SEQ ID NO: 6878220 - DNA, 57 bp, Homo sapiens
atgacagaccctctaaagacaaaccctcctgttgagtcgttagagtagtttgtgcat

SEQ ID NO: 6878221 - DNA, 79 bp, Homo sapiens
ttggtggaagcagggacatcagttaggaggccattataatacagtaatccaggagaaaactgacggtggtttgtaccag

SEQ ID NO: 6878222 - DNA, 78 bp, Homo sapiens
agccctcattatcacacgccttgcttcatttactttatcagaaagaaaatggtggtggtggtggtggtgagaatggct

SEQ ID NO: 6878223 - DNA, 60 bp, Homo sapiens
gagaattctgttcttcgggtgtgtggtgctaagattgttgagcgctcccacagaggtctc

SEQ ID NO: 6878224 - DNA, 62 bp, Homo sapiens
tgccagaaggagggagcagggatcctatgagcctgacatcactgcttcctctcttcatggca

SEQ ID NO: 6878225 - DNA, 81 bp, Homo sapiens
gcattttcacacattatctcattaaatactcaaaattacctagtcaagttgagtattaagtgagataatgtgtgaagttgc

SEQ ID NO: 6878226 - DNA, 55 bp, Homo sapiens
tgtgctaggtgcttgttctcctctggcaaccacagagcccagtgacatcagcaca

SEQ ID NO: 6878227 - DNA, 76 bp, Homo sapiens
tgctattttaagattcttattaggtaattttcttgtggtaaaaaggctttgcttgacttaagaatccactgaagca

SEQ ID NO: 6878228 - DNA, 64 bp, Homo sapiens
tcctgagctttacagtaaggacattcatggcatttcccaagaggccttgccagtagggctggga

SEQ ID NO: 6878229 - DNA, 130 bp, Homo sapiens
cgcacatttggggtgagtgctcagcccaggagcgcacatttggggtgagtgctcagccccggagcgcacatttggggtgagtgctcagccccggagcgcacatttggggtgagtgctcagccccggagcg

SEQ ID NO: 6878230 - DNA, 58 bp, Homo sapiens
taaagcagccagggtctaagccagaagcaatcaaaggctgattctggtctacgcttta

SEQ ID NO: 6878231 - DNA, 66 bp, Homo sapiens
caccgaactttgcaaatgcaattttaaaaatccctccccctattgcaaaatttgcagagttcgatg

SEQ ID NO: 6878232 - DNA, 55 bp, Homo sapiens
gatgccttaggtcatgactcttggaaccagtagaccacagagggctcaaggcatc

SEQ ID NO: 6878233 - DNA, 55 bp, Homo sapiens
gctatggaaagagcatctaggccttttactgctacataaatgtactgtccatggc

SEQ ID NO: 6878234 - DNA, 55 bp, Homo sapiens
cccaggcaggagtgcagtggcatgatctcgggtcactgcaagctccgcctctggg

SEQ ID NO: 6878235 - DNA, 75 bp, Homo sapiens
agaggcagggaaggaaaggtctcatgcctttcaggttgacactaagaaagaggcttccattcctttccctgttct

SEQ ID NO: 6878236 - DNA, 73 bp, Homo sapiens
tctatggaggtcagtggttcctgtgagcatcataatgactaatgttcacagtaatgattctgagtctctagga

SEQ ID NO: 6878237 - DNA, 72 bp, Homo sapiens
tgtgtatagacagtgtgattttgttcatttggctgggccagataaatgagttcatatttttatttgtacaca

SEQ ID NO: 6878238 - DNA, 65 bp, Homo sapiens
gcctccttctcctcgggaggccaggaggacccgggtcactttgccaattctgcggagggggaagt

SEQ ID NO: 6878239 - DNA, 110 bp, Homo sapiens
ctatggaacatatttcagattgatacattattgttaaagaacattagcaaaagccacattttcttcatagcagtagcaccttgtgagagaactgaggtataggttcttag

SEQ ID NO: 6878240 - DNA, 101 bp, Homo sapiens
aaaatagtttcttccagagcttagaatttcagatgattggaaaattcatacatctaggtctgaaagtttaagtctttcgcatctatggagatctctatttt

SEQ ID NO: 6878241 - DNA, 109 bp, Homo sapiens
gaagaagtatgcagggctgggcagtccaggtgaatggtagggtttagggtactgcaaagcatctctgagcttttattatcaacctgtcttaacttgtatttataaattc

SEQ ID NO: 6878242 - DNA, 85 bp, Homo sapiens
ggggcaaagcagcatcttcttctctgggggaactgcgacagcagtggctgttggttacttcagtggagaaagctgcagatgtcct

SEQ ID NO: 6878243 - DNA, 129 bp, Homo sapiens
ttgttatcgaagggctctttttgagggggaaaaatggcaacagaagggagttccctgcaccagcaaaaatgcccatgagaagccttctgttgccatttttccccttcaaaaagagtccttggataacaa

SEQ ID NO: 6878244 - DNA, 90 bp, Homo sapiens
atggatatctctggtgttttagcattaaagaccactggctaatagtgaacaatagtggtctttatcatcttaagacatatagatgtctat

SEQ ID NO: 6878245 - DNA, 67 bp, Homo sapiens
tcctacagaatgatattatttcgtgctggcacattaatgtttccagcacgatactgtcattcctgga

SEQ ID NO: 6878246 - DNA, 68 bp, Homo sapiens
taggctgaggcccatccatgctgctggtctccagggctggaagcacgtgtggatggaccccactccta

SEQ ID NO: 6878247 - DNA, 61 bp, Homo sapiens
caaattccatttacaaggactagatgggaatatctagtagcgtattgaaaatgtgagtttg

SEQ ID NO: 6878248 - DNA, 62 bp, Homo sapiens
gcttctatagcttcaaatgctatagctctctttttgagagctattttgagtttgctggtagc

SEQ ID NO: 6878249 - DNA, 61 bp, Homo sapiens
agcctgggtccttgctgattgctgagcgggcagtgcagctttgtcatgaggacactttgct

SEQ ID NO: 6878250 - DNA, 59 bp, Homo sapiens
ctgtggctctttagttgagcaccccgattcccttgtgttctcccctttagggcctacgg

SEQ ID NO: 6878251 - DNA, 70 bp, Homo sapiens
gttaattcagtcaacataaatccaaggtcttaaggttattaaggactttggaaattatgtgtgaaataac

SEQ ID NO: 6878252 - DNA, 59 bp, Homo sapiens
ggcttgcttcacctacccccagctcatgaaagagggcttggggccagatgaaggaagtt

SEQ ID NO: 6878253 - DNA, 91 bp, Homo sapiens
tgtgctaagggaccatagctaaagcatgactcaagaattactcagtttggagtctgtgaggttatgctttctctactgtttcctaagtacg

SEQ ID NO: 6878254 - DNA, 116 bp, Homo sapiens
agtgttctgctcatttgtgtccatccggcttgttcgaggcctaatatgggtttatacattttgggcgaggagggggcaacagggtgtgaatatcgtttacaagttgcaagaacatt

SEQ ID NO: 6878255 - DNA, 66 bp, Homo sapiens
gtgctgctgccgcggccgccctgctcgtggaagggaggaggaggaatgtggaaggtggcggcgcgc

SEQ ID NO: 6878256 - DNA, 67 bp, Homo sapiens
tcctctagtgtgcaactgatattataaacatgcttttaaaggaatttcattgttgcatggtaggggg

SEQ ID NO: 6878257 - DNA, 101 bp, Homo sapiens
gatatatgagtcagaagttcagaatatattcatgttgtcaggtctggaagtactgttttgacagtgagggtgtagcatttagatgatctgacaaatatatt

SEQ ID NO: 6878258 - DNA, 57 bp, Homo sapiens
ggccagagggagggcacaaatctggaagctgaggttagagtgctttgccttttggcc

SEQ ID NO: 6878259 - DNA, 106 bp, Homo sapiens
atcacatggccaagatgtagctaacaagatcatggtttatctgggagacgagttgtgtcttcacagaataaactcattatctcatcatagatggtgttggcctgat

SEQ ID NO: 6878260 - DNA, 99 bp, Homo sapiens
gaggtgggaggattgcttgaacccaggaggcaaggttgcagtgagccaagatcatgccactgcactccagcctgagtgacagagcgagacccctatctc

SEQ ID NO: 6878261 - DNA, 63 bp, Homo sapiens
aggtgtccaggaagatgctggcctggccaagccatttgtctgggcccttcttgctggaggcct

SEQ ID NO: 6878262 - DNA, 115 bp, Homo sapiens
gccttggttctgcaggcaaccccagccctgcatggccacgtctgggcagaccggcacccctaccctgacacccatctgtgccagtcctgcacggcaaacacctcagagcccaggc

SEQ ID NO: 6878263 - DNA, 77 bp, Homo sapiens
acacatgtacacacaatctctggtcagtattcctattaggaaatgtgccacatgatattgtctctatgtaagtgtgt

SEQ ID NO: 6878264 - DNA, 56 bp, Homo sapiens
ctgcccagaagccagatgggcactggaggaaggccaggtcttggcatttggggcag

SEQ ID NO: 6878265 - DNA, 58 bp, Homo sapiens
aatgtgaaactgctgtttatgggggtcaagtacgaccaaagaacagcaatttcatgtt

SEQ ID NO: 6878266 - DNA, 58 bp, Homo sapiens
cgcccaggtcctgccttggttaccctgcactgctggcagcgtatggcagggccgggtg

SEQ ID NO: 6878267 - DNA, 87 bp, Homo sapiens
aaattcctgaaattcttctctttgctttgtctatatgcaaaaagcccaaatgttgcatagacacaagagaagggtataattgagttt

SEQ ID NO: 6878268 - DNA, 63 bp, Homo sapiens
gaagtcagcagttttatatgcagcttcaatgtaaaacacaaggttctgtatgaaattgacttc

SEQ ID NO: 6878269 - DNA, 86 bp, Homo sapiens
catatagttttgcaagatgttaccactgggggaaactggttaaagggcacacaggatgtctctgtaatatcttttacaactatatg

SEQ ID NO: 6878270 - DNA, 84 bp, Homo sapiens
tattaggttggtgcaaaagtaattgtgggttttgccattacttaaaatggtgaaaaccacaattacttttgcaccaaactaata

SEQ ID NO: 6878271 - DNA, 80 bp, Homo sapiens
gccgttacttggccattatttggctgcagagtccactgagctacacaggcaccctgcagagggatgggggcagtacaggc

SEQ ID NO: 6878272 - DNA, 60 bp, Homo sapiens
ttagattctaagattctaagaatctctgcgtctagaggttctaagattctcagagtctgg

SEQ ID NO: 6878273 - DNA, 78 bp, Homo sapiens
ttgtgcctccttgtactgatatgaagaatcaagatgagattttgattttgcatacatacaagaattttgaggcttcaa

SEQ ID NO: 6878274 - DNA, 57 bp, Homo sapiens
ggatttaggttcgggtagttgggagaagtagatgttccagcagagccctgaagatcc

SEQ ID NO: 6878275 - DNA, 79 bp, Homo sapiens
tgtggttatttagttcagtagtccttcattgtacctcaaggttgtgatgaaattttaatgaattaagttgaatagctca

SEQ ID NO: 6878276 - DNA, 59 bp, Homo sapiens
gcaaaagaaagcctccaaggatcactatcaggatgctggtccctgggacctttccctgt

SEQ ID NO: 6878277 - DNA, 63 bp, Homo sapiens
gctgattctgggaactttgtctctcagggcactgattctgagagcattatttctagaagctgc

SEQ ID NO: 6878278 - DNA, 72 bp, Homo sapiens
tacagatatatagtgtgtgcctccttcctctggacgaagagagttggtctaaatacacattgtattctagtg

SEQ ID NO: 6878279 - DNA, 74 bp, Homo sapiens
tcctttgacctttttactgtgtacgctgtgcttggtgctttacttcagctacttgcagtggaaaagaagaaggg

SEQ ID NO: 6878280 - DNA, 74 bp, Homo sapiens
aatacatgcccaggggagtagtcaatttatttttattcttgttgttatgagttgactattctgggtgcagtatt

SEQ ID NO: 6878281 - DNA, 74 bp, Homo sapiens
ggacgaatttagtgctgggcaaaatgcatttcctgccttttaaaggaatatggatttgctcagctgaggactcc

SEQ ID NO: 6878282 - DNA, 78 bp, Homo sapiens
tgctcaagagatataaaaatgtgggccatatgtagccccaagaaatgcattttatcacattttcatattctctgagca

SEQ ID NO: 6878283 - DNA, 68 bp, Homo sapiens
gtgggagtcgcgggaaggatagaactgccctttctttttctggtggcttttaaacctgtgactgccgc

SEQ ID NO: 6878284 - DNA, 64 bp, Homo sapiens
gagcttctcaagagaaggacatcgaaaattctcacttggtctatgtagtctctttgggaaactc

SEQ ID NO: 6878285 - DNA, 66 bp, Homo sapiens
aagaaaagcatctttgtagtagtgctggaaaactattcagaatatacagataaaaatgctgttctt

SEQ ID NO: 6878286 - DNA, 98 bp, Homo sapiens
acttggaccctcatcccagatatgtatcatggacatgagacttgaaaggcagttttgcaaccattaaggtaaccatgttgagatttcagggtccatgt

SEQ ID NO: 6878287 - DNA, 71 bp, Homo sapiens
gtattgtcatagaggcctatataatttaggaaaacaaactctggaaaatttatgcttctctgtggaaatat

SEQ ID NO: 6878288 - DNA, 59 bp, Homo sapiens
aggaacattctcatttcctgccaacacctcacagtgctgggtttgactgagatgttcct

SEQ ID NO: 6878289 - DNA, 60 bp, Homo sapiens
gaacagtagcacctatgattttgtattttcatacaatattagtggtgttatgaattgttc

SEQ ID NO: 6878290 - DNA, 62 bp, Homo sapiens
tcagaaatgtctgcaaacctaagttgtgtttagaaacaaagctatgaggcatgcatttctga

SEQ ID NO: 6878291 - DNA, 55 bp, Homo sapiens
cagggacttaggtatattatgggatagaatattatgatttatgcccaagtccctg

SEQ ID NO: 6878292 - DNA, 57 bp, Homo sapiens
gtaacttggtcatttctgagacttcctgaagtaggttttccagactgtccaggctat

SEQ ID NO: 6878293 - DNA, 62 bp, Homo sapiens
agctgacattctgtactgtgagcagtgagctgctcccatgtctggcagctgcagttgtagct

SEQ ID NO: 6878294 - DNA, 67 bp, Homo sapiens
ttagccatttgaggtcttcatttattttcctgtctttctgatacagtgagtgacctccagtgcctga

SEQ ID NO: 6878295 - DNA, 64 bp, Homo sapiens
agacatttcctgtgaacctactacatacatgaaggtcatcagagtaggtgataggaaagtttct

SEQ ID NO: 6878296 - DNA, 61 bp, Homo sapiens
tagaatctgccctttttgagcattcagaaatcactctaaaatgtcaaacagagcagagcta

SEQ ID NO: 6878297 - DNA, 72 bp, Homo sapiens
gtgtgtgctcgtatgtatgtgtgcagctacgtatctatgtggaaacacccacgcatgcatatgtgtgtgcat

SEQ ID NO: 6878298 - DNA, 117 bp, Homo sapiens
gtggtagaaacaggaaaagaaaaggtggagggaagattgaagggcactccagtggtcattgtttcctaaggaggcccagtagtgctgcctttatataactttctatttgattaccat

SEQ ID NO: 6878299 - DNA, 78 bp, Homo sapiens
tatttagaaacatctttgtagtgttctccttcgttcttttgtatctaggatgcattttaacaaggagtattctatgta

SEQ ID NO: 6878300 - DNA, 63 bp, Homo sapiens
aggtagcccttggggcctatgcaagctgctattgtacttagaatgggacccaatgggtagcct

SEQ ID NO: 6878301 - DNA, 61 bp, Homo sapiens
ggatatctgcatataatttctgactttagggatacaggagtaatgagtgatgcagatattc

SEQ ID NO: 6878302 - DNA, 61 bp, Homo sapiens
ggtggattgaactaagatggtagcaacagatagggagctatggtaatgttcagtatccact

SEQ ID NO: 6878303 - DNA, 60 bp, Homo sapiens
ggattcctgtttgctatttcagagatactatggttcttatagacagtggcagcaggctcc

SEQ ID NO: 6878304 - DNA, 59 bp, Homo sapiens
agactcagccacacaagactacttccttcaggagatgttggtttatgtgcttagggtct

SEQ ID NO: 6878305 - DNA, 64 bp, Homo sapiens
agagtccaggcatccctcccatagcccatagccaagtatgggagaagggtgcttcagggtctct

SEQ ID NO: 6878306 - DNA, 85 bp, Homo sapiens
gtaaagtcaacaaagccagcaggtgcagaattccacagttcccttaattgtggaattctgcacctggtgattttgttgattttac

SEQ ID NO: 6878307 - DNA, 75 bp, Homo sapiens
agatgctgaggttgtggagtgcattgaatagttttaaataagataaaggcagtgcgactccaaatttagccatct

SEQ ID NO: 6878308 - DNA, 113 bp, Homo sapiens
aaatttttaatgatctttgctcatattgatcatttagtacttgtaaactagtgacccacactctgttttggtaaataatcaactttgagagcaaaagttatttaaataagttt

SEQ ID NO: 6878309 - DNA, 109 bp, Homo sapiens
ccctgggtgtggcatcggggcatggctgtgagcaggcagcttcagagcaaggtgggttgtgtgaaggaggtggctggctcagagccaggccttcagctgaggcctgggg

SEQ ID NO: 6878310 - DNA, 55 bp, Homo sapiens
agtcatttctgcttccatggctcttcacagttggacactaaaagcagtgatgact

SEQ ID NO: 6878311 - DNA, 90 bp, Homo sapiens
ggaaagattgctctatcacagtgatgggatcctagcatgttataaatcgaagattgttctttcctgccactgagatgagcagctctttct

SEQ ID NO: 6878312 - DNA, 85 bp, Homo sapiens
cttagaacatgcaggactttgtggatgatggaaggaggctagattttcttatccatgttaggtaaaggcactggatggttttaag

SEQ ID NO: 6878313 - DNA, 67 bp, Homo sapiens
ccttgcctctaattagctctgtgaccctgggcaaaactgtccacttgcattaatgtggaggcacagg

SEQ ID NO: 6878314 - DNA, 76 bp, Homo sapiens
gtcgactgcactctctccttagctgcagaccatgcacagtgcctggggcggaaggaggagaggtgttgcggtttgc

SEQ ID NO: 6878315 - DNA, 61 bp, Homo sapiens
tgaacataacaggtgcccaggaaggagataaaacctgcttcactggaatctgtaatagtcg

SEQ ID NO: 6878316 - DNA, 58 bp, Homo sapiens
ctttgagtcatcggatgtgtcattggccccatttgacagatgaaagtgtggctcagag

SEQ ID NO: 6878317 - DNA, 69 bp, Homo sapiens
agctctgaggcttgttctatgtatgatctgattaaggaagatttcatattggaaccagttaacagagct

SEQ ID NO: 6878318 - DNA, 102 bp, Homo sapiens
ggaggtgacagtgagcagaggcctgggtcctggggctctggcgggccctttccagcctcagctctgccccaggaactcagcccctctggccctggcacatcc

SEQ ID NO: 6878319 - DNA, 129 bp, Homo sapiens
ttcttttttttttttttttgagatgaagtctagctctgtcacccaggctggattgcagtggctcgatctcggctcacggcaacctccgcctcccgggttcaagtgattcttctgtctcagtctcctgaa

SEQ ID NO: 6878320 - DNA, 56 bp, Homo sapiens
catggttaaaatatggaaaatccagcttttcctagggagtccaaaaattagccatg

SEQ ID NO: 6878321 - DNA, 75 bp, Homo sapiens
cttacagcattcagagtctgcacaacagcactgacatccctgcttcatgtgcaactgtgagtacccatctgtaag

SEQ ID NO: 6878322 - DNA, 56 bp, Homo sapiens
tggcatgttctcttagcagctcccttaacagggtgaggtagggcaggtacgtgcca

SEQ ID NO: 6878323 - DNA, 83 bp, Homo sapiens
ggtcccccaggagcctttgacaaggatgtaaaggacacattaaaaagatgtggccttaggttctagtggctctggtgtgggcc

SEQ ID NO: 6878324 - DNA, 73 bp, Homo sapiens
acaggttgtatagtcttctgtgctcaaaactttccaagaaagcaattctttgagaagcatggctgtattctgt

SEQ ID NO: 6878325 - DNA, 80 bp, Homo sapiens
agttcgataacactctctgttggtaaggctgtaaggcagcagaacttttacccattgctagagagagtgtgaatcgctct

SEQ ID NO: 6878326 - DNA, 111 bp, Homo sapiens
ttctgctgtgtagttttacatggtcccattctgcgttaatgttttatgcatgaggtagcctggctggatttaaggcagagagggccagttcttgaacctgagatagcagaa

SEQ ID NO: 6878327 - DNA, 70 bp, Homo sapiens
cgctggaatccacggcaacactgggcccagctttcctcggtgtgcgggtgctgtggaaggagctccggtg

SEQ ID NO: 6878328 - DNA, 78 bp, Homo sapiens
cttgaaggaggtgatggagttagtcaagtgaattttgagaacagatgtattacactttcttcttcaagctccatcaag

SEQ ID NO: 6878329 - DNA, 84 bp, Homo sapiens
aaactctaaactgttttgcaaaccggagctctgcaagccatattgagctcacacaagcctttggtttgttggaacatagaattt

SEQ ID NO: 6878330 - DNA, 102 bp, Homo sapiens
ttcctctggtcccagactgttcacctggagctgtagccaccaccctgcccttaggttaactgcctcgagtggtagtttagctctttgtgctgtgccgaggga

SEQ ID NO: 6878331 - DNA, 78 bp, Homo sapiens
tctggcagagatatccatcccagagccttcccctgtccttgtaccgtggctcacatatgatgttgtgtctctgttaga

SEQ ID NO: 6878332 - DNA, 130 bp, Homo sapiens
agccagttttggttgtcataactggagtgggacatgctgtgttacttggcatctaatgggtatagattagggatgctgggagacagcaggcagttcacacatcacccccacaacaaagcagtatctggct

SEQ ID NO: 6878333 - DNA, 56 bp, Homo sapiens
ctgagtactgagccctggacgctaggctgccttagtccagaggaggacagactcag

SEQ ID NO: 6878334 - DNA, 62 bp, Homo sapiens
agcagcaaagccaggggatggggatggatggccggggccagccctcactcctgggtttctct

SEQ ID NO: 6878335 - DNA, 58 bp, Homo sapiens
acagtgattctgcaaaccatatcgaacccatgttagatatttgcattctagtcactgt

SEQ ID NO: 6878336 - DNA, 76 bp, Homo sapiens
gtggttcagtggggggcctccaacccgaggggctgcttctccccttggacacagctggcctttccactggacaggc

SEQ ID NO: 6878337 - DNA, 64 bp, Homo sapiens
acagacagacagagaactattcaaaactccaaacttccaatattgaacatctctggatgtttgt

SEQ ID NO: 6878338 - DNA, 68 bp, Homo sapiens
acgcttgccgtatccttctccagtcgtatttttatccaaaagaaggacctggaggaggatgagagcgt

SEQ ID NO: 6878339 - DNA, 62 bp, Homo sapiens
aaaagagaattggagtgtaagaggctctcggaattttcctcagccctctccaattccctttt

SEQ ID NO: 6878340 - DNA, 76 bp, Homo sapiens
gttctggctagaaagttaaacagtgataagaaattatgaagaaatttcacatcaaaaacaattttcagagcagggc

SEQ ID NO: 6878341 - DNA, 67 bp, Homo sapiens
tccaaatgcatcagctcataagagattccacctaaggatctaaactgctagctgactgagatctgga

SEQ ID NO: 6878342 - DNA, 55 bp, Homo sapiens
ttctcttgtgccaagttgttgcctcctccctcccagcccttaggacataagagag

SEQ ID NO: 6878343 - DNA, 77 bp, Homo sapiens
gtgggttggagtctgtgatgctctgggtctggtgactagaacttttaccacagttgccataagaaccaagtgcctat

SEQ ID NO: 6878344 - DNA, 70 bp, Homo sapiens
gggttaaataaacatgagcatctcttcaagctttgaaattctgtggtttggggatgtgtatgtattatcc

SEQ ID NO: 6878345 - DNA, 86 bp, Homo sapiens
gagggatttttgaagcattgctaaagctaattttttgcgtcaatgaaggagatggctttgcccaatgcagtactaaaactctcctc

SEQ ID NO: 6878346 - DNA, 62 bp, Homo sapiens
ccatatttggcgtctctcaggagctcaggaagtacttggctgagtgaacatgtccattgtgg

SEQ ID NO: 6878347 - DNA, 77 bp, Homo sapiens
cttgtgaacagatgacataaacttaacagtattgataaataaagtacagtactctcagtgtgttttctcttcttaag

SEQ ID NO: 6878348 - DNA, 82 bp, Homo sapiens
gagctttttcatagatatctttcttatttgaagaaagatagtatctatctgttttagataagaaaggcttgtgcaatagttt

SEQ ID NO: 6878349 - DNA, 77 bp, Homo sapiens
catgggaagccgcagatgctgctatttcaccctgggctctttgggcctcagaatagtaaaagacatctgattccatg

SEQ ID NO: 6878350 - DNA, 56 bp, Homo sapiens
ggatcatttgcaggaaacattaaacaaactgtttaataattgtggcaaatagatcc

SEQ ID NO: 6878351 - DNA, 74 bp, Homo sapiens
tgttgggaacactctgtgtgtgtctaagtaagggtgtattttctcttggaatctccatagagtgatgcccttca

SEQ ID NO: 6878352 - DNA, 75 bp, Homo sapiens
actgataagaaatggagaatgatattccatcatttggaaaatgatagaatattgggctctctgtctaacctcagt

SEQ ID NO: 6878353 - DNA, 69 bp, Homo sapiens
acagaagtttgacatgtttagctcttccaaatatagagttaatctagcagctaaattggaaatttctgt

SEQ ID NO: 6878354 - DNA, 127 bp, Homo sapiens
ttttttcccctgagtcatctgtgattacattttcatgttacagtatattgttcagggatcattgtggagactgaagagaaatgtacacatggctttatgtaggtcatggtgaaagacagagagaaag

SEQ ID NO: 6878355 - DNA, 95 bp, Homo sapiens
atgtatttttttgttctattgatgtcttttatggagatgtcataaaaagaagattatgacttctcattatgaggcagatggaggagaagatgcat

SEQ ID NO: 6878356 - DNA, 73 bp, Homo sapiens
cggggctcaagctggagtacatctttggcggcacttggcaaccccagccccaggagatctgcgcagtgccccg

SEQ ID NO: 6878357 - DNA, 63 bp, Homo sapiens
tattaggtaggtgcaattaaaagtagtggcaaaaactgcaattacttttgcatcaatctaata

SEQ ID NO: 6878358 - DNA, 60 bp, Homo sapiens
cttctttagggatctcttgctgtgtgattgctataggggagccaagaatctctaaagaag

SEQ ID NO: 6878359 - DNA, 108 bp, Homo sapiens
caggaagcttttattttagcagctaaaaggaagagaaagatttactagcataatagcttctggacgagctactattaatagtagatttgattcctgctgtctgtcctg

SEQ ID NO: 6878360 - DNA, 63 bp, Homo sapiens
ggaggcgtgccctggccccgaggctgctgcaccgcctcagcctcactgtcagtgccgtcgtcc

SEQ ID NO: 6878361 - DNA, 81 bp, Homo sapiens
ggaggggtctggctgcttgtgacccatggccctggaccccaaaactcaggctccttgctcacaggctcagccgttccctcc

SEQ ID NO: 6878362 - DNA, 109 bp, Homo sapiens
atgccataatggattgaaagaggatttgggcatagaatttagagacaaaagccccaggtttgattctaagttctgtcaacttctaataaaatgacctcgaacatggcat

SEQ ID NO: 6878363 - DNA, 56 bp, Homo sapiens
ggatggcaaactgggaccagaggatctcctgggccctgggttctggatttgcctct

SEQ ID NO: 6878364 - DNA, 115 bp, Homo sapiens
cctcagcccacagtgagtctggtttctgagttgtcccggtctagccactttcgtttcccctggggccgggtggaggctggggcagaaagcggaactgagcccgcgtgttctgagg

SEQ ID NO: 6878365 - DNA, 73 bp, Homo sapiens
ggaacaatggagcatgagcagaggagatatatgcaagatgggtgtccactgtggtcccttgctgccccgttcc

SEQ ID NO: 6878366 - DNA, 56 bp, Homo sapiens
tcattactgtctaactgtccctgaaatcatgggactttaagctagaaggtatctga

SEQ ID NO: 6878367 - DNA, 62 bp, Homo sapiens
tgcagtggaagaggtggagatcatggcaaagggaatggggtgccacagagcttccacttgca

SEQ ID NO: 6878368 - DNA, 55 bp, Homo sapiens
gcagtaagatgtttcccagagcacaaacgagtgggtgggaggatttcttaattgt

SEQ ID NO: 6878369 - DNA, 87 bp, Homo sapiens
caggttattgcaatattgtatcagaatagcagcttctagatgggttagagcttgttgttactgatgcatttctctgttatgggcctg

SEQ ID NO: 6878370 - DNA, 63 bp, Homo sapiens
agggccacttgtagactggtgagttatatttaatcataatcatcctgcttgacaaatggcctt

SEQ ID NO: 6878371 - DNA, 84 bp, Homo sapiens
tcatactggagtaagatgtgtgattaagctctgagctgagctagtagttttttcagggagtatcacttttacttgaaagaatga

SEQ ID NO: 6878372 - DNA, 66 bp, Homo sapiens
cctgtctatgtctttgtcccactcccagagtctgactttactgatggaacagagatagagcattgg

SEQ ID NO: 6878373 - DNA, 69 bp, Homo sapiens
ttccactgtaataatggtccccaaacactgacccacaaactgggccaagttggaccatatttcaaggaa

SEQ ID NO: 6878374 - DNA, 90 bp, Homo sapiens
agagagagctggagaaacaaaacacattagccctgtggaaaatcacatgatttctaagaaagtaatggttatgattcttaggctttctct

SEQ ID NO: 6878375 - DNA, 57 bp, Homo sapiens
gactatgggttgagattgtttagtgtgactttgacagatccttaactcagcttggtc

SEQ ID NO: 6878376 - DNA, 59 bp, Homo sapiens
gcttgtggagagattttgaggaggttccaggagagaagtctggaaggtttctcttaggt

SEQ ID NO: 6878377 - DNA, 58 bp, Homo sapiens
gggccttccgactcccaaggccctaaatggagtcagagccttgagaatcggaaggccc

SEQ ID NO: 6878378 - DNA, 126 bp, Homo sapiens
atcaacatccatcaaagcagaaataagtggaaggaggcctagaaaagtggttctggaaggctggtgaccatcccaggatgactcagagctatccttttaacttcttagcctttgattccatgtggt

SEQ ID NO: 6878379 - DNA, 59 bp, Homo sapiens
tacagaagtaaataccaaaagcttctgctaaaagatttgaaggtgtttgcttctaagta

SEQ ID NO: 6878380 - DNA, 92 bp, Homo sapiens
tgaagaattggtctcgagagaaaatgcttcactgaaataattcaggaaactgcccttatggcaagtggggcagattctcttcctgtccttca

SEQ ID NO: 6878381 - DNA, 79 bp, Homo sapiens
gagtacgtgagtaagttgtttccctggctaccttcctggggaaccaaagtttgcggggaaagaacacatcaaagtgctt

SEQ ID NO: 6878382 - DNA, 56 bp, Homo sapiens
ggcatggcacagagactcccaagtgttcaagtcacatttgaagttacagtcatgcc

SEQ ID NO: 6878383 - DNA, 87 bp, Homo sapiens
tagggagctttaggaaaatcatgagagatgaaagaatttgaaaaaagtgaagttacatttttacagattgttctgaggtctcagcta

SEQ ID NO: 6878384 - DNA, 69 bp, Homo sapiens
taaaatatgttggtgtccctgctcaaagtgttaataaggatactttggtatcaaactaaaactattttg

SEQ ID NO: 6878385 - DNA, 72 bp, Homo sapiens
gtattattttgaacaatgcgtaaaaggtgaaggccagctgaagaggcctttttgttgtgaacagaataatat

SEQ ID NO: 6878386 - DNA, 57 bp, Homo sapiens
gcagacattttgaatctaggctacagaggttagtgttctggggacagcaatggctgt

SEQ ID NO: 6878387 - DNA, 60 bp, Homo sapiens
ggacaggatggccagctgatattgactcagagtcttatctacacttggcttgtcttgacc

SEQ ID NO: 6878388 - DNA, 63 bp, Homo sapiens
gtctggaaagtttggcttttattttggtcattgaagttaaggcacatgctttggaaaccagat

SEQ ID NO: 6878389 - DNA, 72 bp, Homo sapiens
cagagctttcttacttgggtggtggggagaaagatattttgagttcttttcatcatttaataggtagccctg

SEQ ID NO: 6878390 - DNA, 71 bp, Homo sapiens
aagcatgaaatttgaccaattatttactgatagagttatggaaagatgaagctgtggcagatttcaagttt

SEQ ID NO: 6878391 - DNA, 58 bp, Homo sapiens
tctgcggcctcccaggcgtcggcgcccattctcggggcgcccaagcgccggccgcaga

SEQ ID NO: 6878392 - DNA, 109 bp, Homo sapiens
gcagtcggcaccatcactctggatgcccccaacctggggtctggaccaacggcctggcccagaaatggccctcaggtgacggcgggatgtctaggaaggtgaggactgt

SEQ ID NO: 6878393 - DNA, 81 bp, Homo sapiens
aatggctacatttgtttttcattgtgagactgtgccgtaatttatttaatcagtgccatattgaaagacatttggatcgtt

SEQ ID NO: 6878394 - DNA, 73 bp, Homo sapiens
ttttattataggaatgctggcccagagataggaatatagcaactaattgaggccaaaaagtcctatgaagaaa

SEQ ID NO: 6878395 - DNA, 59 bp, Homo sapiens
agaaggtgggtgaagcttgctcagtatcctgcttaatgctatcagtttcttccccctct

SEQ ID NO: 6878396 - DNA, 86 bp, Homo sapiens
accatgacctcaagaacagtatttccaggaatccccatcttagcatctaagggattcctgggaaaactggaccgtgaggacaaggt

SEQ ID NO: 6878397 - DNA, 55 bp, Homo sapiens
gaggcgtgtttcctgcctatgacaacctcatggatgtgggcagcacagcagcctc

SEQ ID NO: 6878398 - DNA, 76 bp, Homo sapiens
ccaggcccaggtgtcgatgttcctcccaaggaatgattgggtggatgaatgaacactgagatgtacctgggtgtgg

SEQ ID NO: 6878399 - DNA, 68 bp, Homo sapiens
ctcacatgtactaggcactgcacaaccccttataaagttggtattgttattgcttttgtgcaggtgag

SEQ ID NO: 6878400 - DNA, 57 bp, Homo sapiens
agggtgcagaaggagcctaggagtcgaatatactgtcctttattccttctgtattct

SEQ ID NO: 6878401 - DNA, 78 bp, Homo sapiens
aatttatgtttttctatagctttcttgggagtaatgatattttcatttcactgactcctgttgtgaaaaacaagaatt

SEQ ID NO: 6878402 - DNA, 56 bp, Homo sapiens
ccctgtgaacctctcaatgactcaggagggactccagagcagtggagtttccaggg

SEQ ID NO: 6878403 - DNA, 76 bp, Homo sapiens
ggagtgcaatggggcaatatcagctcaccgcaacctctgcttcccaggttcgagcgattctcctgcctcagcctcc

SEQ ID NO: 6878404 - DNA, 78 bp, Homo sapiens
ccacctgtctggaagtcccttgatgccaggggcatgtttgatccatctttgtgcttccagggctcccaacagtagtgg

SEQ ID NO: 6878405 - DNA, 106 bp, Homo sapiens
tgagacggagtctggctctgtcgcccaggctggagtgcagtggtgcagcgcaatctgggctcactgcaagctcagcctcccgggttcatgccattctcctgcctca

SEQ ID NO: 6878406 - DNA, 97 bp, Homo sapiens
gggtgggctctttctgctaactttgtagttggaccctaattgcttgcagtaggtgtcagtagtcttgggccgacttggcagactgggggccgtgctc

SEQ ID NO: 6878407 - DNA, 101 bp, Homo sapiens
ccgtgtgtctgcgggtgtgaggctgaggatcgtactttccacctataggcacaggtggaggctgcatcatcactcgagcctgtcggccccattcactcagg

SEQ ID NO: 6878408 - DNA, 64 bp, Homo sapiens
ggatctggctgacagatgttgctttgtgcctacaaataacaaacacatctgcaagagccagacc

SEQ ID NO: 6878409 - DNA, 60 bp, Homo sapiens
ctgtatgattccatttctataacatcctcaaaatgacaaaattatagagatggagaacag

SEQ ID NO: 6878410 - DNA, 74 bp, Homo sapiens
gcagagatatgaacgtgaccgtgtgccagaagaaggaagggcccagctggccagatgttacgtccaatccatgc

SEQ ID NO: 6878411 - DNA, 62 bp, Homo sapiens
cagggatggcctggcgggccacagtgagccttctgctcaagagccactagtgtctgtccctg

SEQ ID NO: 6878412 - DNA, 61 bp, Homo sapiens
gagcctctgaggatctgaagggaacagtggatactgttcagaaaaaatcttcatggtgctc

SEQ ID NO: 6878413 - DNA, 56 bp, Homo sapiens
gcagcagctccctatccaggctcctgtttgcagagctggaaatggccgagctctgc

SEQ ID NO: 6878414 - DNA, 69 bp, Homo sapiens
ggtctggaaaggtatttgtctcacctagggtcagcctcaagattccttgagataggacatttccagatc

SEQ ID NO: 6878415 - DNA, 78 bp, Homo sapiens
ggaatctggtggcctcctcgggctgaccctggggatggacgcccagcagcagccccaggaaggttctgagtcagatcc

SEQ ID NO: 6878416 - DNA, 71 bp, Homo sapiens
tccaacccagctagcttccctgcagtgctggggctgctgagcatcaaacgagaagtttgcttggtgttggg

SEQ ID NO: 6878417 - DNA, 60 bp, Homo sapiens
agttggaccttgtagagtttcctccttttctgattaggaggggactcttagatcctggct

SEQ ID NO: 6878418 - DNA, 62 bp, Homo sapiens
tgcttatttggcaaatatggttggcactgctagatgttgaaaaacatgtatgcaaataagca

SEQ ID NO: 6878419 - DNA, 79 bp, Homo sapiens
cataaatattattataaattattaggctgctaaatgggctgttgattatgcagtatgtgtaatttaaggtaatattatg

SEQ ID NO: 6878420 - DNA, 74 bp, Homo sapiens
gtaggaaatttgaaatatgtgggtcttactacacaggataaggctagagatctatagatttgatgattgcctac

SEQ ID NO: 6878421 - DNA, 103 bp, Homo sapiens
catttttctcctcgcaaacttgagatagtaattcttacaggctaagtacaagcttaacactgtccaaagaattccacactgtctaggaaagaggtctgaagtg

SEQ ID NO: 6878422 - DNA, 55 bp, Homo sapiens
ttagttcagcctagttaagtactgatgtttttcaacttggctttgttagaactag

SEQ ID NO: 6878423 - DNA, 74 bp, Homo sapiens
aagggaatcagagattgaagactggtggagctgccccaggcaaatgtgcagcttttgtcttcagtttagccctt

SEQ ID NO: 6878424 - DNA, 59 bp, Homo sapiens
ttccaatacagtttttgaaaggcagaatgaaacatctcaaactagaggctgtaatggaa

SEQ ID NO: 6878425 - DNA, 73 bp, Homo sapiens
tccctagctggtgggatcagcctcagcaccttagcaagtataagtgtgtctgccaccccatcaagctcaggga

SEQ ID NO: 6878426 - DNA, 78 bp, Homo sapiens
taactttccctatgttctctccagcaaagtaactttacattgtagctgaaggctacagcagaacaaaggtagaagttg

SEQ ID NO: 6878427 - DNA, 77 bp, Homo sapiens
cgaaatcgtgcagtgtttggatccatagcgagggtgttgtaaatcatttgtcgctactggtaaaatactgacttttg

SEQ ID NO: 6878428 - DNA, 68 bp, Homo sapiens
aggcttcaggagactcagcatccaggatgggaaagaccatcaaagataagatgtggggtctccagtct

SEQ ID NO: 6878429 - DNA, 74 bp, Homo sapiens
ttgtgtttaaggagtagaatagatgcaccttcattcagaaagtggaagtttatgaagtctaagccaaaacacaa

SEQ ID NO: 6878430 - DNA, 57 bp, Homo sapiens
acacagctgtttgggcatggccagagcgccactctcaagttatgtaacagctgttgt

SEQ ID NO: 6878431 - DNA, 71 bp, Homo sapiens
ggaagtgaaattgaggtaaattctggcccaaacagcagggggctgtttgcttcctacttcttttcctttcc

SEQ ID NO: 6878432 - DNA, 60 bp, Homo sapiens
agaggttagcagtatcttctagtatgaataattgtaactgcagagatctgttcagccttt

SEQ ID NO: 6878433 - DNA, 80 bp, Homo sapiens
tctgtccttgcttccagcccacactccaggtagttgggacttcagccatgttggggaaggtgggctagagtttggaaaga

SEQ ID NO: 6878434 - DNA, 129 bp, Homo sapiens
tctgaaatcaaccctgtcttctggggactctttaaagtgttcatttattcattcactcagtcaatatttattgaatagctgctatgagaaaggcactgtgatggctgttagaggcatgaggttaaaaga

SEQ ID NO: 6878435 - DNA, 82 bp, Homo sapiens
cagaggagtataattcatgttcctgcaagcatgcacccgcaaatgtctgctctgcaagcaggagcaagatctgtgctccctg

SEQ ID NO: 6878436 - DNA, 78 bp, Homo sapiens
gggctggggcggggaggcgcacgggctgggctgaagaaaccgggctggacctgaccgcgtccctgccgaacccctccc

SEQ ID NO: 6878437 - DNA, 100 bp, Homo sapiens
ctgatgtaatgaggcctcccctctatccttatctgtctggtagagtcattctgggctgactgggcaccatcatgagatgggcaggaggtctcatcattgg

SEQ ID NO: 6878438 - DNA, 96 bp, Homo sapiens
ctggaaggctgttattcccatgtctttacctgttgacattttattacttctagggacatagcagggtggagcaaagggagggttggcagcccccag

SEQ ID NO: 6878439 - DNA, 107 bp, Homo sapiens
aaaggaaatcaatgttttgctcttgaggattagcttttattgtcttcgtgttttgcgaaatgtataagctggtcttttggaagcaagaggaaatatgttggtctttt

SEQ ID NO: 6878440 - DNA, 62 bp, Homo sapiens
taatcagaaattctacatcacaatggctcagaattttgtcataggatgtttgcttttggtta

SEQ ID NO: 6878441 - DNA, 97 bp, Homo sapiens
ctagtgccaatttggggagccgtggtgagttctgtctaagatatgtttacaaaaagaatctaaaagataacacacatgagtctccccattggcctag

SEQ ID NO: 6878442 - DNA, 83 bp, Homo sapiens
gagttacggtgacttgctttgttttgaatgtcaaacttgattccaggcttagatatgacagcagaacaagcccatcaaaactt

SEQ ID NO: 6878443 - DNA, 80 bp, Homo sapiens
ggggggcctctccctggttccagggctcagcttcttcatccgtgaaatgaggctggatttggagctcttgaaggtccctc

SEQ ID NO: 6878444 - DNA, 56 bp, Homo sapiens
agaactagcttctgagctgggtattaaggatagaaggatccaggtcatgtagttct

SEQ ID NO: 6878445 - DNA, 80 bp, Homo sapiens
ctagaagtagagtttatatcagtttgtatttattactcataattcaaattgtgagaaatttcaactgtggattcttctag

SEQ ID NO: 6878446 - DNA, 90 bp, Homo sapiens
gatctttgggcaattgcccttactttgtgtgcttcttggtccagtaatggaatccacgagcagtaggtaattgtagcagcctcaactatc

SEQ ID NO: 6878447 - DNA, 79 bp, Homo sapiens
caaatgaaatgcttctctgaaaatactcttgacactttcccatattggtgtgtgtgcccaggtaaagcatttccttttg

SEQ ID NO: 6878448 - DNA, 81 bp, Homo sapiens
gagaactaggcacttaggaatgtgtctgttgcctgggaaaccacacctggcacagagacagtcctgagatccctggcactc

SEQ ID NO: 6878449 - DNA, 56 bp, Homo sapiens
atgaagtctgccaaggaaaggcactatagtgttttgacacctaacagcagctttat

SEQ ID NO: 6878450 - DNA, 95 bp, Homo sapiens
tatgaagggttattgttgaattattttgaataaaaaagtagtttcacttgaagctagataacttttatatttaacgtgttatataaaccctcgta

SEQ ID NO: 6878451 - DNA, 71 bp, Homo sapiens
ggtgttaactgcatagaggtccctgcgtcaaggaagcattcctgacttatatttttgtgtcagctcaaacc

SEQ ID NO: 6878452 - DNA, 72 bp, Homo sapiens
tcaccattctttacatcagcacagcattttatccattttgaggaagctgcagttgaggtcaggagtggatga

SEQ ID NO: 6878453 - DNA, 60 bp, Homo sapiens
ttcattcatggtcttctgagatagccagcacacctggcatcaacaggtgctttgagtgaa

SEQ ID NO: 6878454 - DNA, 77 bp, Homo sapiens
gttgcagccactaacatgttaatcaaaagaagcaaatacatgtttttcccttgagaaaacatggatagtggtgtaac

SEQ ID NO: 6878455 - DNA, 63 bp, Homo sapiens
gtatgcacaatatgatctatttgggtttttttcctaagtgtatgtgaaggtgtgtgtgtgtgc

SEQ ID NO: 6878456 - DNA, 75 bp, Homo sapiens
tcaggactcaccagatgtcgggctgagtcagaccccctgaagattctaggcgtccacatctggttagggaattga

SEQ ID NO: 6878457 - DNA, 114 bp, Homo sapiens
tccacaggccatgggggctgcatgtacgggattagggatggcaggaggaaggtggccctgagcagacagctatgttcccttttgctataactgaggtcctgggcccacgttgga

SEQ ID NO: 6878458 - DNA, 76 bp, Homo sapiens
taatagatgaatgtattgaactgttggagaggttttctgaggttcgaagacctgcacagtttaccattatcagttg

SEQ ID NO: 6878459 - DNA, 59 bp, Homo sapiens
cactctgattccacaaggctccccgaccccgctagtcatctgccttgttgtcagtggtg

SEQ ID NO: 6878460 - DNA, 70 bp, Homo sapiens
ggtctgatagggcccccgtgggtgctcagggagcaccgactgagcccgtaggggccaaggctgacaggcc

SEQ ID NO: 6878461 - DNA, 93 bp, Homo sapiens
cccaccctcaggagccagttgctaaatgtttaccagcaaacaaccaataatggtgggtagaggaattgggctaccttttatgtagagggtggg

SEQ ID NO: 6878462 - DNA, 75 bp, Homo sapiens
gggaggaggctgcattcttcccactgcacaatgaagcctccggccgaagcggcaggaagagcgcagccccgtccc

SEQ ID NO: 6878463 - DNA, 95 bp, Homo sapiens
aagccaaggaatgtaggtggtttctggaagctggaaaaggcaaggaaatggattcttccccagagcctccagaaatacatcttgcaccttgactt

SEQ ID NO: 6878464 - DNA, 122 bp, Homo sapiens
ttggaagaggctaaataatatcaacattatgcttttcagttttaaattttgaatgtctggaaaacttaccagaaaagttttctgagactgacatttgttgcctatgtgttaatttcttctga

SEQ ID NO: 6878465 - DNA, 116 bp, Homo sapiens
ctattccattgactattcaaaaggactcacttttcattttccagatgaagtcactttttcagagtgagctttggaaatcaatgtaaaagtctgttctccttatattcagggcttag

SEQ ID NO: 6878466 - DNA, 79 bp, Homo sapiens
agggaacactataagacagatacagcacatgtagattttgagtcttttgcgagtgtttgtacttgtagacattttgcct

SEQ ID NO: 6878467 - DNA, 84 bp, Homo sapiens
gctctcgctctcagaatccttgcccaggtgcattgcattcagacagcactctcacccaggtagcaaggattagagagggggagc

SEQ ID NO: 6878468 - DNA, 56 bp, Homo sapiens
ctcctctgtattgattgggactgactagaatgtctgtcccagtcagccagagtgag

SEQ ID NO: 6878469 - DNA, 61 bp, Homo sapiens
gagcggtgggaagcccaagagtcactgtagtttcaccaggacactggcttgtcccgccatc

SEQ ID NO: 6878470 - DNA, 80 bp, Homo sapiens
atggaatcttggctggaggagcatttgggaactgctggactagatggtcccagaggtctctgctggttctttggtttcat

SEQ ID NO: 6878471 - DNA, 66 bp, Homo sapiens
cgtgattctttgtgcagccattttctgccaatgctcttcttgggtgcagcagtgtctgcagtcatg

SEQ ID NO: 6878472 - DNA, 63 bp, Homo sapiens
gagtcaatgtgcagtgcagcccacacttgagaggatgaatgtatgtgcactgtcactttgctc

SEQ ID NO: 6878473 - DNA, 62 bp, Homo sapiens
gaccacacgtcccagagagcccagctccatgatgggagagcagggccaggctgactgtggtc

SEQ ID NO: 6878474 - DNA, 61 bp, Homo sapiens
gcacagcagttactgaaataaagtacctcctctatggagcttccattctagtttgctgtgc

SEQ ID NO: 6878475 - DNA, 80 bp, Homo sapiens
gtaatacactactgtagtgatgataattaagtggcaaattctacacagttgattgtcactcagggaattagtgctgttgc

SEQ ID NO: 6878476 - DNA, 61 bp, Homo sapiens
aataagtggcagagttggtaatattgtccacaaccacctgttaatacatctgccactcatt

SEQ ID NO: 6878477 - DNA, 68 bp, Homo sapiens
catacttgtgctccagggagtacatttatcataaaagatggtatagtggtaatctctggattagtgtg

SEQ ID NO: 6878478 - DNA, 60 bp, Homo sapiens
tttgacttttctgtgagcaaacgccaatcactcccaggtgtccttcattatcaagtcaaa

SEQ ID NO: 6878479 - DNA, 69 bp, Homo sapiens
agggagcacagtaagttagtctcccaagatggtgccatttaattcagactgtactttctgcagctctct

SEQ ID NO: 6878480 - DNA, 63 bp, Homo sapiens
gctgggaacatgtaccaagtcttgttcaaagatctgtcttcaacttttggctacatgcttagc

SEQ ID NO: 6878481 - DNA, 110 bp, Homo sapiens
tgggcctgcctccactggctgaagacagtatccaggtggtgaagagcatgcgtgctgcctccccgccctcttacactcttgacctgggagagtctcagctggcaccccca

SEQ ID NO: 6878482 - DNA, 84 bp, Homo sapiens
tcagaactccaggttctttggcctttggactctgggacttacaccagtggctcccaggttcttgggccttgagcctcagactga

SEQ ID NO: 6878483 - DNA, 70 bp, Homo sapiens
caagtactgatggctccaggtgttttctatgttagattccctttgaaagtactgatgccatcagcacttg

SEQ ID NO: 6878484 - DNA, 58 bp, Homo sapiens
gttagggaagcgctgtgttcttggggagagggaggcacaggccgtcgtttaccttgac

SEQ ID NO: 6878485 - DNA, 62 bp, Homo sapiens
tatataattttctgccatatccctaatatctagattagcatctggcatgtggaaattgtgta

SEQ ID NO: 6878486 - DNA, 99 bp, Homo sapiens
taatctttctgaagctcaatttccttttcttaaaaatgagtataacatttacttcatagggttgtaaggattaggtgaattaagtattcaaagagatta

SEQ ID NO: 6878487 - DNA, 66 bp, Homo sapiens
cagaggaggtgcctttttgtaattagtacaagcagactgtatgtgctagctgaggcactctccctg

SEQ ID NO: 6878488 - DNA, 102 bp, Homo sapiens
atcttcatagtgaagcttgctctcttatattgtctttagcccatatagacttctagtctggagtatattttgggagaagatggggagcacagatatgaagat

SEQ ID NO: 6878489 - DNA, 92 bp, Homo sapiens
gtgctcaggcccctggaatcctctctgaaactggagagtctctcgggtagccgatgaagcgctgcctgttttagggtcaggtgcctgggcac

SEQ ID NO: 6878490 - DNA, 72 bp, Homo sapiens
ggccatgctctgctgagatatctgggagaaagtaatttatatttcatcattcctaggtgcagagctccagct

SEQ ID NO: 6878491 - DNA, 69 bp, Homo sapiens
ctacctagtttattatacaagtgtatgtagaatagcgtgcaaatatatgtgtgatgatttactaggaag

SEQ ID NO: 6878492 - DNA, 71 bp, Homo sapiens
ctcagggtcaaagtgaggagtcaggttaacctcacagaggccccagcatggccccactttttctccctggg

SEQ ID NO: 6878493 - DNA, 65 bp, Homo sapiens
gtggtccccagagctgtgtacagccaaaagtaatttcaaactagttcacatttctaggataccat

SEQ ID NO: 6878494 - DNA, 71 bp, Homo sapiens
tgattagttatcttcttctgtggccgctattcccttaacatcaatggcaccttcaagaagaaaataaatca

SEQ ID NO: 6878495 - DNA, 86 bp, Homo sapiens
agcaatgtcatgggagtgatttggtgggagcgcgtaagacagagtcatggcacttattcatatcatggatttctagggacattgtt

SEQ ID NO: 6878496 - DNA, 61 bp, Homo sapiens
tggggcttccaggtaggcctaaggcagaccacagttacatgccacaggacttggtgcccta

SEQ ID NO: 6878497 - DNA, 61 bp, Homo sapiens
cattcaaggttggctcaggaattgggctctggctccaggaactgatttataactttaggtg

SEQ ID NO: 6878498 - DNA, 130 bp, Homo sapiens
gatggaaaatacttttaaaataaaatctgcggaggaagaagtgtgatcatgttctgtgtctctagctcgagttttaattctggcaggaagaggaaaggtcaacatttctcgctcacaagttaatgctgtc

SEQ ID NO: 6878499 - DNA, 61 bp, Homo sapiens
ggtactgttgcttgcataatgctggcatgtcccaacatgtcccaaatgcaggcaaagttcc

SEQ ID NO: 6878500 - DNA, 63 bp, Homo sapiens
cctggaattcccagatgttctgctggtctgtgggacagttggcgggacatgtggaaagctggg

SEQ ID NO: 6878501 - DNA, 72 bp, Homo sapiens
agcagtccgtcctgtcaagcagctgagggccagagctggagggctgcagtggctggttagggacaggacgct

SEQ ID NO: 6878502 - DNA, 62 bp, Homo sapiens
gccatggcgactgcagtggctcggccccttgcagcaaggccagaggctcaggttgccatggc

SEQ ID NO: 6878503 - DNA, 76 bp, Homo sapiens
ttgtcattttagtctatactgtcttgtaacagattgtttcactatctcaaactacagtatggctgtcttgtggcag

SEQ ID NO: 6878504 - DNA, 110 bp, Homo sapiens
gggagtgagagggaggctgagaaggatactgggaccgctttgctttagtgattatcagcatggtctctgggatcaggtggcccagatcaaatcccacccctaccacttcc

SEQ ID NO: 6878505 - DNA, 70 bp, Homo sapiens
tgatgttgcttaatacaatggatagcagctttttaaaacaggcaaagctcttttccaagtattgacgtca

SEQ ID NO: 6878506 - DNA, 65 bp, Homo sapiens
cttccagagatccatgaatacctgagctgtgagcaaaacatctgtatatatgtatttttaggaag

SEQ ID NO: 6878507 - DNA, 64 bp, Homo sapiens
ggtagaagccagtggcttctccctgctgccctcacagcaggtgagcacagccaggctggctgcc

SEQ ID NO: 6878508 - DNA, 70 bp, Homo sapiens
gctgagaatcgtgtgatgtgtctagcacagtgcctggcattgtggctagacagtcacaataaatggtagc

SEQ ID NO: 6878509 - DNA, 96 bp, Homo sapiens
taatgtctggcttaatagaacactgcaggaatcttgtatatatttctgattaaataagctgtgtattgcacatcctgtagcctctgcagaatatta

SEQ ID NO: 6878510 - DNA, 59 bp, Homo sapiens
gttctgtactccaagctcttccacaaccacatgtgtaggctgcttactggtatcagagc

SEQ ID NO: 6878511 - DNA, 59 bp, Homo sapiens
acctgaggacattctccatgtcacgatttgccagagttctgaattaggggttttcaggt

SEQ ID NO: 6878512 - DNA, 75 bp, Homo sapiens
aggtctctccgtaggtgcctgcacgacccaaacacagctgtgtttgtcttaattaggcatcgagtggtagcacct

SEQ ID NO: 6878513 - DNA, 56 bp, Homo sapiens
tattgtcatgttctgtctcttggaacttgagcaagatacagatctacgtgtcaatg

SEQ ID NO: 6878514 - DNA, 56 bp, Homo sapiens
aggaggggatgcttcctctagcatgtcaattcccttgctgaggtagctttcctcct

SEQ ID NO: 6878515 - DNA, 60 bp, Homo sapiens
tgttttgttttgttttcatggcatgatacctgcaaggccaggaaggctgaagccagaaca

SEQ ID NO: 6878516 - DNA, 96 bp, Homo sapiens
gtgtactgcagaggctggacaattaaaactgtgcttcccaaatgcccttgcactgagggttctggatgtgagcgtagttcggccattcagatacac

SEQ ID NO: 6878517 - DNA, 72 bp, Homo sapiens
tcacctgggggcaggggtgcagtgggggctgctggccacaggctcccaagcactgaccccacatccctgtga

SEQ ID NO: 6878518 - DNA, 62 bp, Homo sapiens
gcacacagtgggaaaacctgaagtctttttatccttctgtttttaggtggaccatggtgtgt

SEQ ID NO: 6878519 - DNA, 70 bp, Homo sapiens
cttttctctgcgggtctttcatagtttgggaaaataataaacgaggagctgaagaacctggagaggaagg

SEQ ID NO: 6878520 - DNA, 67 bp, Homo sapiens
tgtaaggaggatatttgagctcagtgggtgatgaatgatttgagctggaaaatccaagaccttggca

SEQ ID NO: 6878521 - DNA, 59 bp, Homo sapiens
gtgccgcgacgcagtcggtgcccgtgtatcccggcaggcgcagagcgaacttgcggcgc

SEQ ID NO: 6878522 - DNA, 79 bp, Homo sapiens
ggtcggaatcagtgctgggcgcactgcagggccgggaagtccatgcccacgttgtggctcagtgcagtgaaagccgatc

SEQ ID NO: 6878523 - DNA, 72 bp, Homo sapiens
ttagaggttattagctcaagctctatagttaaaacagacctaggcttgactgctgattttgccagtttctaa

SEQ ID NO: 6878524 - DNA, 58 bp, Homo sapiens
gctgtattaatagagtatgtggtaggatataaaatccccatacactattctgtatagt

SEQ ID NO: 6878525 - DNA, 76 bp, Homo sapiens
cagcttttgcatgttgtgtacatcatgcagggcctgactgcagccaggtatgctgcctacgaacatgcagaggctg

SEQ ID NO: 6878526 - DNA, 70 bp, Homo sapiens
gctagcctctggaatcctttctcttgacctgtggaagagagaacattttcagggtttcaggggctatggc

SEQ ID NO: 6878527 - DNA, 70 bp, Homo sapiens
ggaagggctgcagaagcagatgtgatctgagccaacctggttttcctcctcagtctgccttctcccttcc

SEQ ID NO: 6878528 - DNA, 79 bp, Homo sapiens
ttgggcttggaggtcttacccagggctattaatgttttgtaattgaaaccatggatttggatgagattacttaacccaa

SEQ ID NO: 6878529 - DNA, 59 bp, Homo sapiens
gacagtttcctttactgtgtgcatttttactgtacactgtatagagtagagtatctgtt

SEQ ID NO: 6878530 - DNA, 70 bp, Homo sapiens
gaggagcctcccccgggagtacctggacttggggatcggtcagatccagccgctcctgggaagggccctc

SEQ ID NO: 6878531 - DNA, 69 bp, Homo sapiens
tctgagagtctctgaggcagatgacccagccaaaccacacctggattttgacccacagaaactctgaga

SEQ ID NO: 6878532 - DNA, 63 bp, Homo sapiens
ttggatatctgctgatgcaccttcctctctttccacaggctggtgacatctagagacatccaa

SEQ ID NO: 6878533 - DNA, 68 bp, Homo sapiens
tggggatttcttctcataactgagaccaaaacagttttgtgcagtctcagaaatgacaggaggtacca

SEQ ID NO: 6878534 - DNA, 75 bp, Homo sapiens
ttctgggcatttctcatagagctgatggtttgaaccctcccaggaggctccagccaatgggtctgtgctctagga

SEQ ID NO: 6878535 - DNA, 58 bp, Homo sapiens
cccacaccatttctagagtcccaagaggtgtcttaaatgcctccagaattggtctggg

SEQ ID NO: 6878536 - DNA, 72 bp, Homo sapiens
gtaaatatcctgttttgcacaattatattgcatcatattgttaattgttgtgtgctaaaacagtttgtttat

SEQ ID NO: 6878537 - DNA, 63 bp, Homo sapiens
agcagccacaggaaacattgcccccgcacatgtcctcatttgcatgctttcttgtgtgctgct

SEQ ID NO: 6878538 - DNA, 101 bp, Homo sapiens
gactttcccggtgtgatccttaggcaagtctctttgtttatagaactgtgggctctttggattggagggactagggcttttggattagcagtgaactagtc

SEQ ID NO: 6878539 - DNA, 87 bp, Homo sapiens
gagtctcagttccagatattgtttgtttcaccaatgcaagacattctgaaaagtgcaaaatatcttaaaagtaggtgctgtggagtc

SEQ ID NO: 6878540 - DNA, 56 bp, Homo sapiens
gaggacttcatggcagattgctggagctaagaaaggcagtatgtctatgagtcttt

SEQ ID NO: 6878541 - DNA, 126 bp, Homo sapiens
ggctgggtattgaggacactggggactctggactggtctcctgggtggctgcctgcctttctgtgcagaaggctggctcagctttccagccctggcttcttagctccccactgttcctcctcagcc

SEQ ID NO: 6878542 - DNA, 66 bp, Homo sapiens
cttaacctatcagaagacttacagtatcgtttgagaagacaaggcttgaattctgatgggtataag

SEQ ID NO: 6878543 - DNA, 57 bp, Homo sapiens
tcctgggaacaagaggaccagtgagctaaagcattgaaggacatcttgtttctagga

SEQ ID NO: 6878544 - DNA, 73 bp, Homo sapiens
gcatgtttggtcatgaatgtcagtgtgacatttcagtcatttaaatcattgacgatcatgtacttttatgtgc

SEQ ID NO: 6878545 - DNA, 63 bp, Homo sapiens
ggtaacaggaccccgcgtggtgtctctgctagagggagagactgattgggtgtccgagtggcc

SEQ ID NO: 6878546 - DNA, 56 bp, Homo sapiens
ccggccctgccctgccctgcggaacgccggctctgcagctgcctctggcgggccgg

SEQ ID NO: 6878547 - DNA, 89 bp, Homo sapiens
ggcagtgagtacccagtgtctggcgataagggagcctccgcagatgtgtctgttgctggtctgcaggctcacctgccagggccacttcc

SEQ ID NO: 6878548 - DNA, 77 bp, Homo sapiens
tgcttcagctattgacactgtcccacagaattcgagggacctcacctcctcgtttttggacgacagaggctgaaaca

SEQ ID NO: 6878549 - DNA, 56 bp, Homo sapiens
cagtgtcttatttgtagctcagagagacaaccttctggctacagtggtaagaactg

SEQ ID NO: 6878550 - DNA, 102 bp, Homo sapiens
gaggcacccaagccttgaaccttctcttccagccgggcttgcacctgggagccaactgctgcaatcctggactgtgaggacagaggaagaggctggggcctc

SEQ ID NO: 6878551 - DNA, 75 bp, Homo sapiens
ttatcatctcatagcaaccctatattgaagatgatgttcttattcctgtcttttaatgaggttactggatgataa

SEQ ID NO: 6878552 - DNA, 65 bp, Homo sapiens
gcaggaaagggccttgccaggtgaagagccggcaaactggtatttacctagagccctctatctgc

SEQ ID NO: 6878553 - DNA, 60 bp, Homo sapiens
ttgtgtactgttggttgatattttctaagtagatgaagatgtaagtcaaaagttgcataa

SEQ ID NO: 6878554 - DNA, 61 bp, Homo sapiens
gagctggggctcagtgggcaggggtcagggggagccctgcagagaccactgaccttagctc

SEQ ID NO: 6878555 - DNA, 106 bp, Homo sapiens
gcggcatttctctttgggatacaaggtgttctatcacttagggaaaactgaaaaccaaagtgataatgatgggaaataaattgatggcctcaaaaggaagggttgc

SEQ ID NO: 6878556 - DNA, 78 bp, Homo sapiens
taaagttgaagactacagaaggagaaatgggtaaatgtgcttagtgttgcccaccttcttttcgtgcctttggctttg

SEQ ID NO: 6878557 - DNA, 59 bp, Homo sapiens
ggacgaagaggatgacaggagccggtgaactcttatcaggcaactgcattactccgttc

SEQ ID NO: 6878558 - DNA, 62 bp, Homo sapiens
cttttcccaagattcagccctcctgaccttaatgggttaccacactgagttttaggacagag

SEQ ID NO: 6878559 - DNA, 78 bp, Homo sapiens
gctagtgtaagctaaacatggcttagaacactcctttttggagcattttatttatgattagtaatactgaacactggc

SEQ ID NO: 6878560 - DNA, 103 bp, Homo sapiens
ggacatggagaagctgagctgtggagccagcaggaccttttctcctggaagagaaaaatgaaacggctggttggctgcgagttgttcagctgagtccttgtcc

SEQ ID NO: 6878561 - DNA, 56 bp, Homo sapiens
cttcagtatctgcaaaatggggacacttgtacctgtctcccaaggaggtcctgagg

SEQ ID NO: 6878562 - DNA, 55 bp, Homo sapiens
ccacggaagggagggcttgttattggagtacctatcacagttctaatttctgtgg

SEQ ID NO: 6878563 - DNA, 57 bp, Homo sapiens
tgacctccaagggaaaatgtaagtgagcagaaacactcaaatttcgcttggagttca

SEQ ID NO: 6878564 - DNA, 67 bp, Homo sapiens
ttgcttggcacagctccaggcatgcggactatggtgtgtaattgctgcccctggagctccacagcaa

SEQ ID NO: 6878565 - DNA, 69 bp, Homo sapiens
gcggtggatggcccccggagagacgatgcatgtcttcccgcctttcttccggccggccatcctctccgc

SEQ ID NO: 6878566 - DNA, 55 bp, Homo sapiens
ggtggttcacgcctataatcccagcactttgggaggctgaggcgggtggatcacc

SEQ ID NO: 6878567 - DNA, 58 bp, Homo sapiens
accccctgcctgcagcaggggcaccatcactaaagaaggcgcctgcaggcacgggggt

SEQ ID NO: 6878568 - DNA, 55 bp, Homo sapiens
tcaccaggctcctgttaagatgctattgcagaatatttcccagagccatgagtga

SEQ ID NO: 6878569 - DNA, 59 bp, Homo sapiens
ttgaagctctaacttccaatacctcagaatgtgactgtatttgaagacagggtctttaa

SEQ ID NO: 6878570 - DNA, 69 bp, Homo sapiens
gcttattggtggagtcaggccctccaaataggaaagaaaagagaacctgatcaccaccaatttaaaagt

SEQ ID NO: 6878571 - DNA, 82 bp, Homo sapiens
tcaaattgattctgaggaatttgagttctccacactcttttctggcaatgtgctttttctcagatcatcagaaacaatgtga

SEQ ID NO: 6878572 - DNA, 58 bp, Homo sapiens
cagctttaccaatatttggaaagtttgacagcaacctgtttaagtgctggtagggttg

SEQ ID NO: 6878573 - DNA, 69 bp, Homo sapiens
accttttgccgaaggtatctgagatgatgtgaaactatttgaatctcttgagactttggggttaaaggt

SEQ ID NO: 6878574 - DNA, 127 bp, Homo sapiens
ctgaaaatatataacatttaagtaagtctaatgtaatgatatgttgaatgtgcatctatgaataccaatgattatttctgattcaatggatttttaccttattttgcaagttgttctatattttcag

SEQ ID NO: 6878575 - DNA, 55 bp, Homo sapiens
agtgcacaatcttcatatggcgttttaattaaactgcctatgattattgtgtgtt

SEQ ID NO: 6878576 - DNA, 66 bp, Homo sapiens
ttgctcctgccagcactgcctcctgaggtccacgtctcattgttccaggagcatgctggctggcga

SEQ ID NO: 6878577 - DNA, 63 bp, Homo sapiens
caagggaagaggacagggacctgccagcatcaccagtcgccactcctttcctccttctaaatg

SEQ ID NO: 6878578 - DNA, 89 bp, Homo sapiens
gaatggcatgaaccccggaggcggagcttgcagtgagcagagattgcaccactgcactccagcctgggtgacagagtgagactccgttt

SEQ ID NO: 6878579 - DNA, 83 bp, Homo sapiens
gctgggcccaccattgagatgatgtgtctttcctgcctgggtactgtccacagggagcattgtgacatatcactgggcccagc

SEQ ID NO: 6878580 - DNA, 64 bp, Homo sapiens
catccccttgtgggctggcagcatttttgctaacactgccttaaatgatgctactggcaggatg

SEQ ID NO: 6878581 - DNA, 64 bp, Homo sapiens
gaggtgagaggcctgagagctggaggcttgttggtttgctgctctttctgtctgtccatccatc

SEQ ID NO: 6878582 - DNA, 96 bp, Homo sapiens
ttctttgtccctgcttatatttgtcaactttacaatccttttattaccagcaaaagctttgggaagctacaaataaaagcagggattataaaagga

SEQ ID NO: 6878583 - DNA, 67 bp, Homo sapiens
aacagggtttgaggtaaactaaagaggggggagtctctaggctgttcatgctcagacctaccatgtt

SEQ ID NO: 6878584 - DNA, 66 bp, Homo sapiens
tatttgactcttaggaagactcaagctccatattaaatgcaatagaatctaactgagggttctgta

SEQ ID NO: 6878585 - DNA, 85 bp, Homo sapiens
cgttaaacatggattctgatcacagatcgtttctgctaattaaacaaatatttttgcagagctgtctcggtttccgctgttgccg

SEQ ID NO: 6878586 - DNA, 65 bp, Homo sapiens
ttagaccagttcaatggccttatatcctaaacaaaacttgattgttggaccttggactggactgg

SEQ ID NO: 6878587 - DNA, 76 bp, Homo sapiens
aggggatggacacagtgctctagacggagacttctttattcaaaagagaattctctggcgcgctgtgctatgccct

SEQ ID NO: 6878588 - DNA, 69 bp, Homo sapiens
cactaattatcatgaggctgagagtttatgttttactttgaaaaaactttgcctccttgatagtttctg

SEQ ID NO: 6878589 - DNA, 56 bp, Homo sapiens
gctcccaaggactcactgagtaccctctcagttaactcagagaaatgtctgggagc

SEQ ID NO: 6878590 - DNA, 55 bp, Homo sapiens
gatggccaagtacatggctggggtgttgaaggtctcaaatatgatctgggtcatc

SEQ ID NO: 6878591 - DNA, 67 bp, Homo sapiens
ggctgtggcaggcgtgcattgaggactgtgagggtgacaacagagactgggatgcctgcctttggct

SEQ ID NO: 6878592 - DNA, 59 bp, Homo sapiens
ggccttggatccaagctgcggctccagctggagactaaccagctatgtgaccttaggcc

SEQ ID NO: 6878593 - DNA, 59 bp, Homo sapiens
tgcgtatttgcttcttgcttccagcaccaattgtggccaatggagtgaggcaaagagca

SEQ ID NO: 6878594 - DNA, 85 bp, Homo sapiens
cagggactttaaagcactggagtcatcatctagtgatgctgctttgagctgttagaaacgatgctagagttttattaagtctctg

SEQ ID NO: 6878595 - DNA, 64 bp, Homo sapiens
gtagctccacatggctgggaggcctcagaatcatggcctgaggcaaaagttatgtggtagcggc

SEQ ID NO: 6878596 - DNA, 73 bp, Homo sapiens
agctacaaagacaaatttgtgtagttatggcaaacagaaactgtatgctctggaaataaatgatttagtagct

SEQ ID NO: 6878597 - DNA, 60 bp, Homo sapiens
caaagagtccagcaccctctccttccaggtatataaacggtgcattgctgggctcctttg

SEQ ID NO: 6878598 - DNA, 56 bp, Homo sapiens
gctgtgggtccggaccccacgggacccctatgggacccccacaggacccccacggc

SEQ ID NO: 6878599 - DNA, 92 bp, Homo sapiens
ccaagaatcttgtagttcattagcacaaaataaataaagtgagcatttatgataatcttattatgtgctagagaatgtactagatacaatgg

SEQ ID NO: 6878600 - DNA, 69 bp, Homo sapiens
aactcatggtactaagttgagtttaatatgtttgccacaaaagccaactgcaacttcgtaaagtgagtt

SEQ ID NO: 6878601 - DNA, 114 bp, Homo sapiens
atatactgcagataaaattgtggactgagcagttatataactatctagatgcattttatttactaagagcagtgggccttgttaacttcagttctaagatcgatttaagtatat

SEQ ID NO: 6878602 - DNA, 98 bp, Homo sapiens
cccttccttctctaacagtggttttcagctgggagttttgccctccagggaacaattgccaatgtctggagacatttctgattggtagtggtgaaggg

SEQ ID NO: 6878603 - DNA, 65 bp, Homo sapiens
ttagaaagggtgtctgaatctgcaagggtgggatgcagaattaaatcaaaggacactttctctga

SEQ ID NO: 6878604 - DNA, 64 bp, Homo sapiens
gtgctcttgggggtgtatgtttacttaaaatgcaatgagtcagccttggcagccccttcaccac

SEQ ID NO: 6878605 - DNA, 65 bp, Homo sapiens
aggcagagctacaagaagacagtgccacattattttcattggaatctatgtacgcatctatgcct

SEQ ID NO: 6878606 - DNA, 69 bp, Homo sapiens
gtctaggcccttttgcctttctctgaggccctgaggcttcctgaagaggatggttgaggaagacctgat

SEQ ID NO: 6878607 - DNA, 83 bp, Homo sapiens
tagtttgttcccaaatgctcacccatgtgctaggtgtacaaagccatcacagcaatgactaaggcactttgggaatgatgcta

SEQ ID NO: 6878608 - DNA, 72 bp, Homo sapiens
agtcagagcctgaaattgtctgtgcccaagtctctcctcagaaatttagcacagcattttccctttctgtct

SEQ ID NO: 6878609 - DNA, 71 bp, Homo sapiens
gaagaaattgtgatcaaaagctgggattgttttcagaaaaaccttatcctggctttaggtcagaggccttt

SEQ ID NO: 6878610 - DNA, 65 bp, Homo sapiens
ggtcccaatctaatcacatgagtccttagaagaaacttaagagggaaatgtgactatggaagact

SEQ ID NO: 6878611 - DNA, 58 bp, Homo sapiens
agattgaacgagctggcatggatgcctcaggccgccaagtcattatctcttctaatct

SEQ ID NO: 6878612 - DNA, 69 bp, Homo sapiens
tctcttggaaagcttgcccacttctctcttatttgcaaccctgaacgaggcactgaaggttccagggga

SEQ ID NO: 6878613 - DNA, 87 bp, Homo sapiens
aaagatgtgtaactcaccagggaggcttaacttattctgactcttctggataaacatgcatgttatccttgatgtttatgcattttt

SEQ ID NO: 6878614 - DNA, 64 bp, Homo sapiens
cttgcagagtcctaaacactcaggactgaatcacagcacccatggaggtagggcttaaggcaag

SEQ ID NO: 6878615 - DNA, 86 bp, Homo sapiens
agaaatgctcatagacttgggctctttgttctagcacttacttatagtgctgccttaaaaaattctaaacatcttgagcattatct

SEQ ID NO: 6878616 - DNA, 82 bp, Homo sapiens
cttaccattgaacagttattctttatgcaaccagcatcacagtgctctactttgcttggaaggaatgatggcataatgtagg

SEQ ID NO: 6878617 - DNA, 66 bp, Homo sapiens
tgaggatatttgtttttctttcttaaagctacagttcagagcttgggaatgctaacagatgactca

SEQ ID NO: 6878618 - DNA, 64 bp, Homo sapiens
tttcaaaataagtgccagtgttggagatttgaggttgatctctaaataacacttattgaagaag

SEQ ID NO: 6878619 - DNA, 67 bp, Homo sapiens
tccctcaaatcctattttgttgccacagataccactgatgccttaggtcacaaaggatcatgaggga

SEQ ID NO: 6878620 - DNA, 92 bp, Homo sapiens
gcgggcgggacaggaagcacaggctgggcagcctccccggccagggaggagccaggctgggccacctcccggtctgtctgccgactacccgc

SEQ ID NO: 6878621 - DNA, 67 bp, Homo sapiens
ttaagcgttttgagaagccctgcgggaaagaaaactctttattccagtgtttctcaaattgatttga

SEQ ID NO: 6878622 - DNA, 91 bp, Homo sapiens
ttttggtagtagagatggcgtttcaccatgttgaccaggctgatctcgaactcctgatctcaagtgatccacccacctcagcctcccaaag

SEQ ID NO: 6878623 - DNA, 55 bp, Homo sapiens
tcgggaagctgcagcctcatttctcaagcccagaagagttatgtggcttgcctga

SEQ ID NO: 6878624 - DNA, 61 bp, Homo sapiens
gctgtgggccacacggctgagttcttccaatacggaagccccgagctggaggctcacacgc

SEQ ID NO: 6878625 - DNA, 60 bp, Homo sapiens
ttatgctgagtgaaagaagccagacatcaggagatgtccagcatgattccattcatatga

SEQ ID NO: 6878626 - DNA, 61 bp, Homo sapiens
tcttcccagaggttgagtcacttatgctgctgagcacaggaattttgacctttgggtgagg

SEQ ID NO: 6878627 - DNA, 58 bp, Homo sapiens
tgctcctggatgaggtactccacgatgttggtgtggcccgtcactctggccgggagca

SEQ ID NO: 6878628 - DNA, 56 bp, Homo sapiens
gttttattttaaatcccaaacggtaattttctacagtgggaggactgagataaaac

SEQ ID NO: 6878629 - DNA, 71 bp, Homo sapiens
gaggctgaaaccgttatccactgacatctatctcacattggttgaaggtcactgttaagggtattagcttc

SEQ ID NO: 6878630 - DNA, 85 bp, Homo sapiens
ccgggctggaatgattaatacaagtgcggcgttgcttgtccctagatgctgccagagctcacttaatgcattcctgttgttttgg

SEQ ID NO: 6878631 - DNA, 59 bp, Homo sapiens
agctcccagcctcctccgtcccaccctcacccgggcctggtggagaggctggcgggact

SEQ ID NO: 6878632 - DNA, 79 bp, Homo sapiens
tggagttgttctgggttcaaggggagtctgcagtgtggttaactgccctgccctgttgaaactagatatatcatttcca

SEQ ID NO: 6878633 - DNA, 79 bp, Homo sapiens
attattcaacacttgagaaattgagaacaaggattcaaatcccaaagacttaaagtttcttgtaaaagtgttgagtgat

SEQ ID NO: 6878634 - DNA, 55 bp, Homo sapiens
gaaggccgttcaaacctcaacattgatcacccggtgcagaggacgtggcggcctc

SEQ ID NO: 6878635 - DNA, 87 bp, Homo sapiens
gaacattagactcaacttcaaatggcttaagtataagtgagatttattatcacacataaaaagaagactagaggtagtgtagtgatc

SEQ ID NO: 6878636 - DNA, 67 bp, Homo sapiens
cttgaaatgaatgatgatctgtgaaattttcagtgaatgagagttacacaacttatcacatcttaag

SEQ ID NO: 6878637 - DNA, 57 bp, Homo sapiens
ggcctaggatcttgatctacttaggaaatctgagtggctccaatttggtcctatgtc

SEQ ID NO: 6878638 - DNA, 77 bp, Homo sapiens
ttgattcagaatacaaagagagaatagggactgtccctgaacaagagatgccctgtgactctcctggacctgagcaa

SEQ ID NO: 6878639 - DNA, 57 bp, Homo sapiens
cccactggcaatattatgagacagaatgtcagtttccccacagtcttgctgagtggg

SEQ ID NO: 6878640 - DNA, 69 bp, Homo sapiens
atgtaagccgcgtctttgttccacagtccttgctctgctgcattctgtggccagagcgccgttgaccat

SEQ ID NO: 6878641 - DNA, 85 bp, Homo sapiens
tgcttttcttctagagttcagaagccaagggtcatctaagcagctgcccctatctggtttctgcaagtctagatggaataagaca

SEQ ID NO: 6878642 - DNA, 82 bp, Homo sapiens
gaacctgttgggggcagctgtcttggttctcaaaagactgaattataaaagtccttgatctagactggcggcccacagtctc

SEQ ID NO: 6878643 - DNA, 60 bp, Homo sapiens
gtcttctgtttactttgaagttgtccatcctgataatgatcacctggtaaagagagagat

SEQ ID NO: 6878644 - DNA, 82 bp, Homo sapiens
tgaatatgtgcttttttgtcttgaagaaatggtgtatcaattgattctgtcaccgtcaggttagaatgagcacttccattta

SEQ ID NO: 6878645 - DNA, 65 bp, Homo sapiens
gtatctctctgtgacagctttgctgaatataacttaaatgtagcagaggaaatccagagtaatgc

SEQ ID NO: 6878646 - DNA, 69 bp, Homo sapiens
tgggtggtgagagaggacactggcatgtctgggggcctatacatctaagatactctctgtcaccagtca

SEQ ID NO: 6878647 - DNA, 71 bp, Homo sapiens
tcaggccacttcacaggtgattgaaaccgcctcaatctatagcctagccaatcacttatgaattgccctgg

SEQ ID NO: 6878648 - DNA, 104 bp, Homo sapiens
tgttcctttaatccatatcacttgaccaggaaagagtgtgactaataatgatatacatacatgacttattcacttcttggtccctcagtgctattttgggttca

SEQ ID NO: 6878649 - DNA, 61 bp, Homo sapiens
gtgggtgcagcactgggcttcgaacccaggccgctgggactctgggcccatgctgcctcac

SEQ ID NO: 6878650 - DNA, 70 bp, Homo sapiens
cgggtggggctggctggtagtgcagtagcgccagtgtcgactgcttgggcggccagcatggcggggcccg

SEQ ID NO: 6878651 - DNA, 60 bp, Homo sapiens
gagtttaatcattgttctatccagccttgatctctatcaacatgatgggaccatgaactc

SEQ ID NO: 6878652 - DNA, 65 bp, Homo sapiens
tgttttgctataaatggtctatcttttgagcccagccaatatggtaactgattatggctctgaca

SEQ ID NO: 6878653 - DNA, 75 bp, Homo sapiens
ggggtctgagagcctgtgttcaaatgccagctctgtcctttcccgctgagtcaccttgaacaggctactcaccct

SEQ ID NO: 6878654 - DNA, 62 bp, Homo sapiens
aaatgtagagaggagcccgattatacagaatgcttttcctgtcatttggcctcttgacattt

SEQ ID NO: 6878655 - DNA, 78 bp, Homo sapiens
gtgtagggaggtggctgaatcaaatcaggcctcactgtcatttgtgtggctttatttgcagccattgtttccctgtgt

SEQ ID NO: 6878656 - DNA, 62 bp, Homo sapiens
agtcaacatatcatatctatcggttgtttttataagtgatgttaataaatgatgttttgact

SEQ ID NO: 6878657 - DNA, 76 bp, Homo sapiens
gaagtgtctgattagcatgttcctgatcctcgttctatttgtagcaaagatgggaggtcagggactgtcacatttc

SEQ ID NO: 6878658 - DNA, 72 bp, Homo sapiens
tgcctcaacattcctgccataaattttttatgggcgcctgaaaataatggattggttggaatatggtgggca

SEQ ID NO: 6878659 - DNA, 68 bp, Homo sapiens
tcctgaagttcaagagtgacatattaggcttatattaggcttatttgtaatgtttgaattatacagga

SEQ ID NO: 6878660 - DNA, 68 bp, Homo sapiens
acacaatctgactggtgtccttataagaaaaggaaatttggacacaaagagagataccagggatgtgt

SEQ ID NO: 6878661 - DNA, 76 bp, Homo sapiens
gcaccatttgttagctgtgctttagccttctgtggagattacgactggaaaggcttgagacattgatgactggttc

SEQ ID NO: 6878662 - DNA, 100 bp, Homo sapiens
tttatttctattatgtgcagagtaaggcagctgttaaatgccattaagatgttaatttcctggctgaagacattgccaaatgtgacacaaataaaatgaa

SEQ ID NO: 6878663 - DNA, 58 bp, Homo sapiens
ttcactctggctagggcatagagcgcgaactaggttctcagacccgaagccagaggaa

SEQ ID NO: 6878664 - DNA, 101 bp, Homo sapiens
gttttgcagatttttccccctaattatttgaagctgttcagcctggtattcgaactattgatgcagagccaaattgccagcaggggagagatctgtccaac

SEQ ID NO: 6878665 - DNA, 65 bp, Homo sapiens
atcatcccagcagcctcgtaaaggagaactcaattgtcacaattttacaggctctgagagatgat

SEQ ID NO: 6878666 - DNA, 82 bp, Homo sapiens
gggctggtgcagtagaagagcttccacctggggctgcgagaaagccgcctgcagccagggagttctctcctcattgcagtct

SEQ ID NO: 6878667 - DNA, 73 bp, Homo sapiens
tgaaataagattttctgtaaaattgttagcacagcattccagttttgataacacttcagatgattttgttgca

SEQ ID NO: 6878668 - DNA, 129 bp, Homo sapiens
cagggaagaataagtggctgtcatagaagaggacttctgagctgctttaaaacttttcaatatattaccgtttgatgcagcacatagtagtctaccacttgtatgctatatttacttgagatttacctg

SEQ ID NO: 6878669 - DNA, 55 bp, Homo sapiens
gcaggagggggcctggagcccagtcccacatctgggcctctccacccttttctgt

SEQ ID NO: 6878670 - DNA, 59 bp, Homo sapiens
gctagttctttgccctgagcagaagtccttggaaagctactgagggcaaagagtgaagc

SEQ ID NO: 6878671 - DNA, 104 bp, Homo sapiens
tagtcaaagccatacaggttctaggactccatgtgtcctggagatgggaattatcatcccagtgagcacaggtagtgccaatcctgatttctgagctgtgacta

SEQ ID NO: 6878672 - DNA, 70 bp, Homo sapiens
ctggtgaagttttattaaatccacagaagtaaaaaccatgttatgaggaactgggagatggggccaccag

SEQ ID NO: 6878673 - DNA, 61 bp, Homo sapiens
ggttcctggggtttagagggaagtgagcagagctgctccctggcctacaggcccagagacc

SEQ ID NO: 6878674 - DNA, 70 bp, Homo sapiens
ttccaaggctgctatttgtttctcagataacttgtgaaaataaatcaagggcagtatttcctttttggag

SEQ ID NO: 6878675 - DNA, 79 bp, Homo sapiens
catcttcccatttcatgctttttacttactgcatgtgatcaatacatgactgtgttagaagaatgaatggataaagatg

SEQ ID NO: 6878676 - DNA, 82 bp, Homo sapiens
ccatttcattgcctgtaaagtgagtggatgcttgctgtacccctgtcataaagttttataggctcaaataaaatgaatgtgg

SEQ ID NO: 6878677 - DNA, 60 bp, Homo sapiens
cctggagcatgagggaaggcagcagatggcagacccgtcagtcacccctctgctctctgg

SEQ ID NO: 6878678 - DNA, 56 bp, Homo sapiens
tgtatactcatgaagccagccctacattgtggtctttggttttctgagtctgtaca

SEQ ID NO: 6878679 - DNA, 60 bp, Homo sapiens
gtaacagcgtgtatgttatcagcagcactatactaatgctgacctcaacaccgtggttat

SEQ ID NO: 6878680 - DNA, 77 bp, Homo sapiens
ggttcagtgaacattggcacaaggcagcaggaaacaaatcctaagctgcactgagtggcaacaaagtttcttgcacc

SEQ ID NO: 6878681 - DNA, 66 bp, Homo sapiens
gcaatcatctgggttaatgtgctcagccagtacatggatgagctactttattagccaaggtactgc

SEQ ID NO: 6878682 - DNA, 118 bp, Homo sapiens
ctttccagcaggacacagtcgaagagaccacaccaagcagatgggcacaagagacagactcaggaattttgcttctgtctcttatgccttgaggtccttatcttcccaacacagaaag

SEQ ID NO: 6878683 - DNA, 72 bp, Homo sapiens
ggggaataatttaaggagtggcaggccacagtgctggctgtttctgttaggtacttcctgcccactcacccc

SEQ ID NO: 6878684 - DNA, 83 bp, Homo sapiens
tgctggcatccagccaaggctgccagagggcaagccccggctcatcagccctctgctggcctcacctcggctaatgccaagca

SEQ ID NO: 6878685 - DNA, 58 bp, Homo sapiens
taatgatgtgtgcaaactgaattcacagtaatgtggtttctatttgtaccgtacgttg

SEQ ID NO: 6878686 - DNA, 67 bp, Homo sapiens
gtgtgtgtgtgtgtgtgtgtatgtgtgtgtggggtgtgtgcatgcatatatgtgcaggctcacacat

SEQ ID NO: 6878687 - DNA, 65 bp, Homo sapiens
gtcacccaggctggagtgcagtggcacaatcttggctcactgcaagttccacctcccgggttcac

SEQ ID NO: 6878688 - DNA, 101 bp, Homo sapiens
cagtttttactcccaagactttgttagtgctcacgtgttagaaaggcacccaaagttttccacgcttttcagaaaggtgagactaccaaaagtgaggattg

SEQ ID NO: 6878689 - DNA, 60 bp, Homo sapiens
tcatgtcagatgttttctcattaagacagattctgttttttgtgatatgacactgtatgg

SEQ ID NO: 6878690 - DNA, 116 bp, Homo sapiens
tggggtttggtataggcagttgctgcttagagataagttgtgtttttaggagccctctggcttgctttactaaataacttaccatttattaagcagtagctatgtgccagaaacta

SEQ ID NO: 6878691 - DNA, 83 bp, Homo sapiens
gctccaggagggaagaggtggtgagcccaggcctttggcaacactggccaggcccagaggcctcttcccacaagtttggaagc

SEQ ID NO: 6878692 - DNA, 91 bp, Homo sapiens
tttagagaatccttcaggcagaggtaccaagattgatttacgtaggattaaggttcttttagtgcctcaatgacttaaagcagtctctgaa

SEQ ID NO: 6878693 - DNA, 67 bp, Homo sapiens
gaaaagccaagagacagatgcccacccaggtgaaggaagatcgagggggctctgtttcatggagggc

SEQ ID NO: 6878694 - DNA, 87 bp, Homo sapiens
tgctatcgtagcagcagatgcaaacttaccttgagagctgaacgtccacaggcacctcagggctggcttttgcagagctgtttagta

SEQ ID NO: 6878695 - DNA, 59 bp, Homo sapiens
gactcactacctaaaccagacttcctgcttctaagtcttgtgctggagggtagtgagtc

SEQ ID NO: 6878696 - DNA, 61 bp, Homo sapiens
taccagcatctaacgctcctgggactcctgtcggttctatgattcatttagaagtttggtg

SEQ ID NO: 6878697 - DNA, 64 bp, Homo sapiens
ctgggagtgcagccttctgggccgctttcttctcagtaggactgagctgtcaggcgcctcccag

SEQ ID NO: 6878698 - DNA, 81 bp, Homo sapiens
tggatgactgccatgtttttttcatttctaatgaatacatgaaactgccacttagaagtacataagacaaggaggagtgca

SEQ ID NO: 6878699 - DNA, 61 bp, Homo sapiens
gatgctcatctgtcctttgatgctcataaattgaatgtgcactcagggacatgtgggtgtc

SEQ ID NO: 6878700 - DNA, 84 bp, Homo sapiens
ggtgtcttgtcaaacatgcagtgagccgatgagggaactgccgcctctttcgaggaaactgccatggtaagcaagcaggacgcc

SEQ ID NO: 6878701 - DNA, 85 bp, Homo sapiens
tgaaagcagaaggaaaggttgcagcagtgttgatgactgattcattttattcatacacctctcagcccttctcttgctgtcttca

SEQ ID NO: 6878702 - DNA, 67 bp, Homo sapiens
tttcctcgatctggggtggtatggtgggtgctagaacaagctactcagagttccactctaaaggaaa

SEQ ID NO: 6878703 - DNA, 64 bp, Homo sapiens
ctggtgtgtattctaatgttagctcttacttgctgattgtcagagcttagggaattcacatgag

SEQ ID NO: 6878704 - DNA, 64 bp, Homo sapiens
gtttccacaactggctttttagcttgttgtttccacaactggctttttagcttgttgttgaaat

SEQ ID NO: 6878705 - DNA, 57 bp, Homo sapiens
ggttatcatcacctttggcagtagctggaaccaaggttatactaggtcatgataatc

SEQ ID NO: 6878706 - DNA, 78 bp, Homo sapiens
ccacatcatctctcaggggacaagggagagaactagagggatagttatgactcagagttctcctgggaggtgaaatgg

SEQ ID NO: 6878707 - DNA, 90 bp, Homo sapiens
ggtgaagaagcagagtctgactgtgatggtggtggatagctacttgcatccacgttttcaacacagccaatgctgccattctggtacacc

SEQ ID NO: 6878708 - DNA, 57 bp, Homo sapiens
gagtattgggattatgggtgtgagctactacagctcctggccccagatcccaatctc

SEQ ID NO: 6878709 - DNA, 70 bp, Homo sapiens
gctctctggatggactaaatagggctggcttggaaaccgtgagtcagcttcctacaaccatctcagaggc

SEQ ID NO: 6878710 - DNA, 96 bp, Homo sapiens
ctgattcataatcctggccttgccatgcataagtgcagcagatttgcttaatacagcaaaccctggctgtgactttgcaggtaccctttgagtgag

SEQ ID NO: 6878711 - DNA, 74 bp, Homo sapiens
ggcatatggacaaatgtaaggcataataataaatgactccaaaatatcgtgtttttccatttgatccaagtgtc

SEQ ID NO: 6878712 - DNA, 67 bp, Homo sapiens
atgagttggcaagtgttccttcctcttctgttttttggaagacttcatgaagaatttgttaatttat

SEQ ID NO: 6878713 - DNA, 60 bp, Homo sapiens
gggcctgctggtgcttccattgagacacccattctcgcaataggaaagaccagctggcct

SEQ ID NO: 6878714 - DNA, 61 bp, Homo sapiens
agcaggaactgacaccaagccaggccccaaggaggcctgtgagtgtggccagttccctgct

SEQ ID NO: 6878715 - DNA, 67 bp, Homo sapiens
tcagccaaatgtattctcacttcagggatgcaagaacaggccttgcaggtgcagtacagccagctga

SEQ ID NO: 6878716 - DNA, 70 bp, Homo sapiens
agtggtgcagaggtgaaagactagcaagataattaacctttgcaggtccggaacctcgccgttggccact

SEQ ID NO: 6878717 - DNA, 73 bp, Homo sapiens
ctcccaaagtgctgggattacaggtgtgagccagcaagactgtcttgtttctttatcatagcatctttgtgag

SEQ ID NO: 6878718 - DNA, 55 bp, Homo sapiens
aatatgcattatacagactgatgccgagtggcgttcaatctgtgtaatacatgtt

SEQ ID NO: 6878719 - DNA, 72 bp, Homo sapiens
atgctaagtcctttgctgaactgtcacatttcaaattatcctataatgttttaaagggaaagggctatgcat

SEQ ID NO: 6878720 - DNA, 85 bp, Homo sapiens
gggcccatggctcctagcttagggaagggagcactgggattccctcagtccacagtctcacttcttgagctatgctgtagggttc

SEQ ID NO: 6878721 - DNA, 56 bp, Homo sapiens
tgccaaaggacatgtcaatatcaggccttcagaagagggaggtagcagttctggca

SEQ ID NO: 6878722 - DNA, 55 bp, Homo sapiens
gtgtgcttgttttgttttactatcaggataggaatgtaaagcattcttggcatac

SEQ ID NO: 6878723 - DNA, 90 bp, Homo sapiens
tagatttaatttgagagcaaatgtttgcttaaggaggaagttacaggaaagttttcggaagtcagataggtgagtccaaattaaagtctg

SEQ ID NO: 6878724 - DNA, 67 bp, Homo sapiens
catttggctttaatagataaggtttctttacttcagttaaaaagcctgtatctataaaaggaaaatg

SEQ ID NO: 6878725 - DNA, 125 bp, Homo sapiens
aaatatcattggtttcctttctctttttagattcaaagtgaagaacttaaatgtctatggaaaatgacaaattcttaatacgttctgaactttactgaagggagaaagatttccaggtgctgttt

SEQ ID NO: 6878726 - DNA, 68 bp, Homo sapiens
gggaggcagaaagatttcatcactaagttctgatcaacatagctgatgaataattattcttcaagccc

SEQ ID NO: 6878727 - DNA, 59 bp, Homo sapiens
ggcagagctagtggcttctcttgttaaaccatggcaggaatcccgcaccagctgctgtc

SEQ ID NO: 6878728 - DNA, 78 bp, Homo sapiens
ttgcttacctgtgattttgagacctatatagtgaaggtttgttgccactttttagtttcctcaaacatgcagaagtaa

SEQ ID NO: 6878729 - DNA, 63 bp, Homo sapiens
agatctgcatttattcctggtcataagtaaactcttgaggcctgtagtcatggatgtagacct

SEQ ID NO: 6878730 - DNA, 120 bp, Homo sapiens
cattttattttgcatacagagtctttgagtcaggaaattagacagcaactagcaggggtggctagcctctgctccctggtgtctgagacctcagctggaaagacttgaaagctgagaatg

SEQ ID NO: 6878731 - DNA, 57 bp, Homo sapiens
gtgaagccgtcaagtagatcagcattcttgcctgttttctttgctgatgagcatcat

SEQ ID NO: 6878732 - DNA, 98 bp, Homo sapiens
tcattttcagttcaaacctggttatagtaacactctgtcatacttaatatacacagggcaacatgcagtgtgctagatttggactcactggaaaaaga

SEQ ID NO: 6878733 - DNA, 72 bp, Homo sapiens
gcccatttctcagcacttcctatctcccaaatactctaaaattgggaggtatgagccagttgagttttgggc

SEQ ID NO: 6878734 - DNA, 129 bp, Homo sapiens
caaatttgccttttgtaagaatcactccaggtgcttattaaacatgcatattcccacaccccatcccagaagtattgaatcggaatgtttaatggatgcctgtgtgattcatacgatgaggcaagtttg

SEQ ID NO: 6878735 - DNA, 69 bp, Homo sapiens
agatttcacatgcaggagccaatgtacatgtatttactttgctgtattctgtttttttgtgtggttttt

SEQ ID NO: 6878736 - DNA, 69 bp, Homo sapiens
gctggcatgcggcaacacgtcggtcagcgaagacttcctgctggcgggctccatcctgctgctgcctgt

SEQ ID NO: 6878737 - DNA, 60 bp, Homo sapiens
gaggcaagttacctacccaaggccttgctgccagtataggtcaaaattagaacttgcttt

SEQ ID NO: 6878738 - DNA, 103 bp, Homo sapiens
ttgaaactttaacctctcctattaaaacttttgtctatttctactgctgtgcacacacagttttgagtgactaaaggttttaatggctgcagttaagttttag

SEQ ID NO: 6878739 - DNA, 62 bp, Homo sapiens
gagagaaggaagtgaatttcccaaccagaagcgtagggaaattcagatggctttcttttctc

SEQ ID NO: 6878740 - DNA, 56 bp, Homo sapiens
tctcttaggagaaattcataaaatgtgaatcaattttatgatgttgatctaagagg

SEQ ID NO: 6878741 - DNA, 65 bp, Homo sapiens
tgtgcacctggtaaacactttgtatatggtacttatcattattagtgttgatattaggatggaca

SEQ ID NO: 6878742 - DNA, 97 bp, Homo sapiens
agctgctgagcccctccctccagctggctggtctgagcagtcgcagcccagctgtgggctctaatggcagcagacagcaggcaggggcccagctgct

SEQ ID NO: 6878743 - DNA, 62 bp, Homo sapiens
tagcctcagtagatccacaagtgaaaggtatactccttcagcacatgtgaattactgaactg

SEQ ID NO: 6878744 - DNA, 83 bp, Homo sapiens
gggaactgctcaggcaaatttctggtgaagctactgcttattaagagaacttcacccatgaatatgcctaaggagtgttttcc

SEQ ID NO: 6878745 - DNA, 66 bp, Homo sapiens
aggcaggtgaatcacttgagtccaggagtttgaggccagcctgggcaacatggtgaatccctatct

SEQ ID NO: 6878746 - DNA, 61 bp, Homo sapiens
gataagatttccttaattagagcaagacacacctagtatctagagcctggaagtcttggtc

SEQ ID NO: 6878747 - DNA, 90 bp, Homo sapiens
gggctcaaaatttaggaggcatttgctcccagggctgacattgcacttttgggaccctcagagcaaatgtctccttaaatttcccagcct

SEQ ID NO: 6878748 - DNA, 55 bp, Homo sapiens
gcttctatgcttcaagagagagcccagaggtaacttcctaagtggctgtagaagc

SEQ ID NO: 6878749 - DNA, 64 bp, Homo sapiens
gggaagcagacggcggggaaatcccacactgctcagtcctggcccatttcctccctctcttctc

SEQ ID NO: 6878750 - DNA, 99 bp, Homo sapiens
ctggtctctttggagggccctttcattggcagagctctctgggcaagaggagctggggagcctcactccagttgaggggtcctctgggtccaggaccag

SEQ ID NO: 6878751 - DNA, 57 bp, Homo sapiens
acatcttccttgttccaatttgggcttattcaaccaaggagtagagcaggaagctgt

SEQ ID NO: 6878752 - DNA, 57 bp, Homo sapiens
tcttctccctgtcctatcaagacttacagcaaggtcccaggttgacagggagacaga

SEQ ID NO: 6878753 - DNA, 114 bp, Homo sapiens
cgctccttggggacattcatcgaggaggaggcagtgtcggtggcaggatgtggaagccacacacctggatgctggccttgccttggctccttttcggctgtggtctcttgagcg

SEQ ID NO: 6878754 - DNA, 78 bp, Homo sapiens
ggaacgatggttgaatgtagcatttatggttgaatgtagagaaaatacagtataatgagtcgctttgttccaggttcc

SEQ ID NO: 6878755 - DNA, 57 bp, Homo sapiens
gagtaccattcacatgtgcaggcagtactagggggcttgcatttgttatttgtactc

SEQ ID NO: 6878756 - DNA, 68 bp, Homo sapiens
gttaaatacatgcttatatggaaaggaagagaaaaaactctcaatctttagaccaaggcatgatgaac

SEQ ID NO: 6878757 - DNA, 64 bp, Homo sapiens
gggatgaagcctgaagaaccccaatctcaagaactgacgaggtagactttcaaggttacgttcc

SEQ ID NO: 6878758 - DNA, 69 bp, Homo sapiens
tgctcctccctgggaggctggcattctgctttcaaggacaacatcagatgctcagggaatagaggagca

SEQ ID NO: 6878759 - DNA, 61 bp, Homo sapiens
ggctaaatggaatgtagatgtcaggagaaaatgctccaccacttcctgcagccattcagcc

SEQ ID NO: 6878760 - DNA, 89 bp, Homo sapiens
ctgaattgaatcctgcctagaatttacttattttttcatttttgctattggtgagacagttggtgaaatctaaatatagttcagactag

SEQ ID NO: 6878761 - DNA, 67 bp, Homo sapiens
tggagaactggggccaggaccctggggtctctgccaatgcctcaaaggcctggcaccagaagtccca

SEQ ID NO: 6878762 - DNA, 82 bp, Homo sapiens
ttgctttattttgtgagggattactaccaaaagaacaataaactttcccttcggttctgtactccctctcaaggctgagcaa

SEQ ID NO: 6878763 - DNA, 76 bp, Homo sapiens
gtttttcccggtttttataggactcattaaggcagagataatttgttgtaatcattttatgaaaacatggaggaat

SEQ ID NO: 6878764 - DNA, 114 bp, Homo sapiens
tacctaaaaacaaggattgcttagtgaaagtgtttgcatatttttaagtttacagagctcctcagactttaatgtgcaaatgaaacacttggagatcttgtcaaaatgcaggtg

SEQ ID NO: 6878765 - DNA, 71 bp, Homo sapiens
atgtaagaggacattctggacaaggcaagctcctggcatttgacagatgctaatgctgcttctttttgcat

SEQ ID NO: 6878766 - DNA, 85 bp, Homo sapiens
tatgtgaatcatgtctaggggcaggggtttgaaggtacaaagcctctaggtaccccaactctagttgcagagcatgacccatata

SEQ ID NO: 6878767 - DNA, 67 bp, Homo sapiens
gactcttgtgaaacatggcaagtttgggctctgtggcttaagaaatgtctagtttttgtcaaaagtt

SEQ ID NO: 6878768 - DNA, 56 bp, Homo sapiens
ggccttgggcagacacgtcacacactttactggatcaaacggtgtcagccttggcc

SEQ ID NO: 6878769 - DNA, 102 bp, Homo sapiens
ggtgctgtggttcacacctgtaatcccagcatttcaggaggctgaggtgggaggatcacttgagcccaggagtctgaggctacagtgaaccatgatggcacc

SEQ ID NO: 6878770 - DNA, 64 bp, Homo sapiens
gacattttccaattgcagatcagatacatgtgcactgcacattggaaatgcattggaaagagtt

SEQ ID NO: 6878771 - DNA, 55 bp, Homo sapiens
ccttggctggtaagccaaatgaaagcagggttttcatagaggaagccagtcttgg

SEQ ID NO: 6878772 - DNA, 99 bp, Homo sapiens
acgtaatatcatacatgttcacatcgatggattttgcttaggttttcttctccttgcctgtgtgcatgcatgtgtttgtgtgtgtgtgtgtgtgtttgt

SEQ ID NO: 6878773 - DNA, 82 bp, Homo sapiens
tgttaatttgattgtaggagctaaaatattttatatgtataatatgtagaaagttattttactcttatcaggtaaataagca

SEQ ID NO: 6878774 - DNA, 68 bp, Homo sapiens
gtgggccctgtttccagtttttaaaaatgaactcttgaaatgaaggtgggctggacatggtggctcat

SEQ ID NO: 6878775 - DNA, 71 bp, Homo sapiens
gtgcctgttccatttagctggcaaacaatgttagaattactgattagccagtgaaatggagaaattggcac

SEQ ID NO: 6878776 - DNA, 104 bp, Homo sapiens
ccagttacctatgtggacagttaggttattttggtttttcactatcacaaacaatggtacaattaaaataattttgtaagctcatctgtcaggtaagtccctgg

SEQ ID NO: 6878777 - DNA, 83 bp, Homo sapiens
cagaatctgccccaggacctcttctggagaaaatcccgtctcttgttccacttctctgaatgtctctgttggggcaaattctg

SEQ ID NO: 6878778 - DNA, 66 bp, Homo sapiens
ctctgaagggagggccaagccctccatccaaccattcactgggcctgtccccctcctccttcagag

SEQ ID NO: 6878779 - DNA, 79 bp, Homo sapiens
ctatcagagctttagtttccacggttataatgacacccatcttgcatagtggctgtgagaattagaataatctctgtag

SEQ ID NO: 6878780 - DNA, 67 bp, Homo sapiens
catctcactgaggggtttacaaaagggcctgacttagtgcctggccttggggactcctcagtgaatg

SEQ ID NO: 6878781 - DNA, 64 bp, Homo sapiens
ggctcctgcacctgtccctctgcgtgatccccctcccgtaaggggtttgaacaggcagcgagcc

SEQ ID NO: 6878782 - DNA, 62 bp, Homo sapiens
tgttgtttgtgtgtgtgcgcgtgtgcgcatgcacatgcgtgtttgtatacacacaaaaaata

SEQ ID NO: 6878783 - DNA, 65 bp, Homo sapiens
aggccttatctgaacttcgagcgcgaattaaagaactcgagaaggcgcgctcaccaggtaagtct

SEQ ID NO: 6878784 - DNA, 104 bp, Homo sapiens
tatcctcttcgaggcttttctagtctaagaaatctttacttttcattaggagagttgaggttagcacttacttggctagagtggcagggtctggagtgagggta

SEQ ID NO: 6878785 - DNA, 81 bp, Homo sapiens
ggtttttggtgtgaatgagaaagttaatcatcatgagagaattcagctcagagagcagaacttttttacataccagatgct

SEQ ID NO: 6878786 - DNA, 59 bp, Homo sapiens
tcctaggaatactgcctgaaatgacagtgcatttgctgttcaggtaaaattctttagga

SEQ ID NO: 6878787 - DNA, 125 bp, Homo sapiens
gttgtgcaggatctgatataatcctacattcataagtttttgtgctgggtttggggagagagggtgtctccccagacccagcacaaaaacttatgaatctaggattatatcagatcctgcacaac

SEQ ID NO: 6878788 - DNA, 75 bp, Homo sapiens
tttggggaggagcaggaagtggtgaagttgatagaaggcccaacccactctacctggctccatggaatccctgaa

SEQ ID NO: 6878789 - DNA, 76 bp, Homo sapiens
ttttggtattgtgtatattaggacacattctgatttctgcatcagaacgctgagtgagtgtgcacagtaagcaaag

SEQ ID NO: 6878790 - DNA, 103 bp, Homo sapiens
ctctggggtccttaaatatcggtctcccgtaggttgctgtagtcggccaattcgtaggcctggcaggtggcgccctcggccacctcgtgtgggacgcctaggg

SEQ ID NO: 6878791 - DNA, 83 bp, Homo sapiens
ttataagaaaatatggaatattttttgttaactcaggataggtataaccatcctggctaagacaaaaaatccaagttttgtaa

SEQ ID NO: 6878792 - DNA, 76 bp, Homo sapiens
gggagaccatggccccccgtcccagcacagaggctgcccttggcagtgggcatggggcggacctggttcaagtccc

SEQ ID NO: 6878793 - DNA, 119 bp, Homo sapiens
aggatgtattgatgtttcatgttgtaagtgctttcagtgtgctcttttaacattacttagtttaaaatgaaaagataaaatgaaaagatactgcaaacatagtaatcaagttaactcct

SEQ ID NO: 6878794 - DNA, 122 bp, Homo sapiens
atctttctcatgctgactttaatccagcctatgctagtttcttgttggcagagatgttatggcttctggccaacaaaaactaagtcagttctagctggttagtgtcatgatgtcataaagat

SEQ ID NO: 6878795 - DNA, 57 bp, Homo sapiens
ggatggtgacggcggcccgcttcatctgcaggaagtgccgacgctccagcaccatcc

SEQ ID NO: 6878796 - DNA, 60 bp, Homo sapiens
acactgttgcttacagttttggaccctggcacttcctggggcctaagtaacaacagttgt

SEQ ID NO: 6878797 - DNA, 81 bp, Homo sapiens
gctgcttcaggctggaacaacatgctggaaaattgtggtctgccatgcatttcctttgatgttattccatgccagatcagc

SEQ ID NO: 6878798 - DNA, 98 bp, Homo sapiens
gcagtgagagctgtggcctctggagtcacagtgacctgagtcagagtccagctttgctactgtctatctgtgcttctctaggtggcagatttaactgc

SEQ ID NO: 6878799 - DNA, 126 bp, Homo sapiens
taaagtttattgtttttggaaatagttttttggcaaatattttgttttgtaagttttacatttctaaagttgaataaaattaaatgtttagcaggtgcttgttgtaatagaagctataatatttta

SEQ ID NO: 6878800 - DNA, 57 bp, Homo sapiens
tcagcttgtttatgataagcagtccaaaatgacctcaaaaatcgtggacaagcctga

SEQ ID NO: 6878801 - DNA, 57 bp, Homo sapiens
gaacatgcctgatccatgccctccgcagaagctgcggtggctgggtctggcaggttc

SEQ ID NO: 6878802 - DNA, 75 bp, Homo sapiens
ggggatctgagtccaagagtctggaagaacctgtgccagtggaggacactgacttgttcttccagcactgtcccc

SEQ ID NO: 6878803 - DNA, 95 bp, Homo sapiens
tccttcacttgcaaagaattttacattctaaccaaagattcctgagaaataaatctgtaaatgtagaaatgtaggcttcctgacaggtaagagga

SEQ ID NO: 6878804 - DNA, 55 bp, Homo sapiens
gcctaacttggctttgttcaccctggctcaggctgaagcaactggacaagttggc

SEQ ID NO: 6878805 - DNA, 90 bp, Homo sapiens
tgttggcctgggaaattttacatggctaagaaaatatagtagaataattgctctgcttctcagactatagtagagattcctaggttagca

SEQ ID NO: 6878806 - DNA, 55 bp, Homo sapiens
cctctctttctctcttgtctttctcagagttggaaatgtcagagggatgagcagg

SEQ ID NO: 6878807 - DNA, 72 bp, Homo sapiens
ccttgaaacaggccaggctcccaccttgcttgtgcaacagccactccaggggccagaagcctggcctcaggg

SEQ ID NO: 6878808 - DNA, 63 bp, Homo sapiens
ccaggagtggggaccccggggggctccctcacagagcctgtccccaaggtgctcactgtctgg

SEQ ID NO: 6878809 - DNA, 78 bp, Homo sapiens
gcctgggaatttgggatacatcttgctgagcctagagacagaaaagagcttctaggctgccttccctgagccccgggc

SEQ ID NO: 6878810 - DNA, 71 bp, Homo sapiens
ctggaggagacggggtgcctggagccctgtgagcaatagggccacccacctgccccccaggtctcccacag

SEQ ID NO: 6878811 - DNA, 92 bp, Homo sapiens
cttcacagggtgaggacaaaatgagacacatgtgacttctttgtaaactgtgacaaaatgagacacatgtgactcctttgtaaactgtgaag

SEQ ID NO: 6878812 - DNA, 85 bp, Homo sapiens
tctgcctagctgaagtgtcttttagccacttttatacaaataagtaatgtatacttagaatacttgggacacttcactgggttga

SEQ ID NO: 6878813 - DNA, 84 bp, Homo sapiens
tctgcaatctgtgatagtttgttactttttccttgtctttcatgatctggaaactagaagaatactagtcagttgttttgtaga

SEQ ID NO: 6878814 - DNA, 55 bp, Homo sapiens
ggtcttgccctagaggtctgggggcctgcaaagtccctcacccctaggcaatgcc

SEQ ID NO: 6878815 - DNA, 56 bp, Homo sapiens
cagcctggacagcgaccagagtagtggctcgaccgcttctggctcctgccaggctg

SEQ ID NO: 6878816 - DNA, 56 bp, Homo sapiens
agctccagttacttacctagagtcacctgtgatgtaagttagtgagtaattgagct

SEQ ID NO: 6878817 - DNA, 56 bp, Homo sapiens
actatgaatcagagaaaataagtgacctgcctaaggtcatccagttggtttatggt

SEQ ID NO: 6878818 - DNA, 60 bp, Homo sapiens
ttgaatcacggtattctgcacggggtgccaagccctgtggtaggtgtcctgtgatggcaa

SEQ ID NO: 6878819 - DNA, 81 bp, Homo sapiens
gtcaatgcctgctttcagacctggatgtgggggcctgctgggtgccagccccctgctaggctctgggaataggacaatggc

SEQ ID NO: 6878820 - DNA, 57 bp, Homo sapiens
ggtggcctagaagataaggggagtgtttttctcccagcctgttaccttcttgcctcc

SEQ ID NO: 6878821 - DNA, 101 bp, Homo sapiens
tgaagaattgtgtttagcaataaagggatattaaaattgacatggtttttggcagtggttcttgtcttagtttcctgttgttgctgtcacaaactgctaca

SEQ ID NO: 6878822 - DNA, 61 bp, Homo sapiens
acaaggtgattgggatagctggttttatttatttatttttgaggccattctagcactttgt

SEQ ID NO: 6878823 - DNA, 82 bp, Homo sapiens
aaagagattttgagatgtttctgggaaggaaaagtcagaatcataatttatgcttttctagctagaacatccgtgtcttttt

SEQ ID NO: 6878824 - DNA, 66 bp, Homo sapiens
ggagggtctgcattccaacttgggggtttccagtagcctaagtttgaaaatgcaaatcaaccctcc

SEQ ID NO: 6878825 - DNA, 58 bp, Homo sapiens
gcctgctccgagagtgattgcatttggcacaatatgcagtttgcttcgcagcagtagc

SEQ ID NO: 6878826 - DNA, 75 bp, Homo sapiens
tgcactctaacaaagagactacggtggagtttatagaagcttctacaacgtggttttgttgtatatagatgtgta

SEQ ID NO: 6878827 - DNA, 64 bp, Homo sapiens
cttcgaatcaatctataaatatcagtttccttgcgctataggcaaagtgataatagatttggag

SEQ ID NO: 6878828 - DNA, 72 bp, Homo sapiens
gggcagagttctaaattctttacattggcttcttcccttctgggattcccactgtgaagagagtatgtgccc

SEQ ID NO: 6878829 - DNA, 58 bp, Homo sapiens
tcctggggcttcaatgcttcggtgggctctgcccgctgtgggtcagggggccccggga

SEQ ID NO: 6878830 - DNA, 86 bp, Homo sapiens
gtatattcatcgtgtagaaatactcttttttgccttttacttatttctacatataggttattgagtttttctgcatggttctgtat

SEQ ID NO: 6878831 - DNA, 61 bp, Homo sapiens
gccaggaggctcctcggggctgacggcggggactcgcacgaggcaccgaggagcctctggc

SEQ ID NO: 6878832 - DNA, 78 bp, Homo sapiens
atagctttaaatattatcattcaagacccttctcattagaattgttaggcacttgaattgatgatgttagaaggctgt

SEQ ID NO: 6878833 - DNA, 55 bp, Homo sapiens
tctttacatcacaattgtatggaacagagaccacccatataatggatggaagaga

SEQ ID NO: 6878834 - DNA, 102 bp, Homo sapiens
ggcttctctgggctggggtactgtcctagaaaagctgccagctcaggctcaagcagctgtgggctcccagcttctctctgccgacccccatcccactttgcc

SEQ ID NO: 6878835 - DNA, 89 bp, Homo sapiens
ggtcgctctgggggattggtagagctctgttcactcccgggccaggccgggctcatggacagctctccagccagagaaagaaaccgacc

SEQ ID NO: 6878836 - DNA, 101 bp, Homo sapiens
gtgtgtgctgggccgccgggccctggggacagcctctcacagcatgtctgcaaggtgagtgctcgggtgtcccgcggggcctactgccgtccccaccccac

SEQ ID NO: 6878837 - DNA, 78 bp, Homo sapiens
agaataggggcaacagaaatctgtctctttgtctagacaacaactgcacagacagattttgtctgatgtatctatttt

SEQ ID NO: 6878838 - DNA, 55 bp, Homo sapiens
gttcccaattagtgctatttacagacatgtaacaccatggctgctgattggggat

SEQ ID NO: 6878839 - DNA, 100 bp, Homo sapiens
gtgctgggcgtttttcccctccttgggatcattttctcttattcacgaattgcttcatccataaggaagatgtcctcatctgggggaaaacaaaaagcac

SEQ ID NO: 6878840 - DNA, 75 bp, Homo sapiens
tgctctggacttgagatgtgttgttaacctggctggtaagacaggttcttaagtaacagcacaccttcccaggta

SEQ ID NO: 6878841 - DNA, 88 bp, Homo sapiens
ccagaatctgctaccagacgggacttatcacagatgtagagatctgaaaaataacagatatatattataagccctttcagaattctgg

SEQ ID NO: 6878842 - DNA, 57 bp, Homo sapiens
acagtggtgtctgagtggccagggaaggtagccctccccagctctcagcaccactgt

SEQ ID NO: 6878843 - DNA, 100 bp, Homo sapiens
cttctcagggactttctttattaattcagtggtttctgcaacaagaccccgagtgctagtgctgaccattgatttataaaggtagggagagatggaggag

SEQ ID NO: 6878844 - DNA, 59 bp, Homo sapiens
gaagtaggcaggagggtcagagtcagagagaaagttgacgatgctatgctgctggcttt

SEQ ID NO: 6878845 - DNA, 87 bp, Homo sapiens
tcagtgtgctcttctggtgccagtattaacactgtaacctctgcaattctgactgttcatgctggcccagaatggaggatattttga

SEQ ID NO: 6878846 - DNA, 91 bp, Homo sapiens
ggcatgaagactatatatagctaaaagagatattgtttatatattgttttaagtaatataaaatgtagttactggtgtagcttttcctgtt

SEQ ID NO: 6878847 - DNA, 55 bp, Homo sapiens
atactgattgccgggttgcctaccagctagcttcacagacctgacagtacagtgt

SEQ ID NO: 6878848 - DNA, 55 bp, Homo sapiens
ttcatctagaggttctggccgtgcatgctgagtactgcacaggacatctgatgga

SEQ ID NO: 6878849 - DNA, 112 bp, Homo sapiens
gcctaacttggagtttcttgcagagaaggaaacggcaaaactgcttagttggcccaaatccaaactgacaagccttttctcctttttaagtatttcccaattgctgttaggc

SEQ ID NO: 6878850 - DNA, 89 bp, Homo sapiens
atcacaccttaatgtgtctgatggccctgaattgacggtcatgtcaggagggcctctgatctgacacaggcagtttaggaggctgtggt

SEQ ID NO: 6878851 - DNA, 77 bp, Homo sapiens
tgaacatctggctttgtgaaattgagccctgtgtctgaatgacacaacagaagagcaattgcaaagtcctgtgttca

SEQ ID NO: 6878852 - DNA, 55 bp, Homo sapiens
ttccctttgttgatttcctagtccttggttactagaggagtattttctaagggaa

SEQ ID NO: 6878853 - DNA, 56 bp, Homo sapiens
gcaaatgcactgcatttagattgatttttgtcttagtcaaactggggtacatttgt

SEQ ID NO: 6878854 - DNA, 105 bp, Homo sapiens
ttttacttaaccaaaccggcactttctctttaagtataatcttatatggaacctcattatataaaactaaacagaagagtagctgctgccctggttgaagtagaa

SEQ ID NO: 6878855 - DNA, 70 bp, Homo sapiens
tgttaagactgtacattttccagtctttggaaacagccttattttgaaaactgggcatgtacacttctca

SEQ ID NO: 6878856 - DNA, 122 bp, Homo sapiens
aagctattctaatagcactagtctaatagcataaaatttgctactgttaaataaatgcttatcccctgcataatttacaggtagaattttaagtaattggatcaaatagctagaagaggctt

SEQ ID NO: 6878857 - DNA, 73 bp, Homo sapiens
gagaaaagtgattatgctgtcaaagaagcaaaaggagcttccaacagtaatagtgatcattgaggagtttttc

SEQ ID NO: 6878858 - DNA, 97 bp, Homo sapiens
tggggtaatatccatgtcattatgtaggaaacatagggaaacaaaggaaagtctctgattccactttttcttgacaaaataacactccgggttccca

SEQ ID NO: 6878859 - DNA, 76 bp, Homo sapiens
cctgtgtgaggattcctggttcttctctgccctttgaactgtgtagcatggaagggattaaagattttcacagagg

SEQ ID NO: 6878860 - DNA, 59 bp, Homo sapiens
cttagagccttactcttcttgtctgtaaaataaagatgaggatgacagcaggctcagag

SEQ ID NO: 6878861 - DNA, 62 bp, Homo sapiens
gtgtgtagtgaggagtgtgaccaaaatttaaattttattttgattaaatttaagctacatgc

SEQ ID NO: 6878862 - DNA, 57 bp, Homo sapiens
gcttctcgcgctcgcccctcctaccgcatctccggccaggggcacctgcgacggggc

SEQ ID NO: 6878863 - DNA, 60 bp, Homo sapiens
gtcctcataataaacatttgctgagtctaggtaagaaatcagcagacctgttatttggat

SEQ ID NO: 6878864 - DNA, 56 bp, Homo sapiens
aaagctgttaaatgcataatgccacttggcaaaactactgtgcatttaatggtttt

SEQ ID NO: 6878865 - DNA, 60 bp, Homo sapiens
atctagccaagggtcagctgcacagagagacacatttaggtgaagacactttggcttgat

SEQ ID NO: 6878866 - DNA, 56 bp, Homo sapiens
gagctgcctcccactctcatcagcacggagatccgggctgccagggcggagacatc

SEQ ID NO: 6878867 - DNA, 127 bp, Homo sapiens
gctactgctggtaaataatggagtcttcctttctggctctgccaagttacgcaaagtgtaactgatgatggtggttacacaatatatggtacttggtttggatgcagaattgggatggagcaggggt

SEQ ID NO: 6878868 - DNA, 63 bp, Homo sapiens
gctcacttgtaaccccttcctcaggtccaagagaatgggaggagggtcatgttgaagtgtagc

SEQ ID NO: 6878869 - DNA, 82 bp, Homo sapiens
acctcaagactttcaagtatgcatgcatgcattcattcttcaactagggtatttgacaagcatttttgagtatctgtgatgt

SEQ ID NO: 6878870 - DNA, 55 bp, Homo sapiens
ctgaggtgagcttccctgggctccggaggcactggagtagcgaggcccaccttag

SEQ ID NO: 6878871 - DNA, 84 bp, Homo sapiens
acactgcggaaccgctcctgaccagctgtgtcccacatctgcagcgacaggcactggtcaggctgtccagcccttccctggtgt

SEQ ID NO: 6878872 - DNA, 78 bp, Homo sapiens
gcttaaggtggtaagatattttgtgtgatgtttcatggaatctatggaaatgtaaccaaggctatcagctctatgagc

SEQ ID NO: 6878873 - DNA, 71 bp, Homo sapiens
agagtccccagtacaaggaagcacatatttttggattttgccgtgtgaccttgtctggctggctggacttt

SEQ ID NO: 6878874 - DNA, 112 bp, Homo sapiens
acttaattttattaattcaagaaagtttgctctgttttccgtatgtgccagaaatgatcatggttcattgagaagactgaagggaactttgctgaataaacctttattaagt

SEQ ID NO: 6878875 - DNA, 123 bp, Homo sapiens
gctctacctaagggaagcttgagtagggcatgctttagtttggacttatgaagtattgcatgcttcatatttcatgaagtccaaactaaagcaccccctactcaaggttcccttagctagagt

SEQ ID NO: 6878876 - DNA, 81 bp, Homo sapiens
tgcagtgagaaatgagttaaatcagctctcactgtcaactggaacagccttggagctgagttaattcatcacttactgaca

SEQ ID NO: 6878877 - DNA, 65 bp, Homo sapiens
ggatgagaactttgtagacttgatgaacattgtgaaatgtaacattaggtagacataagccattc

SEQ ID NO: 6878878 - DNA, 56 bp, Homo sapiens
gaggaagcagggcttggctgagatgcaggctgtgggcggctgagctgggcttcctc

SEQ ID NO: 6878879 - DNA, 72 bp, Homo sapiens
cttataacaacagtttactttaaaaaatgacctcttttttccccccatgttgaagttctgctgtgttatagg

SEQ ID NO: 6878880 - DNA, 82 bp, Homo sapiens
ctgtggtttgggagttcatagtgacatgcattctggcttgcagtcatacattggttagtcaaatgcgtgttctcagacacag

SEQ ID NO: 6878881 - DNA, 63 bp, Homo sapiens
ttttgcaaatattcccctaggtctgctcttgctgacagattgatagttgggaatattttgaaa

SEQ ID NO: 6878882 - DNA, 98 bp, Homo sapiens
ggattttctctgctccagtgtctgagcccttagctgggatgactcacatgactcaggaagctgaaggctagaacagctggtttggagaaaccaattcc

SEQ ID NO: 6878883 - DNA, 61 bp, Homo sapiens
ggccttgagagccagtgcaggcccaggagagctgagagtcacctgtgctgccctcggggcc

SEQ ID NO: 6878884 - DNA, 98 bp, Homo sapiens
gccatgggcctatgaggcctccccatctctccttcagctgaggccccgaggttggggctaggacacggaggggtggggtgggcttggcagttcgtggt

SEQ ID NO: 6878885 - DNA, 56 bp, Homo sapiens
tccacagactcatgctcctgaagcaagccacatgtgtggtggcatgagggtgtggg

SEQ ID NO: 6878886 - DNA, 87 bp, Homo sapiens
ttccatgcccagagaaagtaatatggttttcctctgctgcttaacatatagttacacctcagtgagaagatctttctgttcatggaa

SEQ ID NO: 6878887 - DNA, 56 bp, Homo sapiens
ccacattgtaggccctataaggggtcagcccccttcacagtcaccctgctgtgtgg

SEQ ID NO: 6878888 - DNA, 101 bp, Homo sapiens
atcactgcagaaagttgtattggacagtgcagatctacacgctggtgaggccctgtgtgttcattagcattgccttggaagatgtaaccttcaaaggtgat

SEQ ID NO: 6878889 - DNA, 102 bp, Homo sapiens
taaccatgttgtttttctagaccttaaaggccaccctgtgaagctgctgcctgggtattgtggtctcttaaaatggtcctggtgaaaaaaacaacttggtta

SEQ ID NO: 6878890 - DNA, 107 bp, Homo sapiens
tagctccagtgttaaacagttcagcactgggtctgattcaagatggatttccttcatttgacccgcctcagaccccaggtgctggctcagctgtggcgctgcttcta

SEQ ID NO: 6878891 - DNA, 62 bp, Homo sapiens
ccgcctgctcaagtgcgcacccaggggcaagaacggcttcacccctctgcacatggctgtgg

SEQ ID NO: 6878892 - DNA, 107 bp, Homo sapiens
actgggacactgcggcgagcaggggcatggagcagcagaaggggcttggtcaccgttcatggctctgtgtctgtggctccggtggtctcagattccgagtgcccggt

SEQ ID NO: 6878893 - DNA, 71 bp, Homo sapiens
atgtttcaaaagtcaggctattctcagacatgctatacgcaagagaatgtgtccagatttttgatttgcat

SEQ ID NO: 6878894 - DNA, 68 bp, Homo sapiens
gagcctctgaatcatgctcaataatgcttgaccaataatttggtaagcatgttttgcagtgatggctc

SEQ ID NO: 6878895 - DNA, 74 bp, Homo sapiens
gatctccgtacgcagggccactgaaagagcatcacgtagcaaagcttttcaggaaatttgtgtcacaggacgtt

SEQ ID NO: 6878896 - DNA, 62 bp, Homo sapiens
tggagtaagagccaccagccaaggaatgtgcacagcctgcagaagctggtggctctcctcta

SEQ ID NO: 6878897 - DNA, 57 bp, Homo sapiens
acgtccattattgccagccatactgaatccctttgattccgtggatgcaatatgcgt

SEQ ID NO: 6878898 - DNA, 118 bp, Homo sapiens
agccccccaggcccctccctgtcagccatgagcagccgggaggtgtgcaggccctgtagggaaccagcattgatcccaggctgtgggatgggggtggggagggagtaggagaggggct

SEQ ID NO: 6878899 - DNA, 79 bp, Homo sapiens
gtcaaaattcccaaatgcagtcttagaatcctggcaggcacacagacaaatggggcttggcaggtctgggattgttgac

SEQ ID NO: 6878900 - DNA, 56 bp, Homo sapiens
tggccttaattatgtaatttattgcccattgcagtagtctacagtatttgtggtca

SEQ ID NO: 6878901 - DNA, 77 bp, Homo sapiens
gcagctggaagtccaagatcaaggtgtcaggagggttggttccttctgaggcccctccttgacttgcagacagctgt

SEQ ID NO: 6878902 - DNA, 68 bp, Homo sapiens
tggggtagactgatgggactgaggtaatcctgaagagggttcctttcccacgctcagtcctataacca

SEQ ID NO: 6878903 - DNA, 59 bp, Homo sapiens
cagattggaaccctaggcaggcagatttgtgaggtcaaagccagcaggggtctgtactg

SEQ ID NO: 6878904 - DNA, 58 bp, Homo sapiens
tctggaaggaagagctgagtccctggctataccctgccatagcctgctttctcctaga

SEQ ID NO: 6878905 - DNA, 79 bp, Homo sapiens
gggttggtacactggttgaattgtataactggtgatatcactgctgtggttgaataactcatgccagtatttgccactc

SEQ ID NO: 6878906 - DNA, 95 bp, Homo sapiens
gaaaccccgggcggagcagagctgggcttggctggtccatgtgattcccccttgctgaccagcacaggcccctctctcccagggcccagggtttt

SEQ ID NO: 6878907 - DNA, 57 bp, Homo sapiens
gaccagggttgagtcagctgcgtcagtgggagccacacggggcttgtggccatggtc

SEQ ID NO: 6878908 - DNA, 65 bp, Homo sapiens
ctaagcatgaagccctcatcagtctgagagtttctcctcatcagtctgagagtttcttgctgtag

SEQ ID NO: 6878909 - DNA, 61 bp, Homo sapiens
actgttcttcccatttatattgggcaccacttttggttgtatttatgatgggatggatggt

SEQ ID NO: 6878910 - DNA, 78 bp, Homo sapiens
tgcaggaggtcatagctgtgcaggtagccaagtaccgtgcagtactgcaaatgccttgacagttgtaagacctctgca

SEQ ID NO: 6878911 - DNA, 91 bp, Homo sapiens
tggaatctttctgatgctggcacatttctcattatagccaacttggcatcagtaaaccaatgaaatgtgtgcaatattttgaggaaattca

SEQ ID NO: 6878912 - DNA, 129 bp, Homo sapiens
acagatgctatgctctaaattattgataaagattttaaaggtgaaagagatgcagcataatgggaagaactcctatttccttctcttttccttcagaaacttcaggtattttaaaatgttaacatttct

SEQ ID NO: 6878913 - DNA, 72 bp, Homo sapiens
aaaactaagactgtgagctcagagactctggtcagtattaccttagtcacactatggccacagttgtgtttt

SEQ ID NO: 6878914 - DNA, 86 bp, Homo sapiens
accatgaccaagagtccaggtcaagaatgccagtgtgcttctctcaacaaaacatagcttgattctgggcttttaggcttttaggt

SEQ ID NO: 6878915 - DNA, 102 bp, Homo sapiens
ggttttaaaagttgtatagtcatgaatggacactttttaataccatctatgagaaattcaatggcaaagtgttttcatacccatatgctaactgctgatgct

SEQ ID NO: 6878916 - DNA, 62 bp, Homo sapiens
gccctctctttccactcctattgcatctcagagtccttttctagtcgggggaaggggagggt

SEQ ID NO: 6878917 - DNA, 74 bp, Homo sapiens
gccctggccgcctggggccgggtgaatccgccggccagtgcgggtataaattacccgggcccgcgcggccgagc

SEQ ID NO: 6878918 - DNA, 81 bp, Homo sapiens
agttgtaaataattaaaagcttcccaagagttaaatgaaggttatgatgactcttgataacttgttaatctgttgctgact

SEQ ID NO: 6878919 - DNA, 80 bp, Homo sapiens
taactttatttctatcataaggaatctcattttggtggattatattttccatataatgggattccttatcagtgaggttg

SEQ ID NO: 6878920 - DNA, 100 bp, Homo sapiens
caactatttacacttcagtatgtagaacaagtgttttatgcatagttcatatttaatcacatggaatattgaatagacatgcaatcgaaggtggatattg

SEQ ID NO: 6878921 - DNA, 57 bp, Homo sapiens
gtggcacagaagtttagagaacgtagagaaaacggtgagctagataacctgtgccgc

SEQ ID NO: 6878922 - DNA, 85 bp, Homo sapiens
gcagctcatggggtagaagcaatgtctgctggtggaaagagcagaggtttagaatcagaagatttgactgtgaccccaagcctgc

SEQ ID NO: 6878923 - DNA, 84 bp, Homo sapiens
ctcgttaactgtcgacccagaaagatacaggtgaaagaattcaaaaagatacctgtgggcttgaggttagacagtcatttggag

SEQ ID NO: 6878924 - DNA, 58 bp, Homo sapiens
tctgggagactgtgttgaccaacttcttggcaaagtaaactaccactgtttcaccaga

SEQ ID NO: 6878925 - DNA, 124 bp, Homo sapiens
acaggtaaaatcagaagcaggtgtacagtggggctccagggccccccagttgcacggactccttctgaagcctgggagggctctggcaatgtgcccactggtcatatatttttgtacaatttgt

SEQ ID NO: 6878926 - DNA, 90 bp, Homo sapiens
acggattgtgccttggaaagaatactgtgctggaaattagtagatctctaactttcagcaagtaattctggacccaagtacctcattcgt

SEQ ID NO: 6878927 - DNA, 59 bp, Homo sapiens
ccacgctggctgtttcccttagctgccaaggtggaaagctccagggaacaggcagtagg

SEQ ID NO: 6878928 - DNA, 77 bp, Homo sapiens
gaagcactggttgggaaaggcagaggaaagatttcttggtgacttttgagtttttacctttccggaccaattgtttt

SEQ ID NO: 6878929 - DNA, 56 bp, Homo sapiens
tctcatgtattgccctggtgtgactgaggaccatgctcagggaaggccacgtgaga

SEQ ID NO: 6878930 - DNA, 59 bp, Homo sapiens
aagaaccgagattacatgatccatcagcacttcagctgattctctgactcttggctttt

SEQ ID NO: 6878931 - DNA, 60 bp, Homo sapiens
tcctcatctcagcactgagcactcaagaaccacagcatgtgcaaaggacctgaggtagga

SEQ ID NO: 6878932 - DNA, 68 bp, Homo sapiens
tagagaagagaatgcacaaaggtgtctattgcagtaagttttgttctcaacatgtttgtgtcttcctg

SEQ ID NO: 6878933 - DNA, 82 bp, Homo sapiens
ttcctgttgagttgtttaatttggagatatcacaccttcacagaagcacactgtttgtgatgtttcttgatgcttttaggaa

SEQ ID NO: 6878934 - DNA, 73 bp, Homo sapiens
ggctggtgttgtccgggtgagagttagttagaagggcagtatcagttcccactcctggcctggactgctcccc

SEQ ID NO: 6878935 - DNA, 66 bp, Homo sapiens
tggtcataatcaagtcttgatgagacaaacctggcaggtcaggtcagtcttgctaagattgaacca

SEQ ID NO: 6878936 - DNA, 57 bp, Homo sapiens
ctgaccttgtgatccacccaccttggcttctcaaagtgctggtattacaggtgtcag

SEQ ID NO: 6878937 - DNA, 73 bp, Homo sapiens
agttgagttacagatggttaactcccacttgtatgtcccgtgctggtgaagtaataccaggtgtacatcaact

SEQ ID NO: 6878938 - DNA, 65 bp, Homo sapiens
ttcagtttgccagtattttattgatgatttttgcattgatgttcatcagggatatttggcctgaa

SEQ ID NO: 6878939 - DNA, 117 bp, Homo sapiens
tgacagagagagggcaagtttagtgagatccatgcaacacctgccttgtggaggggaagcagggctgacagtggcgtggcgttgagctaagtttagctgcctgtgtgatctctgcca

SEQ ID NO: 6878940 - DNA, 97 bp, Homo sapiens
gcaaggtataaaggtacatatgtgtacctgtgtatgtgtgcatgtgtgtgtatgcatgtttgtacaaaggtacacacgtgtacctgtgtatgtgtgc

SEQ ID NO: 6878941 - DNA, 100 bp, Homo sapiens
ctctgctttacatggctacgttgtttgagggcaggagttggtgagaattagtttggaaaactgacttctctcattcagacatagcttttctggagcagag

SEQ ID NO: 6878942 - DNA, 84 bp, Homo sapiens
aaattttgttttgcttttcacatttagctgtacaatctatgtggaatttactctgtgtatgatgtgagttaagggccaagattt

SEQ ID NO: 6878943 - DNA, 62 bp, Homo sapiens
cagttgcagttgtgtccacagccatttacatagagaggctcacctagggagcactgcaactg

SEQ ID NO: 6878944 - DNA, 65 bp, Homo sapiens
aacaaagatgcattttgttgcctgctaagtctccttaaaatttggcacagcaggtgtgctttgtt

SEQ ID NO: 6878945 - DNA, 88 bp, Homo sapiens
ttagagaaggcagatacaaaaagggagaagatttaaattgactttaacatttacctaatttgtatttagttgcctaaacaagctctga

SEQ ID NO: 6878946 - DNA, 75 bp, Homo sapiens
tgctaacaaagtctaaatcatagaaacaatgaataattatcaatttacagaatattgatttgggctttggtagca

SEQ ID NO: 6878947 - DNA, 76 bp, Homo sapiens
aggatttgaatgtttcagagtccacaacttttaactattatccagagagctagtctctgaacaacatacgaatctt

SEQ ID NO: 6878948 - DNA, 62 bp, Homo sapiens
cccagcaggcacaaatttctagataaggttttcctctgcacaaatttagtgtcccccctggg

SEQ ID NO: 6878949 - DNA, 63 bp, Homo sapiens
ttttgtttatggctgtgtctttagcactcagttgagtgactggcataaagttagagattaaga

SEQ ID NO: 6878950 - DNA, 83 bp, Homo sapiens
attagtgtgatatgatttgtcttgcagctgcttcaaattaagaacaggtgtagaaaacagattatgcaaatactcatattaat

SEQ ID NO: 6878951 - DNA, 70 bp, Homo sapiens
ataggttctgaaggaagtttcaaatgtatctccacaattgtttgggtaaaagcatcctctcaggagctgt

SEQ ID NO: 6878952 - DNA, 60 bp, Homo sapiens
gatgtcttactaactagcctttgctttattattagaaatggggaagtgagtatagacatt

SEQ ID NO: 6878953 - DNA, 77 bp, Homo sapiens
aacatgaggtatagttctattagatgacatcctggtggctttattcatttagtgctatactaaggatttctcatgtt

SEQ ID NO: 6878954 - DNA, 58 bp, Homo sapiens
tacccagcttcaagtcaggacttaaatactacttcctaagtaaaggcttaactgggtg

SEQ ID NO: 6878955 - DNA, 105 bp, Homo sapiens
gctcaaaggaaaaagaacttctctctctagagtgcataatgaaggagcttgacctagacaaggtcaagaaaggtgtctctggaaggggatgtttgctctgagagc

SEQ ID NO: 6878956 - DNA, 58 bp, Homo sapiens
gtttattaactgtcaagtgatttcattaaaaaaggaacaaatttggcagatgatgaac

SEQ ID NO: 6878957 - DNA, 73 bp, Homo sapiens
cctgtcattggttgtcacacagggagaggtgccaaattcagacttctttccttatgttttcaaccaacttggg

SEQ ID NO: 6878958 - DNA, 88 bp, Homo sapiens
gtgaagtctaaataattacttttcctggaaccactgctactgggttatacattatgcttcagggaaaggtgatggcaagagtattcac

SEQ ID NO: 6878959 - DNA, 90 bp, Homo sapiens
gagctttatcagtgtcctatactgtgctaagtgcattacatacatgatctcatttagttttgcagtagcaggcactggttttcccagttt

SEQ ID NO: 6878960 - DNA, 89 bp, Homo sapiens
cccaccccaggtggttctcaggagtagtgggatccatggagaagtcagcccagtcttgcattttctgaagatgccaagtggggaatggg

SEQ ID NO: 6878961 - DNA, 56 bp, Homo sapiens
tcttcacagctttgtccagaagcccacatggtgttgctggcatgcatgctgtagga

SEQ ID NO: 6878962 - DNA, 130 bp, Homo sapiens
ggaaattatgatctgccaccatagatgcctgagttcctgcaagtaagtggctgagaacaacccatccaaactcatctcatgtgagctgactgggagatcaggcctgtcttgctccaaaattataaatttc

SEQ ID NO: 6878963 - DNA, 71 bp, Homo sapiens
gcccacaggggacctggtggctccgttccacacctcaccccagcagggccagcctgagttaccctgtgggc

SEQ ID NO: 6878964 - DNA, 77 bp, Homo sapiens
tcagggtggagcagggcggctattgtgggggtcagcctgggaaggcgtccacaaacctgccagccctgccctcctga

SEQ ID NO: 6878965 - DNA, 86 bp, Homo sapiens
cagtggagacgcagtgtcaccaggcgagtctcccaatttatcagaggtgataatggagcagtctggtgatactcagctctcgcctg

SEQ ID NO: 6878966 - DNA, 74 bp, Homo sapiens
cattctttaatttgtatttctagagggtgtctacatttcttactttcctagtagttacagaatgataaagaatg

SEQ ID NO: 6878967 - DNA, 62 bp, Homo sapiens
acctctgtatctctgattctctgtggctccaaactctagaacagcagtagtatacagtaggt

SEQ ID NO: 6878968 - DNA, 68 bp, Homo sapiens
tcttttgtaggtttttctacagggaaaacctttacaaatatttttctgtaagaaaacctgtacaaaga

SEQ ID NO: 6878969 - DNA, 55 bp, Homo sapiens
aggtctgtttgctgttttctccaatgaaatggttctgggtaaacagcagacgcct

SEQ ID NO: 6878970 - DNA, 79 bp, Homo sapiens
catacctaatagtttgagtgtggaagagtagaacataatgttgactagaagttcagcaactcaaacctattagcagttg

SEQ ID NO: 6878971 - DNA, 60 bp, Homo sapiens
ggctgccagttccttcttactccagcccaagtcaggaaaatcaagcaaggaactgctacc

SEQ ID NO: 6878972 - DNA, 78 bp, Homo sapiens
tcacttagctttagcgttggggataaaggaagacttctatacttctatatttctgaaggttgagaagggctgagctga

SEQ ID NO: 6878973 - DNA, 56 bp, Homo sapiens
aacactttggatgcagaaccaagacaatttccatttggtatgcatcccaaggtgtt

SEQ ID NO: 6878974 - DNA, 65 bp, Homo sapiens
cactagtgttttggagagcacagtttggaaaattctgttttagaatgctcttcaaaatctagctg

SEQ ID NO: 6878975 - DNA, 97 bp, Homo sapiens
atctgatctgctacttatctttgtaagttatatgtagtatattgataataacaggttacacatacattgcttacaaggtgatagagatagattagat

SEQ ID NO: 6878976 - DNA, 64 bp, Homo sapiens
ggttgaagagaagcatatatgtgatgtatgaatgaatgaaagcagtgtttgcttcatcttatcc

SEQ ID NO: 6878977 - DNA, 64 bp, Homo sapiens
ccctccctttgcagcagtgcatctcacggtacagattagagtttagcctgcagaaaaggcaggg

SEQ ID NO: 6878978 - DNA, 75 bp, Homo sapiens
cctgcagcagccttcagtttggcaggagatagatgtggtgatgggaacttctctgcagaatttgagctgctcagg

SEQ ID NO: 6878979 - DNA, 73 bp, Homo sapiens
tctcaaatgggttaaaagttgaatgaattgacaccctgatgttatgatgttggaattttaacttaaactggga

SEQ ID NO: 6878980 - DNA, 60 bp, Homo sapiens
ggacatctgggccccaggtctaggggacttgttcctgtttcctcctgtggcccagagttt

SEQ ID NO: 6878981 - DNA, 62 bp, Homo sapiens
tagaaggccctggtattcttgaggctcactttgccttgggatttctcatgccaatgcttcta

SEQ ID NO: 6878982 - DNA, 73 bp, Homo sapiens
ttctctatacttgaggcccaggaatacacagaaatatgagatcctcaggggtttcaggtgtacatgaagagaa

SEQ ID NO: 6878983 - DNA, 75 bp, Homo sapiens
gagggaatctcatgtggcatagtgtgatcatgggaatgacatcccaccatctttgccatatgatgtaatccactc

SEQ ID NO: 6878984 - DNA, 68 bp, Homo sapiens
cttcctcccttccaatgactatgcttcagattctttcctggtcatcgttttaatggaaggagagaaag

SEQ ID NO: 6878985 - DNA, 63 bp, Homo sapiens
gcactattcatgaatctacattgtggtattgtttaaaataacatgatgtgaagcatgaactgc

SEQ ID NO: 6878986 - DNA, 65 bp, Homo sapiens
gggaagctgaagctagagaaaaggcgggggtctagaagtcccgtggtttctagtttcagcttgtc

SEQ ID NO: 6878987 - DNA, 108 bp, Homo sapiens
ttttttttgcgggggggggcaggggtcaatacacatattattattgtattatatgtatttatatgcataatgtatgtattgactattgactcccccttccaaaaaaaa

SEQ ID NO: 6878988 - DNA, 86 bp, Homo sapiens
tatctttctgcaagatctgctccagtgtggtattctatttaataatgtaaaatgctatttcatggaggagagagtacggaaaggta

SEQ ID NO: 6878989 - DNA, 71 bp, Homo sapiens
ggtgcattttctgcttcttatttcataaaaaagttacatgtgggctttagattgcagaggatttgggcacc

SEQ ID NO: 6878990 - DNA, 78 bp, Homo sapiens
acatttaagggctggcaagggattgaaattgttggagactattatggtttgaattgagtgcccccagccccaatatgt

SEQ ID NO: 6878991 - DNA, 82 bp, Homo sapiens
tgaagctgaggatgttgggttacagatatgtgttattgataaaatcaaaagacacatatgcttaacccaccaccacagaaca

SEQ ID NO: 6878992 - DNA, 55 bp, Homo sapiens
gcagcatctagggcactggcctggagtatcgcaggtgctttgcctaaggtggtgc

SEQ ID NO: 6878993 - DNA, 57 bp, Homo sapiens
ggggataaagtttcattcttcattgaatgtctttaatgaggaaggagactttcaccc

SEQ ID NO: 6878994 - DNA, 94 bp, Homo sapiens
gcaggatgaaagttttaaatgctctgcagagacaaagtgttattgatgcctcaattttacagtgtctgttggggtaaagataattcattcttgt

SEQ ID NO: 6878995 - DNA, 58 bp, Homo sapiens
ctggtcttgtggccctggggaagggccgtgaggtctgagctctagggtctaagggcag

SEQ ID NO: 6878996 - DNA, 80 bp, Homo sapiens
ccctaggagtttacatgacgtgtatttcaggcaaaccacttaacctttcctatgaaaccaatcatgtttgtgtcttaggg

SEQ ID NO: 6878997 - DNA, 124 bp, Homo sapiens
tcattgtgtctcttcagcctcctctggtctgtgacagtttctcagaatttccttgtttttgatgaccttgataattttgaggaagctgttttcaacagcaagagggatcaaggaagcaaaatga

SEQ ID NO: 6878998 - DNA, 81 bp, Homo sapiens
ctgtctttgagtggaaaatgtagcagctacgggaattaagttatatggtagcatgtgtggttacctacttgacggagacag

SEQ ID NO: 6878999 - DNA, 85 bp, Homo sapiens
agagcagaccaggagtgcacaggtggctgccctgtcagccttttccgggagtggtggtggcgcttgcaacaactgctctggcttt

SEQ ID NO: 6879000 - DNA, 96 bp, Homo sapiens
gataccctgaaggtcttgttgagatgcagatttggattcaggaggtcacaggtgggtcctgagattctgcatttctaacaaggtccaggtgatgtc

SEQ ID NO: 6879001 - DNA, 85 bp, Homo sapiens
tatgtcctagtcaacttccgtgtgaattaacatgcatcaagagcatcatcttgacagctacatggaatttcattttaagggtatg

SEQ ID NO: 6879002 - DNA, 88 bp, Homo sapiens
gagagtgatacaaggacatttaggcagcagtgaggatgaataggcctcttctttctgcctctctctgcttggatttgtattcattttc

SEQ ID NO: 6879003 - DNA, 82 bp, Homo sapiens
ggggcctggaggagcaatatggttaggtttgtgttgcacatggttgttgtgtggtcctagctaggttagccctcagggtact

SEQ ID NO: 6879004 - DNA, 101 bp, Homo sapiens
ggttggagtctaagctggtttcctctattcctgtcttactcaagggaaattcctacccctggccaagacagaaataggagaaaccagcttaaaatccatcc

SEQ ID NO: 6879005 - DNA, 56 bp, Homo sapiens
tattcagaaagcacttgctctttaaaaaagaactgaggacaggaactggctgaata

SEQ ID NO: 6879006 - DNA, 56 bp, Homo sapiens
gaaggaaaaatactctgtaaggtttcaaaaacagccgattgcagagattgtccttc

SEQ ID NO: 6879007 - DNA, 81 bp, Homo sapiens
ggcgccaagtcgccactcaggtggccaaatgggagcgcccgtagggcggccctgctcttcggcccttgggtggcgggtccc

SEQ ID NO: 6879008 - DNA, 55 bp, Homo sapiens
gctcaggcctggctatccattgctgacaaagaaagctggtttgcctggcctgggt

SEQ ID NO: 6879009 - DNA, 57 bp, Homo sapiens
ccaggggctgcagatccatggtggccttccagccatcacccatctttctgctcctgg

SEQ ID NO: 6879010 - DNA, 108 bp, Homo sapiens
gtgtagatttcagatggtcaaggtgccatgagggaggggtggtgccgcacaacagtgctgtcattcatcctttcctttcagcatcttatgacggtttgcagtttatat

SEQ ID NO: 6879011 - DNA, 60 bp, Homo sapiens
tgaatcagtataaattctcaaatatgggagaaattttgttcttgagaattatctgagtca

SEQ ID NO: 6879012 - DNA, 55 bp, Homo sapiens
gaaggctgcgaggggagtgccgggtgcagtttcacgtgccttcccctcagccttc

SEQ ID NO: 6879013 - DNA, 79 bp, Homo sapiens
gctagaagagctgcctggagaggcagggatggcccgtggttgaacagagagctttcctacccttccaggcagagctagc

SEQ ID NO: 6879014 - DNA, 79 bp, Homo sapiens
tatgcatagcttctcctataaagtgtggtttccgtggcaacagcaagggggaaacaggtgtgcggaaagctgtgatata

SEQ ID NO: 6879015 - DNA, 64 bp, Homo sapiens
acagcagctgggttcccaccatccccccacagtgcctagcacggggctgggagacacctgctgt

SEQ ID NO: 6879016 - DNA, 55 bp, Homo sapiens
gggctggagggtggggcgtagggtttgaggaggattctgctgcacaccttccccc

SEQ ID NO: 6879017 - DNA, 94 bp, Homo sapiens
ggcaaagtgaaatctcagttaatgtcctatacaatagtgagtgtgcatattgttgtatgtttgttggccatttagatttgtactatgtcttgcc

SEQ ID NO: 6879018 - DNA, 56 bp, Homo sapiens
acccaactccagggtttatctgtgcttagtcaatcagaagtttgaccttggtgggt

SEQ ID NO: 6879019 - DNA, 63 bp, Homo sapiens
taagagaagtcagggtctgcaccaggcacagcccaacaccaggtacagcccctgcttctgttg

SEQ ID NO: 6879020 - DNA, 66 bp, Homo sapiens
ttggctttacaagcagtggcactcaggctgagatacgcatgtgacattatatattgtgaagaccaa

SEQ ID NO: 6879021 - DNA, 57 bp, Homo sapiens
tggcagcatctgaagtgaattgctttttggaaagagggggagtctttgatgtcgcca

SEQ ID NO: 6879022 - DNA, 112 bp, Homo sapiens
cagaatgttatatcaggcattataaataattcctaggcaatatttagaatggctgcaagccatttttagaattggctgagaattatttacaataccctgctcccacattttg

SEQ ID NO: 6879023 - DNA, 60 bp, Homo sapiens
gtcatcatcaggcagatgctgctccagtgcgaggacgatgcaattcgctatgatggtggc

SEQ ID NO: 6879024 - DNA, 59 bp, Homo sapiens
ttcatgactctccctctgtttatttattaaggagtaaatcaatggcagagttaattgaa

SEQ ID NO: 6879025 - DNA, 62 bp, Homo sapiens
tgcagaagtcagaccatctgaattactgtttccacagcaactacaattcagtcggctctgca

SEQ ID NO: 6879026 - DNA, 57 bp, Homo sapiens
atggcctccgacccatgacgtgcttaggaaagttgatattcatggtttgggggccat

SEQ ID NO: 6879027 - DNA, 67 bp, Homo sapiens
ctcttcataggcaccctgtctgagggagagttctgcagtcccctcaggctctgggtgcctacctggg

SEQ ID NO: 6879028 - DNA, 80 bp, Homo sapiens
gagtcctatgatttgtcttggatgaggattaacaggttgtagtctatttgaataatatgttcaggaggaatgaaggactt

SEQ ID NO: 6879029 - DNA, 58 bp, Homo sapiens
cttggagcgggccttgagtgcccggcggcgtgcgctgcgggctgtcaggcgtgccagg

SEQ ID NO: 6879030 - DNA, 74 bp, Homo sapiens
tcatagagtttacaacatcttgtccttcaattgcagtcagtctctgtcttgaactggatttgtgagctccttga

SEQ ID NO: 6879031 - DNA, 88 bp, Homo sapiens
gagaggcgagtaatatcctgacattcaggtgttcaatgccagctgtcagcctctggcccctgccagtgttaggaatgattcccctgtc

SEQ ID NO: 6879032 - DNA, 65 bp, Homo sapiens
ttgggctttcaaaagtattgtttctgatctgggatcaagaacttattttggaaattagcacccaa

SEQ ID NO: 6879033 - DNA, 57 bp, Homo sapiens
ataactctgttcttccttctctcgagcattcatgagaaggtgggcctgctgagttat

SEQ ID NO: 6879034 - DNA, 86 bp, Homo sapiens
agggtcttgctctatcacccaggctgaagtgcagtagtgtgatcccacctcactgctgcctcagcttcctgggctcaagtgatcct

SEQ ID NO: 6879035 - DNA, 67 bp, Homo sapiens
agcctctcagagtgctgggattacaggtgtgagccaccacacccggcccaaaagttctgagatggct

SEQ ID NO: 6879036 - DNA, 90 bp, Homo sapiens
cgtagtatctattcttaattccaaagactgagtgaaggaaatgatcctgccttccatttctcatggatataagaactgtttagagctgcg

SEQ ID NO: 6879037 - DNA, 68 bp, Homo sapiens
gaaaggagatatagacttcatatattggtgggatttaaatcaaaccagtaggaagtctattattagtc

SEQ ID NO: 6879038 - DNA, 64 bp, Homo sapiens
tgtgaatattaataatgtctcctgcacccgattattgtgaggatgacatgaagtggtgttcata

SEQ ID NO: 6879039 - DNA, 113 bp, Homo sapiens
cccaaatcctagctgtcccagggggcctgtgcttggccagagaggttcctcaccttactgaggtggctctgcttgaggccagcctgcaggccgctggtgaagtaggaagtggg

SEQ ID NO: 6879040 - DNA, 66 bp, Homo sapiens
aggttgcattctagtggttactttttaaaaaatgcttttaagctctttggcatttggaggcaacct

SEQ ID NO: 6879041 - DNA, 66 bp, Homo sapiens
atttttcactcaagcatctacagggattcagctgatctaggctgggctctaagctttgggaagaat

SEQ ID NO: 6879042 - DNA, 118 bp, Homo sapiens
tgtttcaggactaaagagttggctacagtacaagcaatgcatttttgaacattgatttgccagaagtgtatctgttgtctgttgctccaggctggcatttttaattatttctgggaca

SEQ ID NO: 6879043 - DNA, 72 bp, Homo sapiens
agactcaaagctatgtaggcaagttgttacagaaacctagaactctgagctgagccagcatggcaggggtct

SEQ ID NO: 6879044 - DNA, 90 bp, Homo sapiens
ggctgggtgcaggaagagggggtggagctaaatgtctactggctgggtgggttgcagagggtatggcttcaccttcattggtacccagct

SEQ ID NO: 6879045 - DNA, 74 bp, Homo sapiens
gctctgaaatgatcacaagtctgaagaatgagaaacattttcatttccattcagtgtggtctggcagctggagc

SEQ ID NO: 6879046 - DNA, 56 bp, Homo sapiens
ttgaagacacagacatatagaggctccacctacttattatattgctgtgtctccag

SEQ ID NO: 6879047 - DNA, 89 bp, Homo sapiens
aatgtagctataatggtgaagagcatggatttccaaattggatagccccacgattgaattctggctccacctcctttactagctgtgtt

SEQ ID NO: 6879048 - DNA, 55 bp, Homo sapiens
gggttaaagagcccaatgtatgctggatttagtaagatttgggccctcccaaccc

SEQ ID NO: 6879049 - DNA, 74 bp, Homo sapiens
ttcacctcagattctcccgtgtcgggggtgtcatacttctcagttgacagctacctacatggtggtgaggggaa

SEQ ID NO: 6879050 - DNA, 56 bp, Homo sapiens
taagggcatgagaagcttgaaaggacactgtccaggcacggtggctcatgcctgta

SEQ ID NO: 6879051 - DNA, 79 bp, Homo sapiens
ggaaccaggagccagctagagagctcgagagagtctgattgcctgaggcatcctctgagagctctagatatccatttct

SEQ ID NO: 6879052 - DNA, 97 bp, Homo sapiens
gagaaaatattgctagacaatgacagtggttccaaggcagctttaagaacagaagtgccacatgtaactcactgtgattcatatctgtgttttgctt

SEQ ID NO: 6879053 - DNA, 95 bp, Homo sapiens
gggacccttgctgaagctgcctgtctttcctccctcgtagagacagggcgctttagaggagaggtggcggagtttgggaagtcagttagggaccc

SEQ ID NO: 6879054 - DNA, 61 bp, Homo sapiens
ctcagtaaatagtggagatgtgggctttacttgtcagagtgcattccatgtgtttcctgag

SEQ ID NO: 6879055 - DNA, 69 bp, Homo sapiens
tgacagagctggagaataattttaggaaaactaaatctccctgttgctatgtttgtgccagctttgtca

SEQ ID NO: 6879056 - DNA, 72 bp, Homo sapiens
cagtcagtgacactctgtgtcaatgtgtcacctttaaagggacaaaggagagatacagagggccactgattg

SEQ ID NO: 6879057 - DNA, 129 bp, Homo sapiens
gaggaacatgaggcatgttgtcagtgagtaagaagtggcagtcattatcgctgagtcagaattgatggctcttgttcgtaccatggcttagccatgtttgaattatttgtttacttgtttctttcctcc

SEQ ID NO: 6879058 - DNA, 73 bp, Homo sapiens
gtgaagaccagtccacgtcaagaagaggttaagactatgatctcacttctgtcatgtggcacaagcttttcat

SEQ ID NO: 6879059 - DNA, 57 bp, Homo sapiens
ctgaccttgtgatccgcccgccttggcctcccaaagtgctgggattacaagtgtgag

SEQ ID NO: 6879060 - DNA, 62 bp, Homo sapiens
ctctcctggctctgggccttctgcgcctttgttcaagggcttcggcatccacagctggagag

SEQ ID NO: 6879061 - DNA, 67 bp, Homo sapiens
gggcaacacatagctcagtatcacttactttgatgccaaaatgtgaggaagaggggcttggttgccc

SEQ ID NO: 6879062 - DNA, 71 bp, Homo sapiens
aggtagccacattttattaccaagtatcttgagctgacagccaggctaagtgagtaaaatgtggtgaatct

SEQ ID NO: 6879063 - DNA, 82 bp, Homo sapiens
ctttcctccatggattttctcacaatgcagaaggaacaaggatggattctggctctgcatatggaactgccatgcaggatgg

SEQ ID NO: 6879064 - DNA, 62 bp, Homo sapiens
gcaagggcagatagctggtccaagcactcttgtgtgcttttgagcaaatcatctgtcctttc

SEQ ID NO: 6879065 - DNA, 70 bp, Homo sapiens
tgggcagctagcacatcaggcccaggagtctgctgcgttgcagaagctgctgaagtgttggccctgccca

SEQ ID NO: 6879066 - DNA, 60 bp, Homo sapiens
actttgtctgcatggaataatatactcatctgttcagtgagttacatgtatagataaagt

SEQ ID NO: 6879067 - DNA, 85 bp, Homo sapiens
gggaatgtggattcaggtggaattaattaagagagaactaacttccagctctttattagtgtgttgcacctgcatcctagtggcc

SEQ ID NO: 6879068 - DNA, 55 bp, Homo sapiens
ggctcggccgtggaggtttgctgtcctcttcccccaggaaacttcacggtcagcc

SEQ ID NO: 6879069 - DNA, 127 bp, Homo sapiens
cagagtgcccttgctgccttcaagtgtgtacccctggctatccttgagccaatgactgattgatgtggagtcaatcagtcattagccaaggtagcccagcccttgcttacagacaggtggaactctg

SEQ ID NO: 6879070 - DNA, 82 bp, Homo sapiens
gagctcaagacaaatgaaaacggaccagagctattccaccacgtagtgaaatcctggatttttcaagtcatgtcctgaggtc

SEQ ID NO: 6879071 - DNA, 76 bp, Homo sapiens
gggatacacagctggtaggtagcagatttggaattaaaatctaggtctgcctaactgccaactgcctgtttatccc

SEQ ID NO: 6879072 - DNA, 68 bp, Homo sapiens
tactactaacacagtttttcagacagagatttaatgggatctcgttttgagaactgtgttatatagta

SEQ ID NO: 6879073 - DNA, 67 bp, Homo sapiens
ctgcagtgttcctgaaccatgtgagtagtgttcattttaaactcaaacacatgcaaggcacctgcag

SEQ ID NO: 6879074 - DNA, 73 bp, Homo sapiens
aaagtcttacagacaagctgaagtacaggtacctactttgaaatgtcttctgtttcctgctgtgaaagatttt

SEQ ID NO: 6879075 - DNA, 62 bp, Homo sapiens
tgggtggctgcagagggcacagcattcagagtcccaggagccagctcctttgtagtcggcca

SEQ ID NO: 6879076 - DNA, 57 bp, Homo sapiens
catgctatttgtgagtgtcttcgtgtatgcaagtgtatatatgtacaagtgtgtgtg

SEQ ID NO: 6879077 - DNA, 58 bp, Homo sapiens
ggagttacacagaagtcagtttgagtcccagttcagctgcttactagctgtgtgaccc

SEQ ID NO: 6879078 - DNA, 66 bp, Homo sapiens
gtggaggttgtgagcattttggtgagcttttcctctaggaaagttctttcagcttagagcccccat

SEQ ID NO: 6879079 - DNA, 118 bp, Homo sapiens
ggtaaccagagggcagcaaaggggattgatatactttgagatgatgctgatcggggttgggaagatacaacaaacgcagtttttctaagtatcccttttgggccccttgctggtctcc

SEQ ID NO: 6879080 - DNA, 62 bp, Homo sapiens
tttgacagtgatgatatatacagaaaggtatatagcctgctaatatgttttcactgtataaa

SEQ ID NO: 6879081 - DNA, 78 bp, Homo sapiens
ggagaaatagggaactttgggagagggattgaggtggaattttcctgccctatccttggatcctgtgttcctggtccc

SEQ ID NO: 6879082 - DNA, 57 bp, Homo sapiens
aaacatctcaaagaggtatttgttatgtgtgagaacagatgccttgtaatggtgttt

SEQ ID NO: 6879083 - DNA, 88 bp, Homo sapiens
ggggtcattggagtgttcccgtctcttggatttcacagtgctcaccaggatggccacgatgatgaaagagaacattccaatcatcacc

SEQ ID NO: 6879084 - DNA, 70 bp, Homo sapiens
gtttcctacactgtagtattatctagtccaaaatgtgaatatgctgaggttaaagctgaagttaggaaac

SEQ ID NO: 6879085 - DNA, 129 bp, Homo sapiens
aatgtgaaaaatagtatgtacaaagttcagaagattgcattttgagatagtaggtttctagttgctcgtgtaatctggagatttcttttcaatagaagtgcaaaatttgtgcacagacatactcgtatt

SEQ ID NO: 6879086 - DNA, 59 bp, Homo sapiens
gggtctgacctgggcacaccatattgaatagtggttaaggctttacagtcaaacgacct

SEQ ID NO: 6879087 - DNA, 69 bp, Homo sapiens
tctcagatcatggatctattacttggatcaaaaagtactgcacagggaagtagatactatgatctctga

SEQ ID NO: 6879088 - DNA, 73 bp, Homo sapiens
gctctctgcggcttggctgtagctttagcgctgttgggctgacggcctggagttcagccaagtcccaatgagc

SEQ ID NO: 6879089 - DNA, 78 bp, Homo sapiens
caccaagttgatggcatgaacgctgcagtcagtagcttccttgtagcactaaagaacagttcgttcatgtcactggtg

SEQ ID NO: 6879090 - DNA, 108 bp, Homo sapiens
gatggggatgctgtatccagagagaggagagagatgactttagggagaggtggtgtaccctctgagaggcacactttgagaactactttctctgcgcaagttttcatc

SEQ ID NO: 6879091 - DNA, 59 bp, Homo sapiens
tagagacaaagatttgcagattaggctagcaaatagaataaaactgtaactttgtcctg

SEQ ID NO: 6879092 - DNA, 64 bp, Homo sapiens
ggcacatttataagtggacataggaatgagaaagagtaaattctgtgtaattttttaaatggcc

SEQ ID NO: 6879093 - DNA, 72 bp, Homo sapiens
tgcatcagtaagtcagtagaactgtggtcagttaatagtgtattttaaatgacagcaggaactgattatgta

SEQ ID NO: 6879094 - DNA, 128 bp, Homo sapiens
gtgagccatgggactcagtgccactgctcaaggtctccatggctgagcctgggggctcttacaacaggctccatgcccaaggtggcagttgtggaaccatcagagagggcacagagctcatggtttat

SEQ ID NO: 6879095 - DNA, 67 bp, Homo sapiens
gttcacagcttgtgttttctctatgtgcaaccatttatttttggagatggtacaaggagctgtgagc

SEQ ID NO: 6879096 - DNA, 91 bp, Homo sapiens
tttgtccatttcttcctccttcccttttccgccagaagtagccgtccggggcttttggccagatggggaaactgaggcaagactgggcaga

SEQ ID NO: 6879097 - DNA, 59 bp, Homo sapiens
ttttaattgcaattatggtcccttatgagtcccctgggagggcatgattgcaattaaaa

SEQ ID NO: 6879098 - DNA, 62 bp, Homo sapiens
ggctggccatggtgtttgcaataaatacactgtgtttattgttgttagtcataagtcaagcc

SEQ ID NO: 6879099 - DNA, 86 bp, Homo sapiens
aggaccttagagtgttctccttggttcaaatgataaaattcatttgaattttataggaaccagggaaataagtattttctgcacct

SEQ ID NO: 6879100 - DNA, 55 bp, Homo sapiens
gatgagtcactcagcagaaaaggtgtgtccaggcgcctgcctgcctcggctcatt

SEQ ID NO: 6879101 - DNA, 77 bp, Homo sapiens
gttacctgatgcttcaagcttccttataatctccttgccaagggggtattttatgaataatttgatgtaataggaac

SEQ ID NO: 6879102 - DNA, 65 bp, Homo sapiens
ctggtactccctggggtcagtcccctcatccaggtggaccagatgatcccatgggatggcatcag

SEQ ID NO: 6879103 - DNA, 58 bp, Homo sapiens
caactatagggagagtggttaacatggtataccatatgaatcttgctccctagggttg

SEQ ID NO: 6879104 - DNA, 65 bp, Homo sapiens
gtgtttgaacatggcaataaacctacacagtggctcccactgatgttcagccatgttctgaacat

SEQ ID NO: 6879105 - DNA, 71 bp, Homo sapiens
aagagattttcacagatgttttggagtctatttagtcagtcagattcatccatcatttgagaaggtttgtt

SEQ ID NO: 6879106 - DNA, 77 bp, Homo sapiens
gtactgctttgagatccagatttccattcctttggataaatacccaaaagtaggattgctgaatcatacggcagtac

SEQ ID NO: 6879107 - DNA, 61 bp, Homo sapiens
tcatttctcctaagtgaaatatactgtttgttttcctgtgtgtgcatggagggggcagtga

SEQ ID NO: 6879108 - DNA, 58 bp, Homo sapiens
gcctgttagaaccagtgagggaagcagttcagccatcctgccagtgaagctgacgggc

SEQ ID NO: 6879109 - DNA, 70 bp, Homo sapiens
atagcctgggtttttattaaggagtgggaaggtgtcctcagtttcgttagtgaagagccctctaggttgt

SEQ ID NO: 6879110 - DNA, 73 bp, Homo sapiens
ttgctcttactcaaatagctgcccctagtggactgaagagttattactggagtgagtttggatcaaagagcaa

SEQ ID NO: 6879111 - DNA, 61 bp, Homo sapiens
agaggtgtctgttaggaataggcagccagtgttcaaaggatggcctcctctcagatgctct

SEQ ID NO: 6879112 - DNA, 64 bp, Homo sapiens
acccctttcctgcctcaggaagtagcatggcctccaaactccacttgctgggtaggaaaagagt

SEQ ID NO: 6879113 - DNA, 55 bp, Homo sapiens
gtcatcagcattggagatccagcacagatgtgctttttgtgtccaggccgatggc

SEQ ID NO: 6879114 - DNA, 96 bp, Homo sapiens
agtcagctggtatagaagaatcaactgaaaattggtgagagtgaagactatcttccttttctgttgcttttgatttctatataatccaggtgtact

SEQ ID NO: 6879115 - DNA, 80 bp, Homo sapiens
cagttaatctatgctgctgtgttacagtagggtttggcattcctcactgtgtcattgaacatggaaagtatgggccactg

SEQ ID NO: 6879116 - DNA, 76 bp, Homo sapiens
aatgatgaatacctcagcaggtaatgatttggtatttactttactcttttaaattattcttgaggtgtttattgtt

SEQ ID NO: 6879117 - DNA, 57 bp, Homo sapiens
gctgactttgacttggtcattgatatccctagaattcaatgactggtccaaggtggc

SEQ ID NO: 6879118 - DNA, 87 bp, Homo sapiens
ctacagccacatctggggacaagatgatttttgatcctactatgagcaggaagaaaaagaagtcatttatgttagatgagggtgggg

SEQ ID NO: 6879119 - DNA, 129 bp, Homo sapiens
gcccacatcagagccaaactagagttctgtctgtactgagagttctgtctctacacctgtttatacatagctccaagatcatgcagagatttcagtaacagcagggttttgctctgtcgtgtcccaggc

SEQ ID NO: 6879120 - DNA, 68 bp, Homo sapiens
accatctgagcctgcaaccatagaaccgtgtacaaggggcacaggagctgtggggcagtgtatgaggt

SEQ ID NO: 6879121 - DNA, 78 bp, Homo sapiens
gacagtaaactcgttcccaaacccaagcacgactgtgacttgttctctgggttaggggaactattgagtcagaatgtc

SEQ ID NO: 6879122 - DNA, 124 bp, Homo sapiens
tgattattatggcatcacttaggttactagaataagattgagtcagggacttccaaagtgttaggattcactttgaagtccatctggcccagtggttaccagtcatgactacatatcagaatca

SEQ ID NO: 6879123 - DNA, 65 bp, Homo sapiens
gaatcagaactcctaccacagagagtgatttctgaatcaaattttatagggaggggttctgtttc

SEQ ID NO: 6879124 - DNA, 106 bp, Homo sapiens
gaattttgtttttaatgtaggcttttaaatgggctttgatggaacttggttccatagaaggaatcccagataaggctttttaaaagccgagcccagccatggattc

SEQ ID NO: 6879125 - DNA, 61 bp, Homo sapiens
cttggggatgcaaagccagtgtgccaaaatgacctacagcattctcaggcccatcctcagg

SEQ ID NO: 6879126 - DNA, 58 bp, Homo sapiens
caaagtgctggaattacaggtgtgagccaccgcaccctgcccctattcctgccttttg

SEQ ID NO: 6879127 - DNA, 84 bp, Homo sapiens
ctcttagatgtgttcatagggtatttccatagtatacagttgcagtgtgcttgtggggcctgcccacagtgacagatctggaag

SEQ ID NO: 6879128 - DNA, 79 bp, Homo sapiens
gtcccttctagctcctactgttgcagacagtaaaaatgatactaatgatgacctgtgcagcagcagctgtggagatgac

SEQ ID NO: 6879129 - DNA, 81 bp, Homo sapiens
cattttatcctagcttcttcatcttcctcccaccaaaatgtaatactagtatgggttagtgtttcccagtaggatgaaatg

SEQ ID NO: 6879130 - DNA, 108 bp, Homo sapiens
ccagctcctgacacaccatgcgctaggtgctcagtcactaatggtctcgcgaaggagtgatcagtgagtgaagcaggggctgctgcatgggaaaggtgagcgggctgg

SEQ ID NO: 6879131 - DNA, 81 bp, Homo sapiens
tggctgaaaatcatgttatgtacaaatatgacttgattcaatacaatttattgtttgggtataatttgaattagaaagcca

SEQ ID NO: 6879132 - DNA, 76 bp, Homo sapiens
gcagccggtccttgccagggatggctcatgccccagctccagagagaagcaggtagacatctctgcaaggagctgc

SEQ ID NO: 6879133 - DNA, 71 bp, Homo sapiens
taggtgtggtggttaatactgtgtgtcaacgtgactggattgaaggatacaaagtattaatcctggatgtg

SEQ ID NO: 6879134 - DNA, 69 bp, Homo sapiens
gcatgacagcattcaagacatagagttagcaactgaagcttaaacctctgtgtgtgtgtgtgtgtgtgt

SEQ ID NO: 6879135 - DNA, 60 bp, Homo sapiens
tcattgtttaccaatattgaatgtcagttagtttggatttattaggttggtgaaaaatga

SEQ ID NO: 6879136 - DNA, 103 bp, Homo sapiens
tgttttattagtggcctatatccctgatattggtgttaagtctaaaattaacaactttgaattagactttgctacaggtcttatggatcacatagatagaaca

SEQ ID NO: 6879137 - DNA, 65 bp, Homo sapiens
ggtctcctagtcaacctataatgtgaccccagttgatagcagcttgtgagtttgctagggctgcc

SEQ ID NO: 6879138 - DNA, 71 bp, Homo sapiens
gcctttaggaggtgatttactcatgagggtggagccctcatgagtgggattaatgaccttatataagaggc

SEQ ID NO: 6879139 - DNA, 76 bp, Homo sapiens
tggtgccagcatttgcttctggtgggggcttcagggagcttccactcatgacggaaggcaaagggcagcagcatca

SEQ ID NO: 6879140 - DNA, 76 bp, Homo sapiens
tttttgccacacattttggtggtatattaggattctaggcagtcataacaaattaccaaaaacgtagtggcttaaa

SEQ ID NO: 6879141 - DNA, 129 bp, Homo sapiens
aaaagagtcatgtaaattagcatttgtttttggaaggttttgcattgtaaagtcatagatcatgtttacagaagctttaggaatgaataaaaatcttctcactgactgcacattatctcattttccttt

SEQ ID NO: 6879142 - DNA, 125 bp, Homo sapiens
tcactctgaggcatttttatctgcacaatagctattaacaagtaatgggaaaagtggagataggctggttactctaggtggctgtaaaacaagtgtagataggacacaaaggagcagcagagtga

SEQ ID NO: 6879143 - DNA, 113 bp, Homo sapiens
gccagtaatgtctttaatggacagataactttctttgcagtgagccagagcttcaatttgcttcctcacggtgcaacaggaatggcatctcattaaaattgaacattaagggc

SEQ ID NO: 6879144 - DNA, 59 bp, Homo sapiens
cctggtgcttaccagagcttttgtcctctgagaattggactcactttgtaggcatgggg

SEQ ID NO: 6879145 - DNA, 79 bp, Homo sapiens
ttttacacagagcatagaactgttgctatttaggagataggcagctatctcctaaaagaagacagggccctgagtggag

SEQ ID NO: 6879146 - DNA, 84 bp, Homo sapiens
ccctagtcttctcttcctttgtcaactgatcatagggaactcctcatgaggctattagtgcagtcttggggagaagaggcaggg

SEQ ID NO: 6879147 - DNA, 104 bp, Homo sapiens
tatcaaatttttctttcaagaacctggaaagcggttcattttgttttatcgagcagattgtgaaaagagttttcttgcagagtttttgttttataatcaaaata

SEQ ID NO: 6879148 - DNA, 71 bp, Homo sapiens
gatagtgctatgcttggggatatgagacaactagaataattgtagctcacatttatcaggcacttactatt

SEQ ID NO: 6879149 - DNA, 60 bp, Homo sapiens
tgggggtggaggggcgagagacgctcgggagacctaggcgtccggcctctctcgctcccg

SEQ ID NO: 6879150 - DNA, 60 bp, Homo sapiens
aagttgctgtttctctgtgtctggtggaaggtgtctatggttgcagagtgagggtctctt

SEQ ID NO: 6879151 - DNA, 63 bp, Homo sapiens
gttgtctgggagattgaatgagttaagtttgtaaagagcttagaacagtgtctgccagagaat

SEQ ID NO: 6879152 - DNA, 65 bp, Homo sapiens
gtggcagttgaattttgttcagaacacattgaatttgaggtgtctttggaatatttagctgaagc

SEQ ID NO: 6879153 - DNA, 60 bp, Homo sapiens
ggcagagagagaggccagtatttgaggactgatatttaaatgaacaacttgatttttgcc

SEQ ID NO: 6879154 - DNA, 73 bp, Homo sapiens
ctttgtgcctcataaaagctttgtttacactttccagtaaaaaggtgtgtacatatttttaatgggctcatag

SEQ ID NO: 6879155 - DNA, 85 bp, Homo sapiens
gtggtaaagatgataacaggttgaatccgaatgttctcgataacatgtcttcttgttcaacctgactttattttcctctgaccac

SEQ ID NO: 6879156 - DNA, 71 bp, Homo sapiens
tttgcagcctttaaggaaaatgaataatgttgaagcttctacttgttatttgttttgttaaaggtcataaa

SEQ ID NO: 6879157 - DNA, 129 bp, Homo sapiens
ccagagctggagccaggctatcttgggtcgtgggggtcaggcaaagtggctggccgggagatctgctgagtgggtcagccggtcagtcctgagcagccgggcctctggtgcccaggtccacgtgactgg

SEQ ID NO: 6879158 - DNA, 101 bp, Homo sapiens
tccaggctgtcacctgctttgtagtgtttgctgatttctgtgacccatctgttggtaggtttcaagccaccagtgagataccacagagcaaacagctggga

SEQ ID NO: 6879159 - DNA, 58 bp, Homo sapiens
gcgccgcgaagaagccgggaagagtttgccaggcttgcctctgctgcccgccggctgc

SEQ ID NO: 6879160 - DNA, 101 bp, Homo sapiens
ggacttggataaagttttcctaaatgatgcactggcctggtgtagggtcaccatgtgacattctgcccaccagcggttgcatatgaactctgtccttgtct

SEQ ID NO: 6879161 - DNA, 58 bp, Homo sapiens
tgggctgctgttacaggggctggtggggagagccccagctgcctgtgctgggagccca

SEQ ID NO: 6879162 - DNA, 64 bp, Homo sapiens
tccactggaagccaggttactgttcagactttatcgacacttcactgggcttcacacacctgga

SEQ ID NO: 6879163 - DNA, 73 bp, Homo sapiens
tgggcctctcagttaagactgcactggactatcaatattcgtgctccagataactacttggctaagaggacca

SEQ ID NO: 6879164 - DNA, 61 bp, Homo sapiens
gtgttttgttacgtgatgtgtcagggtatataagcatgcctgcacagatgtcaacattcac

SEQ ID NO: 6879165 - DNA, 98 bp, Homo sapiens
agatcatctctacttcaggttttaccatgtaatgggcactctcaagtttattcctgccctaaaaatgcatgcagctggtgataagaagagactgattt

SEQ ID NO: 6879166 - DNA, 67 bp, Homo sapiens
aagtgggaggatctcttgaggccaggagttcaagacgagccttggcaacatagtgagacccccattt

SEQ ID NO: 6879167 - DNA, 130 bp, Homo sapiens
tcagaatctctgggaggacttgttaagacacaaattactgggcctcaatctcagagtttctaatgtaatagaaaatatggggtgagcccagagaatttgcaatttctttcaagtttttgggtgatgttga

SEQ ID NO: 6879168 - DNA, 66 bp, Homo sapiens
tattcatgagataggcagttttatggggtttgtgtatgagcctgaagagtgagtatttcctgatta

SEQ ID NO: 6879169 - DNA, 82 bp, Homo sapiens
tcttgctgggagccctcagtctggctgggaagacagatgctaaagatgtgatcataccaatcagctgacctccctgcacaga

SEQ ID NO: 6879170 - DNA, 102 bp, Homo sapiens
ttctggtcatccgagtattctgtttatttctgtgggtcccttggtaaacaggaatttacagtacccagcaaagataaacttatggaactcattaccccagaa

SEQ ID NO: 6879171 - DNA, 80 bp, Homo sapiens
ggatgtactacatttgttctatagcttttgggaaacatatttaccaaacagcttgaagggaataatttgtcaaggcatcc

SEQ ID NO: 6879172 - DNA, 78 bp, Homo sapiens
gtagataatgatacctatgtgacagtattattgtggtaattaaattataaatgttgccacataggtgtcatttgatgc

SEQ ID NO: 6879173 - DNA, 78 bp, Homo sapiens
gtgttgtttgaagcaattaagtttgtgatctgttatagccacagtagatcaaaaacttaatggctttatacctgacat

SEQ ID NO: 6879174 - DNA, 59 bp, Homo sapiens
ctcacgatgcgctcaaactccatggcctgcttcacctcctggggaaagccatcgatgag

SEQ ID NO: 6879175 - DNA, 56 bp, Homo sapiens
ctagtgaccacacgtctggaattgtgcaatgggccagtacttggttgtggttatag

SEQ ID NO: 6879176 - DNA, 86 bp, Homo sapiens
tttctagattcactgaggcttgctatgattcatatttgggaaggaattcaatgagacattgcaagtccagaaaacagaagtggaga

SEQ ID NO: 6879177 - DNA, 57 bp, Homo sapiens
gcctgctttgtgcctgatctttagctccatgtgcatgagaatgggtcagtggcaggt

SEQ ID NO: 6879178 - DNA, 129 bp, Homo sapiens
cattaaaatcacctaggagcttattaaaaatataaattcctgggcccagcactagacctaatgaatcagcatttccaagcgtgggtccaagaatctgtgatttaaataagtacccctagataattgatg

SEQ ID NO: 6879179 - DNA, 107 bp, Homo sapiens
gcccggaggcaggccagtgtgccgctgctgcaatagcaccacctccgccttgcctgcgaaggaaggcagggaagctggcatcacggaactcttcctgtgctcccggc

SEQ ID NO: 6879180 - DNA, 83 bp, Homo sapiens
cagatgatctcatgtgctgttagaggaagtgtaaattagtcaacactttctggagctgcacatattctgatttatccaatctg

SEQ ID NO: 6879181 - DNA, 74 bp, Homo sapiens
gccatggccaggtcctctgcagcgtctcacagaacttgaggagtgagactctggaggggctggtcctatgtggc

SEQ ID NO: 6879182 - DNA, 73 bp, Homo sapiens
gcctgctgtctgtatggaggaggtgctagcccggtccaccgggctgctgcccacccctgcatgccccagttgc

SEQ ID NO: 6879183 - DNA, 56 bp, Homo sapiens
gctgcacctactctgccctttagccggaagcggtaggctggctggcagtgggcagc

SEQ ID NO: 6879184 - DNA, 72 bp, Homo sapiens
tcattatttctcaaccaggtcaaaaaggcagaaacagttctgcagaattttttaggtggttggaaatgttga

SEQ ID NO: 6879185 - DNA, 68 bp, Homo sapiens
caagattcagcttcaaaaaatggtcttatgtacaaagcagccagtaccattccgttggagctggcttg

SEQ ID NO: 6879186 - DNA, 74 bp, Homo sapiens
gtgggggtgctcactgactccagggttcagccactgtctgcatgctaatgagctaaggagtcccacacctccac

SEQ ID NO: 6879187 - DNA, 77 bp, Homo sapiens
gagggtggaggtccaagatcaagggcaggttggtttctcttgaggcttctctccttggcttgcagacggccacattc

SEQ ID NO: 6879188 - DNA, 129 bp, Homo sapiens
gagaccagcccagttcttggctccccgcccaatgctctgtccaagacaccatagtggaaacctgggtctgctgaataggggccctgtggttgctagggcacaggatgaagccaaagttggaaaactctt

SEQ ID NO: 6879189 - DNA, 74 bp, Homo sapiens
aggagagaggaagatgggagagctctggaatgactgtgatttctccaccctgctttcttatctccctttatcct

SEQ ID NO: 6879190 - DNA, 75 bp, Homo sapiens
attaaaaccaacatcaatatattgtaatggttgttcttgtccggttgaaagttaatagctgatgttggttttaat

SEQ ID NO: 6879191 - DNA, 58 bp, Homo sapiens
tcagagataactgctacagataggaacctctccttctgtggcgcatagttgtctctgg

SEQ ID NO: 6879192 - DNA, 99 bp, Homo sapiens
agaatctattcaaggggttcacagtctttgacaagccctttcaagcagcaggatgcagtggaaggggcagagactgaagagtccaatgacctgggttct

SEQ ID NO: 6879193 - DNA, 130 bp, Homo sapiens
tttatgtcatacattacatcatgcgaatttttgtgtttgtgccacttagtaatatatctgttagagaacagatggaaggcatagaggttttaaacagcaggagcggtgatttaatcagatttgtacatta

SEQ ID NO: 6879194 - DNA, 84 bp, Homo sapiens
aaagatggttaaatactgagggtgaaaaataaagttaggatccttatttgaaattatttaaataccttcagttccatcctcttt

SEQ ID NO: 6879195 - DNA, 56 bp, Homo sapiens
tagagacatccatatagttgcttctatgatatggcaagcaacaataaaatgtcctg

SEQ ID NO: 6879196 - DNA, 56 bp, Homo sapiens
gtcgcaaacttgctgcctgtgagtgcaatccagcccacaggttcattctgtgtgac

SEQ ID NO: 6879197 - DNA, 57 bp, Homo sapiens
gatgtctttttccaggctcttttgctttatagcaatagacccaagagtaaaggcatc

SEQ ID NO: 6879198 - DNA, 61 bp, Homo sapiens
gttaaatgttctcgccacatacaaaaaaatggtaactatatgaggtgatggacatattaac

SEQ ID NO: 6879199 - DNA, 66 bp, Homo sapiens
catcctggccctcatgaccccttccaggtgtggaggacctgtgtgaagggggcagaggggcaggtg

SEQ ID NO: 6879200 - DNA, 97 bp, Homo sapiens
tctaagtcattgactagagaaaactgtgtatcttggagtgggcaaacacgttatcacctgtctaggattatggttatctttcaagtctagaacaaga

SEQ ID NO: 6879201 - DNA, 56 bp, Homo sapiens
ggtcctggttagcggctttcagatgtctacctttgacagctgtcttagcttgggct

SEQ ID NO: 6879202 - DNA, 70 bp, Homo sapiens
ggagcccttgctgaccttccaaagggtttactgcagagaaaaagccaaatcagagatcagtaaaggctct

SEQ ID NO: 6879203 - DNA, 57 bp, Homo sapiens
gaagtctgacaggtctgaatcaagcacagcatgaagcttgattctttggcagacatc

SEQ ID NO: 6879204 - DNA, 62 bp, Homo sapiens
gggttttattaactttaacatcactgggcttccagaggtcttctgtgtggttggtgaaactc

SEQ ID NO: 6879205 - DNA, 87 bp, Homo sapiens
atggcttttagcttaatggactttttaactgataggagctaaaaggctgagctcctactaatgaatctatgagctaatgacagctat

SEQ ID NO: 6879206 - DNA, 63 bp, Homo sapiens
gagtccttccaagaggaggatggggcgaactttccagctagagtttgacctaaggaaggattt

SEQ ID NO: 6879207 - DNA, 83 bp, Homo sapiens
tctgtgtccagcttttaccaaatgagcattattcaacaaagataactgcctagacaattggtacaggcttggaaaacttcaga

SEQ ID NO: 6879208 - DNA, 64 bp, Homo sapiens
tgtttcagatttgtttttgtttctgttctaactctaagcagacagagctcacaagtctttggca

SEQ ID NO: 6879209 - DNA, 63 bp, Homo sapiens
tgtggcatagtaggctgtcaaaaatggtagctgctgttattatgatgatcacctattagccca

SEQ ID NO: 6879210 - DNA, 76 bp, Homo sapiens
ggggtggccctaccctctggaatatacaaaaccttacacagacacaatgtgtacaccggggaacgggggccacccc

SEQ ID NO: 6879211 - DNA, 128 bp, Homo sapiens
ccccagataggccgaagtcccctcctgagtgcaggtggcaggtcagagaggggcaggaaagttcttctgaggtctcatgacttgcataaggccttgaggcactcacctggggaaaatattacctgggg

SEQ ID NO: 6879212 - DNA, 114 bp, Homo sapiens
ttcatgatgtgatttttatgactttgtcattaagtagggatttgtggtattcctcaaacattccaagaggcaaaccacaaaactctgaatggtgaaagttgtctttattttgaa

SEQ ID NO: 6879213 - DNA, 75 bp, Homo sapiens
gtttgaggaggtatagtaagatttgggcattttgaacttacagtgctggagcaacattattgtgccttgtccaac

SEQ ID NO: 6879214 - DNA, 62 bp, Homo sapiens
gaacattgttttccctatatccacctatattcattgttggaataagggagccaacaatgttt

SEQ ID NO: 6879215 - DNA, 55 bp, Homo sapiens
aagcaggtaaatatgtttccctttttctgtttcagaggtcaacatttatctgttt

SEQ ID NO: 6879216 - DNA, 75 bp, Homo sapiens
ggggagatacagttcaatccataacagctcccttcttggtgccaagggaaaatgaccggatgctgtgtgctcctt

SEQ ID NO: 6879217 - DNA, 56 bp, Homo sapiens
tctgtgctagaggagttggccactgaccaagaagtgggctctcctaatttcacaga

SEQ ID NO: 6879218 - DNA, 95 bp, Homo sapiens
tccgtatagagagaaacagtgttgctaagttctgaactagttatactgtaaaatgggtttaacagagtaggaaccctgtttttcacctgtaagga

SEQ ID NO: 6879219 - DNA, 88 bp, Homo sapiens
ttgtctgtctatatttgaaagagctgatacatgaagttatgcaaacttcattcatatgctttgttagagttatagaaaaaaaagataa

SEQ ID NO: 6879220 - DNA, 66 bp, Homo sapiens
cagtacataataggtgctcaataatgacttcttgaatttggaagtgtctagcacctggatgcactg

SEQ ID NO: 6879221 - DNA, 62 bp, Homo sapiens
aatggcagagctgggatatgaacccaggtagtctggtcatgaagttcccactctgagccatt

SEQ ID NO: 6879222 - DNA, 80 bp, Homo sapiens
agaaaggttttttgaataattcagaaacagcaaagcaagtggtggtttgtctgtactgccgttattcagagagaacatct

SEQ ID NO: 6879223 - DNA, 79 bp, Homo sapiens
cctggtccttgggcggggcagagggctatctttgtgggagtggagtggcttttcttgcttctggctgatgggactaagg

SEQ ID NO: 6879224 - DNA, 81 bp, Homo sapiens
tgagtgaggagggattggggagatagtcacggttgcacagcagacgctgagccaggcactgctcctggattaactcactca

SEQ ID NO: 6879225 - DNA, 80 bp, Homo sapiens
ttaggttggtgcaaaagtaattgtgatttttgccattgaaagcaatggcgaaaactgtaattacttttgcaccagtctaa

SEQ ID NO: 6879226 - DNA, 79 bp, Homo sapiens
ttatctgttgcttaatgcgcattaggaaaggacaatgttattgtagtctgcaggatgctattaataaagttatggataa

SEQ ID NO: 6879227 - DNA, 89 bp, Homo sapiens
cagccatcgcaccagccagaaggggaggtcttcgtggggcagggcccctgcctgcctgccctggggggcctccttgcggtgggaggctg

SEQ ID NO: 6879228 - DNA, 75 bp, Homo sapiens
ggattaggcacaacagagcactgccttattccccataagctagaatacgagcagtctatcttgtgatttaactcc

SEQ ID NO: 6879229 - DNA, 61 bp, Homo sapiens
tctggggtagggagggagtactgtagccatggttttactcacagtaaattccctgcaaaga

SEQ ID NO: 6879230 - DNA, 61 bp, Homo sapiens
cagaatgttgtcatcctgggatgggaaggcctgacacctgcttctctgcttgacagttctg

SEQ ID NO: 6879231 - DNA, 62 bp, Homo sapiens
gaatgatttggttgtttagatttgtcatgactcattgactataaatagcaacagaattattt

SEQ ID NO: 6879232 - DNA, 90 bp, Homo sapiens
gttctaaagctttaaaatttccccaccatgtatataaaggattgaagtgtcacagtactgagttggggagtttggaagacactttgggat

SEQ ID NO: 6879233 - DNA, 61 bp, Homo sapiens
ttgcatgtactcaggggaaaggtgcatgattgtgcatttgttaacctctgtgtatatggga

SEQ ID NO: 6879234 - DNA, 78 bp, Homo sapiens
gctgttgtcagctattgtatttgactgtctgcatggaggtgcttatgtgacagatctctatacatgaagataatttgc

SEQ ID NO: 6879235 - DNA, 69 bp, Homo sapiens
tctggcagtaaagagccttcattaaattatttttaatagtaagcatttattgaagcttattacgttaga

SEQ ID NO: 6879236 - DNA, 81 bp, Homo sapiens
tggctttcagctatttctgtagtatagtttattttcagtgcctttctcattaaaaaagtattacatttagtaattaggcca

SEQ ID NO: 6879237 - DNA, 80 bp, Homo sapiens
ggcctgagggatgggctgggccgccagggagatgggaagggagcatccaaggtgaccagggtggtcagctcattcaggcc

SEQ ID NO: 6879238 - DNA, 55 bp, Homo sapiens
agtgacagaaactttgcttttaaagacaagtaaggaggcaaggtagatgtctgct

SEQ ID NO: 6879239 - DNA, 58 bp, Homo sapiens
gcttgctttctatggcccatagaccccatactgtggtgtcctaagtggaaggacaagc

SEQ ID NO: 6879240 - DNA, 79 bp, Homo sapiens
cctaccctctcccgcctccagggctacaaggcaccagaccagtgggtcctggccgctggcccctgagaggcagggcagg

SEQ ID NO: 6879241 - DNA, 62 bp, Homo sapiens
ttccctactatcagaaggcccgttgctaagagatgccttgtttctttgcctcttagagggaa

SEQ ID NO: 6879242 - DNA, 65 bp, Homo sapiens
atgcatgatgaacttgctttcaattaaggattatcctttaatgaagtgcgttgtttaatgtgtgt

SEQ ID NO: 6879243 - DNA, 104 bp, Homo sapiens
cagtgtgcagctccccaggtttctccagacatccagttctcaaggggtcctgctgtgattgggagaaaccgaggctggggagagactaaaagcttctgtgcctg

SEQ ID NO: 6879244 - DNA, 60 bp, Homo sapiens
ctctggcctgactgcctttgctcctgggcagaaccgtccgtgaagacagacagacagcag

SEQ ID NO: 6879245 - DNA, 68 bp, Homo sapiens
aggcctcagctaaagagaagggtgtcgctggagcaagtttccgtgcccttcagctttgctgaaagcct

SEQ ID NO: 6879246 - DNA, 68 bp, Homo sapiens
gaagcagaaaacacggagtgggaatccctgggtcagctcctggaggtcccagttcctgtagatgtgtc

SEQ ID NO: 6879247 - DNA, 80 bp, Homo sapiens
tattagagacttatcagcatgtggaaaaagggtgcttttcagccgttcagaaaactcttcacacatgctgccctctgata

SEQ ID NO: 6879248 - DNA, 76 bp, Homo sapiens
tttccaacacattccagtgaatcacagttagatgccagactggcagacgtgacacattctggacatggttaggaag

SEQ ID NO: 6879249 - DNA, 60 bp, Homo sapiens
ttcctgaagctgaaaacttccagcatgtcaagatatttctgggacaaacagcttttggag

SEQ ID NO: 6879250 - DNA, 65 bp, Homo sapiens
agtgaccatctaacgcctgtgatggtgggaagcacgctgtaaggtacagtaagttgggtggtcct

SEQ ID NO: 6879251 - DNA, 66 bp, Homo sapiens
gacatgtgttttttctctttaggagtatagttctccattgtactgccttggtaggaataaccattc

SEQ ID NO: 6879252 - DNA, 67 bp, Homo sapiens
ctcagggagggctgcaatgagacagagaatcctgagattgttcctcatgtgcagatcttcacctggg

SEQ ID NO: 6879253 - DNA, 76 bp, Homo sapiens
ttgggaagctgtgtattacagaatatttaggagcacccctgacccatgtctgccagataccagcagcacctcccag

SEQ ID NO: 6879254 - DNA, 60 bp, Homo sapiens
ttttatacttgtgttgagtacatgtgagctgtatatcaatatgtactacaggtgataaag

SEQ ID NO: 6879255 - DNA, 87 bp, Homo sapiens
ggtaaatttcttaaataatgtgaacttctgtttcttcaaggcaagtttgttacagctgtgacttgaaacgtgaacagatcatttgcc

SEQ ID NO: 6879256 - DNA, 71 bp, Homo sapiens
aagagagaaggaaacagatgagttgcagctggtccaggaggaggacggcactgatctgatttccctccctt

SEQ ID NO: 6879257 - DNA, 57 bp, Homo sapiens
tcctcagaatggatggcaggggttgcaaaccatgtgcctgccttccatgctgagtga

SEQ ID NO: 6879258 - DNA, 70 bp, Homo sapiens
gaagccatgcaggagactggctgtggtagttttcatgtgaatttttatcttcagtgcttttcatgtcttc

SEQ ID NO: 6879259 - DNA, 79 bp, Homo sapiens
gctcccatgtgtgcgcaccctcccggcatccctcccttcggcaggaatggggttcagggagggttgcaagcttgggggc

SEQ ID NO: 6879260 - DNA, 57 bp, Homo sapiens
tgagggaggcctccatctgccatctgtgttgctgagggtgggtgggggtccccctcg

SEQ ID NO: 6879261 - DNA, 86 bp, Homo sapiens
cagtctggttgggacatgcagtggcagctcctggtgtataacatctttcacacaccttgagtctatctgcttgctgcctttgactg

SEQ ID NO: 6879262 - DNA, 82 bp, Homo sapiens
tgtttcttctgcaaagagactttgagtctggttgaccaaatgttttgaaagtcaagtcatgactcaaaggaagtagaaagca

SEQ ID NO: 6879263 - DNA, 22 bp, Homo sapiens
ttatttgcccatgtttagcaga

SEQ ID NO: 6879264 - DNA, 22 bp, Homo sapiens
gggccaaggggagctggaaggg

SEQ ID NO: 6879265 - DNA, 22 bp, Homo sapiens
ggcagaggtagctggaaccagg

SEQ ID NO: 6879266 - DNA, 22 bp, Homo sapiens
tggcagtgggaagctggaagtc

SEQ ID NO: 6879267 - DNA, 22 bp, Homo sapiens
aggcagtgtgtagctggaagag

SEQ ID NO: 6879268 - DNA, 22 bp, Homo sapiens
cgcactggagctggaacgagtc

SEQ ID NO: 6879269 - DNA, 22 bp, Homo sapiens
tggcagtaaagctggaaaagtg

SEQ ID NO: 6879270 - DNA, 22 bp, Homo sapiens
ggacggggagctggaaagggga

SEQ ID NO: 6879271 - DNA, 22 bp, Homo sapiens
tagattgtaagctccttgaggg

SEQ ID NO: 6879272 - DNA, 22 bp, Homo sapiens
aggaagagctggaccagaggac

SEQ ID NO: 6879273 - DNA, 22 bp, Homo sapiens
tgcagtgcagctggaatatctt

SEQ ID NO: 6879274 - DNA, 22 bp, Homo sapiens
tgtcaagttgttaagttctggg

SEQ ID NO: 6879275 - DNA, 22 bp, Homo sapiens
aggctgtagatctagacatgta

SEQ ID NO: 6879276 - DNA, 22 bp, Homo sapiens
ggggaggaagctggaacacggg

SEQ ID NO: 6879277 - DNA, 22 bp, Homo sapiens
aggacaagacaaggaccagaga

SEQ ID NO: 6879278 - DNA, 22 bp, Homo sapiens
tggaagcccagaaggaagcaga

SEQ ID NO: 6879279 - DNA, 22 bp, Homo sapiens
tggcagtagagctggaacttga

SEQ ID NO: 6879280 - DNA, 22 bp, Homo sapiens
ttagacagagctccttgagggc

SEQ ID NO: 6879281 - DNA, 22 bp, Homo sapiens
aggcagatgggagctggaagtt

SEQ ID NO: 6879282 - DNA, 22 bp, Homo sapiens
acacacagaaggaagccccact

SEQ ID NO: 6879283 - DNA, 23 bp, Homo sapiens
tagactgcaggctccttgagggc

SEQ ID NO: 6879284 - DNA, 22 bp, Homo sapiens
tgcagtgcagctggaagttggc

SEQ ID NO: 6879285 - DNA, 21 bp, Homo sapiens
ggcagagaagctggaagttgg

SEQ ID NO: 6879286 - DNA, 22 bp, Homo sapiens
ttcacagtggctaagttctgca

SEQ ID NO: 6879287 - DNA, 22 bp, Homo sapiens
gggctactgagctggaactggg

SEQ ID NO: 6879288 - DNA, 22 bp, Homo sapiens
tggaaggggagctggaaagggg

SEQ ID NO: 6879289 - DNA, 22 bp, Homo sapiens
gagcagctgagctggaatgaga

SEQ ID NO: 6879290 - DNA, 22 bp, Homo sapiens
tcagtggttaagttctgtccac

SEQ ID NO: 6879291 - DNA, 21 bp, Homo sapiens
tggcaggcagctggaagcttg

SEQ ID NO: 6879292 - DNA, 22 bp, Homo sapiens
tctaaagctccttccactaaaa

SEQ ID NO: 6879293 - DNA, 22 bp, Homo sapiens
agcaggggcagggttttgtgct

SEQ ID NO: 6879294 - DNA, 22 bp, Homo sapiens
agagctagaaggaagcatttct

SEQ ID NO: 6879295 - DNA, 22 bp, Homo sapiens
agaagcagaaggaagcagggcc

SEQ ID NO: 6879296 - DNA, 22 bp, Homo sapiens
tgggcagtccagctggaaacgg

SEQ ID NO: 6879297 - DNA, 22 bp, Homo sapiens
tgggtagggagctggaatccta

SEQ ID NO: 6879298 - DNA, 22 bp, Homo sapiens
aggcagtggagctggaataggc

SEQ ID NO: 6879299 - DNA, 22 bp, Homo sapiens
ggtcatagagctggaaattggc

SEQ ID NO: 6879300 - DNA, 22 bp, Homo sapiens
ttccagatgtttaagttctgct

SEQ ID NO: 6879301 - DNA, 22 bp, Homo sapiens
ggctcagaggagctggaacggt

SEQ ID NO: 6879302 - DNA, 22 bp, Homo sapiens
aggccagtgcagctggaacaga

SEQ ID NO: 6879303 - DNA, 22 bp, Homo sapiens
agagcagatggagctggaagag

SEQ ID NO: 6879304 - DNA, 22 bp, Homo sapiens
ggcagaggaagctggaagtggg

SEQ ID NO: 6879305 - DNA, 22 bp, Homo sapiens
ggaaggggagctggaaagggta

SEQ ID NO: 6879306 - DNA, 22 bp, Homo sapiens
ctagttttaagctccttgaggt

SEQ ID NO: 6879307 - DNA, 22 bp, Homo sapiens
gagactgtaagctccttgagga

SEQ ID NO: 6879308 - DNA, 22 bp, Homo sapiens
agagacagggttttgtcgtgtt

SEQ ID NO: 6879309 - DNA, 22 bp, Homo sapiens
aggcaggggagctggaagggta

SEQ ID NO: 6879310 - DNA, 22 bp, Homo sapiens
ccagactggggctccttgaggg

SEQ ID NO: 6879311 - DNA, 22 bp, Homo sapiens
ttcatactgtttaagttctgtt

SEQ ID NO: 6879312 - DNA, 22 bp, Homo sapiens
tggctgggagctggaactgggc

SEQ ID NO: 6879313 - DNA, 22 bp, Homo sapiens
ctagcagaagctccttgagggt

SEQ ID NO: 6879314 - DNA, 22 bp, Homo sapiens
tggcgtgaagctggaaggcgga

SEQ ID NO: 6879315 - DNA, 22 bp, Homo sapiens
cgccagtggcagctggaacagg

SEQ ID NO: 6879316 - DNA, 22 bp, Homo sapiens
gagcagctcgagaaggaagcag

SEQ ID NO: 6879317 - DNA, 22 bp, Homo sapiens
tcaggtagtggttaagttctgt

SEQ ID NO: 6879318 - DNA, 22 bp, Homo sapiens
cagacagaaggctccttgaggt

SEQ ID NO: 6879319 - DNA, 22 bp, Homo sapiens
ttcaggtttttaagttctgcct

SEQ ID NO: 6879320 - DNA, 22 bp, Homo sapiens
attcaagagcccatgtttcctg

SEQ ID NO: 6879321 - DNA, 22 bp, Homo sapiens
tagactggaagctccttgaggc

SEQ ID NO: 6879322 - DNA, 22 bp, Homo sapiens
tgaggaagtggttgtatggttt

SEQ ID NO: 6879323 - DNA, 22 bp, Homo sapiens
taggcagattccatattttggc

SEQ ID NO: 6879324 - DNA, 22 bp, Homo sapiens
tgcagaggagctggaaggctgg

SEQ ID NO: 6879325 - DNA, 22 bp, Homo sapiens
ggcagaggagctggaaacatgg

SEQ ID NO: 6879326 - DNA, 22 bp, Homo sapiens
ctaattgtaagctccttgaggg

SEQ ID NO: 6879327 - DNA, 22 bp, Homo sapiens
ggacatagatctagactttaaa

SEQ ID NO: 6879328 - DNA, 22 bp, Homo sapiens
gggctgagagctggaatctgag

SEQ ID NO: 6879329 - DNA, 22 bp, Homo sapiens
tagagtgtaagctccttgaggg

SEQ ID NO: 6879330 - DNA, 22 bp, Homo sapiens
tttcagactgcccatgtttgcc

SEQ ID NO: 6879331 - DNA, 22 bp, Homo sapiens
cagactgtgagctccttgaggg

SEQ ID NO: 6879332 - DNA, 22 bp, Homo sapiens
tagactgtgagctccttgaggg

SEQ ID NO: 6879333 - DNA, 22 bp, Homo sapiens
ggtagactgagctccttgagga

SEQ ID NO: 6879334 - DNA, 22 bp, Homo sapiens
gggcaagaagctggaagcattc

SEQ ID NO: 6879335 - DNA, 22 bp, Homo sapiens
agcaggagggttttgtagagtc

SEQ ID NO: 6879336 - DNA, 22 bp, Homo sapiens
gggatggggagctggaaagggg

SEQ ID NO: 6879337 - DNA, 22 bp, Homo sapiens
aagagtggagctggaaagtggg

SEQ ID NO: 6879338 - DNA, 22 bp, Homo sapiens
aggcaagattaggaccagaaga

SEQ ID NO: 6879339 - DNA, 23 bp, Homo sapiens
agggcactgaagctggaattggg

SEQ ID NO: 6879340 - DNA, 18 bp, Homo sapiens
cacctcccagcccctgcc

SEQ ID NO: 6879341 - DNA, 13 bp, Homo sapiens
acagagcacgcct

SEQ ID NO: 6879342 - DNA, 13 bp, Homo sapiens
tctccctgagcct

SEQ ID NO: 6879343 - DNA, 18 bp, Homo sapiens
cctctcactccccagccc

SEQ ID NO: 6879344 - DNA, 16 bp, Homo sapiens
cactctgccctctgct

SEQ ID NO: 6879345 - DNA, 15 bp, Homo sapiens
aggtatgtctgtgcc

SEQ ID NO: 6879346 - DNA, 11 bp, Homo sapiens
cactcttgact

SEQ ID NO: 6879347 - DNA, 14 bp, Homo sapiens
tacactcctgctgt

SEQ ID NO: 6879348 - DNA, 14 bp, Homo sapiens
ccaaaaagcacata

SEQ ID NO: 6879349 - DNA, 17 bp, Homo sapiens
ggtgagggcaagaggtg

SEQ ID NO: 6879350 - DNA, 18 bp, Homo sapiens
acaattgtgtagcctttt

SEQ ID NO: 6879351 - DNA, 23 bp, Homo sapiens
agatgctggcccagggcccagag

SEQ ID NO: 6879352 - DNA, 15 bp, Homo sapiens
gcctctcccaggcag

SEQ ID NO: 6879353 - DNA, 20 bp, Homo sapiens
ctctgtttcttcctttctgt

SEQ ID NO: 6879354 - DNA, 21 bp, Homo sapiens
gtcccagcccctcctccctca

SEQ ID NO: 6879355 - DNA, 23 bp, Homo sapiens
agccttccccttatcctccctgt

SEQ ID NO: 6879356 - DNA, 14 bp, Homo sapiens
ccggcccccttcct

SEQ ID NO: 6879357 - DNA, 12 bp, Homo sapiens
aagccactggaa

SEQ ID NO: 6879358 - DNA, 20 bp, Homo sapiens
ctctggggcaggctgcttca

SEQ ID NO: 6879359 - DNA, 20 bp, Homo sapiens
gacagcttacaggagccagc

SEQ ID NO: 6879360 - DNA, 16 bp, Homo sapiens
cctgtccccgccttcc

SEQ ID NO: 6879361 - DNA, 24 bp, Homo sapiens
cccagctacattcctcagctgcca

SEQ ID NO: 6879362 - DNA, 16 bp, Homo sapiens
cctgaaagtaatttca

SEQ ID NO: 6879363 - DNA, 22 bp, Homo sapiens
caagatctgccagacctgcatg

SEQ ID NO: 6879364 - DNA, 19 bp, Homo sapiens
cgaggcctggctctggagc

SEQ ID NO: 6879365 - DNA, 13 bp, Homo sapiens
ttcgtctgtccca

SEQ ID NO: 6879366 - DNA, 15 bp, Homo sapiens
actatctcacttcca

SEQ ID NO: 6879367 - DNA, 20 bp, Homo sapiens
tgttccttactttactgcct

SEQ ID NO: 6879368 - DNA, 19 bp, Homo sapiens
ccagcctgcgcctgctgca

SEQ ID NO: 6879369 - DNA, 19 bp, Homo sapiens
atccctgaacccctggcca

SEQ ID NO: 6879370 - DNA, 19 bp, Homo sapiens
gcttgctttcttctcctgt

SEQ ID NO: 6879371 - DNA, 22 bp, Homo sapiens
tttccaaaataaaaaccttcca

SEQ ID NO: 6879372 - DNA, 17 bp, Homo sapiens
tccacttgtttgcactg

SEQ ID NO: 6879373 - DNA, 13 bp, Homo sapiens
gggctgtgcctta

SEQ ID NO: 6879374 - DNA, 22 bp, Homo sapiens
gctcacagaacccttggagcca

SEQ ID NO: 6879375 - DNA, 22 bp, Homo sapiens
cctccccggagccggcactgca

SEQ ID NO: 6879376 - DNA, 12 bp, Homo sapiens
acagcagctcca

SEQ ID NO: 6879377 - DNA, 15 bp, Homo sapiens
ctgcgtgcacttccc

SEQ ID NO: 6879378 - DNA, 22 bp, Homo sapiens
tcagtgccacttgacattcctt

SEQ ID NO: 6879379 - DNA, 22 bp, Homo sapiens
acctggccgggtcaccctgtga

SEQ ID NO: 6879380 - DNA, 14 bp, Homo sapiens
actagtttttccta

SEQ ID NO: 6879381 - DNA, 13 bp, Homo sapiens
tttcccctttcca

SEQ ID NO: 6879382 - DNA, 20 bp, Homo sapiens
ctttcttccggcccctcccc

SEQ ID NO: 6879383 - DNA, 13 bp, Homo sapiens
aggccccttgctg

SEQ ID NO: 6879384 - DNA, 17 bp, Homo sapiens
tgaagtgtacctgtgta

SEQ ID NO: 6879385 - DNA, 18 bp, Homo sapiens
tcaataaaagagctgtct

SEQ ID NO: 6879386 - DNA, 13 bp, Homo sapiens
ttcctgcactcca

SEQ ID NO: 6879387 - DNA, 14 bp, Homo sapiens
gttcgactcagcct

SEQ ID NO: 6879388 - DNA, 15 bp, Homo sapiens
ctaactcttgctcac

SEQ ID NO: 6879389 - DNA, 15 bp, Homo sapiens
ctggaggtctggctg

SEQ ID NO: 6879390 - DNA, 16 bp, Homo sapiens
agttgttgactgtgat

SEQ ID NO: 6879391 - DNA, 21 bp, Homo sapiens
ataattatgagtttgcttatg

SEQ ID NO: 6879392 - DNA, 17 bp, Homo sapiens
cacttaaactttgtcac

SEQ ID NO: 6879393 - DNA, 19 bp, Homo sapiens
ccaggctcctacctgtctg

SEQ ID NO: 6879394 - DNA, 21 bp, Homo sapiens
gcatcctaagaaatatgtgag

SEQ ID NO: 6879395 - DNA, 20 bp, Homo sapiens
actgtttactcacattgtcc

SEQ ID NO: 6879396 - DNA, 14 bp, Homo sapiens
ttaaagcatctgta

SEQ ID NO: 6879397 - DNA, 20 bp, Homo sapiens
atatattttagggctgtaga

SEQ ID NO: 6879398 - DNA, 20 bp, Homo sapiens
tggatacatctgctgtgtgg

SEQ ID NO: 6879399 - DNA, 14 bp, Homo sapiens
aacgcagcctccag

SEQ ID NO: 6879400 - DNA, 13 bp, Homo sapiens
tcctgttcctgcc

SEQ ID NO: 6879401 - DNA, 22 bp, Homo sapiens
ctactttaaatcctaccaaagt

SEQ ID NO: 6879402 - DNA, 16 bp, Homo sapiens
cagggggagtctttgc

SEQ ID NO: 6879403 - DNA, 16 bp, Homo sapiens
cacataaatgcagccc

SEQ ID NO: 6879404 - DNA, 22 bp, Homo sapiens
gatttggagcactctgagttta

SEQ ID NO: 6879405 - DNA, 16 bp, Homo sapiens
atttaatggactgtga

SEQ ID NO: 6879406 - DNA, 16 bp, Homo sapiens
tccggcctgcagccca

SEQ ID NO: 6879407 - DNA, 17 bp, Homo sapiens
ctccattgggactgatt

SEQ ID NO: 6879408 - DNA, 14 bp, Homo sapiens
tggtgtactgtgtt

SEQ ID NO: 6879409 - DNA, 15 bp, Homo sapiens
ctgtctgtgcacatg

SEQ ID NO: 6879410 - DNA, 12 bp, Homo sapiens
catgctccctcc

SEQ ID NO: 6879411 - DNA, 18 bp, Homo sapiens
cctgccccaccccatcca

SEQ ID NO: 6879412 - DNA, 20 bp, Homo sapiens
tacatgtattgcacattgta

SEQ ID NO: 6879413 - DNA, 14 bp, Homo sapiens
aaaataacacttaa

SEQ ID NO: 6879414 - DNA, 13 bp, Homo sapiens
caatcatatgtga

SEQ ID NO: 6879415 - DNA, 17 bp, Homo sapiens
acattcttccatcatca

SEQ ID NO: 6879416 - DNA, 18 bp, Homo sapiens
atagctcttcacttcctc

SEQ ID NO: 6879417 - DNA, 18 bp, Homo sapiens
ctagagcctgcctggagc

SEQ ID NO: 6879418 - DNA, 16 bp, Homo sapiens
acctacgttcctggcc

SEQ ID NO: 6879419 - DNA, 19 bp, Homo sapiens
ctcaaaggagctttctcaa

SEQ ID NO: 6879420 - DNA, 12 bp, Homo sapiens
gaggggacccag

SEQ ID NO: 6879421 - DNA, 16 bp, Homo sapiens
aggggcatctgtctgt

SEQ ID NO: 6879422 - DNA, 13 bp, Homo sapiens
acaaccggtccct

SEQ ID NO: 6879423 - DNA, 12 bp, Homo sapiens
ggttcctctgcc

SEQ ID NO: 6879424 - DNA, 20 bp, Homo sapiens
ccagctgctgtgccccacca

SEQ ID NO: 6879425 - DNA, 14 bp, Homo sapiens
ttaagggaagctga

SEQ ID NO: 6879426 - DNA, 19 bp, Homo sapiens
ttgttaataataagataat

SEQ ID NO: 6879427 - DNA, 23 bp, Homo sapiens
agcccagatggctccctgggctg

SEQ ID NO: 6879428 - DNA, 21 bp, Homo sapiens
aggagactgggcacccctgcc

SEQ ID NO: 6879429 - DNA, 20 bp, Homo sapiens
cgtcctgtagcacgctgcct

SEQ ID NO: 6879430 - DNA, 18 bp, Homo sapiens
cttgcatctcattgctct

SEQ ID NO: 6879431 - DNA, 15 bp, Homo sapiens
taatactctgttgta

SEQ ID NO: 6879432 - DNA, 14 bp, Homo sapiens
tgtaatattctgtt

SEQ ID NO: 6879433 - DNA, 14 bp, Homo sapiens
agaaatatacagtt

SEQ ID NO: 6879434 - DNA, 16 bp, Homo sapiens
caagtgaatctttctc

SEQ ID NO: 6879435 - DNA, 17 bp, Homo sapiens
cccaccccaccctgccc

SEQ ID NO: 6879436 - DNA, 16 bp, Homo sapiens
caggcctgagctgctt

SEQ ID NO: 6879437 - DNA, 12 bp, Homo sapiens
cagtcactgcca

SEQ ID NO: 6879438 - DNA, 20 bp, Homo sapiens
atatccatgagctgcactga

SEQ ID NO: 6879439 - DNA, 15 bp, Homo sapiens
ctttgattatttgca

SEQ ID NO: 6879440 - DNA, 17 bp, Homo sapiens
tcagtcagggtttgtca

SEQ ID NO: 6879441 - DNA, 16 bp, Homo sapiens
tggccctcctggctgt

SEQ ID NO: 6879442 - DNA, 21 bp, Homo sapiens
ccatgatttagcaagcaacta

SEQ ID NO: 6879443 - DNA, 13 bp, Homo sapiens
catccctgggcct

SEQ ID NO: 6879444 - DNA, 21 bp, Homo sapiens
ccagcttggggccaccaaagc

SEQ ID NO: 6879445 - DNA, 11 bp, Homo sapiens
aataaagtgta

SEQ ID NO: 6879446 - DNA, 14 bp, Homo sapiens
ttaacacactggcc

SEQ ID NO: 6879447 - DNA, 13 bp, Homo sapiens
ccagtcagcctct

SEQ ID NO: 6879448 - DNA, 21 bp, Homo sapiens
cctccccagccagcccttccc

SEQ ID NO: 6879449 - DNA, 18 bp, Homo sapiens
cctcccccattccctcca

SEQ ID NO: 6879450 - DNA, 23 bp, Homo sapiens
ggttctgttttcgtaccttccca

SEQ ID NO: 6879451 - DNA, 19 bp, Homo sapiens
ctgtgtctgagtggcttca

SEQ ID NO: 6879452 - DNA, 14 bp, Homo sapiens
gtccctctgcccca

SEQ ID NO: 6879453 - DNA, 22 bp, Homo sapiens
ctcagtcctcccctcacagcct

SEQ ID NO: 6879454 - DNA, 19 bp, Homo sapiens
gattcccactgccgctgcc

SEQ ID NO: 6879455 - DNA, 17 bp, Homo sapiens
cagttttgtgtacagta

SEQ ID NO: 6879456 - DNA, 21 bp, Homo sapiens
ttactttttgtaaatgctgta

SEQ ID NO: 6879457 - DNA, 14 bp, Homo sapiens
cttccacctgctct

SEQ ID NO: 6879458 - DNA, 14 bp, Homo sapiens
aaactcactgtgat

SEQ ID NO: 6879459 - DNA, 17 bp, Homo sapiens
ctttttccttcctgccc

SEQ ID NO: 6879460 - DNA, 17 bp, Homo sapiens
cctgtgtaacagctcct

SEQ ID NO: 6879461 - DNA, 12 bp, Homo sapiens
cagcttgtttaa

SEQ ID NO: 6879462 - DNA, 20 bp, Homo sapiens
ctatttaagtggactgtatt

SEQ ID NO: 6879463 - DNA, 20 bp, Homo sapiens
cagaattttgttggtctgaa

SEQ ID NO: 6879464 - DNA, 21 bp, Homo sapiens
gaaggggcctgggctgtgagg

SEQ ID NO: 6879465 - DNA, 15 bp, Homo sapiens
taatgatattttatg

SEQ ID NO: 6879466 - DNA, 19 bp, Homo sapiens
tgtccttgcacctgagcct

SEQ ID NO: 6879467 - DNA, 16 bp, Homo sapiens
aatctactaattccac

SEQ ID NO: 6879468 - DNA, 16 bp, Homo sapiens
tggtggggctgagcct

SEQ ID NO: 6879469 - DNA, 14 bp, Homo sapiens
ccaggtcccagccc

SEQ ID NO: 6879470 - DNA, 14 bp, Homo sapiens
cgctgtcactggct

SEQ ID NO: 6879471 - DNA, 22 bp, Homo sapiens
cccggcccagagaccccttcct

SEQ ID NO: 6879472 - DNA, 20 bp, Homo sapiens
atatgaaactctacatttaa

SEQ ID NO: 6879473 - DNA, 13 bp, Homo sapiens
ctgtccatggcct

SEQ ID NO: 6879474 - DNA, 18 bp, Homo sapiens
ttcagtgactcctgctgg

SEQ ID NO: 6879475 - DNA, 13 bp, Homo sapiens
ctgctcagcttct

SEQ ID NO: 6879476 - DNA, 16 bp, Homo sapiens
agaatgtgacctttaa

SEQ ID NO: 6879477 - DNA, 16 bp, Homo sapiens
cacacgaaccctgcca

SEQ ID NO: 6879478 - DNA, 19 bp, Homo sapiens
ccaggtcgggcagtggagg

SEQ ID NO: 6879479 - DNA, 16 bp, Homo sapiens
cctccgggcctcggcc

SEQ ID NO: 6879480 - DNA, 15 bp, Homo sapiens
cccagcagcctgcca

SEQ ID NO: 6879481 - DNA, 23 bp, Homo sapiens
aatattctaaaaaagatactgta

SEQ ID NO: 6879482 - DNA, 17 bp, Homo sapiens
cactgaaagttttgtaa

SEQ ID NO: 6879483 - DNA, 19 bp, Homo sapiens
tgaatttgcaaagtactgt

SEQ ID NO: 6879484 - DNA, 23 bp, Homo sapiens
ctccggaggactcaccactgccc

SEQ ID NO: 6879485 - DNA, 14 bp, Homo sapiens
ccagacccccagca

SEQ ID NO: 6879486 - DNA, 13 bp, Homo sapiens
cactcccactgcc

SEQ ID NO: 6879487 - DNA, 12 bp, Homo sapiens
agaggccctgga

SEQ ID NO: 6879488 - DNA, 19 bp, Homo sapiens
ccttcccacggccactgca

SEQ ID NO: 6879489 - DNA, 20 bp, Homo sapiens
cctgcttgagctttctgtgc

SEQ ID NO: 6879490 - DNA, 22 bp, Homo sapiens
acaaaattttctcattttcttt

SEQ ID NO: 6879491 - DNA, 18 bp, Homo sapiens
gcccaagctaagccatca

SEQ ID NO: 6879492 - DNA, 17 bp, Homo sapiens
ttgaaaatgtgtttgct

SEQ ID NO: 6879493 - DNA, 13 bp, Homo sapiens
ttttaccctgtgt

SEQ ID NO: 6879494 - DNA, 18 bp, Homo sapiens
tcctccaccgccatggct

SEQ ID NO: 6879495 - DNA, 18 bp, Homo sapiens
tgggggcactcagccacg

SEQ ID NO: 6879496 - DNA, 16 bp, Homo sapiens
cagagtgctggactgt

SEQ ID NO: 6879497 - DNA, 22 bp, Homo sapiens
cctctcatccaggtcctttcct

SEQ ID NO: 6879498 - DNA, 23 bp, Homo sapiens
ctcccacggggaccactgggccc

SEQ ID NO: 6879499 - DNA, 20 bp, Homo sapiens
ctcagaggctgacactgaca

SEQ ID NO: 6879500 - DNA, 14 bp, Homo sapiens
cctccccccagccc

SEQ ID NO: 6879501 - DNA, 21 bp, Homo sapiens
ctagtcctttataagttgctt

SEQ ID NO: 6879502 - DNA, 14 bp, Homo sapiens
aataattgtttcca

SEQ ID NO: 6879503 - DNA, 18 bp, Homo sapiens
gtgacaaccctggcctca

SEQ ID NO: 6879504 - DNA, 15 bp, Homo sapiens
aggagcttacccaag

SEQ ID NO: 6879505 - DNA, 17 bp, Homo sapiens
tggtgtcacttactgtt

SEQ ID NO: 6879506 - DNA, 20 bp, Homo sapiens
catccaaactgtatcttcct

SEQ ID NO: 6879507 - DNA, 19 bp, Homo sapiens
cctgcccctgccccaaccc

SEQ ID NO: 6879508 - DNA, 20 bp, Homo sapiens
gaggggcaaatagagagtct

SEQ ID NO: 6879509 - DNA, 20 bp, Homo sapiens
aaatttgatggtgaatatta

SEQ ID NO: 6879510 - DNA, 17 bp, Homo sapiens
aactccctagttaccca

SEQ ID NO: 6879511 - DNA, 13 bp, Homo sapiens
gaaaactaactca

SEQ ID NO: 6879512 - DNA, 14 bp, Homo sapiens
tatacccactgcat

SEQ ID NO: 6879513 - DNA, 21 bp, Homo sapiens
cactgtagtttttgaaaatta

SEQ ID NO: 6879514 - DNA, 14 bp, Homo sapiens
ccttctcccctgcc

SEQ ID NO: 6879515 - DNA, 12 bp, Homo sapiens
aattttactgtg

SEQ ID NO: 6879516 - DNA, 17 bp, Homo sapiens
aaagaagcactctgctg

SEQ ID NO: 6879517 - DNA, 20 bp, Homo sapiens
acactctcccattatattta

SEQ ID NO: 6879518 - DNA, 18 bp, Homo sapiens
cccttccttttccctgct

SEQ ID NO: 6879519 - DNA, 19 bp, Homo sapiens
ccttccctcacccccagca

SEQ ID NO: 6879520 - DNA, 16 bp, Homo sapiens
aggagaaccaaatctg

SEQ ID NO: 6879521 - DNA, 23 bp, Homo sapiens
ctacaacataatgatactgaatt

SEQ ID NO: 6879522 - DNA, 17 bp, Homo sapiens
ctgtacataattgcatg

SEQ ID NO: 6879523 - DNA, 18 bp, Homo sapiens
cagcttgtgattcctacc

SEQ ID NO: 6879524 - DNA, 23 bp, Homo sapiens
ctccagcctccctgtctccagct

SEQ ID NO: 6879525 - DNA, 13 bp, Homo sapiens
tctatacattcct

SEQ ID NO: 6879526 - DNA, 19 bp, Homo sapiens
acttttgttattccatcaa

SEQ ID NO: 6879527 - DNA, 19 bp, Homo sapiens
gctgcttctcccaggcaag

SEQ ID NO: 6879528 - DNA, 15 bp, Homo sapiens
tcctgagtctgggca

SEQ ID NO: 6879529 - DNA, 15 bp, Homo sapiens
ctgcttgggcttcat

SEQ ID NO: 6879530 - DNA, 19 bp, Homo sapiens
gcaagctgtgttacttgaa

SEQ ID NO: 6879531 - DNA, 14 bp, Homo sapiens
ccagtccccagccc

SEQ ID NO: 6879532 - DNA, 18 bp, Homo sapiens
gaaaatcagcctgctcca

SEQ ID NO: 6879533 - DNA, 23 bp, Homo sapiens
ggagcaaagcctgttcatggcag

SEQ ID NO: 6879534 - DNA, 14 bp, Homo sapiens
cccttccagctccc

SEQ ID NO: 6879535 - DNA, 22 bp, Homo sapiens
catttctcaatcagtgcagtga

SEQ ID NO: 6879536 - DNA, 20 bp, Homo sapiens
agagctggaaggcagggcag

SEQ ID NO: 6879537 - DNA, 17 bp, Homo sapiens
cctgggcctatggagag

SEQ ID NO: 6879538 - DNA, 22 bp, Homo sapiens
tatgtacaaaatgaattgcctt

SEQ ID NO: 6879539 - DNA, 21 bp, Homo sapiens
ctgaaacacgaaacttgttat

SEQ ID NO: 6879540 - DNA, 20 bp, Homo sapiens
cacatggagccccctctgcc

SEQ ID NO: 6879541 - DNA, 13 bp, Homo sapiens
tcattgacttcat

SEQ ID NO: 6879542 - DNA, 18 bp, Homo sapiens
caggtgacagtgaagata

SEQ ID NO: 6879543 - DNA, 20 bp, Homo sapiens
tgagcaggaaagactggccc

SEQ ID NO: 6879544 - DNA, 23 bp, Homo sapiens
ctaatgttgtatcatactcttct

SEQ ID NO: 6879545 - DNA, 14 bp, Homo sapiens
actggcaggggaga

SEQ ID NO: 6879546 - DNA, 13 bp, Homo sapiens
cccttcccctcct

SEQ ID NO: 6879547 - DNA, 14 bp, Homo sapiens
tcccggataggcta

SEQ ID NO: 6879548 - DNA, 23 bp, Homo sapiens
ctttgagatgtgttcctcctgct

SEQ ID NO: 6879549 - DNA, 12 bp, Homo sapiens
cttcccatgcct

SEQ ID NO: 6879550 - DNA, 18 bp, Homo sapiens
caggtgcccctctctcca

SEQ ID NO: 6879551 - DNA, 14 bp, Homo sapiens
tctgcctgagattc

SEQ ID NO: 6879552 - DNA, 20 bp, Homo sapiens
cctctgggagtccccatccc

SEQ ID NO: 6879553 - DNA, 22 bp, Homo sapiens
catttcgttccctgattattta

SEQ ID NO: 6879554 - DNA, 20 bp, Homo sapiens
acatccaccaaactcctgcc

SEQ ID NO: 6879555 - DNA, 15 bp, Homo sapiens
cactacaccacacac

SEQ ID NO: 6879556 - DNA, 14 bp, Homo sapiens
acatcatgaattta

SEQ ID NO: 6879557 - DNA, 19 bp, Homo sapiens
aaattcccttcatctggaa

SEQ ID NO: 6879558 - DNA, 14 bp, Homo sapiens
attttctccctgga

SEQ ID NO: 6879559 - DNA, 13 bp, Homo sapiens
ctggcctcctgcc

SEQ ID NO: 6879560 - DNA, 17 bp, Homo sapiens
caatgttctttgtctca

SEQ ID NO: 6879561 - DNA, 18 bp, Homo sapiens
ttgcatctgggtagctgt

SEQ ID NO: 6879562 - DNA, 22 bp, Homo sapiens
aaagactattcaaacagtctca

SEQ ID NO: 6879563 - DNA, 19 bp, Homo sapiens
cagcacccccacccacctc

SEQ ID NO: 6879564 - DNA, 17 bp, Homo sapiens
ctgcccccatcacctct

SEQ ID NO: 6879565 - DNA, 23 bp, Homo sapiens
taaccccgtctgctcctccctcc

SEQ ID NO: 6879566 - DNA, 18 bp, Homo sapiens
ccaacaagaatgcattga

SEQ ID NO: 6879567 - DNA, 16 bp, Homo sapiens
caagggaacctgtgtc

SEQ ID NO: 6879568 - DNA, 14 bp, Homo sapiens
caaactacctatat

SEQ ID NO: 6879569 - DNA, 17 bp, Homo sapiens
accagcatcacctgcct

SEQ ID NO: 6879570 - DNA, 18 bp, Homo sapiens
ctggtattctctttgcct

SEQ ID NO: 6879571 - DNA, 13 bp, Homo sapiens
aggagacagacac

SEQ ID NO: 6879572 - DNA, 16 bp, Homo sapiens
tgccaagtgcctgctt

SEQ ID NO: 6879573 - DNA, 21 bp, Homo sapiens
agcacagctcctcccctgccg

SEQ ID NO: 6879574 - DNA, 17 bp, Homo sapiens
aaggagggcctctggtg

SEQ ID NO: 6879575 - DNA, 19 bp, Homo sapiens
agctctctaggcctctcca

SEQ ID NO: 6879576 - DNA, 19 bp, Homo sapiens
ccgtccccggcccctgccc

SEQ ID NO: 6879577 - DNA, 14 bp, Homo sapiens
cctgctctgcttcc

SEQ ID NO: 6879578 - DNA, 16 bp, Homo sapiens
cttcctatcccatccc

SEQ ID NO: 6879579 - DNA, 12 bp, Homo sapiens
cttcctgtccct

SEQ ID NO: 6879580 - DNA, 20 bp, Homo sapiens
gcaccacggcgtttttttac

SEQ ID NO: 6879581 - DNA, 13 bp, Homo sapiens
gccccgcctgcct

SEQ ID NO: 6879582 - DNA, 17 bp, Homo sapiens
gtccaccccccacacac

SEQ ID NO: 6879583 - DNA, 16 bp, Homo sapiens
aggcatttgctgaata

SEQ ID NO: 6879584 - DNA, 14 bp, Homo sapiens
ctccgtcactacct

SEQ ID NO: 6879585 - DNA, 15 bp, Homo sapiens
cactatggtgccaat

SEQ ID NO: 6879586 - DNA, 13 bp, Homo sapiens
agctcactgtgac

SEQ ID NO: 6879587 - DNA, 20 bp, Homo sapiens
cttaagcgattctcatgcct

SEQ ID NO: 6879588 - DNA, 21 bp, Homo sapiens
aggatcctgagccagatttca

SEQ ID NO: 6879589 - DNA, 16 bp, Homo sapiens
ccagtttatgtttgtg

SEQ ID NO: 6879590 - DNA, 19 bp, Homo sapiens
actggcatgtcatttgcac

SEQ ID NO: 6879591 - DNA, 12 bp, Homo sapiens
caatgtctccca

SEQ ID NO: 6879592 - DNA, 18 bp, Homo sapiens
ttcagatgtcttctgcct

SEQ ID NO: 6879593 - DNA, 16 bp, Homo sapiens
cacagcagcccctgca

SEQ ID NO: 6879594 - DNA, 12 bp, Homo sapiens
cttcctacctct

SEQ ID NO: 6879595 - DNA, 14 bp, Homo sapiens
ccttactggcactg

SEQ ID NO: 6879596 - DNA, 17 bp, Homo sapiens
tggtgtgccctgtgtgt

SEQ ID NO: 6879597 - DNA, 20 bp, Homo sapiens
tacatttttgtggttttgag

SEQ ID NO: 6879598 - DNA, 16 bp, Homo sapiens
ctccacgttctgctca

SEQ ID NO: 6879599 - DNA, 18 bp, Homo sapiens
cttccagaccacctgcca

SEQ ID NO: 6879600 - DNA, 23 bp, Homo sapiens
aatgatgtatgttgaagcctttg

SEQ ID NO: 6879601 - DNA, 18 bp, Homo sapiens
agcttcagagcctagcca

SEQ ID NO: 6879602 - DNA, 23 bp, Homo sapiens
atatttatactctagaacatgca

SEQ ID NO: 6879603 - DNA, 12 bp, Homo sapiens
cactctgcctct

SEQ ID NO: 6879604 - DNA, 13 bp, Homo sapiens
cctcagccctgct

SEQ ID NO: 6879605 - DNA, 22 bp, Homo sapiens
catttatttattcatgtgtaca

SEQ ID NO: 6879606 - DNA, 16 bp, Homo sapiens
ctcacagcctctgacc

SEQ ID NO: 6879607 - DNA, 18 bp, Homo sapiens
aacatccttaaatgtcta

SEQ ID NO: 6879608 - DNA, 16 bp, Homo sapiens
ccagtccaccctgcct

SEQ ID NO: 6879609 - DNA, 13 bp, Homo sapiens
cctctccccaccc

SEQ ID NO: 6879610 - DNA, 16 bp, Homo sapiens
cttgggggtctgctct

SEQ ID NO: 6879611 - DNA, 18 bp, Homo sapiens
ctgccaccaaatctgtct

SEQ ID NO: 6879612 - DNA, 19 bp, Homo sapiens
tgatccacccacctcggcc

SEQ ID NO: 6879613 - DNA, 14 bp, Homo sapiens
caacactaacatga

SEQ ID NO: 6879614 - DNA, 15 bp, Homo sapiens
tggccgccccctgcc

SEQ ID NO: 6879615 - DNA, 15 bp, Homo sapiens
acattcaatgaatta

SEQ ID NO: 6879616 - DNA, 11 bp, Homo sapiens
tggcctctgcc

SEQ ID NO: 6879617 - DNA, 19 bp, Homo sapiens
taggctcagagatgtgcac

SEQ ID NO: 6879618 - DNA, 16 bp, Homo sapiens
ctctcgtttctgccca

SEQ ID NO: 6879619 - DNA, 20 bp, Homo sapiens
ccctgcacacacctgcacac

SEQ ID NO: 6879620 - DNA, 19 bp, Homo sapiens
ctggtttgccggtggtgca

SEQ ID NO: 6879621 - DNA, 21 bp, Homo sapiens
aggttccccaagggccctggc

SEQ ID NO: 6879622 - DNA, 21 bp, Homo sapiens
ctcccacgccctcctccctcc

SEQ ID NO: 6879623 - DNA, 20 bp, Homo sapiens
agctcttggtgggcccaggg

SEQ ID NO: 6879624 - DNA, 17 bp, Homo sapiens
ccacatcttgctctgct

SEQ ID NO: 6879625 - DNA, 16 bp, Homo sapiens
cagagtgcacagctgt

SEQ ID NO: 6879626 - DNA, 15 bp, Homo sapiens
cagcgtcctcagcac

SEQ ID NO: 6879627 - DNA, 16 bp, Homo sapiens
gcctcattgtgccaag

SEQ ID NO: 6879628 - DNA, 12 bp, Homo sapiens
ttggtcttgccc

SEQ ID NO: 6879629 - DNA, 17 bp, Homo sapiens
gtcattctttattcttt

SEQ ID NO: 6879630 - DNA, 22 bp, Homo sapiens
agtgttgtgggcttcctgctgg

SEQ ID NO: 6879631 - DNA, 15 bp, Homo sapiens
atggcatcctgtgaa

SEQ ID NO: 6879632 - DNA, 20 bp, Homo sapiens
cttccaccctgccctggcct

SEQ ID NO: 6879633 - DNA, 20 bp, Homo sapiens
ccctgtccggcccagtgcca

SEQ ID NO: 6879634 - DNA, 19 bp, Homo sapiens
acacttgagatgatttcca

SEQ ID NO: 6879635 - DNA, 14 bp, Homo sapiens
ttaatgcctgccca

SEQ ID NO: 6879636 - DNA, 17 bp, Homo sapiens
gatagatgctggcccag

SEQ ID NO: 6879637 - DNA, 17 bp, Homo sapiens
agtctccggcctctcca

SEQ ID NO: 6879638 - DNA, 22 bp, Homo sapiens
tacttgagaataaatgagcatt

SEQ ID NO: 6879639 - DNA, 20 bp, Homo sapiens
ctacgtgtgaaatctgtctt

SEQ ID NO: 6879640 - DNA, 19 bp, Homo sapiens
tgtttgagacagggtctca

SEQ ID NO: 6879641 - DNA, 15 bp, Homo sapiens
aagagctccttgatg

SEQ ID NO: 6879642 - DNA, 19 bp, Homo sapiens
tccttttcttttgttactg

SEQ ID NO: 6879643 - DNA, 20 bp, Homo sapiens
ccagtgtcatttctcatcca

SEQ ID NO: 6879644 - DNA, 21 bp, Homo sapiens
ccagtgggatgggctctacct

SEQ ID NO: 6879645 - DNA, 15 bp, Homo sapiens
ctccaggcaccgcct

SEQ ID NO: 6879646 - DNA, 21 bp, Homo sapiens
gttctagcagtccccagctga

SEQ ID NO: 6879647 - DNA, 18 bp, Homo sapiens
cccggccactccctgcca

SEQ ID NO: 6879648 - DNA, 14 bp, Homo sapiens
cccatccccctgcc

SEQ ID NO: 6879649 - DNA, 17 bp, Homo sapiens
catatttacctcagcct

SEQ ID NO: 6879650 - DNA, 22 bp, Homo sapiens
gacactgccttagcctcttgga

SEQ ID NO: 6879651 - DNA, 14 bp, Homo sapiens
aatacttattttca

SEQ ID NO: 6879652 - DNA, 22 bp, Homo sapiens
atgcctcctcctgccctccgcc

SEQ ID NO: 6879653 - DNA, 20 bp, Homo sapiens
tcctacctggggactcctca

SEQ ID NO: 6879654 - DNA, 18 bp, Homo sapiens
ccttccccaggcccacca

SEQ ID NO: 6879655 - DNA, 17 bp, Homo sapiens
attgaattggaaagact

SEQ ID NO: 6879656 - DNA, 12 bp, Homo sapiens
caagctgtgcca

SEQ ID NO: 6879657 - DNA, 18 bp, Homo sapiens
actgtggcccttctgtcc

SEQ ID NO: 6879658 - DNA, 19 bp, Homo sapiens
tggtacccagccatctgcc

SEQ ID NO: 6879659 - DNA, 17 bp, Homo sapiens
cacgattgacctgtcct

SEQ ID NO: 6879660 - DNA, 21 bp, Homo sapiens
cctcaccctgagccccttcct

SEQ ID NO: 6879661 - DNA, 16 bp, Homo sapiens
tcggccagagctccca

SEQ ID NO: 6879662 - DNA, 13 bp, Homo sapiens
catgtccccttcc

SEQ ID NO: 6879663 - DNA, 20 bp, Homo sapiens
cattgaccagctctcttcct

SEQ ID NO: 6879664 - DNA, 16 bp, Homo sapiens
cctgcactgtcctgct

SEQ ID NO: 6879665 - DNA, 19 bp, Homo sapiens
ctcccaactcccttctgct

SEQ ID NO: 6879666 - DNA, 19 bp, Homo sapiens
ggtgccaaccacctctggc

SEQ ID NO: 6879667 - DNA, 20 bp, Homo sapiens
tacctgaaaacactgtgcac

SEQ ID NO: 6879668 - DNA, 19 bp, Homo sapiens
actaagtgatgctgtgata

SEQ ID NO: 6879669 - DNA, 15 bp, Homo sapiens
cctctggctttccca

SEQ ID NO: 6879670 - DNA, 22 bp, Homo sapiens
accttccttcaactgctctgca

SEQ ID NO: 6879671 - DNA, 16 bp, Homo sapiens
tccctctgcctcatcc

SEQ ID NO: 6879672 - DNA, 18 bp, Homo sapiens
tgggaacccgactgtgaa

SEQ ID NO: 6879673 - DNA, 17 bp, Homo sapiens
ggtttggacacagtgtt

SEQ ID NO: 6879674 - DNA, 20 bp, Homo sapiens
tccatgtgtcccccctgtgg

SEQ ID NO: 6879675 - DNA, 19 bp, Homo sapiens
gctgcccaggctctgctga

SEQ ID NO: 6879676 - DNA, 23 bp, Homo sapiens
tgttcccagcccctcctccctca

SEQ ID NO: 6879677 - DNA, 14 bp, Homo sapiens
tcccattgtattta

SEQ ID NO: 6879678 - DNA, 14 bp, Homo sapiens
gcatagagcaatta

SEQ ID NO: 6879679 - DNA, 22 bp, Homo sapiens
ccctacacacacactccctgct

SEQ ID NO: 6879680 - DNA, 16 bp, Homo sapiens
cataccccactgggca

SEQ ID NO: 6879681 - DNA, 15 bp, Homo sapiens
actcagaactgtccc

SEQ ID NO: 6879682 - DNA, 18 bp, Homo sapiens
ctcgcattttctctagct

SEQ ID NO: 6879683 - DNA, 17 bp, Homo sapiens
cacattgaaactgtatt

SEQ ID NO: 6879684 - DNA, 20 bp, Homo sapiens
cttgctggagtcatgtgcct

SEQ ID NO: 6879685 - DNA, 17 bp, Homo sapiens
tctagtcagtatctgta

SEQ ID NO: 6879686 - DNA, 14 bp, Homo sapiens
ccttctcccctcca

SEQ ID NO: 6879687 - DNA, 13 bp, Homo sapiens
ccttctcctgcct

SEQ ID NO: 6879688 - DNA, 17 bp, Homo sapiens
gtagctccctcctccca

SEQ ID NO: 6879689 - DNA, 15 bp, Homo sapiens
ccatttctctctcca

SEQ ID NO: 6879690 - DNA, 16 bp, Homo sapiens
cctcttaacctcttct

SEQ ID NO: 6879691 - DNA, 12 bp, Homo sapiens
ctgagagccagg

SEQ ID NO: 6879692 - DNA, 22 bp, Homo sapiens
catgcctgggaatcctgctgcc

SEQ ID NO: 6879693 - DNA, 13 bp, Homo sapiens
ctcagcagctctg

SEQ ID NO: 6879694 - DNA, 13 bp, Homo sapiens
tgttgcagtgtag

SEQ ID NO: 6879695 - DNA, 22 bp, Homo sapiens
cagattcaggccagcccagcca

SEQ ID NO: 6879696 - DNA, 21 bp, Homo sapiens
tcctaccttggtcctgcctct

SEQ ID NO: 6879697 - DNA, 16 bp, Homo sapiens
ctactaggtctgctcc

SEQ ID NO: 6879698 - DNA, 18 bp, Homo sapiens
caggatctgtctgtgcac

SEQ ID NO: 6879699 - DNA, 20 bp, Homo sapiens
ttcaagtttttcatactgta

SEQ ID NO: 6879700 - DNA, 20 bp, Homo sapiens
tgccaggcacctggcctgct

SEQ ID NO: 6879701 - DNA, 23 bp, Homo sapiens
gcttcactgaccagcggctgctc

SEQ ID NO: 6879702 - DNA, 15 bp, Homo sapiens
ctcatcccccctgct

SEQ ID NO: 6879703 - DNA, 19 bp, Homo sapiens
acctctgcttttatctcag

SEQ ID NO: 6879704 - DNA, 13 bp, Homo sapiens
ccactctacctcc

SEQ ID NO: 6879705 - DNA, 23 bp, Homo sapiens
aaccccagctgccggcagtgctg

SEQ ID NO: 6879706 - DNA, 17 bp, Homo sapiens
ggttccgtgtccacccc

SEQ ID NO: 6879707 - DNA, 16 bp, Homo sapiens
ccagtctgtgtttaca

SEQ ID NO: 6879708 - DNA, 13 bp, Homo sapiens
ctcagtacagggc

SEQ ID NO: 6879709 - DNA, 19 bp, Homo sapiens
tgttccttcgagggttcca

SEQ ID NO: 6879710 - DNA, 21 bp, Homo sapiens
agctcaggctgagcccagcca

SEQ ID NO: 6879711 - DNA, 19 bp, Homo sapiens
tggcctatgaccctgtgcc

SEQ ID NO: 6879712 - DNA, 20 bp, Homo sapiens
cctgatcccagacccattcc

SEQ ID NO: 6879713 - DNA, 18 bp, Homo sapiens
cctgtcccttgcctctgc

SEQ ID NO: 6879714 - DNA, 13 bp, Homo sapiens
ctgcctgagattc

SEQ ID NO: 6879715 - DNA, 17 bp, Homo sapiens
aaacgtatgcatgtgaa

SEQ ID NO: 6879716 - DNA, 16 bp, Homo sapiens
aggcggctcctcctca

SEQ ID NO: 6879717 - DNA, 19 bp, Homo sapiens
gcttttctggggcccagga

SEQ ID NO: 6879718 - DNA, 21 bp, Homo sapiens
ccttcctcatccaccccatcc

SEQ ID NO: 6879719 - DNA, 17 bp, Homo sapiens
caagagcttaacagtgt

SEQ ID NO: 6879720 - DNA, 11 bp, Homo sapiens
cttgctgtgtg

SEQ ID NO: 6879721 - DNA, 20 bp, Homo sapiens
tacagtaactttatgtgtaa

SEQ ID NO: 6879722 - DNA, 19 bp, Homo sapiens
atctataaaactttctgta

SEQ ID NO: 6879723 - DNA, 16 bp, Homo sapiens
agagcagcgcccaggc

SEQ ID NO: 6879724 - DNA, 20 bp, Homo sapiens
ccagtggtcatgctcagcct

SEQ ID NO: 6879725 - DNA, 22 bp, Homo sapiens
cttctgagcagcgagcctgcta

SEQ ID NO: 6879726 - DNA, 18 bp, Homo sapiens
tccctgtaatgcactcct

SEQ ID NO: 6879727 - DNA, 17 bp, Homo sapiens
gattattgtctgattga

SEQ ID NO: 6879728 - DNA, 15 bp, Homo sapiens
cctcccctcctctcc

SEQ ID NO: 6879729 - DNA, 17 bp, Homo sapiens
aagctgaacactgaagt

SEQ ID NO: 6879730 - DNA, 23 bp, Homo sapiens
ataatttttaaagtatatattta

SEQ ID NO: 6879731 - DNA, 13 bp, Homo sapiens
atgcccctggccc

SEQ ID NO: 6879732 - DNA, 15 bp, Homo sapiens
cctccattcccaccc

SEQ ID NO: 6879733 - DNA, 20 bp, Homo sapiens
cctcccgagctcctcttcca

SEQ ID NO: 6879734 - DNA, 17 bp, Homo sapiens
cccttgcaccccttcct

SEQ ID NO: 6879735 - DNA, 21 bp, Homo sapiens
ctacctacgtttgcaccgcct

SEQ ID NO: 6879736 - DNA, 13 bp, Homo sapiens
ccacatctgtcct

SEQ ID NO: 6879737 - DNA, 19 bp, Homo sapiens
ctctttccccacctcttcc

SEQ ID NO: 6879738 - DNA, 23 bp, Homo sapiens
cctccccgcagagctcccttcct

SEQ ID NO: 6879739 - DNA, 22 bp, Homo sapiens
gcccaccccgcctctgggctca

SEQ ID NO: 6879740 - DNA, 19 bp, Homo sapiens
agccaggaatttcccagga

SEQ ID NO: 6879741 - DNA, 15 bp, Homo sapiens
atctgcctgtggcct

SEQ ID NO: 6879742 - DNA, 13 bp, Homo sapiens
agaaagagacaca

SEQ ID NO: 6879743 - DNA, 13 bp, Homo sapiens
caatggatatttg

SEQ ID NO: 6879744 - DNA, 21 bp, Homo sapiens
ttcttacccagattgtgtaca

SEQ ID NO: 6879745 - DNA, 14 bp, Homo sapiens
ttcatctattcttt

SEQ ID NO: 6879746 - DNA, 14 bp, Homo sapiens
acagttgttactta

SEQ ID NO: 6879747 - DNA, 19 bp, Homo sapiens
tctttctgtcccctcttcc

SEQ ID NO: 6879748 - DNA, 22 bp, Homo sapiens
ccaaaaaaggacgtaaaattta

SEQ ID NO: 6879749 - DNA, 17 bp, Homo sapiens
taatgagagtgcactgc

SEQ ID NO: 6879750 - DNA, 14 bp, Homo sapiens
tagccactgctggt

SEQ ID NO: 6879751 - DNA, 13 bp, Homo sapiens
ctttcagctcctg

SEQ ID NO: 6879752 - DNA, 15 bp, Homo sapiens
gatttcagtagtttc

SEQ ID NO: 6879753 - DNA, 23 bp, Homo sapiens
cctctcgctcctcaacccctccc

SEQ ID NO: 6879754 - DNA, 23 bp, Homo sapiens
cctgacccggattggccctgccc

SEQ ID NO: 6879755 - DNA, 15 bp, Homo sapiens
ttaagaagacatgac

SEQ ID NO: 6879756 - DNA, 11 bp, Homo sapiens
aagaccaaaga

SEQ ID NO: 6879757 - DNA, 17 bp, Homo sapiens
caaggacaaagtctcca

SEQ ID NO: 6879758 - DNA, 22 bp, Homo sapiens
aatttgtatctgaaggagattt

SEQ ID NO: 6879759 - DNA, 20 bp, Homo sapiens
catccgcagactgcttggcc

SEQ ID NO: 6879760 - DNA, 12 bp, Homo sapiens
aggcaggggagt

SEQ ID NO: 6879761 - DNA, 19 bp, Homo sapiens
cagcctgggcaatgtgata

SEQ ID NO: 6879762 - DNA, 19 bp, Homo sapiens
cagtccccagaactctgcc

SEQ ID NO: 6879763 - DNA, 22 bp, Homo sapiens
ccctcccagacaggccctccct

SEQ ID NO: 6879764 - DNA, 13 bp, Homo sapiens
ccaacctcctgct

SEQ ID NO: 6879765 - DNA, 18 bp, Homo sapiens
attgatgaaaagatttaa

SEQ ID NO: 6879766 - DNA, 23 bp, Homo sapiens
ccggtcccttgagacctcagcca

SEQ ID NO: 6879767 - DNA, 23 bp, Homo sapiens
ccttgctttggggggtgtgctga

SEQ ID NO: 6879768 - DNA, 16 bp, Homo sapiens
aggtacgcacagacag

SEQ ID NO: 6879769 - DNA, 13 bp, Homo sapiens
tgtttacatggcg

SEQ ID NO: 6879770 - DNA, 11 bp, Homo sapiens
tgaatttgcat

SEQ ID NO: 6879771 - DNA, 17 bp, Homo sapiens
taatgattcaatgtgaa

SEQ ID NO: 6879772 - DNA, 14 bp, Homo sapiens
ccactgagctggct

SEQ ID NO: 6879773 - DNA, 13 bp, Homo sapiens
gaccactcagccc

SEQ ID NO: 6879774 - DNA, 18 bp, Homo sapiens
tcatgcttgacataccta

SEQ ID NO: 6879775 - DNA, 16 bp, Homo sapiens
attctgttagctgctc

SEQ ID NO: 6879776 - DNA, 21 bp, Homo sapiens
tagtctacttcttaaaattca

SEQ ID NO: 6879777 - DNA, 20 bp, Homo sapiens
gcatccacccagtgctgcca

SEQ ID NO: 6879778 - DNA, 14 bp, Homo sapiens
aggaaatattcttt

SEQ ID NO: 6879779 - DNA, 17 bp, Homo sapiens
cacaagctccctggtga

SEQ ID NO: 6879780 - DNA, 16 bp, Homo sapiens
tctcatgtgctttgta

SEQ ID NO: 6879781 - DNA, 21 bp, Homo sapiens
ctgcagagagcacctggtggg

SEQ ID NO: 6879782 - DNA, 17 bp, Homo sapiens
gaatgtattattctgca

SEQ ID NO: 6879783 - DNA, 23 bp, Homo sapiens
tttccccattgaccctcacctga

SEQ ID NO: 6879784 - DNA, 16 bp, Homo sapiens
ataaatcacacattca

SEQ ID NO: 6879785 - DNA, 23 bp, Homo sapiens
cttccctctcgctcccctctgcc

SEQ ID NO: 6879786 - DNA, 15 bp, Homo sapiens
ccgtccacccttcca

SEQ ID NO: 6879787 - DNA, 20 bp, Homo sapiens
aatttttgagtagcatatta

SEQ ID NO: 6879788 - DNA, 18 bp, Homo sapiens
agaggatgagagcccaga

SEQ ID NO: 6879789 - DNA, 15 bp, Homo sapiens
ccccaagcctctgcc

SEQ ID NO: 6879790 - DNA, 16 bp, Homo sapiens
ctattaaagatatttc

SEQ ID NO: 6879791 - DNA, 13 bp, Homo sapiens
ggctccccttgcc

SEQ ID NO: 6879792 - DNA, 20 bp, Homo sapiens
gacttggagaatactgccaa

SEQ ID NO: 6879793 - DNA, 23 bp, Homo sapiens
cccatctcccaccctgtacctca

SEQ ID NO: 6879794 - DNA, 20 bp, Homo sapiens
cactgcattcattctgagcc

SEQ ID NO: 6879795 - DNA, 16 bp, Homo sapiens
caagctcctcctccct

SEQ ID NO: 6879796 - DNA, 18 bp, Homo sapiens
cccttgaaccccctccct

SEQ ID NO: 6879797 - DNA, 16 bp, Homo sapiens
cactccaaccctgccc

SEQ ID NO: 6879798 - DNA, 17 bp, Homo sapiens
cattcccctcccacctc

SEQ ID NO: 6879799 - DNA, 18 bp, Homo sapiens
cctccagctccctgtgcc

SEQ ID NO: 6879800 - DNA, 18 bp, Homo sapiens
cagaaggctggggccagt

SEQ ID NO: 6879801 - DNA, 12 bp, Homo sapiens
cactctacctcc

SEQ ID NO: 6879802 - DNA, 16 bp, Homo sapiens
tttccttttctctgcc

SEQ ID NO: 6879803 - DNA, 15 bp, Homo sapiens
agctcatccctctca

SEQ ID NO: 6879804 - DNA, 20 bp, Homo sapiens
cgcctgatggtgctgctcag

SEQ ID NO: 6879805 - DNA, 17 bp, Homo sapiens
agtgttgaaaatgttca

SEQ ID NO: 6879806 - DNA, 20 bp, Homo sapiens
tcccaccctgtacctcatcc

SEQ ID NO: 6879807 - DNA, 23 bp, Homo sapiens
acttcaagtgcatgctctctgca

SEQ ID NO: 6879808 - DNA, 20 bp, Homo sapiens
ttctacacattgctacctca

SEQ ID NO: 6879809 - DNA, 18 bp, Homo sapiens
cccaggcggtcactgccc

SEQ ID NO: 6879810 - DNA, 20 bp, Homo sapiens
ccctgcttcatatctctccc

SEQ ID NO: 6879811 - DNA, 19 bp, Homo sapiens
attgaaatcagcatgacaa

SEQ ID NO: 6879812 - DNA, 16 bp, Homo sapiens
gcttagacctcagcct

SEQ ID NO: 6879813 - DNA, 21 bp, Homo sapiens
tatttatgaagaaaatactta

SEQ ID NO: 6879814 - DNA, 12 bp, Homo sapiens
gattttgcacaa

SEQ ID NO: 6879815 - DNA, 22 bp, Homo sapiens
ttaatctctgttatgtactgta

SEQ ID NO: 6879816 - DNA, 23 bp, Homo sapiens
tgttctaactagtaatcttggcc

SEQ ID NO: 6879817 - DNA, 15 bp, Homo sapiens
ctctagcctctttct

SEQ ID NO: 6879818 - DNA, 23 bp, Homo sapiens
acaagttagaaaattcagctcct

SEQ ID NO: 6879819 - DNA, 17 bp, Homo sapiens
tacctggggactcctca

SEQ ID NO: 6879820 - DNA, 17 bp, Homo sapiens
cctccctgatcccaccc

SEQ ID NO: 6879821 - DNA, 17 bp, Homo sapiens
cagaatggaatgctctg

SEQ ID NO: 6879822 - DNA, 22 bp, Homo sapiens
tcccactccctttccaacctca

SEQ ID NO: 6879823 - DNA, 15 bp, Homo sapiens
cttccacctcagcct

SEQ ID NO: 6879824 - DNA, 22 bp, Homo sapiens
atcccaaaggatgagaatgtga

SEQ ID NO: 6879825 - DNA, 15 bp, Homo sapiens
gtccactgttgagcc

SEQ ID NO: 6879826 - DNA, 21 bp, Homo sapiens
atatgttcacacctagcgtca

SEQ ID NO: 6879827 - DNA, 20 bp, Homo sapiens
ccctgtcccctcccccttcc

SEQ ID NO: 6879828 - DNA, 14 bp, Homo sapiens
ccagcctcagtgcc

SEQ ID NO: 6879829 - DNA, 14 bp, Homo sapiens
agtttgtaggtaaa

SEQ ID NO: 6879830 - DNA, 15 bp, Homo sapiens
aggacacgaaggctg

SEQ ID NO: 6879831 - DNA, 20 bp, Homo sapiens
ctacacagtgggaactctga

SEQ ID NO: 6879832 - DNA, 19 bp, Homo sapiens
tcagttggttgtgtctttt

SEQ ID NO: 6879833 - DNA, 13 bp, Homo sapiens
gctacagcaaata

SEQ ID NO: 6879834 - DNA, 16 bp, Homo sapiens
cctggccctgcttcct

SEQ ID NO: 6879835 - DNA, 15 bp, Homo sapiens
ccctctgctctgcct

SEQ ID NO: 6879836 - DNA, 21 bp, Homo sapiens
cctcccatggccttccctccc

SEQ ID NO: 6879837 - DNA, 12 bp, Homo sapiens
tgcccctctgcc

SEQ ID NO: 6879838 - DNA, 21 bp, Homo sapiens
agttgccaccacctctgtggc

SEQ ID NO: 6879839 - DNA, 12 bp, Homo sapiens
gtctctgctgcc

SEQ ID NO: 6879840 - DNA, 20 bp, Homo sapiens
aaattctgaatttgcaaagt

SEQ ID NO: 6879841 - DNA, 15 bp, Homo sapiens
gtgttgcctcctccc

SEQ ID NO: 6879842 - DNA, 17 bp, Homo sapiens
agggtctcccctcctgc

SEQ ID NO: 6879843 - DNA, 14 bp, Homo sapiens
cacaaactacctct

SEQ ID NO: 6879844 - DNA, 19 bp, Homo sapiens
gcaacactccggtcagccc

SEQ ID NO: 6879845 - DNA, 23 bp, Homo sapiens
gctttataaaaaaaagttgttta

SEQ ID NO: 6879846 - DNA, 19 bp, Homo sapiens
taaaacaagaaagtttccc

SEQ ID NO: 6879847 - DNA, 18 bp, Homo sapiens
catagctcttcacttcct

SEQ ID NO: 6879848 - DNA, 17 bp, Homo sapiens
gccacggccaggccaga

SEQ ID NO: 6879849 - DNA, 14 bp, Homo sapiens
actctcctgcctca

SEQ ID NO: 6879850 - DNA, 15 bp, Homo sapiens
ctctgcaatgcttct

SEQ ID NO: 6879851 - DNA, 12 bp, Homo sapiens
aatttgctgctg

SEQ ID NO: 6879852 - DNA, 15 bp, Homo sapiens
agcctgatgtttaca

SEQ ID NO: 6879853 - DNA, 15 bp, Homo sapiens
taagcaaaatgtgat

SEQ ID NO: 6879854 - DNA, 19 bp, Homo sapiens
ccatccctggccccctccc

SEQ ID NO: 6879855 - DNA, 21 bp, Homo sapiens
taaaggtctgcactcctttat

SEQ ID NO: 6879856 - DNA, 19 bp, Homo sapiens
tagttttctagatgacata

SEQ ID NO: 6879857 - DNA, 17 bp, Homo sapiens
cagctgggcctcctgcc

SEQ ID NO: 6879858 - DNA, 18 bp, Homo sapiens
gaaaaaatgttggattta

SEQ ID NO: 6879859 - DNA, 21 bp, Homo sapiens
cccttgggcagagtcctgcct

SEQ ID NO: 6879860 - DNA, 22 bp, Homo sapiens
attgtttaaaaatcttaatgta

SEQ ID NO: 6879861 - DNA, 23 bp, Homo sapiens
tccaggggtgggacaccctgtga

SEQ ID NO: 6879862 - DNA, 21 bp, Homo sapiens
tgggtggaaaacagggtgcta

SEQ ID NO: 6879863 - DNA, 22 bp, Homo sapiens
taaaagtcacaatgttctttat

SEQ ID NO: 6879864 - DNA, 13 bp, Homo sapiens
cctggcctctgcc

SEQ ID NO: 6879865 - DNA, 12 bp, Homo sapiens
ccgttgtttact

SEQ ID NO: 6879866 - DNA, 13 bp, Homo sapiens
agaaaactgtgat

SEQ ID NO: 6879867 - DNA, 18 bp, Homo sapiens
cgaaacccttgactgtta

SEQ ID NO: 6879868 - DNA, 23 bp, Homo sapiens
ttctggttttctagcccctctgg

SEQ ID NO: 6879869 - DNA, 20 bp, Homo sapiens
aggccgaggaccaccagcag

SEQ ID NO: 6879870 - DNA, 14 bp, Homo sapiens
acattttgtttcca

SEQ ID NO: 6879871 - DNA, 22 bp, Homo sapiens
agcagttggggccctcttgcca

SEQ ID NO: 6879872 - DNA, 21 bp, Homo sapiens
tgatggatttaacagcatgac

SEQ ID NO: 6879873 - DNA, 20 bp, Homo sapiens
caccgcaggggactgtctca

SEQ ID NO: 6879874 - DNA, 21 bp, Homo sapiens
ctcctgggaaacctgcctttg

SEQ ID NO: 6879875 - DNA, 14 bp, Homo sapiens
aatgaatctttgac

SEQ ID NO: 6879876 - DNA, 14 bp, Homo sapiens
acgtttaaagtgta

SEQ ID NO: 6879877 - DNA, 15 bp, Homo sapiens
atttttttaactgtg

SEQ ID NO: 6879878 - DNA, 17 bp, Homo sapiens
aatggtttggtgctttt

SEQ ID NO: 6879879 - DNA, 19 bp, Homo sapiens
ttctctgctgcctctgtgg

SEQ ID NO: 6879880 - DNA, 15 bp, Homo sapiens
tttcaatgtactgta

SEQ ID NO: 6879881 - DNA, 17 bp, Homo sapiens
catttgcaccctccgcc

SEQ ID NO: 6879882 - DNA, 15 bp, Homo sapiens
agagggacctctccc

SEQ ID NO: 6879883 - DNA, 14 bp, Homo sapiens
atactctgttgcct

SEQ ID NO: 6879884 - DNA, 17 bp, Homo sapiens
agaccatataactgtga

SEQ ID NO: 6879885 - DNA, 19 bp, Homo sapiens
ggaaacggtttttttcttt

SEQ ID NO: 6879886 - DNA, 13 bp, Homo sapiens
acccgcctctccc

SEQ ID NO: 6879887 - DNA, 18 bp, Homo sapiens
ctagtggggtctccctct

SEQ ID NO: 6879888 - DNA, 15 bp, Homo sapiens
ccagtccccagccct

SEQ ID NO: 6879889 - DNA, 14 bp, Homo sapiens
atgaaatctttctt

SEQ ID NO: 6879890 - DNA, 22 bp, Homo sapiens
cactgtccgctgtctccctcct

SEQ ID NO: 6879891 - DNA, 15 bp, Homo sapiens
accacctgcttctga

SEQ ID NO: 6879892 - DNA, 20 bp, Homo sapiens
ccactattatagaaattctg

SEQ ID NO: 6879893 - DNA, 21 bp, Homo sapiens
ccatgcccacctgcccatcac

SEQ ID NO: 6879894 - DNA, 14 bp, Homo sapiens
tgggctcctctgca

SEQ ID NO: 6879895 - DNA, 14 bp, Homo sapiens
cttccccactgcct

SEQ ID NO: 6879896 - DNA, 17 bp, Homo sapiens
cctggctgacctgctgt

SEQ ID NO: 6879897 - DNA, 19 bp, Homo sapiens
agaatcagtaggaccaggc

SEQ ID NO: 6879898 - DNA, 18 bp, Homo sapiens
taaagccagtcatcatct

SEQ ID NO: 6879899 - DNA, 20 bp, Homo sapiens
gctcctacatccagctcctc

SEQ ID NO: 6879900 - DNA, 14 bp, Homo sapiens
atttacctcagcct

SEQ ID NO: 6879901 - DNA, 18 bp, Homo sapiens
gcataacaaattctgaat

SEQ ID NO: 6879902 - DNA, 16 bp, Homo sapiens
gcctcgtgtcctgcta

SEQ ID NO: 6879903 - DNA, 19 bp, Homo sapiens
aactctctgtcttctctcc

SEQ ID NO: 6879904 - DNA, 22 bp, Homo sapiens
ttttctcgtccccctccctgcc

SEQ ID NO: 6879905 - DNA, 16 bp, Homo sapiens
gactgggacagcccag

SEQ ID NO: 6879906 - DNA, 20 bp, Homo sapiens
ccctcagtctggcccttcct

SEQ ID NO: 6879907 - DNA, 23 bp, Homo sapiens
gtggacaccattaacaggtcttt

SEQ ID NO: 6879908 - DNA, 16 bp, Homo sapiens
ctgtgtgtctggtggg

SEQ ID NO: 6879909 - DNA, 12 bp, Homo sapiens
aagtgtacaatt

SEQ ID NO: 6879910 - DNA, 15 bp, Homo sapiens
tgtattattgctgtt

SEQ ID NO: 6879911 - DNA, 13 bp, Homo sapiens
cactgccatgtca

SEQ ID NO: 6879912 - DNA, 13 bp, Homo sapiens
atggagaaagctg

SEQ ID NO: 6879913 - DNA, 13 bp, Homo sapiens
aagcactgtgcta

SEQ ID NO: 6879914 - DNA, 21 bp, Homo sapiens
cccagggtagcccgcctgcca

SEQ ID NO: 6879915 - DNA, 19 bp, Homo sapiens
ccaggctggcgcagccaag

SEQ ID NO: 6879916 - DNA, 18 bp, Homo sapiens
ccagtccggtgccttcca

SEQ ID NO: 6879917 - DNA, 15 bp, Homo sapiens
tggtgtcactctgcc

SEQ ID NO: 6879918 - DNA, 16 bp, Homo sapiens
ccttgcttttgcttct

SEQ ID NO: 6879919 - DNA, 17 bp, Homo sapiens
tcattgcctcctgttct

SEQ ID NO: 6879920 - DNA, 19 bp, Homo sapiens
atcctgcccaaaatgtgaa

SEQ ID NO: 6879921 - DNA, 19 bp, Homo sapiens
atcgtgccattacactcca

SEQ ID NO: 6879922 - DNA, 12 bp, Homo sapiens
aatcagccttta

SEQ ID NO: 6879923 - DNA, 22 bp, Homo sapiens
tcgtggtgatcaattaaatgta

SEQ ID NO: 6879924 - DNA, 15 bp, Homo sapiens
atcctttccctctcc

SEQ ID NO: 6879925 - DNA, 23 bp, Homo sapiens
ccaagggacagcccacggtctgg

SEQ ID NO: 6879926 - DNA, 21 bp, Homo sapiens
aacatcatcaaggcactgcct

SEQ ID NO: 6879927 - DNA, 17 bp, Homo sapiens
tccaccttggctctgcc

SEQ ID NO: 6879928 - DNA, 13 bp, Homo sapiens
ctgttttcccccc

SEQ ID NO: 6879929 - DNA, 16 bp, Homo sapiens
atgggggtgcatttga

SEQ ID NO: 6879930 - DNA, 15 bp, Homo sapiens
gacagcttctctgca

SEQ ID NO: 6879931 - DNA, 17 bp, Homo sapiens
aacccagtcactgtgag

SEQ ID NO: 6879932 - DNA, 15 bp, Homo sapiens
tcattccattgccta

SEQ ID NO: 6879933 - DNA, 20 bp, Homo sapiens
atactattaaacatgctgta

SEQ ID NO: 6879934 - DNA, 16 bp, Homo sapiens
ctccctgccctgtcct

SEQ ID NO: 6879935 - DNA, 20 bp, Homo sapiens
tgctgagtcatgtctttcct

SEQ ID NO: 6879936 - DNA, 21 bp, Homo sapiens
agattccagaacgccctgtgt

SEQ ID NO: 6879937 - DNA, 22 bp, Homo sapiens
acttatttagtattctgcctca

SEQ ID NO: 6879938 - DNA, 16 bp, Homo sapiens
gccaatggtgcttccc

SEQ ID NO: 6879939 - DNA, 19 bp, Homo sapiens
cttcccctttactcagccc

SEQ ID NO: 6879940 - DNA, 17 bp, Homo sapiens
attcctaaaactctgcc

SEQ ID NO: 6879941 - DNA, 16 bp, Homo sapiens
tcaagcgattcttctg

SEQ ID NO: 6879942 - DNA, 14 bp, Homo sapiens
actacctctgtgcc

SEQ ID NO: 6879943 - DNA, 15 bp, Homo sapiens
ctctgggtccttcct

SEQ ID NO: 6879944 - DNA, 14 bp, Homo sapiens
catcccctgcctcc

SEQ ID NO: 6879945 - DNA, 13 bp, Homo sapiens
atcttttactgtg

SEQ ID NO: 6879946 - DNA, 15 bp, Homo sapiens
aatattaaagccatg

SEQ ID NO: 6879947 - DNA, 16 bp, Homo sapiens
gcctcatgcctgctga

SEQ ID NO: 6879948 - DNA, 14 bp, Homo sapiens
cagcttttcttgcc

SEQ ID NO: 6879949 - DNA, 17 bp, Homo sapiens
ccttctctcatctctta

SEQ ID NO: 6879950 - DNA, 16 bp, Homo sapiens
ttactactattctgtt

SEQ ID NO: 6879951 - DNA, 17 bp, Homo sapiens
catgctggagcctgtgt

SEQ ID NO: 6879952 - DNA, 15 bp, Homo sapiens
ctgtgccttcctccc

SEQ ID NO: 6879953 - DNA, 21 bp, Homo sapiens
gccgaggaatgtgaagccaga

SEQ ID NO: 6879954 - DNA, 16 bp, Homo sapiens
aggactccactggaca

SEQ ID NO: 6879955 - DNA, 18 bp, Homo sapiens
cccagctttatctgtcac

SEQ ID NO: 6879956 - DNA, 21 bp, Homo sapiens
ctgattattacttctgtttct

SEQ ID NO: 6879957 - DNA, 15 bp, Homo sapiens
gacagatggaccaaa

SEQ ID NO: 6879958 - DNA, 15 bp, Homo sapiens
ccttgtctgctgctc

SEQ ID NO: 6879959 - DNA, 15 bp, Homo sapiens
gcatccaatctgctc

SEQ ID NO: 6879960 - DNA, 20 bp, Homo sapiens
aagtggggtagactgaggga

SEQ ID NO: 6879961 - DNA, 18 bp, Homo sapiens
caagtctctctgtgaata

SEQ ID NO: 6879962 - DNA, 14 bp, Homo sapiens
taaaattatactgt

SEQ ID NO: 6879963 - DNA, 24 bp, Homo sapiens
tagatttggctcctctgcttctca

SEQ ID NO: 6879964 - DNA, 23 bp, Homo sapiens
tatactgaaagatctctgtcaca

SEQ ID NO: 6879965 - DNA, 22 bp, Homo sapiens
ctcaagatactgctactgtaat

SEQ ID NO: 6879966 - DNA, 23 bp, Homo sapiens
atgcctttgagacagtttcttag

SEQ ID NO: 6879967 - DNA, 16 bp, Homo sapiens
ctcaaactccccagct

SEQ ID NO: 6879968 - DNA, 18 bp, Homo sapiens
cccttgctctcccctgcc

SEQ ID NO: 6879969 - DNA, 17 bp, Homo sapiens
aggccacactcagcaca

SEQ ID NO: 6879970 - DNA, 15 bp, Homo sapiens
cttgccactgcctct

SEQ ID NO: 6879971 - DNA, 18 bp, Homo sapiens
gcaaaatgtcttgtgtat

SEQ ID NO: 6879972 - DNA, 16 bp, Homo sapiens
ccattgttcccttcct

SEQ ID NO: 6879973 - DNA, 16 bp, Homo sapiens
acagacaccacagcct

SEQ ID NO: 6879974 - DNA, 22 bp, Homo sapiens
ttctgacccatgctgccctgtg

SEQ ID NO: 6879975 - DNA, 17 bp, Homo sapiens
ccctcccaccgctgcct

SEQ ID NO: 6879976 - DNA, 17 bp, Homo sapiens
aaagccaaactctgcca

SEQ ID NO: 6879977 - DNA, 21 bp, Homo sapiens
ttcctccaaactcctgcctgt

SEQ ID NO: 6879978 - DNA, 17 bp, Homo sapiens
gcacaaactgcagctgt

SEQ ID NO: 6879979 - DNA, 13 bp, Homo sapiens
ccagccccagcca

SEQ ID NO: 6879980 - DNA, 15 bp, Homo sapiens
tttcccacccatctc

SEQ ID NO: 6879981 - DNA, 14 bp, Homo sapiens
ccaggaccagctgg

SEQ ID NO: 6879982 - DNA, 15 bp, Homo sapiens
cgttcccttctcccc

SEQ ID NO: 6879983 - DNA, 20 bp, Homo sapiens
caggcggaggggcttggagc

SEQ ID NO: 6879984 - DNA, 18 bp, Homo sapiens
cacccagtctgttgctgc

SEQ ID NO: 6879985 - DNA, 14 bp, Homo sapiens
ccctgcactttcct

SEQ ID NO: 6879986 - DNA, 13 bp, Homo sapiens
ctgtcctgtgatg

SEQ ID NO: 6879987 - DNA, 17 bp, Homo sapiens
ctcctccctgctcctca

SEQ ID NO: 6879988 - DNA, 18 bp, Homo sapiens
ccttcctgtcctgcctcc

SEQ ID NO: 6879989 - DNA, 23 bp, Homo sapiens
taagaatgtacagttgagctcag

SEQ ID NO: 6879990 - DNA, 16 bp, Homo sapiens
caccagcctgctgaca

SEQ ID NO: 6879991 - DNA, 22 bp, Homo sapiens
aaacttttacatttttctgatg

SEQ ID NO: 6879992 - DNA, 19 bp, Homo sapiens
cactgaatcagctgctgac

SEQ ID NO: 6879993 - DNA, 16 bp, Homo sapiens
agatgctggcccaggg

SEQ ID NO: 6879994 - DNA, 18 bp, Homo sapiens
agagtgtcaaccagacag

SEQ ID NO: 6879995 - DNA, 13 bp, Homo sapiens
aatgctgtgaata

SEQ ID NO: 6879996 - DNA, 14 bp, Homo sapiens
agagactcccagga

SEQ ID NO: 6879997 - DNA, 18 bp, Homo sapiens
ccagccttgctctcttca

SEQ ID NO: 6879998 - DNA, 23 bp, Homo sapiens
gctatttttaatttcctgtgagg

SEQ ID NO: 6879999 - DNA, 19 bp, Homo sapiens
ctcctagcctgctctgcca

SEQ ID NO: 6880000 - DNA, 15 bp, Homo sapiens
taggtttttcttgct

SEQ ID NO: 6880001 - DNA, 17 bp, Homo sapiens
tattgtgttgactttat

SEQ ID NO: 6880002 - DNA, 18 bp, Homo sapiens
cacgtgatggaccaaagc

SEQ ID NO: 6880003 - DNA, 16 bp, Homo sapiens
cactgaattcactcca

SEQ ID NO: 6880004 - DNA, 16 bp, Homo sapiens
gtgacccacatgccat

SEQ ID NO: 6880005 - DNA, 20 bp, Homo sapiens
cctcccgagtagctgggact

SEQ ID NO: 6880006 - DNA, 13 bp, Homo sapiens
ctgcagcacttta

SEQ ID NO: 6880007 - DNA, 20 bp, Homo sapiens
ctctgagccccctgtgccca

SEQ ID NO: 6880008 - DNA, 17 bp, Homo sapiens
ttgcattctattgcctt

SEQ ID NO: 6880009 - DNA, 21 bp, Homo sapiens
tgggctactgccactgtgtgc

SEQ ID NO: 6880010 - DNA, 12 bp, Homo sapiens
gacactgctgca

SEQ ID NO: 6880011 - DNA, 20 bp, Homo sapiens
cactgccaggcacctggcct

SEQ ID NO: 6880012 - DNA, 16 bp, Homo sapiens
cccccgcgccctccct

SEQ ID NO: 6880013 - DNA, 13 bp, Homo sapiens
tgaaagaaaataa

SEQ ID NO: 6880014 - DNA, 13 bp, Homo sapiens
ataatgatactta

SEQ ID NO: 6880015 - DNA, 20 bp, Homo sapiens
acctgccactcacacagcca

SEQ ID NO: 6880016 - DNA, 16 bp, Homo sapiens
gaactcatgtgattta

SEQ ID NO: 6880017 - DNA, 12 bp, Homo sapiens
atatcagtttga

SEQ ID NO: 6880018 - DNA, 18 bp, Homo sapiens
acttgttcattctgtgac

SEQ ID NO: 6880019 - DNA, 15 bp, Homo sapiens
cacctccctgcctcc

SEQ ID NO: 6880020 - DNA, 23 bp, Homo sapiens
cctgccagcccctcggctctgcc

SEQ ID NO: 6880021 - DNA, 17 bp, Homo sapiens
attcatgctgcctgcca

SEQ ID NO: 6880022 - DNA, 13 bp, Homo sapiens
agtctacccagag

SEQ ID NO: 6880023 - DNA, 20 bp, Homo sapiens
tcccaggggagccagctgct

SEQ ID NO: 6880024 - DNA, 21 bp, Homo sapiens
cccttccccatttcctcttcc

SEQ ID NO: 6880025 - DNA, 19 bp, Homo sapiens
ccatttaacattgtttttg

SEQ ID NO: 6880026 - DNA, 21 bp, Homo sapiens
tctgcatcatctgtagatact

SEQ ID NO: 6880027 - DNA, 22 bp, Homo sapiens
acatgacagtggttatatttca

SEQ ID NO: 6880028 - DNA, 17 bp, Homo sapiens
ccctctcactgtctgag

SEQ ID NO: 6880029 - DNA, 16 bp, Homo sapiens
tatccatgagctgcac

SEQ ID NO: 6880030 - DNA, 17 bp, Homo sapiens
ctatacacaccctgccc

SEQ ID NO: 6880031 - DNA, 18 bp, Homo sapiens
gaccacccccgatgggat

SEQ ID NO: 6880032 - DNA, 23 bp, Homo sapiens
aatacagcttcattatctgagtt

SEQ ID NO: 6880033 - DNA, 18 bp, Homo sapiens
cctgccccggccactctg

SEQ ID NO: 6880034 - DNA, 15 bp, Homo sapiens
aaccacctctctgtc

SEQ ID NO: 6880035 - DNA, 21 bp, Homo sapiens
ccagcccctggggcccagccc

SEQ ID NO: 6880036 - DNA, 20 bp, Homo sapiens
actcctgcctgagtttccag

SEQ ID NO: 6880037 - DNA, 15 bp, Homo sapiens
gttttaaagcttcca

SEQ ID NO: 6880038 - DNA, 14 bp, Homo sapiens
tattacttgtgcac

SEQ ID NO: 6880039 - DNA, 16 bp, Homo sapiens
gaggggcgggacccag

SEQ ID NO: 6880040 - DNA, 21 bp, Homo sapiens
aggtcttggccgactcaggga

SEQ ID NO: 6880041 - DNA, 15 bp, Homo sapiens
tgatccaagctggtc

SEQ ID NO: 6880042 - DNA, 23 bp, Homo sapiens
ggcttctccagggaattcttaca

SEQ ID NO: 6880043 - DNA, 20 bp, Homo sapiens
cattctacttgctctggacc

SEQ ID NO: 6880044 - DNA, 15 bp, Homo sapiens
tccttacttgcactg

SEQ ID NO: 6880045 - DNA, 15 bp, Homo sapiens
catgaccccttctct

SEQ ID NO: 6880046 - DNA, 13 bp, Homo sapiens
tctatgtttgtat

SEQ ID NO: 6880047 - DNA, 15 bp, Homo sapiens
ccctgcctgccttct

SEQ ID NO: 6880048 - DNA, 16 bp, Homo sapiens
ctcattggccagctca

SEQ ID NO: 6880049 - DNA, 15 bp, Homo sapiens
tgctttcccctgtgg

SEQ ID NO: 6880050 - DNA, 22 bp, Homo sapiens
aagacattttgtttttactgta

SEQ ID NO: 6880051 - DNA, 15 bp, Homo sapiens
gctgtacatactttt

SEQ ID NO: 6880052 - DNA, 17 bp, Homo sapiens
ctgcctttgagcttctc

SEQ ID NO: 6880053 - DNA, 16 bp, Homo sapiens
caaactcctgacctca

SEQ ID NO: 6880054 - DNA, 18 bp, Homo sapiens
acaataccagatcactca

SEQ ID NO: 6880055 - DNA, 12 bp, Homo sapiens
gagccctgctct

SEQ ID NO: 6880056 - DNA, 18 bp, Homo sapiens
cctgtctgttcccagccc

SEQ ID NO: 6880057 - DNA, 22 bp, Homo sapiens
atttggggacagattcagtctt

SEQ ID NO: 6880058 - DNA, 18 bp, Homo sapiens
caggatcatggtgtaata

SEQ ID NO: 6880059 - DNA, 21 bp, Homo sapiens
gttttgttctgtatattttgt

SEQ ID NO: 6880060 - DNA, 12 bp, Homo sapiens
agctgcctctga

SEQ ID NO: 6880061 - DNA, 20 bp, Homo sapiens
cttttctcccacctccttcc

SEQ ID NO: 6880062 - DNA, 11 bp, Homo sapiens
aacccagagag

SEQ ID NO: 6880063 - DNA, 22 bp, Homo sapiens
tgcctaaggtcacagctaataa

SEQ ID NO: 6880064 - DNA, 15 bp, Homo sapiens
aacttccactgttaa

SEQ ID NO: 6880065 - DNA, 22 bp, Homo sapiens
cagtggaaggacactcttggct

SEQ ID NO: 6880066 - DNA, 17 bp, Homo sapiens
cttcctgggtcctgcct

SEQ ID NO: 6880067 - DNA, 17 bp, Homo sapiens
ctggatctacctggagg

SEQ ID NO: 6880068 - DNA, 16 bp, Homo sapiens
agccaggagtctgtgc

SEQ ID NO: 6880069 - DNA, 20 bp, Homo sapiens
gctattgcagaatgaagcca

SEQ ID NO: 6880070 - DNA, 16 bp, Homo sapiens
gaatgttctgacatta

SEQ ID NO: 6880071 - DNA, 15 bp, Homo sapiens
ctgccttctgtctct

SEQ ID NO: 6880072 - DNA, 20 bp, Homo sapiens
acattacaaacaaaggattt

SEQ ID NO: 6880073 - DNA, 16 bp, Homo sapiens
agccctctccacccag

SEQ ID NO: 6880074 - DNA, 21 bp, Homo sapiens
gcttggtgagtgcgtactttt

SEQ ID NO: 6880075 - DNA, 15 bp, Homo sapiens
gggaaatgagccagc

SEQ ID NO: 6880076 - DNA, 11 bp, Homo sapiens
agaactgtgaa

SEQ ID NO: 6880077 - DNA, 13 bp, Homo sapiens
tccgcctgcctct

SEQ ID NO: 6880078 - DNA, 17 bp, Homo sapiens
agccctgctccctgcct

SEQ ID NO: 6880079 - DNA, 18 bp, Homo sapiens
agctgtagagtccttggc

SEQ ID NO: 6880080 - DNA, 21 bp, Homo sapiens
cctgtccacacccagctcagc

SEQ ID NO: 6880081 - DNA, 16 bp, Homo sapiens
acctcaagttcttgga

SEQ ID NO: 6880082 - DNA, 14 bp, Homo sapiens
agttcttcacctct

SEQ ID NO: 6880083 - DNA, 15 bp, Homo sapiens
cacagccacacacac

SEQ ID NO: 6880084 - DNA, 18 bp, Homo sapiens
ctgcttcccatcctaccc

SEQ ID NO: 6880085 - DNA, 17 bp, Homo sapiens
ctggatcagcgtggcct

SEQ ID NO: 6880086 - DNA, 14 bp, Homo sapiens
ccttgtctcttcct

SEQ ID NO: 6880087 - DNA, 13 bp, Homo sapiens
gcatggcagctgg

SEQ ID NO: 6880088 - DNA, 20 bp, Homo sapiens
ttggtcctgcctaaatttca

SEQ ID NO: 6880089 - DNA, 11 bp, Homo sapiens
ccctccatccg

SEQ ID NO: 6880090 - DNA, 18 bp, Homo sapiens
catttcaaagccctgcct

SEQ ID NO: 6880091 - DNA, 23 bp, Homo sapiens
ctcaggtgatccacccacctcag

SEQ ID NO: 6880092 - DNA, 11 bp, Homo sapiens
ccacctgctgc

SEQ ID NO: 6880093 - DNA, 15 bp, Homo sapiens
gctctgaactgcaca

SEQ ID NO: 6880094 - DNA, 21 bp, Homo sapiens
cctctttaatgctgtctttgt

SEQ ID NO: 6880095 - DNA, 20 bp, Homo sapiens
agccatatgacaatttcaaa

SEQ ID NO: 6880096 - DNA, 18 bp, Homo sapiens
aagctatgtatcgctcct

SEQ ID NO: 6880097 - DNA, 23 bp, Homo sapiens
tcctagaagaaccaaatacctca

SEQ ID NO: 6880098 - DNA, 18 bp, Homo sapiens
tcactcctacctggtaat

SEQ ID NO: 6880099 - DNA, 18 bp, Homo sapiens
gccttgggctgctcctca

SEQ ID NO: 6880100 - DNA, 12 bp, Homo sapiens
gaaacctgtgaa

SEQ ID NO: 6880101 - DNA, 14 bp, Homo sapiens
cttatgtctctgcc

SEQ ID NO: 6880102 - DNA, 15 bp, Homo sapiens
atctagcagctggcc

SEQ ID NO: 6880103 - DNA, 15 bp, Homo sapiens
agctgcacattcctg

SEQ ID NO: 6880104 - DNA, 15 bp, Homo sapiens
agacagtccctgcca

SEQ ID NO: 6880105 - DNA, 19 bp, Homo sapiens
agatcctcttgccacatct

SEQ ID NO: 6880106 - DNA, 14 bp, Homo sapiens
ccccagccccttct

SEQ ID NO: 6880107 - DNA, 23 bp, Homo sapiens
cagctgtttctagagttcctacc

SEQ ID NO: 6880108 - DNA, 16 bp, Homo sapiens
cttaagatcaaaacag

SEQ ID NO: 6880109 - DNA, 22 bp, Homo sapiens
taatgattaagggacatttcta

SEQ ID NO: 6880110 - DNA, 17 bp, Homo sapiens
ccctacaaccccagcct

SEQ ID NO: 6880111 - DNA, 20 bp, Homo sapiens
catatagaccaattgaagca

SEQ ID NO: 6880112 - DNA, 19 bp, Homo sapiens
ctatgtgattctggaagca

SEQ ID NO: 6880113 - DNA, 22 bp, Homo sapiens
gactccgggaccattgacctca

SEQ ID NO: 6880114 - DNA, 18 bp, Homo sapiens
tggtgcattgctgtgtga

SEQ ID NO: 6880115 - DNA, 15 bp, Homo sapiens
gttttgtgtactttt

SEQ ID NO: 6880116 - DNA, 18 bp, Homo sapiens
atcagacatacagctgcc

SEQ ID NO: 6880117 - DNA, 17 bp, Homo sapiens
accaaatctgacatatt

SEQ ID NO: 6880118 - DNA, 15 bp, Homo sapiens
aacgagaagtgccct

SEQ ID NO: 6880119 - DNA, 19 bp, Homo sapiens
ggtgggtatgcgagaccag

SEQ ID NO: 6880120 - DNA, 16 bp, Homo sapiens
ctgccagcccctgcca

SEQ ID NO: 6880121 - DNA, 12 bp, Homo sapiens
gcctctgcctcc

SEQ ID NO: 6880122 - DNA, 15 bp, Homo sapiens
cccgtcttctctcca

SEQ ID NO: 6880123 - DNA, 16 bp, Homo sapiens
caggaccttgcttcct

SEQ ID NO: 6880124 - DNA, 21 bp, Homo sapiens
tcgccttagcatgtttgctga

SEQ ID NO: 6880125 - DNA, 20 bp, Homo sapiens
tgatccacccaccttggcct

SEQ ID NO: 6880126 - DNA, 17 bp, Homo sapiens
cacttcctcccctcgcc

SEQ ID NO: 6880127 - DNA, 23 bp, Homo sapiens
tatgtgttcttcgtaactttatg

SEQ ID NO: 6880128 - DNA, 15 bp, Homo sapiens
tccagcatccagcct

SEQ ID NO: 6880129 - DNA, 21 bp, Homo sapiens
cactcctgagacccctggcct

SEQ ID NO: 6880130 - DNA, 20 bp, Homo sapiens
caccatgcaaatgtcttcca

SEQ ID NO: 6880131 - DNA, 14 bp, Homo sapiens
caaccacagtgcca

SEQ ID NO: 6880132 - DNA, 18 bp, Homo sapiens
ccaaagagaaacctatta

SEQ ID NO: 6880133 - DNA, 17 bp, Homo sapiens
cctgtctgccccagccc

SEQ ID NO: 6880134 - DNA, 17 bp, Homo sapiens
ggacagaaagaccctga

SEQ ID NO: 6880135 - DNA, 21 bp, Homo sapiens
ttagtagagatttcatagcta

SEQ ID NO: 6880136 - DNA, 15 bp, Homo sapiens
tttccagcctcagcc

SEQ ID NO: 6880137 - DNA, 15 bp, Homo sapiens
ggctcctccctctgc

SEQ ID NO: 6880138 - DNA, 16 bp, Homo sapiens
gtccctacctgcttca

SEQ ID NO: 6880139 - DNA, 13 bp, Homo sapiens
tgacaactgtgac

SEQ ID NO: 6880140 - DNA, 18 bp, Homo sapiens
agcttcagtctctgcagt

SEQ ID NO: 6880141 - DNA, 15 bp, Homo sapiens
cctccaagcctgcct

SEQ ID NO: 6880142 - DNA, 15 bp, Homo sapiens
gctccatggctgcca

SEQ ID NO: 6880143 - DNA, 17 bp, Homo sapiens
cactgagctctgcctca

SEQ ID NO: 6880144 - DNA, 21 bp, Homo sapiens
gcatctttgttacttccttat

SEQ ID NO: 6880145 - DNA, 22 bp, Homo sapiens
aactgagccaaacacactgtaa

SEQ ID NO: 6880146 - DNA, 18 bp, Homo sapiens
acctctctctgctcctca

SEQ ID NO: 6880147 - DNA, 19 bp, Homo sapiens
aaccccccactccctgcca

SEQ ID NO: 6880148 - DNA, 21 bp, Homo sapiens
tcaggcagacaagagctgctg

SEQ ID NO: 6880149 - DNA, 16 bp, Homo sapiens
cactcctgtcccgcct

SEQ ID NO: 6880150 - DNA, 15 bp, Homo sapiens
gccccaaaaccacag

SEQ ID NO: 6880151 - DNA, 19 bp, Homo sapiens
cgcagagcctgacgctcag

SEQ ID NO: 6880152 - DNA, 17 bp, Homo sapiens
agtgtgttgtctgtgca

SEQ ID NO: 6880153 - DNA, 13 bp, Homo sapiens
gcccacctctgct

SEQ ID NO: 6880154 - DNA, 14 bp, Homo sapiens
cctcctccctgcat

SEQ ID NO: 6880155 - DNA, 14 bp, Homo sapiens
cctcacccctgccc

SEQ ID NO: 6880156 - DNA, 23 bp, Homo sapiens
atttttcaataaagtactgcaaa

SEQ ID NO: 6880157 - DNA, 17 bp, Homo sapiens
agggagcccctttgatg

SEQ ID NO: 6880158 - DNA, 16 bp, Homo sapiens
agctgattactgtcaa

SEQ ID NO: 6880159 - DNA, 20 bp, Homo sapiens
ccctggacacagctcttcat

SEQ ID NO: 6880160 - DNA, 21 bp, Homo sapiens
ctgtattttttcttgcattga

SEQ ID NO: 6880161 - DNA, 19 bp, Homo sapiens
ccctcaacaccctgcttct

SEQ ID NO: 6880162 - DNA, 16 bp, Homo sapiens
ttttgaccttgtattg

SEQ ID NO: 6880163 - DNA, 17 bp, Homo sapiens
actacgctcctgtctcc

SEQ ID NO: 6880164 - DNA, 22 bp, Homo sapiens
ctggcctccctttgtgtgcata

SEQ ID NO: 6880165 - DNA, 18 bp, Homo sapiens
acttcagggcagatttta

SEQ ID NO: 6880166 - DNA, 14 bp, Homo sapiens
cctgccccagagaa

SEQ ID NO: 6880167 - DNA, 23 bp, Homo sapiens
tcttgtgggagacagcagcctgt

SEQ ID NO: 6880168 - DNA, 20 bp, Homo sapiens
accacaaacggagcccctga

SEQ ID NO: 6880169 - DNA, 18 bp, Homo sapiens
cgcatgccccctcgtgcc

SEQ ID NO: 6880170 - DNA, 23 bp, Homo sapiens
gtgacccggcaccccctgcagct

SEQ ID NO: 6880171 - DNA, 14 bp, Homo sapiens
aaaccctctgtgaa

SEQ ID NO: 6880172 - DNA, 12 bp, Homo sapiens
tccacctcagcc

SEQ ID NO: 6880173 - DNA, 14 bp, Homo sapiens
cccttcccctgcct

SEQ ID NO: 6880174 - DNA, 11 bp, Homo sapiens
ccagtgaaatg

SEQ ID NO: 6880175 - DNA, 13 bp, Homo sapiens
ccttgcccttcct

SEQ ID NO: 6880176 - DNA, 14 bp, Homo sapiens
cgtgtatgtttctt

SEQ ID NO: 6880177 - DNA, 11 bp, Homo sapiens
cctcctctgct

SEQ ID NO: 6880178 - DNA, 17 bp, Homo sapiens
gacccttgcctgcctcc

SEQ ID NO: 6880179 - DNA, 21 bp, Homo sapiens
tggcctgccaggctcctctcc

SEQ ID NO: 6880180 - DNA, 13 bp, Homo sapiens
taatatgtctttt

SEQ ID NO: 6880181 - DNA, 18 bp, Homo sapiens
caccaggcctcactggct

SEQ ID NO: 6880182 - DNA, 20 bp, Homo sapiens
catgccctgttcagctactc

SEQ ID NO: 6880183 - DNA, 19 bp, Homo sapiens
ctgtcatctagccccttcg

SEQ ID NO: 6880184 - DNA, 17 bp, Homo sapiens
ctggggaaggagccagt

SEQ ID NO: 6880185 - DNA, 23 bp, Homo sapiens
tcgccccttccctctctccctgc

SEQ ID NO: 6880186 - DNA, 15 bp, Homo sapiens
agctctcacagacat

SEQ ID NO: 6880187 - DNA, 13 bp, Homo sapiens
ggttctctgctgt

SEQ ID NO: 6880188 - DNA, 16 bp, Homo sapiens
tgtggtttttgtgtgt

SEQ ID NO: 6880189 - DNA, 16 bp, Homo sapiens
agttttcttgtttctg

SEQ ID NO: 6880190 - DNA, 23 bp, Homo sapiens
cttggcccagcactgcccatccc

SEQ ID NO: 6880191 - DNA, 12 bp, Homo sapiens
cccctctgttct

SEQ ID NO: 6880192 - DNA, 23 bp, Homo sapiens
ctctggcagcaccgcctcttccc

SEQ ID NO: 6880193 - DNA, 20 bp, Homo sapiens
tggaatttccattgacattt

SEQ ID NO: 6880194 - DNA, 18 bp, Homo sapiens
ccctcagcctccccttct

SEQ ID NO: 6880195 - DNA, 20 bp, Homo sapiens
caagcctgagaactgaattt

SEQ ID NO: 6880196 - DNA, 23 bp, Homo sapiens
ctttaaaattgtcacctctgtta

SEQ ID NO: 6880197 - DNA, 16 bp, Homo sapiens
cagatccagactgtaa

SEQ ID NO: 6880198 - DNA, 19 bp, Homo sapiens
cctcctcactggccatccc

SEQ ID NO: 6880199 - DNA, 20 bp, Homo sapiens
ccaggtggctagcaaattag

SEQ ID NO: 6880200 - DNA, 15 bp, Homo sapiens
gccttccctctgcat

SEQ ID NO: 6880201 - DNA, 17 bp, Homo sapiens
aggccaaattaatcttt

SEQ ID NO: 6880202 - DNA, 23 bp, Homo sapiens
ccagcagtgtggagaccctgcca

SEQ ID NO: 6880203 - DNA, 18 bp, Homo sapiens
gcaaaagcagtgggctcc

SEQ ID NO: 6880204 - DNA, 17 bp, Homo sapiens
agcacagctccctgcca

SEQ ID NO: 6880205 - DNA, 14 bp, Homo sapiens
gaccaaggagcatc

SEQ ID NO: 6880206 - DNA, 11 bp, Homo sapiens
cttcccatcct

SEQ ID NO: 6880207 - DNA, 22 bp, Homo sapiens
agaaaacaggcactgccctggt

SEQ ID NO: 6880208 - DNA, 14 bp, Homo sapiens
caccgttctgtgca

SEQ ID NO: 6880209 - DNA, 14 bp, Homo sapiens
tgactgccttgcct

SEQ ID NO: 6880210 - DNA, 21 bp, Homo sapiens
gacagagcaggctttgtgaga

SEQ ID NO: 6880211 - DNA, 18 bp, Homo sapiens
caaggtggcctctgcctg

SEQ ID NO: 6880212 - DNA, 15 bp, Homo sapiens
tcattgatgggattt

SEQ ID NO: 6880213 - DNA, 19 bp, Homo sapiens
ttcattttgaaaatatgta

SEQ ID NO: 6880214 - DNA, 17 bp, Homo sapiens
aaattacagatgtgaaa

SEQ ID NO: 6880215 - DNA, 16 bp, Homo sapiens
aatccacaaatatgct

SEQ ID NO: 6880216 - DNA, 23 bp, Homo sapiens
cccaggagcagctggcactgaca

SEQ ID NO: 6880217 - DNA, 17 bp, Homo sapiens
ctgcaggccctccctct

SEQ ID NO: 6880218 - DNA, 23 bp, Homo sapiens
cctaagggctaaggcctcttgct

SEQ ID NO: 6880219 - DNA, 15 bp, Homo sapiens
ctgggctctggtggg

SEQ ID NO: 6880220 - DNA, 16 bp, Homo sapiens
cttttgcacccctccc

SEQ ID NO: 6880221 - DNA, 17 bp, Homo sapiens
aatttttttcagtatta

SEQ ID NO: 6880222 - DNA, 17 bp, Homo sapiens
catcaggctctgttcct

SEQ ID NO: 6880223 - DNA, 13 bp, Homo sapiens
cagcagagccagg

SEQ ID NO: 6880224 - DNA, 19 bp, Homo sapiens
gggttgtttccaggagaaa

SEQ ID NO: 6880225 - DNA, 22 bp, Homo sapiens
agcagaggaggggccgctgcca

SEQ ID NO: 6880226 - DNA, 20 bp, Homo sapiens
tctgccggtcccccatgcca

SEQ ID NO: 6880227 - DNA, 18 bp, Homo sapiens
ccttgcttttgcttctag

SEQ ID NO: 6880228 - DNA, 16 bp, Homo sapiens
accaattgtgctgcca

SEQ ID NO: 6880229 - DNA, 23 bp, Homo sapiens
atctgaagtcagatctgcctaag

SEQ ID NO: 6880230 - DNA, 16 bp, Homo sapiens
tccatgtcctatgcct

SEQ ID NO: 6880231 - DNA, 20 bp, Homo sapiens
tctccccagtgcctgccact

SEQ ID NO: 6880232 - DNA, 23 bp, Homo sapiens
ctggtctcaaactcctgacctca

SEQ ID NO: 6880233 - DNA, 15 bp, Homo sapiens
cctgctgctgctact

SEQ ID NO: 6880234 - DNA, 11 bp, Homo sapiens
ctgcctggagg

SEQ ID NO: 6880235 - DNA, 19 bp, Homo sapiens
ctatggagtgcaccaaaga

SEQ ID NO: 6880236 - DNA, 16 bp, Homo sapiens
tatactttgttctgtt

SEQ ID NO: 6880237 - DNA, 15 bp, Homo sapiens
ccttgcccctgctct

SEQ ID NO: 6880238 - DNA, 23 bp, Homo sapiens
atagtgactaaactacattataa

SEQ ID NO: 6880239 - DNA, 14 bp, Homo sapiens
aggactctgcctcc

SEQ ID NO: 6880240 - DNA, 17 bp, Homo sapiens
caaccctccctcagccc

SEQ ID NO: 6880241 - DNA, 18 bp, Homo sapiens
cctctcccttcccttccc

SEQ ID NO: 6880242 - DNA, 19 bp, Homo sapiens
cctcacacccacctgctgc

SEQ ID NO: 6880243 - DNA, 13 bp, Homo sapiens
caacttgtaaata

SEQ ID NO: 6880244 - DNA, 12 bp, Homo sapiens
tgactcatgcct

SEQ ID NO: 6880245 - DNA, 21 bp, Homo sapiens
aatctgagggcactctctgcc

SEQ ID NO: 6880246 - DNA, 20 bp, Homo sapiens
ctttgccctgctgccctccc

SEQ ID NO: 6880247 - DNA, 17 bp, Homo sapiens
accaggctgcagcctcc

SEQ ID NO: 6880248 - DNA, 22 bp, Homo sapiens
cttaagtccagaagcctcctgt

SEQ ID NO: 6880249 - DNA, 13 bp, Homo sapiens
taaagttgaattt

SEQ ID NO: 6880250 - DNA, 17 bp, Homo sapiens
ccttcaaccccctcgcc

SEQ ID NO: 6880251 - DNA, 21 bp, Homo sapiens
ccctggggaggacccctgccc

SEQ ID NO: 6880252 - DNA, 12 bp, Homo sapiens
ttttctccctct

SEQ ID NO: 6880253 - DNA, 20 bp, Homo sapiens
cccttctgggcatctgttct

SEQ ID NO: 6880254 - DNA, 15 bp, Homo sapiens
cgtcggtctgtgccc

SEQ ID NO: 6880255 - DNA, 22 bp, Homo sapiens
cacttctggggccagcccctcc

SEQ ID NO: 6880256 - DNA, 13 bp, Homo sapiens
ccagcccagagac

SEQ ID NO: 6880257 - DNA, 22 bp, Homo sapiens
ggaaaattagttcccattcttt

SEQ ID NO: 6880258 - DNA, 18 bp, Homo sapiens
acgccgatataagccata

SEQ ID NO: 6880259 - DNA, 12 bp, Homo sapiens
tgggctgagccc

SEQ ID NO: 6880260 - DNA, 13 bp, Homo sapiens
cagtgcctgctga

SEQ ID NO: 6880261 - DNA, 22 bp, Homo sapiens
ccttgggttagacctacagggg

SEQ ID NO: 6880262 - DNA, 16 bp, Homo sapiens
atgcttctactgtgac

SEQ ID NO: 6880263 - DNA, 16 bp, Homo sapiens
ccaagagatctgtgtg

SEQ ID NO: 6880264 - DNA, 16 bp, Homo sapiens
actgttcttgctgcta

SEQ ID NO: 6880265 - DNA, 18 bp, Homo sapiens
atactgccaaaacattta

SEQ ID NO: 6880266 - DNA, 13 bp, Homo sapiens
ctgtcctctcccc

SEQ ID NO: 6880267 - DNA, 14 bp, Homo sapiens
ctttcccccttccc

SEQ ID NO: 6880268 - DNA, 20 bp, Homo sapiens
cctttctgactgtccctgcc

SEQ ID NO: 6880269 - DNA, 14 bp, Homo sapiens
agcctggcctgccc

SEQ ID NO: 6880270 - DNA, 19 bp, Homo sapiens
ctgttgcaaattccacccc

SEQ ID NO: 6880271 - DNA, 17 bp, Homo sapiens
tccatccccctgcctcc

SEQ ID NO: 6880272 - DNA, 15 bp, Homo sapiens
ttggtcctcttgcct

SEQ ID NO: 6880273 - DNA, 22 bp, Homo sapiens
ctctacacaggggccctgtaca

SEQ ID NO: 6880274 - DNA, 18 bp, Homo sapiens
ctgaggccagcctggcct

SEQ ID NO: 6880275 - DNA, 17 bp, Homo sapiens
aacccacctctcctgcc

SEQ ID NO: 6880276 - DNA, 22 bp, Homo sapiens
ctctgttgcctcctctctccct

SEQ ID NO: 6880277 - DNA, 20 bp, Homo sapiens
cagaagcctggactctgccc

SEQ ID NO: 6880278 - DNA, 17 bp, Homo sapiens
aatttttcccagtattt

SEQ ID NO: 6880279 - DNA, 16 bp, Homo sapiens
caggagacccacaggt

SEQ ID NO: 6880280 - DNA, 22 bp, Homo sapiens
gcctgtcttcagatcctgctgc

SEQ ID NO: 6880281 - DNA, 15 bp, Homo sapiens
tcccttcatgtttta

SEQ ID NO: 6880282 - DNA, 21 bp, Homo sapiens
accgccgcagaagcagcccct

SEQ ID NO: 6880283 - DNA, 12 bp, Homo sapiens
tatatgctgcat

SEQ ID NO: 6880284 - DNA, 14 bp, Homo sapiens
gactttgctcctca

SEQ ID NO: 6880285 - DNA, 20 bp, Homo sapiens
cagctttgctcatatttccc

SEQ ID NO: 6880286 - DNA, 16 bp, Homo sapiens
ccttctttaaatcaaa

SEQ ID NO: 6880287 - DNA, 17 bp, Homo sapiens
ctacacagaccctgccc

SEQ ID NO: 6880288 - DNA, 16 bp, Homo sapiens
acagtttcttcatgca

SEQ ID NO: 6880289 - DNA, 18 bp, Homo sapiens
ccctccccacccctgcct

SEQ ID NO: 6880290 - DNA, 22 bp, Homo sapiens
catagaaggaagtgtgtttgcc

SEQ ID NO: 6880291 - DNA, 19 bp, Homo sapiens
catcatcaaggcactgcct

SEQ ID NO: 6880292 - DNA, 21 bp, Homo sapiens
caaagctaggatggttctgtg

SEQ ID NO: 6880293 - DNA, 17 bp, Homo sapiens
ctgggaccagagccaga

SEQ ID NO: 6880294 - DNA, 12 bp, Homo sapiens
ggcccctctgcc

SEQ ID NO: 6880295 - DNA, 14 bp, Homo sapiens
ataaaactatttaa

SEQ ID NO: 6880296 - DNA, 19 bp, Homo sapiens
cgctcaggggctccatgct

SEQ ID NO: 6880297 - DNA, 18 bp, Homo sapiens
cccttggtgccctcgcct

SEQ ID NO: 6880298 - DNA, 21 bp, Homo sapiens
cctatgccctgcccttcctca

SEQ ID NO: 6880299 - DNA, 23 bp, Homo sapiens
gcctgcgcccaccccgctctgca

SEQ ID NO: 6880300 - DNA, 16 bp, Homo sapiens
ccagataccagcccct

SEQ ID NO: 6880301 - DNA, 23 bp, Homo sapiens
ctgtgggctgcactctgtgccca

SEQ ID NO: 6880302 - DNA, 19 bp, Homo sapiens
cttactttgtaaattctga

SEQ ID NO: 6880303 - DNA, 16 bp, Homo sapiens
cccttctcccctgccc

SEQ ID NO: 6880304 - DNA, 13 bp, Homo sapiens
acagtgcatctca

SEQ ID NO: 6880305 - DNA, 22 bp, Homo sapiens
ggtgccaaaaccaggcctctgc

SEQ ID NO: 6880306 - DNA, 18 bp, Homo sapiens
aactgcacaatgcattga

SEQ ID NO: 6880307 - DNA, 18 bp, Homo sapiens
aggcgcggttcaggtcag

SEQ ID NO: 6880308 - DNA, 16 bp, Homo sapiens
ccaaggacccagccct

SEQ ID NO: 6880309 - DNA, 23 bp, Homo sapiens
ccctgcgtcctgacgccctgcgt

SEQ ID NO: 6880310 - DNA, 15 bp, Homo sapiens
caaattagcatgcaa

SEQ ID NO: 6880311 - DNA, 16 bp, Homo sapiens
caggatgcctgagccc

SEQ ID NO: 6880312 - DNA, 22 bp, Homo sapiens
tctgcttacaattccctgctgt

SEQ ID NO: 6880313 - DNA, 13 bp, Homo sapiens
gtaccagctgctg

SEQ ID NO: 6880314 - DNA, 17 bp, Homo sapiens
tccaccgccaccccact

SEQ ID NO: 6880315 - DNA, 13 bp, Homo sapiens
cacagccacacac

SEQ ID NO: 6880316 - DNA, 15 bp, Homo sapiens
ccagcctgctagcta

SEQ ID NO: 6880317 - DNA, 20 bp, Homo sapiens
tacaatctttattatgcatt

SEQ ID NO: 6880318 - DNA, 23 bp, Homo sapiens
ctagtctcctttgcactgagggc

SEQ ID NO: 6880319 - DNA, 17 bp, Homo sapiens
agcagccccaggagaag

SEQ ID NO: 6880320 - DNA, 22 bp, Homo sapiens
cctctgtccttcccccagcaca

SEQ ID NO: 6880321 - DNA, 13 bp, Homo sapiens
ccctcccctgccc

SEQ ID NO: 6880322 - DNA, 13 bp, Homo sapiens
cccttccctgcct

SEQ ID NO: 6880323 - DNA, 20 bp, Homo sapiens
cactctcccccaccccctcc

SEQ ID NO: 6880324 - DNA, 22 bp, Homo sapiens
atcagaagtaactcccactcct

SEQ ID NO: 6880325 - DNA, 21 bp, Homo sapiens
gaaatcatcggagtcagccag

SEQ ID NO: 6880326 - DNA, 17 bp, Homo sapiens
ctgttttagctgaggga

SEQ ID NO: 6880327 - DNA, 21 bp, Homo sapiens
aaagcctcctgccccctgcca

SEQ ID NO: 6880328 - DNA, 12 bp, Homo sapiens
taaatctgtctg

SEQ ID NO: 6880329 - DNA, 22 bp, Homo sapiens
cagctcctgagtagctgggcct

SEQ ID NO: 6880330 - DNA, 19 bp, Homo sapiens
agcttctgcttttctgccc

SEQ ID NO: 6880331 - DNA, 15 bp, Homo sapiens
atgattctcctctcc

SEQ ID NO: 6880332 - DNA, 16 bp, Homo sapiens
ccaaatatgcactttc

SEQ ID NO: 6880333 - DNA, 18 bp, Homo sapiens
atctctcccacttcctcc

SEQ ID NO: 6880334 - DNA, 21 bp, Homo sapiens
cttgctgcaggccctccctct

SEQ ID NO: 6880335 - DNA, 15 bp, Homo sapiens
aattcattggctcct

SEQ ID NO: 6880336 - DNA, 12 bp, Homo sapiens
actcactgtgtg

SEQ ID NO: 6880337 - DNA, 17 bp, Homo sapiens
gccctgcgttggagcca

SEQ ID NO: 6880338 - DNA, 19 bp, Homo sapiens
taacatttttcaatagcgt

SEQ ID NO: 6880339 - DNA, 14 bp, Homo sapiens
taatttttgctttt

SEQ ID NO: 6880340 - DNA, 20 bp, Homo sapiens
ccttctctgtctgcctctcc

SEQ ID NO: 6880341 - DNA, 15 bp, Homo sapiens
ccctttctctctcct

SEQ ID NO: 6880342 - DNA, 14 bp, Homo sapiens
aagacactgtgcag

SEQ ID NO: 6880343 - DNA, 13 bp, Homo sapiens
gcctcctctgtcc

SEQ ID NO: 6880344 - DNA, 20 bp, Homo sapiens
ctccacccccgccacggcca

SEQ ID NO: 6880345 - DNA, 14 bp, Homo sapiens
tcatgttttgctaa

SEQ ID NO: 6880346 - DNA, 20 bp, Homo sapiens
tagaagaaccaaatacctca

SEQ ID NO: 6880347 - DNA, 17 bp, Homo sapiens
attgtgacttcactgta

SEQ ID NO: 6880348 - DNA, 19 bp, Homo sapiens
cccttgggccacccctcct

SEQ ID NO: 6880349 - DNA, 15 bp, Homo sapiens
accattactgagggg

SEQ ID NO: 6880350 - DNA, 22 bp, Homo sapiens
ccctatcctacttccccttcct

SEQ ID NO: 6880351 - DNA, 14 bp, Homo sapiens
gtgccgctcctgct

SEQ ID NO: 6880352 - DNA, 22 bp, Homo sapiens
gcctcccctcctctgcttgcca

SEQ ID NO: 6880353 - DNA, 17 bp, Homo sapiens
aagggaggcctgagggg

SEQ ID NO: 6880354 - DNA, 22 bp, Homo sapiens
ctatccttataggcctgtccct

SEQ ID NO: 6880355 - DNA, 17 bp, Homo sapiens
tcatcaaggcactgcct

SEQ ID NO: 6880356 - DNA, 19 bp, Homo sapiens
caaattatcttgatacatt

SEQ ID NO: 6880357 - DNA, 13 bp, Homo sapiens
agacttattgcca

SEQ ID NO: 6880358 - DNA, 14 bp, Homo sapiens
tcatccaatgtgaa

SEQ ID NO: 6880359 - DNA, 15 bp, Homo sapiens
ccaggtgcccagcta

SEQ ID NO: 6880360 - DNA, 18 bp, Homo sapiens
cagcttacaggagccagc

SEQ ID NO: 6880361 - DNA, 23 bp, Homo sapiens
tccagctcagtcccacagcccct

SEQ ID NO: 6880362 - DNA, 14 bp, Homo sapiens
tctgcattaataat

SEQ ID NO: 6880363 - DNA, 14 bp, Homo sapiens
aatcatagtgccat

SEQ ID NO: 6880364 - DNA, 17 bp, Homo sapiens
ataaatgggaacattta

SEQ ID NO: 6880365 - DNA, 19 bp, Homo sapiens
cctgcccccaccccttcct

SEQ ID NO: 6880366 - DNA, 14 bp, Homo sapiens
agacctgtcttcca

SEQ ID NO: 6880367 - DNA, 15 bp, Homo sapiens
acttaaaaaatgtcc

SEQ ID NO: 6880368 - DNA, 22 bp, Homo sapiens
caggttctggttagctcagccc

SEQ ID NO: 6880369 - DNA, 18 bp, Homo sapiens
agtcttttaaaaagtatt

SEQ ID NO: 6880370 - DNA, 16 bp, Homo sapiens
acctccccccactgca

SEQ ID NO: 6880371 - DNA, 20 bp, Homo sapiens
tctattttgatgcagcattt

SEQ ID NO: 6880372 - DNA, 22 bp, Homo sapiens
agccaaagaaatgaacattcca

SEQ ID NO: 6880373 - DNA, 13 bp, Homo sapiens
aaattttagctct

SEQ ID NO: 6880374 - DNA, 17 bp, Homo sapiens
ccctccccccagctccc

SEQ ID NO: 6880375 - DNA, 15 bp, Homo sapiens
cctaccatgctgctt

SEQ ID NO: 6880376 - DNA, 15 bp, Homo sapiens
atcaactttactgta

SEQ ID NO: 6880377 - DNA, 19 bp, Homo sapiens
cttctctgttggtctgcct

SEQ ID NO: 6880378 - DNA, 21 bp, Homo sapiens
tccccggcggggtgcctgctg

SEQ ID NO: 6880379 - DNA, 17 bp, Homo sapiens
tacacagaccctgccca

SEQ ID NO: 6880380 - DNA, 17 bp, Homo sapiens
attttgtcacagctctt

SEQ ID NO: 6880381 - DNA, 18 bp, Homo sapiens
ccaacccctcctccctca

SEQ ID NO: 6880382 - DNA, 20 bp, Homo sapiens
cagagcccaccagccagccc

SEQ ID NO: 6880383 - DNA, 21 bp, Homo sapiens
cagcttgaccgtgaggccaga

SEQ ID NO: 6880384 - DNA, 14 bp, Homo sapiens
ccacagacactcct

SEQ ID NO: 6880385 - DNA, 22 bp, Homo sapiens
gcttgcagagatgaggccgcca

SEQ ID NO: 6880386 - DNA, 15 bp, Homo sapiens
cagagagttctggtg

SEQ ID NO: 6880387 - DNA, 14 bp, Homo sapiens
ccatctctctggcc

SEQ ID NO: 6880388 - DNA, 16 bp, Homo sapiens
tatggaaataaatgta

SEQ ID NO: 6880389 - DNA, 19 bp, Homo sapiens
cagttgtagaatgtattgt

SEQ ID NO: 6880390 - DNA, 17 bp, Homo sapiens
taccgaatgtgtcttta

SEQ ID NO: 6880391 - DNA, 21 bp, Homo sapiens
ccctatggggaggccctgcct

SEQ ID NO: 6880392 - DNA, 14 bp, Homo sapiens
ccacctcccttccc

SEQ ID NO: 6880393 - DNA, 19 bp, Homo sapiens
ttcatttagtcatgtgacc

SEQ ID NO: 6880394 - DNA, 15 bp, Homo sapiens
agccgattctctgcc

SEQ ID NO: 6880395 - DNA, 18 bp, Homo sapiens
cttgtgggagacagcagc

SEQ ID NO: 6880396 - DNA, 15 bp, Homo sapiens
ccgcctgccctgcct

SEQ ID NO: 6880397 - DNA, 15 bp, Homo sapiens
catttggcttcctct

SEQ ID NO: 6880398 - DNA, 14 bp, Homo sapiens
caattatgtttctt

SEQ ID NO: 6880399 - DNA, 11 bp, Homo sapiens
atcactgtgaa

SEQ ID NO: 6880400 - DNA, 14 bp, Homo sapiens
aagccttcttgctg

SEQ ID NO: 6880401 - DNA, 18 bp, Homo sapiens
aggctgaggcaggagaat

SEQ ID NO: 6880402 - DNA, 15 bp, Homo sapiens
aagctagactgtgtc

SEQ ID NO: 6880403 - DNA, 21 bp, Homo sapiens
caggaccagatgtccgtctct

SEQ ID NO: 6880404 - DNA, 17 bp, Homo sapiens
catccgggacgcttcca

SEQ ID NO: 6880405 - DNA, 15 bp, Homo sapiens
cctgatttcagggaa

SEQ ID NO: 6880406 - DNA, 17 bp, Homo sapiens
atgtcagaaacaatgac

SEQ ID NO: 6880407 - DNA, 15 bp, Homo sapiens
atatataattctgta

SEQ ID NO: 6880408 - DNA, 20 bp, Homo sapiens
ctctaaagcagagatgtatt

SEQ ID NO: 6880409 - DNA, 11 bp, Homo sapiens
ggagtgccttc

SEQ ID NO: 6880410 - DNA, 13 bp, Homo sapiens
ggggctctgtgtt

SEQ ID NO: 6880411 - DNA, 22 bp, Homo sapiens
cctctcccattgtccctctgcc

SEQ ID NO: 6880412 - DNA, 22 bp, Homo sapiens
cagggtctctagtgctgtgaaa

SEQ ID NO: 6880413 - DNA, 16 bp, Homo sapiens
cacgcagttctttcca

SEQ ID NO: 6880414 - DNA, 15 bp, Homo sapiens
cttccacctgtgccc

SEQ ID NO: 6880415 - DNA, 15 bp, Homo sapiens
ctctgttcccttcct

SEQ ID NO: 6880416 - DNA, 21 bp, Homo sapiens
caagtagctgggactgcaggc

SEQ ID NO: 6880417 - DNA, 14 bp, Homo sapiens
gagccttgtgcatg

SEQ ID NO: 6880418 - DNA, 19 bp, Homo sapiens
caccttctttctggactgg

SEQ ID NO: 6880419 - DNA, 14 bp, Homo sapiens
cttcagtctgctcc

SEQ ID NO: 6880420 - DNA, 16 bp, Homo sapiens
atgtgtatttactgta

SEQ ID NO: 6880421 - DNA, 18 bp, Homo sapiens
cccaaagtcctctgctcc

SEQ ID NO: 6880422 - DNA, 18 bp, Homo sapiens
ccgatggtctctctccct

SEQ ID NO: 6880423 - DNA, 13 bp, Homo sapiens
ctatgaaattggt

SEQ ID NO: 6880424 - DNA, 13 bp, Homo sapiens
aggggagagagca

SEQ ID NO: 6880425 - DNA, 19 bp, Homo sapiens
aatcagttctcaatttcat

SEQ ID NO: 6880426 - DNA, 24 bp, Homo sapiens
caaatataagacatttgtttgctg

SEQ ID NO: 6880427 - DNA, 22 bp, Homo sapiens
agttattgcagtttatcattca

SEQ ID NO: 6880428 - DNA, 16 bp, Homo sapiens
cctggtcctccctccc

SEQ ID NO: 6880429 - DNA, 16 bp, Homo sapiens
cacattggaaagcaca

SEQ ID NO: 6880430 - DNA, 21 bp, Homo sapiens
ccttctctgtctgcctctcca

SEQ ID NO: 6880431 - DNA, 16 bp, Homo sapiens
actcttgctctttcta

SEQ ID NO: 6880432 - DNA, 22 bp, Homo sapiens
tgcctataatacttgcaactaa

SEQ ID NO: 6880433 - DNA, 17 bp, Homo sapiens
agcctgtggcctttgca

SEQ ID NO: 6880434 - DNA, 18 bp, Homo sapiens
tgcctgctccctgtctgt

SEQ ID NO: 6880435 - DNA, 21 bp, Homo sapiens
attgtgtgcgctgcctggcca

SEQ ID NO: 6880436 - DNA, 22 bp, Homo sapiens
acatttatgtacaaaatgaatt

SEQ ID NO: 6880437 - DNA, 18 bp, Homo sapiens
tgggccagtcctggttgt

SEQ ID NO: 6880438 - DNA, 18 bp, Homo sapiens
acgccaacttctcccacc

SEQ ID NO: 6880439 - DNA, 13 bp, Homo sapiens
caagctcctccct

SEQ ID NO: 6880440 - DNA, 18 bp, Homo sapiens
ccatgggcacctctgctg

SEQ ID NO: 6880441 - DNA, 13 bp, Homo sapiens
cttctacctgccc

SEQ ID NO: 6880442 - DNA, 19 bp, Homo sapiens
cgctgccaccacgtctgcc

SEQ ID NO: 6880443 - DNA, 16 bp, Homo sapiens
agcttagccttgtgcc

SEQ ID NO: 6880444 - DNA, 15 bp, Homo sapiens
tgacaagtgtctttt

SEQ ID NO: 6880445 - DNA, 19 bp, Homo sapiens
cctgctcatcacccttccg

SEQ ID NO: 6880446 - DNA, 20 bp, Homo sapiens
agagatctatgggcatttgg

SEQ ID NO: 6880447 - DNA, 16 bp, Homo sapiens
tcggttgttctttcct

SEQ ID NO: 6880448 - DNA, 13 bp, Homo sapiens
tcattttgcactg

SEQ ID NO: 6880449 - DNA, 20 bp, Homo sapiens
cggttgccactctcctcccc

SEQ ID NO: 6880450 - DNA, 13 bp, Homo sapiens
gactcttctctca

SEQ ID NO: 6880451 - DNA, 14 bp, Homo sapiens
cagtacagtcttat

SEQ ID NO: 6880452 - DNA, 15 bp, Homo sapiens
tttgcaggctggctt

SEQ ID NO: 6880453 - DNA, 11 bp, Homo sapiens
ctatgtttact

SEQ ID NO: 6880454 - DNA, 22 bp, Homo sapiens
ctccagctggaattgctgctct

SEQ ID NO: 6880455 - DNA, 21 bp, Homo sapiens
caagaagccctccttgccacc

SEQ ID NO: 6880456 - DNA, 14 bp, Homo sapiens
aggcccctgtgcag

SEQ ID NO: 6880457 - DNA, 23 bp, Homo sapiens
cacatgtggccatggcctctgca

SEQ ID NO: 6880458 - DNA, 13 bp, Homo sapiens
ttgcatttctgta

SEQ ID NO: 6880459 - DNA, 13 bp, Homo sapiens
atgaaatattttt

SEQ ID NO: 6880460 - DNA, 12 bp, Homo sapiens
gcacctgcctca

SEQ ID NO: 6880461 - DNA, 15 bp, Homo sapiens
cttctcgtgtttgct

SEQ ID NO: 6880462 - DNA, 21 bp, Homo sapiens
tggtttgttatcagtacaatt

SEQ ID NO: 6880463 - DNA, 23 bp, Homo sapiens
cttcccacagcctcttcctcccc

SEQ ID NO: 6880464 - DNA, 13 bp, Homo sapiens
cacacttctgggc

SEQ ID NO: 6880465 - DNA, 15 bp, Homo sapiens
agtcaccatgcaagg

SEQ ID NO: 6880466 - DNA, 15 bp, Homo sapiens
cttctggcctttcct

SEQ ID NO: 6880467 - DNA, 12 bp, Homo sapiens
gtaatggtgctt

SEQ ID NO: 6880468 - DNA, 14 bp, Homo sapiens
aaccttttttgtct

SEQ ID NO: 6880469 - DNA, 17 bp, Homo sapiens
gaaaacagtgaatctta

SEQ ID NO: 6880470 - DNA, 19 bp, Homo sapiens
ctcttcagtgactcctgct

SEQ ID NO: 6880471 - DNA, 21 bp, Homo sapiens
ccttctagttgcccccattcc

SEQ ID NO: 6880472 - DNA, 14 bp, Homo sapiens
cctcttctcttcct

SEQ ID NO: 6880473 - DNA, 17 bp, Homo sapiens
atattttgattattgta

SEQ ID NO: 6880474 - DNA, 15 bp, Homo sapiens
cgtgtgctcctctcc

SEQ ID NO: 6880475 - DNA, 16 bp, Homo sapiens
agcagtccccagctga

SEQ ID NO: 6880476 - DNA, 13 bp, Homo sapiens
actggcctctgcc

SEQ ID NO: 6880477 - DNA, 17 bp, Homo sapiens
atctgtttgttactgca

SEQ ID NO: 6880478 - DNA, 14 bp, Homo sapiens
actttccatgacag

SEQ ID NO: 6880479 - DNA, 19 bp, Homo sapiens
cattttcagtcttgtagtg

SEQ ID NO: 6880480 - DNA, 21 bp, Homo sapiens
ggccctgctgaagctgctgca

SEQ ID NO: 6880481 - DNA, 20 bp, Homo sapiens
ctattttaaaaccatgcagc

SEQ ID NO: 6880482 - DNA, 13 bp, Homo sapiens
ctcactcaggact

SEQ ID NO: 6880483 - DNA, 14 bp, Homo sapiens
cactctctgggact

SEQ ID NO: 6880484 - DNA, 13 bp, Homo sapiens
attgactcttgag

SEQ ID NO: 6880485 - DNA, 19 bp, Homo sapiens
cttcctggcctcactggct

SEQ ID NO: 6880486 - DNA, 12 bp, Homo sapiens
gccccaggccag

SEQ ID NO: 6880487 - DNA, 12 bp, Homo sapiens
cacagttgaccc

SEQ ID NO: 6880488 - DNA, 22 bp, Homo sapiens
ggactgaccaaagactgcagaa

SEQ ID NO: 6880489 - DNA, 16 bp, Homo sapiens
actactgcagtcttta

SEQ ID NO: 6880490 - DNA, 15 bp, Homo sapiens
cactgtgctgagtct

SEQ ID NO: 6880491 - DNA, 12 bp, Homo sapiens
tactctgagccc

SEQ ID NO: 6880492 - DNA, 20 bp, Homo sapiens
ctcaccctcataccatctgc

SEQ ID NO: 6880493 - DNA, 14 bp, Homo sapiens
tgctcatgctgctc

SEQ ID NO: 6880494 - DNA, 14 bp, Homo sapiens
tataaattatctga

SEQ ID NO: 6880495 - DNA, 13 bp, Homo sapiens
aaaattctagtct

SEQ ID NO: 6880496 - DNA, 16 bp, Homo sapiens
tcatagaaatacctca

SEQ ID NO: 6880497 - DNA, 14 bp, Homo sapiens
ggcgggggagccaa

SEQ ID NO: 6880498 - DNA, 22 bp, Homo sapiens
catctctctggggccctgggcc

SEQ ID NO: 6880499 - DNA, 17 bp, Homo sapiens
ctcaaggacaaagtctc

SEQ ID NO: 6880500 - DNA, 13 bp, Homo sapiens
agaccacctgcca

SEQ ID NO: 6880501 - DNA, 15 bp, Homo sapiens
agcactgcctcctgt

SEQ ID NO: 6880502 - DNA, 16 bp, Homo sapiens
gtcagcaggcccagga

SEQ ID NO: 6880503 - DNA, 14 bp, Homo sapiens
caaagccactggaa

SEQ ID NO: 6880504 - DNA, 22 bp, Homo sapiens
cagctccttgggaggaagcaga

SEQ ID NO: 6880505 - DNA, 19 bp, Homo sapiens
gtttcccatcccactgctc

SEQ ID NO: 6880506 - DNA, 12 bp, Homo sapiens
accaccctgcca

SEQ ID NO: 6880507 - DNA, 21 bp, Homo sapiens
ctcccatgtgtgatgctgaca

SEQ ID NO: 6880508 - DNA, 21 bp, Homo sapiens
acttcctggattttctttcta

SEQ ID NO: 6880509 - DNA, 20 bp, Homo sapiens
gtatttgcaaggctgattta

SEQ ID NO: 6880510 - DNA, 23 bp, Homo sapiens
agacttcaggttgttctgtataa

SEQ ID NO: 6880511 - DNA, 21 bp, Homo sapiens
ctgacggaagccaacttggct

SEQ ID NO: 6880512 - DNA, 17 bp, Homo sapiens
tcataagatattcttta

SEQ ID NO: 6880513 - DNA, 12 bp, Homo sapiens
cattgacttcat

SEQ ID NO: 6880514 - DNA, 15 bp, Homo sapiens
acacaccagtttaca

SEQ ID NO: 6880515 - DNA, 17 bp, Homo sapiens
gcctgctacacaggcag

SEQ ID NO: 6880516 - DNA, 13 bp, Homo sapiens
gcaaaccaacaag

SEQ ID NO: 6880517 - DNA, 14 bp, Homo sapiens
gccccccaccccag

SEQ ID NO: 6880518 - DNA, 15 bp, Homo sapiens
cattctcctgcctca

SEQ ID NO: 6880519 - DNA, 18 bp, Homo sapiens
gtgatcctaaatatgaca

SEQ ID NO: 6880520 - DNA, 15 bp, Homo sapiens
cttccatttctgcct

SEQ ID NO: 6880521 - DNA, 20 bp, Homo sapiens
cacccacaagtgccactgcc

SEQ ID NO: 6880522 - DNA, 23 bp, Homo sapiens
tccctcgacagcgcccctgctgt

SEQ ID NO: 6880523 - DNA, 21 bp, Homo sapiens
cctggcccagcggcccctccc

SEQ ID NO: 6880524 - DNA, 18 bp, Homo sapiens
atcatcaaggcactgcct

SEQ ID NO: 6880525 - DNA, 15 bp, Homo sapiens
acgtcaccctcctga

SEQ ID NO: 6880526 - DNA, 16 bp, Homo sapiens
ccgccaccctgtctca

SEQ ID NO: 6880527 - DNA, 18 bp, Homo sapiens
agctaccctcagcctcca

SEQ ID NO: 6880528 - DNA, 22 bp, Homo sapiens
gcctgccacctggacccctgca

SEQ ID NO: 6880529 - DNA, 17 bp, Homo sapiens
cttcctgccctgtacct

SEQ ID NO: 6880530 - DNA, 13 bp, Homo sapiens
gccaactgcctcc

SEQ ID NO: 6880531 - DNA, 13 bp, Homo sapiens
atgctgccctgtg

SEQ ID NO: 6880532 - DNA, 23 bp, Homo sapiens
cacttgtaggtttctctgcctcc

SEQ ID NO: 6880533 - DNA, 16 bp, Homo sapiens
cgtttttctcgtcccc

SEQ ID NO: 6880534 - DNA, 19 bp, Homo sapiens
ggcttctctccacagtgtt

SEQ ID NO: 6880535 - DNA, 18 bp, Homo sapiens
cgcttttgtgcctctcac

SEQ ID NO: 6880536 - DNA, 14 bp, Homo sapiens
gaatataaatgtgt

SEQ ID NO: 6880537 - DNA, 16 bp, Homo sapiens
taattttttggtacaa

SEQ ID NO: 6880538 - DNA, 20 bp, Homo sapiens
agatgcatttgggtccagga

SEQ ID NO: 6880539 - DNA, 17 bp, Homo sapiens
ctaattcagcatgtgtt

SEQ ID NO: 6880540 - DNA, 15 bp, Homo sapiens
gaaaatgtgaagctg

SEQ ID NO: 6880541 - DNA, 14 bp, Homo sapiens
cttttatatctgta

SEQ ID NO: 6880542 - DNA, 23 bp, Homo sapiens
ccagaggaatcctggcagcccag

SEQ ID NO: 6880543 - DNA, 12 bp, Homo sapiens
cctcctcctgcc

SEQ ID NO: 6880544 - DNA, 19 bp, Homo sapiens
gagcatccctaattcttca

SEQ ID NO: 6880545 - DNA, 11 bp, Homo sapiens
ccatgcactgt

SEQ ID NO: 6880546 - DNA, 16 bp, Homo sapiens
cccattgttcccttcc

SEQ ID NO: 6880547 - DNA, 15 bp, Homo sapiens
tcactctgttgctca

SEQ ID NO: 6880548 - DNA, 15 bp, Homo sapiens
aatttggagtaaata

SEQ ID NO: 6880549 - DNA, 13 bp, Homo sapiens
cccttctgctact

SEQ ID NO: 6880550 - DNA, 21 bp, Homo sapiens
cagctggtgtagctacagaga

SEQ ID NO: 6880551 - DNA, 13 bp, Homo sapiens
agcctgcaggcag

SEQ ID NO: 6880552 - DNA, 13 bp, Homo sapiens
ttacttttctgtt

SEQ ID NO: 6880553 - DNA, 18 bp, Homo sapiens
ctttctcttccccttcct

SEQ ID NO: 6880554 - DNA, 13 bp, Homo sapiens
agactcctcagga

SEQ ID NO: 6880555 - DNA, 21 bp, Homo sapiens
tccggaggggacccagctcct

SEQ ID NO: 6880556 - DNA, 14 bp, Homo sapiens
tgcacacacctgcc

SEQ ID NO: 6880557 - DNA, 16 bp, Homo sapiens
catgtgagctcttcct

SEQ ID NO: 6880558 - DNA, 14 bp, Homo sapiens
gacaggggctcagg

SEQ ID NO: 6880559 - DNA, 20 bp, Homo sapiens
attgttccaagacattgtca

SEQ ID NO: 6880560 - DNA, 17 bp, Homo sapiens
aaagggcagaaggggaa

SEQ ID NO: 6880561 - DNA, 21 bp, Homo sapiens
tgcccaggacggtctgtgccc

SEQ ID NO: 6880562 - DNA, 14 bp, Homo sapiens
ctttcacacttcca

SEQ ID NO: 6880563 - DNA, 17 bp, Homo sapiens
tcccaccaggctgctca

SEQ ID NO: 6880564 - DNA, 19 bp, Homo sapiens
tccccgcccgccctcctct

SEQ ID NO: 6880565 - DNA, 14 bp, Homo sapiens
gaagatctgattta

SEQ ID NO: 6880566 - DNA, 16 bp, Homo sapiens
taaatgtctgcactga

SEQ ID NO: 6880567 - DNA, 20 bp, Homo sapiens
ccacttcctttgtgtttata

SEQ ID NO: 6880568 - DNA, 20 bp, Homo sapiens
ggctcactgaaacctctgcc

SEQ ID NO: 6880569 - DNA, 15 bp, Homo sapiens
cattctgctctgccc

SEQ ID NO: 6880570 - DNA, 21 bp, Homo sapiens
tccctgttatttttctgccct

SEQ ID NO: 6880571 - DNA, 14 bp, Homo sapiens
cagagtctgtctct

SEQ ID NO: 6880572 - DNA, 21 bp, Homo sapiens
tcacctgctcccagtcctgcc

SEQ ID NO: 6880573 - DNA, 12 bp, Homo sapiens
gtaaagccatgc

SEQ ID NO: 6880574 - DNA, 16 bp, Homo sapiens
ctggaatttgggcaga

SEQ ID NO: 6880575 - DNA, 21 bp, Homo sapiens
caacgtgctgcttacactcca

SEQ ID NO: 6880576 - DNA, 14 bp, Homo sapiens
cctccagctttcct

SEQ ID NO: 6880577 - DNA, 12 bp, Homo sapiens
atgaccctgtgc

SEQ ID NO: 6880578 - DNA, 12 bp, Homo sapiens
cgtctcctccct

SEQ ID NO: 6880579 - DNA, 16 bp, Homo sapiens
tgcctccaccgctgcc

SEQ ID NO: 6880580 - DNA, 20 bp, Homo sapiens
ccagtatttttgctgcttct

SEQ ID NO: 6880581 - DNA, 21 bp, Homo sapiens
tgtgccatagtcacatggcct

SEQ ID NO: 6880582 - DNA, 18 bp, Homo sapiens
cgctgtgctgccctgccc

SEQ ID NO: 6880583 - DNA, 14 bp, Homo sapiens
cacaagctgcctct

SEQ ID NO: 6880584 - DNA, 17 bp, Homo sapiens
cttcatcgaatctacta

SEQ ID NO: 6880585 - DNA, 17 bp, Homo sapiens
cagctgcttctgcccac

SEQ ID NO: 6880586 - DNA, 21 bp, Homo sapiens
tgggcctggcggcctgtgggt

SEQ ID NO: 6880587 - DNA, 11 bp, Homo sapiens
ctcctgtgcct

SEQ ID NO: 6880588 - DNA, 14 bp, Homo sapiens
ttgaagtctgctca

SEQ ID NO: 6880589 - DNA, 18 bp, Homo sapiens
agtcccagcagccagcca

SEQ ID NO: 6880590 - DNA, 18 bp, Homo sapiens
ggactttcccacccagga

SEQ ID NO: 6880591 - DNA, 20 bp, Homo sapiens
ttcaagcgattctcctgcct

SEQ ID NO: 6880592 - DNA, 21 bp, Homo sapiens
aagtgtgtttccttcagtgca

SEQ ID NO: 6880593 - DNA, 12 bp, Homo sapiens
ctctctgtctgg

SEQ ID NO: 6880594 - DNA, 22 bp, Homo sapiens
ctgcaagggctccccactgcct

SEQ ID NO: 6880595 - DNA, 16 bp, Homo sapiens
ctcttcctaccctcct

SEQ ID NO: 6880596 - DNA, 20 bp, Homo sapiens
ctcacccggcctcttcgcct

SEQ ID NO: 6880597 - DNA, 23 bp, Homo sapiens
tgcctgccaaagtagtcctggca

SEQ ID NO: 6880598 - DNA, 21 bp, Homo sapiens
ccagggcattcgggccacagg

SEQ ID NO: 6880599 - DNA, 15 bp, Homo sapiens
ctgaaatccttgaga

SEQ ID NO: 6880600 - DNA, 20 bp, Homo sapiens
tatcgttattataaatgtta

SEQ ID NO: 6880601 - DNA, 21 bp, Homo sapiens
ctttatggttaatactattaa

SEQ ID NO: 6880602 - DNA, 13 bp, Homo sapiens
catataactgtga

SEQ ID NO: 6880603 - DNA, 20 bp, Homo sapiens
cctgtcccttttcccttaca

SEQ ID NO: 6880604 - DNA, 15 bp, Homo sapiens
ccaggggacagctgg

SEQ ID NO: 6880605 - DNA, 21 bp, Homo sapiens
tccaagggagggtgcagccct

SEQ ID NO: 6880606 - DNA, 17 bp, Homo sapiens
cactctcttccctttcc

SEQ ID NO: 6880607 - DNA, 13 bp, Homo sapiens
agagtcctctgaa

SEQ ID NO: 6880608 - DNA, 15 bp, Homo sapiens
caagaggtacagggt

SEQ ID NO: 6880609 - DNA, 15 bp, Homo sapiens
acatcagctgaattc

SEQ ID NO: 6880610 - DNA, 14 bp, Homo sapiens
aaggacacagcagt

SEQ ID NO: 6880611 - DNA, 13 bp, Homo sapiens
taactacatttat

SEQ ID NO: 6880612 - DNA, 12 bp, Homo sapiens
aaagcctagtcc

SEQ ID NO: 6880613 - DNA, 22 bp, Homo sapiens
ggaagcctcagattccttccca

SEQ ID NO: 6880614 - DNA, 18 bp, Homo sapiens
cccccgcatcccctgcct

SEQ ID NO: 6880615 - DNA, 14 bp, Homo sapiens
cccagcacctgcct

SEQ ID NO: 6880616 - DNA, 20 bp, Homo sapiens
tttcccagtgagcctctgcg

SEQ ID NO: 6880617 - DNA, 20 bp, Homo sapiens
attttgaaaggtcagaattt

SEQ ID NO: 6880618 - DNA, 14 bp, Homo sapiens
ccggtcccagtccg

SEQ ID NO: 6880619 - DNA, 16 bp, Homo sapiens
cctcgtggccagcccg

SEQ ID NO: 6880620 - DNA, 14 bp, Homo sapiens
ctattccctggaga

SEQ ID NO: 6880621 - DNA, 15 bp, Homo sapiens
ctgcgtcatggctca

SEQ ID NO: 6880622 - DNA, 23 bp, Homo sapiens
agcgaggtgtaaagttgttcgcc

SEQ ID NO: 6880623 - DNA, 15 bp, Homo sapiens
caggggcttggattt

SEQ ID NO: 6880624 - DNA, 14 bp, Homo sapiens
aattaaaaaccact

SEQ ID NO: 6880625 - DNA, 16 bp, Homo sapiens
tgggccaagccagctg

SEQ ID NO: 6880626 - DNA, 18 bp, Homo sapiens
gcatgggcattgcagcct

SEQ ID NO: 6880627 - DNA, 17 bp, Homo sapiens
aagtttttcatactgta

SEQ ID NO: 6880628 - DNA, 19 bp, Homo sapiens
tacaccactacattctgtt

SEQ ID NO: 6880629 - DNA, 16 bp, Homo sapiens
tccttccctctttccc

SEQ ID NO: 6880630 - DNA, 16 bp, Homo sapiens
tgcaacctctgcctcc

SEQ ID NO: 6880631 - DNA, 15 bp, Homo sapiens
atcttgattaatgta

SEQ ID NO: 6880632 - DNA, 16 bp, Homo sapiens
acatttaaagagattt

SEQ ID NO: 6880633 - DNA, 19 bp, Homo sapiens
tctgcgtggcgcaggtgcc

SEQ ID NO: 6880634 - DNA, 18 bp, Homo sapiens
tctgatgaaatgttaaca

SEQ ID NO: 6880635 - DNA, 13 bp, Homo sapiens
actgaacatgcct

SEQ ID NO: 6880636 - DNA, 16 bp, Homo sapiens
tacttcaaatgtcatt

SEQ ID NO: 6880637 - DNA, 13 bp, Homo sapiens
tgcccctgctgct

SEQ ID NO: 6880638 - DNA, 15 bp, Homo sapiens
gaacacccactggcc

SEQ ID NO: 6880639 - DNA, 16 bp, Homo sapiens
catctagcagtaaata

SEQ ID NO: 6880640 - DNA, 15 bp, Homo sapiens
caaaattctgttttg

SEQ ID NO: 6880641 - DNA, 16 bp, Homo sapiens
acacacggtgccttta

SEQ ID NO: 6880642 - DNA, 14 bp, Homo sapiens
agctgtctgtctct

SEQ ID NO: 6880643 - DNA, 20 bp, Homo sapiens
gggcagtgcttggcccagga

SEQ ID NO: 6880644 - DNA, 13 bp, Homo sapiens
ttctctgctccac

SEQ ID NO: 6880645 - DNA, 14 bp, Homo sapiens
cccgccctcttcct

SEQ ID NO: 6880646 - DNA, 14 bp, Homo sapiens
ctccccctcctgct

SEQ ID NO: 6880647 - DNA, 15 bp, Homo sapiens
ccctcccgccccttc

SEQ ID NO: 6880648 - DNA, 18 bp, Homo sapiens
tgtttggttatagtgcaa

SEQ ID NO: 6880649 - DNA, 20 bp, Homo sapiens
aaacttcctcaatgcattga

SEQ ID NO: 6880650 - DNA, 21 bp, Homo sapiens
ccttcgaggttgccccttccc

SEQ ID NO: 6880651 - DNA, 20 bp, Homo sapiens
cctggctaggactgtggagg

SEQ ID NO: 6880652 - DNA, 20 bp, Homo sapiens
agcgaccacccctgcctcca

SEQ ID NO: 6880653 - DNA, 11 bp, Homo sapiens
cacctgtgaga

SEQ ID NO: 6880654 - DNA, 13 bp, Homo sapiens
tggagaagccatt

SEQ ID NO: 6880655 - DNA, 15 bp, Homo sapiens
ctctccacctcagcc

SEQ ID NO: 6880656 - DNA, 17 bp, Homo sapiens
caagattgagctctctg

SEQ ID NO: 6880657 - DNA, 19 bp, Homo sapiens
atgtggccatggcctctgc

SEQ ID NO: 6880658 - DNA, 18 bp, Homo sapiens
ctttctttggtgcctttc

SEQ ID NO: 6880659 - DNA, 14 bp, Homo sapiens
tatatatatatgta

SEQ ID NO: 6880660 - DNA, 14 bp, Homo sapiens
cccagtttctgcct

SEQ ID NO: 6880661 - DNA, 20 bp, Homo sapiens
ggccgctctccccctgcagc

SEQ ID NO: 6880662 - DNA, 22 bp, Homo sapiens
gactggaggcccctggagccag

SEQ ID NO: 6880663 - DNA, 14 bp, Homo sapiens
cttcacctcctgcc

SEQ ID NO: 6880664 - DNA, 14 bp, Homo sapiens
cctgatctcttcct

SEQ ID NO: 6880665 - DNA, 15 bp, Homo sapiens
ccttagcccccaccc

SEQ ID NO: 6880666 - DNA, 17 bp, Homo sapiens
ctctgccattctgtgca

SEQ ID NO: 6880667 - DNA, 20 bp, Homo sapiens
caggcttttctcaggagctt

SEQ ID NO: 6880668 - DNA, 18 bp, Homo sapiens
tggcctgccttgaagcca

SEQ ID NO: 6880669 - DNA, 18 bp, Homo sapiens
ggagatcctaactgagaa

SEQ ID NO: 6880670 - DNA, 19 bp, Homo sapiens
ctgtatacaaacaggtgct

SEQ ID NO: 6880671 - DNA, 19 bp, Homo sapiens
gagttgatctggaacccag

SEQ ID NO: 6880672 - DNA, 16 bp, Homo sapiens
acgtgcacacacctgc

SEQ ID NO: 6880673 - DNA, 19 bp, Homo sapiens
cactttttccttactgtgc

SEQ ID NO: 6880674 - DNA, 14 bp, Homo sapiens
ggacagacccaggt

SEQ ID NO: 6880675 - DNA, 17 bp, Homo sapiens
tccagctttcctgtatt

SEQ ID NO: 6880676 - DNA, 17 bp, Homo sapiens
aggttctgggcctctga

SEQ ID NO: 6880677 - DNA, 18 bp, Homo sapiens
aggatatattttattttt

SEQ ID NO: 6880678 - DNA, 13 bp, Homo sapiens
aagttagttcagt

SEQ ID NO: 6880679 - DNA, 20 bp, Homo sapiens
aatgttggcaaatcacttca

SEQ ID NO: 6880680 - DNA, 11 bp, Homo sapiens
caaggcctccc

SEQ ID NO: 6880681 - DNA, 23 bp, Homo sapiens
taaatatcacagtattatctgtg

SEQ ID NO: 6880682 - DNA, 17 bp, Homo sapiens
ctcactgagcactgttt

SEQ ID NO: 6880683 - DNA, 17 bp, Homo sapiens
aggttgctggttgctgt

SEQ ID NO: 6880684 - DNA, 16 bp, Homo sapiens
cactcagagctgctga

SEQ ID NO: 6880685 - DNA, 13 bp, Homo sapiens
gcccagcccaggc

SEQ ID NO: 6880686 - DNA, 16 bp, Homo sapiens
cagaacttcatctgcc

SEQ ID NO: 6880687 - DNA, 20 bp, Homo sapiens
cacgtggactctgtgctcac

SEQ ID NO: 6880688 - DNA, 14 bp, Homo sapiens
tttgtaaacattta

SEQ ID NO: 6880689 - DNA, 18 bp, Homo sapiens
ccaggcccagccagttgg

SEQ ID NO: 6880690 - DNA, 14 bp, Homo sapiens
catgatgtactaaa

SEQ ID NO: 6880691 - DNA, 18 bp, Homo sapiens
tccctgttttctgagccc

SEQ ID NO: 6880692 - DNA, 18 bp, Homo sapiens
tgcccgcccacctctgct

SEQ ID NO: 6880693 - DNA, 13 bp, Homo sapiens
ctttccctacctt

SEQ ID NO: 6880694 - DNA, 14 bp, Homo sapiens
cttagctctgccct

SEQ ID NO: 6880695 - DNA, 18 bp, Homo sapiens
gcatccagtatcttgaag

SEQ ID NO: 6880696 - DNA, 21 bp, Homo sapiens
agccagggtgtggccctgcca

SEQ ID NO: 6880697 - DNA, 12 bp, Homo sapiens
aaaggatatttt

SEQ ID NO: 6880698 - DNA, 13 bp, Homo sapiens
ctcaccccatccc

SEQ ID NO: 6880699 - DNA, 12 bp, Homo sapiens
aggtaacagtta

SEQ ID NO: 6880700 - DNA, 12 bp, Homo sapiens
cattttggcgct

SEQ ID NO: 6880701 - DNA, 14 bp, Homo sapiens
ttggctctcccacc

SEQ ID NO: 6880702 - DNA, 17 bp, Homo sapiens
cctgtgcaatgcattag

SEQ ID NO: 6880703 - DNA, 17 bp, Homo sapiens
agctcctcctccctgca

SEQ ID NO: 6880704 - DNA, 17 bp, Homo sapiens
ccagagctggcgctcag

SEQ ID NO: 6880705 - DNA, 20 bp, Homo sapiens
aaagttaataacagctcctt

SEQ ID NO: 6880706 - DNA, 15 bp, Homo sapiens
agcagtggcaggcag

SEQ ID NO: 6880707 - DNA, 18 bp, Homo sapiens
cagccttccctctgcatt

SEQ ID NO: 6880708 - DNA, 23 bp, Homo sapiens
cctacgagggaggaacacctgat

SEQ ID NO: 6880709 - DNA, 20 bp, Homo sapiens
cacctcctcctgctgctcac

SEQ ID NO: 6880710 - DNA, 20 bp, Homo sapiens
ctcccctccaaaatgtgcct

SEQ ID NO: 6880711 - DNA, 22 bp, Homo sapiens
gctgtttactgcttttcattag

SEQ ID NO: 6880712 - DNA, 16 bp, Homo sapiens
ctccatggcccttcct

SEQ ID NO: 6880713 - DNA, 21 bp, Homo sapiens
cctgccagtgaagtccttcag

SEQ ID NO: 6880714 - DNA, 18 bp, Homo sapiens
cttccacccctctcctca

SEQ ID NO: 6880715 - DNA, 13 bp, Homo sapiens
ttccattgtttaa

SEQ ID NO: 6880716 - DNA, 13 bp, Homo sapiens
ccactctgcttct

SEQ ID NO: 6880717 - DNA, 14 bp, Homo sapiens
atgttttgctaatg

SEQ ID NO: 6880718 - DNA, 14 bp, Homo sapiens
gaaaaactgctgta

SEQ ID NO: 6880719 - DNA, 13 bp, Homo sapiens
aatctctgcctct

SEQ ID NO: 6880720 - DNA, 19 bp, Homo sapiens
ttaaaagaaatatacagtt

SEQ ID NO: 6880721 - DNA, 12 bp, Homo sapiens
atattttgctaa

SEQ ID NO: 6880722 - DNA, 13 bp, Homo sapiens
ccagccctgggaa

SEQ ID NO: 6880723 - DNA, 17 bp, Homo sapiens
gcctttttggcctgtga

SEQ ID NO: 6880724 - DNA, 16 bp, Homo sapiens
acacccacctgctgct

SEQ ID NO: 6880725 - DNA, 21 bp, Homo sapiens
ctgcacttggcctcttcggga

SEQ ID NO: 6880726 - DNA, 20 bp, Homo sapiens
agcagtgttgctcagctcct

SEQ ID NO: 6880727 - DNA, 23 bp, Homo sapiens
aacagggtccaggaatggtgctt

SEQ ID NO: 6880728 - DNA, 11 bp, Homo sapiens
ttgacatttaa

SEQ ID NO: 6880729 - DNA, 15 bp, Homo sapiens
caatcccctaacaca

SEQ ID NO: 6880730 - DNA, 13 bp, Homo sapiens
tccccctcccact

SEQ ID NO: 6880731 - DNA, 16 bp, Homo sapiens
ctttttaacattctca

SEQ ID NO: 6880732 - DNA, 15 bp, Homo sapiens
ccctccctctgctct

SEQ ID NO: 6880733 - DNA, 15 bp, Homo sapiens
gagtcatttctgatt

SEQ ID NO: 6880734 - DNA, 23 bp, Homo sapiens
cagctgtttggccaatgtgcata

SEQ ID NO: 6880735 - DNA, 20 bp, Homo sapiens
agacaggctgggtcctgcca

SEQ ID NO: 6880736 - DNA, 18 bp, Homo sapiens
agctcttggcccctgtgt

SEQ ID NO: 6880737 - DNA, 12 bp, Homo sapiens
ataaaactgtgt

SEQ ID NO: 6880738 - DNA, 13 bp, Homo sapiens
cttccatgtgcct

SEQ ID NO: 6880739 - DNA, 19 bp, Homo sapiens
ctgcctatatatgtaaata

SEQ ID NO: 6880740 - DNA, 19 bp, Homo sapiens
ccagggtgtggccctgcca

SEQ ID NO: 6880741 - DNA, 20 bp, Homo sapiens
tctattaaagtgactttcta

SEQ ID NO: 6880742 - DNA, 23 bp, Homo sapiens
cttccccctttctctgcctggca

SEQ ID NO: 6880743 - DNA, 18 bp, Homo sapiens
ctgctgggcgtctgttct

SEQ ID NO: 6880744 - DNA, 14 bp, Homo sapiens
cattcccccttcct

SEQ ID NO: 6880745 - DNA, 12 bp, Homo sapiens
accatctcttca

SEQ ID NO: 6880746 - DNA, 13 bp, Homo sapiens
ctgcgcctctcca

SEQ ID NO: 6880747 - DNA, 21 bp, Homo sapiens
tagacaagatattgtacataa

SEQ ID NO: 6880748 - DNA, 14 bp, Homo sapiens
ctgacaacatttct

SEQ ID NO: 6880749 - DNA, 16 bp, Homo sapiens
agcccggacctctgga

SEQ ID NO: 6880750 - DNA, 16 bp, Homo sapiens
gagctgagtcacctcc

SEQ ID NO: 6880751 - DNA, 18 bp, Homo sapiens
ctgcatcccgatacctca

SEQ ID NO: 6880752 - DNA, 13 bp, Homo sapiens
ccttgcctctgct

SEQ ID NO: 6880753 - DNA, 11 bp, Homo sapiens
gacctacctcc

SEQ ID NO: 6880754 - DNA, 17 bp, Homo sapiens
taccaaaatttgtgcac

SEQ ID NO: 6880755 - DNA, 16 bp, Homo sapiens
caaaagatgcttctca

SEQ ID NO: 6880756 - DNA, 13 bp, Homo sapiens
tcccagccatgcc

SEQ ID NO: 6880757 - DNA, 15 bp, Homo sapiens
tggggcctgggctgt

SEQ ID NO: 6880758 - DNA, 12 bp, Homo sapiens
agaccctctgcc

SEQ ID NO: 6880759 - DNA, 19 bp, Homo sapiens
cacaagccttactcacctc

SEQ ID NO: 6880760 - DNA, 23 bp, Homo sapiens
atgtgaagctatttgatatgcac

SEQ ID NO: 6880761 - DNA, 15 bp, Homo sapiens
ctgtcctcccatccc

SEQ ID NO: 6880762 - DNA, 17 bp, Homo sapiens
atggctttgtgctgctg

SEQ ID NO: 6880763 - DNA, 17 bp, Homo sapiens
ctaagcagcatttctga

SEQ ID NO: 6880764 - DNA, 13 bp, Homo sapiens
gtatcacagtgtt

SEQ ID NO: 6880765 - DNA, 14 bp, Homo sapiens
gggaaggatgggaa

SEQ ID NO: 6880766 - DNA, 12 bp, Homo sapiens
gttgctgcctca

SEQ ID NO: 6880767 - DNA, 15 bp, Homo sapiens
gaggaagggccagga

SEQ ID NO: 6880768 - DNA, 16 bp, Homo sapiens
gcctaactaactggca

SEQ ID NO: 6880769 - DNA, 17 bp, Homo sapiens
tgcctcccattctgacc

SEQ ID NO: 6880770 - DNA, 22 bp, Homo sapiens
ctcttgcccttcctactcctca

SEQ ID NO: 6880771 - DNA, 13 bp, Homo sapiens
cctcatctgtgcc

SEQ ID NO: 6880772 - DNA, 21 bp, Homo sapiens
agtgttgtgccccttcactca

SEQ ID NO: 6880773 - DNA, 18 bp, Homo sapiens
atcctcattgcctcctgt

SEQ ID NO: 6880774 - DNA, 22 bp, Homo sapiens
ctagaaaacgcgaccttggccg

SEQ ID NO: 6880775 - DNA, 14 bp, Homo sapiens
ctctcccctcctct

SEQ ID NO: 6880776 - DNA, 14 bp, Homo sapiens
cagaaccagcacta

SEQ ID NO: 6880777 - DNA, 21 bp, Homo sapiens
gccacccttggtctcatgccc

SEQ ID NO: 6880778 - DNA, 22 bp, Homo sapiens
ctcctgggccctctctgctctg

SEQ ID NO: 6880779 - DNA, 19 bp, Homo sapiens
tggggtggggggggtgctg

SEQ ID NO: 6880780 - DNA, 23 bp, Homo sapiens
tctgaacacacacgccagctcct

SEQ ID NO: 6880781 - DNA, 18 bp, Homo sapiens
atacttgtcaatatttaa

SEQ ID NO: 6880782 - DNA, 15 bp, Homo sapiens
ttaccctcctctgct

SEQ ID NO: 6880783 - DNA, 22 bp, Homo sapiens
tttcccaagctagactgtgtct

SEQ ID NO: 6880784 - DNA, 14 bp, Homo sapiens
atctgctcagccct

SEQ ID NO: 6880785 - DNA, 20 bp, Homo sapiens
cctgcaccctcttctcctct

SEQ ID NO: 6880786 - DNA, 13 bp, Homo sapiens
ctgcctcaggact

SEQ ID NO: 6880787 - DNA, 12 bp, Homo sapiens
tgctgctggcca

SEQ ID NO: 6880788 - DNA, 19 bp, Homo sapiens
aatgtttgcctctgcctct

SEQ ID NO: 6880789 - DNA, 14 bp, Homo sapiens
caaaaatctgcctg

SEQ ID NO: 6880790 - DNA, 11 bp, Homo sapiens
ttggcatttct

SEQ ID NO: 6880791 - DNA, 13 bp, Homo sapiens
acatcttacctct

SEQ ID NO: 6880792 - DNA, 12 bp, Homo sapiens
accccttcctcc

SEQ ID NO: 6880793 - DNA, 10 bp, Homo sapiens
ttctgtgtgg

SEQ ID NO: 6880794 - DNA, 19 bp, Homo sapiens
gcctcgcctgggcccaggc

SEQ ID NO: 6880795 - DNA, 16 bp, Homo sapiens
gccttctgcctgctga

SEQ ID NO: 6880796 - DNA, 18 bp, Homo sapiens
taaaagtttcaatgtgat

SEQ ID NO: 6880797 - DNA, 14 bp, Homo sapiens
ctcagttctgctct

SEQ ID NO: 6880798 - DNA, 18 bp, Homo sapiens
caccatggtgactgccac

SEQ ID NO: 6880799 - DNA, 17 bp, Homo sapiens
tgaattattgacactga

SEQ ID NO: 6880800 - DNA, 20 bp, Homo sapiens
ccttccccatgaaccctgcc

SEQ ID NO: 6880801 - DNA, 19 bp, Homo sapiens
gtgtagttaaggagcctaa

SEQ ID NO: 6880802 - DNA, 22 bp, Homo sapiens
tgcaaataaggacagcagctgg

SEQ ID NO: 6880803 - DNA, 22 bp, Homo sapiens
tactttgtgtcttttgttctct

SEQ ID NO: 6880804 - DNA, 21 bp, Homo sapiens
cgagcccagctacattcctca

SEQ ID NO: 6880805 - DNA, 17 bp, Homo sapiens
gagacatgagaaaggga

SEQ ID NO: 6880806 - DNA, 16 bp, Homo sapiens
atgtggtcacagctgt

SEQ ID NO: 6880807 - DNA, 16 bp, Homo sapiens
actctgtaaaagtgtc

SEQ ID NO: 6880808 - DNA, 13 bp, Homo sapiens
tctaagctgtgtg

SEQ ID NO: 6880809 - DNA, 14 bp, Homo sapiens
cgctttcccatctt

SEQ ID NO: 6880810 - DNA, 18 bp, Homo sapiens
gtccagtgctctgcctca

SEQ ID NO: 6880811 - DNA, 17 bp, Homo sapiens
caccagagcctccctca

SEQ ID NO: 6880812 - DNA, 16 bp, Homo sapiens
actgagcttctctgtg

SEQ ID NO: 6880813 - DNA, 20 bp, Homo sapiens
agacctggggctgctgtgaa

SEQ ID NO: 6880814 - DNA, 15 bp, Homo sapiens
cttcctgtcctgcct

SEQ ID NO: 6880815 - DNA, 12 bp, Homo sapiens
ctttgcttgctt

SEQ ID NO: 6880816 - DNA, 15 bp, Homo sapiens
atcattatttatgta

SEQ ID NO: 6880817 - DNA, 21 bp, Homo sapiens
ctcttctgcaagcctcatgcc

SEQ ID NO: 6880818 - DNA, 13 bp, Homo sapiens
ctggactgaggac

SEQ ID NO: 6880819 - DNA, 23 bp, Homo sapiens
ccaagtccaaatgtttacaggga

SEQ ID NO: 6880820 - DNA, 17 bp, Homo sapiens
ctcctccaggcctgcct

SEQ ID NO: 6880821 - DNA, 20 bp, Homo sapiens
ccctagctcctccccttcct

SEQ ID NO: 6880822 - DNA, 14 bp, Homo sapiens
ctgtatcactgcct

SEQ ID NO: 6880823 - DNA, 16 bp, Homo sapiens
atacctaagtactgta

SEQ ID NO: 6880824 - DNA, 14 bp, Homo sapiens
tgcttattgttcca

SEQ ID NO: 6880825 - DNA, 14 bp, Homo sapiens
agccctcaggccag

SEQ ID NO: 6880826 - DNA, 17 bp, Homo sapiens
tggcgccccctggtggg

SEQ ID NO: 6880827 - DNA, 15 bp, Homo sapiens
aacagcaaagccata

SEQ ID NO: 6880828 - DNA, 14 bp, Homo sapiens
catcccagcagccc

SEQ ID NO: 6880829 - DNA, 12 bp, Homo sapiens
catggtgaaatt

SEQ ID NO: 6880830 - DNA, 13 bp, Homo sapiens
aggatcctcctgg

SEQ ID NO: 6880831 - DNA, 19 bp, Homo sapiens
ctctccagcatcccagcct

SEQ ID NO: 6880832 - DNA, 21 bp, Homo sapiens
tgcagggcagtcattggctgt

SEQ ID NO: 6880833 - DNA, 15 bp, Homo sapiens
agtgtgtattgttcc

SEQ ID NO: 6880834 - DNA, 15 bp, Homo sapiens
ttgcatttatatgta

SEQ ID NO: 6880835 - DNA, 17 bp, Homo sapiens
agcacctcccagcccct

SEQ ID NO: 6880836 - DNA, 15 bp, Homo sapiens
tcttccacctgtgcc

SEQ ID NO: 6880837 - DNA, 15 bp, Homo sapiens
ttgccctcccatccc

SEQ ID NO: 6880838 - DNA, 17 bp, Homo sapiens
accagcactcagcctca

SEQ ID NO: 6880839 - DNA, 23 bp, Homo sapiens
gacctgaagagcgctcctctgcc

SEQ ID NO: 6880840 - DNA, 20 bp, Homo sapiens
cccttcttttgaccccttcc

SEQ ID NO: 6880841 - DNA, 11 bp, Homo sapiens
cttcatatcta

SEQ ID NO: 6880842 - DNA, 23 bp, Homo sapiens
tgcccactaggatcccactggcg

SEQ ID NO: 6880843 - DNA, 15 bp, Homo sapiens
actacagtttgttag

SEQ ID NO: 6880844 - DNA, 17 bp, Homo sapiens
tgtccccaccctccact

SEQ ID NO: 6880845 - DNA, 16 bp, Homo sapiens
cttgtcggctccagtc

SEQ ID NO: 6880846 - DNA, 22 bp, Homo sapiens
cctctgccggtcgggcagccag

SEQ ID NO: 6880847 - DNA, 17 bp, Homo sapiens
cctctccaggcatttag

SEQ ID NO: 6880848 - DNA, 17 bp, Homo sapiens
atggtctctctccctct

SEQ ID NO: 6880849 - DNA, 21 bp, Homo sapiens
ctccagctgtcgtctgactct

SEQ ID NO: 6880850 - DNA, 23 bp, Homo sapiens
gccaacgttcgatttctacctca

SEQ ID NO: 6880851 - DNA, 12 bp, Homo sapiens
ctcctctctgct

SEQ ID NO: 6880852 - DNA, 14 bp, Homo sapiens
tggggtatgtgtgt

SEQ ID NO: 6880853 - DNA, 15 bp, Homo sapiens
aaccaggacccaggg

SEQ ID NO: 6880854 - DNA, 20 bp, Homo sapiens
ctaccccagggccctggcca

SEQ ID NO: 6880855 - DNA, 13 bp, Homo sapiens
ctagagcagacag

SEQ ID NO: 6880856 - DNA, 15 bp, Homo sapiens
ctgggaatgggagag

SEQ ID NO: 6880857 - DNA, 17 bp, Homo sapiens
atgtactagtactgtgt

SEQ ID NO: 6880858 - DNA, 21 bp, Homo sapiens
gggagcctggagcccctgtgt

SEQ ID NO: 6880859 - DNA, 13 bp, Homo sapiens
ccaaataaattca

SEQ ID NO: 6880860 - DNA, 19 bp, Homo sapiens
ccagccccctccagctcat

SEQ ID NO: 6880861 - DNA, 23 bp, Homo sapiens
cactgccgtcacccactctgcac

SEQ ID NO: 6880862 - DNA, 21 bp, Homo sapiens
ccaggctagaatggaaaactg

SEQ ID NO: 6880863 - DNA, 17 bp, Homo sapiens
gtgattctcctgcctca

SEQ ID NO: 6880864 - DNA, 16 bp, Homo sapiens
attgcaacaatgcaaa

SEQ ID NO: 6880865 - DNA, 13 bp, Homo sapiens
acttgttcttggt

SEQ ID NO: 6880866 - DNA, 15 bp, Homo sapiens
tgcaaggcaaagtaa

SEQ ID NO: 6880867 - DNA, 18 bp, Homo sapiens
atttgacatgagtctcca

SEQ ID NO: 6880868 - DNA, 18 bp, Homo sapiens
ataagtggaggcacttta

SEQ ID NO: 6880869 - DNA, 17 bp, Homo sapiens
attctaccaagctgtca

SEQ ID NO: 6880870 - DNA, 14 bp, Homo sapiens
atgccagagggcca

SEQ ID NO: 6880871 - DNA, 16 bp, Homo sapiens
tgatgttttttctgta

SEQ ID NO: 6880872 - DNA, 16 bp, Homo sapiens
cagacacacacacgca

SEQ ID NO: 6880873 - DNA, 20 bp, Homo sapiens
caagtgctggcccacccagt

SEQ ID NO: 6880874 - DNA, 22 bp, Homo sapiens
ctgtagctttaaaaccacagct

SEQ ID NO: 6880875 - DNA, 21 bp, Homo sapiens
ctcctacctggggactcctca

SEQ ID NO: 6880876 - DNA, 22 bp, Homo sapiens
ctgccgagacagaccctctgcc

SEQ ID NO: 6880877 - DNA, 14 bp, Homo sapiens
gcctcactggctgg

SEQ ID NO: 6880878 - DNA, 15 bp, Homo sapiens
cttgcagaactgcca

SEQ ID NO: 6880879 - DNA, 15 bp, Homo sapiens
ctccttaaaaatgta

SEQ ID NO: 6880880 - DNA, 22 bp, Homo sapiens
tcttgataagaccaccacctca

SEQ ID NO: 6880881 - DNA, 15 bp, Homo sapiens
gattctcctgcctca

SEQ ID NO: 6880882 - DNA, 15 bp, Homo sapiens
tcttttgttactgtt

SEQ ID NO: 6880883 - DNA, 15 bp, Homo sapiens
gaaagacatcaatga

SEQ ID NO: 6880884 - DNA, 22 bp, Homo sapiens
gagggcttcctctagaagccaa

SEQ ID NO: 6880885 - DNA, 23 bp, Homo sapiens
agcacatcactgagaagatggca

SEQ ID NO: 6880886 - DNA, 19 bp, Homo sapiens
ccttccccctttctctgcc

SEQ ID NO: 6880887 - DNA, 21 bp, Homo sapiens
catgctcctctgcctgtgccc

SEQ ID NO: 6880888 - DNA, 17 bp, Homo sapiens
ctctcccaccccggcct

SEQ ID NO: 6880889 - DNA, 18 bp, Homo sapiens
ctcttgagttcctctgca

SEQ ID NO: 6880890 - DNA, 15 bp, Homo sapiens
cgttagccttcctct

SEQ ID NO: 6880891 - DNA, 14 bp, Homo sapiens
gccatgactgctca

SEQ ID NO: 6880892 - DNA, 22 bp, Homo sapiens
ccatgctcaccgccctgcttca

SEQ ID NO: 6880893 - DNA, 17 bp, Homo sapiens
ccatcagggccctgccc

SEQ ID NO: 6880894 - DNA, 20 bp, Homo sapiens
atatttcctttatgtgaatt

SEQ ID NO: 6880895 - DNA, 14 bp, Homo sapiens
agctgatggcagct

SEQ ID NO: 6880896 - DNA, 18 bp, Homo sapiens
cctctggtggctcctcct

SEQ ID NO: 6880897 - DNA, 19 bp, Homo sapiens
gggtccaggaatggtgctt

SEQ ID NO: 6880898 - DNA, 22 bp, Homo sapiens
agctgtactgagttctcatcca

SEQ ID NO: 6880899 - DNA, 19 bp, Homo sapiens
ttaacacctgatgtgtaca

SEQ ID NO: 6880900 - DNA, 16 bp, Homo sapiens
taatgttttaaatgta

SEQ ID NO: 6880901 - DNA, 19 bp, Homo sapiens
taacactgtgtacacctca

SEQ ID NO: 6880902 - DNA, 22 bp, Homo sapiens
ctttccccagcatcactcccca

SEQ ID NO: 6880903 - DNA, 13 bp, Homo sapiens
cattctcactcct

SEQ ID NO: 6880904 - DNA, 22 bp, Homo sapiens
agcttcctccagacccctgtgg

SEQ ID NO: 6880905 - DNA, 17 bp, Homo sapiens
gctaggccagagcccac

SEQ ID NO: 6880906 - DNA, 12 bp, Homo sapiens
gccaccacacac

SEQ ID NO: 6880907 - DNA, 20 bp, Homo sapiens
tgttcttgtaaaactgtgac

SEQ ID NO: 6880908 - DNA, 19 bp, Homo sapiens
tgatcctcccacctcagcc

SEQ ID NO: 6880909 - DNA, 16 bp, Homo sapiens
ataaacttaactttaa

SEQ ID NO: 6880910 - DNA, 22 bp, Homo sapiens
cttaggtcctcacttctgtctc

SEQ ID NO: 6880911 - DNA, 22 bp, Homo sapiens
caggaatggggggcgggccagg

SEQ ID NO: 6880912 - DNA, 15 bp, Homo sapiens
caggacccccttccc

SEQ ID NO: 6880913 - DNA, 16 bp, Homo sapiens
cctgcctatccatcct

SEQ ID NO: 6880914 - DNA, 21 bp, Homo sapiens
ttcaggaacctcgagtactgt

SEQ ID NO: 6880915 - DNA, 17 bp, Homo sapiens
cagttcaaatcctcacc

SEQ ID NO: 6880916 - DNA, 19 bp, Homo sapiens
tcccagccctacccttgtt

SEQ ID NO: 6880917 - DNA, 15 bp, Homo sapiens
catggtgatgcaagt

SEQ ID NO: 6880918 - DNA, 16 bp, Homo sapiens
cctcttgaccctgcac

SEQ ID NO: 6880919 - DNA, 17 bp, Homo sapiens
tcctctgagcagcctct

SEQ ID NO: 6880920 - DNA, 15 bp, Homo sapiens
cctccactccttcca

SEQ ID NO: 6880921 - DNA, 13 bp, Homo sapiens
atgtgtgccctgg

SEQ ID NO: 6880922 - DNA, 16 bp, Homo sapiens
gctatagttgcagccc

SEQ ID NO: 6880923 - DNA, 16 bp, Homo sapiens
cagctcctcccctgcc

SEQ ID NO: 6880924 - DNA, 20 bp, Homo sapiens
tagtgtgaatattcctttat

SEQ ID NO: 6880925 - DNA, 23 bp, Homo sapiens
gagagagggcgcccagcccaggc

SEQ ID NO: 6880926 - DNA, 21 bp, Homo sapiens
acctcacagtgacccttccca

SEQ ID NO: 6880927 - DNA, 17 bp, Homo sapiens
tgctgcccctccctgcc

SEQ ID NO: 6880928 - DNA, 14 bp, Homo sapiens
ctttatactgtgaa

SEQ ID NO: 6880929 - DNA, 16 bp, Homo sapiens
aatgtgacatttacac

SEQ ID NO: 6880930 - DNA, 15 bp, Homo sapiens
atttactagtagcca

SEQ ID NO: 6880931 - DNA, 22 bp, Homo sapiens
gatttataaagatttttgttaa

SEQ ID NO: 6880932 - DNA, 21 bp, Homo sapiens
tcaggtggtgtccttcttcct

SEQ ID NO: 6880933 - DNA, 17 bp, Homo sapiens
cccactcctcactgccc

SEQ ID NO: 6880934 - DNA, 16 bp, Homo sapiens
cactgaaacctctgtt

SEQ ID NO: 6880935 - DNA, 22 bp, Homo sapiens
gaccactcttggctattgaaga

SEQ ID NO: 6880936 - DNA, 18 bp, Homo sapiens
acctcactgtcagcgttt

SEQ ID NO: 6880937 - DNA, 16 bp, Homo sapiens
tgaagatacagtggag

SEQ ID NO: 6880938 - DNA, 18 bp, Homo sapiens
acattgtgttttcctaaa

SEQ ID NO: 6880939 - DNA, 14 bp, Homo sapiens
cacacacacagcca

SEQ ID NO: 6880940 - DNA, 20 bp, Homo sapiens
gagctagttggttgaatttt

SEQ ID NO: 6880941 - DNA, 21 bp, Homo sapiens
gctcttttattttcctgctgg

SEQ ID NO: 6880942 - DNA, 20 bp, Homo sapiens
agctctcaaatccctctcca

SEQ ID NO: 6880943 - DNA, 21 bp, Homo sapiens
tgaggctggcatcctggctgg

SEQ ID NO: 6880944 - DNA, 12 bp, Homo sapiens
cattttgcactg

SEQ ID NO: 6880945 - DNA, 13 bp, Homo sapiens
ggacctcctccct

SEQ ID NO: 6880946 - DNA, 16 bp, Homo sapiens
cttttgtgcccctgct

SEQ ID NO: 6880947 - DNA, 14 bp, Homo sapiens
cttctgcccttcct

SEQ ID NO: 6880948 - DNA, 20 bp, Homo sapiens
ccctgccccccagccctcct

SEQ ID NO: 6880949 - DNA, 23 bp, Homo sapiens
ctcctgggcccctccctacctca

SEQ ID NO: 6880950 - DNA, 22 bp, Homo sapiens
taatctgtcaaaacactgtgga

SEQ ID NO: 6880951 - DNA, 22 bp, Homo sapiens
tgttgataaattccactggact

SEQ ID NO: 6880952 - DNA, 18 bp, Homo sapiens
tgactactactctgccaa

SEQ ID NO: 6880953 - DNA, 23 bp, Homo sapiens
ctccagtccccagaactctgcct

SEQ ID NO: 6880954 - DNA, 14 bp, Homo sapiens
acattgctacctca

SEQ ID NO: 6880955 - DNA, 15 bp, Homo sapiens
catgagtgtctgtga

SEQ ID NO: 6880956 - DNA, 20 bp, Homo sapiens
aagttctatgaagagtatta

SEQ ID NO: 6880957 - DNA, 23 bp, Homo sapiens
ccctgcttgctggaaaactgcca

SEQ ID NO: 6880958 - DNA, 15 bp, Homo sapiens
ctgcagggactgcca

SEQ ID NO: 6880959 - DNA, 21 bp, Homo sapiens
actggcactgtggcactgcca

SEQ ID NO: 6880960 - DNA, 12 bp, Homo sapiens
ttctctgcctcc

SEQ ID NO: 6880961 - DNA, 16 bp, Homo sapiens
gtttgtaggctgtggg

SEQ ID NO: 6880962 - DNA, 12 bp, Homo sapiens
aacactgtggaa

SEQ ID NO: 6880963 - DNA, 20 bp, Homo sapiens
cctcttgagttcctctgcag

SEQ ID NO: 6880964 - DNA, 20 bp, Homo sapiens
cagaacccagggctctgccc

SEQ ID NO: 6880965 - DNA, 15 bp, Homo sapiens
ctttccaccccctcc

SEQ ID NO: 6880966 - DNA, 17 bp, Homo sapiens
agaacacccactggcca

SEQ ID NO: 6880967 - DNA, 12 bp, Homo sapiens
aattgcatttcc

SEQ ID NO: 6880968 - DNA, 20 bp, Homo sapiens
caatctttgaaagacttcca

SEQ ID NO: 6880969 - DNA, 11 bp, Homo sapiens
actctcaggga

SEQ ID NO: 6880970 - DNA, 17 bp, Homo sapiens
aaagtgccagcattcca

SEQ ID NO: 6880971 - DNA, 18 bp, Homo sapiens
actgcaggggccactcca

SEQ ID NO: 6880972 - DNA, 15 bp, Homo sapiens
accgtgcctggccag

SEQ ID NO: 6880973 - DNA, 19 bp, Homo sapiens
atttatgtaatgaagtaaa

SEQ ID NO: 6880974 - DNA, 19 bp, Homo sapiens
cacgcaccccgcccctgca

SEQ ID NO: 6880975 - DNA, 17 bp, Homo sapiens
actgaagcaacttgatg

SEQ ID NO: 6880976 - DNA, 18 bp, Homo sapiens
ttgcccctggctttgcct

SEQ ID NO: 6880977 - DNA, 20 bp, Homo sapiens
aggagcccctggacatgcct

SEQ ID NO: 6880978 - DNA, 21 bp, Homo sapiens
tgacaccatcttttattcttt

SEQ ID NO: 6880979 - DNA, 20 bp, Homo sapiens
catggtggcacacgcctgta

SEQ ID NO: 6880980 - DNA, 18 bp, Homo sapiens
tataaatactgcaaatca

SEQ ID NO: 6880981 - DNA, 15 bp, Homo sapiens
cctgccccccttccc

SEQ ID NO: 6880982 - DNA, 21 bp, Homo sapiens
ctcttcttggggcccagtgca

SEQ ID NO: 6880983 - DNA, 22 bp, Homo sapiens
ataactgatgagatacatttga

SEQ ID NO: 6880984 - DNA, 20 bp, Homo sapiens
ctgcacaataactcctccca

SEQ ID NO: 6880985 - DNA, 18 bp, Homo sapiens
tagtttcaaagtgtctca

SEQ ID NO: 6880986 - DNA, 15 bp, Homo sapiens
cctcctccccttcct

SEQ ID NO: 6880987 - DNA, 14 bp, Homo sapiens
taccggccactgca

SEQ ID NO: 6880988 - DNA, 17 bp, Homo sapiens
cactccctggccttgcc

SEQ ID NO: 6880989 - DNA, 20 bp, Homo sapiens
catattattttagtgtgtaa

SEQ ID NO: 6880990 - DNA, 19 bp, Homo sapiens
cttccagagctctgaccca

SEQ ID NO: 6880991 - DNA, 22 bp, Homo sapiens
tagacaagtaaaattatcctct

SEQ ID NO: 6880992 - DNA, 21 bp, Homo sapiens
aagaaagagaatgaactgtgg

SEQ ID NO: 6880993 - DNA, 16 bp, Homo sapiens
acaacttgtatttcca

SEQ ID NO: 6880994 - DNA, 16 bp, Homo sapiens
tccagaagctgctcct

SEQ ID NO: 6880995 - DNA, 16 bp, Homo sapiens
caatcctcctacctca

SEQ ID NO: 6880996 - DNA, 15 bp, Homo sapiens
gtaaatcacttgtaa

SEQ ID NO: 6880997 - DNA, 14 bp, Homo sapiens
acacattgccttct

SEQ ID NO: 6880998 - DNA, 13 bp, Homo sapiens
ggtccacccagga

SEQ ID NO: 6880999 - DNA, 16 bp, Homo sapiens
ccattctgctccttcc

SEQ ID NO: 6881000 - DNA, 21 bp, Homo sapiens
gcctcttcctccctccctgca

SEQ ID NO: 6881001 - DNA, 23 bp, Homo sapiens
accagtcagggacagcagcctcc

SEQ ID NO: 6881002 - DNA, 20 bp, Homo sapiens
cagtgccacttgacattcct

SEQ ID NO: 6881003 - DNA, 15 bp, Homo sapiens
cccgctgctgctgct

SEQ ID NO: 6881004 - DNA, 14 bp, Homo sapiens
ccgctccccagccc

SEQ ID NO: 6881005 - DNA, 16 bp, Homo sapiens
ccacaccctgcctgct

SEQ ID NO: 6881006 - DNA, 23 bp, Homo sapiens
gaagcacactctggtcttggaat

SEQ ID NO: 6881007 - DNA, 20 bp, Homo sapiens
taacttgaaaagattgcaaa

SEQ ID NO: 6881008 - DNA, 14 bp, Homo sapiens
agagctgcagccag

SEQ ID NO: 6881009 - DNA, 20 bp, Homo sapiens
agagggctacaaaggaggac

SEQ ID NO: 6881010 - DNA, 18 bp, Homo sapiens
gccttcgttaactgtgta

SEQ ID NO: 6881011 - DNA, 12 bp, Homo sapiens
aacttctcagtc

SEQ ID NO: 6881012 - DNA, 18 bp, Homo sapiens
ctttgcagacctgggact

SEQ ID NO: 6881013 - DNA, 17 bp, Homo sapiens
aggtgtgtactcagggc

SEQ ID NO: 6881014 - DNA, 14 bp, Homo sapiens
tcagtgcctgctgt

SEQ ID NO: 6881015 - DNA, 16 bp, Homo sapiens
ttgaatctgttactga

SEQ ID NO: 6881016 - DNA, 20 bp, Homo sapiens
atttcccaaagtcctctgct

SEQ ID NO: 6881017 - DNA, 16 bp, Homo sapiens
ccttgccgctgggaga

SEQ ID NO: 6881018 - DNA, 11 bp, Homo sapiens
aacctcaggga

SEQ ID NO: 6881019 - DNA, 19 bp, Homo sapiens
tttccaccaggccgtgcct

SEQ ID NO: 6881020 - DNA, 19 bp, Homo sapiens
tgctgtcctgatctgtgat

SEQ ID NO: 6881021 - DNA, 13 bp, Homo sapiens
aaaagtacattta

SEQ ID NO: 6881022 - DNA, 15 bp, Homo sapiens
cagttttgatattta

SEQ ID NO: 6881023 - DNA, 13 bp, Homo sapiens
tgtcccctctgtc

SEQ ID NO: 6881024 - DNA, 17 bp, Homo sapiens
agaccggcctgccagga

SEQ ID NO: 6881025 - DNA, 13 bp, Homo sapiens
aaacacactgtaa

SEQ ID NO: 6881026 - DNA, 20 bp, Homo sapiens
cagtcctcccctcacagcct

SEQ ID NO: 6881027 - DNA, 12 bp, Homo sapiens
cacccctctgcc

SEQ ID NO: 6881028 - DNA, 20 bp, Homo sapiens
tgaacctaggacttgagcct

SEQ ID NO: 6881029 - DNA, 20 bp, Homo sapiens
tctctgcgagcaacagtgcc

SEQ ID NO: 6881030 - DNA, 20 bp, Homo sapiens
cctgtccccctcccctccca

SEQ ID NO: 6881031 - DNA, 20 bp, Homo sapiens
cagtttataatagtaagccc

SEQ ID NO: 6881032 - DNA, 17 bp, Homo sapiens
cccccaacaccccgcct

SEQ ID NO: 6881033 - DNA, 16 bp, Homo sapiens
atcatgaaatatgcat

SEQ ID NO: 6881034 - DNA, 14 bp, Homo sapiens
ctggagttccttat

SEQ ID NO: 6881035 - DNA, 17 bp, Homo sapiens
ccaagactccagccctg

SEQ ID NO: 6881036 - DNA, 19 bp, Homo sapiens
catgtgggtgtcagtgtca

SEQ ID NO: 6881037 - DNA, 23 bp, Homo sapiens
ctctgccatcagcccctgctgct

SEQ ID NO: 6881038 - DNA, 19 bp, Homo sapiens
tcaggccaggtgcagtggc

SEQ ID NO: 6881039 - DNA, 18 bp, Homo sapiens
acctccaggggctcctgg

SEQ ID NO: 6881040 - DNA, 15 bp, Homo sapiens
gaaattctgaatttg

SEQ ID NO: 6881041 - DNA, 18 bp, Homo sapiens
gtaaaggtgatgaattta

SEQ ID NO: 6881042 - DNA, 22 bp, Homo sapiens
tgttgctgactactactctgcc

SEQ ID NO: 6881043 - DNA, 22 bp, Homo sapiens
cttcaggcccccgccttggcct

SEQ ID NO: 6881044 - DNA, 12 bp, Homo sapiens
caagccctgccc

SEQ ID NO: 6881045 - DNA, 17 bp, Homo sapiens
ttcagtcccctctctct

SEQ ID NO: 6881046 - DNA, 13 bp, Homo sapiens
aataaaatgtgat

SEQ ID NO: 6881047 - DNA, 18 bp, Homo sapiens
cccaaaggactccaccca

SEQ ID NO: 6881048 - DNA, 19 bp, Homo sapiens
cttttgaagtcttccctca

SEQ ID NO: 6881049 - DNA, 16 bp, Homo sapiens
gaagagccggagcctc

SEQ ID NO: 6881050 - DNA, 20 bp, Homo sapiens
acctgcacaaacatagacag

SEQ ID NO: 6881051 - DNA, 17 bp, Homo sapiens
catctattctctgcctt

SEQ ID NO: 6881052 - DNA, 23 bp, Homo sapiens
agctttccttctgcccttcctcc

SEQ ID NO: 6881053 - DNA, 21 bp, Homo sapiens
agacattttgtttttactgta

SEQ ID NO: 6881054 - DNA, 13 bp, Homo sapiens
tcactctgcctct

SEQ ID NO: 6881055 - DNA, 20 bp, Homo sapiens
actctaattagagaactgga

SEQ ID NO: 6881056 - DNA, 15 bp, Homo sapiens
gccaaggagctgcta

SEQ ID NO: 6881057 - DNA, 14 bp, Homo sapiens
gcccaagcccaggc

SEQ ID NO: 6881058 - DNA, 17 bp, Homo sapiens
aagatcatatacgtgaa

SEQ ID NO: 6881059 - DNA, 21 bp, Homo sapiens
tcctctggcccagcctaccct

SEQ ID NO: 6881060 - DNA, 12 bp, Homo sapiens
ccagcccagccc

SEQ ID NO: 6881061 - DNA, 24 bp, Homo sapiens
agctcagcagacatccacacacag

SEQ ID NO: 6881062 - DNA, 17 bp, Homo sapiens
ctgtctgagccctgccc

SEQ ID NO: 6881063 - DNA, 13 bp, Homo sapiens
aaggctctgtgct

SEQ ID NO: 6881064 - DNA, 16 bp, Homo sapiens
attcaaaagttccaag

SEQ ID NO: 6881065 - DNA, 16 bp, Homo sapiens
acttagtgatcattta

SEQ ID NO: 6881066 - DNA, 13 bp, Homo sapiens
cctcgctcctcct

SEQ ID NO: 6881067 - DNA, 19 bp, Homo sapiens
ttaaaatgtgaggcaataa

SEQ ID NO: 6881068 - DNA, 21 bp, Homo sapiens
ctctcctcaggaccctcagcc

SEQ ID NO: 6881069 - DNA, 17 bp, Homo sapiens
aatatagacagtgccct

SEQ ID NO: 6881070 - DNA, 19 bp, Homo sapiens
agccagcttcctgtgcaga

SEQ ID NO: 6881071 - DNA, 15 bp, Homo sapiens
cctacccctcttcca

SEQ ID NO: 6881072 - DNA, 22 bp, Homo sapiens
cttcccagagtcacaagtagcc

SEQ ID NO: 6881073 - DNA, 20 bp, Homo sapiens
ttagattattttatctggta

SEQ ID NO: 6881074 - DNA, 10 bp, Homo sapiens
gggcccaggc

SEQ ID NO: 6881075 - DNA, 11 bp, Homo sapiens
gagaagccatt

SEQ ID NO: 6881076 - DNA, 19 bp, Homo sapiens
agaaatatatcctgtgtac

SEQ ID NO: 6881077 - DNA, 20 bp, Homo sapiens
ctctttaatgctgtctttgt

SEQ ID NO: 6881078 - DNA, 19 bp, Homo sapiens
ccctccttctcccctgccg

SEQ ID NO: 6881079 - DNA, 19 bp, Homo sapiens
ctgaagccacacagcccag

SEQ ID NO: 6881080 - DNA, 15 bp, Homo sapiens
gtgttcctcctcccc

SEQ ID NO: 6881081 - DNA, 12 bp, Homo sapiens
cttcctccctcc

SEQ ID NO: 6881082 - DNA, 20 bp, Homo sapiens
ccatcatgtggccccaccca

SEQ ID NO: 6881083 - DNA, 18 bp, Homo sapiens
gggtcctctgcttcctga

SEQ ID NO: 6881084 - DNA, 17 bp, Homo sapiens
aaaaactcctgggctta

SEQ ID NO: 6881085 - DNA, 15 bp, Homo sapiens
tccggctcccagcct

SEQ ID NO: 6881086 - DNA, 13 bp, Homo sapiens
gctttgtctgtcc

SEQ ID NO: 6881087 - DNA, 13 bp, Homo sapiens
gcagcccagagag

SEQ ID NO: 6881088 - DNA, 17 bp, Homo sapiens
agtcttcagacccagag

SEQ ID NO: 6881089 - DNA, 17 bp, Homo sapiens
ccatcctttctgcctct

SEQ ID NO: 6881090 - DNA, 19 bp, Homo sapiens
ttaatgaaggtgtgctaca

SEQ ID NO: 6881091 - DNA, 16 bp, Homo sapiens
ctttcctatcacctcg

SEQ ID NO: 6881092 - DNA, 14 bp, Homo sapiens
cttcccactgtcct

SEQ ID NO: 6881093 - DNA, 12 bp, Homo sapiens
ctgtcatgtgtc

SEQ ID NO: 6881094 - DNA, 15 bp, Homo sapiens
tgcatggcatttgtt

SEQ ID NO: 6881095 - DNA, 14 bp, Homo sapiens
cttccgcccctgcc

SEQ ID NO: 6881096 - DNA, 13 bp, Homo sapiens
tctcccttgtcct

SEQ ID NO: 6881097 - DNA, 16 bp, Homo sapiens
acacactactacctct

SEQ ID NO: 6881098 - DNA, 22 bp, Homo sapiens
catgcctctggaggcctctggc

SEQ ID NO: 6881099 - DNA, 21 bp, Homo sapiens
tccaaggaaaccacagctgct

SEQ ID NO: 6881100 - DNA, 17 bp, Homo sapiens
ctttttattccctgccc

SEQ ID NO: 6881101 - DNA, 23 bp, Homo sapiens
ttccagaagaagagaagctgctg

SEQ ID NO: 6881102 - DNA, 20 bp, Homo sapiens
ggggaggctttgggagcaaa

SEQ ID NO: 6881103 - DNA, 21 bp, Homo sapiens
ggcaaggtttacactgcggaa

SEQ ID NO: 6881104 - DNA, 14 bp, Homo sapiens
ctgaaacactggac

SEQ ID NO: 6881105 - DNA, 23 bp, Homo sapiens
ccctgcctcctgccaccccttcc

SEQ ID NO: 6881106 - DNA, 14 bp, Homo sapiens
caacctctgcctcc

SEQ ID NO: 6881107 - DNA, 15 bp, Homo sapiens
caagctctgccctgg

SEQ ID NO: 6881108 - DNA, 18 bp, Homo sapiens
ctactagggacctgggga

SEQ ID NO: 6881109 - DNA, 23 bp, Homo sapiens
tactataagtagttggtttgtat

SEQ ID NO: 6881110 - DNA, 22 bp, Homo sapiens
tccagctctggcttcctgctga

SEQ ID NO: 6881111 - DNA, 14 bp, Homo sapiens
ggccatcctaccca

SEQ ID NO: 6881112 - DNA, 13 bp, Homo sapiens
cccaccagcttta

SEQ ID NO: 6881113 - DNA, 15 bp, Homo sapiens
cagttcatcttttta

SEQ ID NO: 6881114 - DNA, 22 bp, Homo sapiens
tagtcctgtgaatgccactgcc

SEQ ID NO: 6881115 - DNA, 15 bp, Homo sapiens
cctgccctcccaccc

SEQ ID NO: 6881116 - DNA, 20 bp, Homo sapiens
atcatctcctgccttcctcc

SEQ ID NO: 6881117 - DNA, 14 bp, Homo sapiens
ctgtactcctccca

SEQ ID NO: 6881118 - DNA, 14 bp, Homo sapiens
tgcctctcttgccc

SEQ ID NO: 6881119 - DNA, 13 bp, Homo sapiens
agttccctcctgc

SEQ ID NO: 6881120 - DNA, 15 bp, Homo sapiens
tgaagcaaaaactac

SEQ ID NO: 6881121 - DNA, 19 bp, Homo sapiens
agggaaactaagattcttt

SEQ ID NO: 6881122 - DNA, 17 bp, Homo sapiens
tgtcctttccatctgtc

SEQ ID NO: 6881123 - DNA, 21 bp, Homo sapiens
tggctcactgcaacttctgcc

SEQ ID NO: 6881124 - DNA, 16 bp, Homo sapiens
ctgttagctgctcact

SEQ ID NO: 6881125 - DNA, 21 bp, Homo sapiens
tctgggcaggactcagctccc

SEQ ID NO: 6881126 - DNA, 22 bp, Homo sapiens
tggagtttctctaaagtcacta

SEQ ID NO: 6881127 - DNA, 13 bp, Homo sapiens
cagaataaagcaa

SEQ ID NO: 6881128 - DNA, 14 bp, Homo sapiens
tatttcatgcgcac

SEQ ID NO: 6881129 - DNA, 15 bp, Homo sapiens
atcttctcagctccc

SEQ ID NO: 6881130 - DNA, 13 bp, Homo sapiens
cagctctcagcca

SEQ ID NO: 6881131 - DNA, 14 bp, Homo sapiens
tgccccgtctctgt

SEQ ID NO: 6881132 - DNA, 23 bp, Homo sapiens
ttcagctgaggtttgcacttcct

SEQ ID NO: 6881133 - DNA, 16 bp, Homo sapiens
agaaacctgtatcttt

SEQ ID NO: 6881134 - DNA, 17 bp, Homo sapiens
cttccatactgtttgcc

SEQ ID NO: 6881135 - DNA, 23 bp, Homo sapiens
acatgttaagataacttactgta

SEQ ID NO: 6881136 - DNA, 11 bp, Homo sapiens
tcacagctcac

SEQ ID NO: 6881137 - DNA, 17 bp, Homo sapiens
cctcccacccccatctc

SEQ ID NO: 6881138 - DNA, 23 bp, Homo sapiens
ctcttcaagctgtcccctctgtc

SEQ ID NO: 6881139 - DNA, 13 bp, Homo sapiens
tgcgggagccaga

SEQ ID NO: 6881140 - DNA, 14 bp, Homo sapiens
gtttgttactttga

SEQ ID NO: 6881141 - DNA, 16 bp, Homo sapiens
gtagggaagttttatg

SEQ ID NO: 6881142 - DNA, 19 bp, Homo sapiens
tgcccctggccctgcctca

SEQ ID NO: 6881143 - DNA, 18 bp, Homo sapiens
ttcatactctgttgcctc

SEQ ID NO: 6881144 - DNA, 23 bp, Homo sapiens
accttccatctcaacctacctcg

SEQ ID NO: 6881145 - DNA, 14 bp, Homo sapiens
ccactccctgtcca

SEQ ID NO: 6881146 - DNA, 19 bp, Homo sapiens
caaagaaacaagctgtgca

SEQ ID NO: 6881147 - DNA, 19 bp, Homo sapiens
tacgggcgctgcagcctcc

SEQ ID NO: 6881148 - DNA, 19 bp, Homo sapiens
ttcacttcataatccagta

SEQ ID NO: 6881149 - DNA, 17 bp, Homo sapiens
ctctggtcgctcctgcc

SEQ ID NO: 6881150 - DNA, 15 bp, Homo sapiens
tccagccctggctga

SEQ ID NO: 6881151 - DNA, 17 bp, Homo sapiens
tcgggtgaatctgtcta

SEQ ID NO: 6881152 - DNA, 17 bp, Homo sapiens
cctgcaaactcactgct

SEQ ID NO: 6881153 - DNA, 15 bp, Homo sapiens
tgtcactctgcctct

SEQ ID NO: 6881154 - DNA, 20 bp, Homo sapiens
cttttctcctactcttgggt

SEQ ID NO: 6881155 - DNA, 14 bp, Homo sapiens
tgttcttgctgcta

SEQ ID NO: 6881156 - DNA, 17 bp, Homo sapiens
tgccttttgctgctgct

SEQ ID NO: 6881157 - DNA, 13 bp, Homo sapiens
acggtcagtttgg

SEQ ID NO: 6881158 - DNA, 13 bp, Homo sapiens
agtaccctgcagg

SEQ ID NO: 6881159 - DNA, 19 bp, Homo sapiens
cagatcatttcaaaactca

SEQ ID NO: 6881160 - DNA, 20 bp, Homo sapiens
gaatatcagaatatgattca

SEQ ID NO: 6881161 - DNA, 16 bp, Homo sapiens
gcacaggcctctgcct

SEQ ID NO: 6881162 - DNA, 18 bp, Homo sapiens
tgataggcagcactgaaa

SEQ ID NO: 6881163 - DNA, 13 bp, Homo sapiens
accctgttgctac

SEQ ID NO: 6881164 - DNA, 20 bp, Homo sapiens
cagggagaaaatccaggtca

SEQ ID NO: 6881165 - DNA, 23 bp, Homo sapiens
tccagagacctgctccagatcct

SEQ ID NO: 6881166 - DNA, 18 bp, Homo sapiens
tactaagcactgtgttta

SEQ ID NO: 6881167 - DNA, 14 bp, Homo sapiens
cttcacctccttct

SEQ ID NO: 6881168 - DNA, 15 bp, Homo sapiens
atcatagttactgtg

SEQ ID NO: 6881169 - DNA, 17 bp, Homo sapiens
cagccacacacacagaa

SEQ ID NO: 6881170 - DNA, 13 bp, Homo sapiens
cctccctcttcct

SEQ ID NO: 6881171 - DNA, 17 bp, Homo sapiens
cgtcttcctctctctca

SEQ ID NO: 6881172 - DNA, 12 bp, Homo sapiens
ctctcccctgcc

SEQ ID NO: 6881173 - DNA, 18 bp, Homo sapiens
gctgccagcgtctgttgt

SEQ ID NO: 6881174 - DNA, 13 bp, Homo sapiens
agctacattcctc

SEQ ID NO: 6881175 - DNA, 12 bp, Homo sapiens
ttacctccctcg

SEQ ID NO: 6881176 - DNA, 15 bp, Homo sapiens
taaattatgagattt

SEQ ID NO: 6881177 - DNA, 15 bp, Homo sapiens
accataaagccttta

SEQ ID NO: 6881178 - DNA, 19 bp, Homo sapiens
tccagcccatgctggctgg

SEQ ID NO: 6881179 - DNA, 18 bp, Homo sapiens
ctttctagttcagctgcc

SEQ ID NO: 6881180 - DNA, 22 bp, Homo sapiens
tggcaggtcactgtcactgccg

SEQ ID NO: 6881181 - DNA, 12 bp, Homo sapiens
atgctgtgaata

SEQ ID NO: 6881182 - DNA, 15 bp, Homo sapiens
gagcctgcggctgct

SEQ ID NO: 6881183 - DNA, 21 bp, Homo sapiens
taactcttagaagtgttgtaa

SEQ ID NO: 6881184 - DNA, 12 bp, Homo sapiens
gctaactggtta

SEQ ID NO: 6881185 - DNA, 17 bp, Homo sapiens
ctgggcccgctttgcct

SEQ ID NO: 6881186 - DNA, 14 bp, Homo sapiens
cagctttgctgctg

SEQ ID NO: 6881187 - DNA, 16 bp, Homo sapiens
cgctgtcccaggcatg

SEQ ID NO: 6881188 - DNA, 17 bp, Homo sapiens
tccacgtgtggcctccg

SEQ ID NO: 6881189 - DNA, 17 bp, Homo sapiens
tgttctcacactggtct

SEQ ID NO: 6881190 - DNA, 15 bp, Homo sapiens
ccttctccccttcct

SEQ ID NO: 6881191 - DNA, 21 bp, Homo sapiens
acccaccaggccagctcagga

SEQ ID NO: 6881192 - DNA, 21 bp, Homo sapiens
ccctgtgatggggccctgcct

SEQ ID NO: 6881193 - DNA, 19 bp, Homo sapiens
cctttctttgctgtttgca

SEQ ID NO: 6881194 - DNA, 15 bp, Homo sapiens
agaaaacatcactga

SEQ ID NO: 6881195 - DNA, 15 bp, Homo sapiens
gcacagagttgttac

SEQ ID NO: 6881196 - DNA, 16 bp, Homo sapiens
ccactgaatctgtaca

SEQ ID NO: 6881197 - DNA, 15 bp, Homo sapiens
ggtctatacattcct

SEQ ID NO: 6881198 - DNA, 23 bp, Homo sapiens
ctatttatttgaggtcagtgttt

SEQ ID NO: 6881199 - DNA, 18 bp, Homo sapiens
gcttggcgatgccagcca

SEQ ID NO: 6881200 - DNA, 21 bp, Homo sapiens
catgacacccgtgagcgcctg

SEQ ID NO: 6881201 - DNA, 12 bp, Homo sapiens
cccttccctgct

SEQ ID NO: 6881202 - DNA, 18 bp, Homo sapiens
ccaaccccccagcactga

SEQ ID NO: 6881203 - DNA, 15 bp, Homo sapiens
aaataagtgaatcta

SEQ ID NO: 6881204 - DNA, 21 bp, Homo sapiens
cacgccggggctggccctgcc

SEQ ID NO: 6881205 - DNA, 19 bp, Homo sapiens
ctcttcccaagtcctcgcc

SEQ ID NO: 6881206 - DNA, 16 bp, Homo sapiens
atgcctgcactgggaa

SEQ ID NO: 6881207 - DNA, 15 bp, Homo sapiens
gaactttctccctca

SEQ ID NO: 6881208 - DNA, 17 bp, Homo sapiens
tctagctttgttgtcct

SEQ ID NO: 6881209 - DNA, 17 bp, Homo sapiens
cttctcagtttctgcct

SEQ ID NO: 6881210 - DNA, 16 bp, Homo sapiens
acaaaatacattcttt

SEQ ID NO: 6881211 - DNA, 15 bp, Homo sapiens
gtttctaaagctgcc

SEQ ID NO: 6881212 - DNA, 18 bp, Homo sapiens
ctgcctagctcttgggcc

SEQ ID NO: 6881213 - DNA, 15 bp, Homo sapiens
ttgcggaagccatag

SEQ ID NO: 6881214 - DNA, 22 bp, Homo sapiens
cactcacacaggacccccttcc

SEQ ID NO: 6881215 - DNA, 14 bp, Homo sapiens
ccaggagcagctgg

SEQ ID NO: 6881216 - DNA, 16 bp, Homo sapiens
ccctgcacctgcttct

SEQ ID NO: 6881217 - DNA, 15 bp, Homo sapiens
tgtatatacatatta

SEQ ID NO: 6881218 - DNA, 14 bp, Homo sapiens
gtactgtgttttta

SEQ ID NO: 6881219 - DNA, 13 bp, Homo sapiens
ccctccccctcct

SEQ ID NO: 6881220 - DNA, 13 bp, Homo sapiens
cactccccttgcc

SEQ ID NO: 6881221 - DNA, 14 bp, Homo sapiens
ctgcagtggctccc

SEQ ID NO: 6881222 - DNA, 22 bp, Homo sapiens
gaagtttacatttttatttatg

SEQ ID NO: 6881223 - DNA, 15 bp, Homo sapiens
ccgtggactcttcct

SEQ ID NO: 6881224 - DNA, 15 bp, Homo sapiens
cactgaggagacaga

SEQ ID NO: 6881225 - DNA, 18 bp, Homo sapiens
cactttttaacattctca

SEQ ID NO: 6881226 - DNA, 12 bp, Homo sapiens
cctttgcattca

SEQ ID NO: 6881227 - DNA, 20 bp, Homo sapiens
cctccccaaggccccctgcc

SEQ ID NO: 6881228 - DNA, 12 bp, Homo sapiens
acacacactcct

SEQ ID NO: 6881229 - DNA, 19 bp, Homo sapiens
caaaaataaaaaatctgaa

SEQ ID NO: 6881230 - DNA, 22 bp, Homo sapiens
ctgtggcgagccatttgtccca

SEQ ID NO: 6881231 - DNA, 17 bp, Homo sapiens
agaatctgctgttgcca

SEQ ID NO: 6881232 - DNA, 17 bp, Homo sapiens
catttcttttcttttta

SEQ ID NO: 6881233 - DNA, 22 bp, Homo sapiens
agattccacacaaaatgtcaca

SEQ ID NO: 6881234 - DNA, 16 bp, Homo sapiens
ctgtgctactttgcct

SEQ ID NO: 6881235 - DNA, 14 bp, Homo sapiens
acgtatgtatttca

SEQ ID NO: 6881236 - DNA, 13 bp, Homo sapiens
caatatcctaata

SEQ ID NO: 6881237 - DNA, 13 bp, Homo sapiens
caacctctgcctc

SEQ ID NO: 6881238 - DNA, 18 bp, Homo sapiens
agagttgacccctcctga

SEQ ID NO: 6881239 - DNA, 14 bp, Homo sapiens
cagctgcctctgct

SEQ ID NO: 6881240 - DNA, 23 bp, Homo sapiens
cctttgtggccttcccccttcct

SEQ ID NO: 6881241 - DNA, 19 bp, Homo sapiens
ctaaaggtccacaggtcta

SEQ ID NO: 6881242 - DNA, 18 bp, Homo sapiens
cacccggcattctctgcc

SEQ ID NO: 6881243 - DNA, 21 bp, Homo sapiens
acatgtttacttttcagggca

SEQ ID NO: 6881244 - DNA, 14 bp, Homo sapiens
ccctgtgccccgcc

SEQ ID NO: 6881245 - DNA, 14 bp, Homo sapiens
cctctcccccttca

SEQ ID NO: 6881246 - DNA, 16 bp, Homo sapiens
cctttgcctctgtcct

SEQ ID NO: 6881247 - DNA, 21 bp, Homo sapiens
cttccaggtccaaacccttca

SEQ ID NO: 6881248 - DNA, 15 bp, Homo sapiens
cagacttggcctcca

SEQ ID NO: 6881249 - DNA, 16 bp, Homo sapiens
cttggctgctcttcca

SEQ ID NO: 6881250 - DNA, 13 bp, Homo sapiens
cccactctgctct

SEQ ID NO: 6881251 - DNA, 21 bp, Homo sapiens
tcccttaactctaaccctgtg

SEQ ID NO: 6881252 - DNA, 22 bp, Homo sapiens
tcatagcccagtagaccttgtt

SEQ ID NO: 6881253 - DNA, 20 bp, Homo sapiens
gaggacagtgctgaccccag

SEQ ID NO: 6881254 - DNA, 14 bp, Homo sapiens
ctcccacactgcta

SEQ ID NO: 6881255 - DNA, 22 bp, Homo sapiens
ctttattgtccaccatgctctc

SEQ ID NO: 6881256 - DNA, 18 bp, Homo sapiens
ccctcctcgtcccctgcc

SEQ ID NO: 6881257 - DNA, 16 bp, Homo sapiens
agattgattgtattgt

SEQ ID NO: 6881258 - DNA, 20 bp, Homo sapiens
ctcaggtaatcgacctgcct

SEQ ID NO: 6881259 - DNA, 15 bp, Homo sapiens
agcagaaagtgcctt

SEQ ID NO: 6881260 - DNA, 12 bp, Homo sapiens
cacttgtacaaa

SEQ ID NO: 6881261 - DNA, 16 bp, Homo sapiens
cattgccaagtgccat

SEQ ID NO: 6881262 - DNA, 13 bp, Homo sapiens
cctattgctgcta

SEQ ID NO: 6881263 - DNA, 21 bp, Homo sapiens
tccaagcagactccagcccct

SEQ ID NO: 6881264 - DNA, 16 bp, Homo sapiens
ctctctgcatctgacc

SEQ ID NO: 6881265 - DNA, 17 bp, Homo sapiens
caactgtggataaattt

SEQ ID NO: 6881266 - DNA, 14 bp, Homo sapiens
aagatgacctgccc

SEQ ID NO: 6881267 - DNA, 15 bp, Homo sapiens
tttctttttactgtt

SEQ ID NO: 6881268 - DNA, 15 bp, Homo sapiens
cctctcgccccatcc

SEQ ID NO: 6881269 - DNA, 15 bp, Homo sapiens
agcatggagacagca

SEQ ID NO: 6881270 - DNA, 22 bp, Homo sapiens
gaaacattttttcttctgaaga

SEQ ID NO: 6881271 - DNA, 14 bp, Homo sapiens
tctggcctcccacc

SEQ ID NO: 6881272 - DNA, 12 bp, Homo sapiens
aaatctgaagag

SEQ ID NO: 6881273 - DNA, 20 bp, Homo sapiens
cagcagccccgtctgcccac

SEQ ID NO: 6881274 - DNA, 19 bp, Homo sapiens
ccttctgctgcccaggcca

SEQ ID NO: 6881275 - DNA, 18 bp, Homo sapiens
ccctcctctgccccctcc

SEQ ID NO: 6881276 - DNA, 23 bp, Homo sapiens
aagccagttggcttctgtgcctg

SEQ ID NO: 6881277 - DNA, 17 bp, Homo sapiens
ctggttccctctttcct

SEQ ID NO: 6881278 - DNA, 22 bp, Homo sapiens
actgcccagccccttttctctg

SEQ ID NO: 6881279 - DNA, 23 bp, Homo sapiens
gctttcagggcagcccctgcaga

SEQ ID NO: 6881280 - DNA, 19 bp, Homo sapiens
cagttgggaagtctcagcc

SEQ ID NO: 6881281 - DNA, 17 bp, Homo sapiens
tatttactgactgctta

SEQ ID NO: 6881282 - DNA, 17 bp, Homo sapiens
caacaccatgattcctt

SEQ ID NO: 6881283 - DNA, 15 bp, Homo sapiens
actttttaaaatgtt

SEQ ID NO: 6881284 - DNA, 12 bp, Homo sapiens
ctcatctgtctc

SEQ ID NO: 6881285 - DNA, 19 bp, Homo sapiens
acatgtgtacatatatgta

SEQ ID NO: 6881286 - DNA, 20 bp, Homo sapiens
caagatggcgaccaccaaag

SEQ ID NO: 6881287 - DNA, 16 bp, Homo sapiens
cagagggaccagctgg

SEQ ID NO: 6881288 - DNA, 16 bp, Homo sapiens
acctccgcccctgccc

SEQ ID NO: 6881289 - DNA, 15 bp, Homo sapiens
gacgttttctccgca

SEQ ID NO: 6881290 - DNA, 15 bp, Homo sapiens
ttcagggtgatgcca

SEQ ID NO: 6881291 - DNA, 18 bp, Homo sapiens
tcaccaggtgcatctgca

SEQ ID NO: 6881292 - DNA, 17 bp, Homo sapiens
tgtgtcaagacatttct

SEQ ID NO: 6881293 - DNA, 20 bp, Homo sapiens
catatatagacagctttgac

SEQ ID NO: 6881294 - DNA, 15 bp, Homo sapiens
ctgttttctccctct

SEQ ID NO: 6881295 - DNA, 12 bp, Homo sapiens
cttccagagccc

SEQ ID NO: 6881296 - DNA, 16 bp, Homo sapiens
gcatctgatttgcata

SEQ ID NO: 6881297 - DNA, 12 bp, Homo sapiens
ccacccctgcct

SEQ ID NO: 6881298 - DNA, 23 bp, Homo sapiens
tttcccccagcaacgcccctcca

SEQ ID NO: 6881299 - DNA, 15 bp, Homo sapiens
tcaattagtacagta

SEQ ID NO: 6881300 - DNA, 23 bp, Homo sapiens
agtgcaataaatctgacccagtg

SEQ ID NO: 6881301 - DNA, 17 bp, Homo sapiens
cctgtgggactcatcct

SEQ ID NO: 6881302 - DNA, 17 bp, Homo sapiens
agctggtaaaaatgaca

SEQ ID NO: 6881303 - DNA, 17 bp, Homo sapiens
attatttttaatatgta

SEQ ID NO: 6881304 - DNA, 15 bp, Homo sapiens
ccacttgacattcct

SEQ ID NO: 6881305 - DNA, 22 bp, Homo sapiens
ctttggaaccagactcttgcct

SEQ ID NO: 6881306 - DNA, 14 bp, Homo sapiens
ccttctgccctcct

SEQ ID NO: 6881307 - DNA, 22 bp, Homo sapiens
gccatggactctacactgtgaa

SEQ ID NO: 6881308 - DNA, 18 bp, Homo sapiens
ctctgccctccctggcct

SEQ ID NO: 6881309 - DNA, 15 bp, Homo sapiens
aattgtgtaactgtt

SEQ ID NO: 6881310 - DNA, 20 bp, Homo sapiens
gagtccagcccctcctccct

SEQ ID NO: 6881311 - DNA, 17 bp, Homo sapiens
catctcaacctacctcg

SEQ ID NO: 6881312 - DNA, 13 bp, Homo sapiens
ccaattaaattta

SEQ ID NO: 6881313 - DNA, 22 bp, Homo sapiens
tcacatgctccttgcctctgct

SEQ ID NO: 6881314 - DNA, 19 bp, Homo sapiens
ctgagggtccacctggaga

SEQ ID NO: 6881315 - DNA, 14 bp, Homo sapiens
ctcaacaccctgct

SEQ ID NO: 6881316 - DNA, 16 bp, Homo sapiens
agtgaaggaagaacct

SEQ ID NO: 6881317 - DNA, 15 bp, Homo sapiens
cacgccggcctctgc

SEQ ID NO: 6881318 - DNA, 17 bp, Homo sapiens
agttcctgctgcctgca

SEQ ID NO: 6881319 - DNA, 15 bp, Homo sapiens
ctttccttccttccc

SEQ ID NO: 6881320 - DNA, 20 bp, Homo sapiens
ctcccagaggctcctggagc

SEQ ID NO: 6881321 - DNA, 18 bp, Homo sapiens
ctatctttgccaccctca

SEQ ID NO: 6881322 - DNA, 23 bp, Homo sapiens
ctctgtaaccacctctctgtctt

SEQ ID NO: 6881323 - DNA, 19 bp, Homo sapiens
ccaggatcactctctgctg

SEQ ID NO: 6881324 - DNA, 16 bp, Homo sapiens
tctccccctgttcaca

SEQ ID NO: 6881325 - DNA, 16 bp, Homo sapiens
gagatcacaccactgc

SEQ ID NO: 6881326 - DNA, 19 bp, Homo sapiens
ctctactaaggctttccta

SEQ ID NO: 6881327 - DNA, 13 bp, Homo sapiens
ctcatgcctgaga

SEQ ID NO: 6881328 - DNA, 18 bp, Homo sapiens
accccataagccctgaga

SEQ ID NO: 6881329 - DNA, 17 bp, Homo sapiens
ccttttcttttgttact

SEQ ID NO: 6881330 - DNA, 18 bp, Homo sapiens
agcgccactgtccgctgt

SEQ ID NO: 6881331 - DNA, 15 bp, Homo sapiens
tctgttatgtactgt

SEQ ID NO: 6881332 - DNA, 13 bp, Homo sapiens
atcctcctgccca

SEQ ID NO: 6881333 - DNA, 20 bp, Homo sapiens
atgagtccatgtcctatgcc

SEQ ID NO: 6881334 - DNA, 15 bp, Homo sapiens
ccttccaccctgccc

SEQ ID NO: 6881335 - DNA, 22 bp, Homo sapiens
cacttcctgcttaaacttgacc

SEQ ID NO: 6881336 - DNA, 16 bp, Homo sapiens
aatgtaaatttactga

SEQ ID NO: 6881337 - DNA, 17 bp, Homo sapiens
tggggcctgccctctgc

SEQ ID NO: 6881338 - DNA, 22 bp, Homo sapiens
cctggagaggacggccctgcct

SEQ ID NO: 6881339 - DNA, 20 bp, Homo sapiens
cctcatcctcatacccaccc

SEQ ID NO: 6881340 - DNA, 21 bp, Homo sapiens
gagatttaagttcctgctgcc

SEQ ID NO: 6881341 - DNA, 16 bp, Homo sapiens
actcaaaactcttgaa

SEQ ID NO: 6881342 - DNA, 22 bp, Homo sapiens
ttggagtaaatatatatgtcaa

SEQ ID NO: 6881343 - DNA, 14 bp, Homo sapiens
acatttgttgaata

SEQ ID NO: 6881344 - DNA, 17 bp, Homo sapiens
ctgctaccctccctgct

SEQ ID NO: 6881345 - DNA, 14 bp, Homo sapiens
aaaatgacatttta

SEQ ID NO: 6881346 - DNA, 23 bp, Homo sapiens
cttctcagccacaaaccctgcct

SEQ ID NO: 6881347 - DNA, 19 bp, Homo sapiens
tgagtccatgtcctatgcc

SEQ ID NO: 6881348 - DNA, 16 bp, Homo sapiens
cagtttcactccctct

SEQ ID NO: 6881349 - DNA, 13 bp, Homo sapiens
ccacccccagccc

SEQ ID NO: 6881350 - DNA, 22 bp, Homo sapiens
ctcctgggcccctccctacctc

SEQ ID NO: 6881351 - DNA, 13 bp, Homo sapiens
cttctcactgcca

SEQ ID NO: 6881352 - DNA, 21 bp, Homo sapiens
ctccttcccccagcccaataa

SEQ ID NO: 6881353 - DNA, 15 bp, Homo sapiens
caatgcttctgtagc

SEQ ID NO: 6881354 - DNA, 22 bp, Homo sapiens
tgactcaacatgttactgacca

SEQ ID NO: 6881355 - DNA, 15 bp, Homo sapiens
aaatgaactactgct

SEQ ID NO: 6881356 - DNA, 13 bp, Homo sapiens
tctggcttggcct

SEQ ID NO: 6881357 - DNA, 14 bp, Homo sapiens
tcttccccctctcc

SEQ ID NO: 6881358 - DNA, 18 bp, Homo sapiens
tgcaagggaatgaatcca

SEQ ID NO: 6881359 - DNA, 14 bp, Homo sapiens
agttcaatacagtg

SEQ ID NO: 6881360 - DNA, 18 bp, Homo sapiens
agaatgtcaggaatttaa

SEQ ID NO: 6881361 - DNA, 15 bp, Homo sapiens
ccgcctgcctctgcc

SEQ ID NO: 6881362 - DNA, 15 bp, Homo sapiens
ctgctcactcccgct

SEQ ID NO: 6881363 - DNA, 22 bp, Homo sapiens
ctctcctggcctatccgctgcc

SEQ ID NO: 6881364 - DNA, 19 bp, Homo sapiens
ctctccatccctctcctct

SEQ ID NO: 6881365 - DNA, 23 bp, Homo sapiens
ggactggaaaaatgaactgtatt

SEQ ID NO: 6881366 - DNA, 16 bp, Homo sapiens
gctattcacctcagta

SEQ ID NO: 6881367 - DNA, 15 bp, Homo sapiens
tccatccctggtgaa

SEQ ID NO: 6881368 - DNA, 14 bp, Homo sapiens
agagctccacagaa

SEQ ID NO: 6881369 - DNA, 14 bp, Homo sapiens
catgtccccttcct

SEQ ID NO: 6881370 - DNA, 18 bp, Homo sapiens
agcacgcatgtccctcca

SEQ ID NO: 6881371 - DNA, 22 bp, Homo sapiens
caaatggcattgggctgagtaa

SEQ ID NO: 6881372 - DNA, 22 bp, Homo sapiens
cacctgcccttttttctgcctc

SEQ ID NO: 6881373 - DNA, 22 bp, Homo sapiens
accaagcttcagagcctagcca

SEQ ID NO: 6881374 - DNA, 14 bp, Homo sapiens
catcccctgcctct

SEQ ID NO: 6881375 - DNA, 12 bp, Homo sapiens
actgtttctcag

SEQ ID NO: 6881376 - DNA, 18 bp, Homo sapiens
taactaaatttgtctttc

SEQ ID NO: 6881377 - DNA, 20 bp, Homo sapiens
tacctaccacagtgtctgta

SEQ ID NO: 6881378 - DNA, 14 bp, Homo sapiens
aaaacctgcttcct

SEQ ID NO: 6881379 - DNA, 14 bp, Homo sapiens
actcagaaagccaa

SEQ ID NO: 6881380 - DNA, 18 bp, Homo sapiens
ctactcaatactacctct

SEQ ID NO: 6881381 - DNA, 17 bp, Homo sapiens
tcccagctggcagcgcc

SEQ ID NO: 6881382 - DNA, 17 bp, Homo sapiens
tgctatttaacatttta

SEQ ID NO: 6881383 - DNA, 14 bp, Homo sapiens
gccttagcatgttt

SEQ ID NO: 6881384 - DNA, 22 bp, Homo sapiens
cattccctccacccacttgcct

SEQ ID NO: 6881385 - DNA, 18 bp, Homo sapiens
tcagccctgctccctgcc

SEQ ID NO: 6881386 - DNA, 21 bp, Homo sapiens
agctttctcaatgtcttccca

SEQ ID NO: 6881387 - DNA, 15 bp, Homo sapiens
gacagttctgaagaa

SEQ ID NO: 6881388 - DNA, 16 bp, Homo sapiens
ctacaccacacacaac

SEQ ID NO: 6881389 - DNA, 13 bp, Homo sapiens
actgtcatcttca

SEQ ID NO: 6881390 - DNA, 13 bp, Homo sapiens
agagaaattctgt

SEQ ID NO: 6881391 - DNA, 23 bp, Homo sapiens
ctgccactcacccttcctggccc

SEQ ID NO: 6881392 - DNA, 17 bp, Homo sapiens
ccttacctcccctgcca

SEQ ID NO: 6881393 - DNA, 18 bp, Homo sapiens
gccacaggcctggcctca

SEQ ID NO: 6881394 - DNA, 15 bp, Homo sapiens
gacaagacttcagta

SEQ ID NO: 6881395 - DNA, 18 bp, Homo sapiens
gatcacttaagcccagga

SEQ ID NO: 6881396 - DNA, 19 bp, Homo sapiens
gaacaaaaaaatctgcaga

SEQ ID NO: 6881397 - DNA, 17 bp, Homo sapiens
ccaggagccccagccag

SEQ ID NO: 6881398 - DNA, 16 bp, Homo sapiens
cctgctctcctcttct

SEQ ID NO: 6881399 - DNA, 20 bp, Homo sapiens
ccctgcccccaccccttcct

SEQ ID NO: 6881400 - DNA, 23 bp, Homo sapiens
ttgtgtattgagtcttaactgta

SEQ ID NO: 6881401 - DNA, 11 bp, Homo sapiens
aaactcagccg

SEQ ID NO: 6881402 - DNA, 14 bp, Homo sapiens
cactactcctctgc

SEQ ID NO: 6881403 - DNA, 19 bp, Homo sapiens
agctgcccggcgcctgccc

SEQ ID NO: 6881404 - DNA, 16 bp, Homo sapiens
ttggcatgtctcctca

SEQ ID NO: 6881405 - DNA, 21 bp, Homo sapiens
accacactcaccccagcctca

SEQ ID NO: 6881406 - DNA, 18 bp, Homo sapiens
ctgtggagacactgagtc

SEQ ID NO: 6881407 - DNA, 22 bp, Homo sapiens
cactgctccctgaagccagcct

SEQ ID NO: 6881408 - DNA, 20 bp, Homo sapiens
cactccctttcccctcttcc

SEQ ID NO: 6881409 - DNA, 16 bp, Homo sapiens
tcccaccattcctgcc

SEQ ID NO: 6881410 - DNA, 21 bp, Homo sapiens
acacacaggaactctgtgtga

SEQ ID NO: 6881411 - DNA, 22 bp, Homo sapiens
acgctcgcgggcagcgggccag

SEQ ID NO: 6881412 - DNA, 14 bp, Homo sapiens
gaccagtcccacac

SEQ ID NO: 6881413 - DNA, 20 bp, Homo sapiens
ccagcctggtggcccagcta

SEQ ID NO: 6881414 - DNA, 22 bp, Homo sapiens
gctttcccctgtggggatctca

SEQ ID NO: 6881415 - DNA, 15 bp, Homo sapiens
aaggtgaagcacata

SEQ ID NO: 6881416 - DNA, 15 bp, Homo sapiens
aatgacctaattgat

SEQ ID NO: 6881417 - DNA, 19 bp, Homo sapiens
aggatggatgaatctggac

SEQ ID NO: 6881418 - DNA, 17 bp, Homo sapiens
aaacattttatactgta

SEQ ID NO: 6881419 - DNA, 15 bp, Homo sapiens
gtcactgtcactgcc

SEQ ID NO: 6881420 - DNA, 20 bp, Homo sapiens
cctggagagtgcacatgccc

SEQ ID NO: 6881421 - DNA, 19 bp, Homo sapiens
atcctccagggggcctgca

SEQ ID NO: 6881422 - DNA, 17 bp, Homo sapiens
catcactgagttttcca

SEQ ID NO: 6881423 - DNA, 16 bp, Homo sapiens
agcttccagtgcatgt

SEQ ID NO: 6881424 - DNA, 22 bp, Homo sapiens
actgagtacgttgtgcatttgg

SEQ ID NO: 6881425 - DNA, 21 bp, Homo sapiens
tgcctcctcctgccctccgcc

SEQ ID NO: 6881426 - DNA, 17 bp, Homo sapiens
ctggaccctgttgctaa

SEQ ID NO: 6881427 - DNA, 14 bp, Homo sapiens
cccactctcattcc

SEQ ID NO: 6881428 - DNA, 18 bp, Homo sapiens
aaagggagccatgctctt

SEQ ID NO: 6881429 - DNA, 17 bp, Homo sapiens
ggggtccaccagtgtgt

SEQ ID NO: 6881430 - DNA, 20 bp, Homo sapiens
tccgggcctttctctggctt

SEQ ID NO: 6881431 - DNA, 16 bp, Homo sapiens
tgcctgccatggctgt

SEQ ID NO: 6881432 - DNA, 17 bp, Homo sapiens
ctctccttctcctagct

SEQ ID NO: 6881433 - DNA, 13 bp, Homo sapiens
ccttgctctgcac

SEQ ID NO: 6881434 - DNA, 22 bp, Homo sapiens
cagttcttcctgcaaccactct

SEQ ID NO: 6881435 - DNA, 21 bp, Homo sapiens
ctgaagccacctctctgcctg

SEQ ID NO: 6881436 - DNA, 14 bp, Homo sapiens
agaacccctctgct

SEQ ID NO: 6881437 - DNA, 18 bp, Homo sapiens
aagtcaccggagctttca

SEQ ID NO: 6881438 - DNA, 13 bp, Homo sapiens
cagaaaacaaaac

SEQ ID NO: 6881439 - DNA, 14 bp, Homo sapiens
acccaggccctcca

SEQ ID NO: 6881440 - DNA, 19 bp, Homo sapiens
cagtcatagggctgataat

SEQ ID NO: 6881441 - DNA, 20 bp, Homo sapiens
agcctgtgcgtcccagctga

SEQ ID NO: 6881442 - DNA, 20 bp, Homo sapiens
ctggctcccacaggcagctt

SEQ ID NO: 6881443 - DNA, 21 bp, Homo sapiens
tcagtgccacttgacattcct

SEQ ID NO: 6881444 - DNA, 17 bp, Homo sapiens
tgtcataaattactgtt

SEQ ID NO: 6881445 - DNA, 16 bp, Homo sapiens
cctctctctctctcct

SEQ ID NO: 6881446 - DNA, 21 bp, Homo sapiens
ccctgcccaaactccccttcc

SEQ ID NO: 6881447 - DNA, 14 bp, Homo sapiens
acagcaattcatgg

SEQ ID NO: 6881448 - DNA, 20 bp, Homo sapiens
gggggtagagctgatccaga

SEQ ID NO: 6881449 - DNA, 16 bp, Homo sapiens
ctccacccacttgcct

SEQ ID NO: 6881450 - DNA, 18 bp, Homo sapiens
agagccgcaccctggctg

SEQ ID NO: 6881451 - DNA, 17 bp, Homo sapiens
gcccatcccctgcctct

SEQ ID NO: 6881452 - DNA, 15 bp, Homo sapiens
ctcaggccagtgcca

SEQ ID NO: 6881453 - DNA, 17 bp, Homo sapiens
accaaaggagacatatc

SEQ ID NO: 6881454 - DNA, 15 bp, Homo sapiens
aatatgaaagccaca

SEQ ID NO: 6881455 - DNA, 22 bp, Homo sapiens
ctctgcggggcagggccttcct

SEQ ID NO: 6881456 - DNA, 16 bp, Homo sapiens
tctggcaatcttgccc

SEQ ID NO: 6881457 - DNA, 14 bp, Homo sapiens
cctcctgccctcct

SEQ ID NO: 6881458 - DNA, 17 bp, Homo sapiens
aggaggcatgcctctga

SEQ ID NO: 6881459 - DNA, 20 bp, Homo sapiens
ctttaagtgtgctgggcaga

SEQ ID NO: 6881460 - DNA, 12 bp, Homo sapiens
tttttactgcca

SEQ ID NO: 6881461 - DNA, 21 bp, Homo sapiens
acctgctgtctgggtggctca

SEQ ID NO: 6881462 - DNA, 16 bp, Homo sapiens
atttgccttcagtctt

SEQ ID NO: 6881463 - DNA, 14 bp, Homo sapiens
taaaattatctgtt

SEQ ID NO: 6881464 - DNA, 14 bp, Homo sapiens
tataaatatcagta

SEQ ID NO: 6881465 - DNA, 13 bp, Homo sapiens
gagctgctgagca

SEQ ID NO: 6881466 - DNA, 20 bp, Homo sapiens
ccttactattcccactttca

SEQ ID NO: 6881467 - DNA, 16 bp, Homo sapiens
gtctctgatgcagctt

SEQ ID NO: 6881468 - DNA, 19 bp, Homo sapiens
ctcttcctaccctgcctcc

SEQ ID NO: 6881469 - DNA, 15 bp, Homo sapiens
accctaccagctcct

SEQ ID NO: 6881470 - DNA, 19 bp, Homo sapiens
gagggaagagggagaccaa

SEQ ID NO: 6881471 - DNA, 17 bp, Homo sapiens
aaaatcagcctgctcca

SEQ ID NO: 6881472 - DNA, 13 bp, Homo sapiens
agatcctgctgcc

SEQ ID NO: 6881473 - DNA, 20 bp, Homo sapiens
atatttgaagcagctctgcc

SEQ ID NO: 6881474 - DNA, 16 bp, Homo sapiens
gaatcccaaatttgat

SEQ ID NO: 6881475 - DNA, 15 bp, Homo sapiens
cttccacctccctcc

SEQ ID NO: 6881476 - DNA, 20 bp, Homo sapiens
cctgtctgtccaacccctcc

SEQ ID NO: 6881477 - DNA, 13 bp, Homo sapiens
atagctgtattga

SEQ ID NO: 6881478 - DNA, 18 bp, Homo sapiens
gccctgctgaagctgctg

SEQ ID NO: 6881479 - DNA, 12 bp, Homo sapiens
atgggagccaga

SEQ ID NO: 6881480 - DNA, 15 bp, Homo sapiens
tgctgggactggcca

SEQ ID NO: 6881481 - DNA, 19 bp, Homo sapiens
agctgcctgggatccctca

SEQ ID NO: 6881482 - DNA, 13 bp, Homo sapiens
aggacacctgccc

SEQ ID NO: 6881483 - DNA, 18 bp, Homo sapiens
atgcacagtatctgctgt

SEQ ID NO: 6881484 - DNA, 21 bp, Homo sapiens
aagctcttggacaacagctct

SEQ ID NO: 6881485 - DNA, 12 bp, Homo sapiens
cagctactggaa

SEQ ID NO: 6881486 - DNA, 21 bp, Homo sapiens
cactcctgtccctgtagctca

SEQ ID NO: 6881487 - DNA, 18 bp, Homo sapiens
gcagagtggcctgtgagc

SEQ ID NO: 6881488 - DNA, 19 bp, Homo sapiens
cccggctgggcctccttct

SEQ ID NO: 6881489 - DNA, 19 bp, Homo sapiens
aaagtacatagtgaatttt

SEQ ID NO: 6881490 - DNA, 18 bp, Homo sapiens
cctgtggctgcgcttcct

SEQ ID NO: 6881491 - DNA, 12 bp, Homo sapiens
atgtctgtgcta

SEQ ID NO: 6881492 - DNA, 15 bp, Homo sapiens
cttcctctccagcct

SEQ ID NO: 6881493 - DNA, 15 bp, Homo sapiens
gtctggtttctgtcc

SEQ ID NO: 6881494 - DNA, 18 bp, Homo sapiens
gactcaagattcccagga

SEQ ID NO: 6881495 - DNA, 19 bp, Homo sapiens
agtgtacccccgcccaggc

SEQ ID NO: 6881496 - DNA, 17 bp, Homo sapiens
cttcccccacccctcca

SEQ ID NO: 6881497 - DNA, 13 bp, Homo sapiens
gccgacctcagcc

SEQ ID NO: 6881498 - DNA, 17 bp, Homo sapiens
acaacaatactacctca

SEQ ID NO: 6881499 - DNA, 15 bp, Homo sapiens
gaattccaacttgaa

SEQ ID NO: 6881500 - DNA, 17 bp, Homo sapiens
cctgtgccaccccttcc

SEQ ID NO: 6881501 - DNA, 19 bp, Homo sapiens
acccaccaaccctcagggc

SEQ ID NO: 6881502 - DNA, 13 bp, Homo sapiens
cagacattctgcc

SEQ ID NO: 6881503 - DNA, 22 bp, Homo sapiens
ccggtccgcccgcttccctcct

SEQ ID NO: 6881504 - DNA, 18 bp, Homo sapiens
cacagcttgtctcttgcc

SEQ ID NO: 6881505 - DNA, 13 bp, Homo sapiens
tgtctctctccat

SEQ ID NO: 6881506 - DNA, 15 bp, Homo sapiens
ttcgtcatcttccct

SEQ ID NO: 6881507 - DNA, 14 bp, Homo sapiens
cttcctccctccct

SEQ ID NO: 6881508 - DNA, 13 bp, Homo sapiens
cttcaggttcctc

SEQ ID NO: 6881509 - DNA, 12 bp, Homo sapiens
ctgctcctccct

SEQ ID NO: 6881510 - DNA, 21 bp, Homo sapiens
ccctatccattctctccttcc

SEQ ID NO: 6881511 - DNA, 16 bp, Homo sapiens
caataaaatgcactga

SEQ ID NO: 6881512 - DNA, 19 bp, Homo sapiens
cgcttctgcagcctcggcc

SEQ ID NO: 6881513 - DNA, 21 bp, Homo sapiens
ccttctaggcatctcctctcc

SEQ ID NO: 6881514 - DNA, 13 bp, Homo sapiens
ccctgctctttct

SEQ ID NO: 6881515 - DNA, 14 bp, Homo sapiens
ctgtgcctcctccc

SEQ ID NO: 6881516 - DNA, 18 bp, Homo sapiens
cacttctctgctgcctct

SEQ ID NO: 6881517 - DNA, 22 bp, Homo sapiens
cttcagacgagatcctgtttca

SEQ ID NO: 6881518 - DNA, 23 bp, Homo sapiens
cacagccgcagcctccctctgac

SEQ ID NO: 6881519 - DNA, 14 bp, Homo sapiens
caatattgtttcta

SEQ ID NO: 6881520 - DNA, 15 bp, Homo sapiens
gacccaacttgccaa

SEQ ID NO: 6881521 - DNA, 17 bp, Homo sapiens
cagatctggaatgtgaa

SEQ ID NO: 6881522 - DNA, 20 bp, Homo sapiens
taataaattgaaattgtgaa

SEQ ID NO: 6881523 - DNA, 18 bp, Homo sapiens
cctgccatgggccagcct

SEQ ID NO: 6881524 - DNA, 17 bp, Homo sapiens
ccctcccggccctgcct

SEQ ID NO: 6881525 - DNA, 15 bp, Homo sapiens
ggtttgggagccagg

SEQ ID NO: 6881526 - DNA, 15 bp, Homo sapiens
ctccctcctctggcc

SEQ ID NO: 6881527 - DNA, 18 bp, Homo sapiens
ctccttttcttttgttac

SEQ ID NO: 6881528 - DNA, 16 bp, Homo sapiens
caaatgaaatgccaaa

SEQ ID NO: 6881529 - DNA, 15 bp, Homo sapiens
tggagctcctgctgg

SEQ ID NO: 6881530 - DNA, 14 bp, Homo sapiens
gcctgcgcctgctg

SEQ ID NO: 6881531 - DNA, 21 bp, Homo sapiens
aatctgttagcattattgcca

SEQ ID NO: 6881532 - DNA, 14 bp, Homo sapiens
catccaccttggct

SEQ ID NO: 6881533 - DNA, 22 bp, Homo sapiens
tatggtcacagacttctggcct

SEQ ID NO: 6881534 - DNA, 13 bp, Homo sapiens
cacctctgaggac

SEQ ID NO: 6881535 - DNA, 20 bp, Homo sapiens
tgttatcccaagaccctgcc

SEQ ID NO: 6881536 - DNA, 14 bp, Homo sapiens
ctctgcctcctcct

SEQ ID NO: 6881537 - DNA, 12 bp, Homo sapiens
tgctgcggctgt

SEQ ID NO: 6881538 - DNA, 14 bp, Homo sapiens
ctttatctcctgct

SEQ ID NO: 6881539 - DNA, 17 bp, Homo sapiens
cctgcctgacccatccc

SEQ ID NO: 6881540 - DNA, 13 bp, Homo sapiens
gctgcactgtgaa

SEQ ID NO: 6881541 - DNA, 14 bp, Homo sapiens
atttcttttgctat

SEQ ID NO: 6881542 - DNA, 11 bp, Homo sapiens
aatagttcctg

SEQ ID NO: 6881543 - DNA, 15 bp, Homo sapiens
acagattcacactgt

SEQ ID NO: 6881544 - DNA, 16 bp, Homo sapiens
acactgttactccaca

SEQ ID NO: 6881545 - DNA, 19 bp, Homo sapiens
tctgttgtcctccccttgg

SEQ ID NO: 6881546 - DNA, 16 bp, Homo sapiens
acccacctccctgcct

SEQ ID NO: 6881547 - DNA, 20 bp, Homo sapiens
catctggaaagttttctcca

SEQ ID NO: 6881548 - DNA, 16 bp, Homo sapiens
ctctcctcccctccct

SEQ ID NO: 6881549 - DNA, 18 bp, Homo sapiens
tcacagctggaccctgct

SEQ ID NO: 6881550 - DNA, 22 bp, Homo sapiens
ctgagctggcctctcactgcct

SEQ ID NO: 6881551 - DNA, 20 bp, Homo sapiens
ccagggcaaggccccttcca

SEQ ID NO: 6881552 - DNA, 14 bp, Homo sapiens
cctgccccaggcct

SEQ ID NO: 6881553 - DNA, 13 bp, Homo sapiens
cagtcctgcctga

SEQ ID NO: 6881554 - DNA, 14 bp, Homo sapiens
cactccccagggag

SEQ ID NO: 6881555 - DNA, 18 bp, Homo sapiens
cttggagccccagtgcca

SEQ ID NO: 6881556 - DNA, 18 bp, Homo sapiens
tgtccgtgtgcctcctgt

SEQ ID NO: 6881557 - DNA, 15 bp, Homo sapiens
ggtgacctcttgcct

SEQ ID NO: 6881558 - DNA, 19 bp, Homo sapiens
ctgtgtttgaactgaagtc

SEQ ID NO: 6881559 - DNA, 15 bp, Homo sapiens
ttccccagccccact

SEQ ID NO: 6881560 - DNA, 19 bp, Homo sapiens
actgatgcgaaaacttgaa

SEQ ID NO: 6881561 - DNA, 16 bp, Homo sapiens
ggcaagtggatgggaa

SEQ ID NO: 6881562 - DNA, 15 bp, Homo sapiens
tgcccctctctccat

SEQ ID NO: 6881563 - DNA, 16 bp, Homo sapiens
caatcccacctagccc

SEQ ID NO: 6881564 - DNA, 13 bp, Homo sapiens
ctctacctggccg

SEQ ID NO: 6881565 - DNA, 17 bp, Homo sapiens
gttcatgatagtgtgat

SEQ ID NO: 6881566 - DNA, 19 bp, Homo sapiens
gctctcaggccagctgctt

SEQ ID NO: 6881567 - DNA, 14 bp, Homo sapiens
caatcaaccaaagt

SEQ ID NO: 6881568 - DNA, 21 bp, Homo sapiens
cacacagaaaatatactgtaa

SEQ ID NO: 6881569 - DNA, 15 bp, Homo sapiens
tctatttttgcactg

SEQ ID NO: 6881570 - DNA, 16 bp, Homo sapiens
gagccctattgctgct

SEQ ID NO: 6881571 - DNA, 14 bp, Homo sapiens
cccagctcactgca

SEQ ID NO: 6881572 - DNA, 16 bp, Homo sapiens
agcctggcatctgtgc

SEQ ID NO: 6881573 - DNA, 13 bp, Homo sapiens
cactcccctctcc

SEQ ID NO: 6881574 - DNA, 21 bp, Homo sapiens
gaagacttaactggcccagaa

SEQ ID NO: 6881575 - DNA, 14 bp, Homo sapiens
cctggacccctgca

SEQ ID NO: 6881576 - DNA, 15 bp, Homo sapiens
ctattaaaagactca

SEQ ID NO: 6881577 - DNA, 17 bp, Homo sapiens
ctccagttttctcctct

SEQ ID NO: 6881578 - DNA, 15 bp, Homo sapiens
agacaaaggcccaga

SEQ ID NO: 6881579 - DNA, 15 bp, Homo sapiens
acttggggtcaggaa

SEQ ID NO: 6881580 - DNA, 20 bp, Homo sapiens
ccctcaacaggcccagggag

SEQ ID NO: 6881581 - DNA, 15 bp, Homo sapiens
ctatggccagtctgc

SEQ ID NO: 6881582 - DNA, 16 bp, Homo sapiens
atgctatttctggcct

SEQ ID NO: 6881583 - DNA, 20 bp, Homo sapiens
cagacctggctctcagagga

SEQ ID NO: 6881584 - DNA, 18 bp, Homo sapiens
ccaggattcccccagcca

SEQ ID NO: 6881585 - DNA, 23 bp, Homo sapiens
gtattttttacttttcacactgt

SEQ ID NO: 6881586 - DNA, 21 bp, Homo sapiens
actttccatctctgcctgtca

SEQ ID NO: 6881587 - DNA, 16 bp, Homo sapiens
cacaggcctctgcctg

SEQ ID NO: 6881588 - DNA, 20 bp, Homo sapiens
gaacacagcatgtgccaaga

SEQ ID NO: 6881589 - DNA, 15 bp, Homo sapiens
tcttgttaatgtcat

SEQ ID NO: 6881590 - DNA, 14 bp, Homo sapiens
cagctcattatgaa

SEQ ID NO: 6881591 - DNA, 17 bp, Homo sapiens
ctacctgccctggaaca

SEQ ID NO: 6881592 - DNA, 12 bp, Homo sapiens
cggtccacaggt

SEQ ID NO: 6881593 - DNA, 14 bp, Homo sapiens
cattcccactgcca

SEQ ID NO: 6881594 - DNA, 19 bp, Homo sapiens
aagtttccaagcaaatgtt

SEQ ID NO: 6881595 - DNA, 16 bp, Homo sapiens
cttgcccttgccctga

SEQ ID NO: 6881596 - DNA, 22 bp, Homo sapiens
ccttgagatgcttcactttcct

SEQ ID NO: 6881597 - DNA, 14 bp, Homo sapiens
caaaccactgtaca

SEQ ID NO: 6881598 - DNA, 17 bp, Homo sapiens
tactactgcagtcttta

SEQ ID NO: 6881599 - DNA, 14 bp, Homo sapiens
accagctgcaaagt

SEQ ID NO: 6881600 - DNA, 21 bp, Homo sapiens
cttcctagagcatctgtccca

SEQ ID NO: 6881601 - DNA, 19 bp, Homo sapiens
tgttccccaccgccctgcc

SEQ ID NO: 6881602 - DNA, 18 bp, Homo sapiens
gacacctccccctaccca

SEQ ID NO: 6881603 - DNA, 18 bp, Homo sapiens
cagcttgaacctgcttcc

SEQ ID NO: 6881604 - DNA, 18 bp, Homo sapiens
aagatacacttgtaaata

SEQ ID NO: 6881605 - DNA, 15 bp, Homo sapiens
ttcagcatctactct

SEQ ID NO: 6881606 - DNA, 21 bp, Homo sapiens
tcaatgttcacgcaacttgaa

SEQ ID NO: 6881607 - DNA, 17 bp, Homo sapiens
attaagaaacaatttaa

SEQ ID NO: 6881608 - DNA, 22 bp, Homo sapiens
ctcttccgaaaaatcctcttcc

SEQ ID NO: 6881609 - DNA, 15 bp, Homo sapiens
ccagcaaagcctcca

SEQ ID NO: 6881610 - DNA, 17 bp, Homo sapiens
ctgcttgcacacttccc

SEQ ID NO: 6881611 - DNA, 12 bp, Homo sapiens
agtgcccagccc

SEQ ID NO: 6881612 - DNA, 17 bp, Homo sapiens
caagatttgaccaaatc

SEQ ID NO: 6881613 - DNA, 17 bp, Homo sapiens
atcccatctctcccact

SEQ ID NO: 6881614 - DNA, 18 bp, Homo sapiens
cataatggttgtgaaatg

SEQ ID NO: 6881615 - DNA, 14 bp, Homo sapiens
accagccagatcct

SEQ ID NO: 6881616 - DNA, 17 bp, Homo sapiens
ctgctgtattgatatca

SEQ ID NO: 6881617 - DNA, 15 bp, Homo sapiens
accagaagggcttca

SEQ ID NO: 6881618 - DNA, 12 bp, Homo sapiens
gctccagctgcc

SEQ ID NO: 6881619 - DNA, 14 bp, Homo sapiens
ccatttccccctcc

SEQ ID NO: 6881620 - DNA, 22 bp, Homo sapiens
acatctcaacaggcctcagggc

SEQ ID NO: 6881621 - DNA, 17 bp, Homo sapiens
gtccattgacatgtaca

SEQ ID NO: 6881622 - DNA, 20 bp, Homo sapiens
tctaagccctgttctcctgt

SEQ ID NO: 6881623 - DNA, 14 bp, Homo sapiens
cttccttccgctct

SEQ ID NO: 6881624 - DNA, 18 bp, Homo sapiens
atctttccttgtctctca

SEQ ID NO: 6881625 - DNA, 19 bp, Homo sapiens
gttcagcccctcctctgcc

SEQ ID NO: 6881626 - DNA, 21 bp, Homo sapiens
gacagtcataaatactgtcaa

SEQ ID NO: 6881627 - DNA, 16 bp, Homo sapiens
ctgtgtccatctgacc

SEQ ID NO: 6881628 - DNA, 12 bp, Homo sapiens
ccatatgctctt

SEQ ID NO: 6881629 - DNA, 17 bp, Homo sapiens
tagagcttaaattgtca

SEQ ID NO: 6881630 - DNA, 21 bp, Homo sapiens
gttttcattcccccttcctag

SEQ ID NO: 6881631 - DNA, 17 bp, Homo sapiens
caccatgcgctgctcaa

SEQ ID NO: 6881632 - DNA, 16 bp, Homo sapiens
caatgcaacctctgcc

SEQ ID NO: 6881633 - DNA, 13 bp, Homo sapiens
caagttgctctga

SEQ ID NO: 6881634 - DNA, 19 bp, Homo sapiens
cgatccctcccctcagcct

SEQ ID NO: 6881635 - DNA, 21 bp, Homo sapiens
ctcagaggaaaggcagtatgg

SEQ ID NO: 6881636 - DNA, 17 bp, Homo sapiens
ctcagatccttgtttca

SEQ ID NO: 6881637 - DNA, 18 bp, Homo sapiens
tcaggccagcccagccag

SEQ ID NO: 6881638 - DNA, 14 bp, Homo sapiens
acaattactgtgag

SEQ ID NO: 6881639 - DNA, 17 bp, Homo sapiens
agcccctcccaccacag

SEQ ID NO: 6881640 - DNA, 19 bp, Homo sapiens
ctttttcttcttccctccc

SEQ ID NO: 6881641 - DNA, 22 bp, Homo sapiens
gacaccactgagctctgcctca

SEQ ID NO: 6881642 - DNA, 14 bp, Homo sapiens
taatgagactttaa

SEQ ID NO: 6881643 - DNA, 23 bp, Homo sapiens
tgccttcgcaccttgctgtgtga

SEQ ID NO: 6881644 - DNA, 21 bp, Homo sapiens
aacaacctgccacaatgtgat

SEQ ID NO: 6881645 - DNA, 17 bp, Homo sapiens
aaatggtgttgagattt

SEQ ID NO: 6881646 - DNA, 20 bp, Homo sapiens
ctggaggggcaccaggtgga

SEQ ID NO: 6881647 - DNA, 21 bp, Homo sapiens
tttaaaaatacaattattgta

SEQ ID NO: 6881648 - DNA, 23 bp, Homo sapiens
tcttcctgcaaccactctgtggc

SEQ ID NO: 6881649 - DNA, 19 bp, Homo sapiens
ccactgcaaaccctgctgc

SEQ ID NO: 6881650 - DNA, 16 bp, Homo sapiens
tgaagtattaagccta

SEQ ID NO: 6881651 - DNA, 15 bp, Homo sapiens
ccatatttttttctg

SEQ ID NO: 6881652 - DNA, 12 bp, Homo sapiens
gagagccctgga

SEQ ID NO: 6881653 - DNA, 18 bp, Homo sapiens
tccgtcaacgttgtactg

SEQ ID NO: 6881654 - DNA, 17 bp, Homo sapiens
aggcagcaccaccacac

SEQ ID NO: 6881655 - DNA, 22 bp, Homo sapiens
tctgttgcgctcccgcatttct

SEQ ID NO: 6881656 - DNA, 21 bp, Homo sapiens
tctgcacactctcttctccat

SEQ ID NO: 6881657 - DNA, 18 bp, Homo sapiens
actatgatttctgaattg

SEQ ID NO: 6881658 - DNA, 21 bp, Homo sapiens
tgaccaactagacattctgtc

SEQ ID NO: 6881659 - DNA, 17 bp, Homo sapiens
cttgagggtgggccagc

SEQ ID NO: 6881660 - DNA, 21 bp, Homo sapiens
ccagccaccaccactgtccct

SEQ ID NO: 6881661 - DNA, 19 bp, Homo sapiens
ctaactgttgttactggaa

SEQ ID NO: 6881662 - DNA, 16 bp, Homo sapiens
ttacaggctcctgcca

SEQ ID NO: 6881663 - DNA, 13 bp, Homo sapiens
ttctccttcctca

SEQ ID NO: 6881664 - DNA, 17 bp, Homo sapiens
gcaggcccaatgctgct

SEQ ID NO: 6881665 - DNA, 14 bp, Homo sapiens
tgacaagtactgta

SEQ ID NO: 6881666 - DNA, 20 bp, Homo sapiens
cattgtctgttggcaaattt

SEQ ID NO: 6881667 - DNA, 15 bp, Homo sapiens
cagatccgcatgtgt

SEQ ID NO: 6881668 - DNA, 18 bp, Homo sapiens
catggcttaatgcttctt

SEQ ID NO: 6881669 - DNA, 14 bp, Homo sapiens
tcacatatgtctta

SEQ ID NO: 6881670 - DNA, 12 bp, Homo sapiens
agggcccagccc

SEQ ID NO: 6881671 - DNA, 14 bp, Homo sapiens
cacactgtcttccc

SEQ ID NO: 6881672 - DNA, 16 bp, Homo sapiens
caccctacctgtgcct

SEQ ID NO: 6881673 - DNA, 19 bp, Homo sapiens
ccttggtgtttcccttcct

SEQ ID NO: 6881674 - DNA, 15 bp, Homo sapiens
cccggccccctgccc

SEQ ID NO: 6881675 - DNA, 15 bp, Homo sapiens
aacttaaataattta

SEQ ID NO: 6881676 - DNA, 14 bp, Homo sapiens
atattacattgcat

SEQ ID NO: 6881677 - DNA, 21 bp, Homo sapiens
cattctcatatgtagccctca

SEQ ID NO: 6881678 - DNA, 20 bp, Homo sapiens
ctgacagtacccgactgttt

SEQ ID NO: 6881679 - DNA, 12 bp, Homo sapiens
tactgtacaata

SEQ ID NO: 6881680 - DNA, 18 bp, Homo sapiens
ctgaaattaatttgtgaa

SEQ ID NO: 6881681 - DNA, 20 bp, Homo sapiens
gcaccgactagacacacaaa

SEQ ID NO: 6881682 - DNA, 21 bp, Homo sapiens
tgaaataaacctgcactgaaa

SEQ ID NO: 6881683 - DNA, 15 bp, Homo sapiens
tagacagtattgcca

SEQ ID NO: 6881684 - DNA, 16 bp, Homo sapiens
agggaggcccatgtga

SEQ ID NO: 6881685 - DNA, 12 bp, Homo sapiens
gtaatagctcag

SEQ ID NO: 6881686 - DNA, 14 bp, Homo sapiens
ctttgctctttctt

SEQ ID NO: 6881687 - DNA, 22 bp, Homo sapiens
ctggccaccagccatcctccct

SEQ ID NO: 6881688 - DNA, 18 bp, Homo sapiens
atctttctcttccctgaa

SEQ ID NO: 6881689 - DNA, 22 bp, Homo sapiens
caagatttccctaaaaattcca

SEQ ID NO: 6881690 - DNA, 11 bp, Homo sapiens
catccctgtga

SEQ ID NO: 6881691 - DNA, 21 bp, Homo sapiens
tgtactcacatataacatgca

SEQ ID NO: 6881692 - DNA, 18 bp, Homo sapiens
aaatgcaactctaactct

SEQ ID NO: 6881693 - DNA, 22 bp, Homo sapiens
ctctccagaaacagctgcttct

SEQ ID NO: 6881694 - DNA, 16 bp, Homo sapiens
gctccatgtgcatata

SEQ ID NO: 6881695 - DNA, 21 bp, Homo sapiens
ctacttacctaccacatgcca

SEQ ID NO: 6881696 - DNA, 22 bp, Homo sapiens
attccagtacagtattctttta

SEQ ID NO: 6881697 - DNA, 13 bp, Homo sapiens
atatgatatgcat

SEQ ID NO: 6881698 - DNA, 18 bp, Homo sapiens
agatccccaagcctggca

SEQ ID NO: 6881699 - DNA, 19 bp, Homo sapiens
ctgtggctccctctctcct

SEQ ID NO: 6881700 - DNA, 13 bp, Homo sapiens
ccatttctgaact

SEQ ID NO: 6881701 - DNA, 14 bp, Homo sapiens
accttttctctccc

SEQ ID NO: 6881702 - DNA, 22 bp, Homo sapiens
tactgaattggcttccagattt

SEQ ID NO: 6881703 - DNA, 22 bp, Homo sapiens
tgctttggttaaaaatggctca

SEQ ID NO: 6881704 - DNA, 11 bp, Homo sapiens
agaatgtcatt

SEQ ID NO: 6881705 - DNA, 17 bp, Homo sapiens
agcctcgtgtcctgcta

SEQ ID NO: 6881706 - DNA, 21 bp, Homo sapiens
ccttagcccggatgcccaccc

SEQ ID NO: 6881707 - DNA, 20 bp, Homo sapiens
ggaaactcttgctattgaat

SEQ ID NO: 6881708 - DNA, 16 bp, Homo sapiens
atggaacccaatggac

SEQ ID NO: 6881709 - DNA, 16 bp, Homo sapiens
agtagatggtgaaatt

SEQ ID NO: 6881710 - DNA, 18 bp, Homo sapiens
cccagcattgctggttct

SEQ ID NO: 6881711 - DNA, 18 bp, Homo sapiens
cctacatccagctcctct

SEQ ID NO: 6881712 - DNA, 15 bp, Homo sapiens
tactagatgtcttta

SEQ ID NO: 6881713 - DNA, 17 bp, Homo sapiens
cccaccacaccctccct

SEQ ID NO: 6881714 - DNA, 17 bp, Homo sapiens
cagaaatatatatacat

SEQ ID NO: 6881715 - DNA, 16 bp, Homo sapiens
taaatggcacctgtat

SEQ ID NO: 6881716 - DNA, 18 bp, Homo sapiens
tgcctccgggcctcggcc

SEQ ID NO: 6881717 - DNA, 22 bp, Homo sapiens
atgttagacttgctccctctcc

SEQ ID NO: 6881718 - DNA, 16 bp, Homo sapiens
cgggtgggcctggcct

SEQ ID NO: 6881719 - DNA, 12 bp, Homo sapiens
cagccgtgcact

SEQ ID NO: 6881720 - DNA, 13 bp, Homo sapiens
ccaaacctggaga

SEQ ID NO: 6881721 - DNA, 19 bp, Homo sapiens
ccacatgcctgcgcctgct

SEQ ID NO: 6881722 - DNA, 19 bp, Homo sapiens
tgcatgttttccagctcct

SEQ ID NO: 6881723 - DNA, 19 bp, Homo sapiens
agtgccagctactcaggag

SEQ ID NO: 6881724 - DNA, 14 bp, Homo sapiens
tgtgagctcttccc

SEQ ID NO: 6881725 - DNA, 16 bp, Homo sapiens
caccagagctgcctcc

SEQ ID NO: 6881726 - DNA, 19 bp, Homo sapiens
ccttttgttaatgcattgt

SEQ ID NO: 6881727 - DNA, 19 bp, Homo sapiens
cattagtaaatgtctttgt

SEQ ID NO: 6881728 - DNA, 14 bp, Homo sapiens
tacacattttgtaa

SEQ ID NO: 6881729 - DNA, 17 bp, Homo sapiens
ccagcattccagcccct

SEQ ID NO: 6881730 - DNA, 12 bp, Homo sapiens
ggattattcttt

SEQ ID NO: 6881731 - DNA, 22 bp, Homo sapiens
ttggtatgtgccaggcttgcct

SEQ ID NO: 6881732 - DNA, 23 bp, Homo sapiens
cttcctgagggctaattctggga

SEQ ID NO: 6881733 - DNA, 17 bp, Homo sapiens
aacccatgcccctgaca

SEQ ID NO: 6881734 - DNA, 19 bp, Homo sapiens
tccctgcctccagctgtca

SEQ ID NO: 6881735 - DNA, 21 bp, Homo sapiens
gggacagaggccaaggactga

SEQ ID NO: 6881736 - DNA, 15 bp, Homo sapiens
cattctgctacttca

SEQ ID NO: 6881737 - DNA, 21 bp, Homo sapiens
ggcaggcattcctgaagggaa

SEQ ID NO: 6881738 - DNA, 21 bp, Homo sapiens
gccttccctcactcttcctca

SEQ ID NO: 6881739 - DNA, 19 bp, Homo sapiens
ctccggggccccactggct

SEQ ID NO: 6881740 - DNA, 12 bp, Homo sapiens
tatggttttatt

SEQ ID NO: 6881741 - DNA, 18 bp, Homo sapiens
cccagcctcgcctgtcac

SEQ ID NO: 6881742 - DNA, 15 bp, Homo sapiens
gccatgcctcatgcc

SEQ ID NO: 6881743 - DNA, 12 bp, Homo sapiens
ctctgcttccca

SEQ ID NO: 6881744 - DNA, 14 bp, Homo sapiens
acgcttccagacca

SEQ ID NO: 6881745 - DNA, 17 bp, Homo sapiens
aaattatctgaatatta

SEQ ID NO: 6881746 - DNA, 14 bp, Homo sapiens
tagtgatttgctat

SEQ ID NO: 6881747 - DNA, 11 bp, Homo sapiens
aataaagcatt

SEQ ID NO: 6881748 - DNA, 18 bp, Homo sapiens
actctttatgatctggcc

SEQ ID NO: 6881749 - DNA, 17 bp, Homo sapiens
cctttctttgcctctgc

SEQ ID NO: 6881750 - DNA, 17 bp, Homo sapiens
tttcctggcagctgctg

SEQ ID NO: 6881751 - DNA, 15 bp, Homo sapiens
atgctttgaaaatgt

SEQ ID NO: 6881752 - DNA, 19 bp, Homo sapiens
ggagccaccttgccaccca

SEQ ID NO: 6881753 - DNA, 12 bp, Homo sapiens
caagcctggagg

SEQ ID NO: 6881754 - DNA, 14 bp, Homo sapiens
ctccgccagccaca

SEQ ID NO: 6881755 - DNA, 12 bp, Homo sapiens
ccctctcttccc

SEQ ID NO: 6881756 - DNA, 17 bp, Homo sapiens
ctatttaaaaaactgta

SEQ ID NO: 6881757 - DNA, 15 bp, Homo sapiens
gcctgccatagccag

SEQ ID NO: 6881758 - DNA, 14 bp, Homo sapiens
cagagaactgtctt

SEQ ID NO: 6881759 - DNA, 19 bp, Homo sapiens
tccggcctctccagcctca

SEQ ID NO: 6881760 - DNA, 17 bp, Homo sapiens
aactagcatatctgcct

SEQ ID NO: 6881761 - DNA, 16 bp, Homo sapiens
acttgaaaccagtatt

SEQ ID NO: 6881762 - DNA, 14 bp, Homo sapiens
cacacacctctgcc

SEQ ID NO: 6881763 - DNA, 16 bp, Homo sapiens
cttatggacactgcct

SEQ ID NO: 6881764 - DNA, 19 bp, Homo sapiens
ctttcaggaaatttttgca

SEQ ID NO: 6881765 - DNA, 16 bp, Homo sapiens
agcccctcctccctca

SEQ ID NO: 6881766 - DNA, 12 bp, Homo sapiens
taaaacattctt

SEQ ID NO: 6881767 - DNA, 18 bp, Homo sapiens
ccttctccaccccagccc

SEQ ID NO: 6881768 - DNA, 23 bp, Homo sapiens
ggaagctggctgggctggctgaa

SEQ ID NO: 6881769 - DNA, 17 bp, Homo sapiens
cttctgttgctgcctca

SEQ ID NO: 6881770 - DNA, 19 bp, Homo sapiens
gctctccccctgcagccgt

SEQ ID NO: 6881771 - DNA, 21 bp, Homo sapiens
gatggaggttctcagagccaa

SEQ ID NO: 6881772 - DNA, 20 bp, Homo sapiens
attttcaagtttacacttca

SEQ ID NO: 6881773 - DNA, 20 bp, Homo sapiens
ccaccgggccactccttcct

SEQ ID NO: 6881774 - DNA, 20 bp, Homo sapiens
cagttctcatgggtggcact

SEQ ID NO: 6881775 - DNA, 17 bp, Homo sapiens
cttagccttgctgtaga

SEQ ID NO: 6881776 - DNA, 14 bp, Homo sapiens
tgtagccactggca

SEQ ID NO: 6881777 - DNA, 20 bp, Homo sapiens
ccgcgggtgggactcttccc

SEQ ID NO: 6881778 - DNA, 18 bp, Homo sapiens
tggcctgggtcctcggcc

SEQ ID NO: 6881779 - DNA, 16 bp, Homo sapiens
cctctctctccctcca

SEQ ID NO: 6881780 - DNA, 19 bp, Homo sapiens
ttcttttaagccctgctct

SEQ ID NO: 6881781 - DNA, 18 bp, Homo sapiens
tacctgtcatctgggcca

SEQ ID NO: 6881782 - DNA, 14 bp, Homo sapiens
gaatttttcttgcg

SEQ ID NO: 6881783 - DNA, 20 bp, Homo sapiens
cggttcccacaagcctgcct

SEQ ID NO: 6881784 - DNA, 19 bp, Homo sapiens
cccttgctctcccctgccc

SEQ ID NO: 6881785 - DNA, 20 bp, Homo sapiens
ctcttacgcccaacccttcc

SEQ ID NO: 6881786 - DNA, 13 bp, Homo sapiens
cactttattgcca

SEQ ID NO: 6881787 - DNA, 18 bp, Homo sapiens
cctcctctctccctgcct

SEQ ID NO: 6881788 - DNA, 18 bp, Homo sapiens
actcctgaaacctcttcc

SEQ ID NO: 6881789 - DNA, 13 bp, Homo sapiens
tttctctccctcc

SEQ ID NO: 6881790 - DNA, 17 bp, Homo sapiens
catttgctaaggcagct

SEQ ID NO: 6881791 - DNA, 23 bp, Homo sapiens
cctctgcctgggatgcccttccc

SEQ ID NO: 6881792 - DNA, 22 bp, Homo sapiens
catttggaggaaaaaaagcatg

SEQ ID NO: 6881793 - DNA, 16 bp, Homo sapiens
cagagacatacttgaa

SEQ ID NO: 6881794 - DNA, 14 bp, Homo sapiens
gttttttactttgg

SEQ ID NO: 6881795 - DNA, 21 bp, Homo sapiens
ataggagaacgtatcaataca

SEQ ID NO: 6881796 - DNA, 16 bp, Homo sapiens
agattacatctgcctt

SEQ ID NO: 6881797 - DNA, 14 bp, Homo sapiens
cagttactcagccc

SEQ ID NO: 6881798 - DNA, 14 bp, Homo sapiens
cctgcctatcctct

SEQ ID NO: 6881799 - DNA, 14 bp, Homo sapiens
ctctcactcctgcc

SEQ ID NO: 6881800 - DNA, 13 bp, Homo sapiens
tacctatatgcag

SEQ ID NO: 6881801 - DNA, 16 bp, Homo sapiens
ccaaaagggcagccag

SEQ ID NO: 6881802 - DNA, 18 bp, Homo sapiens
agcttcctgtttcttccc

SEQ ID NO: 6881803 - DNA, 12 bp, Homo sapiens
cgtcctgcagtg

SEQ ID NO: 6881804 - DNA, 18 bp, Homo sapiens
caaatgttacatagtgta

SEQ ID NO: 6881805 - DNA, 11 bp, Homo sapiens
caccactgccc

SEQ ID NO: 6881806 - DNA, 18 bp, Homo sapiens
ctacatgtgccaccaaca

SEQ ID NO: 6881807 - DNA, 19 bp, Homo sapiens
agcaattcataaaaactgc

SEQ ID NO: 6881808 - DNA, 20 bp, Homo sapiens
tctgtcaccacatcttgtct

SEQ ID NO: 6881809 - DNA, 14 bp, Homo sapiens
aaattaaatattta

SEQ ID NO: 6881810 - DNA, 17 bp, Homo sapiens
cccaagaggtctgagcc

SEQ ID NO: 6881811 - DNA, 20 bp, Homo sapiens
catgccttgtgctgttaata

SEQ ID NO: 6881812 - DNA, 22 bp, Homo sapiens
actgcacaataaaaccaagcct

SEQ ID NO: 6881813 - DNA, 18 bp, Homo sapiens
taccccaccctgcccact

SEQ ID NO: 6881814 - DNA, 13 bp, Homo sapiens
cctggtggcagct

SEQ ID NO: 6881815 - DNA, 17 bp, Homo sapiens
aagctcctgtcctccca

SEQ ID NO: 6881816 - DNA, 21 bp, Homo sapiens
ctccaagaggctccctcctgt

SEQ ID NO: 6881817 - DNA, 17 bp, Homo sapiens
gtcctcccaagctgtgc

SEQ ID NO: 6881818 - DNA, 23 bp, Homo sapiens
aattttttaattatttaaatgta

SEQ ID NO: 6881819 - DNA, 15 bp, Homo sapiens
cccagggctcctgca

SEQ ID NO: 6881820 - DNA, 22 bp, Homo sapiens
taacagtacctgtgcctgagaa

SEQ ID NO: 6881821 - DNA, 17 bp, Homo sapiens
gtacctatttggtgcta

SEQ ID NO: 6881822 - DNA, 15 bp, Homo sapiens
aaaattaaaatttaa

SEQ ID NO: 6881823 - DNA, 22 bp, Homo sapiens
catgccctccactccactgcct

SEQ ID NO: 6881824 - DNA, 23 bp, Homo sapiens
cccagccctccccacctgctcac

SEQ ID NO: 6881825 - DNA, 18 bp, Homo sapiens
acactgcagccctctcca

SEQ ID NO: 6881826 - DNA, 21 bp, Homo sapiens
tgcactgaagagctcttggcc

SEQ ID NO: 6881827 - DNA, 18 bp, Homo sapiens
tcctggtgctctctgcca

SEQ ID NO: 6881828 - DNA, 16 bp, Homo sapiens
tccggcgtcagcctcc

SEQ ID NO: 6881829 - DNA, 14 bp, Homo sapiens
tggggatagtctgg

SEQ ID NO: 6881830 - DNA, 16 bp, Homo sapiens
cctcctcacccttccc

SEQ ID NO: 6881831 - DNA, 13 bp, Homo sapiens
cacgacctgtcct

SEQ ID NO: 6881832 - DNA, 10 bp, Homo sapiens
gggccctggg

SEQ ID NO: 6881833 - DNA, 16 bp, Homo sapiens
tgtctattctgagcct

SEQ ID NO: 6881834 - DNA, 21 bp, Homo sapiens
catctccttacctctggaacc

SEQ ID NO: 6881835 - DNA, 14 bp, Homo sapiens
acggccactgcagt

SEQ ID NO: 6881836 - DNA, 18 bp, Homo sapiens
gaaattagatttgtgcaa

SEQ ID NO: 6881837 - DNA, 23 bp, Homo sapiens
tggatgtccctattctgccatgg

SEQ ID NO: 6881838 - DNA, 12 bp, Homo sapiens
tttccagtcaga

SEQ ID NO: 6881839 - DNA, 17 bp, Homo sapiens
ccaaggaggcctgggga

SEQ ID NO: 6881840 - DNA, 20 bp, Homo sapiens
cactgtctgttgcttcagta

SEQ ID NO: 6881841 - DNA, 15 bp, Homo sapiens
tgttctgcactgaaa

SEQ ID NO: 6881842 - DNA, 23 bp, Homo sapiens
agaggattttagctaggatttga

SEQ ID NO: 6881843 - DNA, 14 bp, Homo sapiens
catttcacccctcc

SEQ ID NO: 6881844 - DNA, 19 bp, Homo sapiens
tccatccaaacctacctta

SEQ ID NO: 6881845 - DNA, 16 bp, Homo sapiens
catcaaggcactgcct

SEQ ID NO: 6881846 - DNA, 22 bp, Homo sapiens
cccaggtgctaggaacactcct

SEQ ID NO: 6881847 - DNA, 23 bp, Homo sapiens
ctcatggccttccacgtcttcct

SEQ ID NO: 6881848 - DNA, 14 bp, Homo sapiens
caaaggcagaggaa

SEQ ID NO: 6881849 - DNA, 17 bp, Homo sapiens
gcttcaccatcttggcc

SEQ ID NO: 6881850 - DNA, 18 bp, Homo sapiens
cttccccttatcctccct

SEQ ID NO: 6881851 - DNA, 13 bp, Homo sapiens
ttccttgaagccg

SEQ ID NO: 6881852 - DNA, 15 bp, Homo sapiens
agaccaccacctcag

SEQ ID NO: 6881853 - DNA, 16 bp, Homo sapiens
agagtggagcccaggg

SEQ ID NO: 6881854 - DNA, 18 bp, Homo sapiens
caggtgtgcctgtgctcc

SEQ ID NO: 6881855 - DNA, 21 bp, Homo sapiens
tgggtgagcatacctgtctca

SEQ ID NO: 6881856 - DNA, 13 bp, Homo sapiens
agggaagctacag

SEQ ID NO: 6881857 - DNA, 14 bp, Homo sapiens
caccttgtggcaag

SEQ ID NO: 6881858 - DNA, 17 bp, Homo sapiens
accataggtcaccttta

SEQ ID NO: 6881859 - DNA, 18 bp, Homo sapiens
gtaaatcagatgttgaat

SEQ ID NO: 6881860 - DNA, 18 bp, Homo sapiens
tatgttttggtatctgtt

SEQ ID NO: 6881861 - DNA, 16 bp, Homo sapiens
aataccaactatttca

SEQ ID NO: 6881862 - DNA, 15 bp, Homo sapiens
aattgaaagagaatt

SEQ ID NO: 6881863 - DNA, 22 bp, Homo sapiens
cagtctccggcctctccagcct

SEQ ID NO: 6881864 - DNA, 20 bp, Homo sapiens
tcatagtatatgattgtatt

SEQ ID NO: 6881865 - DNA, 21 bp, Homo sapiens
tgtccgcgtcctttcctctcc

SEQ ID NO: 6881866 - DNA, 18 bp, Homo sapiens
acctgccctgccctgcca

SEQ ID NO: 6881867 - DNA, 23 bp, Homo sapiens
tcactgccccaccagccacctct

SEQ ID NO: 6881868 - DNA, 15 bp, Homo sapiens
ttatgttcctgctgt

SEQ ID NO: 6881869 - DNA, 19 bp, Homo sapiens
tggaacagtgtttacttta

SEQ ID NO: 6881870 - DNA, 20 bp, Homo sapiens
cactgccttggcccctccct

SEQ ID NO: 6881871 - DNA, 12 bp, Homo sapiens
acatagcctttg

SEQ ID NO: 6881872 - DNA, 14 bp, Homo sapiens
caagaatgctgaaa

SEQ ID NO: 6881873 - DNA, 16 bp, Homo sapiens
aacaaacactgtgatg

SEQ ID NO: 6881874 - DNA, 18 bp, Homo sapiens
ggtggtcttcaagcctgg

SEQ ID NO: 6881875 - DNA, 16 bp, Homo sapiens
cttttaaagtgtttca

SEQ ID NO: 6881876 - DNA, 14 bp, Homo sapiens
cctccaccctgcat

SEQ ID NO: 6881877 - DNA, 17 bp, Homo sapiens
cactgaccatccactct

SEQ ID NO: 6881878 - DNA, 16 bp, Homo sapiens
catttcttcctctgca

SEQ ID NO: 6881879 - DNA, 16 bp, Homo sapiens
cttgtaaaactgtgac

SEQ ID NO: 6881880 - DNA, 17 bp, Homo sapiens
ctgcattgacctggagg

SEQ ID NO: 6881881 - DNA, 17 bp, Homo sapiens
aagcatttgccctgtgg

SEQ ID NO: 6881882 - DNA, 16 bp, Homo sapiens
ccttcttccccttccc

SEQ ID NO: 6881883 - DNA, 22 bp, Homo sapiens
acccctcccctcccacccacag

SEQ ID NO: 6881884 - DNA, 17 bp, Homo sapiens
cgggtggggctggtggg

SEQ ID NO: 6881885 - DNA, 15 bp, Homo sapiens
agttcccgctctgca

SEQ ID NO: 6881886 - DNA, 23 bp, Homo sapiens
aaatccaggtctcgggtccgatt

SEQ ID NO: 6881887 - DNA, 14 bp, Homo sapiens
tgtctcccctctgc

SEQ ID NO: 6881888 - DNA, 19 bp, Homo sapiens
actctttttctaaagtgtt

SEQ ID NO: 6881889 - DNA, 14 bp, Homo sapiens
cctgcccctgttct

SEQ ID NO: 6881890 - DNA, 14 bp, Homo sapiens
taaaagtatcttta

SEQ ID NO: 6881891 - DNA, 15 bp, Homo sapiens
acagagaagccttca

SEQ ID NO: 6881892 - DNA, 20 bp, Homo sapiens
tccacccttggcctgtctca

SEQ ID NO: 6881893 - DNA, 21 bp, Homo sapiens
ctcctgtaaatggtgtacata

SEQ ID NO: 6881894 - DNA, 22 bp, Homo sapiens
cacaatctttccttgtctctca

SEQ ID NO: 6881895 - DNA, 17 bp, Homo sapiens
atcaataaaattctgta

SEQ ID NO: 6881896 - DNA, 18 bp, Homo sapiens
ctatgcctgcactgggaa

SEQ ID NO: 6881897 - DNA, 17 bp, Homo sapiens
ctccagggaatccgcct

SEQ ID NO: 6881898 - DNA, 16 bp, Homo sapiens
tccaacgcccctgtgg

SEQ ID NO: 6881899 - DNA, 14 bp, Homo sapiens
cctcgccccagcct

SEQ ID NO: 6881900 - DNA, 16 bp, Homo sapiens
ctgatccctccacccc

SEQ ID NO: 6881901 - DNA, 17 bp, Homo sapiens
aggtgttttaagactga

SEQ ID NO: 6881902 - DNA, 21 bp, Homo sapiens
acctaaagggtatgagctgga

SEQ ID NO: 6881903 - DNA, 22 bp, Homo sapiens
cagtggcctcaaccctccctca

SEQ ID NO: 6881904 - DNA, 17 bp, Homo sapiens
gcctgcgctcctctgca

SEQ ID NO: 6881905 - DNA, 13 bp, Homo sapiens
ctatccctggcca

SEQ ID NO: 6881906 - DNA, 11 bp, Homo sapiens
acccagctcct

SEQ ID NO: 6881907 - DNA, 16 bp, Homo sapiens
tgctaacctcactgcc

SEQ ID NO: 6881908 - DNA, 17 bp, Homo sapiens
aaacttgttattgtgaa

SEQ ID NO: 6881909 - DNA, 20 bp, Homo sapiens
cagtacacttggtgtactgg

SEQ ID NO: 6881910 - DNA, 13 bp, Homo sapiens
gctctgcccaggc

SEQ ID NO: 6881911 - DNA, 16 bp, Homo sapiens
cagtaaataactggaa

SEQ ID NO: 6881912 - DNA, 23 bp, Homo sapiens
tttctcctgggcccgctttgcct

SEQ ID NO: 6881913 - DNA, 17 bp, Homo sapiens
atctggcaacatcttta

SEQ ID NO: 6881914 - DNA, 14 bp, Homo sapiens
catcctggaaattt

SEQ ID NO: 6881915 - DNA, 20 bp, Homo sapiens
aggagagtacccccctgaga

SEQ ID NO: 6881916 - DNA, 18 bp, Homo sapiens
tgacccggcctctctgcc

SEQ ID NO: 6881917 - DNA, 22 bp, Homo sapiens
tcaaagtgttgctgtggctcca

SEQ ID NO: 6881918 - DNA, 13 bp, Homo sapiens
agcctccctctga

SEQ ID NO: 6881919 - DNA, 22 bp, Homo sapiens
cctactgtggggagagatggca

SEQ ID NO: 6881920 - DNA, 14 bp, Homo sapiens
ctaagtccactcta

SEQ ID NO: 6881921 - DNA, 14 bp, Homo sapiens
tagtggtgttttaa

SEQ ID NO: 6881922 - DNA, 16 bp, Homo sapiens
taatgagaacatttac

SEQ ID NO: 6881923 - DNA, 23 bp, Homo sapiens
aggtttcccagtgagcctctgcg

SEQ ID NO: 6881924 - DNA, 22 bp, Homo sapiens
ccaacagcttgaccagacctag

SEQ ID NO: 6881925 - DNA, 15 bp, Homo sapiens
ctcatactggtctca

SEQ ID NO: 6881926 - DNA, 13 bp, Homo sapiens
accagccacctca

SEQ ID NO: 6881927 - DNA, 14 bp, Homo sapiens
cttagtcactgcct

SEQ ID NO: 6881928 - DNA, 19 bp, Homo sapiens
tgtcgctttctcagtgtgt

SEQ ID NO: 6881929 - DNA, 16 bp, Homo sapiens
tcttcctgacacttta

SEQ ID NO: 6881930 - DNA, 13 bp, Homo sapiens
caaactgcacatc

SEQ ID NO: 6881931 - DNA, 21 bp, Homo sapiens
ctcgttctcgtgacccagtgg

SEQ ID NO: 6881932 - DNA, 12 bp, Homo sapiens
tccccagctccc

SEQ ID NO: 6881933 - DNA, 12 bp, Homo sapiens
cacacagccaca

SEQ ID NO: 6881934 - DNA, 21 bp, Homo sapiens
actgagccaaacacactgtaa

SEQ ID NO: 6881935 - DNA, 16 bp, Homo sapiens
attgaagaaaagcact

SEQ ID NO: 6881936 - DNA, 14 bp, Homo sapiens
tcactgcaacctct

SEQ ID NO: 6881937 - DNA, 14 bp, Homo sapiens
caatggtgcttccc

SEQ ID NO: 6881938 - DNA, 13 bp, Homo sapiens
caatcttggagct

SEQ ID NO: 6881939 - DNA, 22 bp, Homo sapiens
cactgccatggaattccctcct

SEQ ID NO: 6881940 - DNA, 16 bp, Homo sapiens
ccgtcgggcccctgcc

SEQ ID NO: 6881941 - DNA, 21 bp, Homo sapiens
gcacaaacacacctctgccac

SEQ ID NO: 6881942 - DNA, 23 bp, Homo sapiens
agcagctggtgccccacctgcct

SEQ ID NO: 6881943 - DNA, 17 bp, Homo sapiens
ctgtcctctcccctcca

SEQ ID NO: 6881944 - DNA, 16 bp, Homo sapiens
ctatctcccccagccc

SEQ ID NO: 6881945 - DNA, 13 bp, Homo sapiens
tagatctgagccc

SEQ ID NO: 6881946 - DNA, 16 bp, Homo sapiens
cttgaacactggggga

SEQ ID NO: 6881947 - DNA, 22 bp, Homo sapiens
agtgaaaatcgaggaagcacct

SEQ ID NO: 6881948 - DNA, 17 bp, Homo sapiens
agtctttctcactgcct

SEQ ID NO: 6881949 - DNA, 23 bp, Homo sapiens
ccagctctgttcttcctcagcca

SEQ ID NO: 6881950 - DNA, 19 bp, Homo sapiens
ggcaattgttacaagtgtt

SEQ ID NO: 6881951 - DNA, 16 bp, Homo sapiens
aatactgttattcttt

SEQ ID NO: 6881952 - DNA, 14 bp, Homo sapiens
agtgggcctgctga

SEQ ID NO: 6881953 - DNA, 11 bp, Homo sapiens
tgcagtacttt

SEQ ID NO: 6881954 - DNA, 18 bp, Homo sapiens
aagtataaagtcacttcc

SEQ ID NO: 6881955 - DNA, 17 bp, Homo sapiens
ttcctaaagtctctgct

SEQ ID NO: 6881956 - DNA, 11 bp, Homo sapiens
tctctcttcca

SEQ ID NO: 6881957 - DNA, 21 bp, Homo sapiens
ctgacaggatgtggcactgct

SEQ ID NO: 6881958 - DNA, 14 bp, Homo sapiens
tccccacctgctca

SEQ ID NO: 6881959 - DNA, 21 bp, Homo sapiens
agcctccgacgctgcctctca

SEQ ID NO: 6881960 - DNA, 13 bp, Homo sapiens
attcagtacttta

SEQ ID NO: 6881961 - DNA, 18 bp, Homo sapiens
tatttgaatcttgtctca

SEQ ID NO: 6881962 - DNA, 22 bp, Homo sapiens
ctgtagctccctcctcccatct

SEQ ID NO: 6881963 - DNA, 15 bp, Homo sapiens
aaatgcatgatttta

SEQ ID NO: 6881964 - DNA, 15 bp, Homo sapiens
ggtgtcaccccagag

SEQ ID NO: 6881965 - DNA, 15 bp, Homo sapiens
cactttcccccttcc

SEQ ID NO: 6881966 - DNA, 15 bp, Homo sapiens
agctaccctcagcct

SEQ ID NO: 6881967 - DNA, 19 bp, Homo sapiens
ccctgctgtcattgcttct

SEQ ID NO: 6881968 - DNA, 14 bp, Homo sapiens
cgccagcttggctc

SEQ ID NO: 6881969 - DNA, 19 bp, Homo sapiens
acatagccgattctctgcc

SEQ ID NO: 6881970 - DNA, 15 bp, Homo sapiens
gtgccgcctgctcct

SEQ ID NO: 6881971 - DNA, 18 bp, Homo sapiens
cctgcccgaccccatctc

SEQ ID NO: 6881972 - DNA, 16 bp, Homo sapiens
ctttccaccccctccc

SEQ ID NO: 6881973 - DNA, 13 bp, Homo sapiens
ctttgtctgtcca

SEQ ID NO: 6881974 - DNA, 23 bp, Homo sapiens
tcgtgccagggcaggctacccct

SEQ ID NO: 6881975 - DNA, 18 bp, Homo sapiens
ccccaggcatcccatccc

SEQ ID NO: 6881976 - DNA, 13 bp, Homo sapiens
atgaaaagccata

SEQ ID NO: 6881977 - DNA, 14 bp, Homo sapiens
cacaggccttctgt

SEQ ID NO: 6881978 - DNA, 20 bp, Homo sapiens
ttgcctgctgagctgtgccc

SEQ ID NO: 6881979 - DNA, 19 bp, Homo sapiens
tgatattccatagtatatt

SEQ ID NO: 6881980 - DNA, 17 bp, Homo sapiens
cagcacccactcagcca

SEQ ID NO: 6881981 - DNA, 15 bp, Homo sapiens
tgctccctcctctcc

SEQ ID NO: 6881982 - DNA, 20 bp, Homo sapiens
aggctggcgagagtctggcc

SEQ ID NO: 6881983 - DNA, 16 bp, Homo sapiens
ccatcccgcccttccc

SEQ ID NO: 6881984 - DNA, 17 bp, Homo sapiens
cacatgcatacacacac

SEQ ID NO: 6881985 - DNA, 17 bp, Homo sapiens
cctctgcttgccatccc

SEQ ID NO: 6881986 - DNA, 19 bp, Homo sapiens
tcccggccccgcgcgtgcc

SEQ ID NO: 6881987 - DNA, 23 bp, Homo sapiens
caatcaaaaatatgtgtttttaa

SEQ ID NO: 6881988 - DNA, 23 bp, Homo sapiens
ccactctcaggaccaccctgcca

SEQ ID NO: 6881989 - DNA, 15 bp, Homo sapiens
cattattgtagtttg

SEQ ID NO: 6881990 - DNA, 16 bp, Homo sapiens
atgtttttaaaagttt

SEQ ID NO: 6881991 - DNA, 15 bp, Homo sapiens
cttcctgcccttccc

SEQ ID NO: 6881992 - DNA, 17 bp, Homo sapiens
acccacaagctgcctct

SEQ ID NO: 6881993 - DNA, 17 bp, Homo sapiens
caatctccagggctcca

SEQ ID NO: 6881994 - DNA, 21 bp, Homo sapiens
caataaagtgaccctgctctc

SEQ ID NO: 6881995 - DNA, 18 bp, Homo sapiens
gaacagtgctctgcctct

SEQ ID NO: 6881996 - DNA, 17 bp, Homo sapiens
agttgtgttcatgctga

SEQ ID NO: 6881997 - DNA, 23 bp, Homo sapiens
aacaataatatttcaagtgccta

SEQ ID NO: 6881998 - DNA, 19 bp, Homo sapiens
gctcctccttcccctgtgg

SEQ ID NO: 6881999 - DNA, 18 bp, Homo sapiens
tctctccccttgcactgg

SEQ ID NO: 6882000 - DNA, 21 bp, Homo sapiens
gtaatttaagtgacacagaca

SEQ ID NO: 6882001 - DNA, 20 bp, Homo sapiens
ctgcctacattccctggcct

SEQ ID NO: 6882002 - DNA, 24 bp, Homo sapiens
ctggagaaagagctgcctggatga

SEQ ID NO: 6882003 - DNA, 20 bp, Homo sapiens
ataaagtgagaaaactgtga

SEQ ID NO: 6882004 - DNA, 17 bp, Homo sapiens
ttcttgcttggaagcca

SEQ ID NO: 6882005 - DNA, 15 bp, Homo sapiens
gcctgccctgcctca

SEQ ID NO: 6882006 - DNA, 15 bp, Homo sapiens
gtgtccttcctccac

SEQ ID NO: 6882007 - DNA, 18 bp, Homo sapiens
cctggggtctctctccct

SEQ ID NO: 6882008 - DNA, 16 bp, Homo sapiens
cagcagctggacttga

SEQ ID NO: 6882009 - DNA, 20 bp, Homo sapiens
caactccaacctctcggccc

SEQ ID NO: 6882010 - DNA, 12 bp, Homo sapiens
atcttcctgtgt

SEQ ID NO: 6882011 - DNA, 14 bp, Homo sapiens
agggcatctcctgt

SEQ ID NO: 6882012 - DNA, 21 bp, Homo sapiens
ctggatttatagtatgtgact

SEQ ID NO: 6882013 - DNA, 13 bp, Homo sapiens
atgatcagtgttg

SEQ ID NO: 6882014 - DNA, 16 bp, Homo sapiens
ggtaactcttcttgat

SEQ ID NO: 6882015 - DNA, 21 bp, Homo sapiens
taagaacacctgacaacttct

SEQ ID NO: 6882016 - DNA, 20 bp, Homo sapiens
accaggaggggtctgcctcc

SEQ ID NO: 6882017 - DNA, 21 bp, Homo sapiens
ttccagttttttgccactgca

SEQ ID NO: 6882018 - DNA, 21 bp, Homo sapiens
gattaaacagcaaagccatat

SEQ ID NO: 6882019 - DNA, 17 bp, Homo sapiens
ccatttgccatgctgct

SEQ ID NO: 6882020 - DNA, 15 bp, Homo sapiens
agctgccctagctga

SEQ ID NO: 6882021 - DNA, 14 bp, Homo sapiens
ctaattaacatata

SEQ ID NO: 6882022 - DNA, 19 bp, Homo sapiens
tcgtctcaatggtattgta

SEQ ID NO: 6882023 - DNA, 19 bp, Homo sapiens
ctttaaactcagggacaga

SEQ ID NO: 6882024 - DNA, 21 bp, Homo sapiens
ccttgtgatgtcatacagaga

SEQ ID NO: 6882025 - DNA, 18 bp, Homo sapiens
aattctggtcacattcca

SEQ ID NO: 6882026 - DNA, 21 bp, Homo sapiens
ctcctcttcatggcatcttca

SEQ ID NO: 6882027 - DNA, 15 bp, Homo sapiens
agagatgtgtgttga

SEQ ID NO: 6882028 - DNA, 18 bp, Homo sapiens
cttcctgccctgtggccc

SEQ ID NO: 6882029 - DNA, 21 bp, Homo sapiens
cctggggtataaaactttcct

SEQ ID NO: 6882030 - DNA, 21 bp, Homo sapiens
ttggcctgctaaggtcttgga

SEQ ID NO: 6882031 - DNA, 21 bp, Homo sapiens
atctgtaacactattacagta

SEQ ID NO: 6882032 - DNA, 12 bp, Homo sapiens
atacttttgcaa

SEQ ID NO: 6882033 - DNA, 14 bp, Homo sapiens
aattgcctgatttg

SEQ ID NO: 6882034 - DNA, 15 bp, Homo sapiens
aggcccccctctgcc

SEQ ID NO: 6882035 - DNA, 21 bp, Homo sapiens
ggacatcctgtcatctgagaa

SEQ ID NO: 6882036 - DNA, 21 bp, Homo sapiens
tgcacctcctaccctcccacc

SEQ ID NO: 6882037 - DNA, 21 bp, Homo sapiens
cctttcccatcaccccttccc

SEQ ID NO: 6882038 - DNA, 13 bp, Homo sapiens
caaagcagccacg

SEQ ID NO: 6882039 - DNA, 22 bp, Homo sapiens
gcatgtgcggctgaactgagaa

SEQ ID NO: 6882040 - DNA, 16 bp, Homo sapiens
aaatatcacagtatta

SEQ ID NO: 6882041 - DNA, 14 bp, Homo sapiens
ctgccctctgctct

SEQ ID NO: 6882042 - DNA, 16 bp, Homo sapiens
ctatattttatttctg

SEQ ID NO: 6882043 - DNA, 15 bp, Homo sapiens
cttctgactcttccc

SEQ ID NO: 6882044 - DNA, 24 bp, Homo sapiens
aaactgtaaaatgatactgtagaa

SEQ ID NO: 6882045 - DNA, 23 bp, Homo sapiens
ataattttgtgttgtacaattaa

SEQ ID NO: 6882046 - DNA, 15 bp, Homo sapiens
accgtccctcagtga

SEQ ID NO: 6882047 - DNA, 19 bp, Homo sapiens
acttacatttacaaactga

SEQ ID NO: 6882048 - DNA, 19 bp, Homo sapiens
ggaagattaaaaccacaga

SEQ ID NO: 6882049 - DNA, 16 bp, Homo sapiens
accagcaggctcctca

SEQ ID NO: 6882050 - DNA, 14 bp, Homo sapiens
cacttgcctcttcc

SEQ ID NO: 6882051 - DNA, 16 bp, Homo sapiens
ccaaggctctgagcaa

SEQ ID NO: 6882052 - DNA, 13 bp, Homo sapiens
tggtttgccatgt

SEQ ID NO: 6882053 - DNA, 15 bp, Homo sapiens
gtcctgaagctgctg

SEQ ID NO: 6882054 - DNA, 17 bp, Homo sapiens
cttacaattgcactgct

SEQ ID NO: 6882055 - DNA, 17 bp, Homo sapiens
cacctcagatggcagct

SEQ ID NO: 6882056 - DNA, 19 bp, Homo sapiens
ctgaataccacttacctca

SEQ ID NO: 6882057 - DNA, 16 bp, Homo sapiens
catggttttacagtga

SEQ ID NO: 6882058 - DNA, 14 bp, Homo sapiens
tctttattgcacta

SEQ ID NO: 6882059 - DNA, 14 bp, Homo sapiens
tacagagcctgttt

SEQ ID NO: 6882060 - DNA, 12 bp, Homo sapiens
ctattaacatga

SEQ ID NO: 6882061 - DNA, 18 bp, Homo sapiens
ccaccagtctgactgttt

SEQ ID NO: 6882062 - DNA, 23 bp, Homo sapiens
taagtgctgtataaaatcagcca

SEQ ID NO: 6882063 - DNA, 19 bp, Homo sapiens
taaaaatctaccttctgta

SEQ ID NO: 6882064 - DNA, 17 bp, Homo sapiens
cctttcctccccacctt

SEQ ID NO: 6882065 - DNA, 15 bp, Homo sapiens
tacagtttgtttaca

SEQ ID NO: 6882066 - DNA, 15 bp, Homo sapiens
acaaaactgttcttt

SEQ ID NO: 6882067 - DNA, 19 bp, Homo sapiens
gcctgggaggaagatgttt

SEQ ID NO: 6882068 - DNA, 23 bp, Homo sapiens
gatatcattttaaaaactttatt

SEQ ID NO: 6882069 - DNA, 12 bp, Homo sapiens
ccaatgctgctt

SEQ ID NO: 6882070 - DNA, 17 bp, Homo sapiens
ctattttttctgaggaa

SEQ ID NO: 6882071 - DNA, 15 bp, Homo sapiens
agcctgagcaggcag

SEQ ID NO: 6882072 - DNA, 16 bp, Homo sapiens
accttgaatgctgcca

SEQ ID NO: 6882073 - DNA, 16 bp, Homo sapiens
ctctgctgaatgcagg

SEQ ID NO: 6882074 - DNA, 14 bp, Homo sapiens
catactgtctggga

SEQ ID NO: 6882075 - DNA, 14 bp, Homo sapiens
ttctctgcttgcct

SEQ ID NO: 6882076 - DNA, 13 bp, Homo sapiens
acagcctcttgcc

SEQ ID NO: 6882077 - DNA, 22 bp, Homo sapiens
ggtccgcaccagctgctctgcc

SEQ ID NO: 6882078 - DNA, 16 bp, Homo sapiens
atgcggatcctgctgg

SEQ ID NO: 6882079 - DNA, 17 bp, Homo sapiens
ctctggggggcagttgg

SEQ ID NO: 6882080 - DNA, 16 bp, Homo sapiens
caggccagctcaggaa

SEQ ID NO: 6882081 - DNA, 12 bp, Homo sapiens
cgtgagcatgca

SEQ ID NO: 6882082 - DNA, 13 bp, Homo sapiens
ccccaccccttcc

SEQ ID NO: 6882083 - DNA, 22 bp, Homo sapiens
caattccatgacaatatgccct

SEQ ID NO: 6882084 - DNA, 14 bp, Homo sapiens
ccgtccgccctgct

SEQ ID NO: 6882085 - DNA, 12 bp, Homo sapiens
cttatgcttcca

SEQ ID NO: 6882086 - DNA, 21 bp, Homo sapiens
tagaggcttctccgccagcct

SEQ ID NO: 6882087 - DNA, 16 bp, Homo sapiens
tgcacctccccccact

SEQ ID NO: 6882088 - DNA, 17 bp, Homo sapiens
aggggtggccgtcctga

SEQ ID NO: 6882089 - DNA, 21 bp, Homo sapiens
tgccagtcgcgctgcctgtgt

SEQ ID NO: 6882090 - DNA, 14 bp, Homo sapiens
gctgatcctgctga

SEQ ID NO: 6882091 - DNA, 20 bp, Homo sapiens
ctttctcccccgacactgct

SEQ ID NO: 6882092 - DNA, 23 bp, Homo sapiens
tcagtgtgctaacctcactgcct

SEQ ID NO: 6882093 - DNA, 21 bp, Homo sapiens
ttctcaaaagaggttacttta

SEQ ID NO: 6882094 - DNA, 18 bp, Homo sapiens
gaaaacttcaaagctgaa

SEQ ID NO: 6882095 - DNA, 20 bp, Homo sapiens
ctactcagcagccctcctca

SEQ ID NO: 6882096 - DNA, 20 bp, Homo sapiens
tggtggcagctcacctctcc

SEQ ID NO: 6882097 - DNA, 21 bp, Homo sapiens
gtagccatcaagcacttccca

SEQ ID NO: 6882098 - DNA, 13 bp, Homo sapiens
tgctatgaagcca

SEQ ID NO: 6882099 - DNA, 15 bp, Homo sapiens
tctcctgtgatgtcc

SEQ ID NO: 6882100 - DNA, 23 bp, Homo sapiens
aatggccagcccagatggctccc

SEQ ID NO: 6882101 - DNA, 21 bp, Homo sapiens
tgcgtggtatacatgtgtaca

SEQ ID NO: 6882102 - DNA, 18 bp, Homo sapiens
ccaacccctccttcccca

SEQ ID NO: 6882103 - DNA, 19 bp, Homo sapiens
ctctgctatgtctgtgatg

SEQ ID NO: 6882104 - DNA, 18 bp, Homo sapiens
gcccttccatgtgccttt

SEQ ID NO: 6882105 - DNA, 21 bp, Homo sapiens
acctagcaacatatctctgcc

SEQ ID NO: 6882106 - DNA, 15 bp, Homo sapiens
acttgttattgtgaa

SEQ ID NO: 6882107 - DNA, 21 bp, Homo sapiens
cctcccagacctgcctcttcc

SEQ ID NO: 6882108 - DNA, 17 bp, Homo sapiens
atcccttcaaccccact

SEQ ID NO: 6882109 - DNA, 16 bp, Homo sapiens
tccagaaacagctgct

SEQ ID NO: 6882110 - DNA, 19 bp, Homo sapiens
ataccccctgccccagaga

SEQ ID NO: 6882111 - DNA, 22 bp, Homo sapiens
cttacaaggcaggcctttccta

SEQ ID NO: 6882112 - DNA, 23 bp, Homo sapiens
aatgtggttatttctctgatttg

SEQ ID NO: 6882113 - DNA, 14 bp, Homo sapiens
ctctgcctgcattc

SEQ ID NO: 6882114 - DNA, 17 bp, Homo sapiens
cattaaccgatgcttta

SEQ ID NO: 6882115 - DNA, 13 bp, Homo sapiens
aggaaggctgtga

SEQ ID NO: 6882116 - DNA, 20 bp, Homo sapiens
actatcccctgcgctttgaa

SEQ ID NO: 6882117 - DNA, 19 bp, Homo sapiens
ctgtgagcatggggccagg

SEQ ID NO: 6882118 - DNA, 13 bp, Homo sapiens
cacacacacaaaa

SEQ ID NO: 6882119 - DNA, 22 bp, Homo sapiens
tggttcagggttggcccctgcc

SEQ ID NO: 6882120 - DNA, 23 bp, Homo sapiens
cttttgaataatgtagtgcagtc

SEQ ID NO: 6882121 - DNA, 18 bp, Homo sapiens
cctgtttttaagctgttt

SEQ ID NO: 6882122 - DNA, 20 bp, Homo sapiens
gtgggccctaccctcctgct

SEQ ID NO: 6882123 - DNA, 15 bp, Homo sapiens
ttcattgctgtgtca

SEQ ID NO: 6882124 - DNA, 23 bp, Homo sapiens
tcatggctgttatctgtctttat

SEQ ID NO: 6882125 - DNA, 19 bp, Homo sapiens
acctaatgggaatcattcc

SEQ ID NO: 6882126 - DNA, 20 bp, Homo sapiens
tctcctgggcagctgcctcc

SEQ ID NO: 6882127 - DNA, 22 bp, Homo sapiens
ttccctgcccctgtgcctctgt

SEQ ID NO: 6882128 - DNA, 13 bp, Homo sapiens
cagtgtctgttca

SEQ ID NO: 6882129 - DNA, 19 bp, Homo sapiens
ccatgtagaacttgaacta

SEQ ID NO: 6882130 - DNA, 14 bp, Homo sapiens
catggagttgtgat

SEQ ID NO: 6882131 - DNA, 17 bp, Homo sapiens
cctgcctcagccttcca

SEQ ID NO: 6882132 - DNA, 19 bp, Homo sapiens
ccagtgtctggcccagcca

SEQ ID NO: 6882133 - DNA, 21 bp, Homo sapiens
gtctcactgtgttgcccaggc

SEQ ID NO: 6882134 - DNA, 20 bp, Homo sapiens
ctgcagtttggccctggagc

SEQ ID NO: 6882135 - DNA, 18 bp, Homo sapiens
tctcattgtcacctctgt

SEQ ID NO: 6882136 - DNA, 17 bp, Homo sapiens
agcccagccctgttctg

SEQ ID NO: 6882137 - DNA, 18 bp, Homo sapiens
tagattgttttgccactt

SEQ ID NO: 6882138 - DNA, 17 bp, Homo sapiens
ctaataagctagttgaa

SEQ ID NO: 6882139 - DNA, 23 bp, Homo sapiens
ttacagaagagtaaactggtgag

SEQ ID NO: 6882140 - DNA, 19 bp, Homo sapiens
cctttacctaccaccttcc

SEQ ID NO: 6882141 - DNA, 13 bp, Homo sapiens
ctctgctgtctaa

SEQ ID NO: 6882142 - DNA, 23 bp, Homo sapiens
ctatcctgggacctccccagccc

SEQ ID NO: 6882143 - DNA, 23 bp, Homo sapiens
aattttttttttaaatgattcca

SEQ ID NO: 6882144 - DNA, 15 bp, Homo sapiens
cgtgaagccacagga

SEQ ID NO: 6882145 - DNA, 18 bp, Homo sapiens
ctgtcaccaccctgctca

SEQ ID NO: 6882146 - DNA, 16 bp, Homo sapiens
acaaaaggaagactgg

SEQ ID NO: 6882147 - DNA, 18 bp, Homo sapiens
atctgtctgagccctgcc

SEQ ID NO: 6882148 - DNA, 22 bp, Homo sapiens
agggcgtgtggtttccctgccc

SEQ ID NO: 6882149 - DNA, 19 bp, Homo sapiens
cctcagtctggcccttcct

SEQ ID NO: 6882150 - DNA, 15 bp, Homo sapiens
acactctgcctggcc

SEQ ID NO: 6882151 - DNA, 13 bp, Homo sapiens
cattccgcagccc

SEQ ID NO: 6882152 - DNA, 12 bp, Homo sapiens
cagaacagctgt

SEQ ID NO: 6882153 - DNA, 22 bp, Homo sapiens
acttgaagcacttaagtcttcc

SEQ ID NO: 6882154 - DNA, 23 bp, Homo sapiens
cctgggcaggcggtccccatccc

SEQ ID NO: 6882155 - DNA, 20 bp, Homo sapiens
cacctgcaaagctctgtggc

SEQ ID NO: 6882156 - DNA, 16 bp, Homo sapiens
aggtcccagttgctgt

SEQ ID NO: 6882157 - DNA, 15 bp, Homo sapiens
ctaacctcactgcct

SEQ ID NO: 6882158 - DNA, 23 bp, Homo sapiens
ctccaaccttctgccctcctgcc

SEQ ID NO: 6882159 - DNA, 19 bp, Homo sapiens
agccacagggtctgcctcc

SEQ ID NO: 6882160 - DNA, 16 bp, Homo sapiens
agtgtctttctagcca

SEQ ID NO: 6882161 - DNA, 14 bp, Homo sapiens
gcccagcctctgcc

SEQ ID NO: 6882162 - DNA, 14 bp, Homo sapiens
cttatcagaactcc

SEQ ID NO: 6882163 - DNA, 12 bp, Homo sapiens
ctcagcagttga

SEQ ID NO: 6882164 - DNA, 12 bp, Homo sapiens
ttctgcagctgt

SEQ ID NO: 6882165 - DNA, 20 bp, Homo sapiens
tgcatttaaaagatacagtt

SEQ ID NO: 6882166 - DNA, 14 bp, Homo sapiens
tgccaatgccatga

SEQ ID NO: 6882167 - DNA, 14 bp, Homo sapiens
gaaaagctgcctct

SEQ ID NO: 6882168 - DNA, 17 bp, Homo sapiens
ctctgctggctcaggag

SEQ ID NO: 6882169 - DNA, 23 bp, Homo sapiens
gaggcctataatgaagctttata

SEQ ID NO: 6882170 - DNA, 16 bp, Homo sapiens
agctgtcttcccctga

SEQ ID NO: 6882171 - DNA, 19 bp, Homo sapiens
agacaagctcctcccttga

SEQ ID NO: 6882172 - DNA, 12 bp, Homo sapiens
agccccacccag

SEQ ID NO: 6882173 - DNA, 21 bp, Homo sapiens
agtctaggagctccttctggc

SEQ ID NO: 6882174 - DNA, 16 bp, Homo sapiens
aggctgggcccctggg

SEQ ID NO: 6882175 - DNA, 23 bp, Homo sapiens
catctcctgctcaccacctgcct

SEQ ID NO: 6882176 - DNA, 13 bp, Homo sapiens
actttctctctcc

SEQ ID NO: 6882177 - DNA, 21 bp, Homo sapiens
tttggatatgtaaaacattta

SEQ ID NO: 6882178 - DNA, 20 bp, Homo sapiens
acatcaccgacgcgtctcct

SEQ ID NO: 6882179 - DNA, 14 bp, Homo sapiens
ccttcccccatccc

SEQ ID NO: 6882180 - DNA, 15 bp, Homo sapiens
actcctacctcagcc

SEQ ID NO: 6882181 - DNA, 13 bp, Homo sapiens
ctgttctgcactg

SEQ ID NO: 6882182 - DNA, 13 bp, Homo sapiens
cactgatggctca

SEQ ID NO: 6882183 - DNA, 17 bp, Homo sapiens
gcctgcatcttcttgca

SEQ ID NO: 6882184 - DNA, 19 bp, Homo sapiens
cccatccagctaccaccac

SEQ ID NO: 6882185 - DNA, 20 bp, Homo sapiens
acaaaagaagcccggctcct

SEQ ID NO: 6882186 - DNA, 17 bp, Homo sapiens
cccattctataaattca

SEQ ID NO: 6882187 - DNA, 21 bp, Homo sapiens
ccagccctgctggccgcctca

SEQ ID NO: 6882188 - DNA, 23 bp, Homo sapiens
acgatcaagttgttgactgtgat

SEQ ID NO: 6882189 - DNA, 22 bp, Homo sapiens
agtccgggccggggcctctgcc

SEQ ID NO: 6882190 - DNA, 18 bp, Homo sapiens
ccctagcaatacagggag

SEQ ID NO: 6882191 - DNA, 17 bp, Homo sapiens
cagttcatactgaatga

SEQ ID NO: 6882192 - DNA, 17 bp, Homo sapiens
aaatgtatccagaggaa

SEQ ID NO: 6882193 - DNA, 16 bp, Homo sapiens
tgagaatgtgccatgt

SEQ ID NO: 6882194 - DNA, 21 bp, Homo sapiens
caattcaggactggctcaccc

SEQ ID NO: 6882195 - DNA, 17 bp, Homo sapiens
ctgataaagttccttaa

SEQ ID NO: 6882196 - DNA, 18 bp, Homo sapiens
gaatgtcatttgctaatg

SEQ ID NO: 6882197 - DNA, 19 bp, Homo sapiens
tatgccccattcaacatct

SEQ ID NO: 6882198 - DNA, 22 bp, Homo sapiens
ccttcccagctctccctctggc

SEQ ID NO: 6882199 - DNA, 12 bp, Homo sapiens
cttcctgcagtc

SEQ ID NO: 6882200 - DNA, 23 bp, Homo sapiens
ctctccagcctcagccccctgct

SEQ ID NO: 6882201 - DNA, 19 bp, Homo sapiens
agtcattccacacatttcc

SEQ ID NO: 6882202 - DNA, 14 bp, Homo sapiens
aaaagttgcagctg

SEQ ID NO: 6882203 - DNA, 15 bp, Homo sapiens
cactatagtgtaata

SEQ ID NO: 6882204 - DNA, 14 bp, Homo sapiens
tagccgactgcgct

SEQ ID NO: 6882205 - DNA, 15 bp, Homo sapiens
ccctgtcgcccctcc

SEQ ID NO: 6882206 - DNA, 16 bp, Homo sapiens
acttgtgtctctgtgc

SEQ ID NO: 6882207 - DNA, 16 bp, Homo sapiens
cagatcaccccagcct

SEQ ID NO: 6882208 - DNA, 16 bp, Homo sapiens
aggtgctgacggccag

SEQ ID NO: 6882209 - DNA, 17 bp, Homo sapiens
aggaagtgtaacagctg

SEQ ID NO: 6882210 - DNA, 15 bp, Homo sapiens
cattacgtgcattta

SEQ ID NO: 6882211 - DNA, 15 bp, Homo sapiens
cattccagacttcaa

SEQ ID NO: 6882212 - DNA, 22 bp, Homo sapiens
ttctgtgcatttgtgtctgcct

SEQ ID NO: 6882213 - DNA, 16 bp, Homo sapiens
agatttgtacatatta

SEQ ID NO: 6882214 - DNA, 17 bp, Homo sapiens
cttctgaagtgctgctc

SEQ ID NO: 6882215 - DNA, 23 bp, Homo sapiens
cactcacacagccaggtgccttg

SEQ ID NO: 6882216 - DNA, 16 bp, Homo sapiens
caagagcatcatgcct

SEQ ID NO: 6882217 - DNA, 14 bp, Homo sapiens
ccatggcttcctcc

SEQ ID NO: 6882218 - DNA, 20 bp, Homo sapiens
cacttcaagctcaccctgct

SEQ ID NO: 6882219 - DNA, 14 bp, Homo sapiens
ggcagctcacctct

SEQ ID NO: 6882220 - DNA, 18 bp, Homo sapiens
cctcccaagacccagccg

SEQ ID NO: 6882221 - DNA, 23 bp, Homo sapiens
ctcttttaccctggcccctctcc

SEQ ID NO: 6882222 - DNA, 21 bp, Homo sapiens
acagcagtcacaggcccagga

SEQ ID NO: 6882223 - DNA, 23 bp, Homo sapiens
agccttgaactttgacctctgca

SEQ ID NO: 6882224 - DNA, 12 bp, Homo sapiens
tgggacaattag

SEQ ID NO: 6882225 - DNA, 17 bp, Homo sapiens
gtctattgtcacatgat

SEQ ID NO: 6882226 - DNA, 16 bp, Homo sapiens
aaaatgagactttcta

SEQ ID NO: 6882227 - DNA, 14 bp, Homo sapiens
tcttaggtttactg

SEQ ID NO: 6882228 - DNA, 23 bp, Homo sapiens
tctgtaccccatgaccttatcct

SEQ ID NO: 6882229 - DNA, 22 bp, Homo sapiens
cccacaatttctttaaaaaaga

SEQ ID NO: 6882230 - DNA, 20 bp, Homo sapiens
gcaccgtgtcctcctctgag

SEQ ID NO: 6882231 - DNA, 18 bp, Homo sapiens
tacttaattcctttctca

SEQ ID NO: 6882232 - DNA, 19 bp, Homo sapiens
ttcccgccccacctcccat

SEQ ID NO: 6882233 - DNA, 17 bp, Homo sapiens
taattccacagctgctc

SEQ ID NO: 6882234 - DNA, 22 bp, Homo sapiens
gccaccccactgagagctgctc

SEQ ID NO: 6882235 - DNA, 20 bp, Homo sapiens
gatgtccctgaagtcttgca

SEQ ID NO: 6882236 - DNA, 23 bp, Homo sapiens
cttttggtcttcagcctccctca

SEQ ID NO: 6882237 - DNA, 19 bp, Homo sapiens
actttgtcctaagagattt

SEQ ID NO: 6882238 - DNA, 17 bp, Homo sapiens
aggattttatgctttaa

SEQ ID NO: 6882239 - DNA, 14 bp, Homo sapiens
cagcatcccagcct

SEQ ID NO: 6882240 - DNA, 16 bp, Homo sapiens
ctccactccactgcct

SEQ ID NO: 6882241 - DNA, 15 bp, Homo sapiens
tgtaattatatctga

SEQ ID NO: 6882242 - DNA, 21 bp, Homo sapiens
gtttaggcctcatttctttgt

SEQ ID NO: 6882243 - DNA, 16 bp, Homo sapiens
ggaccagtcccagagc

SEQ ID NO: 6882244 - DNA, 13 bp, Homo sapiens
acaagccctggca

SEQ ID NO: 6882245 - DNA, 22 bp, Homo sapiens
taatgtaactgctcttgggcaa

SEQ ID NO: 6882246 - DNA, 22 bp, Homo sapiens
caacaggacagagttcacagga

SEQ ID NO: 6882247 - DNA, 16 bp, Homo sapiens
actggcccacccctct

SEQ ID NO: 6882248 - DNA, 13 bp, Homo sapiens
tttacgtactgta

SEQ ID NO: 6882249 - DNA, 22 bp, Homo sapiens
ggacagattcagtcttgcctta

SEQ ID NO: 6882250 - DNA, 22 bp, Homo sapiens
atcaccagtcctagctcttaca

SEQ ID NO: 6882251 - DNA, 20 bp, Homo sapiens
agctgctgttctcaggacag

SEQ ID NO: 6882252 - DNA, 20 bp, Homo sapiens
ctcagcctacagcagtgtgg

SEQ ID NO: 6882253 - DNA, 17 bp, Homo sapiens
ccgacaccactcctgcc

SEQ ID NO: 6882254 - DNA, 22 bp, Homo sapiens
catgttcacaccgctgcactca

SEQ ID NO: 6882255 - DNA, 13 bp, Homo sapiens
atctgtctgtgca

SEQ ID NO: 6882256 - DNA, 14 bp, Homo sapiens
agccatgcccagga

SEQ ID NO: 6882257 - DNA, 23 bp, Homo sapiens
tggaacccggtgctccctctgtc

SEQ ID NO: 6882258 - DNA, 16 bp, Homo sapiens
ggtgcagagtgcccag

SEQ ID NO: 6882259 - DNA, 22 bp, Homo sapiens
tccagcaggagggacagtctca

SEQ ID NO: 6882260 - DNA, 20 bp, Homo sapiens
gtgatttgtaaaacagtggt

SEQ ID NO: 6882261 - DNA, 20 bp, Homo sapiens
tcatgttaacctctgctttt

SEQ ID NO: 6882262 - DNA, 12 bp, Homo sapiens
gtataatgtgat

SEQ ID NO: 6882263 - DNA, 12 bp, Homo sapiens
gtaaaatgtgaa

SEQ ID NO: 6882264 - DNA, 15 bp, Homo sapiens
cctcccgcccttcca

SEQ ID NO: 6882265 - DNA, 15 bp, Homo sapiens
ctcagtgctttcctc

SEQ ID NO: 6882266 - DNA, 13 bp, Homo sapiens
cccagcctgctct

SEQ ID NO: 6882267 - DNA, 22 bp, Homo sapiens
ccctctgcccccagctgctcct

SEQ ID NO: 6882268 - DNA, 15 bp, Homo sapiens
accacttatttctaa

SEQ ID NO: 6882269 - DNA, 20 bp, Homo sapiens
aagctccaggtgccctgtgg

SEQ ID NO: 6882270 - DNA, 17 bp, Homo sapiens
cctttgggttctttctg

SEQ ID NO: 6882271 - DNA, 13 bp, Homo sapiens
gttccctctgcct

SEQ ID NO: 6882272 - DNA, 18 bp, Homo sapiens
acctcagatggcagcttt

SEQ ID NO: 6882273 - DNA, 17 bp, Homo sapiens
atttgctgaatatgcaa

SEQ ID NO: 6882274 - DNA, 17 bp, Homo sapiens
caggatggcctttcctt

SEQ ID NO: 6882275 - DNA, 18 bp, Homo sapiens
gctaagcctctgcttccg

SEQ ID NO: 6882276 - DNA, 14 bp, Homo sapiens
cctgccccctgcca

SEQ ID NO: 6882277 - DNA, 23 bp, Homo sapiens
caggcagtagatgtgcttctgaa

SEQ ID NO: 6882278 - DNA, 17 bp, Homo sapiens
acaaatttaacttttaa

SEQ ID NO: 6882279 - DNA, 19 bp, Homo sapiens
cttgtaggtttctctgcct

SEQ ID NO: 6882280 - DNA, 12 bp, Homo sapiens
tccacatctgcc

SEQ ID NO: 6882281 - DNA, 15 bp, Homo sapiens
actgtgtttctgtgc

SEQ ID NO: 6882282 - DNA, 21 bp, Homo sapiens
ctacttttttttagttcaata

SEQ ID NO: 6882283 - DNA, 17 bp, Homo sapiens
atttatttttgtactgt

SEQ ID NO: 6882284 - DNA, 12 bp, Homo sapiens
cctgccctgtgg

SEQ ID NO: 6882285 - DNA, 13 bp, Homo sapiens
cacagcactgcct

SEQ ID NO: 6882286 - DNA, 14 bp, Homo sapiens
gcccatccaaacac

SEQ ID NO: 6882287 - DNA, 18 bp, Homo sapiens
tggttctgtgtctgtgtt

SEQ ID NO: 6882288 - DNA, 15 bp, Homo sapiens
aaaagacaaatttaa

SEQ ID NO: 6882289 - DNA, 21 bp, Homo sapiens
cgattcccaagctcccttccg

SEQ ID NO: 6882290 - DNA, 18 bp, Homo sapiens
cacctggccccttctcca

SEQ ID NO: 6882291 - DNA, 22 bp, Homo sapiens
cctcctgagcctcacctttcct

SEQ ID NO: 6882292 - DNA, 17 bp, Homo sapiens
ccctctgtgtctgctct

SEQ ID NO: 6882293 - DNA, 13 bp, Homo sapiens
gctgattcttgta

SEQ ID NO: 6882294 - DNA, 21 bp, Homo sapiens
cccagcccagcaccccttcct

SEQ ID NO: 6882295 - DNA, 13 bp, Homo sapiens
tggcccttctgcc

SEQ ID NO: 6882296 - DNA, 15 bp, Homo sapiens
caaactgctgtctct

SEQ ID NO: 6882297 - DNA, 22 bp, Homo sapiens
ccagcccctcctccctcaggcc

SEQ ID NO: 6882298 - DNA, 14 bp, Homo sapiens
acctcacccttgca

SEQ ID NO: 6882299 - DNA, 23 bp, Homo sapiens
tgtttctccccctgggctctgcc

SEQ ID NO: 6882300 - DNA, 20 bp, Homo sapiens
tattgtctgtctacatttct

SEQ ID NO: 6882301 - DNA, 14 bp, Homo sapiens
tgagactctgtctc

SEQ ID NO: 6882302 - DNA, 16 bp, Homo sapiens
aggattccttcttccc

SEQ ID NO: 6882303 - DNA, 22 bp, Homo sapiens
cctgcttctggcgccccaccca

SEQ ID NO: 6882304 - DNA, 20 bp, Homo sapiens
cattcccccggtgcctctcc

SEQ ID NO: 6882305 - DNA, 19 bp, Homo sapiens
tgacattgctggtcatcct

SEQ ID NO: 6882306 - DNA, 20 bp, Homo sapiens
agtctcactgttgcccaggc

SEQ ID NO: 6882307 - DNA, 13 bp, Homo sapiens
acttctcttgcct

SEQ ID NO: 6882308 - DNA, 21 bp, Homo sapiens
acacacagaaaatatactgta

SEQ ID NO: 6882309 - DNA, 18 bp, Homo sapiens
aataattgcatcagttca

SEQ ID NO: 6882310 - DNA, 21 bp, Homo sapiens
cacgacctgtcctgtctttga

SEQ ID NO: 6882311 - DNA, 19 bp, Homo sapiens
caatcctgattcatattta

SEQ ID NO: 6882312 - DNA, 18 bp, Homo sapiens
ctcatgctgcccctgcct

SEQ ID NO: 6882313 - DNA, 13 bp, Homo sapiens
cgctcccctctgc

SEQ ID NO: 6882314 - DNA, 23 bp, Homo sapiens
ctcacccctggttctcatctttc

SEQ ID NO: 6882315 - DNA, 22 bp, Homo sapiens
tacacaaatgtgatttttgtaa

SEQ ID NO: 6882316 - DNA, 20 bp, Homo sapiens
acttgctgctgtcttgttgc

SEQ ID NO: 6882317 - DNA, 17 bp, Homo sapiens
gcccagggctcagcctg

SEQ ID NO: 6882318 - DNA, 13 bp, Homo sapiens
attgttgttgcca

SEQ ID NO: 6882319 - DNA, 12 bp, Homo sapiens
cacactcatcca

SEQ ID NO: 6882320 - DNA, 18 bp, Homo sapiens
tataaatacaaatctgta

SEQ ID NO: 6882321 - DNA, 20 bp, Homo sapiens
aacactgtccttccctgcca

SEQ ID NO: 6882322 - DNA, 12 bp, Homo sapiens
ttcatatactta

SEQ ID NO: 6882323 - DNA, 20 bp, Homo sapiens
tccataataattctgcttta

SEQ ID NO: 6882324 - DNA, 15 bp, Homo sapiens
ctcagcttcgtgcct

SEQ ID NO: 6882325 - DNA, 15 bp, Homo sapiens
gaaatgctctgatta

SEQ ID NO: 6882326 - DNA, 15 bp, Homo sapiens
cctccctgcccatcc

SEQ ID NO: 6882327 - DNA, 20 bp, Homo sapiens
ggagcccctggacatgcctg

SEQ ID NO: 6882328 - DNA, 21 bp, Homo sapiens
aaatagtttcaaatgagttta

SEQ ID NO: 6882329 - DNA, 16 bp, Homo sapiens
acaggactctgcctcc

SEQ ID NO: 6882330 - DNA, 16 bp, Homo sapiens
tgccccctcctctccc

SEQ ID NO: 6882331 - DNA, 16 bp, Homo sapiens
ccttgaagacatatca

SEQ ID NO: 6882332 - DNA, 18 bp, Homo sapiens
acacctggccgcctccag

SEQ ID NO: 6882333 - DNA, 17 bp, Homo sapiens
acactggtctcagagga

SEQ ID NO: 6882334 - DNA, 22 bp, Homo sapiens
tgacttgcaaagacctacctcc

SEQ ID NO: 6882335 - DNA, 22 bp, Homo sapiens
ctttccatgggcccgctgcctc

SEQ ID NO: 6882336 - DNA, 23 bp, Homo sapiens
catggggggagcaccctgagggc

SEQ ID NO: 6882337 - DNA, 18 bp, Homo sapiens
taggtttctaaaaagtca

SEQ ID NO: 6882338 - DNA, 14 bp, Homo sapiens
taaaaaatatctta

SEQ ID NO: 6882339 - DNA, 21 bp, Homo sapiens
ttcccagcccctcctccctca

SEQ ID NO: 6882340 - DNA, 17 bp, Homo sapiens
tccctgacgtctgccac

SEQ ID NO: 6882341 - DNA, 19 bp, Homo sapiens
gcccacgacactgcagccc

SEQ ID NO: 6882342 - DNA, 17 bp, Homo sapiens
tgtaactatatcatcct

SEQ ID NO: 6882343 - DNA, 22 bp, Homo sapiens
actgtcccacaaaatatttcta

SEQ ID NO: 6882344 - DNA, 19 bp, Homo sapiens
gcctcttctttgtgccttt

SEQ ID NO: 6882345 - DNA, 23 bp, Homo sapiens
tgaccattcaattagtggtcata

SEQ ID NO: 6882346 - DNA, 23 bp, Homo sapiens
gcagacacacacacacacacaaa

SEQ ID NO: 6882347 - DNA, 13 bp, Homo sapiens
cagagtctggagc

SEQ ID NO: 6882348 - DNA, 19 bp, Homo sapiens
ccaagctggtcccactcag

SEQ ID NO: 6882349 - DNA, 19 bp, Homo sapiens
tccacacacagcagctcca

SEQ ID NO: 6882350 - DNA, 18 bp, Homo sapiens
agctgtcctgtgatgtca

SEQ ID NO: 6882351 - DNA, 16 bp, Homo sapiens
tgtgccaccctctgca

SEQ ID NO: 6882352 - DNA, 14 bp, Homo sapiens
gctgcctgggctgt

SEQ ID NO: 6882353 - DNA, 16 bp, Homo sapiens
gctcaggaattgaaga

SEQ ID NO: 6882354 - DNA, 12 bp, Homo sapiens
acttgatattta

SEQ ID NO: 6882355 - DNA, 16 bp, Homo sapiens
gatactacaacttttg

SEQ ID NO: 6882356 - DNA, 16 bp, Homo sapiens
cccagtgccactgccc

SEQ ID NO: 6882357 - DNA, 12 bp, Homo sapiens
atgtagccatgg

SEQ ID NO: 6882358 - DNA, 13 bp, Homo sapiens
caatttaaagcaa

SEQ ID NO: 6882359 - DNA, 18 bp, Homo sapiens
tctgcttgatttttgcct

SEQ ID NO: 6882360 - DNA, 18 bp, Homo sapiens
gagattgtggtggtgcta

SEQ ID NO: 6882361 - DNA, 21 bp, Homo sapiens
tgaggtaccgtctacatttca

SEQ ID NO: 6882362 - DNA, 18 bp, Homo sapiens
ttagaaaattcagctcct

SEQ ID NO: 6882363 - DNA, 22 bp, Homo sapiens
ggctcctgtggtagtcctccca

SEQ ID NO: 6882364 - DNA, 13 bp, Homo sapiens
atcctacagtgaa

SEQ ID NO: 6882365 - DNA, 15 bp, Homo sapiens
ttgccagttgtcctc

SEQ ID NO: 6882366 - DNA, 17 bp, Homo sapiens
gcccaggaagcccacac

SEQ ID NO: 6882367 - DNA, 15 bp, Homo sapiens
cccaagatctgccag

SEQ ID NO: 6882368 - DNA, 19 bp, Homo sapiens
aagcaaggtgtccctgcct

SEQ ID NO: 6882369 - DNA, 22 bp, Homo sapiens
agcttagccttgtgccctgccc

SEQ ID NO: 6882370 - DNA, 13 bp, Homo sapiens
cctgcctgtctgc

SEQ ID NO: 6882371 - DNA, 16 bp, Homo sapiens
ctagaatgagaaatca

SEQ ID NO: 6882372 - DNA, 19 bp, Homo sapiens
cagaagacaccagagcaga

SEQ ID NO: 6882373 - DNA, 13 bp, Homo sapiens
cccagatctgcct

SEQ ID NO: 6882374 - DNA, 20 bp, Homo sapiens
actttggtaatgtgtcaaag

SEQ ID NO: 6882375 - DNA, 13 bp, Homo sapiens
ccttccccttcct

SEQ ID NO: 6882376 - DNA, 21 bp, Homo sapiens
ttctaggcctttcctctgcac

SEQ ID NO: 6882377 - DNA, 21 bp, Homo sapiens
acacatagcgccgtgctgtaa

SEQ ID NO: 6882378 - DNA, 15 bp, Homo sapiens
tgtactgaattcttt

SEQ ID NO: 6882379 - DNA, 22 bp, Homo sapiens
caggccgaggcaggaggagccc

SEQ ID NO: 6882380 - DNA, 15 bp, Homo sapiens
ccctgcgcctttcct

SEQ ID NO: 6882381 - DNA, 19 bp, Homo sapiens
gcctgcaggtgagcaggca

SEQ ID NO: 6882382 - DNA, 18 bp, Homo sapiens
cacgaagtgttgcatgga

SEQ ID NO: 6882383 - DNA, 21 bp, Homo sapiens
aatgcattgttgtaaagtatt

SEQ ID NO: 6882384 - DNA, 15 bp, Homo sapiens
ctgcaacctctgcct

SEQ ID NO: 6882385 - DNA, 16 bp, Homo sapiens
tgccaagtccctggaa

SEQ ID NO: 6882386 - DNA, 19 bp, Homo sapiens
caatcctctcacctcagcc

SEQ ID NO: 6882387 - DNA, 19 bp, Homo sapiens
tagatcccatgtcacctca

SEQ ID NO: 6882388 - DNA, 21 bp, Homo sapiens
actgccaggctgcctcctgcc

SEQ ID NO: 6882389 - DNA, 15 bp, Homo sapiens
tgggcagctgcctcc

SEQ ID NO: 6882390 - DNA, 16 bp, Homo sapiens
cttttctgtctctgcc

SEQ ID NO: 6882391 - DNA, 19 bp, Homo sapiens
cttcaagtgatatatgtat

SEQ ID NO: 6882392 - DNA, 15 bp, Homo sapiens
agggaagacatttct

SEQ ID NO: 6882393 - DNA, 20 bp, Homo sapiens
ttcacagagcacgcctgcca

SEQ ID NO: 6882394 - DNA, 15 bp, Homo sapiens
catatccgggtgctc

SEQ ID NO: 6882395 - DNA, 18 bp, Homo sapiens
cctttgcatagctctcct

SEQ ID NO: 6882396 - DNA, 21 bp, Homo sapiens
ccctgcttcatatctctccct

SEQ ID NO: 6882397 - DNA, 14 bp, Homo sapiens
ccctccctgcttca

SEQ ID NO: 6882398 - DNA, 18 bp, Homo sapiens
ctgtccctctcagtgcct

SEQ ID NO: 6882399 - DNA, 17 bp, Homo sapiens
ccgcagttcctgtccct

SEQ ID NO: 6882400 - DNA, 21 bp, Homo sapiens
accctttccggcacactgcca

SEQ ID NO: 6882401 - DNA, 14 bp, Homo sapiens
atagaatatagcat

SEQ ID NO: 6882402 - DNA, 15 bp, Homo sapiens
aactgcaacactgga

SEQ ID NO: 6882403 - DNA, 15 bp, Homo sapiens
acctgggcagctcct

SEQ ID NO: 6882404 - DNA, 23 bp, Homo sapiens
cggggcaaagctgctgggccagt

SEQ ID NO: 6882405 - DNA, 17 bp, Homo sapiens
ctgaggtgcccaggaga

SEQ ID NO: 6882406 - DNA, 13 bp, Homo sapiens
cttcactcctgct

SEQ ID NO: 6882407 - DNA, 19 bp, Homo sapiens
cttagaagtagtatgttat

SEQ ID NO: 6882408 - DNA, 22 bp, Homo sapiens
cgtcctttgaacctgtgcaata

SEQ ID NO: 6882409 - DNA, 19 bp, Homo sapiens
cctcctccccagctcttct

SEQ ID NO: 6882410 - DNA, 12 bp, Homo sapiens
gactctgtgctc

SEQ ID NO: 6882411 - DNA, 18 bp, Homo sapiens
cttctgcttttctgccct

SEQ ID NO: 6882412 - DNA, 19 bp, Homo sapiens
gaaggagcggcgccctgga

SEQ ID NO: 6882413 - DNA, 18 bp, Homo sapiens
cacatgaatctgcacatc

SEQ ID NO: 6882414 - DNA, 18 bp, Homo sapiens
ctcaaggacaaagtctcc

SEQ ID NO: 6882415 - DNA, 22 bp, Homo sapiens
acaagtactggttgactttcta

SEQ ID NO: 6882416 - DNA, 14 bp, Homo sapiens
aacttttgtactga

SEQ ID NO: 6882417 - DNA, 16 bp, Homo sapiens
tcctccctctgcctca

SEQ ID NO: 6882418 - DNA, 16 bp, Homo sapiens
ctcagctgcccatccc

SEQ ID NO: 6882419 - DNA, 20 bp, Homo sapiens
cgctgccctgggtcctgcct

SEQ ID NO: 6882420 - DNA, 15 bp, Homo sapiens
acagtggcagtattg

SEQ ID NO: 6882421 - DNA, 14 bp, Homo sapiens
ttggtttacattta

SEQ ID NO: 6882422 - DNA, 17 bp, Homo sapiens
attcaagtaacacttta

SEQ ID NO: 6882423 - DNA, 21 bp, Homo sapiens
cctgtcctctttcagctcctg

SEQ ID NO: 6882424 - DNA, 15 bp, Homo sapiens
tctgtgggcagctgg

SEQ ID NO: 6882425 - DNA, 23 bp, Homo sapiens
tagctgaaaactaatgtactgta

SEQ ID NO: 6882426 - DNA, 23 bp, Homo sapiens
tatgagtgaagaatttatctgtg

SEQ ID NO: 6882427 - DNA, 17 bp, Homo sapiens
tggggggtccagtctgt

SEQ ID NO: 6882428 - DNA, 19 bp, Homo sapiens
aggacacggaccctgtgtg

SEQ ID NO: 6882429 - DNA, 16 bp, Homo sapiens
caaaattatgctgcat

SEQ ID NO: 6882430 - DNA, 13 bp, Homo sapiens
agctgctgagccg

SEQ ID NO: 6882431 - DNA, 19 bp, Homo sapiens
gaaaagctattagccagga

SEQ ID NO: 6882432 - DNA, 23 bp, Homo sapiens
ctaccccttcctgtcctgcctcc

SEQ ID NO: 6882433 - DNA, 23 bp, Homo sapiens
tgcggcccactttcctgagctgt

SEQ ID NO: 6882434 - DNA, 17 bp, Homo sapiens
taaaggcagctgcctct

SEQ ID NO: 6882435 - DNA, 16 bp, Homo sapiens
ctttgcagctgctgtc

SEQ ID NO: 6882436 - DNA, 20 bp, Homo sapiens
ctgcacagagctctccagct

SEQ ID NO: 6882437 - DNA, 13 bp, Homo sapiens
actagaaattctt

SEQ ID NO: 6882438 - DNA, 18 bp, Homo sapiens
cacaataggtctttctct

SEQ ID NO: 6882439 - DNA, 14 bp, Homo sapiens
atcctcctacctca

SEQ ID NO: 6882440 - DNA, 16 bp, Homo sapiens
gcctggcatctgtgcg

SEQ ID NO: 6882441 - DNA, 20 bp, Homo sapiens
tccacagttgtcagttgtga

SEQ ID NO: 6882442 - DNA, 20 bp, Homo sapiens
ggaccctggtgacctcctgt

SEQ ID NO: 6882443 - DNA, 13 bp, Homo sapiens
ctaagcctggaca

SEQ ID NO: 6882444 - DNA, 12 bp, Homo sapiens
aggcccactctg

SEQ ID NO: 6882445 - DNA, 16 bp, Homo sapiens
tgcctccactcccact

SEQ ID NO: 6882446 - DNA, 13 bp, Homo sapiens
tcacgcccagcct

SEQ ID NO: 6882447 - DNA, 18 bp, Homo sapiens
ccggtcccacccctccct

SEQ ID NO: 6882448 - DNA, 19 bp, Homo sapiens
ctgtctagccactccctcc

SEQ ID NO: 6882449 - DNA, 18 bp, Homo sapiens
ccctttccttcactgccc

SEQ ID NO: 6882450 - DNA, 14 bp, Homo sapiens
agtgcccccagccc

SEQ ID NO: 6882451 - DNA, 18 bp, Homo sapiens
ctgaacatttgacttgaa

SEQ ID NO: 6882452 - DNA, 21 bp, Homo sapiens
tcaggagagagcttcctgttt

SEQ ID NO: 6882453 - DNA, 22 bp, Homo sapiens
aactgccaggctgcctcctgcc

SEQ ID NO: 6882454 - DNA, 13 bp, Homo sapiens
agcaataacacta

SEQ ID NO: 6882455 - DNA, 23 bp, Homo sapiens
ctgtgggtggggaggccctgcct

SEQ ID NO: 6882456 - DNA, 23 bp, Homo sapiens
ccatgtgtgtcagcccatgtcaa

SEQ ID NO: 6882457 - DNA, 16 bp, Homo sapiens
cactgcaacctccgcc

SEQ ID NO: 6882458 - DNA, 19 bp, Homo sapiens
ccaaagaatgcatgttctg

SEQ ID NO: 6882459 - DNA, 18 bp, Homo sapiens
cagaacatacactgtgaa

SEQ ID NO: 6882460 - DNA, 23 bp, Homo sapiens
gccactgccttcgcttcttgcct

SEQ ID NO: 6882461 - DNA, 17 bp, Homo sapiens
ccctaccactgtcttct

SEQ ID NO: 6882462 - DNA, 14 bp, Homo sapiens
cccttcccacgtcc

SEQ ID NO: 6882463 - DNA, 18 bp, Homo sapiens
ctggcccctcccacatcc

SEQ ID NO: 6882464 - DNA, 18 bp, Homo sapiens
gcaccccctcctgctgca

SEQ ID NO: 6882465 - DNA, 23 bp, Homo sapiens
cagcttcccaacaatactttgtg

SEQ ID NO: 6882466 - DNA, 11 bp, Homo sapiens
cccctttccta

SEQ ID NO: 6882467 - DNA, 16 bp, Homo sapiens
tggttatagccctgcc

SEQ ID NO: 6882468 - DNA, 20 bp, Homo sapiens
tgagttctgacactgtgtgt

SEQ ID NO: 6882469 - DNA, 20 bp, Homo sapiens
aaaatccctcttcctccaaa

SEQ ID NO: 6882470 - DNA, 21 bp, Homo sapiens
agaactgttgcctaattggaa

SEQ ID NO: 6882471 - DNA, 18 bp, Homo sapiens
cctttctggccccagcct

SEQ ID NO: 6882472 - DNA, 17 bp, Homo sapiens
tttcttttgttactgtt

SEQ ID NO: 6882473 - DNA, 15 bp, Homo sapiens
ccaaggagctgagaa

SEQ ID NO: 6882474 - DNA, 15 bp, Homo sapiens
caagcctgtgcaaaa

SEQ ID NO: 6882475 - DNA, 23 bp, Homo sapiens
actgtctgcttctctctctctca

SEQ ID NO: 6882476 - DNA, 18 bp, Homo sapiens
catagacccatctggagg

SEQ ID NO: 6882477 - DNA, 13 bp, Homo sapiens
ccttatctgtgcg

SEQ ID NO: 6882478 - DNA, 13 bp, Homo sapiens
tgctgtcttgccc

SEQ ID NO: 6882479 - DNA, 21 bp, Homo sapiens
tgtttttctcactccttttgg

SEQ ID NO: 6882480 - DNA, 23 bp, Homo sapiens
atacatgtgtgtatatatgtgta

SEQ ID NO: 6882481 - DNA, 15 bp, Homo sapiens
catcattccaggccc

SEQ ID NO: 6882482 - DNA, 12 bp, Homo sapiens
actacatctgcc

SEQ ID NO: 6882483 - DNA, 21 bp, Homo sapiens
cccttgcccttgccctgacct

SEQ ID NO: 6882484 - DNA, 12 bp, Homo sapiens
tgaaatacctca

SEQ ID NO: 6882485 - DNA, 23 bp, Homo sapiens
ctattccccaccctccccttccc

SEQ ID NO: 6882486 - DNA, 17 bp, Homo sapiens
atgtgagctaggagaag

SEQ ID NO: 6882487 - DNA, 19 bp, Homo sapiens
actgggggcctctgcctcc

SEQ ID NO: 6882488 - DNA, 22 bp, Homo sapiens
tctttgagggactgcctctgcc

SEQ ID NO: 6882489 - DNA, 16 bp, Homo sapiens
tgaaaagccatatcta

SEQ ID NO: 6882490 - DNA, 18 bp, Homo sapiens
ttaatactgttattcttt

SEQ ID NO: 6882491 - DNA, 19 bp, Homo sapiens
gcctctgacttaagctgcc

SEQ ID NO: 6882492 - DNA, 23 bp, Homo sapiens
gacacgcgcccccctcccagagg

SEQ ID NO: 6882493 - DNA, 14 bp, Homo sapiens
caatgttcattgta

SEQ ID NO: 6882494 - DNA, 12 bp, Homo sapiens
agcaatattctt

SEQ ID NO: 6882495 - DNA, 19 bp, Homo sapiens
gtgatcaataaaatgtgat

SEQ ID NO: 6882496 - DNA, 21 bp, Homo sapiens
ctatcaaaaactgactttatt

SEQ ID NO: 6882497 - DNA, 16 bp, Homo sapiens
agggttctgcctctcc

SEQ ID NO: 6882498 - DNA, 21 bp, Homo sapiens
ctgctgagtccgacctggcct

SEQ ID NO: 6882499 - DNA, 15 bp, Homo sapiens
ttctatcagtacttt

SEQ ID NO: 6882500 - DNA, 15 bp, Homo sapiens
cattccatgatttta

SEQ ID NO: 6882501 - DNA, 21 bp, Homo sapiens
cacaatatttcttttgttgta

SEQ ID NO: 6882502 - DNA, 21 bp, Homo sapiens
atcactcactcactccccact

SEQ ID NO: 6882503 - DNA, 18 bp, Homo sapiens
ctgtacctgttcctcccc

SEQ ID NO: 6882504 - DNA, 20 bp, Homo sapiens
gaatattgctgatggtgcaa

SEQ ID NO: 6882505 - DNA, 17 bp, Homo sapiens
attgtccctctgcccca

SEQ ID NO: 6882506 - DNA, 22 bp, Homo sapiens
ttccagcaattctcctgcctca

SEQ ID NO: 6882507 - DNA, 18 bp, Homo sapiens
ccacaatctgggactttc

SEQ ID NO: 6882508 - DNA, 15 bp, Homo sapiens
ctcctagcctctccg

SEQ ID NO: 6882509 - DNA, 13 bp, Homo sapiens
atggggaggagac

SEQ ID NO: 6882510 - DNA, 14 bp, Homo sapiens
attagaacatttaa

SEQ ID NO: 6882511 - DNA, 16 bp, Homo sapiens
tattctctgtttgctt

SEQ ID NO: 6882512 - DNA, 15 bp, Homo sapiens
cacacatgcatacac

SEQ ID NO: 6882513 - DNA, 21 bp, Homo sapiens
tttgtaactttttacattaca

SEQ ID NO: 6882514 - DNA, 16 bp, Homo sapiens
tggccatcactcagcc

SEQ ID NO: 6882515 - DNA, 14 bp, Homo sapiens
attgttttattgta

SEQ ID NO: 6882516 - DNA, 18 bp, Homo sapiens
ctttctttttctgtctct

SEQ ID NO: 6882517 - DNA, 20 bp, Homo sapiens
agagcacatactgtgttcca

SEQ ID NO: 6882518 - DNA, 12 bp, Homo sapiens
cactgcatttca

SEQ ID NO: 6882519 - DNA, 17 bp, Homo sapiens
ctagtactctctgctct

SEQ ID NO: 6882520 - DNA, 21 bp, Homo sapiens
cattccacagctgccctggct

SEQ ID NO: 6882521 - DNA, 12 bp, Homo sapiens
ccctcactgtca

SEQ ID NO: 6882522 - DNA, 19 bp, Homo sapiens
ctttcaagcagtcgtgcct

SEQ ID NO: 6882523 - DNA, 13 bp, Homo sapiens
gacaagcccagga

SEQ ID NO: 6882524 - DNA, 13 bp, Homo sapiens
tgggtctgtgtgt

SEQ ID NO: 6882525 - DNA, 23 bp, Homo sapiens
tatgccatttgtttatttttata

SEQ ID NO: 6882526 - DNA, 21 bp, Homo sapiens
cttcccacctctctcactcct

SEQ ID NO: 6882527 - DNA, 15 bp, Homo sapiens
cctttttcccttccc

SEQ ID NO: 6882528 - DNA, 16 bp, Homo sapiens
tgaacttttgtactga

SEQ ID NO: 6882529 - DNA, 19 bp, Homo sapiens
cctctccctgtccccaccc

SEQ ID NO: 6882530 - DNA, 20 bp, Homo sapiens
cttagcttagacctcagcct

SEQ ID NO: 6882531 - DNA, 12 bp, Homo sapiens
caacccctcctc

SEQ ID NO: 6882532 - DNA, 13 bp, Homo sapiens
ccttcctgcttga

SEQ ID NO: 6882533 - DNA, 22 bp, Homo sapiens
gcccaccctgggctccacacag

SEQ ID NO: 6882534 - DNA, 23 bp, Homo sapiens
cttttgacagctggtccctgcct

SEQ ID NO: 6882535 - DNA, 22 bp, Homo sapiens
ccaaggaggcggaggcgctcct

SEQ ID NO: 6882536 - DNA, 20 bp, Homo sapiens
aaggtgtgtccttgaactga

SEQ ID NO: 6882537 - DNA, 16 bp, Homo sapiens
cagcatttgtgtgtta

SEQ ID NO: 6882538 - DNA, 16 bp, Homo sapiens
tcgcctttgtcttgta

SEQ ID NO: 6882539 - DNA, 13 bp, Homo sapiens
cattactctgcac

SEQ ID NO: 6882540 - DNA, 18 bp, Homo sapiens
acttctggcctccagcct

SEQ ID NO: 6882541 - DNA, 21 bp, Homo sapiens
ccttctctcaatccctttgca

SEQ ID NO: 6882542 - DNA, 22 bp, Homo sapiens
cgcttctcctccaggtatttga

SEQ ID NO: 6882543 - DNA, 16 bp, Homo sapiens
ctttccctcccttcct

SEQ ID NO: 6882544 - DNA, 15 bp, Homo sapiens
gaatttttttctgca

SEQ ID NO: 6882545 - DNA, 15 bp, Homo sapiens
ccacacctcctgcct

SEQ ID NO: 6882546 - DNA, 13 bp, Homo sapiens
tttcccctcttcc

SEQ ID NO: 6882547 - DNA, 21 bp, Homo sapiens
ccatctcttcctacccaacca

SEQ ID NO: 6882548 - DNA, 20 bp, Homo sapiens
agccaccttcctgactggga

SEQ ID NO: 6882549 - DNA, 16 bp, Homo sapiens
tgacttgtctgcctcc

SEQ ID NO: 6882550 - DNA, 14 bp, Homo sapiens
ttgcctcccttcct

SEQ ID NO: 6882551 - DNA, 13 bp, Homo sapiens
gatacctgtgagg

SEQ ID NO: 6882552 - DNA, 17 bp, Homo sapiens
cttccttgctctgcacc

SEQ ID NO: 6882553 - DNA, 14 bp, Homo sapiens
caataacagtttta

SEQ ID NO: 6882554 - DNA, 16 bp, Homo sapiens
gcctccacactgacca

SEQ ID NO: 6882555 - DNA, 14 bp, Homo sapiens
ctccccactctgct

SEQ ID NO: 6882556 - DNA, 22 bp, Homo sapiens
gctccgtccaggagcctgtgcc

SEQ ID NO: 6882557 - DNA, 19 bp, Homo sapiens
gcacacagcggctgcctcc

SEQ ID NO: 6882558 - DNA, 16 bp, Homo sapiens
gagttcctctgcagtt

SEQ ID NO: 6882559 - DNA, 16 bp, Homo sapiens
tgtctcctacctctgc

SEQ ID NO: 6882560 - DNA, 17 bp, Homo sapiens
ctgggcctggggtgcat

SEQ ID NO: 6882561 - DNA, 14 bp, Homo sapiens
cagcccagtgcaaa

SEQ ID NO: 6882562 - DNA, 23 bp, Homo sapiens
cccatcccgtaagaccaccttcc

SEQ ID NO: 6882563 - DNA, 14 bp, Homo sapiens
agcctcgcatgcca

SEQ ID NO: 6882564 - DNA, 15 bp, Homo sapiens
acttttctgccaaaa

SEQ ID NO: 6882565 - DNA, 24 bp, Homo sapiens
ccttaatttcctttttgacactga

SEQ ID NO: 6882566 - DNA, 23 bp, Homo sapiens
catgtttccctactaacatccca

SEQ ID NO: 6882567 - DNA, 20 bp, Homo sapiens
aaactggttctgtgttgaaa

SEQ ID NO: 6882568 - DNA, 20 bp, Homo sapiens
gtactacagctatatttgat

SEQ ID NO: 6882569 - DNA, 13 bp, Homo sapiens
cccatccctgcct

SEQ ID NO: 6882570 - DNA, 17 bp, Homo sapiens
tgccccttgggcatcca

SEQ ID NO: 6882571 - DNA, 14 bp, Homo sapiens
cactgcactccagc

SEQ ID NO: 6882572 - DNA, 13 bp, Homo sapiens
catcccactgcca

SEQ ID NO: 6882573 - DNA, 16 bp, Homo sapiens
ctcagccccagcccag

SEQ ID NO: 6882574 - DNA, 13 bp, Homo sapiens
aacattaactcta

SEQ ID NO: 6882575 - DNA, 13 bp, Homo sapiens
tctggcctttcct

SEQ ID NO: 6882576 - DNA, 16 bp, Homo sapiens
agttcctgtgcctcca

SEQ ID NO: 6882577 - DNA, 18 bp, Homo sapiens
aaaagcccagtgacctga

SEQ ID NO: 6882578 - DNA, 15 bp, Homo sapiens
tcctgggtcctgcct

SEQ ID NO: 6882579 - DNA, 14 bp, Homo sapiens
gccacttaccttca

SEQ ID NO: 6882580 - DNA, 13 bp, Homo sapiens
ctctcctgcctca

SEQ ID NO: 6882581 - DNA, 15 bp, Homo sapiens
ctggttacctggaga

SEQ ID NO: 6882582 - DNA, 19 bp, Homo sapiens
cacagcccctggcactgca

SEQ ID NO: 6882583 - DNA, 20 bp, Homo sapiens
tagaaagttcaaaaagtcta

SEQ ID NO: 6882584 - DNA, 15 bp, Homo sapiens
ctccgggtcactgct

SEQ ID NO: 6882585 - DNA, 18 bp, Homo sapiens
ccgcaggggactgtctca

SEQ ID NO: 6882586 - DNA, 17 bp, Homo sapiens
gaattatatctaattta

SEQ ID NO: 6882587 - DNA, 19 bp, Homo sapiens
actactcaatactacctct

SEQ ID NO: 6882588 - DNA, 24 bp, Homo sapiens
cctccctctcagaggcctgctgcc

SEQ ID NO: 6882589 - DNA, 17 bp, Homo sapiens
cactacctcctcaggga

SEQ ID NO: 6882590 - DNA, 16 bp, Homo sapiens
ctccaggcccatctca

SEQ ID NO: 6882591 - DNA, 22 bp, Homo sapiens
cacccactagccctctttctct

SEQ ID NO: 6882592 - DNA, 14 bp, Homo sapiens
ctcccctctctgct

SEQ ID NO: 6882593 - DNA, 16 bp, Homo sapiens
aggtggttcgtgctgt

SEQ ID NO: 6882594 - DNA, 14 bp, Homo sapiens
tggagactcctgcc

SEQ ID NO: 6882595 - DNA, 14 bp, Homo sapiens
tatagatgtctttt

SEQ ID NO: 6882596 - DNA, 18 bp, Homo sapiens
gtgatctcgactcccccc

SEQ ID NO: 6882597 - DNA, 13 bp, Homo sapiens
cacatcctctcca

SEQ ID NO: 6882598 - DNA, 15 bp, Homo sapiens
ccagcctcagctcag

SEQ ID NO: 6882599 - DNA, 19 bp, Homo sapiens
tctggctgaaaacttgcct

SEQ ID NO: 6882600 - DNA, 15 bp, Homo sapiens
taaatttgatactta

SEQ ID NO: 6882601 - DNA, 16 bp, Homo sapiens
ctctcccctctctgct

SEQ ID NO: 6882602 - DNA, 20 bp, Homo sapiens
tatttcagtgttacctgtgt

SEQ ID NO: 6882603 - DNA, 17 bp, Homo sapiens
cttcactgaacatgcct

SEQ ID NO: 6882604 - DNA, 15 bp, Homo sapiens
cagatcatcttggaa

SEQ ID NO: 6882605 - DNA, 19 bp, Homo sapiens
cattctatgactcttgtct

SEQ ID NO: 6882606 - DNA, 18 bp, Homo sapiens
gctatttctattccttat

SEQ ID NO: 6882607 - DNA, 14 bp, Homo sapiens
ccgtggcccttcct

SEQ ID NO: 6882608 - DNA, 21 bp, Homo sapiens
cacgtgcacacacctgcacac

SEQ ID NO: 6882609 - DNA, 15 bp, Homo sapiens
ccctctgccccatcc

SEQ ID NO: 6882610 - DNA, 17 bp, Homo sapiens
ccaaccctgcccctgcc

SEQ ID NO: 6882611 - DNA, 19 bp, Homo sapiens
ctaccccctcctctctgcc

SEQ ID NO: 6882612 - DNA, 14 bp, Homo sapiens
acaacagtagtttc

SEQ ID NO: 6882613 - DNA, 23 bp, Homo sapiens
gcttctgagcagcgagcctgcta

SEQ ID NO: 6882614 - DNA, 23 bp, Homo sapiens
taatcagccccagagtgctttaa

SEQ ID NO: 6882615 - DNA, 14 bp, Homo sapiens
ttcacagttctgta

SEQ ID NO: 6882616 - DNA, 18 bp, Homo sapiens
ctccacccccagctgctt

SEQ ID NO: 6882617 - DNA, 20 bp, Homo sapiens
ctcctgttttctccctctca

SEQ ID NO: 6882618 - DNA, 19 bp, Homo sapiens
ctggggaggaagggccagg

SEQ ID NO: 6882619 - DNA, 11 bp, Homo sapiens
cttctgtctcc

SEQ ID NO: 6882620 - DNA, 17 bp, Homo sapiens
ctcagggtcactgtcct

SEQ ID NO: 6882621 - DNA, 12 bp, Homo sapiens
cctccccagccc

SEQ ID NO: 6882622 - DNA, 17 bp, Homo sapiens
cagtaccccatggagct

SEQ ID NO: 6882623 - DNA, 16 bp, Homo sapiens
ctgccaggacacctgc

SEQ ID NO: 6882624 - DNA, 14 bp, Homo sapiens
cctgaccggcacct

SEQ ID NO: 6882625 - DNA, 17 bp, Homo sapiens
ttcccagctctccctct

SEQ ID NO: 6882626 - DNA, 18 bp, Homo sapiens
agacaaatctcagaacct

SEQ ID NO: 6882627 - DNA, 20 bp, Homo sapiens
cgtacccccgtggtctttga

SEQ ID NO: 6882628 - DNA, 13 bp, Homo sapiens
cgtccatctctct

SEQ ID NO: 6882629 - DNA, 23 bp, Homo sapiens
acatttgccttgcagaactgcca

SEQ ID NO: 6882630 - DNA, 22 bp, Homo sapiens
tgaattcgatgcgtattctgtg

SEQ ID NO: 6882631 - DNA, 22 bp, Homo sapiens
taccattaaaccatctccctgg

SEQ ID NO: 6882632 - DNA, 22 bp, Homo sapiens
gcaattctcctgcctcagcctc

SEQ ID NO: 6882633 - DNA, 18 bp, Homo sapiens
tgcacaccagttactgtt

SEQ ID NO: 6882634 - DNA, 19 bp, Homo sapiens
cacaaacctgaatggtctg

SEQ ID NO: 6882635 - DNA, 21 bp, Homo sapiens
cagaatcgctccaccttgcag

SEQ ID NO: 6882636 - DNA, 21 bp, Homo sapiens
caactccaaggcaaatgtcca

SEQ ID NO: 6882637 - DNA, 20 bp, Homo sapiens
agttcagagctgccctctcc

SEQ ID NO: 6882638 - DNA, 16 bp, Homo sapiens
cctgcggagtgaagag

SEQ ID NO: 6882639 - DNA, 16 bp, Homo sapiens
tgccttacctcctgcc

SEQ ID NO: 6882640 - DNA, 21 bp, Homo sapiens
taatcagtaaatagtgtcata

SEQ ID NO: 6882641 - DNA, 17 bp, Homo sapiens
ctctgagtcctggccca

SEQ ID NO: 6882642 - DNA, 17 bp, Homo sapiens
cgctcctccctgctcct

SEQ ID NO: 6882643 - DNA, 16 bp, Homo sapiens
ttaatttccttctgtt

SEQ ID NO: 6882644 - DNA, 20 bp, Homo sapiens
ggaacccttctccataccca

SEQ ID NO: 6882645 - DNA, 23 bp, Homo sapiens
tcttctctatatttttatttcat

SEQ ID NO: 6882646 - DNA, 13 bp, Homo sapiens
ccactctttgcta

SEQ ID NO: 6882647 - DNA, 22 bp, Homo sapiens
ccatgatttcatgtactgcatt

SEQ ID NO: 6882648 - DNA, 12 bp, Homo sapiens
ctgggcctgcta

SEQ ID NO: 6882649 - DNA, 17 bp, Homo sapiens
cagcaactgcccttcca

SEQ ID NO: 6882650 - DNA, 22 bp, Homo sapiens
catttactgcattcttctgatc

SEQ ID NO: 6882651 - DNA, 15 bp, Homo sapiens
agctgcacagggcag

SEQ ID NO: 6882652 - DNA, 20 bp, Homo sapiens
tctgcacctagaacctccct

SEQ ID NO: 6882653 - DNA, 17 bp, Homo sapiens
cagtgttctcacagtgt

SEQ ID NO: 6882654 - DNA, 22 bp, Homo sapiens
ctctgcccctcagggggccagc

SEQ ID NO: 6882655 - DNA, 15 bp, Homo sapiens
cagaactcttcctcc

SEQ ID NO: 6882656 - DNA, 21 bp, Homo sapiens
cctagccaggtctcctgggaa

SEQ ID NO: 6882657 - DNA, 22 bp, Homo sapiens
ctttgatacataaacttttgca

SEQ ID NO: 6882658 - DNA, 18 bp, Homo sapiens
cacgtctggctccctgcc

SEQ ID NO: 6882659 - DNA, 17 bp, Homo sapiens
aacattcgaatctctgc

SEQ ID NO: 6882660 - DNA, 15 bp, Homo sapiens
ggaggctaagcctgg

SEQ ID NO: 6882661 - DNA, 15 bp, Homo sapiens
gcagagtagctgctt

SEQ ID NO: 6882662 - DNA, 14 bp, Homo sapiens
tgtggccctgtcct

SEQ ID NO: 6882663 - DNA, 19 bp, Homo sapiens
tgcttctctgacttctgcc

SEQ ID NO: 6882664 - DNA, 22 bp, Homo sapiens
ggaagacctaaggcagacagga

SEQ ID NO: 6882665 - DNA, 16 bp, Homo sapiens
agcttgtctcttgcct

SEQ ID NO: 6882666 - DNA, 15 bp, Homo sapiens
cgctgctcaacctct

SEQ ID NO: 6882667 - DNA, 14 bp, Homo sapiens
cttcagatcctgct

SEQ ID NO: 6882668 - DNA, 12 bp, Homo sapiens
ccacgtggagaa

SEQ ID NO: 6882669 - DNA, 20 bp, Homo sapiens
tgttggtcaggctggtctca

SEQ ID NO: 6882670 - DNA, 13 bp, Homo sapiens
taaatttgttgaa

SEQ ID NO: 6882671 - DNA, 12 bp, Homo sapiens
ccaagctgtgct

SEQ ID NO: 6882672 - DNA, 16 bp, Homo sapiens
caagcacctgcagatt

SEQ ID NO: 6882673 - DNA, 18 bp, Homo sapiens
caggtgctcatgctgctc

SEQ ID NO: 6882674 - DNA, 13 bp, Homo sapiens
ccgcagcacgcct

SEQ ID NO: 6882675 - DNA, 23 bp, Homo sapiens
tagctgggatttgaactgagccg

SEQ ID NO: 6882676 - DNA, 16 bp, Homo sapiens
cttttcagcttctgct

SEQ ID NO: 6882677 - DNA, 13 bp, Homo sapiens
gccctccaggccg

SEQ ID NO: 6882678 - DNA, 15 bp, Homo sapiens
attcattagctgtga

SEQ ID NO: 6882679 - DNA, 20 bp, Homo sapiens
ctgtaggtttctctcttccc

SEQ ID NO: 6882680 - DNA, 16 bp, Homo sapiens
cagatccgcatgtgtc

SEQ ID NO: 6882681 - DNA, 17 bp, Homo sapiens
tgtacagtttgtttaca

SEQ ID NO: 6882682 - DNA, 18 bp, Homo sapiens
caattcatgtagtttctg

SEQ ID NO: 6882683 - DNA, 22 bp, Homo sapiens
taactaggattataatgctgcc

SEQ ID NO: 6882684 - DNA, 16 bp, Homo sapiens
ttcagtgattactgtc

SEQ ID NO: 6882685 - DNA, 21 bp, Homo sapiens
tttggtcctgcctaaatttca

SEQ ID NO: 6882686 - DNA, 22 bp, Homo sapiens
ctccccgctccgtctctgtcct

SEQ ID NO: 6882687 - DNA, 16 bp, Homo sapiens
cctcccgggccctccc

SEQ ID NO: 6882688 - DNA, 16 bp, Homo sapiens
caggtgacatgtgaaa

SEQ ID NO: 6882689 - DNA, 21 bp, Homo sapiens
tgctctcctcttgccactgcc

SEQ ID NO: 6882690 - DNA, 20 bp, Homo sapiens
ctgacaggccttcctcctct

SEQ ID NO: 6882691 - DNA, 22 bp, Homo sapiens
cccatgcttaacatacccgcct

SEQ ID NO: 6882692 - DNA, 17 bp, Homo sapiens
cctgccctgccctgcca

SEQ ID NO: 6882693 - DNA, 20 bp, Homo sapiens
ataacttccttgcccctgct

SEQ ID NO: 6882694 - DNA, 20 bp, Homo sapiens
tcagtgtctccccgtgtcct

SEQ ID NO: 6882695 - DNA, 16 bp, Homo sapiens
aaatgaagcagaggaa

SEQ ID NO: 6882696 - DNA, 18 bp, Homo sapiens
ctctgcacgctcaatgcc

SEQ ID NO: 6882697 - DNA, 12 bp, Homo sapiens
ggaggccagcta

SEQ ID NO: 6882698 - DNA, 15 bp, Homo sapiens
ctgtctcctctgtca

SEQ ID NO: 6882699 - DNA, 16 bp, Homo sapiens
attgtaaggtctttgt

SEQ ID NO: 6882700 - DNA, 16 bp, Homo sapiens
ctcctgggatctgctc

SEQ ID NO: 6882701 - DNA, 20 bp, Homo sapiens
cttcaccaaagatctgctcc

SEQ ID NO: 6882702 - DNA, 19 bp, Homo sapiens
caccttctgtccccagccc

SEQ ID NO: 6882703 - DNA, 19 bp, Homo sapiens
agcatctgtcccactggga

SEQ ID NO: 6882704 - DNA, 15 bp, Homo sapiens
cccagttctgctcct

SEQ ID NO: 6882705 - DNA, 17 bp, Homo sapiens
agctggttagaaatgca

SEQ ID NO: 6882706 - DNA, 19 bp, Homo sapiens
tgaacagtcacgcctgaaa

SEQ ID NO: 6882707 - DNA, 16 bp, Homo sapiens
tgactgggccctgcct

SEQ ID NO: 6882708 - DNA, 16 bp, Homo sapiens
catccaccaccttgcc

SEQ ID NO: 6882709 - DNA, 21 bp, Homo sapiens
cctcccagcccattgctgcca

SEQ ID NO: 6882710 - DNA, 17 bp, Homo sapiens
tgacaacagcctgagaa

SEQ ID NO: 6882711 - DNA, 20 bp, Homo sapiens
gaggatgctctttcccagga

SEQ ID NO: 6882712 - DNA, 11 bp, Homo sapiens
cctcttcctca

SEQ ID NO: 6882713 - DNA, 13 bp, Homo sapiens
ggtgcctggctgg

SEQ ID NO: 6882714 - DNA, 23 bp, Homo sapiens
gctcaggcagacaagagctgctg

SEQ ID NO: 6882715 - DNA, 15 bp, Homo sapiens
agcctccagagccag

SEQ ID NO: 6882716 - DNA, 19 bp, Homo sapiens
catgaatctgcacatctgt

SEQ ID NO: 6882717 - DNA, 20 bp, Homo sapiens
tctccatccttaactgtcca

SEQ ID NO: 6882718 - DNA, 14 bp, Homo sapiens
ctaagccagcctgg

SEQ ID NO: 6882719 - DNA, 23 bp, Homo sapiens
ctttcttccactaccctccctcg

SEQ ID NO: 6882720 - DNA, 22 bp, Homo sapiens
taaatctgtgaacttgaaattt

SEQ ID NO: 6882721 - DNA, 20 bp, Homo sapiens
catctcccccaccctgtgcc

SEQ ID NO: 6882722 - DNA, 14 bp, Homo sapiens
cttctcccctgccc

SEQ ID NO: 6882723 - DNA, 14 bp, Homo sapiens
tgtctccctggccc

SEQ ID NO: 6882724 - DNA, 14 bp, Homo sapiens
taacttgtttgtaa

SEQ ID NO: 6882725 - DNA, 15 bp, Homo sapiens
atcttcgtcctgccc

SEQ ID NO: 6882726 - DNA, 23 bp, Homo sapiens
ctctcccgtgcatcccccctgct

SEQ ID NO: 6882727 - DNA, 20 bp, Homo sapiens
aaggatacaaaagcatgtga

SEQ ID NO: 6882728 - DNA, 23 bp, Homo sapiens
actggcctgttctgtaggagaga

SEQ ID NO: 6882729 - DNA, 15 bp, Homo sapiens
ctgttccctttgcct

SEQ ID NO: 6882730 - DNA, 15 bp, Homo sapiens
actctgtatctatgc

SEQ ID NO: 6882731 - DNA, 13 bp, Homo sapiens
agcttcctgtgca

SEQ ID NO: 6882732 - DNA, 13 bp, Homo sapiens
acaggattttaca

SEQ ID NO: 6882733 - DNA, 15 bp, Homo sapiens
cccagcacctgctcc

SEQ ID NO: 6882734 - DNA, 12 bp, Homo sapiens
cttcacactgca

SEQ ID NO: 6882735 - DNA, 14 bp, Homo sapiens
tcagtttttactga

SEQ ID NO: 6882736 - DNA, 19 bp, Homo sapiens
ccagcctggcccagctccc

SEQ ID NO: 6882737 - DNA, 14 bp, Homo sapiens
ctccatcctcctgt

SEQ ID NO: 6882738 - DNA, 20 bp, Homo sapiens
agaggaataaagctgtgagc

SEQ ID NO: 6882739 - DNA, 15 bp, Homo sapiens
gtattttttccttaa

SEQ ID NO: 6882740 - DNA, 16 bp, Homo sapiens
tcactgtcatctgcca

SEQ ID NO: 6882741 - DNA, 20 bp, Homo sapiens
ctttacccttgagccctccc

SEQ ID NO: 6882742 - DNA, 19 bp, Homo sapiens
aggagaatcatgtttcttt

SEQ ID NO: 6882743 - DNA, 14 bp, Homo sapiens
cacaccatctggcc

SEQ ID NO: 6882744 - DNA, 13 bp, Homo sapiens
atcagtgtgaatg

SEQ ID NO: 6882745 - DNA, 13 bp, Homo sapiens
cctgcgctcctct

SEQ ID NO: 6882746 - DNA, 21 bp, Homo sapiens
cttgttctgagtaagtgtgtt

SEQ ID NO: 6882747 - DNA, 19 bp, Homo sapiens
ctattccagctgtcccccc

SEQ ID NO: 6882748 - DNA, 18 bp, Homo sapiens
ggcctgccaccctcctgc

SEQ ID NO: 6882749 - DNA, 23 bp, Homo sapiens
ctgtcccctcacagactcttcca

SEQ ID NO: 6882750 - DNA, 21 bp, Homo sapiens
acatgcttttctgccactcca

SEQ ID NO: 6882751 - DNA, 19 bp, Homo sapiens
gaggatcacttgggcccag

SEQ ID NO: 6882752 - DNA, 22 bp, Homo sapiens
accagtcgccctctgtgcctaa

SEQ ID NO: 6882753 - DNA, 17 bp, Homo sapiens
tgccatgggcctgctgc

SEQ ID NO: 6882754 - DNA, 15 bp, Homo sapiens
cttggcaaattctga

SEQ ID NO: 6882755 - DNA, 22 bp, Homo sapiens
tattgagtaatattacatttca

SEQ ID NO: 6882756 - DNA, 20 bp, Homo sapiens
atcaagagtttattattgta

SEQ ID NO: 6882757 - DNA, 21 bp, Homo sapiens
caataaaaactgtctgtctcc

SEQ ID NO: 6882758 - DNA, 13 bp, Homo sapiens
ggagcccctgtgt

SEQ ID NO: 6882759 - DNA, 16 bp, Homo sapiens
cattctgaccatttca

SEQ ID NO: 6882760 - DNA, 19 bp, Homo sapiens
ttcagtggtttccctgccc

SEQ ID NO: 6882761 - DNA, 20 bp, Homo sapiens
tagctgccaagccccatcct

SEQ ID NO: 6882762 - DNA, 14 bp, Homo sapiens
acaattttctgtaa

SEQ ID NO: 6882763 - DNA, 16 bp, Homo sapiens
ctacttgctctggacc

SEQ ID NO: 6882764 - DNA, 23 bp, Homo sapiens
ctgaaagaggaggacccctgcct

SEQ ID NO: 6882765 - DNA, 16 bp, Homo sapiens
ctgccctccctggcct

SEQ ID NO: 6882766 - DNA, 16 bp, Homo sapiens
ggatctgaccctccca

SEQ ID NO: 6882767 - DNA, 15 bp, Homo sapiens
aggggcagctcctga

SEQ ID NO: 6882768 - DNA, 17 bp, Homo sapiens
ccctccagaccctgcct

SEQ ID NO: 6882769 - DNA, 17 bp, Homo sapiens
acttttatgtgagattt

SEQ ID NO: 6882770 - DNA, 16 bp, Homo sapiens
ctcagtgctctctcca

SEQ ID NO: 6882771 - DNA, 14 bp, Homo sapiens
cattctcctgtgcc

SEQ ID NO: 6882772 - DNA, 19 bp, Homo sapiens
ctgaagactcattcttctg

SEQ ID NO: 6882773 - DNA, 16 bp, Homo sapiens
tgaatgaaaaatttaa

SEQ ID NO: 6882774 - DNA, 17 bp, Homo sapiens
ctctgcactcccctgct

SEQ ID NO: 6882775 - DNA, 13 bp, Homo sapiens
gctcccgcctcca

SEQ ID NO: 6882776 - DNA, 16 bp, Homo sapiens
aaatgtacctgatgta

SEQ ID NO: 6882777 - DNA, 15 bp, Homo sapiens
cctgggcctgtctca

SEQ ID NO: 6882778 - DNA, 18 bp, Homo sapiens
gggaggctggggacccag

SEQ ID NO: 6882779 - DNA, 15 bp, Homo sapiens
aaggagccagctccc

SEQ ID NO: 6882780 - DNA, 14 bp, Homo sapiens
ccagggcagcctcg

SEQ ID NO: 6882781 - DNA, 16 bp, Homo sapiens
ctctttctctcttccc

SEQ ID NO: 6882782 - DNA, 16 bp, Homo sapiens
tttaatatttactcta

SEQ ID NO: 6882783 - DNA, 23 bp, Homo sapiens
acctttcagataactgttattta

SEQ ID NO: 6882784 - DNA, 15 bp, Homo sapiens
tgggctcctggctgc

SEQ ID NO: 6882785 - DNA, 20 bp, Homo sapiens
cctgcaaactcactgctcaa

SEQ ID NO: 6882786 - DNA, 19 bp, Homo sapiens
taaaaatacaattattgta

SEQ ID NO: 6882787 - DNA, 13 bp, Homo sapiens
tcactcttcctca

SEQ ID NO: 6882788 - DNA, 14 bp, Homo sapiens
cttctccccttcca

SEQ ID NO: 6882789 - DNA, 18 bp, Homo sapiens
cctgccaggctcctctcc

SEQ ID NO: 6882790 - DNA, 13 bp, Homo sapiens
cctcccacatccc

SEQ ID NO: 6882791 - DNA, 13 bp, Homo sapiens
acgcaccactgct

SEQ ID NO: 6882792 - DNA, 19 bp, Homo sapiens
ataggtagggagatattta

SEQ ID NO: 6882793 - DNA, 20 bp, Homo sapiens
tacatcctaaggttcttgct

SEQ ID NO: 6882794 - DNA, 13 bp, Homo sapiens
atctatctgtgct

SEQ ID NO: 6882795 - DNA, 22 bp, Homo sapiens
atcaagacgtttaactgcagtt

SEQ ID NO: 6882796 - DNA, 22 bp, Homo sapiens
gccctccctcagccgtcagcca

SEQ ID NO: 6882797 - DNA, 21 bp, Homo sapiens
ctaaaattgttttttgttgta

SEQ ID NO: 6882798 - DNA, 15 bp, Homo sapiens
ttctgctcctctcca

SEQ ID NO: 6882799 - DNA, 20 bp, Homo sapiens
cttctaaaactgtactttga

SEQ ID NO: 6882800 - DNA, 13 bp, Homo sapiens
cccggctcccacc

SEQ ID NO: 6882801 - DNA, 14 bp, Homo sapiens
gtagtctctgtgct

SEQ ID NO: 6882802 - DNA, 16 bp, Homo sapiens
cctgatgccccttccc

SEQ ID NO: 6882803 - DNA, 22 bp, Homo sapiens
tgagctttgcatgttccactaa

SEQ ID NO: 6882804 - DNA, 21 bp, Homo sapiens
gagcaattccaggctgagcca

SEQ ID NO: 6882805 - DNA, 12 bp, Homo sapiens
accaccctgagg

SEQ ID NO: 6882806 - DNA, 15 bp, Homo sapiens
ctgaggcccctgcct

SEQ ID NO: 6882807 - DNA, 21 bp, Homo sapiens
gcgaaacccggtgcatctggc

SEQ ID NO: 6882808 - DNA, 13 bp, Homo sapiens
ctcgttctgctca

SEQ ID NO: 6882809 - DNA, 23 bp, Homo sapiens
attaaactttgaagcaactgtga

SEQ ID NO: 6882810 - DNA, 18 bp, Homo sapiens
cgatgcgtattctgtggc

SEQ ID NO: 6882811 - DNA, 21 bp, Homo sapiens
gattcaatgcccctgaattta

SEQ ID NO: 6882812 - DNA, 17 bp, Homo sapiens
ttcagttcctctttgca

SEQ ID NO: 6882813 - DNA, 21 bp, Homo sapiens
cccagctctacattctgctct

SEQ ID NO: 6882814 - DNA, 14 bp, Homo sapiens
gccgtccctcctgt

SEQ ID NO: 6882815 - DNA, 15 bp, Homo sapiens
gccaaaaaaaaaaga

SEQ ID NO: 6882816 - DNA, 21 bp, Homo sapiens
cagacggatgcccattcctgc

SEQ ID NO: 6882817 - DNA, 18 bp, Homo sapiens
accagcaatgccctgcct

SEQ ID NO: 6882818 - DNA, 22 bp, Homo sapiens
gaggacagtgctgaccccagga

SEQ ID NO: 6882819 - DNA, 14 bp, Homo sapiens
actttctgaaaatt

SEQ ID NO: 6882820 - DNA, 23 bp, Homo sapiens
ttgtataaatttatttactgcta

SEQ ID NO: 6882821 - DNA, 21 bp, Homo sapiens
gcggtgtgtctccagctgatt

SEQ ID NO: 6882822 - DNA, 12 bp, Homo sapiens
atctgtctgtcc

SEQ ID NO: 6882823 - DNA, 17 bp, Homo sapiens
caaataaacagttgtta

SEQ ID NO: 6882824 - DNA, 12 bp, Homo sapiens
atttctcaggaa

SEQ ID NO: 6882825 - DNA, 18 bp, Homo sapiens
tacaattttgtttctgta

SEQ ID NO: 6882826 - DNA, 19 bp, Homo sapiens
cttcacctcttccactcct

SEQ ID NO: 6882827 - DNA, 18 bp, Homo sapiens
ggatttgatgctgtttga

SEQ ID NO: 6882828 - DNA, 13 bp, Homo sapiens
ctccctctgtctt

SEQ ID NO: 6882829 - DNA, 15 bp, Homo sapiens
caatagtgtgttctg

SEQ ID NO: 6882830 - DNA, 14 bp, Homo sapiens
ctcccacgcctgct

SEQ ID NO: 6882831 - DNA, 21 bp, Homo sapiens
aattgtatcagaggcctataa

SEQ ID NO: 6882832 - DNA, 13 bp, Homo sapiens
acagccctgtcag

SEQ ID NO: 6882833 - DNA, 18 bp, Homo sapiens
cttagaacccttctgctt

SEQ ID NO: 6882834 - DNA, 16 bp, Homo sapiens
aaactgacagtattaa

SEQ ID NO: 6882835 - DNA, 17 bp, Homo sapiens
tctctcaaccttggcct

SEQ ID NO: 6882836 - DNA, 21 bp, Homo sapiens
cttaacaaaccaacatctttg

SEQ ID NO: 6882837 - DNA, 12 bp, Homo sapiens
aggacacactga

SEQ ID NO: 6882838 - DNA, 18 bp, Homo sapiens
gtgaagaagccctgttct

SEQ ID NO: 6882839 - DNA, 18 bp, Homo sapiens
ctcccactcccatctcct

SEQ ID NO: 6882840 - DNA, 12 bp, Homo sapiens
actactacctct

SEQ ID NO: 6882841 - DNA, 15 bp, Homo sapiens
cgctcatgttgagcc

SEQ ID NO: 6882842 - DNA, 12 bp, Homo sapiens
ctgctctgcata

SEQ ID NO: 6882843 - DNA, 14 bp, Homo sapiens
tggacttgtatatt

SEQ ID NO: 6882844 - DNA, 15 bp, Homo sapiens
cagtgagcagtgttg

SEQ ID NO: 6882845 - DNA, 22 bp, Homo sapiens
ccacatccctgggcctgctgct

SEQ ID NO: 6882846 - DNA, 15 bp, Homo sapiens
ccgtccccccatccc

SEQ ID NO: 6882847 - DNA, 16 bp, Homo sapiens
tcaagatgacagctct

SEQ ID NO: 6882848 - DNA, 18 bp, Homo sapiens
ttaatgtatctatttgta

SEQ ID NO: 6882849 - DNA, 22 bp, Homo sapiens
gtttgggctggagctcctccct

SEQ ID NO: 6882850 - DNA, 22 bp, Homo sapiens
ccagcttcggagggcccctgcg

SEQ ID NO: 6882851 - DNA, 16 bp, Homo sapiens
tcaacatgagtgtatt

SEQ ID NO: 6882852 - DNA, 14 bp, Homo sapiens
tcacaaatgtcatt

SEQ ID NO: 6882853 - DNA, 21 bp, Homo sapiens
aacactcatgcggcccagcca

SEQ ID NO: 6882854 - DNA, 14 bp, Homo sapiens
aactcactgtgctc

SEQ ID NO: 6882855 - DNA, 14 bp, Homo sapiens
tatcaactctcact

SEQ ID NO: 6882856 - DNA, 15 bp, Homo sapiens
ctccattactgtgat

SEQ ID NO: 6882857 - DNA, 13 bp, Homo sapiens
cttggctgcccca

SEQ ID NO: 6882858 - DNA, 13 bp, Homo sapiens
ttcggctgtctca

SEQ ID NO: 6882859 - DNA, 19 bp, Homo sapiens
ctgcctagctcttgggcct

SEQ ID NO: 6882860 - DNA, 17 bp, Homo sapiens
atggctgtgcctctgcc

SEQ ID NO: 6882861 - DNA, 12 bp, Homo sapiens
tctccactgctc

SEQ ID NO: 6882862 - DNA, 16 bp, Homo sapiens
actacctatccttaca

SEQ ID NO: 6882863 - DNA, 20 bp, Homo sapiens
tgacccacagctctgggcct

SEQ ID NO: 6882864 - DNA, 16 bp, Homo sapiens
tcccttcttctgtcat

SEQ ID NO: 6882865 - DNA, 14 bp, Homo sapiens
ctatttctacctca

SEQ ID NO: 6882866 - DNA, 18 bp, Homo sapiens
aaaacaaacaacctgcca

SEQ ID NO: 6882867 - DNA, 15 bp, Homo sapiens
gccccatgctctgcc

SEQ ID NO: 6882868 - DNA, 20 bp, Homo sapiens
cctcctcacagacctctgct

SEQ ID NO: 6882869 - DNA, 12 bp, Homo sapiens
ctttcccttcca

SEQ ID NO: 6882870 - DNA, 14 bp, Homo sapiens
cacatccccacctt

SEQ ID NO: 6882871 - DNA, 15 bp, Homo sapiens
actcatactgtgctg

SEQ ID NO: 6882872 - DNA, 16 bp, Homo sapiens
atgccccactctgctg

SEQ ID NO: 6882873 - DNA, 18 bp, Homo sapiens
ccaccctagccaatgtct

SEQ ID NO: 6882874 - DNA, 17 bp, Homo sapiens
actgccaaaatgctcta

SEQ ID NO: 6882875 - DNA, 15 bp, Homo sapiens
gcccgggcaggccag

SEQ ID NO: 6882876 - DNA, 13 bp, Homo sapiens
ctcagctggctgt

SEQ ID NO: 6882877 - DNA, 16 bp, Homo sapiens
cattctctcccatcct

SEQ ID NO: 6882878 - DNA, 15 bp, Homo sapiens
gacctctctgcctct

SEQ ID NO: 6882879 - DNA, 17 bp, Homo sapiens
cctcagcggctccagct

SEQ ID NO: 6882880 - DNA, 20 bp, Homo sapiens
tgagggacatgctcacctct

SEQ ID NO: 6882881 - DNA, 22 bp, Homo sapiens
attttggaggtgcttgatctat

SEQ ID NO: 6882882 - DNA, 23 bp, Homo sapiens
ccctctctctcactcccctctcc

SEQ ID NO: 6882883 - DNA, 17 bp, Homo sapiens
catcttgtgcatgcaaa

SEQ ID NO: 6882884 - DNA, 16 bp, Homo sapiens
catatgtaggaaaatt

SEQ ID NO: 6882885 - DNA, 14 bp, Homo sapiens
tattaactactgta

SEQ ID NO: 6882886 - DNA, 20 bp, Homo sapiens
tgcgcctccatccatctgtc

SEQ ID NO: 6882887 - DNA, 24 bp, Homo sapiens
tccccaccccttcgacatgctgcc

SEQ ID NO: 6882888 - DNA, 21 bp, Homo sapiens
acctgcgggtcctcagctgct

SEQ ID NO: 6882889 - DNA, 22 bp, Homo sapiens
cccagactttagtgccctgccc

SEQ ID NO: 6882890 - DNA, 16 bp, Homo sapiens
tgttggacagctgctt

SEQ ID NO: 6882891 - DNA, 22 bp, Homo sapiens
cctatcagtgtgccccccatcc

SEQ ID NO: 6882892 - DNA, 16 bp, Homo sapiens
gcacgtctcctgctgc

SEQ ID NO: 6882893 - DNA, 17 bp, Homo sapiens
cccttccccgagggatg

SEQ ID NO: 6882894 - DNA, 23 bp, Homo sapiens
caacaattctcccgggactctgc

SEQ ID NO: 6882895 - DNA, 15 bp, Homo sapiens
cagcttgctgagggg

SEQ ID NO: 6882896 - DNA, 16 bp, Homo sapiens
ccttacatcttttcta

SEQ ID NO: 6882897 - DNA, 15 bp, Homo sapiens
tctcttacatcagta

SEQ ID NO: 6882898 - DNA, 21 bp, Homo sapiens
cactcagggcttctcctctgc

SEQ ID NO: 6882899 - DNA, 13 bp, Homo sapiens
catgccactgcct

SEQ ID NO: 6882900 - DNA, 15 bp, Homo sapiens
acatgcctctctcag

SEQ ID NO: 6882901 - DNA, 18 bp, Homo sapiens
ctgccctttcaaagcact

SEQ ID NO: 6882902 - DNA, 14 bp, Homo sapiens
ggtgcccctcttcc

SEQ ID NO: 6882903 - DNA, 22 bp, Homo sapiens
accagcctgtcacccagctcct

SEQ ID NO: 6882904 - DNA, 20 bp, Homo sapiens
ctcatctgtacatactgttt

SEQ ID NO: 6882905 - DNA, 17 bp, Homo sapiens
ccttccagctccctccc

SEQ ID NO: 6882906 - DNA, 19 bp, Homo sapiens
ataagttggaaacactaaa

SEQ ID NO: 6882907 - DNA, 18 bp, Homo sapiens
tcattttttttttttgag

SEQ ID NO: 6882908 - DNA, 14 bp, Homo sapiens
cacccacctcagcc

SEQ ID NO: 6882909 - DNA, 14 bp, Homo sapiens
tgtccccccttgaa

SEQ ID NO: 6882910 - DNA, 13 bp, Homo sapiens
cttgcctgcctcc

SEQ ID NO: 6882911 - DNA, 16 bp, Homo sapiens
gcataatatgcatata

SEQ ID NO: 6882912 - DNA, 14 bp, Homo sapiens
tgggcccctctgac

SEQ ID NO: 6882913 - DNA, 16 bp, Homo sapiens
tgccaggtccttgccc

SEQ ID NO: 6882914 - DNA, 22 bp, Homo sapiens
tctcctggcccctgcctgctgg

SEQ ID NO: 6882915 - DNA, 13 bp, Homo sapiens
cctcctctctgcc

SEQ ID NO: 6882916 - DNA, 22 bp, Homo sapiens
tgcacctatagcccccactgcc

SEQ ID NO: 6882917 - DNA, 15 bp, Homo sapiens
tcagccttgctgctc

SEQ ID NO: 6882918 - DNA, 16 bp, Homo sapiens
gccaaacctctgttca

SEQ ID NO: 6882919 - DNA, 13 bp, Homo sapiens
taaatacaggaaa

SEQ ID NO: 6882920 - DNA, 19 bp, Homo sapiens
ctttataaaaagtgaaata

SEQ ID NO: 6882921 - DNA, 12 bp, Homo sapiens
ttcatcaggacc

SEQ ID NO: 6882922 - DNA, 16 bp, Homo sapiens
aagtcctttgtgaata

SEQ ID NO: 6882923 - DNA, 19 bp, Homo sapiens
cacttctagatctcagcca

SEQ ID NO: 6882924 - DNA, 21 bp, Homo sapiens
ccaggaaaggaggaccagtca

SEQ ID NO: 6882925 - DNA, 20 bp, Homo sapiens
cagtgcctggtgttctgaag

SEQ ID NO: 6882926 - DNA, 14 bp, Homo sapiens
gctcttttgcacaa

SEQ ID NO: 6882927 - DNA, 16 bp, Homo sapiens
attgccataatatgat

SEQ ID NO: 6882928 - DNA, 22 bp, Homo sapiens
ttcctgagtcccatccctgcgt

SEQ ID NO: 6882929 - DNA, 18 bp, Homo sapiens
cccgccgttccctgcgct

SEQ ID NO: 6882930 - DNA, 21 bp, Homo sapiens
cctctctctcacctacttcct

SEQ ID NO: 6882931 - DNA, 14 bp, Homo sapiens
aattccaacttgaa

SEQ ID NO: 6882932 - DNA, 21 bp, Homo sapiens
acactgtcaatggactgcacc

SEQ ID NO: 6882933 - DNA, 10 bp, Homo sapiens
ctccctgccg

SEQ ID NO: 6882934 - DNA, 16 bp, Homo sapiens
cctcttcccccttccc

SEQ ID NO: 6882935 - DNA, 22 bp, Homo sapiens
aactgccaaacctcctgtcagt

SEQ ID NO: 6882936 - DNA, 22 bp, Homo sapiens
atcaaacagccccagtcttcct

SEQ ID NO: 6882937 - DNA, 18 bp, Homo sapiens
gaaatccataaactaaga

SEQ ID NO: 6882938 - DNA, 16 bp, Homo sapiens
ggagttcatcttgaat

SEQ ID NO: 6882939 - DNA, 17 bp, Homo sapiens
ctctccctaccttgcct

SEQ ID NO: 6882940 - DNA, 15 bp, Homo sapiens
ctgtctgtctctccc

SEQ ID NO: 6882941 - DNA, 18 bp, Homo sapiens
tgctgctgtccagtgcct

SEQ ID NO: 6882942 - DNA, 15 bp, Homo sapiens
agccagggcctgcga

SEQ ID NO: 6882943 - DNA, 15 bp, Homo sapiens
cattatctgtactga

SEQ ID NO: 6882944 - DNA, 13 bp, Homo sapiens
caacctctggagc

SEQ ID NO: 6882945 - DNA, 20 bp, Homo sapiens
ggttcactgcaacctccgcc

SEQ ID NO: 6882946 - DNA, 15 bp, Homo sapiens
agaacatatgttgca

SEQ ID NO: 6882947 - DNA, 20 bp, Homo sapiens
cctgggtgggtggtggggag

SEQ ID NO: 6882948 - DNA, 13 bp, Homo sapiens
gttgaatatttgt

SEQ ID NO: 6882949 - DNA, 13 bp, Homo sapiens
gttccctgctgcg

SEQ ID NO: 6882950 - DNA, 12 bp, Homo sapiens
taatttgcactg

SEQ ID NO: 6882951 - DNA, 17 bp, Homo sapiens
cttttccagcctcagcc

SEQ ID NO: 6882952 - DNA, 22 bp, Homo sapiens
ctaatgtttaaaagcaaaactg

SEQ ID NO: 6882953 - DNA, 22 bp, Homo sapiens
catttgctgagtttcccttcct

SEQ ID NO: 6882954 - DNA, 15 bp, Homo sapiens
aagtcatcctcctgg

SEQ ID NO: 6882955 - DNA, 19 bp, Homo sapiens
cacttttttcctgtcaata

SEQ ID NO: 6882956 - DNA, 20 bp, Homo sapiens
tccacctgtcttggcctccc

SEQ ID NO: 6882957 - DNA, 22 bp, Homo sapiens
taattaggcaaggctatgtgat

SEQ ID NO: 6882958 - DNA, 21 bp, Homo sapiens
cagtgtcccctccactgtcac

SEQ ID NO: 6882959 - DNA, 15 bp, Homo sapiens
ctggtagctgagggg

SEQ ID NO: 6882960 - DNA, 14 bp, Homo sapiens
ttccctcctcccat

SEQ ID NO: 6882961 - DNA, 17 bp, Homo sapiens
tctcccaggcctctgcc

SEQ ID NO: 6882962 - DNA, 22 bp, Homo sapiens
ttgaatgagtgtgttttgtaca

SEQ ID NO: 6882963 - DNA, 13 bp, Homo sapiens
acctgtctgctgc

SEQ ID NO: 6882964 - DNA, 15 bp, Homo sapiens
cctgacgaaatggaa

SEQ ID NO: 6882965 - DNA, 17 bp, Homo sapiens
cctccgccccagacaca

SEQ ID NO: 6882966 - DNA, 21 bp, Homo sapiens
cccttccctctctccctgcct

SEQ ID NO: 6882967 - DNA, 15 bp, Homo sapiens
atccccgtctctgcc

SEQ ID NO: 6882968 - DNA, 18 bp, Homo sapiens
ctccgtagctctgctgct

SEQ ID NO: 6882969 - DNA, 12 bp, Homo sapiens
acataactgaaa

SEQ ID NO: 6882970 - DNA, 15 bp, Homo sapiens
actcttagaagtgtt

SEQ ID NO: 6882971 - DNA, 13 bp, Homo sapiens
gcctcgcctgccc

SEQ ID NO: 6882972 - DNA, 15 bp, Homo sapiens
actgctgcaccagag

SEQ ID NO: 6882973 - DNA, 18 bp, Homo sapiens
actctttccgactgccca

SEQ ID NO: 6882974 - DNA, 12 bp, Homo sapiens
cttccccagccc

SEQ ID NO: 6882975 - DNA, 16 bp, Homo sapiens
tagaggttctgcctct

SEQ ID NO: 6882976 - DNA, 22 bp, Homo sapiens
cagttctaggggagaagagccc

SEQ ID NO: 6882977 - DNA, 17 bp, Homo sapiens
acatttgtacagaattt

SEQ ID NO: 6882978 - DNA, 23 bp, Homo sapiens
agggattctggtcttcactgcca

SEQ ID NO: 6882979 - DNA, 17 bp, Homo sapiens
accgcagacaggaccag

SEQ ID NO: 6882980 - DNA, 13 bp, Homo sapiens
cgcatctgctcat

SEQ ID NO: 6882981 - DNA, 17 bp, Homo sapiens
catgtgtgtatatatgt

SEQ ID NO: 6882982 - DNA, 21 bp, Homo sapiens
agagtctgtgtgtagccagga

SEQ ID NO: 6882983 - DNA, 19 bp, Homo sapiens
ttccaccctgccctggcct

SEQ ID NO: 6882984 - DNA, 19 bp, Homo sapiens
caccagctatctgtcatct

SEQ ID NO: 6882985 - DNA, 20 bp, Homo sapiens
ctccaggcccagcctggccc

SEQ ID NO: 6882986 - DNA, 13 bp, Homo sapiens
ccctgttcttcct

SEQ ID NO: 6882987 - DNA, 14 bp, Homo sapiens
ccatcctccctcca

SEQ ID NO: 6882988 - DNA, 15 bp, Homo sapiens
cagaccccccagccc

SEQ ID NO: 6882989 - DNA, 18 bp, Homo sapiens
tgaagctgacaatttatg

SEQ ID NO: 6882990 - DNA, 23 bp, Homo sapiens
gctagacacatgaaggtaaataa

SEQ ID NO: 6882991 - DNA, 18 bp, Homo sapiens
ccatccctgctctggtcc

SEQ ID NO: 6882992 - DNA, 11 bp, Homo sapiens
ttatgtttgcc

SEQ ID NO: 6882993 - DNA, 20 bp, Homo sapiens
ctcctcgctcctccttccca

SEQ ID NO: 6882994 - DNA, 15 bp, Homo sapiens
ctagtggcttgtcct

SEQ ID NO: 6882995 - DNA, 13 bp, Homo sapiens
ggcctttgcattt

SEQ ID NO: 6882996 - DNA, 20 bp, Homo sapiens
tgtaaatcacttgtaaataa

SEQ ID NO: 6882997 - DNA, 12 bp, Homo sapiens
cacacactggac

SEQ ID NO: 6882998 - DNA, 16 bp, Homo sapiens
cctccaaccttctgcc

SEQ ID NO: 6882999 - DNA, 13 bp, Homo sapiens
gccctcctctgcc

SEQ ID NO: 6883000 - DNA, 13 bp, Homo sapiens
atttctctttctc

SEQ ID NO: 6883001 - DNA, 13 bp, Homo sapiens
cgtccgtctgtct

SEQ ID NO: 6883002 - DNA, 14 bp, Homo sapiens
tataaaataatgta

SEQ ID NO: 6883003 - DNA, 12 bp, Homo sapiens
ctgctctgcctg

SEQ ID NO: 6883004 - DNA, 20 bp, Homo sapiens
cgcctgcccgtctctctccc

SEQ ID NO: 6883005 - DNA, 13 bp, Homo sapiens
actgaactgtgaa

SEQ ID NO: 6883006 - DNA, 12 bp, Homo sapiens
tctgctcctgct

SEQ ID NO: 6883007 - DNA, 18 bp, Homo sapiens
tactctgttgcctcctct

SEQ ID NO: 6883008 - DNA, 15 bp, Homo sapiens
cttttgagtgcctta

SEQ ID NO: 6883009 - DNA, 17 bp, Homo sapiens
acatagatgtatcatta

SEQ ID NO: 6883010 - DNA, 15 bp, Homo sapiens
atgtggaatgcagtc

SEQ ID NO: 6883011 - DNA, 17 bp, Homo sapiens
tattgtcctaagtgtca

SEQ ID NO: 6883012 - DNA, 14 bp, Homo sapiens
ctcagctctgggcc

SEQ ID NO: 6883013 - DNA, 12 bp, Homo sapiens
aaacatgtcatg

SEQ ID NO: 6883014 - DNA, 20 bp, Homo sapiens
tgggcactaagggtggagag

SEQ ID NO: 6883015 - DNA, 13 bp, Homo sapiens
acccatctctccc

SEQ ID NO: 6883016 - DNA, 14 bp, Homo sapiens
ctcccatctgcact

SEQ ID NO: 6883017 - DNA, 20 bp, Homo sapiens
tctctgccctgggctcctct

SEQ ID NO: 6883018 - DNA, 13 bp, Homo sapiens
tggtcctgtctgt

SEQ ID NO: 6883019 - DNA, 19 bp, Homo sapiens
acattcatgtaactctcca

SEQ ID NO: 6883020 - DNA, 14 bp, Homo sapiens
aggaattccctgga

SEQ ID NO: 6883021 - DNA, 18 bp, Homo sapiens
agctctgcgccaggcaga

SEQ ID NO: 6883022 - DNA, 16 bp, Homo sapiens
ctgtccccccactccc

SEQ ID NO: 6883023 - DNA, 20 bp, Homo sapiens
agcataatatgaagcctttg

SEQ ID NO: 6883024 - DNA, 13 bp, Homo sapiens
ccatcctggggca

SEQ ID NO: 6883025 - DNA, 18 bp, Homo sapiens
tgcagagcagcagcacct

SEQ ID NO: 6883026 - DNA, 17 bp, Homo sapiens
cttcccttccactgcct

SEQ ID NO: 6883027 - DNA, 21 bp, Homo sapiens
caactgaagccttcttctgcc

SEQ ID NO: 6883028 - DNA, 16 bp, Homo sapiens
ctgtctagctgtttca

SEQ ID NO: 6883029 - DNA, 16 bp, Homo sapiens
cacttatttatgaatt

SEQ ID NO: 6883030 - DNA, 18 bp, Homo sapiens
aagaagccctccttgcca

SEQ ID NO: 6883031 - DNA, 18 bp, Homo sapiens
cctgtcccacccccaccc

SEQ ID NO: 6883032 - DNA, 17 bp, Homo sapiens
gcgattctcctgcctca

SEQ ID NO: 6883033 - DNA, 17 bp, Homo sapiens
agccagaggactgtgat

SEQ ID NO: 6883034 - DNA, 15 bp, Homo sapiens
tcctctagctgtggg

SEQ ID NO: 6883035 - DNA, 15 bp, Homo sapiens
tcctccccctgttct

SEQ ID NO: 6883036 - DNA, 22 bp, Homo sapiens
ctgcctgaggggcagcctgcct

SEQ ID NO: 6883037 - DNA, 15 bp, Homo sapiens
tttgcacctgtcccc

SEQ ID NO: 6883038 - DNA, 16 bp, Homo sapiens
tgtctcttacatctcc

SEQ ID NO: 6883039 - DNA, 21 bp, Homo sapiens
ctacttgctctggacctgccc

SEQ ID NO: 6883040 - DNA, 23 bp, Homo sapiens
tgtagggggccttgcggaagcca

SEQ ID NO: 6883041 - DNA, 16 bp, Homo sapiens
cacaggacacagtcag

SEQ ID NO: 6883042 - DNA, 22 bp, Homo sapiens
ctttgcccagggtcctgtgcct

SEQ ID NO: 6883043 - DNA, 12 bp, Homo sapiens
acaaacctgccc

SEQ ID NO: 6883044 - DNA, 22 bp, Homo sapiens
taaaaaggaaatttgtttgtat

SEQ ID NO: 6883045 - DNA, 16 bp, Homo sapiens
aatctatagaaagtgt

SEQ ID NO: 6883046 - DNA, 16 bp, Homo sapiens
atttaagtttgttgct

SEQ ID NO: 6883047 - DNA, 18 bp, Homo sapiens
gtccttttcttttcttga

SEQ ID NO: 6883048 - DNA, 15 bp, Homo sapiens
atcattccctctcat

SEQ ID NO: 6883049 - DNA, 22 bp, Homo sapiens
atactgcttgaccgtactctca

SEQ ID NO: 6883050 - DNA, 15 bp, Homo sapiens
attcactctccatta

SEQ ID NO: 6883051 - DNA, 15 bp, Homo sapiens
ggatcctgagccaga

SEQ ID NO: 6883052 - DNA, 14 bp, Homo sapiens
cagcaaacagctga

SEQ ID NO: 6883053 - DNA, 21 bp, Homo sapiens
ataaagctgttctcattcctg

SEQ ID NO: 6883054 - DNA, 15 bp, Homo sapiens
tgtggagctcctgct

SEQ ID NO: 6883055 - DNA, 12 bp, Homo sapiens
tctctctgtgaa

SEQ ID NO: 6883056 - DNA, 14 bp, Homo sapiens
ctccacatctgcct

SEQ ID NO: 6883057 - DNA, 21 bp, Homo sapiens
caccaaggaaacgctacctct

SEQ ID NO: 6883058 - DNA, 16 bp, Homo sapiens
aggggtaccactgaat

SEQ ID NO: 6883059 - DNA, 16 bp, Homo sapiens
accacacccagcctca

SEQ ID NO: 6883060 - DNA, 15 bp, Homo sapiens
tgaattaaacatgaa

SEQ ID NO: 6883061 - DNA, 22 bp, Homo sapiens
tgctcctgcccaggagcagctt

SEQ ID NO: 6883062 - DNA, 18 bp, Homo sapiens
tgctgcccctccctgcct

SEQ ID NO: 6883063 - DNA, 14 bp, Homo sapiens
cactcatgctgaaa

SEQ ID NO: 6883064 - DNA, 14 bp, Homo sapiens
ctcacgtcctgaga

SEQ ID NO: 6883065 - DNA, 17 bp, Homo sapiens
ctgttaacccagtgttc

SEQ ID NO: 6883066 - DNA, 23 bp, Homo sapiens
cagcatctgaccatctgtgacta

SEQ ID NO: 6883067 - DNA, 12 bp, Homo sapiens
attatgtataaa

SEQ ID NO: 6883068 - DNA, 22 bp, Homo sapiens
tgaggactcggccactgtgtct

SEQ ID NO: 6883069 - DNA, 14 bp, Homo sapiens
gacaaaggcccaga

SEQ ID NO: 6883070 - DNA, 20 bp, Homo sapiens
ccagggcatcttgctggcta

SEQ ID NO: 6883071 - DNA, 13 bp, Homo sapiens
agttccctctgcc

SEQ ID NO: 6883072 - DNA, 18 bp, Homo sapiens
caaggatcctgagccaga

SEQ ID NO: 6883073 - DNA, 14 bp, Homo sapiens
cttccatctcttcc

SEQ ID NO: 6883074 - DNA, 16 bp, Homo sapiens
ctctcctgccctctgc

SEQ ID NO: 6883075 - DNA, 15 bp, Homo sapiens
ctgcaacctgttgat

SEQ ID NO: 6883076 - DNA, 21 bp, Homo sapiens
cgctgcctcgtagagtgacct

SEQ ID NO: 6883077 - DNA, 19 bp, Homo sapiens
tgcagaccctgcccttgtt

SEQ ID NO: 6883078 - DNA, 13 bp, Homo sapiens
ttacatgtttgca

SEQ ID NO: 6883079 - DNA, 13 bp, Homo sapiens
acctcctgcctcg

SEQ ID NO: 6883080 - DNA, 19 bp, Homo sapiens
gcccctggggatcttgccc

SEQ ID NO: 6883081 - DNA, 19 bp, Homo sapiens
agctgctgcagccctgcca

SEQ ID NO: 6883082 - DNA, 16 bp, Homo sapiens
cctggtgcgctgtgct

SEQ ID NO: 6883083 - DNA, 16 bp, Homo sapiens
aaggcatcattttcac

SEQ ID NO: 6883084 - DNA, 19 bp, Homo sapiens
taccagagttgttctgtct

SEQ ID NO: 6883085 - DNA, 23 bp, Homo sapiens
gccttagaaatgtaaactgccat

SEQ ID NO: 6883086 - DNA, 15 bp, Homo sapiens
caaaacctgcttcct

SEQ ID NO: 6883087 - DNA, 20 bp, Homo sapiens
agcttgtctcttgcctgcca

SEQ ID NO: 6883088 - DNA, 23 bp, Homo sapiens
aatgtgctgaagcaaagtgccca

SEQ ID NO: 6883089 - DNA, 12 bp, Homo sapiens
tcactttgctct

SEQ ID NO: 6883090 - DNA, 20 bp, Homo sapiens
ctcccaacccccctcctgct

SEQ ID NO: 6883091 - DNA, 16 bp, Homo sapiens
cacagggtctgcctcc

SEQ ID NO: 6883092 - DNA, 23 bp, Homo sapiens
ctgttgatgtatctgagttgcca

SEQ ID NO: 6883093 - DNA, 13 bp, Homo sapiens
ccacacccagcct

SEQ ID NO: 6883094 - DNA, 17 bp, Homo sapiens
tcaatcccaattctgtc

SEQ ID NO: 6883095 - DNA, 13 bp, Homo sapiens
ttcagcctcctgt

SEQ ID NO: 6883096 - DNA, 20 bp, Homo sapiens
ctggaccccatctgtgaata

SEQ ID NO: 6883097 - DNA, 13 bp, Homo sapiens
cccttccctccct

SEQ ID NO: 6883098 - DNA, 16 bp, Homo sapiens
ccttctttcctcttcc

SEQ ID NO: 6883099 - DNA, 23 bp, Homo sapiens
aggctgcaaagcaaaacagactg

SEQ ID NO: 6883100 - DNA, 16 bp, Homo sapiens
ctcttcgtcctgatcc

SEQ ID NO: 6883101 - DNA, 20 bp, Homo sapiens
ctccatgctcctcactgccc

SEQ ID NO: 6883102 - DNA, 21 bp, Homo sapiens
ggtctgaaggaatagccagag

SEQ ID NO: 6883103 - DNA, 12 bp, Homo sapiens
aaagtgcaaagc

SEQ ID NO: 6883104 - DNA, 13 bp, Homo sapiens
ccagatggtcatc

SEQ ID NO: 6883105 - DNA, 23 bp, Homo sapiens
agaggactggttctgaggccaga

SEQ ID NO: 6883106 - DNA, 11 bp, Homo sapiens
agccagccaca

SEQ ID NO: 6883107 - DNA, 20 bp, Homo sapiens
cttccttgaccaaagctctc

SEQ ID NO: 6883108 - DNA, 18 bp, Homo sapiens
aatactgaaccacttgta

SEQ ID NO: 6883109 - DNA, 23 bp, Homo sapiens
aatgcttggaatatctgctgtat

SEQ ID NO: 6883110 - DNA, 13 bp, Homo sapiens
tcaatcactgctc

SEQ ID NO: 6883111 - DNA, 20 bp, Homo sapiens
aaattacacccatgcacaga

SEQ ID NO: 6883112 - DNA, 16 bp, Homo sapiens
accatcgtccagccct

SEQ ID NO: 6883113 - DNA, 23 bp, Homo sapiens
tagagacagggtctcactgtgtt

SEQ ID NO: 6883114 - DNA, 14 bp, Homo sapiens
acttctcccctgcc

SEQ ID NO: 6883115 - DNA, 19 bp, Homo sapiens
tgatccgcctgcctctgcc

SEQ ID NO: 6883116 - DNA, 13 bp, Homo sapiens
ctcagctcttcca

SEQ ID NO: 6883117 - DNA, 18 bp, Homo sapiens
agtctcctcactctgtcc

SEQ ID NO: 6883118 - DNA, 16 bp, Homo sapiens
catgcctccctgggcc

SEQ ID NO: 6883119 - DNA, 14 bp, Homo sapiens
tagttccctctgcc

SEQ ID NO: 6883120 - DNA, 15 bp, Homo sapiens
ccatggacaggctgg

SEQ ID NO: 6883121 - DNA, 14 bp, Homo sapiens
ctgcacctgtctca

SEQ ID NO: 6883122 - DNA, 15 bp, Homo sapiens
ctgtccttccttcca

SEQ ID NO: 6883123 - DNA, 20 bp, Homo sapiens
agttgtggaaagcctctgct

SEQ ID NO: 6883124 - DNA, 14 bp, Homo sapiens
gatatatgtattta

SEQ ID NO: 6883125 - DNA, 11 bp, Homo sapiens
ccacccctgct

SEQ ID NO: 6883126 - DNA, 18 bp, Homo sapiens
ctatatccatgtactgta

SEQ ID NO: 6883127 - DNA, 19 bp, Homo sapiens
gtaagctgtttattttata

SEQ ID NO: 6883128 - DNA, 22 bp, Homo sapiens
cttggctcgaatctctgtgcct

SEQ ID NO: 6883129 - DNA, 16 bp, Homo sapiens
ctcccatttctactct

SEQ ID NO: 6883130 - DNA, 12 bp, Homo sapiens
ttgatgcctttt

SEQ ID NO: 6883131 - DNA, 11 bp, Homo sapiens
tccctacctca

SEQ ID NO: 6883132 - DNA, 23 bp, Homo sapiens
ggcatttggcttcctctgctgca

SEQ ID NO: 6883133 - DNA, 15 bp, Homo sapiens
ctgctgctcttggct

SEQ ID NO: 6883134 - DNA, 21 bp, Homo sapiens
ccagcagggagttagcactga

SEQ ID NO: 6883135 - DNA, 17 bp, Homo sapiens
aggtaaaatgtattttt

SEQ ID NO: 6883136 - DNA, 21 bp, Homo sapiens
aaggggttcccactggctcct

SEQ ID NO: 6883137 - DNA, 9 bp, Homo sapiens
aaattgcac

SEQ ID NO: 6883138 - DNA, 18 bp, Homo sapiens
ctgtccgtgccccttccc

SEQ ID NO: 6883139 - DNA, 19 bp, Homo sapiens
tgacactgtttcctgataa

SEQ ID NO: 6883140 - DNA, 17 bp, Homo sapiens
cacaccactgccctgcc

SEQ ID NO: 6883141 - DNA, 14 bp, Homo sapiens
caaagcatgctcag

SEQ ID NO: 6883142 - DNA, 12 bp, Homo sapiens
gcctgtgcagca

SEQ ID NO: 6883143 - DNA, 19 bp, Homo sapiens
ccagtcctggttgtctgaa

SEQ ID NO: 6883144 - DNA, 22 bp, Homo sapiens
tgggagctcctctcctggagga

SEQ ID NO: 6883145 - DNA, 17 bp, Homo sapiens
acattattaatcattcc

SEQ ID NO: 6883146 - DNA, 17 bp, Homo sapiens
ccctgtgcccccagcct

SEQ ID NO: 6883147 - DNA, 15 bp, Homo sapiens
cacgtgtggcctccg

SEQ ID NO: 6883148 - DNA, 15 bp, Homo sapiens
cttcagatgtttcca

SEQ ID NO: 6883149 - DNA, 17 bp, Homo sapiens
agctctgcgccaggcag

SEQ ID NO: 6883150 - DNA, 20 bp, Homo sapiens
ctgcagtgttcgcttggctc

SEQ ID NO: 6883151 - DNA, 13 bp, Homo sapiens
atcagctactgta

SEQ ID NO: 6883152 - DNA, 16 bp, Homo sapiens
aatcttattaaagttt

SEQ ID NO: 6883153 - DNA, 14 bp, Homo sapiens
gtctcatcctccca

SEQ ID NO: 6883154 - DNA, 14 bp, Homo sapiens
accagctcctccag

SEQ ID NO: 6883155 - DNA, 22 bp, Homo sapiens
gatccttttttgtcattttatg

SEQ ID NO: 6883156 - DNA, 18 bp, Homo sapiens
tgctcccaaatgcagctt

SEQ ID NO: 6883157 - DNA, 20 bp, Homo sapiens
caaggactacgttaagggaa

SEQ ID NO: 6883158 - DNA, 14 bp, Homo sapiens
cccgcaacccacag

SEQ ID NO: 6883159 - DNA, 17 bp, Homo sapiens
gccactcacacagccag

SEQ ID NO: 6883160 - DNA, 20 bp, Homo sapiens
ttattttatatcatacagtt

SEQ ID NO: 6883161 - DNA, 14 bp, Homo sapiens
gcttggcacatgac

SEQ ID NO: 6883162 - DNA, 14 bp, Homo sapiens
ctgaggacagctgt

SEQ ID NO: 6883163 - DNA, 18 bp, Homo sapiens
tgctgggaagagctcccc

SEQ ID NO: 6883164 - DNA, 16 bp, Homo sapiens
cttggtggcttttcct

SEQ ID NO: 6883165 - DNA, 23 bp, Homo sapiens
tctgcattactattaactctgca

SEQ ID NO: 6883166 - DNA, 20 bp, Homo sapiens
ttcaagtgattctcatgcct

SEQ ID NO: 6883167 - DNA, 22 bp, Homo sapiens
ctgtcctaggtgaccccatctc

SEQ ID NO: 6883168 - DNA, 16 bp, Homo sapiens
cactcagaggccccca

SEQ ID NO: 6883169 - DNA, 17 bp, Homo sapiens
ctccagcaacacagcct

SEQ ID NO: 6883170 - DNA, 17 bp, Homo sapiens
cagagccatactgcgtc

SEQ ID NO: 6883171 - DNA, 16 bp, Homo sapiens
cctcctaccccttcct

SEQ ID NO: 6883172 - DNA, 24 bp, Homo sapiens
agcactggtgaactgagctgggca

SEQ ID NO: 6883173 - DNA, 20 bp, Homo sapiens
ctgcctggaggacctgagcc

SEQ ID NO: 6883174 - DNA, 19 bp, Homo sapiens
cagagaaaatcaaagcagt

SEQ ID NO: 6883175 - DNA, 13 bp, Homo sapiens
agccagtcttgcc

SEQ ID NO: 6883176 - DNA, 19 bp, Homo sapiens
cttccagcgggccctctgc

SEQ ID NO: 6883177 - DNA, 12 bp, Homo sapiens
ccctccctgcct

SEQ ID NO: 6883178 - DNA, 13 bp, Homo sapiens
tccagctggtgag

SEQ ID NO: 6883179 - DNA, 21 bp, Homo sapiens
aatgccagtaacgcgtcttcc

SEQ ID NO: 6883180 - DNA, 18 bp, Homo sapiens
ctgcactcatagggtgct

SEQ ID NO: 6883181 - DNA, 14 bp, Homo sapiens
acatttgatatttt

SEQ ID NO: 6883182 - DNA, 15 bp, Homo sapiens
actcttcagggtcta

SEQ ID NO: 6883183 - DNA, 16 bp, Homo sapiens
ccttccatctcttcct

SEQ ID NO: 6883184 - DNA, 15 bp, Homo sapiens
gctttgcctgcttga

SEQ ID NO: 6883185 - DNA, 16 bp, Homo sapiens
tcccagccccaggcct

SEQ ID NO: 6883186 - DNA, 19 bp, Homo sapiens
tgtgctggtgtcctgacca

SEQ ID NO: 6883187 - DNA, 19 bp, Homo sapiens
aagccccttgtcctctccc

SEQ ID NO: 6883188 - DNA, 18 bp, Homo sapiens
gttgaatatagcctgcct

SEQ ID NO: 6883189 - DNA, 23 bp, Homo sapiens
tgctcctccttggtgcctggcct

SEQ ID NO: 6883190 - DNA, 20 bp, Homo sapiens
aggtacctttccacccagac

SEQ ID NO: 6883191 - DNA, 21 bp, Homo sapiens
caagctgcccagccctggccc

SEQ ID NO: 6883192 - DNA, 17 bp, Homo sapiens
agcaggaggcacagcag

SEQ ID NO: 6883193 - DNA, 22 bp, Homo sapiens
ctctgagacccttttctcagga

SEQ ID NO: 6883194 - DNA, 21 bp, Homo sapiens
cattccacagagttactgcca

SEQ ID NO: 6883195 - DNA, 20 bp, Homo sapiens
gagcagccctggagtcatgc

SEQ ID NO: 6883196 - DNA, 15 bp, Homo sapiens
catggtcctgtgccc

SEQ ID NO: 6883197 - DNA, 14 bp, Homo sapiens
ctttggcctttcct

SEQ ID NO: 6883198 - DNA, 12 bp, Homo sapiens
aacctttgtcaa

SEQ ID NO: 6883199 - DNA, 14 bp, Homo sapiens
acacagttttgtct

SEQ ID NO: 6883200 - DNA, 14 bp, Homo sapiens
ccacttctggcatg

SEQ ID NO: 6883201 - DNA, 20 bp, Homo sapiens
agccttagagcatctctgcc

SEQ ID NO: 6883202 - DNA, 16 bp, Homo sapiens
aaatcacttgtaaata

SEQ ID NO: 6883203 - DNA, 19 bp, Homo sapiens
aacttagatctctcctgca

SEQ ID NO: 6883204 - DNA, 15 bp, Homo sapiens
agtgcaacctctgct

SEQ ID NO: 6883205 - DNA, 15 bp, Homo sapiens
cctacccctcctgcg

SEQ ID NO: 6883206 - DNA, 19 bp, Homo sapiens
ttgctgctaccgccctggg

SEQ ID NO: 6883207 - DNA, 15 bp, Homo sapiens
gctgtaactcagaca

SEQ ID NO: 6883208 - DNA, 21 bp, Homo sapiens
cacctggatggatctgctcca

SEQ ID NO: 6883209 - DNA, 19 bp, Homo sapiens
ccaaccccacccagctcca

SEQ ID NO: 6883210 - DNA, 21 bp, Homo sapiens
ctagtttcttacacactgtct

SEQ ID NO: 6883211 - DNA, 17 bp, Homo sapiens
aagtgtctctgccttga

SEQ ID NO: 6883212 - DNA, 17 bp, Homo sapiens
ccccaaaccctgcttct

SEQ ID NO: 6883213 - DNA, 15 bp, Homo sapiens
caataaaagagctgt

SEQ ID NO: 6883214 - DNA, 21 bp, Homo sapiens
cccccacggccgtccctgact

SEQ ID NO: 6883215 - DNA, 14 bp, Homo sapiens
ctgctgctctccca

SEQ ID NO: 6883216 - DNA, 15 bp, Homo sapiens
ccactcaccagccct

SEQ ID NO: 6883217 - DNA, 14 bp, Homo sapiens
tagagcacatttag

SEQ ID NO: 6883218 - DNA, 20 bp, Homo sapiens
tgctgggggcacagctgtct

SEQ ID NO: 6883219 - DNA, 17 bp, Homo sapiens
tgggctgccctggtgct

SEQ ID NO: 6883220 - DNA, 15 bp, Homo sapiens
tcatagttctgttaa

SEQ ID NO: 6883221 - DNA, 18 bp, Homo sapiens
gttgccaggttgcagctg

SEQ ID NO: 6883222 - DNA, 20 bp, Homo sapiens
ggtgctgggactgagccagt

SEQ ID NO: 6883223 - DNA, 20 bp, Homo sapiens
gaagcccagcccctactgct

SEQ ID NO: 6883224 - DNA, 19 bp, Homo sapiens
ctggacacaataggtcttt

SEQ ID NO: 6883225 - DNA, 18 bp, Homo sapiens
ctctcaccccactcctgt

SEQ ID NO: 6883226 - DNA, 20 bp, Homo sapiens
ggtggcccggaagaaccaga

SEQ ID NO: 6883227 - DNA, 18 bp, Homo sapiens
cagtctccccttcctggc

SEQ ID NO: 6883228 - DNA, 16 bp, Homo sapiens
gatgaagggcccgaga

SEQ ID NO: 6883229 - DNA, 24 bp, Homo sapiens
actgcccccagaaagcctcctgcc

SEQ ID NO: 6883230 - DNA, 20 bp, Homo sapiens
caggcagacaaccttgtccc

SEQ ID NO: 6883231 - DNA, 17 bp, Homo sapiens
aataatgtaatactgta

SEQ ID NO: 6883232 - DNA, 15 bp, Homo sapiens
catgtatattactga

SEQ ID NO: 6883233 - DNA, 22 bp, Homo sapiens
tcttgcaccccaaagctttcct

SEQ ID NO: 6883234 - DNA, 21 bp, Homo sapiens
cctctgggagtccccatccca

SEQ ID NO: 6883235 - DNA, 14 bp, Homo sapiens
tgctgccccttgca

SEQ ID NO: 6883236 - DNA, 18 bp, Homo sapiens
ctaataaaatattttctg

SEQ ID NO: 6883237 - DNA, 14 bp, Homo sapiens
ctcttctctcctca

SEQ ID NO: 6883238 - DNA, 19 bp, Homo sapiens
gccacctgtagccatctgc

SEQ ID NO: 6883239 - DNA, 22 bp, Homo sapiens
ctgacacgtgatggaccaaagc

SEQ ID NO: 6883240 - DNA, 13 bp, Homo sapiens
ctgtcctgctcac

SEQ ID NO: 6883241 - DNA, 19 bp, Homo sapiens
cgtccaggagcctgtgcct

SEQ ID NO: 6883242 - DNA, 18 bp, Homo sapiens
ctggagcatgagctctgt

SEQ ID NO: 6883243 - DNA, 21 bp, Homo sapiens
ccagctcccccttgcccgcca

SEQ ID NO: 6883244 - DNA, 18 bp, Homo sapiens
cagattttgataactgtt

SEQ ID NO: 6883245 - DNA, 12 bp, Homo sapiens
tgtccctggaca

SEQ ID NO: 6883246 - DNA, 22 bp, Homo sapiens
catcaatatgtatatatgtatt

SEQ ID NO: 6883247 - DNA, 14 bp, Homo sapiens
gcctccctgcctca

SEQ ID NO: 6883248 - DNA, 22 bp, Homo sapiens
atgataccagcagcaactgaaa

SEQ ID NO: 6883249 - DNA, 21 bp, Homo sapiens
gccttccagggatttgcctca

SEQ ID NO: 6883250 - DNA, 22 bp, Homo sapiens
ggtggaggttgcagtgagccaa

SEQ ID NO: 6883251 - DNA, 21 bp, Homo sapiens
cctgtccccagtccccagccc

SEQ ID NO: 6883252 - DNA, 21 bp, Homo sapiens
acagacctggctctcagagga

SEQ ID NO: 6883253 - DNA, 19 bp, Homo sapiens
caggcagacacggatctga

SEQ ID NO: 6883254 - DNA, 16 bp, Homo sapiens
cttctccccacagcct

SEQ ID NO: 6883255 - DNA, 13 bp, Homo sapiens
ctaccagctcctc

SEQ ID NO: 6883256 - DNA, 15 bp, Homo sapiens
ttgtctgtagagaat

SEQ ID NO: 6883257 - DNA, 20 bp, Homo sapiens
agcgaggcgaggctgcctct

SEQ ID NO: 6883258 - DNA, 14 bp, Homo sapiens
caccttggcctccc

SEQ ID NO: 6883259 - DNA, 22 bp, Homo sapiens
ccctccacacctccacccgtcc

SEQ ID NO: 6883260 - DNA, 15 bp, Homo sapiens
ccaatgccacagcca

SEQ ID NO: 6883261 - DNA, 21 bp, Homo sapiens
ccgtcctgctcgccctgtgcc

SEQ ID NO: 6883262 - DNA, 13 bp, Homo sapiens
atgaggcatttgt

SEQ ID NO: 6883263 - DNA, 17 bp, Homo sapiens
gcataccacttttgttc

SEQ ID NO: 6883264 - DNA, 19 bp, Homo sapiens
atcagaagtaactcccact

SEQ ID NO: 6883265 - DNA, 15 bp, Homo sapiens
acagacatctctgca

SEQ ID NO: 6883266 - DNA, 15 bp, Homo sapiens
cagtttcctcagtga

SEQ ID NO: 6883267 - DNA, 19 bp, Homo sapiens
tctttaatgctgtctttgt

SEQ ID NO: 6883268 - DNA, 15 bp, Homo sapiens
cgcttccctcctgcc

SEQ ID NO: 6883269 - DNA, 23 bp, Homo sapiens
caccctgtgggaccgcctggccc

SEQ ID NO: 6883270 - DNA, 20 bp, Homo sapiens
tggctggggtggcctgtgtg

SEQ ID NO: 6883271 - DNA, 22 bp, Homo sapiens
tccagcttctcagtttctgcct

SEQ ID NO: 6883272 - DNA, 20 bp, Homo sapiens
ccctcctcagctccctgcct

SEQ ID NO: 6883273 - DNA, 18 bp, Homo sapiens
ccctctcctccccttcct

SEQ ID NO: 6883274 - DNA, 22 bp, Homo sapiens
ccttgtcgcgcgtctcccatcc

SEQ ID NO: 6883275 - DNA, 16 bp, Homo sapiens
aggctgccctgagggg

SEQ ID NO: 6883276 - DNA, 22 bp, Homo sapiens
cttcccgtcccatatcctgcct

SEQ ID NO: 6883277 - DNA, 16 bp, Homo sapiens
cactgacttctaagta

SEQ ID NO: 6883278 - DNA, 23 bp, Homo sapiens
caaagaaatccaaatttctcatg

SEQ ID NO: 6883279 - DNA, 15 bp, Homo sapiens
cttccaggtctgcct

SEQ ID NO: 6883280 - DNA, 15 bp, Homo sapiens
caaagttgcctaaat

SEQ ID NO: 6883281 - DNA, 17 bp, Homo sapiens
cttcttgggtctgccct

SEQ ID NO: 6883282 - DNA, 13 bp, Homo sapiens
ccagggtctgaaa

SEQ ID NO: 6883283 - DNA, 20 bp, Homo sapiens
aagatggtaagacctctgag

SEQ ID NO: 6883284 - DNA, 14 bp, Homo sapiens
catcagctctgcct

SEQ ID NO: 6883285 - DNA, 16 bp, Homo sapiens
attgacctcatcatta

SEQ ID NO: 6883286 - DNA, 20 bp, Homo sapiens
gagcggctgctcgcccagga

SEQ ID NO: 6883287 - DNA, 17 bp, Homo sapiens
caggcctggcccagcca

SEQ ID NO: 6883288 - DNA, 22 bp, Homo sapiens
ctacctaagaatttcactgtct

SEQ ID NO: 6883289 - DNA, 12 bp, Homo sapiens
actagagggccc

SEQ ID NO: 6883290 - DNA, 15 bp, Homo sapiens
ctgtgcctcctcacc

SEQ ID NO: 6883291 - DNA, 18 bp, Homo sapiens
accacccctctcgcctca

SEQ ID NO: 6883292 - DNA, 21 bp, Homo sapiens
tatctgggattctactttaag

SEQ ID NO: 6883293 - DNA, 14 bp, Homo sapiens
cacttccccatctt

SEQ ID NO: 6883294 - DNA, 19 bp, Homo sapiens
cactaaatgagctcctgcg

SEQ ID NO: 6883295 - DNA, 15 bp, Homo sapiens
tcctcagctccctgc

SEQ ID NO: 6883296 - DNA, 14 bp, Homo sapiens
tacttccatgaatt

SEQ ID NO: 6883297 - DNA, 23 bp, Homo sapiens
ataaacagtgagcatatctggta

SEQ ID NO: 6883298 - DNA, 23 bp, Homo sapiens
cctaagcagaaagtgcctttcag

SEQ ID NO: 6883299 - DNA, 17 bp, Homo sapiens
gcacttttgtttagtct

SEQ ID NO: 6883300 - DNA, 14 bp, Homo sapiens
acctggtctctaca

SEQ ID NO: 6883301 - DNA, 17 bp, Homo sapiens
aaaatgtgtacagtgaa

SEQ ID NO: 6883302 - DNA, 13 bp, Homo sapiens
ccttgttgcactg

SEQ ID NO: 6883303 - DNA, 16 bp, Homo sapiens
cccacgccctgttcac

SEQ ID NO: 6883304 - DNA, 13 bp, Homo sapiens
ctctgctcttgcc

SEQ ID NO: 6883305 - DNA, 19 bp, Homo sapiens
tgagtcgagattgcactgc

SEQ ID NO: 6883306 - DNA, 13 bp, Homo sapiens
tccatcagctccc

SEQ ID NO: 6883307 - DNA, 22 bp, Homo sapiens
cagctcccaacgagcctcctca

SEQ ID NO: 6883308 - DNA, 21 bp, Homo sapiens
cccagccagccacccctgcca

SEQ ID NO: 6883309 - DNA, 19 bp, Homo sapiens
gaaaggtcctgctgtggaa

SEQ ID NO: 6883310 - DNA, 18 bp, Homo sapiens
tgtcttaggctgatgcca

SEQ ID NO: 6883311 - DNA, 14 bp, Homo sapiens
tcctgcccatgccc

SEQ ID NO: 6883312 - DNA, 23 bp, Homo sapiens
ccctctgcctgggatgcccttcc

SEQ ID NO: 6883313 - DNA, 12 bp, Homo sapiens
agacagtatgag

SEQ ID NO: 6883314 - DNA, 23 bp, Homo sapiens
cctgtggccatgaccctgcctct

SEQ ID NO: 6883315 - DNA, 20 bp, Homo sapiens
ttaaacgttaaaagtgtaca

SEQ ID NO: 6883316 - DNA, 22 bp, Homo sapiens
ctagatccacgtgtggcctccg

SEQ ID NO: 6883317 - DNA, 20 bp, Homo sapiens
agcctagccgacctcagcct

SEQ ID NO: 6883318 - DNA, 14 bp, Homo sapiens
tgatgttgatgcaa

SEQ ID NO: 6883319 - DNA, 20 bp, Homo sapiens
actattggaacaaatattta

SEQ ID NO: 6883320 - DNA, 19 bp, Homo sapiens
agaattattcagtgaattt

SEQ ID NO: 6883321 - DNA, 22 bp, Homo sapiens
actgcgggagccagactgtcca

SEQ ID NO: 6883322 - DNA, 19 bp, Homo sapiens
cctgtctgtgtcccagcca

SEQ ID NO: 6883323 - DNA, 23 bp, Homo sapiens
aggctttgccatgggcctgctgc

SEQ ID NO: 6883324 - DNA, 15 bp, Homo sapiens
gcctacctcagcctc

SEQ ID NO: 6883325 - DNA, 21 bp, Homo sapiens
cgttgcaggccaggttatgcc

SEQ ID NO: 6883326 - DNA, 16 bp, Homo sapiens
cctgtctcactcttct

SEQ ID NO: 6883327 - DNA, 21 bp, Homo sapiens
caagaagtcagagaaaacact

SEQ ID NO: 6883328 - DNA, 14 bp, Homo sapiens
ctctctcacctgct

SEQ ID NO: 6883329 - DNA, 17 bp, Homo sapiens
ttccatgactctgccta

SEQ ID NO: 6883330 - DNA, 19 bp, Homo sapiens
cttaggtcctcacttctgt

SEQ ID NO: 6883331 - DNA, 17 bp, Homo sapiens
agcctctggacagccag

SEQ ID NO: 6883332 - DNA, 13 bp, Homo sapiens
ctcgccccttccc

SEQ ID NO: 6883333 - DNA, 18 bp, Homo sapiens
gatggcctttggacccag

SEQ ID NO: 6883334 - DNA, 12 bp, Homo sapiens
tatttgtacata

SEQ ID NO: 6883335 - DNA, 17 bp, Homo sapiens
cttcagagactcctgca

SEQ ID NO: 6883336 - DNA, 15 bp, Homo sapiens
tgcctcccactccat

SEQ ID NO: 6883337 - DNA, 15 bp, Homo sapiens
cttttgcacccctcc

SEQ ID NO: 6883338 - DNA, 22 bp, Homo sapiens
ccctggagggcaagccctgccc

SEQ ID NO: 6883339 - DNA, 19 bp, Homo sapiens
cctctgagtcaccatctta

SEQ ID NO: 6883340 - DNA, 18 bp, Homo sapiens
tgacagctttctaactca

SEQ ID NO: 6883341 - DNA, 16 bp, Homo sapiens
ccacaggagccctgct

SEQ ID NO: 6883342 - DNA, 20 bp, Homo sapiens
attttgcctgacaattgcaa

SEQ ID NO: 6883343 - DNA, 19 bp, Homo sapiens
acagacgtctcaagactga

SEQ ID NO: 6883344 - DNA, 13 bp, Homo sapiens
cttactctcctct

SEQ ID NO: 6883345 - DNA, 15 bp, Homo sapiens
cctcctctcccatcc

SEQ ID NO: 6883346 - DNA, 12 bp, Homo sapiens
ttagaatgtgat

SEQ ID NO: 6883347 - DNA, 20 bp, Homo sapiens
ttacaggagggaacatttcc

SEQ ID NO: 6883348 - DNA, 15 bp, Homo sapiens
aacccaatctggctg

SEQ ID NO: 6883349 - DNA, 19 bp, Homo sapiens
aaaataattgagactgaaa

SEQ ID NO: 6883350 - DNA, 13 bp, Homo sapiens
ccttctcccctcc

SEQ ID NO: 6883351 - DNA, 11 bp, Homo sapiens
atagcactttc

SEQ ID NO: 6883352 - DNA, 15 bp, Homo sapiens
agccctgctccctgc

SEQ ID NO: 6883353 - DNA, 16 bp, Homo sapiens
aaaccaattgctgcta

SEQ ID NO: 6883354 - DNA, 15 bp, Homo sapiens
ctgcccggccggaga

SEQ ID NO: 6883355 - DNA, 19 bp, Homo sapiens
caattctcctgcctttgcc

SEQ ID NO: 6883356 - DNA, 21 bp, Homo sapiens
ggtggggcccatggaggagac

SEQ ID NO: 6883357 - DNA, 22 bp, Homo sapiens
cacagctgggcatgccatgtct

SEQ ID NO: 6883358 - DNA, 11 bp, Homo sapiens
cacccccgtca

SEQ ID NO: 6883359 - DNA, 17 bp, Homo sapiens
ctgttcttcctcagcca

SEQ ID NO: 6883360 - DNA, 19 bp, Homo sapiens
ctcagagcccctccctgct

SEQ ID NO: 6883361 - DNA, 23 bp, Homo sapiens
tggggctagactgggctggctgc

SEQ ID NO: 6883362 - DNA, 22 bp, Homo sapiens
caccctggaggctctctctgcc

SEQ ID NO: 6883363 - DNA, 16 bp, Homo sapiens
ctgatgttcagtgtaa

SEQ ID NO: 6883364 - DNA, 20 bp, Homo sapiens
tctttcctcttccccttgcc

SEQ ID NO: 6883365 - DNA, 20 bp, Homo sapiens
tgtttacatggcgccctgcc

SEQ ID NO: 6883366 - DNA, 15 bp, Homo sapiens
ccagctgacagtcct

SEQ ID NO: 6883367 - DNA, 20 bp, Homo sapiens
atccctcgggaagcagccag

SEQ ID NO: 6883368 - DNA, 17 bp, Homo sapiens
ggaattcagcagtttta

SEQ ID NO: 6883369 - DNA, 22 bp, Homo sapiens
tgctctgcaggcagccttgccc

SEQ ID NO: 6883370 - DNA, 20 bp, Homo sapiens
gatatttgtatttattcttt

SEQ ID NO: 6883371 - DNA, 21 bp, Homo sapiens
tatcagtgttttaaattctga

SEQ ID NO: 6883372 - DNA, 14 bp, Homo sapiens
tatcttttctttag

SEQ ID NO: 6883373 - DNA, 22 bp, Homo sapiens
ctgtgcttcgactactgctcct

SEQ ID NO: 6883374 - DNA, 13 bp, Homo sapiens
aaatatgcactgc

SEQ ID NO: 6883375 - DNA, 16 bp, Homo sapiens
ccttttgcacccctcc

SEQ ID NO: 6883376 - DNA, 14 bp, Homo sapiens
acggccttcttggt

SEQ ID NO: 6883377 - DNA, 16 bp, Homo sapiens
ctcctgccctgtccct

SEQ ID NO: 6883378 - DNA, 18 bp, Homo sapiens
agattgagctctctgccc

SEQ ID NO: 6883379 - DNA, 22 bp, Homo sapiens
accaggtcctgctccgctgcct

SEQ ID NO: 6883380 - DNA, 16 bp, Homo sapiens
gttgttttgttttata

SEQ ID NO: 6883381 - DNA, 16 bp, Homo sapiens
gccagggtctgtgtga

SEQ ID NO: 6883382 - DNA, 15 bp, Homo sapiens
taaaattctgaattt

SEQ ID NO: 6883383 - DNA, 17 bp, Homo sapiens
caccagttatgtttgaa

SEQ ID NO: 6883384 - DNA, 15 bp, Homo sapiens
cagtccggtgccttc

SEQ ID NO: 6883385 - DNA, 14 bp, Homo sapiens
caggctgttctcca

SEQ ID NO: 6883386 - DNA, 16 bp, Homo sapiens
agggccttgcccagag

SEQ ID NO: 6883387 - DNA, 22 bp, Homo sapiens
gaaatagttcaaactgcagcta

SEQ ID NO: 6883388 - DNA, 18 bp, Homo sapiens
agactataaagcagtaga

SEQ ID NO: 6883389 - DNA, 21 bp, Homo sapiens
ttctggggaaagacactgcct

SEQ ID NO: 6883390 - DNA, 21 bp, Homo sapiens
ctattgctagagctcctccct

SEQ ID NO: 6883391 - DNA, 13 bp, Homo sapiens
ctctgcttttcct

SEQ ID NO: 6883392 - DNA, 22 bp, Homo sapiens
caatgatcagacttgatttaca

SEQ ID NO: 6883393 - DNA, 20 bp, Homo sapiens
actcttcagttaagcctttg

SEQ ID NO: 6883394 - DNA, 19 bp, Homo sapiens
cctcactcttgaagtccag

SEQ ID NO: 6883395 - DNA, 21 bp, Homo sapiens
tcactactcacagtctcttta

SEQ ID NO: 6883396 - DNA, 21 bp, Homo sapiens
tggtgcccaccagctggctct

SEQ ID NO: 6883397 - DNA, 20 bp, Homo sapiens
agccttgattggtgttgcca

SEQ ID NO: 6883398 - DNA, 15 bp, Homo sapiens
ccaggcagaaaactg

SEQ ID NO: 6883399 - DNA, 16 bp, Homo sapiens
tcaagtatatgtcatt

SEQ ID NO: 6883400 - DNA, 18 bp, Homo sapiens
agaggctgcccctctcac

SEQ ID NO: 6883401 - DNA, 15 bp, Homo sapiens
tgtctctcactgcat

SEQ ID NO: 6883402 - DNA, 16 bp, Homo sapiens
ctgaggaagcagttgg

SEQ ID NO: 6883403 - DNA, 19 bp, Homo sapiens
cccaggggggcctcctcct

SEQ ID NO: 6883404 - DNA, 16 bp, Homo sapiens
ccttccttccctggct

SEQ ID NO: 6883405 - DNA, 13 bp, Homo sapiens
aaagatgtactga

SEQ ID NO: 6883406 - DNA, 17 bp, Homo sapiens
tagccctttctgtgtgc

SEQ ID NO: 6883407 - DNA, 21 bp, Homo sapiens
gccttcatatcatccacacat

SEQ ID NO: 6883408 - DNA, 14 bp, Homo sapiens
cctccgcccctgcc

SEQ ID NO: 6883409 - DNA, 22 bp, Homo sapiens
ttctgtgtcacgtgaccctgtg

SEQ ID NO: 6883410 - DNA, 13 bp, Homo sapiens
tcctcctacctca

SEQ ID NO: 6883411 - DNA, 19 bp, Homo sapiens
tgtcacattgcattctatt

SEQ ID NO: 6883412 - DNA, 21 bp, Homo sapiens
ctagaaagcccctcacctcag

SEQ ID NO: 6883413 - DNA, 14 bp, Homo sapiens
ctcctgtccctcca

SEQ ID NO: 6883414 - DNA, 18 bp, Homo sapiens
cagaacagcttcaggtta

SEQ ID NO: 6883415 - DNA, 16 bp, Homo sapiens
gaatctgttactgaaa

SEQ ID NO: 6883416 - DNA, 17 bp, Homo sapiens
tatctggagcctgatgt

SEQ ID NO: 6883417 - DNA, 11 bp, Homo sapiens
ggccctaccct

SEQ ID NO: 6883418 - DNA, 21 bp, Homo sapiens
ctttccatgggcccgctgcct

SEQ ID NO: 6883419 - DNA, 23 bp, Homo sapiens
tgacagagcgagactccatctct

SEQ ID NO: 6883420 - DNA, 15 bp, Homo sapiens
acagaaacactgcct

SEQ ID NO: 6883421 - DNA, 10 bp, Homo sapiens
tcccctgagg

SEQ ID NO: 6883422 - DNA, 14 bp, Homo sapiens
aatacacatttcac

SEQ ID NO: 6883423 - DNA, 14 bp, Homo sapiens
tctgccgctgccat

SEQ ID NO: 6883424 - DNA, 16 bp, Homo sapiens
tcctcgggccctgtgg

SEQ ID NO: 6883425 - DNA, 14 bp, Homo sapiens
cagtgcatgcatgt

SEQ ID NO: 6883426 - DNA, 13 bp, Homo sapiens
aaagacactgcct

SEQ ID NO: 6883427 - DNA, 21 bp, Homo sapiens
tgagttcacatgtgccctgcc

SEQ ID NO: 6883428 - DNA, 15 bp, Homo sapiens
gctcctgctgcacca

SEQ ID NO: 6883429 - DNA, 22 bp, Homo sapiens
tgttccatgcctggcccttgcc

SEQ ID NO: 6883430 - DNA, 13 bp, Homo sapiens
ttgattgtttaca

SEQ ID NO: 6883431 - DNA, 20 bp, Homo sapiens
ctcttcctttatcccctcct

SEQ ID NO: 6883432 - DNA, 15 bp, Homo sapiens
atctaataaacttta

SEQ ID NO: 6883433 - DNA, 16 bp, Homo sapiens
caagggcctggcctga

SEQ ID NO: 6883434 - DNA, 17 bp, Homo sapiens
ctgttcttgctgctaga

SEQ ID NO: 6883435 - DNA, 15 bp, Homo sapiens
ttgctggagtactta

SEQ ID NO: 6883436 - DNA, 22 bp, Homo sapiens
ctgcgagacgcacacagctgag

SEQ ID NO: 6883437 - DNA, 22 bp, Homo sapiens
gtgggtcagggggagtctttgc

SEQ ID NO: 6883438 - DNA, 22 bp, Homo sapiens
ggttgatagtttacctgaataa

SEQ ID NO: 6883439 - DNA, 13 bp, Homo sapiens
ccattttgtctgg

SEQ ID NO: 6883440 - DNA, 18 bp, Homo sapiens
taaaaaaagaaatttgat

SEQ ID NO: 6883441 - DNA, 17 bp, Homo sapiens
gcagaacactaacctga

SEQ ID NO: 6883442 - DNA, 23 bp, Homo sapiens
tcttatctagcaagaagattcta

SEQ ID NO: 6883443 - DNA, 14 bp, Homo sapiens
ctgtcgctgcttcg

SEQ ID NO: 6883444 - DNA, 13 bp, Homo sapiens
tagtgcctctgca

SEQ ID NO: 6883445 - DNA, 17 bp, Homo sapiens
cttaagcatctggctct

SEQ ID NO: 6883446 - DNA, 19 bp, Homo sapiens
acagctgtgagccatgcct

SEQ ID NO: 6883447 - DNA, 21 bp, Homo sapiens
tgccgagacagaccctctgcc

SEQ ID NO: 6883448 - DNA, 12 bp, Homo sapiens
cagcgctgacgt

SEQ ID NO: 6883449 - DNA, 15 bp, Homo sapiens
aacgccagtctccca

SEQ ID NO: 6883450 - DNA, 15 bp, Homo sapiens
agtggccctccctca

SEQ ID NO: 6883451 - DNA, 12 bp, Homo sapiens
agagctgcctcc

SEQ ID NO: 6883452 - DNA, 12 bp, Homo sapiens
ttcccctctgct

SEQ ID NO: 6883453 - DNA, 19 bp, Homo sapiens
ctcccgggactcactggca

SEQ ID NO: 6883454 - DNA, 23 bp, Homo sapiens
ccttgtgtgtcaggccctctgcc

SEQ ID NO: 6883455 - DNA, 17 bp, Homo sapiens
tatcagctctatgtcaa

SEQ ID NO: 6883456 - DNA, 18 bp, Homo sapiens
tagaggctttcaaatgta

SEQ ID NO: 6883457 - DNA, 18 bp, Homo sapiens
atttgtttaaacaatctt

SEQ ID NO: 6883458 - DNA, 12 bp, Homo sapiens
taccttctttgg

SEQ ID NO: 6883459 - DNA, 22 bp, Homo sapiens
ccctgggggcatcctgcttcct

SEQ ID NO: 6883460 - DNA, 17 bp, Homo sapiens
tatgaaaagctatctta

SEQ ID NO: 6883461 - DNA, 12 bp, Homo sapiens
caatcatgccct

SEQ ID NO: 6883462 - DNA, 20 bp, Homo sapiens
tcttgggagtatgttgtcat

SEQ ID NO: 6883463 - DNA, 21 bp, Homo sapiens
acagtcccccacccacctcct

SEQ ID NO: 6883464 - DNA, 22 bp, Homo sapiens
tcttttattttggaactatgaa

SEQ ID NO: 6883465 - DNA, 14 bp, Homo sapiens
ggccatccctgtga

SEQ ID NO: 6883466 - DNA, 14 bp, Homo sapiens
ctcagggcgctcag

SEQ ID NO: 6883467 - DNA, 16 bp, Homo sapiens
caaggaagccacagct

SEQ ID NO: 6883468 - DNA, 16 bp, Homo sapiens
cttcatctccctgcca

SEQ ID NO: 6883469 - DNA, 22 bp, Homo sapiens
cgcttactcctctgaccctcct

SEQ ID NO: 6883470 - DNA, 16 bp, Homo sapiens
catgccgtcctgcagt

SEQ ID NO: 6883471 - DNA, 16 bp, Homo sapiens
aggcatgcctgtgtga

SEQ ID NO: 6883472 - DNA, 14 bp, Homo sapiens
tatgagagaatcac

SEQ ID NO: 6883473 - DNA, 15 bp, Homo sapiens
gtaccagtgaatttt

SEQ ID NO: 6883474 - DNA, 14 bp, Homo sapiens
gcattatgtattta

SEQ ID NO: 6883475 - DNA, 13 bp, Homo sapiens
ccatatttttctg

SEQ ID NO: 6883476 - DNA, 20 bp, Homo sapiens
tattcttctttgatagtgta

SEQ ID NO: 6883477 - DNA, 17 bp, Homo sapiens
gagaaaggggagcccac

SEQ ID NO: 6883478 - DNA, 13 bp, Homo sapiens
ctcagaccctgct

SEQ ID NO: 6883479 - DNA, 20 bp, Homo sapiens
ctgttactccattactgtga

SEQ ID NO: 6883480 - DNA, 18 bp, Homo sapiens
cgccagcctacactgcca

SEQ ID NO: 6883481 - DNA, 17 bp, Homo sapiens
cagctgcctctgctccc

SEQ ID NO: 6883482 - DNA, 16 bp, Homo sapiens
caaaatgtcttgtgta

SEQ ID NO: 6883483 - DNA, 12 bp, Homo sapiens
ctcagtctctct

SEQ ID NO: 6883484 - DNA, 20 bp, Homo sapiens
tccagctttccttctgccct

SEQ ID NO: 6883485 - DNA, 18 bp, Homo sapiens
aggtcctgagcactgcca

SEQ ID NO: 6883486 - DNA, 12 bp, Homo sapiens
gtcttaagtgtt

SEQ ID NO: 6883487 - DNA, 13 bp, Homo sapiens
agttctgtagaaa

SEQ ID NO: 6883488 - DNA, 22 bp, Homo sapiens
cgctgcccggcgccctctgtcc

SEQ ID NO: 6883489 - DNA, 15 bp, Homo sapiens
ctctggccctgttgt

SEQ ID NO: 6883490 - DNA, 20 bp, Homo sapiens
gcaaatgtcatgctgcctta

SEQ ID NO: 6883491 - DNA, 19 bp, Homo sapiens
cctttccccacgcccaccc

SEQ ID NO: 6883492 - DNA, 16 bp, Homo sapiens
ctgtgccctccttccc

SEQ ID NO: 6883493 - DNA, 20 bp, Homo sapiens
aaattcatgccccagtatta

SEQ ID NO: 6883494 - DNA, 21 bp, Homo sapiens
caggatattctcacagctcca

SEQ ID NO: 6883495 - DNA, 14 bp, Homo sapiens
ctttcctcttcccc

SEQ ID NO: 6883496 - DNA, 13 bp, Homo sapiens
aatttgaaagttt

SEQ ID NO: 6883497 - DNA, 22 bp, Homo sapiens
tggtcttcagcctccctcagcc

SEQ ID NO: 6883498 - DNA, 13 bp, Homo sapiens
cactcctccctcc

SEQ ID NO: 6883499 - DNA, 15 bp, Homo sapiens
aaatgaactgatttt

SEQ ID NO: 6883500 - DNA, 18 bp, Homo sapiens
aggagggatagagacgca

SEQ ID NO: 6883501 - DNA, 22 bp, Homo sapiens
cagtaggtcccggccagctctg

SEQ ID NO: 6883502 - DNA, 17 bp, Homo sapiens
ccagaaaaggcagccag

SEQ ID NO: 6883503 - DNA, 13 bp, Homo sapiens
catttgtaatgta

SEQ ID NO: 6883504 - DNA, 15 bp, Homo sapiens
ttctccaagtacttt

SEQ ID NO: 6883505 - DNA, 15 bp, Homo sapiens
cagaggccctggagg

SEQ ID NO: 6883506 - DNA, 14 bp, Homo sapiens
aataaagctgtgag

SEQ ID NO: 6883507 - DNA, 22 bp, Homo sapiens
agcattttgctaaatgtgaatg

SEQ ID NO: 6883508 - DNA, 17 bp, Homo sapiens
cctgtccccaccctcca

SEQ ID NO: 6883509 - DNA, 18 bp, Homo sapiens
ttgaaaaaagttactgca

SEQ ID NO: 6883510 - DNA, 14 bp, Homo sapiens
ccgtggaccttcct

SEQ ID NO: 6883511 - DNA, 16 bp, Homo sapiens
ccgaggggctcaggaa

SEQ ID NO: 6883512 - DNA, 19 bp, Homo sapiens
ctgcgggaggccctggccc

SEQ ID NO: 6883513 - DNA, 22 bp, Homo sapiens
gctcctgaaccagtcctgctgc

SEQ ID NO: 6883514 - DNA, 16 bp, Homo sapiens
ctgctggggcctggga

SEQ ID NO: 6883515 - DNA, 17 bp, Homo sapiens
cgctcctggcccagcct

SEQ ID NO: 6883516 - DNA, 18 bp, Homo sapiens
agtagaaagacatctgcc

SEQ ID NO: 6883517 - DNA, 17 bp, Homo sapiens
actcttgttgcccaggc

SEQ ID NO: 6883518 - DNA, 23 bp, Homo sapiens
agaagatgttgaagaatacagtt

SEQ ID NO: 6883519 - DNA, 15 bp, Homo sapiens
tatagatgtattgta

SEQ ID NO: 6883520 - DNA, 18 bp, Homo sapiens
catttttttctacctata

SEQ ID NO: 6883521 - DNA, 17 bp, Homo sapiens
accttaggccttcctct

SEQ ID NO: 6883522 - DNA, 16 bp, Homo sapiens
cctcctccctgcatct

SEQ ID NO: 6883523 - DNA, 15 bp, Homo sapiens
aggggaggccttcca

SEQ ID NO: 6883524 - DNA, 19 bp, Homo sapiens
tcaatctgcagtttgtgaa

SEQ ID NO: 6883525 - DNA, 12 bp, Homo sapiens
ccttctttccta

SEQ ID NO: 6883526 - DNA, 16 bp, Homo sapiens
cccagccccctggccc

SEQ ID NO: 6883527 - DNA, 16 bp, Homo sapiens
cactgtgtacacctca

SEQ ID NO: 6883528 - DNA, 20 bp, Homo sapiens
cacccccatgctgccttcag

SEQ ID NO: 6883529 - DNA, 21 bp, Homo sapiens
cccttgagtaggccctgcttt

SEQ ID NO: 6883530 - DNA, 14 bp, Homo sapiens
ccttccctcttccc

SEQ ID NO: 6883531 - DNA, 23 bp, Homo sapiens
cttcctttctctttctctcttcc

SEQ ID NO: 6883532 - DNA, 23 bp, Homo sapiens
acctccatccccctctgtctgcc

SEQ ID NO: 6883533 - DNA, 15 bp, Homo sapiens
atactagcatactta

SEQ ID NO: 6883534 - DNA, 18 bp, Homo sapiens
ctttagggcagcttgccc

SEQ ID NO: 6883535 - DNA, 11 bp, Homo sapiens
tcatttgctaa

SEQ ID NO: 6883536 - DNA, 19 bp, Homo sapiens
cagaactgcttactagccc

SEQ ID NO: 6883537 - DNA, 20 bp, Homo sapiens
tctctgcccccaaaagtgtc

SEQ ID NO: 6883538 - DNA, 19 bp, Homo sapiens
gctattgtaaggtctttgt

SEQ ID NO: 6883539 - DNA, 17 bp, Homo sapiens
tcccttgctcagtgcct

SEQ ID NO: 6883540 - DNA, 17 bp, Homo sapiens
tcacatccctctcctct

SEQ ID NO: 6883541 - DNA, 19 bp, Homo sapiens
gctcaatgcaacctctgcc

SEQ ID NO: 6883542 - DNA, 15 bp, Homo sapiens
cttttcacactgtct

SEQ ID NO: 6883543 - DNA, 22 bp, Homo sapiens
cgaagactgctaaatgcactga

SEQ ID NO: 6883544 - DNA, 15 bp, Homo sapiens
agggcagaacactaa

SEQ ID NO: 6883545 - DNA, 21 bp, Homo sapiens
ccttgtaccccatcccttcct

SEQ ID NO: 6883546 - DNA, 19 bp, Homo sapiens
catctccctggtgcttatg

SEQ ID NO: 6883547 - DNA, 21 bp, Homo sapiens
ccctgcctgcagccagggctg

SEQ ID NO: 6883548 - DNA, 14 bp, Homo sapiens
tctggccttttcct

SEQ ID NO: 6883549 - DNA, 18 bp, Homo sapiens
acaccatctggcccaggc

SEQ ID NO: 6883550 - DNA, 12 bp, Homo sapiens
ctctcctaccca

SEQ ID NO: 6883551 - DNA, 19 bp, Homo sapiens
ctcgccagcttctcctgcg

SEQ ID NO: 6883552 - DNA, 15 bp, Homo sapiens
acccccacacctcag

SEQ ID NO: 6883553 - DNA, 20 bp, Homo sapiens
gtctcgaactcctgacctca

SEQ ID NO: 6883554 - DNA, 14 bp, Homo sapiens
aattgattgaatta

SEQ ID NO: 6883555 - DNA, 14 bp, Homo sapiens
ctctgcctgtccct

SEQ ID NO: 6883556 - DNA, 16 bp, Homo sapiens
caagctagaactggaa

SEQ ID NO: 6883557 - DNA, 14 bp, Homo sapiens
tcacaagccgtgtt

SEQ ID NO: 6883558 - DNA, 17 bp, Homo sapiens
taaaatagcatactgtg

SEQ ID NO: 6883559 - DNA, 14 bp, Homo sapiens
tgcagcctggctgg

SEQ ID NO: 6883560 - DNA, 15 bp, Homo sapiens
ctactggtctctcta

SEQ ID NO: 6883561 - DNA, 15 bp, Homo sapiens
ttagtttagtgtgtg

SEQ ID NO: 6883562 - DNA, 23 bp, Homo sapiens
ctggagataacagcctcttgccc

SEQ ID NO: 6883563 - DNA, 12 bp, Homo sapiens
gcccgccaccac

SEQ ID NO: 6883564 - DNA, 11 bp, Homo sapiens
ccgagctcctc

SEQ ID NO: 6883565 - DNA, 18 bp, Homo sapiens
gccgcagacgggcacaga

SEQ ID NO: 6883566 - DNA, 11 bp, Homo sapiens
gttctgagggg

SEQ ID NO: 6883567 - DNA, 17 bp, Homo sapiens
agaaatatacagtttga

SEQ ID NO: 6883568 - DNA, 16 bp, Homo sapiens
cacctctctcagagca

SEQ ID NO: 6883569 - DNA, 21 bp, Homo sapiens
tgctccaagggaccctttgcc

SEQ ID NO: 6883570 - DNA, 22 bp, Homo sapiens
ggaggggtggcccagagccata

SEQ ID NO: 6883571 - DNA, 21 bp, Homo sapiens
ccaaattgtctgtctgctctt

SEQ ID NO: 6883572 - DNA, 15 bp, Homo sapiens
cataaatactgtcaa

SEQ ID NO: 6883573 - DNA, 11 bp, Homo sapiens
tctctgcctct

SEQ ID NO: 6883574 - DNA, 12 bp, Homo sapiens
ttcttcacctct

SEQ ID NO: 6883575 - DNA, 20 bp, Homo sapiens
catgccccggccacctctgc

SEQ ID NO: 6883576 - DNA, 18 bp, Homo sapiens
ctccccctccttgtgcct

SEQ ID NO: 6883577 - DNA, 17 bp, Homo sapiens
ccctctgggcctgttct

SEQ ID NO: 6883578 - DNA, 13 bp, Homo sapiens
taaaatgcactga

SEQ ID NO: 6883579 - DNA, 11 bp, Homo sapiens
aaaactgtgac

SEQ ID NO: 6883580 - DNA, 14 bp, Homo sapiens
gatgtggagccagg

SEQ ID NO: 6883581 - DNA, 14 bp, Homo sapiens
tccagtcctgctct

SEQ ID NO: 6883582 - DNA, 14 bp, Homo sapiens
cacccacccctgcc

SEQ ID NO: 6883583 - DNA, 21 bp, Homo sapiens
agacttaatctttgctgaaga

SEQ ID NO: 6883584 - DNA, 21 bp, Homo sapiens
cctctttccccacctcttcct

SEQ ID NO: 6883585 - DNA, 13 bp, Homo sapiens
atcttccctgccc

SEQ ID NO: 6883586 - DNA, 12 bp, Homo sapiens
ctccactctgct

SEQ ID NO: 6883587 - DNA, 15 bp, Homo sapiens
cgccattctcctgcc

SEQ ID NO: 6883588 - DNA, 16 bp, Homo sapiens
tctttggaccctgagg

SEQ ID NO: 6883589 - DNA, 12 bp, Homo sapiens
aaatacatgaag

SEQ ID NO: 6883590 - DNA, 11 bp, Homo sapiens
cctccccttct

SEQ ID NO: 6883591 - DNA, 19 bp, Homo sapiens
ctctgctgcatccccttcc

SEQ ID NO: 6883592 - DNA, 16 bp, Homo sapiens
agaatgtatctgtgaa

SEQ ID NO: 6883593 - DNA, 11 bp, Homo sapiens
caccaggtgca

SEQ ID NO: 6883594 - DNA, 12 bp, Homo sapiens
aagatgtgaatt

SEQ ID NO: 6883595 - DNA, 18 bp, Homo sapiens
cttctgcgggctccctcc

SEQ ID NO: 6883596 - DNA, 12 bp, Homo sapiens
tgtccatctgcc

SEQ ID NO: 6883597 - DNA, 18 bp, Homo sapiens
ccttttcgccccctgcct

SEQ ID NO: 6883598 - DNA, 18 bp, Homo sapiens
ccttggcccctccctccc

SEQ ID NO: 6883599 - DNA, 20 bp, Homo sapiens
tcttttctaatcacagtgtt

SEQ ID NO: 6883600 - DNA, 16 bp, Homo sapiens
tgcacttatgtacttg

SEQ ID NO: 6883601 - DNA, 14 bp, Homo sapiens
actgtaactgctca

SEQ ID NO: 6883602 - DNA, 20 bp, Homo sapiens
tttaagaaactgttactgtc

SEQ ID NO: 6883603 - DNA, 19 bp, Homo sapiens
atttctgtatatttgtcat

SEQ ID NO: 6883604 - DNA, 19 bp, Homo sapiens
tgatggagattaagatgcc

SEQ ID NO: 6883605 - DNA, 19 bp, Homo sapiens
tggcctggcatctgtgtgc

SEQ ID NO: 6883606 - DNA, 18 bp, Homo sapiens
ttgtttttctgctttaga

SEQ ID NO: 6883607 - DNA, 18 bp, Homo sapiens
agggcctagctgctacaa

SEQ ID NO: 6883608 - DNA, 23 bp, Homo sapiens
tccagtccccctatccttggcac

SEQ ID NO: 6883609 - DNA, 14 bp, Homo sapiens
tccatcagctccct

SEQ ID NO: 6883610 - DNA, 19 bp, Homo sapiens
gcccatgcccacctgccca

SEQ ID NO: 6883611 - DNA, 23 bp, Homo sapiens
tgtggctggaggagctggcctgt

SEQ ID NO: 6883612 - DNA, 19 bp, Homo sapiens
ctccagagccagcctggga

SEQ ID NO: 6883613 - DNA, 14 bp, Homo sapiens
accttgaggagaag

SEQ ID NO: 6883614 - DNA, 20 bp, Homo sapiens
actgcaaagttttctttcca

SEQ ID NO: 6883615 - DNA, 17 bp, Homo sapiens
aggattttgtattgcca

SEQ ID NO: 6883616 - DNA, 18 bp, Homo sapiens
caaagtaatctactgtaa

SEQ ID NO: 6883617 - DNA, 23 bp, Homo sapiens
cagtgttttttaggaaaagcatc

SEQ ID NO: 6883618 - DNA, 21 bp, Homo sapiens
tcagcccttgcccccatccct

SEQ ID NO: 6883619 - DNA, 15 bp, Homo sapiens
gcccctcgcacacag

SEQ ID NO: 6883620 - DNA, 12 bp, Homo sapiens
cctccccagcca

SEQ ID NO: 6883621 - DNA, 15 bp, Homo sapiens
cattcagtggcaact

SEQ ID NO: 6883622 - DNA, 16 bp, Homo sapiens
gcaaagacctacctcc

SEQ ID NO: 6883623 - DNA, 20 bp, Homo sapiens
gcaaaatcaggaaaggctgt

SEQ ID NO: 6883624 - DNA, 20 bp, Homo sapiens
acagaaggaatctgtgcaga

SEQ ID NO: 6883625 - DNA, 14 bp, Homo sapiens
tactggcagctcct

SEQ ID NO: 6883626 - DNA, 12 bp, Homo sapiens
gaaagctgatta

SEQ ID NO: 6883627 - DNA, 19 bp, Homo sapiens
aatcccatctattctctgc

SEQ ID NO: 6883628 - DNA, 15 bp, Homo sapiens
tgactgctgcgctgt

SEQ ID NO: 6883629 - DNA, 19 bp, Homo sapiens
tcagccccgacttcctgac

SEQ ID NO: 6883630 - DNA, 19 bp, Homo sapiens
gctttcctgggcctttgca

SEQ ID NO: 6883631 - DNA, 17 bp, Homo sapiens
cctaccgaaaccttgcc

SEQ ID NO: 6883632 - DNA, 18 bp, Homo sapiens
ctgcaagcccactggcca

SEQ ID NO: 6883633 - DNA, 20 bp, Homo sapiens
ttccattctgggtgttttca

SEQ ID NO: 6883634 - DNA, 21 bp, Homo sapiens
aatgtagaaataaattactta

SEQ ID NO: 6883635 - DNA, 14 bp, Homo sapiens
taaataaagtctat

SEQ ID NO: 6883636 - DNA, 11 bp, Homo sapiens
gcctcagcctc

SEQ ID NO: 6883637 - DNA, 19 bp, Homo sapiens
attgtccccgacccttgcc

SEQ ID NO: 6883638 - DNA, 14 bp, Homo sapiens
ccatacttctctca

SEQ ID NO: 6883639 - DNA, 16 bp, Homo sapiens
ccacccagcccttcct

SEQ ID NO: 6883640 - DNA, 16 bp, Homo sapiens
actgtttccctgctga

SEQ ID NO: 6883641 - DNA, 16 bp, Homo sapiens
cctccgcctcccatcc

SEQ ID NO: 6883642 - DNA, 13 bp, Homo sapiens
ttcagcctggcct

SEQ ID NO: 6883643 - DNA, 13 bp, Homo sapiens
ctcatctgtctgg

SEQ ID NO: 6883644 - DNA, 17 bp, Homo sapiens
cattattcctctcaccc

SEQ ID NO: 6883645 - DNA, 19 bp, Homo sapiens
tacatggcgccctgcctcc

SEQ ID NO: 6883646 - DNA, 13 bp, Homo sapiens
acctccttcctcc

SEQ ID NO: 6883647 - DNA, 23 bp, Homo sapiens
ctatgcccctagtaactgctgtc

SEQ ID NO: 6883648 - DNA, 13 bp, Homo sapiens
acctcctcaggga

SEQ ID NO: 6883649 - DNA, 15 bp, Homo sapiens
tataagtgaagtgat

SEQ ID NO: 6883650 - DNA, 12 bp, Homo sapiens
gatcaatgtgac

SEQ ID NO: 6883651 - DNA, 12 bp, Homo sapiens
agcttgtgaatg

SEQ ID NO: 6883652 - DNA, 23 bp, Homo sapiens
cagatccccagcccctcctccct

SEQ ID NO: 6883653 - DNA, 17 bp, Homo sapiens
ctgcaggaggcctggga

SEQ ID NO: 6883654 - DNA, 14 bp, Homo sapiens
gcctgccctggtga

SEQ ID NO: 6883655 - DNA, 19 bp, Homo sapiens
catccacctgtcttggcct

SEQ ID NO: 6883656 - DNA, 15 bp, Homo sapiens
cagtcctgctggcct

SEQ ID NO: 6883657 - DNA, 13 bp, Homo sapiens
agctctcaggccg

SEQ ID NO: 6883658 - DNA, 20 bp, Homo sapiens
aatcacctaattaatttcag

SEQ ID NO: 6883659 - DNA, 12 bp, Homo sapiens
gagacctgtgct

SEQ ID NO: 6883660 - DNA, 14 bp, Homo sapiens
cttcacacccctca

SEQ ID NO: 6883661 - DNA, 19 bp, Homo sapiens
agttggggccctcttgcca

SEQ ID NO: 6883662 - DNA, 15 bp, Homo sapiens
cagctccactggcct

SEQ ID NO: 6883663 - DNA, 15 bp, Homo sapiens
atagagtatatgcac

SEQ ID NO: 6883664 - DNA, 14 bp, Homo sapiens
tacctccctcctca

SEQ ID NO: 6883665 - DNA, 15 bp, Homo sapiens
ctaacctctctgaac

SEQ ID NO: 6883666 - DNA, 21 bp, Homo sapiens
gctataaatgccagagccaac

SEQ ID NO: 6883667 - DNA, 16 bp, Homo sapiens
gaatgcttctgattta

SEQ ID NO: 6883668 - DNA, 13 bp, Homo sapiens
gccattggcctta

SEQ ID NO: 6883669 - DNA, 20 bp, Homo sapiens
aaaaagctcctgtcctccca

SEQ ID NO: 6883670 - DNA, 15 bp, Homo sapiens
cagttccctcagccc

SEQ ID NO: 6883671 - DNA, 13 bp, Homo sapiens
cacatccctctcc

SEQ ID NO: 6883672 - DNA, 15 bp, Homo sapiens
accatcacttcctca

SEQ ID NO: 6883673 - DNA, 14 bp, Homo sapiens
cttctgttctgcct

SEQ ID NO: 6883674 - DNA, 13 bp, Homo sapiens
tgtacaatgtgag

SEQ ID NO: 6883675 - DNA, 22 bp, Homo sapiens
gttcgcacaatctacactgcct

SEQ ID NO: 6883676 - DNA, 18 bp, Homo sapiens
ctgtccagtgcccattcc

SEQ ID NO: 6883677 - DNA, 13 bp, Homo sapiens
aatgaacattcca

SEQ ID NO: 6883678 - DNA, 18 bp, Homo sapiens
tcagggaatccagctccc

SEQ ID NO: 6883679 - DNA, 23 bp, Homo sapiens
actgacctttgtttccttattca

SEQ ID NO: 6883680 - DNA, 13 bp, Homo sapiens
gatataagccata

SEQ ID NO: 6883681 - DNA, 13 bp, Homo sapiens
agcttccctctca

SEQ ID NO: 6883682 - DNA, 13 bp, Homo sapiens
cagcccccagcct

SEQ ID NO: 6883683 - DNA, 18 bp, Homo sapiens
tcccagaggtccagccca

SEQ ID NO: 6883684 - DNA, 11 bp, Homo sapiens
taccaacttcc

SEQ ID NO: 6883685 - DNA, 22 bp, Homo sapiens
cagttaccttaaagctgaattt

SEQ ID NO: 6883686 - DNA, 20 bp, Homo sapiens
ccctgccactcacccttcct

SEQ ID NO: 6883687 - DNA, 18 bp, Homo sapiens
tgcttcttcatcttgaca

SEQ ID NO: 6883688 - DNA, 15 bp, Homo sapiens
atctgtttttacgta

SEQ ID NO: 6883689 - DNA, 19 bp, Homo sapiens
tgccttgcagaactgccat

SEQ ID NO: 6883690 - DNA, 17 bp, Homo sapiens
agcccagctacattcct

SEQ ID NO: 6883691 - DNA, 14 bp, Homo sapiens
atggattcacttct

SEQ ID NO: 6883692 - DNA, 24 bp, Homo sapiens
ttggaagactatcttactatttca

SEQ ID NO: 6883693 - DNA, 15 bp, Homo sapiens
ccttttcccccttcc

SEQ ID NO: 6883694 - DNA, 18 bp, Homo sapiens
ctatgcaaatcagtctca

SEQ ID NO: 6883695 - DNA, 12 bp, Homo sapiens
gtggactgtatt

SEQ ID NO: 6883696 - DNA, 13 bp, Homo sapiens
gcctctccctgca

SEQ ID NO: 6883697 - DNA, 14 bp, Homo sapiens
cattgcactgcagt

SEQ ID NO: 6883698 - DNA, 17 bp, Homo sapiens
agaaaattatattctgt

SEQ ID NO: 6883699 - DNA, 14 bp, Homo sapiens
aagataatttgcat

SEQ ID NO: 6883700 - DNA, 17 bp, Homo sapiens
aatgtttaaaaaagttt

SEQ ID NO: 6883701 - DNA, 15 bp, Homo sapiens
ctccatcagctgtaa

SEQ ID NO: 6883702 - DNA, 13 bp, Homo sapiens
ctatccccggacc

SEQ ID NO: 6883703 - DNA, 19 bp, Homo sapiens
ctccatacacacgctgcct

SEQ ID NO: 6883704 - DNA, 19 bp, Homo sapiens
ctgacctcttgctgtctct

SEQ ID NO: 6883705 - DNA, 17 bp, Homo sapiens
cagtagtgcctgtgatc

SEQ ID NO: 6883706 - DNA, 21 bp, Homo sapiens
tggaatctagaagaaatgaaa

SEQ ID NO: 6883707 - DNA, 16 bp, Homo sapiens
cctctctgccccaccc

SEQ ID NO: 6883708 - DNA, 13 bp, Homo sapiens
acggaccctgtgt

SEQ ID NO: 6883709 - DNA, 20 bp, Homo sapiens
caataaagttgttgcattcc

SEQ ID NO: 6883710 - DNA, 20 bp, Homo sapiens
ccatagaaacatgacactga

SEQ ID NO: 6883711 - DNA, 19 bp, Homo sapiens
cagccgtgtgtgcatgtgc

SEQ ID NO: 6883712 - DNA, 22 bp, Homo sapiens
acattcttccatcatcactgta

SEQ ID NO: 6883713 - DNA, 20 bp, Homo sapiens
tacctcatccatgcacttta

SEQ ID NO: 6883714 - DNA, 22 bp, Homo sapiens
caacatgatgaggtagtacctt

SEQ ID NO: 6883715 - DNA, 22 bp, Homo sapiens
catcctccccaccagagctgcc

SEQ ID NO: 6883716 - DNA, 20 bp, Homo sapiens
cgactctcctgcctcagcct

SEQ ID NO: 6883717 - DNA, 16 bp, Homo sapiens
cagcttctttgcagct

SEQ ID NO: 6883718 - DNA, 17 bp, Homo sapiens
ccctgagcctgcattct

SEQ ID NO: 6883719 - DNA, 21 bp, Homo sapiens
agggcaccctgtggccctggc

SEQ ID NO: 6883720 - DNA, 22 bp, Homo sapiens
cagtattctcccctgattggaa

SEQ ID NO: 6883721 - DNA, 15 bp, Homo sapiens
taaactgactttatc

SEQ ID NO: 6883722 - DNA, 18 bp, Homo sapiens
ctagagggagaagactgt

SEQ ID NO: 6883723 - DNA, 15 bp, Homo sapiens
caggaggtgtgaatg

SEQ ID NO: 6883724 - DNA, 14 bp, Homo sapiens
acctctccctgacc

SEQ ID NO: 6883725 - DNA, 14 bp, Homo sapiens
gaactgctgctgac

SEQ ID NO: 6883726 - DNA, 14 bp, Homo sapiens
ccacgcgtgttctg

SEQ ID NO: 6883727 - DNA, 21 bp, Homo sapiens
cggggggtgtcttccctgcct

SEQ ID NO: 6883728 - DNA, 14 bp, Homo sapiens
cccactccctgcct

SEQ ID NO: 6883729 - DNA, 14 bp, Homo sapiens
cccaccccctgccc

SEQ ID NO: 6883730 - DNA, 16 bp, Homo sapiens
cccttgtaccccatcc

SEQ ID NO: 6883731 - DNA, 22 bp, Homo sapiens
aacattgccatgtaactatgta

SEQ ID NO: 6883732 - DNA, 19 bp, Homo sapiens
acagccttgggcctttcag

SEQ ID NO: 6883733 - DNA, 16 bp, Homo sapiens
tgggggatgcaaataa

SEQ ID NO: 6883734 - DNA, 20 bp, Homo sapiens
aatgctgttggtaaagcaca

SEQ ID NO: 6883735 - DNA, 13 bp, Homo sapiens
attcaaaacgtga

SEQ ID NO: 6883736 - DNA, 17 bp, Homo sapiens
tgattccgcaccctgcc

SEQ ID NO: 6883737 - DNA, 14 bp, Homo sapiens
caacagatctggaa

SEQ ID NO: 6883738 - DNA, 15 bp, Homo sapiens
tctacaccctctgcc

SEQ ID NO: 6883739 - DNA, 21 bp, Homo sapiens
ctcctgggccctctctgctct

SEQ ID NO: 6883740 - DNA, 13 bp, Homo sapiens
gccaagccctggc

SEQ ID NO: 6883741 - DNA, 14 bp, Homo sapiens
cagcattgtctttg

SEQ ID NO: 6883742 - DNA, 13 bp, Homo sapiens
ctttgccactgct

SEQ ID NO: 6883743 - DNA, 18 bp, Homo sapiens
aactctaaccctgtggaa

SEQ ID NO: 6883744 - DNA, 15 bp, Homo sapiens
ccaagactctgctct

SEQ ID NO: 6883745 - DNA, 16 bp, Homo sapiens
cactccagtttgccca

SEQ ID NO: 6883746 - DNA, 17 bp, Homo sapiens
gctactggcagctcctc

SEQ ID NO: 6883747 - DNA, 14 bp, Homo sapiens
cgctcctccctgct

SEQ ID NO: 6883748 - DNA, 16 bp, Homo sapiens
caaaggacctcagctg

SEQ ID NO: 6883749 - DNA, 12 bp, Homo sapiens
aacaggtctcct

SEQ ID NO: 6883750 - DNA, 18 bp, Homo sapiens
agccacccttccctgcct

SEQ ID NO: 6883751 - DNA, 15 bp, Homo sapiens
ctcccttcctggcct

SEQ ID NO: 6883752 - DNA, 14 bp, Homo sapiens
cacgagatttgcca

SEQ ID NO: 6883753 - DNA, 14 bp, Homo sapiens
attctcctgcctca

SEQ ID NO: 6883754 - DNA, 20 bp, Homo sapiens
ggtgaagagaaccgagcaaa

SEQ ID NO: 6883755 - DNA, 21 bp, Homo sapiens
cctgccgacacgctccctccc

SEQ ID NO: 6883756 - DNA, 16 bp, Homo sapiens
caagctagtgtttcta

SEQ ID NO: 6883757 - DNA, 19 bp, Homo sapiens
ccttggctgcagccatccc

SEQ ID NO: 6883758 - DNA, 13 bp, Homo sapiens
caggagagggcct

SEQ ID NO: 6883759 - DNA, 22 bp, Homo sapiens
agggctgggcagggccctgtgg

SEQ ID NO: 6883760 - DNA, 15 bp, Homo sapiens
ctgtgtgtgccctgt

SEQ ID NO: 6883761 - DNA, 14 bp, Homo sapiens
acaattagagatat

SEQ ID NO: 6883762 - DNA, 15 bp, Homo sapiens
tcttccacctcagcc

SEQ ID NO: 6883763 - DNA, 14 bp, Homo sapiens
aatagcctgaattt

SEQ ID NO: 6883764 - DNA, 13 bp, Homo sapiens
gccgccatctgcg

SEQ ID NO: 6883765 - DNA, 16 bp, Homo sapiens
ccagtcaccccggcca

SEQ ID NO: 6883766 - DNA, 20 bp, Homo sapiens
agactcagcgctcctcctgt

SEQ ID NO: 6883767 - DNA, 16 bp, Homo sapiens
atcatggtcagctcac

SEQ ID NO: 6883768 - DNA, 20 bp, Homo sapiens
ccctttcctccccaccttcc

SEQ ID NO: 6883769 - DNA, 13 bp, Homo sapiens
actcagggcccca

SEQ ID NO: 6883770 - DNA, 12 bp, Homo sapiens
caaatatattca

SEQ ID NO: 6883771 - DNA, 23 bp, Homo sapiens
aactcaaggaggtggtgaatttt

SEQ ID NO: 6883772 - DNA, 19 bp, Homo sapiens
ccttagacagtccctgcca

SEQ ID NO: 6883773 - DNA, 15 bp, Homo sapiens
aggctctcaggccag

SEQ ID NO: 6883774 - DNA, 17 bp, Homo sapiens
tcccggcactccatgct

SEQ ID NO: 6883775 - DNA, 16 bp, Homo sapiens
agagactgtttgaatg

SEQ ID NO: 6883776 - DNA, 11 bp, Homo sapiens
cccctcttcca

SEQ ID NO: 6883777 - DNA, 16 bp, Homo sapiens
taacaaaggatactta

SEQ ID NO: 6883778 - DNA, 21 bp, Homo sapiens
cttctctcctttctccctgca

SEQ ID NO: 6883779 - DNA, 16 bp, Homo sapiens
accctgccacagccag

SEQ ID NO: 6883780 - DNA, 21 bp, Homo sapiens
tacaaggggatccagtgtgta

SEQ ID NO: 6883781 - DNA, 21 bp, Homo sapiens
agcccaatccaggtacgcaca

SEQ ID NO: 6883782 - DNA, 20 bp, Homo sapiens
tcctgttactgaatttgcta

SEQ ID NO: 6883783 - DNA, 19 bp, Homo sapiens
gcaccctgcacctgctgcg

SEQ ID NO: 6883784 - DNA, 19 bp, Homo sapiens
cagtcctcacagcctctcc

SEQ ID NO: 6883785 - DNA, 15 bp, Homo sapiens
agcccatgctggctg

SEQ ID NO: 6883786 - DNA, 16 bp, Homo sapiens
caggctgggtcctgcc

SEQ ID NO: 6883787 - DNA, 21 bp, Homo sapiens
actatggtaaataactgtgac

SEQ ID NO: 6883788 - DNA, 13 bp, Homo sapiens
ccaggacagtcag

SEQ ID NO: 6883789 - DNA, 16 bp, Homo sapiens
ggccaggccctctgcc

SEQ ID NO: 6883790 - DNA, 12 bp, Homo sapiens
taaaacatttaa

SEQ ID NO: 6883791 - DNA, 17 bp, Homo sapiens
ggagcattggcccctga

SEQ ID NO: 6883792 - DNA, 20 bp, Homo sapiens
ctctcttgtcctcttctgct

SEQ ID NO: 6883793 - DNA, 20 bp, Homo sapiens
ctgcctccgggcctcggcct

SEQ ID NO: 6883794 - DNA, 19 bp, Homo sapiens
agagaggaaggagattcca

SEQ ID NO: 6883795 - DNA, 19 bp, Homo sapiens
tggttctccttcctcagcc

SEQ ID NO: 6883796 - DNA, 14 bp, Homo sapiens
catctgtctgctct

SEQ ID NO: 6883797 - DNA, 12 bp, Homo sapiens
cctgcccagcct

SEQ ID NO: 6883798 - DNA, 15 bp, Homo sapiens
attaaggaagactga

SEQ ID NO: 6883799 - DNA, 16 bp, Homo sapiens
agtgtgagtggcagcc

SEQ ID NO: 6883800 - DNA, 21 bp, Homo sapiens
acccacccaaaagtcacccag

SEQ ID NO: 6883801 - DNA, 20 bp, Homo sapiens
tgcctgggttttctaactgt

SEQ ID NO: 6883802 - DNA, 19 bp, Homo sapiens
cagagcccaggctcggcct

SEQ ID NO: 6883803 - DNA, 20 bp, Homo sapiens
agtatgtggtactactgtaa

SEQ ID NO: 6883804 - DNA, 23 bp, Homo sapiens
tatccataggtttctctccctcc

SEQ ID NO: 6883805 - DNA, 18 bp, Homo sapiens
cacttcaataattgtcca

SEQ ID NO: 6883806 - DNA, 14 bp, Homo sapiens
ccaccccccagcct

SEQ ID NO: 6883807 - DNA, 23 bp, Homo sapiens
atgattactcctccattactcta

SEQ ID NO: 6883808 - DNA, 17 bp, Homo sapiens
aattcttaacatagcca

SEQ ID NO: 6883809 - DNA, 14 bp, Homo sapiens
caaacacactgtaa

SEQ ID NO: 6883810 - DNA, 18 bp, Homo sapiens
tccagctcaccagcccca

SEQ ID NO: 6883811 - DNA, 21 bp, Homo sapiens
accacttatttattgttgcct

SEQ ID NO: 6883812 - DNA, 15 bp, Homo sapiens
cctcctgcccttaca

SEQ ID NO: 6883813 - DNA, 17 bp, Homo sapiens
catccttctcactgcca

SEQ ID NO: 6883814 - DNA, 23 bp, Homo sapiens
acgacaaaaacaagactgcctcc

SEQ ID NO: 6883815 - DNA, 22 bp, Homo sapiens
actctgttgcctcctctctccc

SEQ ID NO: 6883816 - DNA, 18 bp, Homo sapiens
catggagctcttgttgca

SEQ ID NO: 6883817 - DNA, 16 bp, Homo sapiens
cattttcaccccaccc

SEQ ID NO: 6883818 - DNA, 22 bp, Homo sapiens
tgaaggcaaaaccaactctcta

SEQ ID NO: 6883819 - DNA, 13 bp, Homo sapiens
catcctcctctcc

SEQ ID NO: 6883820 - DNA, 22 bp, Homo sapiens
caataaaggaaatatgcactgc

SEQ ID NO: 6883821 - DNA, 19 bp, Homo sapiens
gatggcccctccttgcaac

SEQ ID NO: 6883822 - DNA, 13 bp, Homo sapiens
tacagtgtctttt

SEQ ID NO: 6883823 - DNA, 15 bp, Homo sapiens
tgtccgccctcttcc

SEQ ID NO: 6883824 - DNA, 20 bp, Homo sapiens
cagagctttgtcacttgcca

SEQ ID NO: 6883825 - DNA, 17 bp, Homo sapiens
ggagtctctgccaccca

SEQ ID NO: 6883826 - DNA, 19 bp, Homo sapiens
acattcccaaggttactta

SEQ ID NO: 6883827 - DNA, 17 bp, Homo sapiens
taccttttaccagcttt

SEQ ID NO: 6883828 - DNA, 17 bp, Homo sapiens
catgctgccttcaggga

SEQ ID NO: 6883829 - DNA, 14 bp, Homo sapiens
aatccttacttcca

SEQ ID NO: 6883830 - DNA, 14 bp, Homo sapiens
ttcctggcactgct

SEQ ID NO: 6883831 - DNA, 19 bp, Homo sapiens
catttatttattactgtcc

SEQ ID NO: 6883832 - DNA, 13 bp, Homo sapiens
aattgctgtgtat

SEQ ID NO: 6883833 - DNA, 13 bp, Homo sapiens
gcctggatgcaca

SEQ ID NO: 6883834 - DNA, 15 bp, Homo sapiens
cagcctgcctctgcc

SEQ ID NO: 6883835 - DNA, 21 bp, Homo sapiens
taactgacaagctccatttaa

SEQ ID NO: 6883836 - DNA, 13 bp, Homo sapiens
cagcctcagagga

SEQ ID NO: 6883837 - DNA, 11 bp, Homo sapiens
ctcctccctca

SEQ ID NO: 6883838 - DNA, 13 bp, Homo sapiens
cccactctacctc

SEQ ID NO: 6883839 - DNA, 20 bp, Homo sapiens
ccgagtctttctcactgcct

SEQ ID NO: 6883840 - DNA, 23 bp, Homo sapiens
cgttctccagcccacacccctcc

SEQ ID NO: 6883841 - DNA, 17 bp, Homo sapiens
cactttccatctctgcc

SEQ ID NO: 6883842 - DNA, 21 bp, Homo sapiens
acttcttctgtaatatttaca

SEQ ID NO: 6883843 - DNA, 18 bp, Homo sapiens
tgggccccatgctctgcc

SEQ ID NO: 6883844 - DNA, 20 bp, Homo sapiens
gctctacaggcctgcagccc

SEQ ID NO: 6883845 - DNA, 15 bp, Homo sapiens
caattgcatctccca

SEQ ID NO: 6883846 - DNA, 23 bp, Homo sapiens
gtagtccgtgctgacagctgctc

SEQ ID NO: 6883847 - DNA, 22 bp, Homo sapiens
tgtaatttttcagctctctgta

SEQ ID NO: 6883848 - DNA, 15 bp, Homo sapiens
tccctgcctgctcct

SEQ ID NO: 6883849 - DNA, 16 bp, Homo sapiens
tgactgattgttttaa

SEQ ID NO: 6883850 - DNA, 12 bp, Homo sapiens
aatgtacttttg

SEQ ID NO: 6883851 - DNA, 19 bp, Homo sapiens
tacggagggaggacatcat

SEQ ID NO: 6883852 - DNA, 22 bp, Homo sapiens
ttccgagtctttctcactgcct

SEQ ID NO: 6883853 - DNA, 22 bp, Homo sapiens
catctgcctcctctcctcctca

SEQ ID NO: 6883854 - DNA, 14 bp, Homo sapiens
acccttcaactcct

SEQ ID NO: 6883855 - DNA, 15 bp, Homo sapiens
gcctcagcctcctga

SEQ ID NO: 6883856 - DNA, 12 bp, Homo sapiens
ctgccccagcct

SEQ ID NO: 6883857 - DNA, 16 bp, Homo sapiens
gcctcccccgcctcca

SEQ ID NO: 6883858 - DNA, 15 bp, Homo sapiens
accctaccttcccca

SEQ ID NO: 6883859 - DNA, 20 bp, Homo sapiens
tgcccagcctgctctcccta

SEQ ID NO: 6883860 - DNA, 18 bp, Homo sapiens
ccatgtcccaccctccct

SEQ ID NO: 6883861 - DNA, 22 bp, Homo sapiens
aaagtgatctgtcccctctccc

SEQ ID NO: 6883862 - DNA, 23 bp, Homo sapiens
tgcctgttggctgctgcggctgt

SEQ ID NO: 6883863 - DNA, 15 bp, Homo sapiens
ttcctctctcccacc

SEQ ID NO: 6883864 - DNA, 14 bp, Homo sapiens
catagatttgaaga

SEQ ID NO: 6883865 - DNA, 17 bp, Homo sapiens
cactccaggccctgccc

SEQ ID NO: 6883866 - DNA, 21 bp, Homo sapiens
ctcagtgggctgtttctgctt

SEQ ID NO: 6883867 - DNA, 20 bp, Homo sapiens
cttaacccacctctcctgcc

SEQ ID NO: 6883868 - DNA, 15 bp, Homo sapiens
tccctgggcctgctg

SEQ ID NO: 6883869 - DNA, 23 bp, Homo sapiens
ctcaagctatccttgcacctcag

SEQ ID NO: 6883870 - DNA, 21 bp, Homo sapiens
catctcctcaccccagtgcct

SEQ ID NO: 6883871 - DNA, 17 bp, Homo sapiens
agctgaaaatgtgtata

SEQ ID NO: 6883872 - DNA, 17 bp, Homo sapiens
aatcatgagcctgttta

SEQ ID NO: 6883873 - DNA, 12 bp, Homo sapiens
aatttgctttac

SEQ ID NO: 6883874 - DNA, 21 bp, Homo sapiens
tctcctaccccacctcatgcc

SEQ ID NO: 6883875 - DNA, 14 bp, Homo sapiens
caggaatgggccaa

SEQ ID NO: 6883876 - DNA, 20 bp, Homo sapiens
acctgtacattcttccatca

SEQ ID NO: 6883877 - DNA, 15 bp, Homo sapiens
gcttattgttccaag

SEQ ID NO: 6883878 - DNA, 13 bp, Homo sapiens
actcactgaagcc

SEQ ID NO: 6883879 - DNA, 13 bp, Homo sapiens
cagcactgcctcc

SEQ ID NO: 6883880 - DNA, 18 bp, Homo sapiens
tgctaagaaagcaaataa

SEQ ID NO: 6883881 - DNA, 16 bp, Homo sapiens
cacccctaagtgccca

SEQ ID NO: 6883882 - DNA, 22 bp, Homo sapiens
ccactgcaccccctcctgctgc

SEQ ID NO: 6883883 - DNA, 20 bp, Homo sapiens
cagccagccctgcctggagg

SEQ ID NO: 6883884 - DNA, 15 bp, Homo sapiens
ccctgggcctgctgc

SEQ ID NO: 6883885 - DNA, 14 bp, Homo sapiens
tgccctacatatct

SEQ ID NO: 6883886 - DNA, 14 bp, Homo sapiens
gcctgcactgggaa

SEQ ID NO: 6883887 - DNA, 21 bp, Homo sapiens
ctcataaaggacactggatca

SEQ ID NO: 6883888 - DNA, 21 bp, Homo sapiens
ctgtgtaacatccaagccaga

SEQ ID NO: 6883889 - DNA, 15 bp, Homo sapiens
gtcctgccagctgcc

SEQ ID NO: 6883890 - DNA, 13 bp, Homo sapiens
atatcatacagtt

SEQ ID NO: 6883891 - DNA, 18 bp, Homo sapiens
cctctcttaccccgtccc

SEQ ID NO: 6883892 - DNA, 23 bp, Homo sapiens
agactattcaaacagtctcagga

SEQ ID NO: 6883893 - DNA, 21 bp, Homo sapiens
cttccatcccaaccagtgcca

SEQ ID NO: 6883894 - DNA, 17 bp, Homo sapiens
cagacacagggacttga

SEQ ID NO: 6883895 - DNA, 19 bp, Homo sapiens
aggaatggaggagccaggc

SEQ ID NO: 6883896 - DNA, 21 bp, Homo sapiens
acatcctccacgttctgctca

SEQ ID NO: 6883897 - DNA, 14 bp, Homo sapiens
acctgcctcctgcc

SEQ ID NO: 6883898 - DNA, 15 bp, Homo sapiens
attagtttgatttaa

SEQ ID NO: 6883899 - DNA, 17 bp, Homo sapiens
agaagtgggagcagctt

SEQ ID NO: 6883900 - DNA, 22 bp, Homo sapiens
ccctgactaaactaccacctca

SEQ ID NO: 6883901 - DNA, 12 bp, Homo sapiens
tgagctgtttcc

SEQ ID NO: 6883902 - DNA, 17 bp, Homo sapiens
gaatttggtctgcctct

SEQ ID NO: 6883903 - DNA, 17 bp, Homo sapiens
ccagtccccacccgcct

SEQ ID NO: 6883904 - DNA, 22 bp, Homo sapiens
aaatggctaataaactgtatta

SEQ ID NO: 6883905 - DNA, 15 bp, Homo sapiens
cacccctccctctgc

SEQ ID NO: 6883906 - DNA, 18 bp, Homo sapiens
atgaaatataaactgtga

SEQ ID NO: 6883907 - DNA, 17 bp, Homo sapiens
agatatataactttaga

SEQ ID NO: 6883908 - DNA, 20 bp, Homo sapiens
caccccatgctggccttgcc

SEQ ID NO: 6883909 - DNA, 23 bp, Homo sapiens
tccatctagagattttcttggca

SEQ ID NO: 6883910 - DNA, 16 bp, Homo sapiens
ccagccgccccagccc

SEQ ID NO: 6883911 - DNA, 14 bp, Homo sapiens
cacaggcctgagat

SEQ ID NO: 6883912 - DNA, 17 bp, Homo sapiens
gacattgacagcaattc

SEQ ID NO: 6883913 - DNA, 15 bp, Homo sapiens
tcacaatgttcttta

SEQ ID NO: 6883914 - DNA, 22 bp, Homo sapiens
tttctccacccaaaccccttcc

SEQ ID NO: 6883915 - DNA, 11 bp, Homo sapiens
tgcctcctgca

SEQ ID NO: 6883916 - DNA, 20 bp, Homo sapiens
ttacattacaaatttctgtt

SEQ ID NO: 6883917 - DNA, 15 bp, Homo sapiens
gcagcaacacccaag

SEQ ID NO: 6883918 - DNA, 22 bp, Homo sapiens
atttgatttcgatgtacagtct

SEQ ID NO: 6883919 - DNA, 22 bp, Homo sapiens
cacaactattttcagatgtgaa

SEQ ID NO: 6883920 - DNA, 15 bp, Homo sapiens
agcgcttctgctgaa

SEQ ID NO: 6883921 - DNA, 15 bp, Homo sapiens
gagtggagcccaggg

SEQ ID NO: 6883922 - DNA, 20 bp, Homo sapiens
ctcttataacttctgaagta

SEQ ID NO: 6883923 - DNA, 13 bp, Homo sapiens
ctcatctgtctcg

SEQ ID NO: 6883924 - DNA, 17 bp, Homo sapiens
cctgatggtcagctccc

SEQ ID NO: 6883925 - DNA, 16 bp, Homo sapiens
tcttcagcctccctca

SEQ ID NO: 6883926 - DNA, 16 bp, Homo sapiens
cttcttcctcccctca

SEQ ID NO: 6883927 - DNA, 11 bp, Homo sapiens
agctattcttt

SEQ ID NO: 6883928 - DNA, 20 bp, Homo sapiens
caatatatccccactactca

SEQ ID NO: 6883929 - DNA, 23 bp, Homo sapiens
gtcttcccagcggttcctgtgca

SEQ ID NO: 6883930 - DNA, 13 bp, Homo sapiens
agcccagctggcc

SEQ ID NO: 6883931 - DNA, 16 bp, Homo sapiens
gatttcttcgctgctc

SEQ ID NO: 6883932 - DNA, 21 bp, Homo sapiens
gttatcgttaagcacaagaca

SEQ ID NO: 6883933 - DNA, 16 bp, Homo sapiens
cctctacctctctcct

SEQ ID NO: 6883934 - DNA, 17 bp, Homo sapiens
agaaaccctggtctccg

SEQ ID NO: 6883935 - DNA, 13 bp, Homo sapiens
aatttaaattgtt

SEQ ID NO: 6883936 - DNA, 23 bp, Homo sapiens
tgctccagcagcacacctcagcc

SEQ ID NO: 6883937 - DNA, 14 bp, Homo sapiens
gagttgctcactca

SEQ ID NO: 6883938 - DNA, 15 bp, Homo sapiens
aggcttcctgactga

SEQ ID NO: 6883939 - DNA, 20 bp, Homo sapiens
catgctggagtacccagcct

SEQ ID NO: 6883940 - DNA, 23 bp, Homo sapiens
gacttcccctgcctcctactcca

SEQ ID NO: 6883941 - DNA, 23 bp, Homo sapiens
gttcccctagtaagtgccttcca

SEQ ID NO: 6883942 - DNA, 13 bp, Homo sapiens
agcgccctgcaga

SEQ ID NO: 6883943 - DNA, 18 bp, Homo sapiens
cccagtgagccctgctct

SEQ ID NO: 6883944 - DNA, 14 bp, Homo sapiens
tatctctctgccta

SEQ ID NO: 6883945 - DNA, 15 bp, Homo sapiens
agtatcaggtctccc

SEQ ID NO: 6883946 - DNA, 13 bp, Homo sapiens
agctcccctgcct

SEQ ID NO: 6883947 - DNA, 14 bp, Homo sapiens
tccctccctgcagg

SEQ ID NO: 6883948 - DNA, 12 bp, Homo sapiens
taaaatactgta

SEQ ID NO: 6883949 - DNA, 15 bp, Homo sapiens
agggtgggccagcat

SEQ ID NO: 6883950 - DNA, 12 bp, Homo sapiens
ccttcctcctca

SEQ ID NO: 6883951 - DNA, 12 bp, Homo sapiens
ctttcctcccca

SEQ ID NO: 6883952 - DNA, 20 bp, Homo sapiens
caagtggagctgtctgtctc

SEQ ID NO: 6883953 - DNA, 13 bp, Homo sapiens
cagttcgcagcca

SEQ ID NO: 6883954 - DNA, 17 bp, Homo sapiens
taaaattagtgagattt

SEQ ID NO: 6883955 - DNA, 21 bp, Homo sapiens
gttccatttttcctctgttca

SEQ ID NO: 6883956 - DNA, 19 bp, Homo sapiens
cagctgggtggcactgcca

SEQ ID NO: 6883957 - DNA, 13 bp, Homo sapiens
tactacctgtgta

SEQ ID NO: 6883958 - DNA, 13 bp, Homo sapiens
taaactactgtaa

SEQ ID NO: 6883959 - DNA, 15 bp, Homo sapiens
acactgtctctacca

SEQ ID NO: 6883960 - DNA, 19 bp, Homo sapiens
ccttgtcttattcccttcc

SEQ ID NO: 6883961 - DNA, 22 bp, Homo sapiens
accatgctgctggggaagacag

SEQ ID NO: 6883962 - DNA, 21 bp, Homo sapiens
ttcctcacacccacctgctgc

SEQ ID NO: 6883963 - DNA, 19 bp, Homo sapiens
cccaagaaacctccatcct

SEQ ID NO: 6883964 - DNA, 21 bp, Homo sapiens
cccacataatacattccatca

SEQ ID NO: 6883965 - DNA, 23 bp, Homo sapiens
gaaaaaccatttttgaaccttaa

SEQ ID NO: 6883966 - DNA, 18 bp, Homo sapiens
cagctttgtgactgtata

SEQ ID NO: 6883967 - DNA, 21 bp, Homo sapiens
gtgcatgcataccacaagaca

SEQ ID NO: 6883968 - DNA, 20 bp, Homo sapiens
cctccctgtgacccgttcca

SEQ ID NO: 6883969 - DNA, 15 bp, Homo sapiens
cagttccctcctgcc

SEQ ID NO: 6883970 - DNA, 14 bp, Homo sapiens
ctcaaacacttatt

SEQ ID NO: 6883971 - DNA, 20 bp, Homo sapiens
tcctaccccacctcatgcct

SEQ ID NO: 6883972 - DNA, 22 bp, Homo sapiens
ctgtggaaccaaagctggccca

SEQ ID NO: 6883973 - DNA, 15 bp, Homo sapiens
atttatgcatgagaa

SEQ ID NO: 6883974 - DNA, 12 bp, Homo sapiens
aaactgtttctc

SEQ ID NO: 6883975 - DNA, 22 bp, Homo sapiens
gacttgtttgtgcatcctgtga

SEQ ID NO: 6883976 - DNA, 20 bp, Homo sapiens
tgtgagattttttattgcta

SEQ ID NO: 6883977 - DNA, 20 bp, Homo sapiens
cctaccactgagcccttgca

SEQ ID NO: 6883978 - DNA, 15 bp, Homo sapiens
catatgattctgctt

SEQ ID NO: 6883979 - DNA, 20 bp, Homo sapiens
tttccacacaggcccatgcc

SEQ ID NO: 6883980 - DNA, 18 bp, Homo sapiens
acaaacatatgtatcttt

SEQ ID NO: 6883981 - DNA, 17 bp, Homo sapiens
agactgcacaggagaat

SEQ ID NO: 6883982 - DNA, 17 bp, Homo sapiens
acttatttattgttgcc

SEQ ID NO: 6883983 - DNA, 13 bp, Homo sapiens
aattgtactgtgt

SEQ ID NO: 6883984 - DNA, 17 bp, Homo sapiens
ctctattatatcttgta

SEQ ID NO: 6883985 - DNA, 21 bp, Homo sapiens
agcctgtgttagtgtctgtcc

SEQ ID NO: 6883986 - DNA, 15 bp, Homo sapiens
caacttcatctggaa

SEQ ID NO: 6883987 - DNA, 14 bp, Homo sapiens
tcattaatgacact

SEQ ID NO: 6883988 - DNA, 18 bp, Homo sapiens
tcagcactctggactcca

SEQ ID NO: 6883989 - DNA, 22 bp, Homo sapiens
ccagatgtggagtctgtgtctg

SEQ ID NO: 6883990 - DNA, 15 bp, Homo sapiens
gcctccaccctctga

SEQ ID NO: 6883991 - DNA, 20 bp, Homo sapiens
tgccccccagcctctggcat

SEQ ID NO: 6883992 - DNA, 12 bp, Homo sapiens
ggaagccctgga

SEQ ID NO: 6883993 - DNA, 14 bp, Homo sapiens
gcctgcttctgtgt

SEQ ID NO: 6883994 - DNA, 16 bp, Homo sapiens
cccaggccgcctgcca

SEQ ID NO: 6883995 - DNA, 16 bp, Homo sapiens
tcccctcacagcctct

SEQ ID NO: 6883996 - DNA, 23 bp, Homo sapiens
gctagactggagtgaggcttcca

SEQ ID NO: 6883997 - DNA, 14 bp, Homo sapiens
atgtgtaatatcat

SEQ ID NO: 6883998 - DNA, 16 bp, Homo sapiens
tccccagcctacctct

SEQ ID NO: 6883999 - DNA, 17 bp, Homo sapiens
taccttttttatacata

SEQ ID NO: 6884000 - DNA, 21 bp, Homo sapiens
gcagacaagtcttgctgtgct

SEQ ID NO: 6884001 - DNA, 24 bp, Homo sapiens
ttccagctagtgacccacatgcca

SEQ ID NO: 6884002 - DNA, 16 bp, Homo sapiens
cctttgacgccatccc

SEQ ID NO: 6884003 - DNA, 18 bp, Homo sapiens
cccactacctatgcttct

SEQ ID NO: 6884004 - DNA, 17 bp, Homo sapiens
gaaagcaggagcagctg

SEQ ID NO: 6884005 - DNA, 17 bp, Homo sapiens
cactgcgccactgctcc

SEQ ID NO: 6884006 - DNA, 14 bp, Homo sapiens
caattgccctgcca

SEQ ID NO: 6884007 - DNA, 20 bp, Homo sapiens
tatatttttttctgaaattt

SEQ ID NO: 6884008 - DNA, 21 bp, Homo sapiens
ctaacagccctcctctgcact

SEQ ID NO: 6884009 - DNA, 13 bp, Homo sapiens
attaaagtgccca

SEQ ID NO: 6884010 - DNA, 17 bp, Homo sapiens
cacacagagattctgga

SEQ ID NO: 6884011 - DNA, 21 bp, Homo sapiens
tggctcactgcaacctccgcc

SEQ ID NO: 6884012 - DNA, 19 bp, Homo sapiens
cctgtccacacccagctca

SEQ ID NO: 6884013 - DNA, 15 bp, Homo sapiens
caaaaaaccccagct

SEQ ID NO: 6884014 - DNA, 19 bp, Homo sapiens
cgtgtagcgtcctgaggaa

SEQ ID NO: 6884015 - DNA, 15 bp, Homo sapiens
tcactaaactttatt

SEQ ID NO: 6884016 - DNA, 14 bp, Homo sapiens
cagactccaggccc

SEQ ID NO: 6884017 - DNA, 14 bp, Homo sapiens
atataaactgtgag

SEQ ID NO: 6884018 - DNA, 13 bp, Homo sapiens
tgtaagttactga

SEQ ID NO: 6884019 - DNA, 14 bp, Homo sapiens
ttgtttttactgta

SEQ ID NO: 6884020 - DNA, 14 bp, Homo sapiens
tgccgggcctgatt

SEQ ID NO: 6884021 - DNA, 14 bp, Homo sapiens
ccagtgcagccact

SEQ ID NO: 6884022 - DNA, 18 bp, Homo sapiens
cattctggcactttaatg

SEQ ID NO: 6884023 - DNA, 12 bp, Homo sapiens
gccactgcctct

SEQ ID NO: 6884024 - DNA, 14 bp, Homo sapiens
ttcattttgtgtaa

SEQ ID NO: 6884025 - DNA, 22 bp, Homo sapiens
gtaggctgtattttcttttata

SEQ ID NO: 6884026 - DNA, 21 bp, Homo sapiens
actccttgtcaacaaagtgct

SEQ ID NO: 6884027 - DNA, 23 bp, Homo sapiens
cagtggccccatccagcatgtgt

SEQ ID NO: 6884028 - DNA, 21 bp, Homo sapiens
ctctagctcagacatctacta

SEQ ID NO: 6884029 - DNA, 18 bp, Homo sapiens
ccatgcccctcccctccc

SEQ ID NO: 6884030 - DNA, 18 bp, Homo sapiens
aattaccagtaaagtgta

SEQ ID NO: 6884031 - DNA, 22 bp, Homo sapiens
ctcagctgcacattcctggccc

SEQ ID NO: 6884032 - DNA, 18 bp, Homo sapiens
ccctgctgctgcctgcct

SEQ ID NO: 6884033 - DNA, 18 bp, Homo sapiens
cagaaatgaccacgtgaa

SEQ ID NO: 6884034 - DNA, 12 bp, Homo sapiens
cacctctgtgcc

SEQ ID NO: 6884035 - DNA, 17 bp, Homo sapiens
gcattttgggttgttta

SEQ ID NO: 6884036 - DNA, 13 bp, Homo sapiens
ctccattctgctt

SEQ ID NO: 6884037 - DNA, 18 bp, Homo sapiens
cgtcttttttctcttccc

SEQ ID NO: 6884038 - DNA, 17 bp, Homo sapiens
cccaggggactgttcct

SEQ ID NO: 6884039 - DNA, 15 bp, Homo sapiens
caagaggctccctcc

SEQ ID NO: 6884040 - DNA, 16 bp, Homo sapiens
ggctgctcatcaccca

SEQ ID NO: 6884041 - DNA, 16 bp, Homo sapiens
caaaagcttcgtgcca

SEQ ID NO: 6884042 - DNA, 14 bp, Homo sapiens
ctgaggactggaga

SEQ ID NO: 6884043 - DNA, 23 bp, Homo sapiens
caagggtatccaagttggactgg

SEQ ID NO: 6884044 - DNA, 12 bp, Homo sapiens
cacttgtaaata

SEQ ID NO: 6884045 - DNA, 17 bp, Homo sapiens
cttctgtcctggtgtca

SEQ ID NO: 6884046 - DNA, 16 bp, Homo sapiens
gatttacgactgaaga

SEQ ID NO: 6884047 - DNA, 22 bp, Homo sapiens
gcagttacagctctgtagttta

SEQ ID NO: 6884048 - DNA, 16 bp, Homo sapiens
cccagcccttctgcct

SEQ ID NO: 6884049 - DNA, 14 bp, Homo sapiens
tgagctgagccagg

SEQ ID NO: 6884050 - DNA, 20 bp, Homo sapiens
caatggaagaagaaaggact

SEQ ID NO: 6884051 - DNA, 22 bp, Homo sapiens
ctgccgtgccgcctgcactcct

SEQ ID NO: 6884052 - DNA, 16 bp, Homo sapiens
cttctggtactctcct

SEQ ID NO: 6884053 - DNA, 15 bp, Homo sapiens
aggagcaaagcctgt

SEQ ID NO: 6884054 - DNA, 19 bp, Homo sapiens
agctcccaggacgcaggga

SEQ ID NO: 6884055 - DNA, 22 bp, Homo sapiens
agaaaggcaaagtacattgtaa

SEQ ID NO: 6884056 - DNA, 15 bp, Homo sapiens
cctaggccagctcct

SEQ ID NO: 6884057 - DNA, 18 bp, Homo sapiens
ctaatgccttactcttct

SEQ ID NO: 6884058 - DNA, 15 bp, Homo sapiens
gaaaaaaattattca

SEQ ID NO: 6884059 - DNA, 17 bp, Homo sapiens
cacagggacttgaagtt

SEQ ID NO: 6884060 - DNA, 21 bp, Homo sapiens
tgactgatcctgaacaagaaa

SEQ ID NO: 6884061 - DNA, 14 bp, Homo sapiens
ctcccgcttgctct

SEQ ID NO: 6884062 - DNA, 18 bp, Homo sapiens
aaaggattttaccaaagc

SEQ ID NO: 6884063 - DNA, 17 bp, Homo sapiens
acatagactgaagattt

SEQ ID NO: 6884064 - DNA, 16 bp, Homo sapiens
caggtgggcagacagt

SEQ ID NO: 6884065 - DNA, 16 bp, Homo sapiens
cctccactccctgtct

SEQ ID NO: 6884066 - DNA, 23 bp, Homo sapiens
aagtgcttagaggttctgcctct

SEQ ID NO: 6884067 - DNA, 17 bp, Homo sapiens
ttgtacagtttgctgta

SEQ ID NO: 6884068 - DNA, 16 bp, Homo sapiens
ctatttatctgtctga

SEQ ID NO: 6884069 - DNA, 13 bp, Homo sapiens
ctgtctctgcatc

SEQ ID NO: 6884070 - DNA, 22 bp, Homo sapiens
cttccatgtgcctttctttgcc

SEQ ID NO: 6884071 - DNA, 16 bp, Homo sapiens
cactccaggtggaaca

SEQ ID NO: 6884072 - DNA, 22 bp, Homo sapiens
ccagctcagtcccacagcccct

SEQ ID NO: 6884073 - DNA, 22 bp, Homo sapiens
ctcaggcctgtgcccactccct

SEQ ID NO: 6884074 - DNA, 22 bp, Homo sapiens
ctagagagggaggcaagccctg

SEQ ID NO: 6884075 - DNA, 18 bp, Homo sapiens
gcccctggccctgcctca

SEQ ID NO: 6884076 - DNA, 17 bp, Homo sapiens
ctcttcctgcccctctt

SEQ ID NO: 6884077 - DNA, 21 bp, Homo sapiens
cactgtggaaggcctccctct

SEQ ID NO: 6884078 - DNA, 18 bp, Homo sapiens
cccttcccctcccctcct

SEQ ID NO: 6884079 - DNA, 14 bp, Homo sapiens
caccattctttctt

SEQ ID NO: 6884080 - DNA, 16 bp, Homo sapiens
aaatataaactgtgag

SEQ ID NO: 6884081 - DNA, 14 bp, Homo sapiens
tcctctcttcctct

SEQ ID NO: 6884082 - DNA, 14 bp, Homo sapiens
tctggccctgtgta

SEQ ID NO: 6884083 - DNA, 15 bp, Homo sapiens
tcctgagcactgcca

SEQ ID NO: 6884084 - DNA, 23 bp, Homo sapiens
aactctaagcagaagactctcca

SEQ ID NO: 6884085 - DNA, 21 bp, Homo sapiens
gtctcactatgttgcccaggc

SEQ ID NO: 6884086 - DNA, 12 bp, Homo sapiens
agctgctggcca

SEQ ID NO: 6884087 - DNA, 15 bp, Homo sapiens
acttggagagagatt

SEQ ID NO: 6884088 - DNA, 16 bp, Homo sapiens
agccaacccctgtgga

SEQ ID NO: 6884089 - DNA, 21 bp, Homo sapiens
ccttccccatttcctcttcct

SEQ ID NO: 6884090 - DNA, 23 bp, Homo sapiens
ctccaagagaacgccctcatgct

SEQ ID NO: 6884091 - DNA, 15 bp, Homo sapiens
ggagctccagcctga

SEQ ID NO: 6884092 - DNA, 14 bp, Homo sapiens
ccagactctgtctc

SEQ ID NO: 6884093 - DNA, 17 bp, Homo sapiens
aaagacaatcactgcca

SEQ ID NO: 6884094 - DNA, 17 bp, Homo sapiens
tgccacgcgctctgcat

SEQ ID NO: 6884095 - DNA, 14 bp, Homo sapiens
catgcatcctcccc

SEQ ID NO: 6884096 - DNA, 18 bp, Homo sapiens
atatttttggcattcctc

SEQ ID NO: 6884097 - DNA, 18 bp, Homo sapiens
ttgttccttcacatttaa

SEQ ID NO: 6884098 - DNA, 12 bp, Homo sapiens
atactgtactga

SEQ ID NO: 6884099 - DNA, 17 bp, Homo sapiens
tataaaaaatatatgta

SEQ ID NO: 6884100 - DNA, 15 bp, Homo sapiens
tcccaagctggctgg

SEQ ID NO: 6884101 - DNA, 20 bp, Homo sapiens
cccttctcccctccccgcct

SEQ ID NO: 6884102 - DNA, 16 bp, Homo sapiens
cgagtcctcaggtaca

SEQ ID NO: 6884103 - DNA, 22 bp, Homo sapiens
tgtgtgagccagagggagctgt

SEQ ID NO: 6884104 - DNA, 22 bp, Homo sapiens
gggcaggcctttttgagccaat

SEQ ID NO: 6884105 - DNA, 18 bp, Homo sapiens
cccataataaccctgcca

SEQ ID NO: 6884106 - DNA, 15 bp, Homo sapiens
tacatgacactgaaa

SEQ ID NO: 6884107 - DNA, 19 bp, Homo sapiens
ttccatgggcccgctgcct

SEQ ID NO: 6884108 - DNA, 20 bp, Homo sapiens
tggcttccctaaactgcagc

SEQ ID NO: 6884109 - DNA, 23 bp, Homo sapiens
tcacaaggcccaggagacctcca

SEQ ID NO: 6884110 - DNA, 22 bp, Homo sapiens
catcagtgactgaattctgcct

SEQ ID NO: 6884111 - DNA, 20 bp, Homo sapiens
caggcagaagaatctttctt

SEQ ID NO: 6884112 - DNA, 19 bp, Homo sapiens
tcaatactctctgagtaca

SEQ ID NO: 6884113 - DNA, 20 bp, Homo sapiens
tggtcttgaagtcctggctt

SEQ ID NO: 6884114 - DNA, 13 bp, Homo sapiens
aactttcacttct

SEQ ID NO: 6884115 - DNA, 14 bp, Homo sapiens
ctgcactctagcct

SEQ ID NO: 6884116 - DNA, 18 bp, Homo sapiens
acatttgatatttttcca

SEQ ID NO: 6884117 - DNA, 17 bp, Homo sapiens
tactaatagagtactta

SEQ ID NO: 6884118 - DNA, 15 bp, Homo sapiens
cttctttgtgccttt

SEQ ID NO: 6884119 - DNA, 11 bp, Homo sapiens
tatcccttccg

SEQ ID NO: 6884120 - DNA, 17 bp, Homo sapiens
ctagccgacctcagcct

SEQ ID NO: 6884121 - DNA, 19 bp, Homo sapiens
catatgtttccccatctct

SEQ ID NO: 6884122 - DNA, 21 bp, Homo sapiens
acatccctgggcctgctgctg

SEQ ID NO: 6884123 - DNA, 15 bp, Homo sapiens
cattgaaactgtatt

SEQ ID NO: 6884124 - DNA, 17 bp, Homo sapiens
taataaaatgcaaatga

SEQ ID NO: 6884125 - DNA, 19 bp, Homo sapiens
atataaaaatatatatagt

SEQ ID NO: 6884126 - DNA, 23 bp, Homo sapiens
ctgagccctccttcttgccctga

SEQ ID NO: 6884127 - DNA, 21 bp, Homo sapiens
actgctttgattggttgtgcc

SEQ ID NO: 6884128 - DNA, 17 bp, Homo sapiens
atcccaggacaccacac

SEQ ID NO: 6884129 - DNA, 22 bp, Homo sapiens
aaactacattaggttgtgaatg

SEQ ID NO: 6884130 - DNA, 18 bp, Homo sapiens
actttcccacactgtgaa

SEQ ID NO: 6884131 - DNA, 14 bp, Homo sapiens
ctccgacgctgcct

SEQ ID NO: 6884132 - DNA, 19 bp, Homo sapiens
cagtgttgacatagccttt

SEQ ID NO: 6884133 - DNA, 13 bp, Homo sapiens
tttatgcatttca

SEQ ID NO: 6884134 - DNA, 21 bp, Homo sapiens
cttaaggtgaggcctgtctgt

SEQ ID NO: 6884135 - DNA, 18 bp, Homo sapiens
ttatgtccactgtgtata

SEQ ID NO: 6884136 - DNA, 21 bp, Homo sapiens
gccccaaaactctcctctgct

SEQ ID NO: 6884137 - DNA, 16 bp, Homo sapiens
ttgggttttcttccct

SEQ ID NO: 6884138 - DNA, 23 bp, Homo sapiens
aggcttagaccctcatgctgcca

SEQ ID NO: 6884139 - DNA, 21 bp, Homo sapiens
aaaatacttttactctgccta

SEQ ID NO: 6884140 - DNA, 23 bp, Homo sapiens
agcatttccaacaccacagacac

SEQ ID NO: 6884141 - DNA, 20 bp, Homo sapiens
aaatcaaaaggcactgtgaa

SEQ ID NO: 6884142 - DNA, 12 bp, Homo sapiens
tggtattctgtc

SEQ ID NO: 6884143 - DNA, 18 bp, Homo sapiens
caaagacatcagtctcca

SEQ ID NO: 6884144 - DNA, 14 bp, Homo sapiens
ctctgacctcctct

SEQ ID NO: 6884145 - DNA, 19 bp, Homo sapiens
ctgtcaaatgtttccttaa

SEQ ID NO: 6884146 - DNA, 19 bp, Homo sapiens
tactcttaggatatttgag

SEQ ID NO: 6884147 - DNA, 14 bp, Homo sapiens
cgcagacctggagc

SEQ ID NO: 6884148 - DNA, 13 bp, Homo sapiens
tctacccatctcc

SEQ ID NO: 6884149 - DNA, 16 bp, Homo sapiens
ttcctgggatgtttaa

SEQ ID NO: 6884150 - DNA, 23 bp, Homo sapiens
ccagagcaaaaatgtaaaaaaca

SEQ ID NO: 6884151 - DNA, 19 bp, Homo sapiens
ctaccacgggtctgccatg

SEQ ID NO: 6884152 - DNA, 15 bp, Homo sapiens
agttcacaaacagta

SEQ ID NO: 6884153 - DNA, 23 bp, Homo sapiens
tcattttgaaaatatgtactgta

SEQ ID NO: 6884154 - DNA, 23 bp, Homo sapiens
ccacacatcagtaatgtattcta

SEQ ID NO: 6884155 - DNA, 12 bp, Homo sapiens
cttacactgcct

SEQ ID NO: 6884156 - DNA, 15 bp, Homo sapiens
caaagacctacctcc

SEQ ID NO: 6884157 - DNA, 17 bp, Homo sapiens
ctcatccccacaatctg

SEQ ID NO: 6884158 - DNA, 14 bp, Homo sapiens
gtactatatctgtt

SEQ ID NO: 6884159 - DNA, 16 bp, Homo sapiens
ctggacacagctcttc

SEQ ID NO: 6884160 - DNA, 16 bp, Homo sapiens
aggatttcaagcctgc

SEQ ID NO: 6884161 - DNA, 17 bp, Homo sapiens
tgtgtacctgtggctgt

SEQ ID NO: 6884162 - DNA, 17 bp, Homo sapiens
ctgcagtaaatctttta

SEQ ID NO: 6884163 - DNA, 17 bp, Homo sapiens
tggccagcaccctctcc

SEQ ID NO: 6884164 - DNA, 18 bp, Homo sapiens
gccccgtgctcctctgcc

SEQ ID NO: 6884165 - DNA, 12 bp, Homo sapiens
ctcccccatcct

SEQ ID NO: 6884166 - DNA, 15 bp, Homo sapiens
cctgatctgcccatc

SEQ ID NO: 6884167 - DNA, 21 bp, Homo sapiens
tatcatgttagtaatacctct

SEQ ID NO: 6884168 - DNA, 20 bp, Homo sapiens
ttacatatctgtcccctgct

SEQ ID NO: 6884169 - DNA, 22 bp, Homo sapiens
atttccatccaaacctacctta

SEQ ID NO: 6884170 - DNA, 17 bp, Homo sapiens
atcctcctgtcttggcc

SEQ ID NO: 6884171 - DNA, 21 bp, Homo sapiens
tttcctttgtaatcactccca

SEQ ID NO: 6884172 - DNA, 18 bp, Homo sapiens
cccagttcatctctgctg

SEQ ID NO: 6884173 - DNA, 13 bp, Homo sapiens
ctcacctcctgct

SEQ ID NO: 6884174 - DNA, 20 bp, Homo sapiens
ctctgcctctaactccctcc

SEQ ID NO: 6884175 - DNA, 14 bp, Homo sapiens
cctcggctcctgct

SEQ ID NO: 6884176 - DNA, 11 bp, Homo sapiens
ctgcagtcaca

SEQ ID NO: 6884177 - DNA, 20 bp, Homo sapiens
cttgggaactccactctcct

SEQ ID NO: 6884178 - DNA, 22 bp, Homo sapiens
tgccgggctgagggcctgctgg

SEQ ID NO: 6884179 - DNA, 13 bp, Homo sapiens
agatgtggtgata

SEQ ID NO: 6884180 - DNA, 18 bp, Homo sapiens
gaggtcttttgacatgtg

SEQ ID NO: 6884181 - DNA, 20 bp, Homo sapiens
accctgtcacccacagaccg

SEQ ID NO: 6884182 - DNA, 14 bp, Homo sapiens
caacctcaccaaac

SEQ ID NO: 6884183 - DNA, 17 bp, Homo sapiens
actgtaggtgttatgta

SEQ ID NO: 6884184 - DNA, 13 bp, Homo sapiens
acctccctcctca

SEQ ID NO: 6884185 - DNA, 15 bp, Homo sapiens
tcagaacctcttccc

SEQ ID NO: 6884186 - DNA, 21 bp, Homo sapiens
catgcttctcatcttgtgaaa

SEQ ID NO: 6884187 - DNA, 15 bp, Homo sapiens
gtattgctgctgtgc

SEQ ID NO: 6884188 - DNA, 14 bp, Homo sapiens
acgtctcctgctgc

SEQ ID NO: 6884189 - DNA, 13 bp, Homo sapiens
taccccctcatcc

SEQ ID NO: 6884190 - DNA, 16 bp, Homo sapiens
cacatgtgccctgcct

SEQ ID NO: 6884191 - DNA, 13 bp, Homo sapiens
acctccttctgca

SEQ ID NO: 6884192 - DNA, 12 bp, Homo sapiens
attatttgctaa

SEQ ID NO: 6884193 - DNA, 18 bp, Homo sapiens
catattgcaggagacatt

SEQ ID NO: 6884194 - DNA, 16 bp, Homo sapiens
cagctgctctaagccc

SEQ ID NO: 6884195 - DNA, 21 bp, Homo sapiens
ggaccaaagccacctgctgcg

SEQ ID NO: 6884196 - DNA, 20 bp, Homo sapiens
tcacagttttggttgcttta

SEQ ID NO: 6884197 - DNA, 14 bp, Homo sapiens
agacctctcccacc

SEQ ID NO: 6884198 - DNA, 20 bp, Homo sapiens
aaattggcatggaaatttaa

SEQ ID NO: 6884199 - DNA, 17 bp, Homo sapiens
accccttttcagcttct

SEQ ID NO: 6884200 - DNA, 13 bp, Homo sapiens
atattttaatgta

SEQ ID NO: 6884201 - DNA, 18 bp, Homo sapiens
aactggagggtgagagga

SEQ ID NO: 6884202 - DNA, 15 bp, Homo sapiens
gcccagctgtagcca

SEQ ID NO: 6884203 - DNA, 18 bp, Homo sapiens
caaggcctctctctgcct

SEQ ID NO: 6884204 - DNA, 13 bp, Homo sapiens
tgattctccctgg

SEQ ID NO: 6884205 - DNA, 19 bp, Homo sapiens
aggctcaagaggcccaggg

SEQ ID NO: 6884206 - DNA, 13 bp, Homo sapiens
gcctccctggtga

SEQ ID NO: 6884207 - DNA, 20 bp, Homo sapiens
cagtccacaaagcattttca

SEQ ID NO: 6884208 - DNA, 23 bp, Homo sapiens
tcaggcacgctgcctcctggtaa

SEQ ID NO: 6884209 - DNA, 16 bp, Homo sapiens
catgccccctcgtgcc

SEQ ID NO: 6884210 - DNA, 23 bp, Homo sapiens
ctttaaaaaagactgaacatgtt

SEQ ID NO: 6884211 - DNA, 16 bp, Homo sapiens
gcatcccagcttgccc

SEQ ID NO: 6884212 - DNA, 23 bp, Homo sapiens
ccttttcttttctaccctagcca

SEQ ID NO: 6884213 - DNA, 17 bp, Homo sapiens
gaagtctgtggactgca

SEQ ID NO: 6884214 - DNA, 19 bp, Homo sapiens
ccatttctgaactgttaca

SEQ ID NO: 6884215 - DNA, 13 bp, Homo sapiens
ctttccccattcc

SEQ ID NO: 6884216 - DNA, 13 bp, Homo sapiens
accccgcctgcct

SEQ ID NO: 6884217 - DNA, 16 bp, Homo sapiens
ccagctgccccagcca

SEQ ID NO: 6884218 - DNA, 21 bp, Homo sapiens
caatgaataaaaactcaagga

SEQ ID NO: 6884219 - DNA, 23 bp, Homo sapiens
ctcagcctgttccttcctgcaga

SEQ ID NO: 6884220 - DNA, 13 bp, Homo sapiens
ggaccctgtgtgg

SEQ ID NO: 6884221 - DNA, 14 bp, Homo sapiens
cactccagtgctca

SEQ ID NO: 6884222 - DNA, 18 bp, Homo sapiens
acactgaaattgcctgaa

SEQ ID NO: 6884223 - DNA, 18 bp, Homo sapiens
cctgcccctccccagccc

SEQ ID NO: 6884224 - DNA, 19 bp, Homo sapiens
cagtatccaaaaatagccc

SEQ ID NO: 6884225 - DNA, 18 bp, Homo sapiens
cgcgtcctttcctctcct

SEQ ID NO: 6884226 - DNA, 21 bp, Homo sapiens
aagaatttaatggactgtgaa

SEQ ID NO: 6884227 - DNA, 19 bp, Homo sapiens
tacaaaatgattgtctttt

SEQ ID NO: 6884228 - DNA, 20 bp, Homo sapiens
tggtcaaggccacctctgcc

SEQ ID NO: 6884229 - DNA, 19 bp, Homo sapiens
cagcattccagctctgccc

SEQ ID NO: 6884230 - DNA, 22 bp, Homo sapiens
gcaaacgtttctcaaatctgct

SEQ ID NO: 6884231 - DNA, 13 bp, Homo sapiens
ctgtccttgccct

SEQ ID NO: 6884232 - DNA, 21 bp, Homo sapiens
aatactatttaagatgtgaaa

SEQ ID NO: 6884233 - DNA, 16 bp, Homo sapiens
tttagagaagccataa

SEQ ID NO: 6884234 - DNA, 11 bp, Homo sapiens
ctctggctgcc

SEQ ID NO: 6884235 - DNA, 21 bp, Homo sapiens
ctctttcaattgcagatgcca

SEQ ID NO: 6884236 - DNA, 15 bp, Homo sapiens
tgcaagtactgctgt

SEQ ID NO: 6884237 - DNA, 16 bp, Homo sapiens
atttgcaccctccgcc

SEQ ID NO: 6884238 - DNA, 18 bp, Homo sapiens
gcctcttggacctctgct

SEQ ID NO: 6884239 - DNA, 20 bp, Homo sapiens
gcacaccaatcttactttgt

SEQ ID NO: 6884240 - DNA, 13 bp, Homo sapiens
cctgcctcagcct

SEQ ID NO: 6884241 - DNA, 16 bp, Homo sapiens
tctgcagactggcagt

SEQ ID NO: 6884242 - DNA, 22 bp, Homo sapiens
cctgcgctcctctgcagcctga

SEQ ID NO: 6884243 - DNA, 20 bp, Homo sapiens
gaaaaatttctggcaaatat

SEQ ID NO: 6884244 - DNA, 14 bp, Homo sapiens
gaataaaaggctgg

SEQ ID NO: 6884245 - DNA, 17 bp, Homo sapiens
acttcccgtagctgcca

SEQ ID NO: 6884246 - DNA, 19 bp, Homo sapiens
tccatccctctcctctgcc

SEQ ID NO: 6884247 - DNA, 20 bp, Homo sapiens
agcctcccgagtagctggga

SEQ ID NO: 6884248 - DNA, 17 bp, Homo sapiens
gattttggctcactgca

SEQ ID NO: 6884249 - DNA, 23 bp, Homo sapiens
taaagctggacaagaagctgcta

SEQ ID NO: 6884250 - DNA, 20 bp, Homo sapiens
ctgtaggaaggtactgtatg

SEQ ID NO: 6884251 - DNA, 20 bp, Homo sapiens
caacaggcctcagggctcct

SEQ ID NO: 6884252 - DNA, 17 bp, Homo sapiens
ctcagcccgcttggcca

SEQ ID NO: 6884253 - DNA, 17 bp, Homo sapiens
caaatttcattgcactt

SEQ ID NO: 6884254 - DNA, 12 bp, Homo sapiens
aaccctgtgctg

SEQ ID NO: 6884255 - DNA, 14 bp, Homo sapiens
gcattacattatta

SEQ ID NO: 6884256 - DNA, 15 bp, Homo sapiens
ccctcctacccctcc

SEQ ID NO: 6884257 - DNA, 19 bp, Homo sapiens
ctcagagcctgacctgaga

SEQ ID NO: 6884258 - DNA, 12 bp, Homo sapiens
ctcagcagccag

SEQ ID NO: 6884259 - DNA, 14 bp, Homo sapiens
ccaatcagcactga

SEQ ID NO: 6884260 - DNA, 15 bp, Homo sapiens
agtaaactattctat

SEQ ID NO: 6884261 - DNA, 12 bp, Homo sapiens
ctgccttggccc

SEQ ID NO: 6884262 - DNA, 16 bp, Homo sapiens
caccgcagcctctgcc

SEQ ID NO: 6884263 - DNA, 14 bp, Homo sapiens
ctccactcactgct

SEQ ID NO: 6884264 - DNA, 19 bp, Homo sapiens
aggtagcccagcactgtga

SEQ ID NO: 6884265 - DNA, 12 bp, Homo sapiens
ctgtcactgccg

SEQ ID NO: 6884266 - DNA, 18 bp, Homo sapiens
gaatgccatttagaatct

SEQ ID NO: 6884267 - DNA, 13 bp, Homo sapiens
atgcaataactct

SEQ ID NO: 6884268 - DNA, 17 bp, Homo sapiens
taagggaacaagttgag

SEQ ID NO: 6884269 - DNA, 22 bp, Homo sapiens
ctttcctgagctgtcgctgcct

SEQ ID NO: 6884270 - DNA, 10 bp, Homo sapiens
agcccagaga

SEQ ID NO: 6884271 - DNA, 21 bp, Homo sapiens
ctttggacagaagcagctctt

SEQ ID NO: 6884272 - DNA, 17 bp, Homo sapiens
caatgcttgatgttaca

SEQ ID NO: 6884273 - DNA, 20 bp, Homo sapiens
tggccatatttacctcagcc

SEQ ID NO: 6884274 - DNA, 11 bp, Homo sapiens
tctctcttcct

SEQ ID NO: 6884275 - DNA, 14 bp, Homo sapiens
cgccctctgtgcct

SEQ ID NO: 6884276 - DNA, 20 bp, Homo sapiens
caccaagtaaatctatctct

SEQ ID NO: 6884277 - DNA, 19 bp, Homo sapiens
ccctgagcagtctacttct

SEQ ID NO: 6884278 - DNA, 15 bp, Homo sapiens
ctccagaagctgctc

SEQ ID NO: 6884279 - DNA, 20 bp, Homo sapiens
tctgtaggttgcacactttg

SEQ ID NO: 6884280 - DNA, 20 bp, Homo sapiens
tttgggggtgggtctggccg

SEQ ID NO: 6884281 - DNA, 21 bp, Homo sapiens
ctccaaatctcttgcttgtca

SEQ ID NO: 6884282 - DNA, 18 bp, Homo sapiens
acattagttctatttcta

SEQ ID NO: 6884283 - DNA, 11 bp, Homo sapiens
agagtgaaata

SEQ ID NO: 6884284 - DNA, 23 bp, Homo sapiens
cagcgggagtctcctcactgcca

SEQ ID NO: 6884285 - DNA, 23 bp, Homo sapiens
ccctcccccacgtctctctgcct

SEQ ID NO: 6884286 - DNA, 23 bp, Homo sapiens
ctccatcacccctggtggctgca

SEQ ID NO: 6884287 - DNA, 21 bp, Homo sapiens
cactgccaggggttcttgagc

SEQ ID NO: 6884288 - DNA, 19 bp, Homo sapiens
cccaactgacttctgctag

SEQ ID NO: 6884289 - DNA, 16 bp, Homo sapiens
tgatataaattctgtg

SEQ ID NO: 6884290 - DNA, 16 bp, Homo sapiens
ctggttccttccttag

SEQ ID NO: 6884291 - DNA, 16 bp, Homo sapiens
ggttttcagagaatta

SEQ ID NO: 6884292 - DNA, 17 bp, Homo sapiens
ccttcataccctctacc

SEQ ID NO: 6884293 - DNA, 18 bp, Homo sapiens
cattttctagatacaata

SEQ ID NO: 6884294 - DNA, 15 bp, Homo sapiens
cagcatgtgctcagc

SEQ ID NO: 6884295 - DNA, 20 bp, Homo sapiens
ttcccttagcctctcccacc

SEQ ID NO: 6884296 - DNA, 17 bp, Homo sapiens
catcttgctctgctgac

SEQ ID NO: 6884297 - DNA, 17 bp, Homo sapiens
aaaggaaaccaaaggaa

SEQ ID NO: 6884298 - DNA, 11 bp, Homo sapiens
acaccctgtga

SEQ ID NO: 6884299 - DNA, 24 bp, Homo sapiens
attgtaatgttactgatcatgcat

SEQ ID NO: 6884300 - DNA, 14 bp, Homo sapiens
tacttctccagcct

SEQ ID NO: 6884301 - DNA, 11 bp, Homo sapiens
agaaagcctga

SEQ ID NO: 6884302 - DNA, 19 bp, Homo sapiens
cattctccactcactgcat

SEQ ID NO: 6884303 - DNA, 16 bp, Homo sapiens
ccatcttcagtttctg

SEQ ID NO: 6884304 - DNA, 16 bp, Homo sapiens
ctggttttctggtggg

SEQ ID NO: 6884305 - DNA, 15 bp, Homo sapiens
tatttctcattgcct

SEQ ID NO: 6884306 - DNA, 19 bp, Homo sapiens
cctcggatgaccatactca

SEQ ID NO: 6884307 - DNA, 22 bp, Homo sapiens
aatttttatttttgctgagact

SEQ ID NO: 6884308 - DNA, 14 bp, Homo sapiens
actatctgtattta

SEQ ID NO: 6884309 - DNA, 20 bp, Homo sapiens
atatgactcacatgatgcat

SEQ ID NO: 6884310 - DNA, 18 bp, Homo sapiens
cctttcacccctcttccc

SEQ ID NO: 6884311 - DNA, 15 bp, Homo sapiens
ttaagacagtgtaca

SEQ ID NO: 6884312 - DNA, 13 bp, Homo sapiens
ccagaatccataa

SEQ ID NO: 6884313 - DNA, 19 bp, Homo sapiens
cattggagctgactgttct

SEQ ID NO: 6884314 - DNA, 14 bp, Homo sapiens
cttgctctgtcccc

SEQ ID NO: 6884315 - DNA, 19 bp, Homo sapiens
attactgtgagaactgtga

SEQ ID NO: 6884316 - DNA, 18 bp, Homo sapiens
accgaggacagcctgcct

SEQ ID NO: 6884317 - DNA, 19 bp, Homo sapiens
tccctcctgggatctgctc

SEQ ID NO: 6884318 - DNA, 14 bp, Homo sapiens
cctgttcagctcca

SEQ ID NO: 6884319 - DNA, 20 bp, Homo sapiens
ctcctccctcctcactccct

SEQ ID NO: 6884320 - DNA, 19 bp, Homo sapiens
cctttacaaccatacttta

SEQ ID NO: 6884321 - DNA, 19 bp, Homo sapiens
tcctgctcaccacctgcct

SEQ ID NO: 6884322 - DNA, 22 bp, Homo sapiens
ccatattgtttgatctacttca

SEQ ID NO: 6884323 - DNA, 15 bp, Homo sapiens
ctgggcccttgtgct

SEQ ID NO: 6884324 - DNA, 21 bp, Homo sapiens
cttgaggaggggcacctgcca

SEQ ID NO: 6884325 - DNA, 16 bp, Homo sapiens
cagctgcctctgctcc

SEQ ID NO: 6884326 - DNA, 18 bp, Homo sapiens
ctccagggtcccctgcca

SEQ ID NO: 6884327 - DNA, 20 bp, Homo sapiens
ctctcctgggcagctgcctc

SEQ ID NO: 6884328 - DNA, 20 bp, Homo sapiens
cctgctggtcacagcctcct

SEQ ID NO: 6884329 - DNA, 11 bp, Homo sapiens
cttccctgcct

SEQ ID NO: 6884330 - DNA, 21 bp, Homo sapiens
cttttcctcctccacccaccc

SEQ ID NO: 6884331 - DNA, 18 bp, Homo sapiens
gtatgtgaattgaagtca

SEQ ID NO: 6884332 - DNA, 16 bp, Homo sapiens
gcccttctgactgttt

SEQ ID NO: 6884333 - DNA, 18 bp, Homo sapiens
tccttcttactctcctct

SEQ ID NO: 6884334 - DNA, 14 bp, Homo sapiens
agctgcacattcct

SEQ ID NO: 6884335 - DNA, 14 bp, Homo sapiens
atgtgtcctcctgc

SEQ ID NO: 6884336 - DNA, 14 bp, Homo sapiens
ccagggctcagcct

SEQ ID NO: 6884337 - DNA, 23 bp, Homo sapiens
agtgctgccccttgcaagccata

SEQ ID NO: 6884338 - DNA, 20 bp, Homo sapiens
cactgggaggctccccttct

SEQ ID NO: 6884339 - DNA, 16 bp, Homo sapiens
gccagacttgcttcct

SEQ ID NO: 6884340 - DNA, 20 bp, Homo sapiens
atccctttacaatgtgaata

SEQ ID NO: 6884341 - DNA, 17 bp, Homo sapiens
cttgatcaacatctttt

SEQ ID NO: 6884342 - DNA, 14 bp, Homo sapiens
tcatgtacatttct

SEQ ID NO: 6884343 - DNA, 21 bp, Homo sapiens
cagtgaaaatgtaagctgttt

SEQ ID NO: 6884344 - DNA, 12 bp, Homo sapiens
tctctatttatg

SEQ ID NO: 6884345 - DNA, 19 bp, Homo sapiens
tcaccctcctagcctgctc

SEQ ID NO: 6884346 - DNA, 12 bp, Homo sapiens
ttaatattcttt

SEQ ID NO: 6884347 - DNA, 17 bp, Homo sapiens
tgcaaagacctacctcc

SEQ ID NO: 6884348 - DNA, 18 bp, Homo sapiens
ctcactgggctcactgca

SEQ ID NO: 6884349 - DNA, 15 bp, Homo sapiens
tacactgagtttcta

SEQ ID NO: 6884350 - DNA, 21 bp, Homo sapiens
tccacagcgagggcagctgct

SEQ ID NO: 6884351 - DNA, 19 bp, Homo sapiens
gctctaatgtttgcatata

SEQ ID NO: 6884352 - DNA, 14 bp, Homo sapiens
gtcttatgcttcca

SEQ ID NO: 6884353 - DNA, 15 bp, Homo sapiens
gacagagttcacagg

SEQ ID NO: 6884354 - DNA, 13 bp, Homo sapiens
gactgatgtcatc

SEQ ID NO: 6884355 - DNA, 17 bp, Homo sapiens
gccatcaccctcaccca

SEQ ID NO: 6884356 - DNA, 14 bp, Homo sapiens
tgtcaacatttgtt

SEQ ID NO: 6884357 - DNA, 12 bp, Homo sapiens
cggctctggagg

SEQ ID NO: 6884358 - DNA, 17 bp, Homo sapiens
cttccagggatttgcct

SEQ ID NO: 6884359 - DNA, 18 bp, Homo sapiens
tatacaagtaaattctgt

SEQ ID NO: 6884360 - DNA, 13 bp, Homo sapiens
cttccagctgctg

SEQ ID NO: 6884361 - DNA, 22 bp, Homo sapiens
actcctaatcaagagtctctcc

SEQ ID NO: 6884362 - DNA, 17 bp, Homo sapiens
ctctatgtctgccttcg

SEQ ID NO: 6884363 - DNA, 11 bp, Homo sapiens
agtcctctgcc

SEQ ID NO: 6884364 - DNA, 18 bp, Homo sapiens
aacgttttcttaaatgtt

SEQ ID NO: 6884365 - DNA, 19 bp, Homo sapiens
gtctttagaatcgctttcc

SEQ ID NO: 6884366 - DNA, 14 bp, Homo sapiens
agaagctccagtga

SEQ ID NO: 6884367 - DNA, 13 bp, Homo sapiens
agccacctgctgc

SEQ ID NO: 6884368 - DNA, 18 bp, Homo sapiens
atcatgagccgttgctaa

SEQ ID NO: 6884369 - DNA, 23 bp, Homo sapiens
catcccaaccaggcacctcttcc

SEQ ID NO: 6884370 - DNA, 19 bp, Homo sapiens
ccctgccctcccctgctcc

SEQ ID NO: 6884371 - DNA, 21 bp, Homo sapiens
aaagagattgtggtggtgcta

SEQ ID NO: 6884372 - DNA, 23 bp, Homo sapiens
tcaagaccaggctgcagcctcca

SEQ ID NO: 6884373 - DNA, 14 bp, Homo sapiens
gttcacacagccca

SEQ ID NO: 6884374 - DNA, 18 bp, Homo sapiens
cataaatatgcagtgata

SEQ ID NO: 6884375 - DNA, 17 bp, Homo sapiens
atcaatgtgacatttac

SEQ ID NO: 6884376 - DNA, 17 bp, Homo sapiens
agctgacagtcagctgt

SEQ ID NO: 6884377 - DNA, 23 bp, Homo sapiens
ggaaagggacccgaagcccaggc

SEQ ID NO: 6884378 - DNA, 14 bp, Homo sapiens
ccttcttccatccc

SEQ ID NO: 6884379 - DNA, 15 bp, Homo sapiens
cgcaagtgcctggga

SEQ ID NO: 6884380 - DNA, 20 bp, Homo sapiens
gagacaaacacctcccagga

SEQ ID NO: 6884381 - DNA, 23 bp, Homo sapiens
cctcccatgagactgccctgccc

SEQ ID NO: 6884382 - DNA, 14 bp, Homo sapiens
tgtgaactgtgtgt

SEQ ID NO: 6884383 - DNA, 13 bp, Homo sapiens
cctgctggcacct

SEQ ID NO: 6884384 - DNA, 16 bp, Homo sapiens
cttattgcttagtaaa

SEQ ID NO: 6884385 - DNA, 12 bp, Homo sapiens
aaattgtattga

SEQ ID NO: 6884386 - DNA, 19 bp, Homo sapiens
atattttatgaacattgta

SEQ ID NO: 6884387 - DNA, 13 bp, Homo sapiens
atcccctgcctcc

SEQ ID NO: 6884388 - DNA, 14 bp, Homo sapiens
ctgcgggagccaga

SEQ ID NO: 6884389 - DNA, 15 bp, Homo sapiens
cccgccaccctgtct

SEQ ID NO: 6884390 - DNA, 19 bp, Homo sapiens
tcagcgctcctcctgtgtg

SEQ ID NO: 6884391 - DNA, 12 bp, Homo sapiens
cttctctgaaca

SEQ ID NO: 6884392 - DNA, 17 bp, Homo sapiens
cttcctgctgagtccct

SEQ ID NO: 6884393 - DNA, 17 bp, Homo sapiens
tgaactaactgccatgt

SEQ ID NO: 6884394 - DNA, 21 bp, Homo sapiens
caaccagcccgacagtgccat

SEQ ID NO: 6884395 - DNA, 13 bp, Homo sapiens
cactgccctctcc

SEQ ID NO: 6884396 - DNA, 15 bp, Homo sapiens
gccagctatctgcct

SEQ ID NO: 6884397 - DNA, 16 bp, Homo sapiens
ctatcaaaacatatca

SEQ ID NO: 6884398 - DNA, 17 bp, Homo sapiens
ccctgaggtcactgcta

SEQ ID NO: 6884399 - DNA, 23 bp, Homo sapiens
tcagtttttattaatctactgta

SEQ ID NO: 6884400 - DNA, 21 bp, Homo sapiens
ccctctctgtttaccctccct

SEQ ID NO: 6884401 - DNA, 19 bp, Homo sapiens
cctgacctccgcccctgcc

SEQ ID NO: 6884402 - DNA, 17 bp, Homo sapiens
ctggaatgaagcatgta

SEQ ID NO: 6884403 - DNA, 19 bp, Homo sapiens
ccagggcccaccccagcct

SEQ ID NO: 6884404 - DNA, 14 bp, Homo sapiens
agctgagtcctggg

SEQ ID NO: 6884405 - DNA, 13 bp, Homo sapiens
acacagctcttca

SEQ ID NO: 6884406 - DNA, 14 bp, Homo sapiens
caagccagctgcct

SEQ ID NO: 6884407 - DNA, 15 bp, Homo sapiens
taaaacaagctgata

SEQ ID NO: 6884408 - DNA, 20 bp, Homo sapiens
agactaattaaaatctggaa

SEQ ID NO: 6884409 - DNA, 20 bp, Homo sapiens
tgccatgactgctcaggcct

SEQ ID NO: 6884410 - DNA, 16 bp, Homo sapiens
gaataaagctgtgagc

SEQ ID NO: 6884411 - DNA, 16 bp, Homo sapiens
atggctttgtcttgaa

SEQ ID NO: 6884412 - DNA, 14 bp, Homo sapiens
cttcggggcctcct

SEQ ID NO: 6884413 - DNA, 20 bp, Homo sapiens
cctcgacttgaccctttcct

SEQ ID NO: 6884414 - DNA, 19 bp, Homo sapiens
tataaatatatattctatt

SEQ ID NO: 6884415 - DNA, 21 bp, Homo sapiens
ctccacccatcctatcagcct

SEQ ID NO: 6884416 - DNA, 12 bp, Homo sapiens
accacctgccca

SEQ ID NO: 6884417 - DNA, 14 bp, Homo sapiens
cacgtgcacagctt

SEQ ID NO: 6884418 - DNA, 14 bp, Homo sapiens
ctccagacagacag

SEQ ID NO: 6884419 - DNA, 16 bp, Homo sapiens
ccattacctccatcca

SEQ ID NO: 6884420 - DNA, 17 bp, Homo sapiens
gcctttatatttcacag

SEQ ID NO: 6884421 - DNA, 15 bp, Homo sapiens
tagatgttgccatgt

SEQ ID NO: 6884422 - DNA, 13 bp, Homo sapiens
ctgagccttgaga

SEQ ID NO: 6884423 - DNA, 16 bp, Homo sapiens
ggggggcacagccaga

SEQ ID NO: 6884424 - DNA, 18 bp, Homo sapiens
tggccggggctgaagcca

SEQ ID NO: 6884425 - DNA, 17 bp, Homo sapiens
ccctcctctcctcgtcc

SEQ ID NO: 6884426 - DNA, 21 bp, Homo sapiens
agcccctgcagacgtctggcc

SEQ ID NO: 6884427 - DNA, 19 bp, Homo sapiens
tggctcctttgcctctgct

SEQ ID NO: 6884428 - DNA, 19 bp, Homo sapiens
cagccggggagctgagggg

SEQ ID NO: 6884429 - DNA, 18 bp, Homo sapiens
ccatatccttaccctcct

SEQ ID NO: 6884430 - DNA, 20 bp, Homo sapiens
acctcgtcctccccctgcca

SEQ ID NO: 6884431 - DNA, 22 bp, Homo sapiens
gccagatataactgtcttgttt

SEQ ID NO: 6884432 - DNA, 14 bp, Homo sapiens
acttaactgtttca

SEQ ID NO: 6884433 - DNA, 20 bp, Homo sapiens
ctaggtttaaaacagcctgg

SEQ ID NO: 6884434 - DNA, 11 bp, Homo sapiens
accctgtctca

SEQ ID NO: 6884435 - DNA, 11 bp, Homo sapiens
aaactaactca

SEQ ID NO: 6884436 - DNA, 18 bp, Homo sapiens
cacttctccccgcagccc

SEQ ID NO: 6884437 - DNA, 14 bp, Homo sapiens
actcagtttgtcag

SEQ ID NO: 6884438 - DNA, 23 bp, Homo sapiens
tacaataaaactaaatgtgtaca

SEQ ID NO: 6884439 - DNA, 14 bp, Homo sapiens
tgctgtgcctgcta

SEQ ID NO: 6884440 - DNA, 20 bp, Homo sapiens
ccctcagcctctcccctgcc

SEQ ID NO: 6884441 - DNA, 22 bp, Homo sapiens
gaaatgtcgatcaagagaatca

SEQ ID NO: 6884442 - DNA, 18 bp, Homo sapiens
agacctcatcaggatgaa

SEQ ID NO: 6884443 - DNA, 15 bp, Homo sapiens
tccttcctcttggct

SEQ ID NO: 6884444 - DNA, 15 bp, Homo sapiens
agcctgcctcaccca

SEQ ID NO: 6884445 - DNA, 19 bp, Homo sapiens
ttgtaataaagtatataat

SEQ ID NO: 6884446 - DNA, 13 bp, Homo sapiens
tgcctgtctctgt

SEQ ID NO: 6884447 - DNA, 23 bp, Homo sapiens
aaggcacacagagattctggatc

SEQ ID NO: 6884448 - DNA, 13 bp, Homo sapiens
tgccccacctgcc

SEQ ID NO: 6884449 - DNA, 14 bp, Homo sapiens
ataatgacttttaa

SEQ ID NO: 6884450 - DNA, 16 bp, Homo sapiens
caacttaaatcactga

SEQ ID NO: 6884451 - DNA, 14 bp, Homo sapiens
ataaagtattcttt

SEQ ID NO: 6884452 - DNA, 18 bp, Homo sapiens
gatagaatttggcccaga

SEQ ID NO: 6884453 - DNA, 16 bp, Homo sapiens
ctgccattctgtgcag

SEQ ID NO: 6884454 - DNA, 18 bp, Homo sapiens
atggtgcttggaggggga

SEQ ID NO: 6884455 - DNA, 13 bp, Homo sapiens
ctgctctgtcccc

SEQ ID NO: 6884456 - DNA, 13 bp, Homo sapiens
tgttccccctgcc

SEQ ID NO: 6884457 - DNA, 15 bp, Homo sapiens
ccctacctccctcct

SEQ ID NO: 6884458 - DNA, 22 bp, Homo sapiens
aaacatttgtaaaaatactgtt

SEQ ID NO: 6884459 - DNA, 22 bp, Homo sapiens
ctccatacccacaatctgagca

SEQ ID NO: 6884460 - DNA, 17 bp, Homo sapiens
gcctgctcagcagccag

SEQ ID NO: 6884461 - DNA, 16 bp, Homo sapiens
acccatgaaacagcag

SEQ ID NO: 6884462 - DNA, 21 bp, Homo sapiens
cttccatctagcagctggcct

SEQ ID NO: 6884463 - DNA, 20 bp, Homo sapiens
cttatgagcgtcactgccca

SEQ ID NO: 6884464 - DNA, 17 bp, Homo sapiens
catgcctggcccttgcc

SEQ ID NO: 6884465 - DNA, 13 bp, Homo sapiens
agcaataactcca

SEQ ID NO: 6884466 - DNA, 17 bp, Homo sapiens
cacgcctatgccctgcc

SEQ ID NO: 6884467 - DNA, 21 bp, Homo sapiens
gccacccacctccctgcctcc

SEQ ID NO: 6884468 - DNA, 14 bp, Homo sapiens
ctctgtctgtccgt

SEQ ID NO: 6884469 - DNA, 17 bp, Homo sapiens
gctgtgattactgcaat

SEQ ID NO: 6884470 - DNA, 17 bp, Homo sapiens
aaacatgtgcccctgcc

SEQ ID NO: 6884471 - DNA, 21 bp, Homo sapiens
cagattggctcacactgagaa

SEQ ID NO: 6884472 - DNA, 18 bp, Homo sapiens
acagtagcttcctagacc

SEQ ID NO: 6884473 - DNA, 13 bp, Homo sapiens
agccccaggccag

SEQ ID NO: 6884474 - DNA, 23 bp, Homo sapiens
acaaagcactggccttgcctcca

SEQ ID NO: 6884475 - DNA, 23 bp, Homo sapiens
ccatttctagaacatccctgcca

SEQ ID NO: 6884476 - DNA, 14 bp, Homo sapiens
aggaccctgctgac

SEQ ID NO: 6884477 - DNA, 22 bp, Homo sapiens
cagagacttggggaccagaggt

SEQ ID NO: 6884478 - DNA, 19 bp, Homo sapiens
cagctgccttcctcatccc

SEQ ID NO: 6884479 - DNA, 16 bp, Homo sapiens
ccaggttcccccagca

SEQ ID NO: 6884480 - DNA, 15 bp, Homo sapiens
gctgcctctgtggaa

SEQ ID NO: 6884481 - DNA, 15 bp, Homo sapiens
cttaaaggcctggaa

SEQ ID NO: 6884482 - DNA, 19 bp, Homo sapiens
ctgtcaccacatcttgtct

SEQ ID NO: 6884483 - DNA, 15 bp, Homo sapiens
ctcctgctctgctcg

SEQ ID NO: 6884484 - DNA, 17 bp, Homo sapiens
cttgccccactctgcct

SEQ ID NO: 6884485 - DNA, 17 bp, Homo sapiens
gtatacattgtcttgat

SEQ ID NO: 6884486 - DNA, 15 bp, Homo sapiens
cctgtggcaggcagc

SEQ ID NO: 6884487 - DNA, 19 bp, Homo sapiens
tcattgggctgttttctca

SEQ ID NO: 6884488 - DNA, 17 bp, Homo sapiens
cattccctctcctgccc

SEQ ID NO: 6884489 - DNA, 22 bp, Homo sapiens
ccagcacagtaggtcccggcca

SEQ ID NO: 6884490 - DNA, 14 bp, Homo sapiens
actccacatctgcc

SEQ ID NO: 6884491 - DNA, 20 bp, Homo sapiens
tgggccatactggcctcgcc

SEQ ID NO: 6884492 - DNA, 20 bp, Homo sapiens
ggtcccagcccctcctccct

SEQ ID NO: 6884493 - DNA, 18 bp, Homo sapiens
tcacaggactctgcctcc

SEQ ID NO: 6884494 - DNA, 16 bp, Homo sapiens
ccctcagcaccccttc

SEQ ID NO: 6884495 - DNA, 14 bp, Homo sapiens
atgtgactctggct

SEQ ID NO: 6884496 - DNA, 15 bp, Homo sapiens
caacactgctgtcca

SEQ ID NO: 6884497 - DNA, 19 bp, Homo sapiens
accgccatcctctgcctca

SEQ ID NO: 6884498 - DNA, 17 bp, Homo sapiens
tccttctttctcttccc

SEQ ID NO: 6884499 - DNA, 17 bp, Homo sapiens
agcagcaggctcaggca

SEQ ID NO: 6884500 - DNA, 11 bp, Homo sapiens
agacactggac

SEQ ID NO: 6884501 - DNA, 16 bp, Homo sapiens
cccacagttgtgttca

SEQ ID NO: 6884502 - DNA, 17 bp, Homo sapiens
actttgttaaatggtta

SEQ ID NO: 6884503 - DNA, 18 bp, Homo sapiens
ttccctcactcttcctca

SEQ ID NO: 6884504 - DNA, 16 bp, Homo sapiens
agggaaactgtgaatg

SEQ ID NO: 6884505 - DNA, 16 bp, Homo sapiens
cctttgaccttcccca

SEQ ID NO: 6884506 - DNA, 18 bp, Homo sapiens
aaacactccacagtgttt

SEQ ID NO: 6884507 - DNA, 22 bp, Homo sapiens
ctctgcagatagtgcctctgca

SEQ ID NO: 6884508 - DNA, 15 bp, Homo sapiens
aggtccctgctgcca

SEQ ID NO: 6884509 - DNA, 14 bp, Homo sapiens
agggtcgtctttgt

SEQ ID NO: 6884510 - DNA, 14 bp, Homo sapiens
cttcttcctgctgg

SEQ ID NO: 6884511 - DNA, 17 bp, Homo sapiens
cccttgccgccccgtgc

SEQ ID NO: 6884512 - DNA, 10 bp, Homo sapiens
ttccctgccc

SEQ ID NO: 6884513 - DNA, 21 bp, Homo sapiens
cccagtcctggcctggcttct

SEQ ID NO: 6884514 - DNA, 14 bp, Homo sapiens
cactttcattgcca

SEQ ID NO: 6884515 - DNA, 13 bp, Homo sapiens
ccacaccctgcct

SEQ ID NO: 6884516 - DNA, 16 bp, Homo sapiens
cttccctacccttcct

SEQ ID NO: 6884517 - DNA, 23 bp, Homo sapiens
ttctgagcccccttcctgtcccc

SEQ ID NO: 6884518 - DNA, 19 bp, Homo sapiens
actccaggccctcctctcc

SEQ ID NO: 6884519 - DNA, 13 bp, Homo sapiens
gtcctggctgctc

SEQ ID NO: 6884520 - DNA, 15 bp, Homo sapiens
tatggaccaaatgta

SEQ ID NO: 6884521 - DNA, 12 bp, Homo sapiens
ccatccccacca

SEQ ID NO: 6884522 - DNA, 23 bp, Homo sapiens
agtggcctggccaggagctcttc

SEQ ID NO: 6884523 - DNA, 17 bp, Homo sapiens
actgctgcaaagtgcaa

SEQ ID NO: 6884524 - DNA, 16 bp, Homo sapiens
cagcaatatgtaaata

SEQ ID NO: 6884525 - DNA, 16 bp, Homo sapiens
gcccggccacacccag

SEQ ID NO: 6884526 - DNA, 14 bp, Homo sapiens
cttcctgcctccca

SEQ ID NO: 6884527 - DNA, 14 bp, Homo sapiens
cttgaagggccaga

SEQ ID NO: 6884528 - DNA, 12 bp, Homo sapiens
agctacattcct

SEQ ID NO: 6884529 - DNA, 23 bp, Homo sapiens
gattccgcaccctgcctacgcca

SEQ ID NO: 6884530 - DNA, 14 bp, Homo sapiens
cctaagtactgtaa

SEQ ID NO: 6884531 - DNA, 21 bp, Homo sapiens
ttatagaataaaagctgtgga

SEQ ID NO: 6884532 - DNA, 23 bp, Homo sapiens
tgccaccccaccctccctggagt

SEQ ID NO: 6884533 - DNA, 14 bp, Homo sapiens
tgattctcctctcc

SEQ ID NO: 6884534 - DNA, 21 bp, Homo sapiens
atataaaggaccctgtttctg

SEQ ID NO: 6884535 - DNA, 19 bp, Homo sapiens
atatctctagtccctgtgt

SEQ ID NO: 6884536 - DNA, 21 bp, Homo sapiens
cactgccttcgcttcttgcct

SEQ ID NO: 6884537 - DNA, 19 bp, Homo sapiens
cgtttccaagcctgggcca

SEQ ID NO: 6884538 - DNA, 18 bp, Homo sapiens
ttctcccaggcctctgcc

SEQ ID NO: 6884539 - DNA, 17 bp, Homo sapiens
agagaagtgcccctgct

SEQ ID NO: 6884540 - DNA, 19 bp, Homo sapiens
ccttcccccatccctacca

SEQ ID NO: 6884541 - DNA, 16 bp, Homo sapiens
atctgacatctctgca

SEQ ID NO: 6884542 - DNA, 20 bp, Homo sapiens
cgtccctgagggcccttccc

SEQ ID NO: 6884543 - DNA, 15 bp, Homo sapiens
tctggtccctcttct

SEQ ID NO: 6884544 - DNA, 19 bp, Homo sapiens
tgctgccccttgcaagcca

SEQ ID NO: 6884545 - DNA, 15 bp, Homo sapiens
cgagacccccatcca

SEQ ID NO: 6884546 - DNA, 23 bp, Homo sapiens
ctgccggtgcacaggcctctgcc

SEQ ID NO: 6884547 - DNA, 21 bp, Homo sapiens
ccaggacaccacacccagcct

SEQ ID NO: 6884548 - DNA, 12 bp, Homo sapiens
caccctgctaca

SEQ ID NO: 6884549 - DNA, 19 bp, Homo sapiens
tcagggcagtatctctctg

SEQ ID NO: 6884550 - DNA, 12 bp, Homo sapiens
tgaccctctgcg

SEQ ID NO: 6884551 - DNA, 21 bp, Homo sapiens
acagtcctcacagcctctccc

SEQ ID NO: 6884552 - DNA, 11 bp, Homo sapiens
cctccccttcc

SEQ ID NO: 6884553 - DNA, 18 bp, Homo sapiens
tccaagttcttcacctct

SEQ ID NO: 6884554 - DNA, 13 bp, Homo sapiens
gtcttcactgcca

SEQ ID NO: 6884555 - DNA, 12 bp, Homo sapiens
gtgtttcttgct

SEQ ID NO: 6884556 - DNA, 19 bp, Homo sapiens
ccacctttactctgctcta

SEQ ID NO: 6884557 - DNA, 17 bp, Homo sapiens
gagttatcatgaatttt

SEQ ID NO: 6884558 - DNA, 21 bp, Homo sapiens
agaggtgccagcaactgaata

SEQ ID NO: 6884559 - DNA, 19 bp, Homo sapiens
tacccccgtggtctttgaa

SEQ ID NO: 6884560 - DNA, 17 bp, Homo sapiens
tgaaccgtcaatgtgaa

SEQ ID NO: 6884561 - DNA, 13 bp, Homo sapiens
ctgtacagtgtta

SEQ ID NO: 6884562 - DNA, 23 bp, Homo sapiens
cagaaagtggtgctcagttgtag

SEQ ID NO: 6884563 - DNA, 12 bp, Homo sapiens
tacatgtgtgta

SEQ ID NO: 6884564 - DNA, 15 bp, Homo sapiens
agctgggccctgcct

SEQ ID NO: 6884565 - DNA, 21 bp, Homo sapiens
tgcttccagtgaggctctgcc

SEQ ID NO: 6884566 - DNA, 18 bp, Homo sapiens
gttcttcgtaactttatg

SEQ ID NO: 6884567 - DNA, 16 bp, Homo sapiens
tccacccccagctcct

SEQ ID NO: 6884568 - DNA, 14 bp, Homo sapiens
acttgtctgcctcc

SEQ ID NO: 6884569 - DNA, 20 bp, Homo sapiens
cttcaggcctccctctctct

SEQ ID NO: 6884570 - DNA, 20 bp, Homo sapiens
caagccagcttcctgtgcag

SEQ ID NO: 6884571 - DNA, 22 bp, Homo sapiens
ctgcctccccttaaaggggaga

SEQ ID NO: 6884572 - DNA, 21 bp, Homo sapiens
atgcacacagcggctgcctcc

SEQ ID NO: 6884573 - DNA, 18 bp, Homo sapiens
gacagaggccccagcctc

SEQ ID NO: 6884574 - DNA, 12 bp, Homo sapiens
tccagacagtcg

SEQ ID NO: 6884575 - DNA, 18 bp, Homo sapiens
caaaatgtaactgttacc

SEQ ID NO: 6884576 - DNA, 18 bp, Homo sapiens
catgtcctgtcctggtcc

SEQ ID NO: 6884577 - DNA, 20 bp, Homo sapiens
atgcccctggccctgcctca

SEQ ID NO: 6884578 - DNA, 15 bp, Homo sapiens
cctgtcctcccaccc

SEQ ID NO: 6884579 - DNA, 21 bp, Homo sapiens
caaggtgaggtgaactccagg

SEQ ID NO: 6884580 - DNA, 11 bp, Homo sapiens
cctcttcctct

SEQ ID NO: 6884581 - DNA, 16 bp, Homo sapiens
aagtcaacctgcctga

SEQ ID NO: 6884582 - DNA, 14 bp, Homo sapiens
cacgtctctctgcc

SEQ ID NO: 6884583 - DNA, 15 bp, Homo sapiens
ctctggacactgcca

SEQ ID NO: 6884584 - DNA, 22 bp, Homo sapiens
ccttccagctccctcccctgct

SEQ ID NO: 6884585 - DNA, 13 bp, Homo sapiens
tcagccctgtgtc

SEQ ID NO: 6884586 - DNA, 15 bp, Homo sapiens
aagcaggacctggca

SEQ ID NO: 6884587 - DNA, 15 bp, Homo sapiens
tgcctgcactgggaa

SEQ ID NO: 6884588 - DNA, 20 bp, Homo sapiens
ccgagtgtggagctgcttcc

SEQ ID NO: 6884589 - DNA, 20 bp, Homo sapiens
ccctggctacttcccttcct

SEQ ID NO: 6884590 - DNA, 12 bp, Homo sapiens
agggcctctgcc

SEQ ID NO: 6884591 - DNA, 18 bp, Homo sapiens
ctttaagcagctcttgct

SEQ ID NO: 6884592 - DNA, 14 bp, Homo sapiens
catagagatattta

SEQ ID NO: 6884593 - DNA, 14 bp, Homo sapiens
atattactgattta

SEQ ID NO: 6884594 - DNA, 19 bp, Homo sapiens
aagcgcctggctgctgctt

SEQ ID NO: 6884595 - DNA, 20 bp, Homo sapiens
cttctccaacaagttgcctc

SEQ ID NO: 6884596 - DNA, 18 bp, Homo sapiens
gcatctttaattccttat

SEQ ID NO: 6884597 - DNA, 17 bp, Homo sapiens
gccctgaggctgtgagc

SEQ ID NO: 6884598 - DNA, 12 bp, Homo sapiens
cacttgtattga

SEQ ID NO: 6884599 - DNA, 13 bp, Homo sapiens
tataacaattgat

SEQ ID NO: 6884600 - DNA, 14 bp, Homo sapiens
ttgaaagacatcaa

SEQ ID NO: 6884601 - DNA, 19 bp, Homo sapiens
tcaagctcaccctgctcct

SEQ ID NO: 6884602 - DNA, 16 bp, Homo sapiens
aggctggcacaggaca

SEQ ID NO: 6884603 - DNA, 23 bp, Homo sapiens
agccagaaggggcacgcctgccc

SEQ ID NO: 6884604 - DNA, 11 bp, Homo sapiens
aaactgtctct

SEQ ID NO: 6884605 - DNA, 23 bp, Homo sapiens
ccctccacatttccccctagcct

SEQ ID NO: 6884606 - DNA, 21 bp, Homo sapiens
caggtctacccctcccggccc

SEQ ID NO: 6884607 - DNA, 17 bp, Homo sapiens
cacacgctgtctcttga

SEQ ID NO: 6884608 - DNA, 21 bp, Homo sapiens
tgaggccccagggctgtgggt

SEQ ID NO: 6884609 - DNA, 13 bp, Homo sapiens
aatcatgtttctt

SEQ ID NO: 6884610 - DNA, 14 bp, Homo sapiens
ttacaaattatgtt

SEQ ID NO: 6884611 - DNA, 21 bp, Homo sapiens
gctgacttcacttattagtct

SEQ ID NO: 6884612 - DNA, 12 bp, Homo sapiens
ctttccatctct

SEQ ID NO: 6884613 - DNA, 21 bp, Homo sapiens
agggcaccatcacaatacaga

SEQ ID NO: 6884614 - DNA, 18 bp, Homo sapiens
cccaagtagtctgctcac

SEQ ID NO: 6884615 - DNA, 16 bp, Homo sapiens
agccctactccctgca

SEQ ID NO: 6884616 - DNA, 15 bp, Homo sapiens
cccaccccgctgcct

SEQ ID NO: 6884617 - DNA, 16 bp, Homo sapiens
tggctgtgcctctgcc

SEQ ID NO: 6884618 - DNA, 16 bp, Homo sapiens
tttccctctcttgcct

SEQ ID NO: 6884619 - DNA, 13 bp, Homo sapiens
tcccgcagcctcg

SEQ ID NO: 6884620 - DNA, 18 bp, Homo sapiens
cacatttattctgctcac

SEQ ID NO: 6884621 - DNA, 15 bp, Homo sapiens
gagagcaccacgtga

SEQ ID NO: 6884622 - DNA, 23 bp, Homo sapiens
ctctgttgctggtcttctcagtt

SEQ ID NO: 6884623 - DNA, 20 bp, Homo sapiens
cagcttctggtactctccta

SEQ ID NO: 6884624 - DNA, 22 bp, Homo sapiens
cattatctgtactgaaagcaaa

SEQ ID NO: 6884625 - DNA, 19 bp, Homo sapiens
ctttttatcttgagtgtta

SEQ ID NO: 6884626 - DNA, 23 bp, Homo sapiens
ctttcattttgcctgagtgtatt

SEQ ID NO: 6884627 - DNA, 21 bp, Homo sapiens
gccctcccctcccctgctgca

SEQ ID NO: 6884628 - DNA, 22 bp, Homo sapiens
tcattttcatgtgtgtgagttt

SEQ ID NO: 6884629 - DNA, 21 bp, Homo sapiens
catattagaaaactttgttag

SEQ ID NO: 6884630 - DNA, 23 bp, Homo sapiens
caacggaagccccctcttcctcc

SEQ ID NO: 6884631 - DNA, 16 bp, Homo sapiens
tcatgcccctggctgg

SEQ ID NO: 6884632 - DNA, 18 bp, Homo sapiens
tccacccgtctctctgcc

SEQ ID NO: 6884633 - DNA, 17 bp, Homo sapiens
cctccacgccactgcct

SEQ ID NO: 6884634 - DNA, 14 bp, Homo sapiens
acagtgagactgta

SEQ ID NO: 6884635 - DNA, 20 bp, Homo sapiens
gttcccctgtcctgtgaatg

SEQ ID NO: 6884636 - DNA, 21 bp, Homo sapiens
tgtctctgagccccctgtgcc

SEQ ID NO: 6884637 - DNA, 17 bp, Homo sapiens
ccttcagtaccctctca

SEQ ID NO: 6884638 - DNA, 17 bp, Homo sapiens
atttggtcctgcctaaa

SEQ ID NO: 6884639 - DNA, 14 bp, Homo sapiens
tccacctccctgca

SEQ ID NO: 6884640 - DNA, 17 bp, Homo sapiens
ttctgcagcaactccca

SEQ ID NO: 6884641 - DNA, 16 bp, Homo sapiens
aggtttttctgtctca

SEQ ID NO: 6884642 - DNA, 19 bp, Homo sapiens
ctcgggcgagtcactgcct

SEQ ID NO: 6884643 - DNA, 16 bp, Homo sapiens
tggccatggcctctgc

SEQ ID NO: 6884644 - DNA, 18 bp, Homo sapiens
gaagagccaagagtccag

SEQ ID NO: 6884645 - DNA, 15 bp, Homo sapiens
ggcccagcctctgcc

SEQ ID NO: 6884646 - DNA, 11 bp, Homo sapiens
cacctcagcct

SEQ ID NO: 6884647 - DNA, 17 bp, Homo sapiens
cctcctcacctcatgcc

SEQ ID NO: 6884648 - DNA, 22 bp, Homo sapiens
agaacctgtctcctactttgaa

SEQ ID NO: 6884649 - DNA, 17 bp, Homo sapiens
ttaaataccagtacttg

SEQ ID NO: 6884650 - DNA, 15 bp, Homo sapiens
agttgcaacttaagt

SEQ ID NO: 6884651 - DNA, 13 bp, Homo sapiens
aatttgctattta

SEQ ID NO: 6884652 - DNA, 12 bp, Homo sapiens
ccagccccagca

SEQ ID NO: 6884653 - DNA, 17 bp, Homo sapiens
ctctgaagtcccttcct

SEQ ID NO: 6884654 - DNA, 23 bp, Homo sapiens
atcatctcctgccttcctcctgg

SEQ ID NO: 6884655 - DNA, 18 bp, Homo sapiens
attgtatctcattactta

SEQ ID NO: 6884656 - DNA, 20 bp, Homo sapiens
catctgtctcggctctgcat

SEQ ID NO: 6884657 - DNA, 15 bp, Homo sapiens
tgagatcaatgtgac

SEQ ID NO: 6884658 - DNA, 14 bp, Homo sapiens
cattagttgcacta

SEQ ID NO: 6884659 - DNA, 15 bp, Homo sapiens
cccatcagccctgct

SEQ ID NO: 6884660 - DNA, 19 bp, Homo sapiens
tagaatatttattacctct

SEQ ID NO: 6884661 - DNA, 16 bp, Homo sapiens
tgccctggctgctgcc

SEQ ID NO: 6884662 - DNA, 16 bp, Homo sapiens
tacaagtaatgaattt

SEQ ID NO: 6884663 - DNA, 14 bp, Homo sapiens
tgtaaattattgta

SEQ ID NO: 6884664 - DNA, 19 bp, Homo sapiens
cctttccctcaccccctcc

SEQ ID NO: 6884665 - DNA, 16 bp, Homo sapiens
gaaccaaacaccttca

SEQ ID NO: 6884666 - DNA, 14 bp, Homo sapiens
agttggcctctgcc

SEQ ID NO: 6884667 - DNA, 15 bp, Homo sapiens
gcttcctctgctgca

SEQ ID NO: 6884668 - DNA, 15 bp, Homo sapiens
caccccacctcttcc

SEQ ID NO: 6884669 - DNA, 16 bp, Homo sapiens
cactaattttgtttta

SEQ ID NO: 6884670 - DNA, 15 bp, Homo sapiens
catcctgctcttcca

SEQ ID NO: 6884671 - DNA, 13 bp, Homo sapiens
acttgacattcct

SEQ ID NO: 6884672 - DNA, 18 bp, Homo sapiens
ccttccatatccctgccc

SEQ ID NO: 6884673 - DNA, 13 bp, Homo sapiens
ttcataatttgtt

SEQ ID NO: 6884674 - DNA, 12 bp, Homo sapiens
ttcttctttctt

SEQ ID NO: 6884675 - DNA, 17 bp, Homo sapiens
gacctatgtctgcctta

SEQ ID NO: 6884676 - DNA, 16 bp, Homo sapiens
attgtgattacgtgta

SEQ ID NO: 6884677 - DNA, 14 bp, Homo sapiens
ccttccaccctgcc

SEQ ID NO: 6884678 - DNA, 13 bp, Homo sapiens
tcctgcctcctca

SEQ ID NO: 6884679 - DNA, 23 bp, Homo sapiens
ctcggcattcacacacagcctgg

SEQ ID NO: 6884680 - DNA, 21 bp, Homo sapiens
caacacccccgacggcctcca

SEQ ID NO: 6884681 - DNA, 21 bp, Homo sapiens
ctagttccctctgctcagcca

SEQ ID NO: 6884682 - DNA, 24 bp, Homo sapiens
cctgccccaactctcccctgacct

SEQ ID NO: 6884683 - DNA, 18 bp, Homo sapiens
catctcccttccacctca

SEQ ID NO: 6884684 - DNA, 16 bp, Homo sapiens
caccatctgctgtctt

SEQ ID NO: 6884685 - DNA, 19 bp, Homo sapiens
atactggaataatttgtaa

SEQ ID NO: 6884686 - DNA, 13 bp, Homo sapiens
tactgagctgcta

SEQ ID NO: 6884687 - DNA, 14 bp, Homo sapiens
cttcaaccctgccc

SEQ ID NO: 6884688 - DNA, 15 bp, Homo sapiens
tgtaaaattaatgta

SEQ ID NO: 6884689 - DNA, 18 bp, Homo sapiens
gccttagcatgtgttgca

SEQ ID NO: 6884690 - DNA, 14 bp, Homo sapiens
tcatatgttgctca

SEQ ID NO: 6884691 - DNA, 13 bp, Homo sapiens
cccttcccctgct

SEQ ID NO: 6884692 - DNA, 13 bp, Homo sapiens
ccctccccctgcc

SEQ ID NO: 6884693 - DNA, 23 bp, Homo sapiens
gtacttccctcttgaaacctgat

SEQ ID NO: 6884694 - DNA, 21 bp, Homo sapiens
cagagaagccttcaagctctg

SEQ ID NO: 6884695 - DNA, 16 bp, Homo sapiens
tctatctaatgacatg

SEQ ID NO: 6884696 - DNA, 14 bp, Homo sapiens
ctcagtctcttcca

SEQ ID NO: 6884697 - DNA, 22 bp, Homo sapiens
cccttgttgcctgcacccttcc

SEQ ID NO: 6884698 - DNA, 12 bp, Homo sapiens
agggaggggagg

SEQ ID NO: 6884699 - DNA, 20 bp, Homo sapiens
caggaacatgacccgtacac

SEQ ID NO: 6884700 - DNA, 13 bp, Homo sapiens
ccactctctggga

SEQ ID NO: 6884701 - DNA, 22 bp, Homo sapiens
cagaagcctccccagctcaccc

SEQ ID NO: 6884702 - DNA, 17 bp, Homo sapiens
cttccccctttctctgc

SEQ ID NO: 6884703 - DNA, 15 bp, Homo sapiens
cacttgctaccctga

SEQ ID NO: 6884704 - DNA, 19 bp, Homo sapiens
catctacatgccatgccta

SEQ ID NO: 6884705 - DNA, 14 bp, Homo sapiens
gccaccctgctgca

SEQ ID NO: 6884706 - DNA, 19 bp, Homo sapiens
agccgagattgcaccactg

SEQ ID NO: 6884707 - DNA, 18 bp, Homo sapiens
ccatcccgtttccctcca

SEQ ID NO: 6884708 - DNA, 23 bp, Homo sapiens
cctggctgaacagtgctctgcct

SEQ ID NO: 6884709 - DNA, 15 bp, Homo sapiens
ctctcccctctcgcc

SEQ ID NO: 6884710 - DNA, 21 bp, Homo sapiens
tcttcccctctgcggctttca

SEQ ID NO: 6884711 - DNA, 23 bp, Homo sapiens
ctccaccgagccacgcagtgcct

SEQ ID NO: 6884712 - DNA, 15 bp, Homo sapiens
atttgttcagctccc

SEQ ID NO: 6884713 - DNA, 19 bp, Homo sapiens
ctcagcaacatcccatcta

SEQ ID NO: 6884714 - DNA, 23 bp, Homo sapiens
ctaaccatgggctcagggccagg

SEQ ID NO: 6884715 - DNA, 12 bp, Homo sapiens
cagctgcactga

SEQ ID NO: 6884716 - DNA, 16 bp, Homo sapiens
tatgagaatatacctt

SEQ ID NO: 6884717 - DNA, 15 bp, Homo sapiens
ctgtctatgcagcct

SEQ ID NO: 6884718 - DNA, 19 bp, Homo sapiens
ctaaaaagagactgtgcca

SEQ ID NO: 6884719 - DNA, 15 bp, Homo sapiens
tcactgaacatgcct

SEQ ID NO: 6884720 - DNA, 18 bp, Homo sapiens
agcgtcccagtctctggc

SEQ ID NO: 6884721 - DNA, 20 bp, Homo sapiens
ttacatggcgccctgcctcc

SEQ ID NO: 6884722 - DNA, 13 bp, Homo sapiens
gcaccagctgctc

SEQ ID NO: 6884723 - DNA, 12 bp, Homo sapiens
gctatgaatttt

SEQ ID NO: 6884724 - DNA, 15 bp, Homo sapiens
gctacctcagtgctc

SEQ ID NO: 6884725 - DNA, 20 bp, Homo sapiens
ctgaaaatatataagctcag

SEQ ID NO: 6884726 - DNA, 18 bp, Homo sapiens
cttagcctgcctcaccca

SEQ ID NO: 6884727 - DNA, 15 bp, Homo sapiens
aattgcgctcagggg

SEQ ID NO: 6884728 - DNA, 21 bp, Homo sapiens
ctggagcgaagccttctgcag

SEQ ID NO: 6884729 - DNA, 21 bp, Homo sapiens
gaggaagactctggagccaag

SEQ ID NO: 6884730 - DNA, 16 bp, Homo sapiens
catccaaacctacctt

SEQ ID NO: 6884731 - DNA, 15 bp, Homo sapiens
ccctcttcccccttc

SEQ ID NO: 6884732 - DNA, 23 bp, Homo sapiens
caagtgaccgacaaaattccagt

SEQ ID NO: 6884733 - DNA, 22 bp, Homo sapiens
cccttcctgtcctgcctcctca

SEQ ID NO: 6884734 - DNA, 22 bp, Homo sapiens
gattcttgtgattgactttttg

SEQ ID NO: 6884735 - DNA, 16 bp, Homo sapiens
tttactcccttctgta

SEQ ID NO: 6884736 - DNA, 13 bp, Homo sapiens
cctcctccctcca

SEQ ID NO: 6884737 - DNA, 12 bp, Homo sapiens
tcggcctggctt

SEQ ID NO: 6884738 - DNA, 16 bp, Homo sapiens
ggacactacacccagc

SEQ ID NO: 6884739 - DNA, 17 bp, Homo sapiens
tatatccccactactca

SEQ ID NO: 6884740 - DNA, 15 bp, Homo sapiens
aggcccagccctggg

SEQ ID NO: 6884741 - DNA, 16 bp, Homo sapiens
ctctactcctacctca

SEQ ID NO: 6884742 - DNA, 16 bp, Homo sapiens
agaccctgccctgtgg

SEQ ID NO: 6884743 - DNA, 21 bp, Homo sapiens
aaacttattaacaactgtgaa

SEQ ID NO: 6884744 - DNA, 18 bp, Homo sapiens
cttgctcttctttctgag

SEQ ID NO: 6884745 - DNA, 23 bp, Homo sapiens
aagaggtaagagcaaaaagtgta

SEQ ID NO: 6884746 - DNA, 16 bp, Homo sapiens
accctcccctgcctcc

SEQ ID NO: 6884747 - DNA, 16 bp, Homo sapiens
cttccttcaactgctc

SEQ ID NO: 6884748 - DNA, 14 bp, Homo sapiens
ctctgtccccttct

SEQ ID NO: 6884749 - DNA, 14 bp, Homo sapiens
tcattttactggta

SEQ ID NO: 6884750 - DNA, 22 bp, Homo sapiens
agcattgtttgcttattgttcc

SEQ ID NO: 6884751 - DNA, 14 bp, Homo sapiens
cgtgaccctctgct

SEQ ID NO: 6884752 - DNA, 21 bp, Homo sapiens
ttccatgggcccgctgcctct

SEQ ID NO: 6884753 - DNA, 19 bp, Homo sapiens
ctttgcactgagggccaca

SEQ ID NO: 6884754 - DNA, 22 bp, Homo sapiens
ttcctgtctcactcttctgtct

SEQ ID NO: 6884755 - DNA, 18 bp, Homo sapiens
aaatcagtttttgactga

SEQ ID NO: 6884756 - DNA, 15 bp, Homo sapiens
atttttgacagtgtt

SEQ ID NO: 6884757 - DNA, 21 bp, Homo sapiens
cttccattgctcccagtgcca

SEQ ID NO: 6884758 - DNA, 14 bp, Homo sapiens
ctcccactcctgct

SEQ ID NO: 6884759 - DNA, 18 bp, Homo sapiens
taagtagatctgctttct

SEQ ID NO: 6884760 - DNA, 21 bp, Homo sapiens
atcaatgttcacgcaacttga

SEQ ID NO: 6884761 - DNA, 21 bp, Homo sapiens
ctgttcccttcctctgtgcca

SEQ ID NO: 6884762 - DNA, 22 bp, Homo sapiens
ccaacagacaccctccactctg

SEQ ID NO: 6884763 - DNA, 19 bp, Homo sapiens
ccaacagaagaactgtgtt

SEQ ID NO: 6884764 - DNA, 13 bp, Homo sapiens
cccttgcctgcct

SEQ ID NO: 6884765 - DNA, 13 bp, Homo sapiens
ccatattgctctt

SEQ ID NO: 6884766 - DNA, 16 bp, Homo sapiens
tgaaggcttctctctg

SEQ ID NO: 6884767 - DNA, 14 bp, Homo sapiens
cgagattgcactgc

SEQ ID NO: 6884768 - DNA, 14 bp, Homo sapiens
cccattcttggccc

SEQ ID NO: 6884769 - DNA, 22 bp, Homo sapiens
cctaaagaaaaatatcttggcc

SEQ ID NO: 6884770 - DNA, 17 bp, Homo sapiens
ccttcccgacccagcca

SEQ ID NO: 6884771 - DNA, 18 bp, Homo sapiens
agtgcgtctgaggggaca

SEQ ID NO: 6884772 - DNA, 18 bp, Homo sapiens
cattccatgactctgcct

SEQ ID NO: 6884773 - DNA, 22 bp, Homo sapiens
ccctcttaagatctgactgcca

SEQ ID NO: 6884774 - DNA, 15 bp, Homo sapiens
ccacattaaattgat

SEQ ID NO: 6884775 - DNA, 18 bp, Homo sapiens
tctggacaggctctgctt

SEQ ID NO: 6884776 - DNA, 14 bp, Homo sapiens
gtgcccgctgcgct

SEQ ID NO: 6884777 - DNA, 17 bp, Homo sapiens
ccctgaccccctgtcct

SEQ ID NO: 6884778 - DNA, 19 bp, Homo sapiens
cagtaaatacactgtgaag

SEQ ID NO: 6884779 - DNA, 19 bp, Homo sapiens
aagttccgtctcctctcca

SEQ ID NO: 6884780 - DNA, 18 bp, Homo sapiens
cttttttgtttgtttctt

SEQ ID NO: 6884781 - DNA, 15 bp, Homo sapiens
cttcgcttcttgcct

SEQ ID NO: 6884782 - DNA, 14 bp, Homo sapiens
cagctccccagccc

SEQ ID NO: 6884783 - DNA, 15 bp, Homo sapiens
ggcccgccctctgcc

SEQ ID NO: 6884784 - DNA, 14 bp, Homo sapiens
ccaccaaaattata

SEQ ID NO: 6884785 - DNA, 12 bp, Homo sapiens
ggctgtgcctta

SEQ ID NO: 6884786 - DNA, 22 bp, Homo sapiens
cttgagctttctgtgcatgtgc

SEQ ID NO: 6884787 - DNA, 22 bp, Homo sapiens
actgcacactcagttctgctct

SEQ ID NO: 6884788 - DNA, 23 bp, Homo sapiens
ccaagcatgggggaccccttccc

SEQ ID NO: 6884789 - DNA, 16 bp, Homo sapiens
agttctgctcctctcc

SEQ ID NO: 6884790 - DNA, 20 bp, Homo sapiens
ctaagaaatatgcacaatag

SEQ ID NO: 6884791 - DNA, 19 bp, Homo sapiens
tctattagactttagaaat

SEQ ID NO: 6884792 - DNA, 15 bp, Homo sapiens
catgcatactttatt

SEQ ID NO: 6884793 - DNA, 14 bp, Homo sapiens
gttattcttgttat

SEQ ID NO: 6884794 - DNA, 23 bp, Homo sapiens
cccagcggccccccgcacagcca

SEQ ID NO: 6884795 - DNA, 19 bp, Homo sapiens
atatgtagcctttactgtt

SEQ ID NO: 6884796 - DNA, 18 bp, Homo sapiens
acctcacacacctctgcc

SEQ ID NO: 6884797 - DNA, 19 bp, Homo sapiens
cttgcccagggctcagcct

SEQ ID NO: 6884798 - DNA, 18 bp, Homo sapiens
gccagtggggcctgtgga

SEQ ID NO: 6884799 - DNA, 22 bp, Homo sapiens
ctcccacaggtcttcactgccc

SEQ ID NO: 6884800 - DNA, 20 bp, Homo sapiens
cgatccacctgtctcagcct

SEQ ID NO: 6884801 - DNA, 20 bp, Homo sapiens
aatttgaggtgaaattcagt

SEQ ID NO: 6884802 - DNA, 15 bp, Homo sapiens
aggatgctgcagtga

SEQ ID NO: 6884803 - DNA, 21 bp, Homo sapiens
attgcctttagaaactgagtc

SEQ ID NO: 6884804 - DNA, 21 bp, Homo sapiens
gcttcatctgtgggatgctga

SEQ ID NO: 6884805 - DNA, 16 bp, Homo sapiens
gcaattactgcctgca

SEQ ID NO: 6884806 - DNA, 24 bp, Homo sapiens
ttacaggtgtgtgccatcatgcct

SEQ ID NO: 6884807 - DNA, 12 bp, Homo sapiens
tatacattcctg

SEQ ID NO: 6884808 - DNA, 13 bp, Homo sapiens
tatgtactgtata

SEQ ID NO: 6884809 - DNA, 16 bp, Homo sapiens
acccaggcagctggca

SEQ ID NO: 6884810 - DNA, 15 bp, Homo sapiens
acatcaggcactgcg

SEQ ID NO: 6884811 - DNA, 14 bp, Homo sapiens
gtgggatcctccct

SEQ ID NO: 6884812 - DNA, 14 bp, Homo sapiens
aagatgtacattta

SEQ ID NO: 6884813 - DNA, 17 bp, Homo sapiens
cctttgggttccatctt

SEQ ID NO: 6884814 - DNA, 14 bp, Homo sapiens
agctggactgacca

SEQ ID NO: 6884815 - DNA, 15 bp, Homo sapiens
tataaagcaagataa

SEQ ID NO: 6884816 - DNA, 19 bp, Homo sapiens
tgaacagtgctctgcctct

SEQ ID NO: 6884817 - DNA, 20 bp, Homo sapiens
tggtcactctgccctctgct

SEQ ID NO: 6884818 - DNA, 13 bp, Homo sapiens
agagctgcctgga

SEQ ID NO: 6884819 - DNA, 17 bp, Homo sapiens
ccaacaccacagacaca

SEQ ID NO: 6884820 - DNA, 15 bp, Homo sapiens
agatatatatttcca

SEQ ID NO: 6884821 - DNA, 15 bp, Homo sapiens
tggactgactgtgtt

SEQ ID NO: 6884822 - DNA, 17 bp, Homo sapiens
tttggttttacatttta

SEQ ID NO: 6884823 - DNA, 23 bp, Homo sapiens
ctctgacagcagcatctctacct

SEQ ID NO: 6884824 - DNA, 19 bp, Homo sapiens
tatttcacagagcacgcct

SEQ ID NO: 6884825 - DNA, 16 bp, Homo sapiens
agctgtgttacttgaa

SEQ ID NO: 6884826 - DNA, 14 bp, Homo sapiens
ccaaaccccagccc

SEQ ID NO: 6884827 - DNA, 15 bp, Homo sapiens
caatctacactgcct

SEQ ID NO: 6884828 - DNA, 19 bp, Homo sapiens
gaaacacagcatgcattta

SEQ ID NO: 6884829 - DNA, 14 bp, Homo sapiens
ctttcttgtttctt

SEQ ID NO: 6884830 - DNA, 18 bp, Homo sapiens
cacaggcagctctgagcc

SEQ ID NO: 6884831 - DNA, 12 bp, Homo sapiens
tccagacttcaa

SEQ ID NO: 6884832 - DNA, 18 bp, Homo sapiens
tccagcatcccagcctca

SEQ ID NO: 6884833 - DNA, 20 bp, Homo sapiens
ctccagagggcactctgctt

SEQ ID NO: 6884834 - DNA, 14 bp, Homo sapiens
cctgccccccttcc

SEQ ID NO: 6884835 - DNA, 22 bp, Homo sapiens
tgccctcccatgttgcatgcct

SEQ ID NO: 6884836 - DNA, 21 bp, Homo sapiens
aggccttggtggagcagccag

SEQ ID NO: 6884837 - DNA, 15 bp, Homo sapiens
cacgattccagtgca

SEQ ID NO: 6884838 - DNA, 19 bp, Homo sapiens
aaacccacgacctgtcctg

SEQ ID NO: 6884839 - DNA, 15 bp, Homo sapiens
ccaatgcttctgttg

SEQ ID NO: 6884840 - DNA, 16 bp, Homo sapiens
cacctgcttctctgcc

SEQ ID NO: 6884841 - DNA, 15 bp, Homo sapiens
tcagccttagctctc

SEQ ID NO: 6884842 - DNA, 12 bp, Homo sapiens
ccccctggcatg

SEQ ID NO: 6884843 - DNA, 16 bp, Homo sapiens
ctcaggttccctgcca

SEQ ID NO: 6884844 - DNA, 12 bp, Homo sapiens
cccctctgcttt

SEQ ID NO: 6884845 - DNA, 13 bp, Homo sapiens
accagccagccct

SEQ ID NO: 6884846 - DNA, 16 bp, Homo sapiens
cagaaagtgcctttca

SEQ ID NO: 6884847 - DNA, 13 bp, Homo sapiens
ctctgtgcctaat

SEQ ID NO: 6884848 - DNA, 23 bp, Homo sapiens
tgcgtcctcctcacctcatgccc

SEQ ID NO: 6884849 - DNA, 20 bp, Homo sapiens
ccatccgtctgtctgtcgcc

SEQ ID NO: 6884850 - DNA, 19 bp, Homo sapiens
ctctcggtgctccatctcc

SEQ ID NO: 6884851 - DNA, 12 bp, Homo sapiens
tacaaatactct

SEQ ID NO: 6884852 - DNA, 19 bp, Homo sapiens
ttacagtccaaaatactgt

SEQ ID NO: 6884853 - DNA, 20 bp, Homo sapiens
cccttcttgctgccctgccc

SEQ ID NO: 6884854 - DNA, 14 bp, Homo sapiens
ctcgaagctgttct

SEQ ID NO: 6884855 - DNA, 17 bp, Homo sapiens
gcattccttacttgcac

SEQ ID NO: 6884856 - DNA, 20 bp, Homo sapiens
tcaggcagcactgacaatag

SEQ ID NO: 6884857 - DNA, 14 bp, Homo sapiens
actgacctacctca

SEQ ID NO: 6884858 - DNA, 19 bp, Homo sapiens
tccctggctgacctgctgt

SEQ ID NO: 6884859 - DNA, 14 bp, Homo sapiens
tgtttccctgctga

SEQ ID NO: 6884860 - DNA, 12 bp, Homo sapiens
ctaatgcatatt

SEQ ID NO: 6884861 - DNA, 22 bp, Homo sapiens
cctgtcagaatcatgctgttct

SEQ ID NO: 6884862 - DNA, 23 bp, Homo sapiens
agcctgtcttcagatcctgctgc

SEQ ID NO: 6884863 - DNA, 23 bp, Homo sapiens
ttagtatttaactacatctgcct

SEQ ID NO: 6884864 - DNA, 18 bp, Homo sapiens
ctcgtccccctccctgcc

SEQ ID NO: 6884865 - DNA, 12 bp, Homo sapiens
ctgctggctccc

SEQ ID NO: 6884866 - DNA, 23 bp, Homo sapiens
cagccctctgtggccaggagccc

SEQ ID NO: 6884867 - DNA, 20 bp, Homo sapiens
agagctgggtaccaggccac

SEQ ID NO: 6884868 - DNA, 22 bp, Homo sapiens
acctcatgcccaccccctgccc

SEQ ID NO: 6884869 - DNA, 18 bp, Homo sapiens
tgcccacccgtgttctcc

SEQ ID NO: 6884870 - DNA, 16 bp, Homo sapiens
gaaaatggctgaagaa

SEQ ID NO: 6884871 - DNA, 18 bp, Homo sapiens
tcattctcataattccta

SEQ ID NO: 6884872 - DNA, 17 bp, Homo sapiens
agtgtgagtaagagctg

SEQ ID NO: 6884873 - DNA, 14 bp, Homo sapiens
gtgaccattattca

SEQ ID NO: 6884874 - DNA, 23 bp, Homo sapiens
gcgtcctcgttcaaaacattcca

SEQ ID NO: 6884875 - DNA, 14 bp, Homo sapiens
ggaaggacacagca

SEQ ID NO: 6884876 - DNA, 15 bp, Homo sapiens
tccccagagctcccc

SEQ ID NO: 6884877 - DNA, 12 bp, Homo sapiens
cacagcagacac

SEQ ID NO: 6884878 - DNA, 20 bp, Homo sapiens
gtccaggaaggcagctgctc

SEQ ID NO: 6884879 - DNA, 22 bp, Homo sapiens
ccaatgttatgccagctccatg

SEQ ID NO: 6884880 - DNA, 17 bp, Homo sapiens
tttttaaattttgtatg

SEQ ID NO: 6884881 - DNA, 15 bp, Homo sapiens
tgggggtctgtgtgt

SEQ ID NO: 6884882 - DNA, 15 bp, Homo sapiens
ctggaacctgtctcc

SEQ ID NO: 6884883 - DNA, 18 bp, Homo sapiens
cttctaattttgtgctct

SEQ ID NO: 6884884 - DNA, 14 bp, Homo sapiens
tcactccagtgctc

SEQ ID NO: 6884885 - DNA, 14 bp, Homo sapiens
agggcccctctgcc

SEQ ID NO: 6884886 - DNA, 14 bp, Homo sapiens
aggccacctctcca

SEQ ID NO: 6884887 - DNA, 23 bp, Homo sapiens
ccatctctcttccagctgcttca

SEQ ID NO: 6884888 - DNA, 20 bp, Homo sapiens
ctgccaggctcccactgccc

SEQ ID NO: 6884889 - DNA, 18 bp, Homo sapiens
attttccctctcttgcct

SEQ ID NO: 6884890 - DNA, 12 bp, Homo sapiens
ggcgccaggaca

SEQ ID NO: 6884891 - DNA, 21 bp, Homo sapiens
gaatttgagtttgctgtttta

SEQ ID NO: 6884892 - DNA, 21 bp, Homo sapiens
cccttcgaggttgccccttcc

SEQ ID NO: 6884893 - DNA, 15 bp, Homo sapiens
gaaaatatactgtaa

SEQ ID NO: 6884894 - DNA, 20 bp, Homo sapiens
cagtccccagcccttctgcc

SEQ ID NO: 6884895 - DNA, 14 bp, Homo sapiens
cattgcccctctgc

SEQ ID NO: 6884896 - DNA, 13 bp, Homo sapiens
tatatataatgta

SEQ ID NO: 6884897 - DNA, 15 bp, Homo sapiens
cttttgtagtgtgtt

SEQ ID NO: 6884898 - DNA, 19 bp, Homo sapiens
ctgagctggggcctggaga

SEQ ID NO: 6884899 - DNA, 19 bp, Homo sapiens
gtgctgctaattctttgca

SEQ ID NO: 6884900 - DNA, 15 bp, Homo sapiens
ctttgcacctctgct

SEQ ID NO: 6884901 - DNA, 15 bp, Homo sapiens
tgtccctctgcccca

SEQ ID NO: 6884902 - DNA, 16 bp, Homo sapiens
actgtatagacagttt

SEQ ID NO: 6884903 - DNA, 18 bp, Homo sapiens
ccacatccaccccagccc

SEQ ID NO: 6884904 - DNA, 18 bp, Homo sapiens
aattttgtcttaagtgtt

SEQ ID NO: 6884905 - DNA, 20 bp, Homo sapiens
attttgtgggcttaattgaa

SEQ ID NO: 6884906 - DNA, 17 bp, Homo sapiens
cccaggaacgctctcct

SEQ ID NO: 6884907 - DNA, 20 bp, Homo sapiens
ttctgtgaagccctttgcct

SEQ ID NO: 6884908 - DNA, 17 bp, Homo sapiens
ctacaagctaaaattag

SEQ ID NO: 6884909 - DNA, 19 bp, Homo sapiens
ctctagcagcacctcctgt

SEQ ID NO: 6884910 - DNA, 13 bp, Homo sapiens
atttgcaggattt

SEQ ID NO: 6884911 - DNA, 17 bp, Homo sapiens
actttttaaacagtgtt

SEQ ID NO: 6884912 - DNA, 18 bp, Homo sapiens
attgcatgtgactctgaa

SEQ ID NO: 6884913 - DNA, 19 bp, Homo sapiens
cctccgaggctccccgcct

SEQ ID NO: 6884914 - DNA, 21 bp, Homo sapiens
taatttcctttttgacactga

SEQ ID NO: 6884915 - DNA, 19 bp, Homo sapiens
tggccaggctgcctggcct

SEQ ID NO: 6884916 - DNA, 16 bp, Homo sapiens
tctcaggccatcatca

SEQ ID NO: 6884917 - DNA, 19 bp, Homo sapiens
gttcttgtaaaactgtgac

SEQ ID NO: 6884918 - DNA, 23 bp, Homo sapiens
aaattataactattacagtgttg

SEQ ID NO: 6884919 - DNA, 15 bp, Homo sapiens
gagctttgttttata

SEQ ID NO: 6884920 - DNA, 16 bp, Homo sapiens
ccttccgccccttccc

SEQ ID NO: 6884921 - DNA, 21 bp, Homo sapiens
caggcgcggtggctcttgcct

SEQ ID NO: 6884922 - DNA, 17 bp, Homo sapiens
aacgtccatctctctcc

SEQ ID NO: 6884923 - DNA, 22 bp, Homo sapiens
catcatttaactgaactgtgaa

SEQ ID NO: 6884924 - DNA, 16 bp, Homo sapiens
cagagtggcctggcca

SEQ ID NO: 6884925 - DNA, 17 bp, Homo sapiens
ccctctcttccccttcc

SEQ ID NO: 6884926 - DNA, 15 bp, Homo sapiens
actattttatattta

SEQ ID NO: 6884927 - DNA, 13 bp, Homo sapiens
gaaattgaatgta

SEQ ID NO: 6884928 - DNA, 22 bp, Homo sapiens
acagatacctccaaccctgccg

SEQ ID NO: 6884929 - DNA, 17 bp, Homo sapiens
tccaccacatctgccag

SEQ ID NO: 6884930 - DNA, 17 bp, Homo sapiens
ccctcgcaaccctgcct

SEQ ID NO: 6884931 - DNA, 19 bp, Homo sapiens
attttaaataacctctggc

SEQ ID NO: 6884932 - DNA, 17 bp, Homo sapiens
cacacaaactgatgatg

SEQ ID NO: 6884933 - DNA, 21 bp, Homo sapiens
acatgttggaggagagagcct

SEQ ID NO: 6884934 - DNA, 20 bp, Homo sapiens
cacgtctgtgagtctgtcct

SEQ ID NO: 6884935 - DNA, 20 bp, Homo sapiens
caatgttttcctttgtcatc

SEQ ID NO: 6884936 - DNA, 17 bp, Homo sapiens
gaagaaggactgaagaa

SEQ ID NO: 6884937 - DNA, 19 bp, Homo sapiens
actcaggagcacagccata

SEQ ID NO: 6884938 - DNA, 17 bp, Homo sapiens
agcacaacccaccacaa

SEQ ID NO: 6884939 - DNA, 15 bp, Homo sapiens
tgaatattttttgaa

SEQ ID NO: 6884940 - DNA, 14 bp, Homo sapiens
acttgccactgcca

SEQ ID NO: 6884941 - DNA, 12 bp, Homo sapiens
tgcactccctgg

SEQ ID NO: 6884942 - DNA, 12 bp, Homo sapiens
cctccccctgct

SEQ ID NO: 6884943 - DNA, 23 bp, Homo sapiens
gaggccccttctctccctgccag

SEQ ID NO: 6884944 - DNA, 15 bp, Homo sapiens
ccttctccccagcca

SEQ ID NO: 6884945 - DNA, 21 bp, Homo sapiens
acagacacctccccctaccca

SEQ ID NO: 6884946 - DNA, 22 bp, Homo sapiens
gagaaaacactttcctggataa

SEQ ID NO: 6884947 - DNA, 16 bp, Homo sapiens
ccgtcctccctcagcc

SEQ ID NO: 6884948 - DNA, 14 bp, Homo sapiens
ttcagaactgccct

SEQ ID NO: 6884949 - DNA, 13 bp, Homo sapiens
cctgccctctgcc

SEQ ID NO: 6884950 - DNA, 12 bp, Homo sapiens
tgtaacccttga

SEQ ID NO: 6884951 - DNA, 18 bp, Homo sapiens
ggcatttagcacagtatt

SEQ ID NO: 6884952 - DNA, 16 bp, Homo sapiens
ctatttcagtgccaat

SEQ ID NO: 6884953 - DNA, 20 bp, Homo sapiens
gttgtggaaagtagctgcta

SEQ ID NO: 6884954 - DNA, 20 bp, Homo sapiens
tgctggttttcctaaatgca

SEQ ID NO: 6884955 - DNA, 18 bp, Homo sapiens
ggtgcacaggcctctgcc

SEQ ID NO: 6884956 - DNA, 20 bp, Homo sapiens
ctcaaaacacttccagtctg

SEQ ID NO: 6884957 - DNA, 18 bp, Homo sapiens
aaatactgtagataatta

SEQ ID NO: 6884958 - DNA, 19 bp, Homo sapiens
tggatacagcagtagacat

SEQ ID NO: 6884959 - DNA, 21 bp, Homo sapiens
tgctgcaaggtggcctctgcc

SEQ ID NO: 6884960 - DNA, 16 bp, Homo sapiens
actcagttttttgtaa

SEQ ID NO: 6884961 - DNA, 23 bp, Homo sapiens
ttaagaaagagaatgaactgtgg

SEQ ID NO: 6884962 - DNA, 13 bp, Homo sapiens
catatccctgccc

SEQ ID NO: 6884963 - DNA, 14 bp, Homo sapiens
tccagcctggagat

SEQ ID NO: 6884964 - DNA, 20 bp, Homo sapiens
ccaagaggggcgggctcaga

SEQ ID NO: 6884965 - DNA, 11 bp, Homo sapiens
ccccagggatg

SEQ ID NO: 6884966 - DNA, 13 bp, Homo sapiens
ttaatattttgtt

SEQ ID NO: 6884967 - DNA, 16 bp, Homo sapiens
cacaagcttctgtcct

SEQ ID NO: 6884968 - DNA, 17 bp, Homo sapiens
cctgctcagcccatccc

SEQ ID NO: 6884969 - DNA, 19 bp, Homo sapiens
atctatttatctgtctgag

SEQ ID NO: 6884970 - DNA, 17 bp, Homo sapiens
cacgtcctgtcagtgcc

SEQ ID NO: 6884971 - DNA, 18 bp, Homo sapiens
gctcctccctctgcctca

SEQ ID NO: 6884972 - DNA, 18 bp, Homo sapiens
caggctggggcctggcct

SEQ ID NO: 6884973 - DNA, 17 bp, Homo sapiens
aattgtgcttctcccca

SEQ ID NO: 6884974 - DNA, 14 bp, Homo sapiens
cacttcctgcccca

SEQ ID NO: 6884975 - DNA, 19 bp, Homo sapiens
ctctctgtctgtctctccc

SEQ ID NO: 6884976 - DNA, 20 bp, Homo sapiens
cagatccccagcccctcctc

SEQ ID NO: 6884977 - DNA, 15 bp, Homo sapiens
ctccctgcctggccc

SEQ ID NO: 6884978 - DNA, 22 bp, Homo sapiens
ctggaacctcagcctggccaga

SEQ ID NO: 6884979 - DNA, 14 bp, Homo sapiens
taatgtgaaatgta

SEQ ID NO: 6884980 - DNA, 17 bp, Homo sapiens
cagagcacagccaatct

SEQ ID NO: 6884981 - DNA, 21 bp, Homo sapiens
cctgtggagacagccctgcct

SEQ ID NO: 6884982 - DNA, 16 bp, Homo sapiens
ccacactgaaattcta

SEQ ID NO: 6884983 - DNA, 20 bp, Homo sapiens
atggtggagggcacttcagg

SEQ ID NO: 6884984 - DNA, 17 bp, Homo sapiens
cattttccccccactct

SEQ ID NO: 6884985 - DNA, 15 bp, Homo sapiens
tcatctcctttgcta

SEQ ID NO: 6884986 - DNA, 18 bp, Homo sapiens
cccggccgccgccctgct

SEQ ID NO: 6884987 - DNA, 14 bp, Homo sapiens
aagccatgagaatg

SEQ ID NO: 6884988 - DNA, 20 bp, Homo sapiens
caaaacacactactacctct

SEQ ID NO: 6884989 - DNA, 22 bp, Homo sapiens
cagaatgactccaccttctcac

SEQ ID NO: 6884990 - DNA, 18 bp, Homo sapiens
cctgtgccaccccttcct

SEQ ID NO: 6884991 - DNA, 15 bp, Homo sapiens
cctcctacccctccc

SEQ ID NO: 6884992 - DNA, 16 bp, Homo sapiens
catcaattctctatca

SEQ ID NO: 6884993 - DNA, 13 bp, Homo sapiens
aaacatgaattta

SEQ ID NO: 6884994 - DNA, 17 bp, Homo sapiens
ggaatactgttttatct

SEQ ID NO: 6884995 - DNA, 20 bp, Homo sapiens
atcggcccacagctcccacc

SEQ ID NO: 6884996 - DNA, 20 bp, Homo sapiens
ctaccaatacaaaatgtatt

SEQ ID NO: 6884997 - DNA, 22 bp, Homo sapiens
ctctctgagtcaaatccagtgg

SEQ ID NO: 6884998 - DNA, 22 bp, Homo sapiens
ttccgtttgatttgtcactgct

SEQ ID NO: 6884999 - DNA, 16 bp, Homo sapiens
cctgtcaccccagtca

SEQ ID NO: 6885000 - DNA, 20 bp, Homo sapiens
ctatccccatctccctgcct

SEQ ID NO: 6885001 - DNA, 23 bp, Homo sapiens
cacacctgaatcagctggacata

SEQ ID NO: 6885002 - DNA, 13 bp, Homo sapiens
caacatgcacatt

SEQ ID NO: 6885003 - DNA, 16 bp, Homo sapiens
cagaaatcactgtgaa

SEQ ID NO: 6885004 - DNA, 20 bp, Homo sapiens
ttcaaaggccacatacctct

SEQ ID NO: 6885005 - DNA, 15 bp, Homo sapiens
ccttgtgccctgccc

SEQ ID NO: 6885006 - DNA, 14 bp, Homo sapiens
cccagtcacttcct

SEQ ID NO: 6885007 - DNA, 22 bp, Homo sapiens
aaaatgtaaaaaccctgctaaa

SEQ ID NO: 6885008 - DNA, 14 bp, Homo sapiens
attatttttacgta

SEQ ID NO: 6885009 - DNA, 22 bp, Homo sapiens
caaaacttcctcaatgcattga

SEQ ID NO: 6885010 - DNA, 15 bp, Homo sapiens
ctcgaagcccttcca

SEQ ID NO: 6885011 - DNA, 20 bp, Homo sapiens
cctgtccccaggcccagccc

SEQ ID NO: 6885012 - DNA, 15 bp, Homo sapiens
cctcccaccgctgcc

SEQ ID NO: 6885013 - DNA, 18 bp, Homo sapiens
gcttctgttctctgctga

SEQ ID NO: 6885014 - DNA, 13 bp, Homo sapiens
cacccttctccca

SEQ ID NO: 6885015 - DNA, 20 bp, Homo sapiens
ccataagacaaacactgcca

SEQ ID NO: 6885016 - DNA, 13 bp, Homo sapiens
tgttgcactgaag

SEQ ID NO: 6885017 - DNA, 21 bp, Homo sapiens
cattctttcttggtgcattcg

SEQ ID NO: 6885018 - DNA, 15 bp, Homo sapiens
tcttccgcccctgcc

SEQ ID NO: 6885019 - DNA, 13 bp, Homo sapiens
cagcttgtttaca

SEQ ID NO: 6885020 - DNA, 14 bp, Homo sapiens
caaaacactgtgga

SEQ ID NO: 6885021 - DNA, 15 bp, Homo sapiens
gaacattttactgtt

SEQ ID NO: 6885022 - DNA, 14 bp, Homo sapiens
aggtgttctgctga

SEQ ID NO: 6885023 - DNA, 14 bp, Homo sapiens
gtagctctgctgct

SEQ ID NO: 6885024 - DNA, 22 bp, Homo sapiens
ctcctcaggcacacagctactc

SEQ ID NO: 6885025 - DNA, 20 bp, Homo sapiens
tgtttacctcactggtgcat

SEQ ID NO: 6885026 - DNA, 12 bp, Homo sapiens
gttctgcactga

SEQ ID NO: 6885027 - DNA, 14 bp, Homo sapiens
tgcgctcctctgca

SEQ ID NO: 6885028 - DNA, 14 bp, Homo sapiens
cctttaccccatcc

SEQ ID NO: 6885029 - DNA, 13 bp, Homo sapiens
cactgtggcagca

SEQ ID NO: 6885030 - DNA, 15 bp, Homo sapiens
gtgtaggcagacaca

SEQ ID NO: 6885031 - DNA, 15 bp, Homo sapiens
attcctttcccttta

SEQ ID NO: 6885032 - DNA, 17 bp, Homo sapiens
agatggctgctgctcac

SEQ ID NO: 6885033 - DNA, 20 bp, Homo sapiens
cctggaagagcccagtctgt

SEQ ID NO: 6885034 - DNA, 15 bp, Homo sapiens
taactgtatcttgag

SEQ ID NO: 6885035 - DNA, 13 bp, Homo sapiens
acttgaaagcatc

SEQ ID NO: 6885036 - DNA, 12 bp, Homo sapiens
cctggctgtgca

SEQ ID NO: 6885037 - DNA, 14 bp, Homo sapiens
ccctacccctgccc

SEQ ID NO: 6885038 - DNA, 22 bp, Homo sapiens
tgcctcatttcttcctctgcat

SEQ ID NO: 6885039 - DNA, 20 bp, Homo sapiens
tctgggcctctgactctgag

SEQ ID NO: 6885040 - DNA, 19 bp, Homo sapiens
tgattcctacccctcttcc

SEQ ID NO: 6885041 - DNA, 22 bp, Homo sapiens
cagaaacaccctcacactggga

SEQ ID NO: 6885042 - DNA, 23 bp, Homo sapiens
ttcccgatggtctctctccctct

SEQ ID NO: 6885043 - DNA, 20 bp, Homo sapiens
ctcatgatccacccacctca

SEQ ID NO: 6885044 - DNA, 18 bp, Homo sapiens
agccgcaagctctcagca

SEQ ID NO: 6885045 - DNA, 17 bp, Homo sapiens
aggaatccagacccggc

SEQ ID NO: 6885046 - DNA, 16 bp, Homo sapiens
aattccacttcctgcc

SEQ ID NO: 6885047 - DNA, 19 bp, Homo sapiens
actcctggtgcccctcgcc

SEQ ID NO: 6885048 - DNA, 18 bp, Homo sapiens
cttggaaccaccagtcta

SEQ ID NO: 6885049 - DNA, 16 bp, Homo sapiens
atcaccttctttgtaa

SEQ ID NO: 6885050 - DNA, 21 bp, Homo sapiens
ctatgaaggatccatctttgt

SEQ ID NO: 6885051 - DNA, 21 bp, Homo sapiens
cgagtccaggagccccagcca

SEQ ID NO: 6885052 - DNA, 18 bp, Homo sapiens
aacagccactcccctcca

SEQ ID NO: 6885053 - DNA, 16 bp, Homo sapiens
actttgcttctctcca

SEQ ID NO: 6885054 - DNA, 23 bp, Homo sapiens
cttgtccctggggcactccccca

SEQ ID NO: 6885055 - DNA, 15 bp, Homo sapiens
cattcaagctattta

SEQ ID NO: 6885056 - DNA, 19 bp, Homo sapiens
atatctggtcagaactgca

SEQ ID NO: 6885057 - DNA, 19 bp, Homo sapiens
ccaaggtttaaagagtcta

SEQ ID NO: 6885058 - DNA, 18 bp, Homo sapiens
gccagcttcctgtgcaga

SEQ ID NO: 6885059 - DNA, 19 bp, Homo sapiens
caaatatgcaaagcactga

SEQ ID NO: 6885060 - DNA, 13 bp, Homo sapiens
aaatgtatattga

SEQ ID NO: 6885061 - DNA, 18 bp, Homo sapiens
ttccctgcctccagctgt

SEQ ID NO: 6885062 - DNA, 19 bp, Homo sapiens
gtaccacaccctgcctgct

SEQ ID NO: 6885063 - DNA, 18 bp, Homo sapiens
agcctggagcccctgtgt

SEQ ID NO: 6885064 - DNA, 12 bp, Homo sapiens
cagacccctgcc

SEQ ID NO: 6885065 - DNA, 15 bp, Homo sapiens
atattattttctgta

SEQ ID NO: 6885066 - DNA, 17 bp, Homo sapiens
agcataagtatacagtt

SEQ ID NO: 6885067 - DNA, 13 bp, Homo sapiens
atgaaccctgccc

SEQ ID NO: 6885068 - DNA, 18 bp, Homo sapiens
tagcaaatgtttactgta

SEQ ID NO: 6885069 - DNA, 17 bp, Homo sapiens
cgactagacacacaaag

SEQ ID NO: 6885070 - DNA, 22 bp, Homo sapiens
cagctggcggaacctggctgcg

SEQ ID NO: 6885071 - DNA, 17 bp, Homo sapiens
cagattcaggccagccc

SEQ ID NO: 6885072 - DNA, 17 bp, Homo sapiens
cttccgttcattgctct

SEQ ID NO: 6885073 - DNA, 14 bp, Homo sapiens
gttctcttcttgaa

SEQ ID NO: 6885074 - DNA, 22 bp, Homo sapiens
taagttgattaaaaatgctttt

SEQ ID NO: 6885075 - DNA, 12 bp, Homo sapiens
ctccagctgctg

SEQ ID NO: 6885076 - DNA, 13 bp, Homo sapiens
ctgggctgatgga

SEQ ID NO: 6885077 - DNA, 17 bp, Homo sapiens
catgcaactccatgcct

SEQ ID NO: 6885078 - DNA, 13 bp, Homo sapiens
gcttccctctgcc

SEQ ID NO: 6885079 - DNA, 13 bp, Homo sapiens
ccttccctgtgcc

SEQ ID NO: 6885080 - DNA, 13 bp, Homo sapiens
cgcacactgtgat

SEQ ID NO: 6885081 - DNA, 16 bp, Homo sapiens
cctcccctcctcttcc

SEQ ID NO: 6885082 - DNA, 14 bp, Homo sapiens
acgtcccctccgcc

SEQ ID NO: 6885083 - DNA, 12 bp, Homo sapiens
tgtcccctctcc

SEQ ID NO: 6885084 - DNA, 20 bp, Homo sapiens
tgcctggaggacctgagcct

SEQ ID NO: 6885085 - DNA, 13 bp, Homo sapiens
ctctgccccttcc

SEQ ID NO: 6885086 - DNA, 20 bp, Homo sapiens
tgtccaggcactgctgccca

SEQ ID NO: 6885087 - DNA, 18 bp, Homo sapiens
ctgggtctccctggtggg

SEQ ID NO: 6885088 - DNA, 20 bp, Homo sapiens
aacatcagacctgtcttcca

SEQ ID NO: 6885089 - DNA, 21 bp, Homo sapiens
cttctttctttgggaatattt

SEQ ID NO: 6885090 - DNA, 16 bp, Homo sapiens
aaaatatcactttgta

SEQ ID NO: 6885091 - DNA, 23 bp, Homo sapiens
tactttgttgcaagtactgctgt

SEQ ID NO: 6885092 - DNA, 23 bp, Homo sapiens
agccttggttggacctattgcca

SEQ ID NO: 6885093 - DNA, 13 bp, Homo sapiens
cttgctctggacc

SEQ ID NO: 6885094 - DNA, 15 bp, Homo sapiens
tgtgatgctgtgtgc

SEQ ID NO: 6885095 - DNA, 16 bp, Homo sapiens
taaatcctaccaaagt

SEQ ID NO: 6885096 - DNA, 13 bp, Homo sapiens
agacagccctcca

SEQ ID NO: 6885097 - DNA, 16 bp, Homo sapiens
agagcccaccagccag

SEQ ID NO: 6885098 - DNA, 20 bp, Homo sapiens
tctgagccacagcagcattt

SEQ ID NO: 6885099 - DNA, 20 bp, Homo sapiens
cttctcttgaggcctgtgct

SEQ ID NO: 6885100 - DNA, 13 bp, Homo sapiens
ggggacagagcca

SEQ ID NO: 6885101 - DNA, 13 bp, Homo sapiens
ccagtcttcctct

SEQ ID NO: 6885102 - DNA, 19 bp, Homo sapiens
atgtcagacagaacttgaa

SEQ ID NO: 6885103 - DNA, 20 bp, Homo sapiens
cacagttttggttgctttaa

SEQ ID NO: 6885104 - DNA, 22 bp, Homo sapiens
agctctgggcctctttttgccc

SEQ ID NO: 6885105 - DNA, 12 bp, Homo sapiens
tgcccctgcagc

SEQ ID NO: 6885106 - DNA, 16 bp, Homo sapiens
cattaatgcccagcca

SEQ ID NO: 6885107 - DNA, 15 bp, Homo sapiens
ctcagaactgtccca

SEQ ID NO: 6885108 - DNA, 22 bp, Homo sapiens
agtgagactgacacctcactga

SEQ ID NO: 6885109 - DNA, 17 bp, Homo sapiens
tagccactctctgccca

SEQ ID NO: 6885110 - DNA, 17 bp, Homo sapiens
tggccctggcctgctgg

SEQ ID NO: 6885111 - DNA, 14 bp, Homo sapiens
cacatcctgtgtca

SEQ ID NO: 6885112 - DNA, 21 bp, Homo sapiens
cctgggtcagtctggtgggag

SEQ ID NO: 6885113 - DNA, 18 bp, Homo sapiens
cttcattctaaaccaaaa

SEQ ID NO: 6885114 - DNA, 17 bp, Homo sapiens
cagtctcagctgctgaa

SEQ ID NO: 6885115 - DNA, 13 bp, Homo sapiens
aaaccagtgtgaa

SEQ ID NO: 6885116 - DNA, 15 bp, Homo sapiens
cgtttcttctttcta

SEQ ID NO: 6885117 - DNA, 12 bp, Homo sapiens
acttgatatttc

SEQ ID NO: 6885118 - DNA, 12 bp, Homo sapiens
taagaccaaaga

SEQ ID NO: 6885119 - DNA, 22 bp, Homo sapiens
cagaaaagtagaattatatcta

SEQ ID NO: 6885120 - DNA, 21 bp, Homo sapiens
ctccccgcctcctccctgcct

SEQ ID NO: 6885121 - DNA, 14 bp, Homo sapiens
tgctcctccctgcc

SEQ ID NO: 6885122 - DNA, 18 bp, Homo sapiens
atccacctgtctcagcct

SEQ ID NO: 6885123 - DNA, 18 bp, Homo sapiens
gcaatataaaaatgtgaa

SEQ ID NO: 6885124 - DNA, 14 bp, Homo sapiens
acctctctttctca

SEQ ID NO: 6885125 - DNA, 17 bp, Homo sapiens
gcctggggtccctctga

SEQ ID NO: 6885126 - DNA, 17 bp, Homo sapiens
cacagcactgcctgcca

SEQ ID NO: 6885127 - DNA, 17 bp, Homo sapiens
ccactccgccagccaca

SEQ ID NO: 6885128 - DNA, 17 bp, Homo sapiens
acgtgctccgtagctct

SEQ ID NO: 6885129 - DNA, 16 bp, Homo sapiens
tagttagctgctttaa

SEQ ID NO: 6885130 - DNA, 20 bp, Homo sapiens
ccatctgcctgaccccttca

SEQ ID NO: 6885131 - DNA, 22 bp, Homo sapiens
gaacacttataagtgaagtgat

SEQ ID NO: 6885132 - DNA, 15 bp, Homo sapiens
atatttttttctgta

SEQ ID NO: 6885133 - DNA, 17 bp, Homo sapiens
ctttcttgctcccttca

SEQ ID NO: 6885134 - DNA, 18 bp, Homo sapiens
atttcagtatcatctcca

SEQ ID NO: 6885135 - DNA, 20 bp, Homo sapiens
ccttgtaaattccccttccc

SEQ ID NO: 6885136 - DNA, 23 bp, Homo sapiens
cactttgttgcaagatgtgaatt

SEQ ID NO: 6885137 - DNA, 16 bp, Homo sapiens
agcaaggccctgctgc

SEQ ID NO: 6885138 - DNA, 15 bp, Homo sapiens
gaatgtagcttccac

SEQ ID NO: 6885139 - DNA, 18 bp, Homo sapiens
acccagcgtggcccaggc

SEQ ID NO: 6885140 - DNA, 14 bp, Homo sapiens
cctttccccttccc

SEQ ID NO: 6885141 - DNA, 16 bp, Homo sapiens
acaatcactattctta

SEQ ID NO: 6885142 - DNA, 18 bp, Homo sapiens
cagtgctgggcccagccg

SEQ ID NO: 6885143 - DNA, 19 bp, Homo sapiens
tgattttgaccttgtattg

SEQ ID NO: 6885144 - DNA, 20 bp, Homo sapiens
acaaccacggtcacacctca

SEQ ID NO: 6885145 - DNA, 16 bp, Homo sapiens
tatctgaaaactggaa

SEQ ID NO: 6885146 - DNA, 18 bp, Homo sapiens
cagtcatggcctgagatg

SEQ ID NO: 6885147 - DNA, 21 bp, Homo sapiens
agatcattgtgaaattattca

SEQ ID NO: 6885148 - DNA, 19 bp, Homo sapiens
agacagtgctgccctgcga

SEQ ID NO: 6885149 - DNA, 15 bp, Homo sapiens
cacaagcttctgtcc

SEQ ID NO: 6885150 - DNA, 14 bp, Homo sapiens
ctggggcttgtcct

SEQ ID NO: 6885151 - DNA, 21 bp, Homo sapiens
agctctgggcctctttttgcc

SEQ ID NO: 6885152 - DNA, 22 bp, Homo sapiens
tggccagtttgaagcctgtgcc

SEQ ID NO: 6885153 - DNA, 21 bp, Homo sapiens
acttattttgtcttattctta

SEQ ID NO: 6885154 - DNA, 14 bp, Homo sapiens
taaattatggcatt

SEQ ID NO: 6885155 - DNA, 16 bp, Homo sapiens
agctcctaagctgcca

SEQ ID NO: 6885156 - DNA, 20 bp, Homo sapiens
actctccccagtgcctgcca

SEQ ID NO: 6885157 - DNA, 15 bp, Homo sapiens
aatgacatgcactga

SEQ ID NO: 6885158 - DNA, 24 bp, Homo sapiens
aagactgttgctcaaatctattca

SEQ ID NO: 6885159 - DNA, 14 bp, Homo sapiens
ttggaaatactgta

SEQ ID NO: 6885160 - DNA, 19 bp, Homo sapiens
tggggtgcttgctgtgtga

SEQ ID NO: 6885161 - DNA, 18 bp, Homo sapiens
acctttacataattgcaa

SEQ ID NO: 6885162 - DNA, 13 bp, Homo sapiens
tcaaaccctgttt

SEQ ID NO: 6885163 - DNA, 21 bp, Homo sapiens
aataaatcacagatgcatata

SEQ ID NO: 6885164 - DNA, 13 bp, Homo sapiens
ccgcgctcaggag

SEQ ID NO: 6885165 - DNA, 17 bp, Homo sapiens
aaaagtagaactttgta

SEQ ID NO: 6885166 - DNA, 16 bp, Homo sapiens
tatatatatatatgta

SEQ ID NO: 6885167 - DNA, 19 bp, Homo sapiens
caagttcctgcactccaga

SEQ ID NO: 6885168 - DNA, 20 bp, Homo sapiens
acagctaatcagcattctca

SEQ ID NO: 6885169 - DNA, 23 bp, Homo sapiens
cagagactttaatcactgctgaa

SEQ ID NO: 6885170 - DNA, 20 bp, Homo sapiens
ggtgcagaggtttcttgaat

SEQ ID NO: 6885171 - DNA, 17 bp, Homo sapiens
gcttcaggtgagccaag

SEQ ID NO: 6885172 - DNA, 15 bp, Homo sapiens
tgattcacctcttcc

SEQ ID NO: 6885173 - DNA, 19 bp, Homo sapiens
cccgcccgagcccctgccc

SEQ ID NO: 6885174 - DNA, 13 bp, Homo sapiens
taaaacactgccc

SEQ ID NO: 6885175 - DNA, 17 bp, Homo sapiens
cacatcctgtgtttcta

SEQ ID NO: 6885176 - DNA, 14 bp, Homo sapiens
ctatataccaaagc

SEQ ID NO: 6885177 - DNA, 21 bp, Homo sapiens
atggccagacgtggtggctca

SEQ ID NO: 6885178 - DNA, 20 bp, Homo sapiens
tctttctgagagttggctca

SEQ ID NO: 6885179 - DNA, 19 bp, Homo sapiens
ttccacacctggcactgct

SEQ ID NO: 6885180 - DNA, 15 bp, Homo sapiens
atcctgaatctgtgc

SEQ ID NO: 6885181 - DNA, 21 bp, Homo sapiens
cgtgttagtgtgtgtgcatgt

SEQ ID NO: 6885182 - DNA, 16 bp, Homo sapiens
aatatgatctgtggag

SEQ ID NO: 6885183 - DNA, 18 bp, Homo sapiens
cacttcatgcccactgcc

SEQ ID NO: 6885184 - DNA, 22 bp, Homo sapiens
cccatttccttgtgctcctgcc

SEQ ID NO: 6885185 - DNA, 19 bp, Homo sapiens
ctcctgtccctccatccca

SEQ ID NO: 6885186 - DNA, 13 bp, Homo sapiens
ctgtccctgtcct

SEQ ID NO: 6885187 - DNA, 20 bp, Homo sapiens
ccctgtgccttgtcacgcca

SEQ ID NO: 6885188 - DNA, 21 bp, Homo sapiens
tcccttgctggccccagccct

SEQ ID NO: 6885189 - DNA, 16 bp, Homo sapiens
ctgagctccagtggaa

SEQ ID NO: 6885190 - DNA, 19 bp, Homo sapiens
agcgtcagctgctccctgg

SEQ ID NO: 6885191 - DNA, 16 bp, Homo sapiens
cctactccctcttcca

SEQ ID NO: 6885192 - DNA, 21 bp, Homo sapiens
tggaagagaggcacctgctgg

SEQ ID NO: 6885193 - DNA, 22 bp, Homo sapiens
ctcccaggggagccagctgctt

SEQ ID NO: 6885194 - DNA, 18 bp, Homo sapiens
cctggttccctctttcct

SEQ ID NO: 6885195 - DNA, 15 bp, Homo sapiens
aaattattctagtca

SEQ ID NO: 6885196 - DNA, 14 bp, Homo sapiens
ccgcttgctctcct

SEQ ID NO: 6885197 - DNA, 15 bp, Homo sapiens
ctcctcgctgtgcca

SEQ ID NO: 6885198 - DNA, 20 bp, Homo sapiens
tcacttctttcccttcctcc

SEQ ID NO: 6885199 - DNA, 20 bp, Homo sapiens
agctacgtgtgcccctctca

SEQ ID NO: 6885200 - DNA, 20 bp, Homo sapiens
tccttccgatgacagtgctc

SEQ ID NO: 6885201 - DNA, 22 bp, Homo sapiens
ctgatggaaaataccagtgttg

SEQ ID NO: 6885202 - DNA, 17 bp, Homo sapiens
ctccaggcatgtgtctg

SEQ ID NO: 6885203 - DNA, 16 bp, Homo sapiens
gcccagagcccttgac

SEQ ID NO: 6885204 - DNA, 15 bp, Homo sapiens
ctgtatgtctgccta

SEQ ID NO: 6885205 - DNA, 22 bp, Homo sapiens
acagataattcatttgtattgc

SEQ ID NO: 6885206 - DNA, 16 bp, Homo sapiens
cctttttgacactgaa

SEQ ID NO: 6885207 - DNA, 17 bp, Homo sapiens
cagggggcatgaccaga

SEQ ID NO: 6885208 - DNA, 14 bp, Homo sapiens
cttccccttgtccc

SEQ ID NO: 6885209 - DNA, 23 bp, Homo sapiens
gaagttggtcttactttgtgcaa

SEQ ID NO: 6885210 - DNA, 16 bp, Homo sapiens
cgttacatctgtgcag

SEQ ID NO: 6885211 - DNA, 12 bp, Homo sapiens
ccagcctggagc

SEQ ID NO: 6885212 - DNA, 18 bp, Homo sapiens
tccggcagaggcagggcc

SEQ ID NO: 6885213 - DNA, 15 bp, Homo sapiens
ttcggtgccctgtgt

SEQ ID NO: 6885214 - DNA, 18 bp, Homo sapiens
ctgcatttaaaagataca

SEQ ID NO: 6885215 - DNA, 19 bp, Homo sapiens
ctttagaaactgagtcctg

SEQ ID NO: 6885216 - DNA, 15 bp, Homo sapiens
aataatttgcactga

SEQ ID NO: 6885217 - DNA, 13 bp, Homo sapiens
tctttttactgtt

SEQ ID NO: 6885218 - DNA, 13 bp, Homo sapiens
aatacactttatt

SEQ ID NO: 6885219 - DNA, 21 bp, Homo sapiens
cataggcaccttttactgtga

SEQ ID NO: 6885220 - DNA, 14 bp, Homo sapiens
tgaagccagctccc

SEQ ID NO: 6885221 - DNA, 16 bp, Homo sapiens
aagttacttgaatttc

SEQ ID NO: 6885222 - DNA, 19 bp, Homo sapiens
cctgctccacagccatccc

SEQ ID NO: 6885223 - DNA, 21 bp, Homo sapiens
gtaattatcgggaacagtgtt

SEQ ID NO: 6885224 - DNA, 15 bp, Homo sapiens
atcccctccctgcct

SEQ ID NO: 6885225 - DNA, 22 bp, Homo sapiens
ctttagatggtggcacattcct

SEQ ID NO: 6885226 - DNA, 13 bp, Homo sapiens
gcctggcttgtcg

SEQ ID NO: 6885227 - DNA, 16 bp, Homo sapiens
tgctccagcctctgcc

SEQ ID NO: 6885228 - DNA, 21 bp, Homo sapiens
tcctacccacacctctgccag

SEQ ID NO: 6885229 - DNA, 16 bp, Homo sapiens
tcctgggcagctgcct

SEQ ID NO: 6885230 - DNA, 21 bp, Homo sapiens
agtctccccgcagccctctcc

SEQ ID NO: 6885231 - DNA, 14 bp, Homo sapiens
ctgtattggcagca

SEQ ID NO: 6885232 - DNA, 16 bp, Homo sapiens
tgtaaagatttctgtt

SEQ ID NO: 6885233 - DNA, 18 bp, Homo sapiens
cccaaccaggccctgcca

SEQ ID NO: 6885234 - DNA, 20 bp, Homo sapiens
agacaggcctttccctgccg

SEQ ID NO: 6885235 - DNA, 15 bp, Homo sapiens
ccagagccaccaaag

SEQ ID NO: 6885236 - DNA, 13 bp, Homo sapiens
taaagtctgtctg

SEQ ID NO: 6885237 - DNA, 14 bp, Homo sapiens
gaattctactggaa

SEQ ID NO: 6885238 - DNA, 18 bp, Homo sapiens
ccctcgtcagctgggatg

SEQ ID NO: 6885239 - DNA, 15 bp, Homo sapiens
gccttcctcctctca

SEQ ID NO: 6885240 - DNA, 13 bp, Homo sapiens
tactgttcttgct

SEQ ID NO: 6885241 - DNA, 14 bp, Homo sapiens
cttttatagttgta

SEQ ID NO: 6885242 - DNA, 13 bp, Homo sapiens
aaggaatgcaaga

SEQ ID NO: 6885243 - DNA, 22 bp, Homo sapiens
cctggctggagaatgtggagaa

SEQ ID NO: 6885244 - DNA, 24 bp, Homo sapiens
atccgtgaggcagggacaagtctt

SEQ ID NO: 6885245 - DNA, 15 bp, Homo sapiens
ctcatacgtccacca

SEQ ID NO: 6885246 - DNA, 17 bp, Homo sapiens
ctttcttgtctttcctc

SEQ ID NO: 6885247 - DNA, 18 bp, Homo sapiens
aagatgcaaatgttttga

SEQ ID NO: 6885248 - DNA, 22 bp, Homo sapiens
cacacctcactgtcatctgcca

SEQ ID NO: 6885249 - DNA, 18 bp, Homo sapiens
gctcctgtggcagctgcc

SEQ ID NO: 6885250 - DNA, 12 bp, Homo sapiens
agagaagccata

SEQ ID NO: 6885251 - DNA, 16 bp, Homo sapiens
tgaaagtgatgacata

SEQ ID NO: 6885252 - DNA, 18 bp, Homo sapiens
ggtccggcagcttctgcc

SEQ ID NO: 6885253 - DNA, 16 bp, Homo sapiens
taccttcaataaagta

SEQ ID NO: 6885254 - DNA, 15 bp, Homo sapiens
agccccagcctgcta

SEQ ID NO: 6885255 - DNA, 20 bp, Homo sapiens
cccatctcatgcccctggct

SEQ ID NO: 6885256 - DNA, 17 bp, Homo sapiens
cccacggtttcagctag

SEQ ID NO: 6885257 - DNA, 17 bp, Homo sapiens
ggttctaaagttctaag

SEQ ID NO: 6885258 - DNA, 17 bp, Homo sapiens
tctggaaggctggctga

SEQ ID NO: 6885259 - DNA, 11 bp, Homo sapiens
tctcctgctgc

SEQ ID NO: 6885260 - DNA, 18 bp, Homo sapiens
cttatatagcacctttca

SEQ ID NO: 6885261 - DNA, 16 bp, Homo sapiens
cctctgaactgctgct

SEQ ID NO: 6885262 - DNA, 17 bp, Homo sapiens
gtggccccctcctcccc

SEQ ID NO: 6885263 - DNA, 20 bp, Homo sapiens
gtctgtaataatagactgta

SEQ ID NO: 6885264 - DNA, 23 bp, Homo sapiens
agagcttgctccagattctgatg

SEQ ID NO: 6885265 - DNA, 23 bp, Homo sapiens
acctcacccttgcaccgtcctca

SEQ ID NO: 6885266 - DNA, 19 bp, Homo sapiens
cagagccaagcactgctca

SEQ ID NO: 6885267 - DNA, 14 bp, Homo sapiens
ataaactagtttcc

SEQ ID NO: 6885268 - DNA, 19 bp, Homo sapiens
catgtgcacccggcctgga

SEQ ID NO: 6885269 - DNA, 13 bp, Homo sapiens
acttccccttgca

SEQ ID NO: 6885270 - DNA, 15 bp, Homo sapiens
agcactgctgcctca

SEQ ID NO: 6885271 - DNA, 17 bp, Homo sapiens
aataaattaatattgta

SEQ ID NO: 6885272 - DNA, 23 bp, Homo sapiens
aggcttccagagagtcctctgga

SEQ ID NO: 6885273 - DNA, 23 bp, Homo sapiens
cagacaggcaagcacctcctgcc

SEQ ID NO: 6885274 - DNA, 17 bp, Homo sapiens
cagaaatgtgctgcaaa

SEQ ID NO: 6885275 - DNA, 18 bp, Homo sapiens
attcccactgccgctgcc

SEQ ID NO: 6885276 - DNA, 19 bp, Homo sapiens
atgtgacttctcccctgcc

SEQ ID NO: 6885277 - DNA, 14 bp, Homo sapiens
ccctctgctgcttt

SEQ ID NO: 6885278 - DNA, 17 bp, Homo sapiens
ttggcagccatgataat

SEQ ID NO: 6885279 - DNA, 14 bp, Homo sapiens
agcacagctgggca

SEQ ID NO: 6885280 - DNA, 14 bp, Homo sapiens
aaacttttctgata

SEQ ID NO: 6885281 - DNA, 14 bp, Homo sapiens
agatgccccctcca

SEQ ID NO: 6885282 - DNA, 15 bp, Homo sapiens
acctgccctctctca

SEQ ID NO: 6885283 - DNA, 19 bp, Homo sapiens
ccagcacaactcagtctgt

SEQ ID NO: 6885284 - DNA, 20 bp, Homo sapiens
taaactgtgtggactgtgat

SEQ ID NO: 6885285 - DNA, 16 bp, Homo sapiens
cattccactccactca

SEQ ID NO: 6885286 - DNA, 12 bp, Homo sapiens
tgtggggccagg

SEQ ID NO: 6885287 - DNA, 18 bp, Homo sapiens
aagtgagctttgctgcta

SEQ ID NO: 6885288 - DNA, 15 bp, Homo sapiens
cacttatccctctcc

SEQ ID NO: 6885289 - DNA, 14 bp, Homo sapiens
cagagttatttccc

SEQ ID NO: 6885290 - DNA, 13 bp, Homo sapiens
aatgaatgtgcac

SEQ ID NO: 6885291 - DNA, 18 bp, Homo sapiens
gcctcccaactcacccca

SEQ ID NO: 6885292 - DNA, 18 bp, Homo sapiens
ccatttttcaaagcaatt

SEQ ID NO: 6885293 - DNA, 14 bp, Homo sapiens
tgaggtcctgagca

SEQ ID NO: 6885294 - DNA, 17 bp, Homo sapiens
cagtcacccttctgggc

SEQ ID NO: 6885295 - DNA, 17 bp, Homo sapiens
acaagacagaggggagc

SEQ ID NO: 6885296 - DNA, 13 bp, Homo sapiens
acactgtcttccc

SEQ ID NO: 6885297 - DNA, 18 bp, Homo sapiens
atggtggctttaggggaa

SEQ ID NO: 6885298 - DNA, 20 bp, Homo sapiens
cccaatcccagctacctcaa

SEQ ID NO: 6885299 - DNA, 17 bp, Homo sapiens
ccttcccctcccagccc

SEQ ID NO: 6885300 - DNA, 21 bp, Homo sapiens
cataagcctcaggcctggccc

SEQ ID NO: 6885301 - DNA, 17 bp, Homo sapiens
gccgccttaagctgatc

SEQ ID NO: 6885302 - DNA, 21 bp, Homo sapiens
catcctcctctccatgcaagt

SEQ ID NO: 6885303 - DNA, 19 bp, Homo sapiens
acccggattggccctgccc

SEQ ID NO: 6885304 - DNA, 14 bp, Homo sapiens
tgtctgctctgcat

SEQ ID NO: 6885305 - DNA, 16 bp, Homo sapiens
actcaatactacctct

SEQ ID NO: 6885306 - DNA, 16 bp, Homo sapiens
aacctggtttttgtat

SEQ ID NO: 6885307 - DNA, 16 bp, Homo sapiens
ccaaggcctctctctg

SEQ ID NO: 6885308 - DNA, 16 bp, Homo sapiens
aacctgcccctcccca

SEQ ID NO: 6885309 - DNA, 22 bp, Homo sapiens
cctgtgtggggaggcagctcca

SEQ ID NO: 6885310 - DNA, 21 bp, Homo sapiens
cagttcccagaaggcatatca

SEQ ID NO: 6885311 - DNA, 14 bp, Homo sapiens
ctgtggccctgccc

SEQ ID NO: 6885312 - DNA, 22 bp, Homo sapiens
acagatctggaacctcagcctg

SEQ ID NO: 6885313 - DNA, 15 bp, Homo sapiens
aggttcctctgcctg

SEQ ID NO: 6885314 - DNA, 16 bp, Homo sapiens
tggccccgcccctgcc

SEQ ID NO: 6885315 - DNA, 23 bp, Homo sapiens
cccttccccatgcttccttgcct

SEQ ID NO: 6885316 - DNA, 23 bp, Homo sapiens
tacctgatggaagtaaagcctca

SEQ ID NO: 6885317 - DNA, 17 bp, Homo sapiens
tcatactcgagtctgag

SEQ ID NO: 6885318 - DNA, 19 bp, Homo sapiens
caggatctcctgccagccc

SEQ ID NO: 6885319 - DNA, 20 bp, Homo sapiens
cctgctggcctgctcttact

SEQ ID NO: 6885320 - DNA, 18 bp, Homo sapiens
gaatcttgtctcaatgct

SEQ ID NO: 6885321 - DNA, 20 bp, Homo sapiens
cccagcccaaattctcctct

SEQ ID NO: 6885322 - DNA, 13 bp, Homo sapiens
cacacctcagccc

SEQ ID NO: 6885323 - DNA, 15 bp, Homo sapiens
ccacctgtacataca

SEQ ID NO: 6885324 - DNA, 18 bp, Homo sapiens
ttaagtattccttggccc

SEQ ID NO: 6885325 - DNA, 21 bp, Homo sapiens
cctgatccctgatcccttcca

SEQ ID NO: 6885326 - DNA, 14 bp, Homo sapiens
agatttatctggat

SEQ ID NO: 6885327 - DNA, 13 bp, Homo sapiens
cctctccatgcaa

SEQ ID NO: 6885328 - DNA, 14 bp, Homo sapiens
acaaagatatcttt

SEQ ID NO: 6885329 - DNA, 19 bp, Homo sapiens
cacgtctggctccctgccc

SEQ ID NO: 6885330 - DNA, 20 bp, Homo sapiens
catctgccccaggtacacct

SEQ ID NO: 6885331 - DNA, 16 bp, Homo sapiens
cagctttcaaagcatt

SEQ ID NO: 6885332 - DNA, 12 bp, Homo sapiens
accgggcctccc

SEQ ID NO: 6885333 - DNA, 17 bp, Homo sapiens
accgcgactaatttcaa

SEQ ID NO: 6885334 - DNA, 21 bp, Homo sapiens
agctcctctccccagcccaga

SEQ ID NO: 6885335 - DNA, 15 bp, Homo sapiens
tgtgctgcctgtggt

SEQ ID NO: 6885336 - DNA, 15 bp, Homo sapiens
tgtacatactggcct

SEQ ID NO: 6885337 - DNA, 17 bp, Homo sapiens
tgacaatgctgccatgc

SEQ ID NO: 6885338 - DNA, 19 bp, Homo sapiens
agattcaggtatgttgcct

SEQ ID NO: 6885339 - DNA, 22 bp, Homo sapiens
gcctcgtgccagcagcctcgca

SEQ ID NO: 6885340 - DNA, 15 bp, Homo sapiens
atttttgctgaattc

SEQ ID NO: 6885341 - DNA, 17 bp, Homo sapiens
cacggtgacacaggtca

SEQ ID NO: 6885342 - DNA, 13 bp, Homo sapiens
taggttaagtctc

SEQ ID NO: 6885343 - DNA, 15 bp, Homo sapiens
tcaccttctttgtaa

SEQ ID NO: 6885344 - DNA, 20 bp, Homo sapiens
cttccagaagatgccctcca

SEQ ID NO: 6885345 - DNA, 16 bp, Homo sapiens
atgctgggctgacggt

SEQ ID NO: 6885346 - DNA, 23 bp, Homo sapiens
gtcatataattaaagactcaaga

SEQ ID NO: 6885347 - DNA, 14 bp, Homo sapiens
tagttatgtctttt

SEQ ID NO: 6885348 - DNA, 19 bp, Homo sapiens
cagctttttattccctgcc

SEQ ID NO: 6885349 - DNA, 23 bp, Homo sapiens
ctgggaaaaactttggaaccaga

SEQ ID NO: 6885350 - DNA, 13 bp, Homo sapiens
tttttttatactg

SEQ ID NO: 6885351 - DNA, 22 bp, Homo sapiens
aaatgttatttccctacattaa

SEQ ID NO: 6885352 - DNA, 18 bp, Homo sapiens
ccctggctccctcctcca

SEQ ID NO: 6885353 - DNA, 22 bp, Homo sapiens
tttagcaatttaatattttgca

SEQ ID NO: 6885354 - DNA, 14 bp, Homo sapiens
tttcctgagctgtc

SEQ ID NO: 6885355 - DNA, 19 bp, Homo sapiens
gagttcaatggctgctgaa

SEQ ID NO: 6885356 - DNA, 21 bp, Homo sapiens
cctgccacgaatttctgtgcc

SEQ ID NO: 6885357 - DNA, 13 bp, Homo sapiens
acactcagaagcc

SEQ ID NO: 6885358 - DNA, 15 bp, Homo sapiens
ctgatcatgcattgt

SEQ ID NO: 6885359 - DNA, 14 bp, Homo sapiens
actttagatgctga

SEQ ID NO: 6885360 - DNA, 15 bp, Homo sapiens
aacgctacctctctg

SEQ ID NO: 6885361 - DNA, 16 bp, Homo sapiens
catcccccctgctgcc

SEQ ID NO: 6885362 - DNA, 21 bp, Homo sapiens
caggaactcgcacctgtgctg

SEQ ID NO: 6885363 - DNA, 23 bp, Homo sapiens
attatgggtatgtgttgccaaag

SEQ ID NO: 6885364 - DNA, 15 bp, Homo sapiens
ttgttttctgactaa

SEQ ID NO: 6885365 - DNA, 18 bp, Homo sapiens
gcattaagggcctgctgg

SEQ ID NO: 6885366 - DNA, 19 bp, Homo sapiens
cagatgaccgtgtacaata

SEQ ID NO: 6885367 - DNA, 15 bp, Homo sapiens
aattttaaaagcata

SEQ ID NO: 6885368 - DNA, 16 bp, Homo sapiens
acacactacaccacac

SEQ ID NO: 6885369 - DNA, 16 bp, Homo sapiens
gaatgtaccttattta

SEQ ID NO: 6885370 - DNA, 21 bp, Homo sapiens
ccagtgacttgttctgagtaa

SEQ ID NO: 6885371 - DNA, 21 bp, Homo sapiens
ttggcagatgcagctcttcct

SEQ ID NO: 6885372 - DNA, 19 bp, Homo sapiens
cactcctgggctctgaaca

SEQ ID NO: 6885373 - DNA, 22 bp, Homo sapiens
cataatcttaaactcttgaata

SEQ ID NO: 6885374 - DNA, 20 bp, Homo sapiens
aaaatttattctacttttaa

SEQ ID NO: 6885375 - DNA, 20 bp, Homo sapiens
ctccagcaactgcccttcca

SEQ ID NO: 6885376 - DNA, 15 bp, Homo sapiens
caatcttgctgtgaa

SEQ ID NO: 6885377 - DNA, 14 bp, Homo sapiens
cccagtatacctca

SEQ ID NO: 6885378 - DNA, 12 bp, Homo sapiens
acagctctggcc

SEQ ID NO: 6885379 - DNA, 23 bp, Homo sapiens
ctttaagcaaggtgtccctgcct

SEQ ID NO: 6885380 - DNA, 20 bp, Homo sapiens
tgtggcacagccctgagtgt

SEQ ID NO: 6885381 - DNA, 20 bp, Homo sapiens
ctgttgcagtggcctggccg

SEQ ID NO: 6885382 - DNA, 22 bp, Homo sapiens
caagactgaaatggcttctatg

SEQ ID NO: 6885383 - DNA, 19 bp, Homo sapiens
caacatgtatctgtctact

SEQ ID NO: 6885384 - DNA, 17 bp, Homo sapiens
ctccagtataatctcct

SEQ ID NO: 6885385 - DNA, 22 bp, Homo sapiens
aaaagttgataggagacttgta

SEQ ID NO: 6885386 - DNA, 17 bp, Homo sapiens
cgggaagcatcctcccc

SEQ ID NO: 6885387 - DNA, 22 bp, Homo sapiens
agccgtgctgagcacacaacag

SEQ ID NO: 6885388 - DNA, 22 bp, Homo sapiens
ccaagtgccagtcttgtgtctg

SEQ ID NO: 6885389 - DNA, 15 bp, Homo sapiens
ttctgttagctgctc

SEQ ID NO: 6885390 - DNA, 21 bp, Homo sapiens
gctcccacacccacctctgcc

SEQ ID NO: 6885391 - DNA, 15 bp, Homo sapiens
agaattgacattgaa

SEQ ID NO: 6885392 - DNA, 13 bp, Homo sapiens
actctcctctgct

SEQ ID NO: 6885393 - DNA, 18 bp, Homo sapiens
aagtgggctcctgacaat

SEQ ID NO: 6885394 - DNA, 23 bp, Homo sapiens
cctctcatccaggtcctttcctt

SEQ ID NO: 6885395 - DNA, 16 bp, Homo sapiens
ccatcttacagagact

SEQ ID NO: 6885396 - DNA, 21 bp, Homo sapiens
cagaaatgtatggcatgtgta

SEQ ID NO: 6885397 - DNA, 17 bp, Homo sapiens
cctctcatgtccctcca

SEQ ID NO: 6885398 - DNA, 16 bp, Homo sapiens
tgtgtcatgccagtga

SEQ ID NO: 6885399 - DNA, 21 bp, Homo sapiens
ccctgggggcatcctgcttcc

SEQ ID NO: 6885400 - DNA, 22 bp, Homo sapiens
gatattgcagtaatgatattta

SEQ ID NO: 6885401 - DNA, 13 bp, Homo sapiens
cctccaccttcca

SEQ ID NO: 6885402 - DNA, 16 bp, Homo sapiens
cacttttttcctgtca

SEQ ID NO: 6885403 - DNA, 17 bp, Homo sapiens
ttcctgcctttaagcca

SEQ ID NO: 6885404 - DNA, 13 bp, Homo sapiens
agctttctttccc

SEQ ID NO: 6885405 - DNA, 19 bp, Homo sapiens
catcccgcttagcctgcct

SEQ ID NO: 6885406 - DNA, 14 bp, Homo sapiens
cgccagtcactgct

SEQ ID NO: 6885407 - DNA, 19 bp, Homo sapiens
ctttctcctggcccctgcc

SEQ ID NO: 6885408 - DNA, 16 bp, Homo sapiens
aggattttaccaaagc

SEQ ID NO: 6885409 - DNA, 22 bp, Homo sapiens
cctctcatctatgctctttcct

SEQ ID NO: 6885410 - DNA, 17 bp, Homo sapiens
cctcggatccccttcct

SEQ ID NO: 6885411 - DNA, 12 bp, Homo sapiens
gactttcctgca

SEQ ID NO: 6885412 - DNA, 17 bp, Homo sapiens
cgtcccgggcactgtca

SEQ ID NO: 6885413 - DNA, 18 bp, Homo sapiens
attattcaaagttgccta

SEQ ID NO: 6885414 - DNA, 18 bp, Homo sapiens
ttcaatttgctatttaca

SEQ ID NO: 6885415 - DNA, 17 bp, Homo sapiens
caaaccaaatcactgaa

SEQ ID NO: 6885416 - DNA, 17 bp, Homo sapiens
cctctcctccccttcct

SEQ ID NO: 6885417 - DNA, 19 bp, Homo sapiens
gccatgaatctctgcctct

SEQ ID NO: 6885418 - DNA, 15 bp, Homo sapiens
gccctggtgctgcca

SEQ ID NO: 6885419 - DNA, 14 bp, Homo sapiens
gaatgcctcctgca

SEQ ID NO: 6885420 - DNA, 21 bp, Homo sapiens
agcttggctcgatgtttgcca

SEQ ID NO: 6885421 - DNA, 23 bp, Homo sapiens
ggtgggggtagagctgatccaga

SEQ ID NO: 6885422 - DNA, 13 bp, Homo sapiens
tgtcgcctctgca

SEQ ID NO: 6885423 - DNA, 16 bp, Homo sapiens
taaaatttatattgta

SEQ ID NO: 6885424 - DNA, 15 bp, Homo sapiens
gccacagcctgctgg

SEQ ID NO: 6885425 - DNA, 16 bp, Homo sapiens
accgcgcccctctgcg

SEQ ID NO: 6885426 - DNA, 13 bp, Homo sapiens
agcccgcctgcca

SEQ ID NO: 6885427 - DNA, 20 bp, Homo sapiens
ctgccaggattgtcactcca

SEQ ID NO: 6885428 - DNA, 19 bp, Homo sapiens
ctgtagaggagcctggagt

SEQ ID NO: 6885429 - DNA, 22 bp, Homo sapiens
tcctgggcatccccagccccct

SEQ ID NO: 6885430 - DNA, 14 bp, Homo sapiens
ccacgccccagccc

SEQ ID NO: 6885431 - DNA, 13 bp, Homo sapiens
aagtccactgtcc

SEQ ID NO: 6885432 - DNA, 20 bp, Homo sapiens
cttatttaaaactcacctcc

SEQ ID NO: 6885433 - DNA, 18 bp, Homo sapiens
gactgctgcgctgtgctg

SEQ ID NO: 6885434 - DNA, 15 bp, Homo sapiens
ctcactgtggggcat

SEQ ID NO: 6885435 - DNA, 13 bp, Homo sapiens
aataaaagaacat

SEQ ID NO: 6885436 - DNA, 20 bp, Homo sapiens
agaatttaatggactgtgaa

SEQ ID NO: 6885437 - DNA, 18 bp, Homo sapiens
aactgattgctcccagga

SEQ ID NO: 6885438 - DNA, 14 bp, Homo sapiens
ctgacatctcctct

SEQ ID NO: 6885439 - DNA, 14 bp, Homo sapiens
gaaatgtctctgct

SEQ ID NO: 6885440 - DNA, 18 bp, Homo sapiens
ccgtccgcccgcccaccc

SEQ ID NO: 6885441 - DNA, 22 bp, Homo sapiens
aacagtttatgcagtgctgctt

SEQ ID NO: 6885442 - DNA, 14 bp, Homo sapiens
gggcctctggctgc

SEQ ID NO: 6885443 - DNA, 20 bp, Homo sapiens
actccgtgaggctgctgcca

SEQ ID NO: 6885444 - DNA, 22 bp, Homo sapiens
tagagatattttgtaaaatgta

SEQ ID NO: 6885445 - DNA, 20 bp, Homo sapiens
acatacctactgactgatga

SEQ ID NO: 6885446 - DNA, 20 bp, Homo sapiens
gcccctgggctctcacccag

SEQ ID NO: 6885447 - DNA, 17 bp, Homo sapiens
tgcctggtactctggca

SEQ ID NO: 6885448 - DNA, 22 bp, Homo sapiens
tgccagggaactggcctgctgc

SEQ ID NO: 6885449 - DNA, 17 bp, Homo sapiens
aactcttaactgaagaa

SEQ ID NO: 6885450 - DNA, 15 bp, Homo sapiens
gccaggtcacacgac

SEQ ID NO: 6885451 - DNA, 17 bp, Homo sapiens
tgtgtcaggccctctgc

SEQ ID NO: 6885452 - DNA, 13 bp, Homo sapiens
tgggccagcctca

SEQ ID NO: 6885453 - DNA, 12 bp, Homo sapiens
atcagcccaggt

SEQ ID NO: 6885454 - DNA, 12 bp, Homo sapiens
acctcactgcct

SEQ ID NO: 6885455 - DNA, 14 bp, Homo sapiens
cttggactcttgct

SEQ ID NO: 6885456 - DNA, 19 bp, Homo sapiens
ctcagcggaccactcttct

SEQ ID NO: 6885457 - DNA, 13 bp, Homo sapiens
cctctctgcttca

SEQ ID NO: 6885458 - DNA, 15 bp, Homo sapiens
acctcagcctcctgt

SEQ ID NO: 6885459 - DNA, 15 bp, Homo sapiens
acatcttcagctccc

SEQ ID NO: 6885460 - DNA, 17 bp, Homo sapiens
ggaatttccctgtgtgg

SEQ ID NO: 6885461 - DNA, 14 bp, Homo sapiens
tgactctcctgcct

SEQ ID NO: 6885462 - DNA, 17 bp, Homo sapiens
cctctcccttcccttcc

SEQ ID NO: 6885463 - DNA, 12 bp, Homo sapiens
cattatccttta

SEQ ID NO: 6885464 - DNA, 11 bp, Homo sapiens
ctttgctgcta

SEQ ID NO: 6885465 - DNA, 13 bp, Homo sapiens
atcaggtctccca

SEQ ID NO: 6885466 - DNA, 17 bp, Homo sapiens
ttttcagaacctcttcc

SEQ ID NO: 6885467 - DNA, 18 bp, Homo sapiens
atatgaatattacatgta

SEQ ID NO: 6885468 - DNA, 17 bp, Homo sapiens
gatgtaaaatcttgtca

SEQ ID NO: 6885469 - DNA, 14 bp, Homo sapiens
atttcatatctaca

SEQ ID NO: 6885470 - DNA, 15 bp, Homo sapiens
cctttgctccctccc

SEQ ID NO: 6885471 - DNA, 16 bp, Homo sapiens
catcacttttcagtga

SEQ ID NO: 6885472 - DNA, 17 bp, Homo sapiens
ccttggcttctgtgatg

SEQ ID NO: 6885473 - DNA, 20 bp, Homo sapiens
ttctgattggacctggccca

SEQ ID NO: 6885474 - DNA, 17 bp, Homo sapiens
ctcctgggcagctgcct

SEQ ID NO: 6885475 - DNA, 17 bp, Homo sapiens
cactgtcactttgctct

SEQ ID NO: 6885476 - DNA, 14 bp, Homo sapiens
ctgcagccctgcca

SEQ ID NO: 6885477 - DNA, 16 bp, Homo sapiens
tcctgcctcagcctcc

SEQ ID NO: 6885478 - DNA, 14 bp, Homo sapiens
gctcaacacatgag

SEQ ID NO: 6885479 - DNA, 13 bp, Homo sapiens
ccctcttccatca

SEQ ID NO: 6885480 - DNA, 10 bp, Homo sapiens
ttctgtgcct

SEQ ID NO: 6885481 - DNA, 11 bp, Homo sapiens
ctttcctcccc

SEQ ID NO: 6885482 - DNA, 11 bp, Homo sapiens
ctctcctccct

SEQ ID NO: 6885483 - DNA, 21 bp, Homo sapiens
gaaccagtgtaactggctgct

SEQ ID NO: 6885484 - DNA, 17 bp, Homo sapiens
gagactcagcctctgct

SEQ ID NO: 6885485 - DNA, 17 bp, Homo sapiens
aaaaatgcctgctgctg

SEQ ID NO: 6885486 - DNA, 14 bp, Homo sapiens
acaataaagactga

SEQ ID NO: 6885487 - DNA, 23 bp, Homo sapiens
aggcacatcattggaatacagga

SEQ ID NO: 6885488 - DNA, 15 bp, Homo sapiens
ctttttactgttgaa

SEQ ID NO: 6885489 - DNA, 14 bp, Homo sapiens
accatctgctgcag

SEQ ID NO: 6885490 - DNA, 20 bp, Homo sapiens
actgttatcagtaatgctaa

SEQ ID NO: 6885491 - DNA, 15 bp, Homo sapiens
caataggtaaagcta

SEQ ID NO: 6885492 - DNA, 19 bp, Homo sapiens
cagggctcagcctggtggg

SEQ ID NO: 6885493 - DNA, 18 bp, Homo sapiens
ctctgccagtcctgtcct

SEQ ID NO: 6885494 - DNA, 23 bp, Homo sapiens
tctttgtggccaaggagctgcta

SEQ ID NO: 6885495 - DNA, 16 bp, Homo sapiens
ccgaactgtgccttcg

SEQ ID NO: 6885496 - DNA, 21 bp, Homo sapiens
gagggcgtcaggcagaggcaa

SEQ ID NO: 6885497 - DNA, 22 bp, Homo sapiens
cttttttttttttttggttgca

SEQ ID NO: 6885498 - DNA, 16 bp, Homo sapiens
cctcaggacccatccc

SEQ ID NO: 6885499 - DNA, 16 bp, Homo sapiens
catccagcctcagaga

SEQ ID NO: 6885500 - DNA, 23 bp, Homo sapiens
ccagcttattgtgtgcgctgcct

SEQ ID NO: 6885501 - DNA, 15 bp, Homo sapiens
catgccctcctctcc

SEQ ID NO: 6885502 - DNA, 19 bp, Homo sapiens
agcaatattgtatattttt

SEQ ID NO: 6885503 - DNA, 16 bp, Homo sapiens
tcataggtacaatctt

SEQ ID NO: 6885504 - DNA, 14 bp, Homo sapiens
tcatgcattactta

SEQ ID NO: 6885505 - DNA, 14 bp, Homo sapiens
cacagttgtgttca

SEQ ID NO: 6885506 - DNA, 15 bp, Homo sapiens
cctcccacctcagcc

SEQ ID NO: 6885507 - DNA, 18 bp, Homo sapiens
ccaggaagccccgctcag

SEQ ID NO: 6885508 - DNA, 17 bp, Homo sapiens
tgatacccccctctgtc

SEQ ID NO: 6885509 - DNA, 23 bp, Homo sapiens
atatttataattaaagaaaattg

SEQ ID NO: 6885510 - DNA, 14 bp, Homo sapiens
aggatccgctgcca

SEQ ID NO: 6885511 - DNA, 22 bp, Homo sapiens
cctgcccgccccaagccctgcc

SEQ ID NO: 6885512 - DNA, 18 bp, Homo sapiens
ccctttacaatgtgaata

SEQ ID NO: 6885513 - DNA, 22 bp, Homo sapiens
cagagtgactgacggctgtgta

SEQ ID NO: 6885514 - DNA, 22 bp, Homo sapiens
cctcccatgagactgccctgcc

SEQ ID NO: 6885515 - DNA, 16 bp, Homo sapiens
ctcctgggcagctgcc

SEQ ID NO: 6885516 - DNA, 14 bp, Homo sapiens
gaaatgctgattta

SEQ ID NO: 6885517 - DNA, 14 bp, Homo sapiens
cctctccccagccc

SEQ ID NO: 6885518 - DNA, 22 bp, Homo sapiens
acagctttctaactcacaggca

SEQ ID NO: 6885519 - DNA, 13 bp, Homo sapiens
tcctccctctgac

SEQ ID NO: 6885520 - DNA, 23 bp, Homo sapiens
cctgccttgatgaagcctgtgcc

SEQ ID NO: 6885521 - DNA, 12 bp, Homo sapiens
cggctcctcccc

SEQ ID NO: 6885522 - DNA, 11 bp, Homo sapiens
gaaattctgtt

SEQ ID NO: 6885523 - DNA, 15 bp, Homo sapiens
taccgagtatctgta

SEQ ID NO: 6885524 - DNA, 21 bp, Homo sapiens
agcccctttaaatcaccatag

SEQ ID NO: 6885525 - DNA, 15 bp, Homo sapiens
ccgtccctcctctcc

SEQ ID NO: 6885526 - DNA, 20 bp, Homo sapiens
acgttgtttcttatagattt

SEQ ID NO: 6885527 - DNA, 21 bp, Homo sapiens
atctttgtattcttcatgaaa

SEQ ID NO: 6885528 - DNA, 13 bp, Homo sapiens
tagcgagctgctc

SEQ ID NO: 6885529 - DNA, 17 bp, Homo sapiens
agctcacaagcccaggc

SEQ ID NO: 6885530 - DNA, 17 bp, Homo sapiens
tggggaaatgtggagaa

SEQ ID NO: 6885531 - DNA, 16 bp, Homo sapiens
gcttcgactactgctc

SEQ ID NO: 6885532 - DNA, 21 bp, Homo sapiens
gtttatattagataaccatat

SEQ ID NO: 6885533 - DNA, 22 bp, Homo sapiens
cctgttcacgctcacccagtca

SEQ ID NO: 6885534 - DNA, 12 bp, Homo sapiens
gggaagcccgga

SEQ ID NO: 6885535 - DNA, 21 bp, Homo sapiens
cagtgcatccttgaactgtca

SEQ ID NO: 6885536 - DNA, 16 bp, Homo sapiens
accctcacacacacag

SEQ ID NO: 6885537 - DNA, 14 bp, Homo sapiens
agtccgctgaagat

SEQ ID NO: 6885538 - DNA, 19 bp, Homo sapiens
tggggcgggtcctagctgt

SEQ ID NO: 6885539 - DNA, 14 bp, Homo sapiens
tatctgtctttatg

SEQ ID NO: 6885540 - DNA, 20 bp, Homo sapiens
gcctcatttcttcctctgca

SEQ ID NO: 6885541 - DNA, 14 bp, Homo sapiens
ccagctccacacat

SEQ ID NO: 6885542 - DNA, 18 bp, Homo sapiens
gggattatgggtcacagg

SEQ ID NO: 6885543 - DNA, 17 bp, Homo sapiens
acaagatggttctagca

SEQ ID NO: 6885544 - DNA, 17 bp, Homo sapiens
cactaaaccacttctct

SEQ ID NO: 6885545 - DNA, 17 bp, Homo sapiens
tactcaatactacctct

SEQ ID NO: 6885546 - DNA, 23 bp, Homo sapiens
ccaacagatgagcgaaaatgtat

SEQ ID NO: 6885547 - DNA, 20 bp, Homo sapiens
tccccctcccccactgccat

SEQ ID NO: 6885548 - DNA, 19 bp, Homo sapiens
caatgattgtttaattgta

SEQ ID NO: 6885549 - DNA, 16 bp, Homo sapiens
cattccatcacagcca

SEQ ID NO: 6885550 - DNA, 16 bp, Homo sapiens
tacaagtaaattctgt

SEQ ID NO: 6885551 - DNA, 11 bp, Homo sapiens
ttacatcttta

SEQ ID NO: 6885552 - DNA, 13 bp, Homo sapiens
tcccccagctcct

SEQ ID NO: 6885553 - DNA, 13 bp, Homo sapiens
ggtgagaacccag

SEQ ID NO: 6885554 - DNA, 20 bp, Homo sapiens
cagctccccaggactcaccc

SEQ ID NO: 6885555 - DNA, 13 bp, Homo sapiens
tccctctgcctca

SEQ ID NO: 6885556 - DNA, 15 bp, Homo sapiens
cctctgccccctccc

SEQ ID NO: 6885557 - DNA, 20 bp, Homo sapiens
cttataagcccagctctgct

SEQ ID NO: 6885558 - DNA, 11 bp, Homo sapiens
caaactccagg

SEQ ID NO: 6885559 - DNA, 21 bp, Homo sapiens
cttcctgcttaaacttgaccc

SEQ ID NO: 6885560 - DNA, 23 bp, Homo sapiens
aggtgcccactccgccagccaca

SEQ ID NO: 6885561 - DNA, 19 bp, Homo sapiens
aactaatctattgggttca

SEQ ID NO: 6885562 - DNA, 18 bp, Homo sapiens
gaaatgtggtcctattta

SEQ ID NO: 6885563 - DNA, 15 bp, Homo sapiens
ccacctccccagcct

SEQ ID NO: 6885564 - DNA, 20 bp, Homo sapiens
tccaccccagtgcacccact

SEQ ID NO: 6885565 - DNA, 15 bp, Homo sapiens
tccagtgctggctgc

SEQ ID NO: 6885566 - DNA, 14 bp, Homo sapiens
accttacattccta

SEQ ID NO: 6885567 - DNA, 18 bp, Homo sapiens
aaagtggttctctgcctt

SEQ ID NO: 6885568 - DNA, 22 bp, Homo sapiens
acttcctgtccagctccaacct

SEQ ID NO: 6885569 - DNA, 14 bp, Homo sapiens
caggtgctcagccc

SEQ ID NO: 6885570 - DNA, 23 bp, Homo sapiens
ctttacattttcagtaccaaaga

SEQ ID NO: 6885571 - DNA, 20 bp, Homo sapiens
cccggacatactctctgcct

SEQ ID NO: 6885572 - DNA, 18 bp, Homo sapiens
ctgcttttcactgctgca

SEQ ID NO: 6885573 - DNA, 12 bp, Homo sapiens
catttctgcctc

SEQ ID NO: 6885574 - DNA, 17 bp, Homo sapiens
ccattgaccacccacca

SEQ ID NO: 6885575 - DNA, 14 bp, Homo sapiens
catgctctggaagc

SEQ ID NO: 6885576 - DNA, 20 bp, Homo sapiens
cagcttgtccttgctcctgg

SEQ ID NO: 6885577 - DNA, 20 bp, Homo sapiens
caccagtctgtctactgtgg

SEQ ID NO: 6885578 - DNA, 16 bp, Homo sapiens
acagcagtctccttca

SEQ ID NO: 6885579 - DNA, 22 bp, Homo sapiens
acacacagaaaatatactgtaa

SEQ ID NO: 6885580 - DNA, 13 bp, Homo sapiens
caagccctggccc

SEQ ID NO: 6885581 - DNA, 20 bp, Homo sapiens
caaacattaatcaccaaagt

SEQ ID NO: 6885582 - DNA, 18 bp, Homo sapiens
ccttcacaaccagccaca

SEQ ID NO: 6885583 - DNA, 14 bp, Homo sapiens
taaactagtttcca

SEQ ID NO: 6885584 - DNA, 12 bp, Homo sapiens
ttgttgcactgc

SEQ ID NO: 6885585 - DNA, 14 bp, Homo sapiens
atagctatatccat

SEQ ID NO: 6885586 - DNA, 21 bp, Homo sapiens
cccaaattgtcacctgcttct

SEQ ID NO: 6885587 - DNA, 18 bp, Homo sapiens
gatcacttgagcccagga

SEQ ID NO: 6885588 - DNA, 22 bp, Homo sapiens
ttgtaacccagattttgctgta

SEQ ID NO: 6885589 - DNA, 22 bp, Homo sapiens
tccagaaagcaggagcagctgt

SEQ ID NO: 6885590 - DNA, 11 bp, Homo sapiens
actgtgcagtt

SEQ ID NO: 6885591 - DNA, 17 bp, Homo sapiens
tataaatgactattgta

SEQ ID NO: 6885592 - DNA, 15 bp, Homo sapiens
gaagttcatcttgca

SEQ ID NO: 6885593 - DNA, 17 bp, Homo sapiens
tcaggatgcacatttct

SEQ ID NO: 6885594 - DNA, 12 bp, Homo sapiens
acaccactgccc

SEQ ID NO: 6885595 - DNA, 20 bp, Homo sapiens
aggacagagctggctgtctt

SEQ ID NO: 6885596 - DNA, 16 bp, Homo sapiens
ttccggcacactgcca

SEQ ID NO: 6885597 - DNA, 15 bp, Homo sapiens
ccttcaacccagtgg

SEQ ID NO: 6885598 - DNA, 13 bp, Homo sapiens
gctttcctgctgg

SEQ ID NO: 6885599 - DNA, 14 bp, Homo sapiens
agcccccaacacag

SEQ ID NO: 6885600 - DNA, 21 bp, Homo sapiens
ctgaccaaaatgtgtttcata

SEQ ID NO: 6885601 - DNA, 21 bp, Homo sapiens
ttccctgggggcatcctgctt

SEQ ID NO: 6885602 - DNA, 15 bp, Homo sapiens
tgccactctgctgcc

SEQ ID NO: 6885603 - DNA, 17 bp, Homo sapiens
gttaacaaccctgttga

SEQ ID NO: 6885604 - DNA, 17 bp, Homo sapiens
atatgtaatatatacat

SEQ ID NO: 6885605 - DNA, 13 bp, Homo sapiens
tacaaagaaataa

SEQ ID NO: 6885606 - DNA, 23 bp, Homo sapiens
tccagcagtgttgctcagctcct

SEQ ID NO: 6885607 - DNA, 21 bp, Homo sapiens
caaaggtcaaaaacaaactag

SEQ ID NO: 6885608 - DNA, 16 bp, Homo sapiens
ccttcacaaccagcca

SEQ ID NO: 6885609 - DNA, 16 bp, Homo sapiens
tgggtagcctgggtgt

SEQ ID NO: 6885610 - DNA, 20 bp, Homo sapiens
cacaaccctgttgctacatc

SEQ ID NO: 6885611 - DNA, 23 bp, Homo sapiens
agctgaagacaaaccactgtaca

SEQ ID NO: 6885612 - DNA, 16 bp, Homo sapiens
agaagatagcatggga

SEQ ID NO: 6885613 - DNA, 13 bp, Homo sapiens
cttgttgcactgc

SEQ ID NO: 6885614 - DNA, 18 bp, Homo sapiens
agtccccacccgcctgca

SEQ ID NO: 6885615 - DNA, 20 bp, Homo sapiens
cattgggcagcgcccttcct

SEQ ID NO: 6885616 - DNA, 23 bp, Homo sapiens
tttggaagagaggcacctgctgg

SEQ ID NO: 6885617 - DNA, 16 bp, Homo sapiens
tgcttttgtttgctct

SEQ ID NO: 6885618 - DNA, 13 bp, Homo sapiens
tccacatctgcct

SEQ ID NO: 6885619 - DNA, 14 bp, Homo sapiens
cccggcctcttcca

SEQ ID NO: 6885620 - DNA, 23 bp, Homo sapiens
ccttatctccacaacctcttccc

SEQ ID NO: 6885621 - DNA, 21 bp, Homo sapiens
ctcccagaaacatctctggcc

SEQ ID NO: 6885622 - DNA, 18 bp, Homo sapiens
tgtatatttagttacgta

SEQ ID NO: 6885623 - DNA, 17 bp, Homo sapiens
gcattcatgtattttgt

SEQ ID NO: 6885624 - DNA, 19 bp, Homo sapiens
ttcagaacttcatctgcca

SEQ ID NO: 6885625 - DNA, 23 bp, Homo sapiens
taactatggtaaataactgtgac

SEQ ID NO: 6885626 - DNA, 20 bp, Homo sapiens
ctgttcttgttacggcagtc

SEQ ID NO: 6885627 - DNA, 22 bp, Homo sapiens
ttaaacttttatgcgcaaatac

SEQ ID NO: 6885628 - DNA, 23 bp, Homo sapiens
tcacaggatgccagcccctgcct

SEQ ID NO: 6885629 - DNA, 14 bp, Homo sapiens
gtaattttgccaaa

SEQ ID NO: 6885630 - DNA, 21 bp, Homo sapiens
taaattctggtatacattgaa

SEQ ID NO: 6885631 - DNA, 15 bp, Homo sapiens
attcctgagtcttcc

SEQ ID NO: 6885632 - DNA, 12 bp, Homo sapiens
acctctcagggc

SEQ ID NO: 6885633 - DNA, 22 bp, Homo sapiens
cctagaaacctttatccctgct

SEQ ID NO: 6885634 - DNA, 17 bp, Homo sapiens
cattgtgaactgacagg

SEQ ID NO: 6885635 - DNA, 16 bp, Homo sapiens
tgcatagtgctgggat

SEQ ID NO: 6885636 - DNA, 14 bp, Homo sapiens
ccaggccagctcag

SEQ ID NO: 6885637 - DNA, 18 bp, Homo sapiens
agaaattacacccaaaga

SEQ ID NO: 6885638 - DNA, 23 bp, Homo sapiens
tgagttgtataaaagttgtactg

SEQ ID NO: 6885639 - DNA, 16 bp, Homo sapiens
ccccggacctacctcc

SEQ ID NO: 6885640 - DNA, 21 bp, Homo sapiens
accagcctccatgctgcctcc

SEQ ID NO: 6885641 - DNA, 13 bp, Homo sapiens
cctccacctctcc

SEQ ID NO: 6885642 - DNA, 21 bp, Homo sapiens
cttgctttctctctcatgcct

SEQ ID NO: 6885643 - DNA, 16 bp, Homo sapiens
cttcccacacctgcct

SEQ ID NO: 6885644 - DNA, 18 bp, Homo sapiens
tgcatatttctgtatatt

SEQ ID NO: 6885645 - DNA, 13 bp, Homo sapiens
ccttaaaatggaa

SEQ ID NO: 6885646 - DNA, 14 bp, Homo sapiens
acgttcacccctcc

SEQ ID NO: 6885647 - DNA, 16 bp, Homo sapiens
ctctctccctacctcc

SEQ ID NO: 6885648 - DNA, 14 bp, Homo sapiens
cccgccccctccct

SEQ ID NO: 6885649 - DNA, 23 bp, Homo sapiens
ggccagagcagctccaccactgt

SEQ ID NO: 6885650 - DNA, 22 bp, Homo sapiens
tttcctcatcctttccctctcc

SEQ ID NO: 6885651 - DNA, 14 bp, Homo sapiens
tatgtgcactgcct

SEQ ID NO: 6885652 - DNA, 18 bp, Homo sapiens
catcccggtgcatgcagg

SEQ ID NO: 6885653 - DNA, 13 bp, Homo sapiens
ctgcctcctccct

SEQ ID NO: 6885654 - DNA, 23 bp, Homo sapiens
aactcaaaaggagaactgtgctc

SEQ ID NO: 6885655 - DNA, 15 bp, Homo sapiens
actgtggaggggagc

SEQ ID NO: 6885656 - DNA, 22 bp, Homo sapiens
tgacctgcccccgctctgccat

SEQ ID NO: 6885657 - DNA, 19 bp, Homo sapiens
acatagcccatccctgcct

SEQ ID NO: 6885658 - DNA, 23 bp, Homo sapiens
gcttccagaccacctgccagcca

SEQ ID NO: 6885659 - DNA, 23 bp, Homo sapiens
cttcctactcttctctctgctct

SEQ ID NO: 6885660 - DNA, 20 bp, Homo sapiens
cttttgttactgttcttgct

SEQ ID NO: 6885661 - DNA, 15 bp, Homo sapiens
gggcgggggagccaa

SEQ ID NO: 6885662 - DNA, 22 bp, Homo sapiens
taatatagaaaaaaacattcta

SEQ ID NO: 6885663 - DNA, 13 bp, Homo sapiens
gagcagctgagca

SEQ ID NO: 6885664 - DNA, 14 bp, Homo sapiens
taacagacactgta

SEQ ID NO: 6885665 - DNA, 12 bp, Homo sapiens
agctcctctgcc

SEQ ID NO: 6885666 - DNA, 22 bp, Homo sapiens
cacgccggggctggccctgccc

SEQ ID NO: 6885667 - DNA, 22 bp, Homo sapiens
gccaaagctaggcctggccaga

SEQ ID NO: 6885668 - DNA, 19 bp, Homo sapiens
cccgaccaatccccagcct

SEQ ID NO: 6885669 - DNA, 18 bp, Homo sapiens
gccctcaatccaccttca

SEQ ID NO: 6885670 - DNA, 19 bp, Homo sapiens
cattttcactggaagattt

SEQ ID NO: 6885671 - DNA, 18 bp, Homo sapiens
agctggacaagaagctgc

SEQ ID NO: 6885672 - DNA, 21 bp, Homo sapiens
ccttcttttcaatgcaatgca

SEQ ID NO: 6885673 - DNA, 17 bp, Homo sapiens
cactgcattcctgtgcc

SEQ ID NO: 6885674 - DNA, 18 bp, Homo sapiens
tagctccccaatccctga

SEQ ID NO: 6885675 - DNA, 23 bp, Homo sapiens
tgcctccccatttcccatctgca

SEQ ID NO: 6885676 - DNA, 15 bp, Homo sapiens
gaactggttcttgcc

SEQ ID NO: 6885677 - DNA, 14 bp, Homo sapiens
ccttgtagctcctc

SEQ ID NO: 6885678 - DNA, 12 bp, Homo sapiens
ccttgctctcct

SEQ ID NO: 6885679 - DNA, 22 bp, Homo sapiens
ccatggagcctacctctgtctg

SEQ ID NO: 6885680 - DNA, 21 bp, Homo sapiens
aatttgtgaaagtggcaagct

SEQ ID NO: 6885681 - DNA, 11 bp, Homo sapiens
gaaggaccaac

SEQ ID NO: 6885682 - DNA, 18 bp, Homo sapiens
aaagcatgctcagtattg

SEQ ID NO: 6885683 - DNA, 14 bp, Homo sapiens
cccagcagctgcca

SEQ ID NO: 6885684 - DNA, 17 bp, Homo sapiens
ctgccctgcctgggcct

SEQ ID NO: 6885685 - DNA, 16 bp, Homo sapiens
cactcaggcctgtgcc

SEQ ID NO: 6885686 - DNA, 16 bp, Homo sapiens
ttctgttgctgcctca

SEQ ID NO: 6885687 - DNA, 22 bp, Homo sapiens
cctgcaagtgcccgccctgccc

SEQ ID NO: 6885688 - DNA, 18 bp, Homo sapiens
cagggccaggcctctgct

SEQ ID NO: 6885689 - DNA, 21 bp, Homo sapiens
cattctcctcctcctccctcc

SEQ ID NO: 6885690 - DNA, 13 bp, Homo sapiens
acggccctcctgg

SEQ ID NO: 6885691 - DNA, 15 bp, Homo sapiens
tgtccaccttctgcc

SEQ ID NO: 6885692 - DNA, 20 bp, Homo sapiens
ggagtgaatgtggcagttta

SEQ ID NO: 6885693 - DNA, 14 bp, Homo sapiens
tgtccatttttaca

SEQ ID NO: 6885694 - DNA, 16 bp, Homo sapiens
taggaaaccaccctga

SEQ ID NO: 6885695 - DNA, 14 bp, Homo sapiens
gaaacgctacctct

SEQ ID NO: 6885696 - DNA, 15 bp, Homo sapiens
cctgaggctcaggga

SEQ ID NO: 6885697 - DNA, 21 bp, Homo sapiens
tgaattttgtgttagagattt

SEQ ID NO: 6885698 - DNA, 19 bp, Homo sapiens
tcgcacaatctacactgcc

SEQ ID NO: 6885699 - DNA, 15 bp, Homo sapiens
ttgcaggatctgtct

SEQ ID NO: 6885700 - DNA, 20 bp, Homo sapiens
cacttctgcgggctccctcc

SEQ ID NO: 6885701 - DNA, 14 bp, Homo sapiens
cagggccgaccaga

SEQ ID NO: 6885702 - DNA, 16 bp, Homo sapiens
caggactccactggac

SEQ ID NO: 6885703 - DNA, 22 bp, Homo sapiens
ctgggcgtggtggctcatgcct

SEQ ID NO: 6885704 - DNA, 23 bp, Homo sapiens
ttatggcaagtgatatcacctct

SEQ ID NO: 6885705 - DNA, 18 bp, Homo sapiens
ttcgtgacaatgtttaca

SEQ ID NO: 6885706 - DNA, 21 bp, Homo sapiens
gagataaacaccaacccagga

SEQ ID NO: 6885707 - DNA, 20 bp, Homo sapiens
ggcaagttttccatattttt

SEQ ID NO: 6885708 - DNA, 14 bp, Homo sapiens
catgtcaacagcgt

SEQ ID NO: 6885709 - DNA, 22 bp, Homo sapiens
atcattgcttatgtcaaatgga

SEQ ID NO: 6885710 - DNA, 19 bp, Homo sapiens
caaacctactgcccacatt

SEQ ID NO: 6885711 - DNA, 15 bp, Homo sapiens
atccttttttgtcat

SEQ ID NO: 6885712 - DNA, 21 bp, Homo sapiens
ccttccccatgcttccttgcc

SEQ ID NO: 6885713 - DNA, 13 bp, Homo sapiens
taggaatgctcaa

SEQ ID NO: 6885714 - DNA, 15 bp, Homo sapiens
agccttccctctgca

SEQ ID NO: 6885715 - DNA, 15 bp, Homo sapiens
caactaggacctcat

SEQ ID NO: 6885716 - DNA, 19 bp, Homo sapiens
cctcccctcacccgctgcc

SEQ ID NO: 6885717 - DNA, 13 bp, Homo sapiens
tgattccctctcc

SEQ ID NO: 6885718 - DNA, 16 bp, Homo sapiens
ccttcctttcctctgc

SEQ ID NO: 6885719 - DNA, 15 bp, Homo sapiens
tcccagttgctgtca

SEQ ID NO: 6885720 - DNA, 14 bp, Homo sapiens
ctcctacctctgct

SEQ ID NO: 6885721 - DNA, 17 bp, Homo sapiens
gcactgtggaactgcca

SEQ ID NO: 6885722 - DNA, 15 bp, Homo sapiens
tacttaactgtgtga

SEQ ID NO: 6885723 - DNA, 18 bp, Homo sapiens
ctaccaccctcgctgcca

SEQ ID NO: 6885724 - DNA, 19 bp, Homo sapiens
gtattctagctaatgtaat

SEQ ID NO: 6885725 - DNA, 14 bp, Homo sapiens
atgcctctgaggcc

SEQ ID NO: 6885726 - DNA, 22 bp, Homo sapiens
tcccacccctgcctcccatgcc

SEQ ID NO: 6885727 - DNA, 13 bp, Homo sapiens
cctcccctcttcc

SEQ ID NO: 6885728 - DNA, 19 bp, Homo sapiens
cacgctcatgtcctgtcct

SEQ ID NO: 6885729 - DNA, 22 bp, Homo sapiens
gtggaggttgcagtgagccaag

SEQ ID NO: 6885730 - DNA, 20 bp, Homo sapiens
ccctcaagccaatcccctcc

SEQ ID NO: 6885731 - DNA, 17 bp, Homo sapiens
ccggtccaccccgtccc

SEQ ID NO: 6885732 - DNA, 14 bp, Homo sapiens
ccttacttgcactg

SEQ ID NO: 6885733 - DNA, 22 bp, Homo sapiens
tcccaagctgggccccagccca

SEQ ID NO: 6885734 - DNA, 16 bp, Homo sapiens
caactctgctgagggt

SEQ ID NO: 6885735 - DNA, 12 bp, Homo sapiens
ctcgccccttcc

SEQ ID NO: 6885736 - DNA, 17 bp, Homo sapiens
cagctaccctgtgtata

SEQ ID NO: 6885737 - DNA, 15 bp, Homo sapiens
tcatttactgtttta

SEQ ID NO: 6885738 - DNA, 15 bp, Homo sapiens
cacttttccagtatt

SEQ ID NO: 6885739 - DNA, 16 bp, Homo sapiens
agaatcactgcagccc

SEQ ID NO: 6885740 - DNA, 17 bp, Homo sapiens
ccagattttaaatttta

SEQ ID NO: 6885741 - DNA, 15 bp, Homo sapiens
cttttactggttgca

SEQ ID NO: 6885742 - DNA, 14 bp, Homo sapiens
gctcttcatctgcc

SEQ ID NO: 6885743 - DNA, 13 bp, Homo sapiens
cctctcattgtct

SEQ ID NO: 6885744 - DNA, 14 bp, Homo sapiens
aatgcctgctgctg

SEQ ID NO: 6885745 - DNA, 15 bp, Homo sapiens
cccagctacattcct

SEQ ID NO: 6885746 - DNA, 14 bp, Homo sapiens
tcatgcttttgcca

SEQ ID NO: 6885747 - DNA, 13 bp, Homo sapiens
ccagcccctgcct

SEQ ID NO: 6885748 - DNA, 10 bp, Homo sapiens
accccagagt

SEQ ID NO: 6885749 - DNA, 15 bp, Homo sapiens
aactgtgttgtatta

SEQ ID NO: 6885750 - DNA, 13 bp, Homo sapiens
ctggtggcagctg

SEQ ID NO: 6885751 - DNA, 17 bp, Homo sapiens
aaggttgagtatgtgaa

SEQ ID NO: 6885752 - DNA, 22 bp, Homo sapiens
atggccacatcctcatggccca

SEQ ID NO: 6885753 - DNA, 17 bp, Homo sapiens
atgcacagatatacttt

SEQ ID NO: 6885754 - DNA, 19 bp, Homo sapiens
ctgcccggggcagctgcca

SEQ ID NO: 6885755 - DNA, 14 bp, Homo sapiens
actttttccagcaa

SEQ ID NO: 6885756 - DNA, 12 bp, Homo sapiens
gtggctgctgcc

SEQ ID NO: 6885757 - DNA, 24 bp, Homo sapiens
ccagcccaaaggggacaggcctca

SEQ ID NO: 6885758 - DNA, 17 bp, Homo sapiens
ctctgtggccagcctgg

SEQ ID NO: 6885759 - DNA, 16 bp, Homo sapiens
ccctgctgctgctcct

SEQ ID NO: 6885760 - DNA, 21 bp, Homo sapiens
gctgagcgcccccgagccctg

SEQ ID NO: 6885761 - DNA, 11 bp, Homo sapiens
acctctgtgcc

SEQ ID NO: 6885762 - DNA, 16 bp, Homo sapiens
agaaagcacaatttaa

SEQ ID NO: 6885763 - DNA, 21 bp, Homo sapiens
caaaagtgatctgtcccctct

SEQ ID NO: 6885764 - DNA, 15 bp, Homo sapiens
aataacattacctta

SEQ ID NO: 6885765 - DNA, 14 bp, Homo sapiens
ctctgccccttccc

SEQ ID NO: 6885766 - DNA, 16 bp, Homo sapiens
tcagctgcacattcct

SEQ ID NO: 6885767 - DNA, 12 bp, Homo sapiens
cagctggcactg

SEQ ID NO: 6885768 - DNA, 11 bp, Homo sapiens
agtttcttgca

SEQ ID NO: 6885769 - DNA, 16 bp, Homo sapiens
ccactttattgcaatg

SEQ ID NO: 6885770 - DNA, 18 bp, Homo sapiens
ctctgccggctctttcct

SEQ ID NO: 6885771 - DNA, 21 bp, Homo sapiens
atttttatgatgacaatcaaa

SEQ ID NO: 6885772 - DNA, 22 bp, Homo sapiens
ggggcttcaggtctctgtgggt

SEQ ID NO: 6885773 - DNA, 21 bp, Homo sapiens
tctcttttccccgcctgcagt

SEQ ID NO: 6885774 - DNA, 21 bp, Homo sapiens
agacttcattgtccctcttca

SEQ ID NO: 6885775 - DNA, 17 bp, Homo sapiens
tgttgaagccactgcct

SEQ ID NO: 6885776 - DNA, 21 bp, Homo sapiens
agcctgggcttgagctgcaga

SEQ ID NO: 6885777 - DNA, 20 bp, Homo sapiens
tgtatcaataaaattctgta

SEQ ID NO: 6885778 - DNA, 15 bp, Homo sapiens
agaaatcactgtgaa

SEQ ID NO: 6885779 - DNA, 17 bp, Homo sapiens
cctccccacgccctccc

SEQ ID NO: 6885780 - DNA, 23 bp, Homo sapiens
cataccttgaacccccctccgcc

SEQ ID NO: 6885781 - DNA, 15 bp, Homo sapiens
cctatttccccaccc

SEQ ID NO: 6885782 - DNA, 20 bp, Homo sapiens
gaaaggtgtgagactgggaa

SEQ ID NO: 6885783 - DNA, 13 bp, Homo sapiens
tcaatgtgacatt

SEQ ID NO: 6885784 - DNA, 13 bp, Homo sapiens
agccttgctgcca

SEQ ID NO: 6885785 - DNA, 15 bp, Homo sapiens
ccagtgccagctcca

SEQ ID NO: 6885786 - DNA, 23 bp, Homo sapiens
catgttgcacacccactcagctc

SEQ ID NO: 6885787 - DNA, 13 bp, Homo sapiens
aattataaatgtt

SEQ ID NO: 6885788 - DNA, 18 bp, Homo sapiens
ctattcctttcccttcct

SEQ ID NO: 6885789 - DNA, 20 bp, Homo sapiens
accaccccagctgctcccct

SEQ ID NO: 6885790 - DNA, 12 bp, Homo sapiens
gagccctctcac

SEQ ID NO: 6885791 - DNA, 15 bp, Homo sapiens
ctccagaatctgctg

SEQ ID NO: 6885792 - DNA, 12 bp, Homo sapiens
gctagcaaatag

SEQ ID NO: 6885793 - DNA, 21 bp, Homo sapiens
tgtcccaaaatcccctcagcc

SEQ ID NO: 6885794 - DNA, 21 bp, Homo sapiens
caagaaaggagagtcttgcag

SEQ ID NO: 6885795 - DNA, 12 bp, Homo sapiens
ctcagcctgcct

SEQ ID NO: 6885796 - DNA, 16 bp, Homo sapiens
tcgccgtccctctgcc

SEQ ID NO: 6885797 - DNA, 21 bp, Homo sapiens
acctattctgaaaaagacata

SEQ ID NO: 6885798 - DNA, 15 bp, Homo sapiens
ctcccctctcctgcg

SEQ ID NO: 6885799 - DNA, 22 bp, Homo sapiens
tgccacacattgtgcttggccc

SEQ ID NO: 6885800 - DNA, 15 bp, Homo sapiens
ccacagcctcttcct

SEQ ID NO: 6885801 - DNA, 11 bp, Homo sapiens
atctctggcct

SEQ ID NO: 6885802 - DNA, 17 bp, Homo sapiens
catcattctctgtctca

SEQ ID NO: 6885803 - DNA, 18 bp, Homo sapiens
ctaccaaacactcagtcc

SEQ ID NO: 6885804 - DNA, 20 bp, Homo sapiens
ctttctacatgactgggcct

SEQ ID NO: 6885805 - DNA, 14 bp, Homo sapiens
caggtcaggatgca

SEQ ID NO: 6885806 - DNA, 21 bp, Homo sapiens
cccagtccgccaaacactcca

SEQ ID NO: 6885807 - DNA, 17 bp, Homo sapiens
gaatctatgaacctgaa

SEQ ID NO: 6885808 - DNA, 17 bp, Homo sapiens
atgtcctcctctgtgaa

SEQ ID NO: 6885809 - DNA, 12 bp, Homo sapiens
gcgggagccaga

SEQ ID NO: 6885810 - DNA, 17 bp, Homo sapiens
attcttcctcctctgct

SEQ ID NO: 6885811 - DNA, 22 bp, Homo sapiens
agctgttttggaacgcagttga

SEQ ID NO: 6885812 - DNA, 13 bp, Homo sapiens
ccaggcagctcct

SEQ ID NO: 6885813 - DNA, 12 bp, Homo sapiens
tgtcctcctgct

SEQ ID NO: 6885814 - DNA, 15 bp, Homo sapiens
ctgtgctcttcctct

SEQ ID NO: 6885815 - DNA, 16 bp, Homo sapiens
aggcgaggctgcctct

SEQ ID NO: 6885816 - DNA, 17 bp, Homo sapiens
ctttcgttaatcttgct

SEQ ID NO: 6885817 - DNA, 21 bp, Homo sapiens
cagaggtccaggtcccagccc

SEQ ID NO: 6885818 - DNA, 20 bp, Homo sapiens
cctttccctccactccttcc

SEQ ID NO: 6885819 - DNA, 20 bp, Homo sapiens
aactaccccacaacacgcct

SEQ ID NO: 6885820 - DNA, 14 bp, Homo sapiens
tgctgcctgcctgt

SEQ ID NO: 6885821 - DNA, 21 bp, Homo sapiens
cagattgtaaaggtaggtgca

SEQ ID NO: 6885822 - DNA, 13 bp, Homo sapiens
ccagctctgttct

SEQ ID NO: 6885823 - DNA, 19 bp, Homo sapiens
gcctgttccttcctgcaga

SEQ ID NO: 6885824 - DNA, 16 bp, Homo sapiens
caagctgcactgtgaa

SEQ ID NO: 6885825 - DNA, 15 bp, Homo sapiens
actattacactgcct

SEQ ID NO: 6885826 - DNA, 13 bp, Homo sapiens
ttttctcttgcca

SEQ ID NO: 6885827 - DNA, 18 bp, Homo sapiens
cacaggagctacctgtgt

SEQ ID NO: 6885828 - DNA, 14 bp, Homo sapiens
tcaattagtacagt

SEQ ID NO: 6885829 - DNA, 17 bp, Homo sapiens
agacaaaccactgtaca

SEQ ID NO: 6885830 - DNA, 23 bp, Homo sapiens
cacacacgcacgcacacacacaa

SEQ ID NO: 6885831 - DNA, 21 bp, Homo sapiens
ccctcagctatcagtgttctt

SEQ ID NO: 6885832 - DNA, 14 bp, Homo sapiens
gtctgttcactgca

SEQ ID NO: 6885833 - DNA, 14 bp, Homo sapiens
gagtcagagccctg

SEQ ID NO: 6885834 - DNA, 20 bp, Homo sapiens
tgttgaccaggctggtctca

SEQ ID NO: 6885835 - DNA, 21 bp, Homo sapiens
tgaatttgcaaagtactgtaa

SEQ ID NO: 6885836 - DNA, 22 bp, Homo sapiens
cacagcagttgaaaagactcca

SEQ ID NO: 6885837 - DNA, 22 bp, Homo sapiens
aggagttagtggattactgcca

SEQ ID NO: 6885838 - DNA, 22 bp, Homo sapiens
tactttttaaaatgttggtgca

SEQ ID NO: 6885839 - DNA, 23 bp, Homo sapiens
cccttcccgccctccccctgcca

SEQ ID NO: 6885840 - DNA, 17 bp, Homo sapiens
tcgtccccctccctgcc

SEQ ID NO: 6885841 - DNA, 15 bp, Homo sapiens
caataaaggcagctg

SEQ ID NO: 6885842 - DNA, 23 bp, Homo sapiens
caccaccttatacatcacttcct

SEQ ID NO: 6885843 - DNA, 15 bp, Homo sapiens
gaatgagatgattta

SEQ ID NO: 6885844 - DNA, 18 bp, Homo sapiens
caccaccacacccctgcc

SEQ ID NO: 6885845 - DNA, 13 bp, Homo sapiens
ctcttctcttcct

SEQ ID NO: 6885846 - DNA, 19 bp, Homo sapiens
tcagtgtgccccccatcct

SEQ ID NO: 6885847 - DNA, 16 bp, Homo sapiens
gtaaaatatagctgta

SEQ ID NO: 6885848 - DNA, 14 bp, Homo sapiens
gatattactttatc

SEQ ID NO: 6885849 - DNA, 14 bp, Homo sapiens
ccagtgctgcttct

SEQ ID NO: 6885850 - DNA, 21 bp, Homo sapiens
cagtctttaaaggcccagccc

SEQ ID NO: 6885851 - DNA, 18 bp, Homo sapiens
ctcttctgctccaccctt

SEQ ID NO: 6885852 - DNA, 20 bp, Homo sapiens
cagtgggaatgttctttctg

SEQ ID NO: 6885853 - DNA, 14 bp, Homo sapiens
cttgcacctgagcc

SEQ ID NO: 6885854 - DNA, 14 bp, Homo sapiens
gatattcagatgta

SEQ ID NO: 6885855 - DNA, 18 bp, Homo sapiens
caaatccaggaccctgcc

SEQ ID NO: 6885856 - DNA, 16 bp, Homo sapiens
ctggctgcctggccca

SEQ ID NO: 6885857 - DNA, 13 bp, Homo sapiens
ctgcccagtctgg

SEQ ID NO: 6885858 - DNA, 15 bp, Homo sapiens
ttgaaagtgcctttg

SEQ ID NO: 6885859 - DNA, 13 bp, Homo sapiens
tcccgctgctgct

SEQ ID NO: 6885860 - DNA, 23 bp, Homo sapiens
tgctcagcccatcccctgcctct

SEQ ID NO: 6885861 - DNA, 12 bp, Homo sapiens
gtgagagcccat

SEQ ID NO: 6885862 - DNA, 14 bp, Homo sapiens
agagcatcatgcct

SEQ ID NO: 6885863 - DNA, 23 bp, Homo sapiens
acttctttcctctccaattgtaa

SEQ ID NO: 6885864 - DNA, 22 bp, Homo sapiens
ttcctgtgaggatagagacttg

SEQ ID NO: 6885865 - DNA, 20 bp, Homo sapiens
agcctgttccttcctgcaga

SEQ ID NO: 6885866 - DNA, 15 bp, Homo sapiens
ttccctctcttgcct

SEQ ID NO: 6885867 - DNA, 21 bp, Homo sapiens
ctggtgagagggccgggcaga

SEQ ID NO: 6885868 - DNA, 13 bp, Homo sapiens
ggttggagggaac

SEQ ID NO: 6885869 - DNA, 13 bp, Homo sapiens
tgccgctacctcc

SEQ ID NO: 6885870 - DNA, 21 bp, Homo sapiens
agcagctgcaccccagcgtca

SEQ ID NO: 6885871 - DNA, 13 bp, Homo sapiens
cttactctgagcc

SEQ ID NO: 6885872 - DNA, 13 bp, Homo sapiens
ctttatagttgta

SEQ ID NO: 6885873 - DNA, 23 bp, Homo sapiens
cactgagaagatggcactgtcca

SEQ ID NO: 6885874 - DNA, 19 bp, Homo sapiens
ctgtcagccaacattgcct

SEQ ID NO: 6885875 - DNA, 20 bp, Homo sapiens
gcccctgcacaggcacacag

SEQ ID NO: 6885876 - DNA, 23 bp, Homo sapiens
tggggcttctttctgctggctga

SEQ ID NO: 6885877 - DNA, 14 bp, Homo sapiens
gactcacacctgaa

SEQ ID NO: 6885878 - DNA, 13 bp, Homo sapiens
agacatacttgaa

SEQ ID NO: 6885879 - DNA, 12 bp, Homo sapiens
ctgcatgcaagc

SEQ ID NO: 6885880 - DNA, 18 bp, Homo sapiens
tcgattcccaagctccct

SEQ ID NO: 6885881 - DNA, 13 bp, Homo sapiens
cctgggctgtcca

SEQ ID NO: 6885882 - DNA, 15 bp, Homo sapiens
cagctgcacattcct

SEQ ID NO: 6885883 - DNA, 19 bp, Homo sapiens
caggtcccacctccagccc

SEQ ID NO: 6885884 - DNA, 17 bp, Homo sapiens
atctatgtgtttctgta

SEQ ID NO: 6885885 - DNA, 22 bp, Homo sapiens
cccagccctcaggccagtgcca

SEQ ID NO: 6885886 - DNA, 17 bp, Homo sapiens
tgtctagaatcctgctt

SEQ ID NO: 6885887 - DNA, 13 bp, Homo sapiens
gagctgagccagg

SEQ ID NO: 6885888 - DNA, 16 bp, Homo sapiens
agtccggtgccttcca

SEQ ID NO: 6885889 - DNA, 21 bp, Homo sapiens
cactgccttggcccctccctc

SEQ ID NO: 6885890 - DNA, 15 bp, Homo sapiens
cacagcgtctgctca

SEQ ID NO: 6885891 - DNA, 15 bp, Homo sapiens
ctcccagcactgcct

SEQ ID NO: 6885892 - DNA, 21 bp, Homo sapiens
gtagtcctcccaagctgtgct

SEQ ID NO: 6885893 - DNA, 23 bp, Homo sapiens
aatatttgaagcagctctgcctt

SEQ ID NO: 6885894 - DNA, 12 bp, Homo sapiens
ttctttcttcct

SEQ ID NO: 6885895 - DNA, 11 bp, Homo sapiens
cacctgacagc

SEQ ID NO: 6885896 - DNA, 14 bp, Homo sapiens
ctgtgtcctctccc

SEQ ID NO: 6885897 - DNA, 21 bp, Homo sapiens
gatttcctgtgtgtgttgccc

SEQ ID NO: 6885898 - DNA, 22 bp, Homo sapiens
ttctgcctgccagctgcactga

SEQ ID NO: 6885899 - DNA, 18 bp, Homo sapiens
tgcctcctccctggctgc

SEQ ID NO: 6885900 - DNA, 19 bp, Homo sapiens
ccgttctccattctgcttt

SEQ ID NO: 6885901 - DNA, 18 bp, Homo sapiens
atggtaaataactgtgac

SEQ ID NO: 6885902 - DNA, 18 bp, Homo sapiens
cttgccacccattcttcc

SEQ ID NO: 6885903 - DNA, 19 bp, Homo sapiens
ttgaattcatttcactgta

SEQ ID NO: 6885904 - DNA, 15 bp, Homo sapiens
gctttatgcaaatac

SEQ ID NO: 6885905 - DNA, 14 bp, Homo sapiens
ccagtccccctgcc

SEQ ID NO: 6885906 - DNA, 15 bp, Homo sapiens
gctggactgaccaaa

SEQ ID NO: 6885907 - DNA, 23 bp, Homo sapiens
cctacagtacaatcagcagtcta

SEQ ID NO: 6885908 - DNA, 16 bp, Homo sapiens
tactttgcattgtctg

SEQ ID NO: 6885909 - DNA, 22 bp, Homo sapiens
catccccttgaggtctcagccc

SEQ ID NO: 6885910 - DNA, 21 bp, Homo sapiens
accctcctagcctgctctgcc

SEQ ID NO: 6885911 - DNA, 14 bp, Homo sapiens
cctctgcccttccc

SEQ ID NO: 6885912 - DNA, 20 bp, Homo sapiens
atttgaaagtgcctttgcag

SEQ ID NO: 6885913 - DNA, 17 bp, Homo sapiens
acatagatcagccatta

SEQ ID NO: 6885914 - DNA, 13 bp, Homo sapiens
catgcactgtgaa

SEQ ID NO: 6885915 - DNA, 14 bp, Homo sapiens
ctgttctcctcccc

SEQ ID NO: 6885916 - DNA, 14 bp, Homo sapiens
ctgttttcctccct

SEQ ID NO: 6885917 - DNA, 14 bp, Homo sapiens
ctctccactttcag

SEQ ID NO: 6885918 - DNA, 18 bp, Homo sapiens
gaggcagatggagcccat

SEQ ID NO: 6885919 - DNA, 23 bp, Homo sapiens
tcgagctctgtagcctggtctgt

SEQ ID NO: 6885920 - DNA, 18 bp, Homo sapiens
ccagattaggcctggagt

SEQ ID NO: 6885921 - DNA, 19 bp, Homo sapiens
ccaggcctgggtctgtgtc

SEQ ID NO: 6885922 - DNA, 17 bp, Homo sapiens
agtgcctagactgttac

SEQ ID NO: 6885923 - DNA, 14 bp, Homo sapiens
aaatgacttattga

SEQ ID NO: 6885924 - DNA, 14 bp, Homo sapiens
tctattattatgaa

SEQ ID NO: 6885925 - DNA, 22 bp, Homo sapiens
caaactgggaacccctttccca

SEQ ID NO: 6885926 - DNA, 16 bp, Homo sapiens
catctcaacctacctc

SEQ ID NO: 6885927 - DNA, 21 bp, Homo sapiens
agctgctgccactctgctgcc

SEQ ID NO: 6885928 - DNA, 22 bp, Homo sapiens
aaccgtcctgctgtccctgtca

SEQ ID NO: 6885929 - DNA, 12 bp, Homo sapiens
caggctccctga

SEQ ID NO: 6885930 - DNA, 17 bp, Homo sapiens
cactgtccttccctgcc

SEQ ID NO: 6885931 - DNA, 12 bp, Homo sapiens
ccggccctgccc

SEQ ID NO: 6885932 - DNA, 20 bp, Homo sapiens
caacaacatgaaactgccta

SEQ ID NO: 6885933 - DNA, 18 bp, Homo sapiens
aatatgaacctattttca

SEQ ID NO: 6885934 - DNA, 18 bp, Homo sapiens
agccctgcttttgcataa

SEQ ID NO: 6885935 - DNA, 17 bp, Homo sapiens
ccaaggggtctgctcct

SEQ ID NO: 6885936 - DNA, 15 bp, Homo sapiens
atgttttccaatatt

SEQ ID NO: 6885937 - DNA, 20 bp, Homo sapiens
ggatgattgcttgagctcag

SEQ ID NO: 6885938 - DNA, 23 bp, Homo sapiens
tgtgattcagaaaatgttctgtt

SEQ ID NO: 6885939 - DNA, 21 bp, Homo sapiens
tatcttctggactatagctgt

SEQ ID NO: 6885940 - DNA, 23 bp, Homo sapiens
gtgtgtatactgtaatcgtgcta

SEQ ID NO: 6885941 - DNA, 23 bp, Homo sapiens
caagtctgtgcctggagctcctg

SEQ ID NO: 6885942 - DNA, 18 bp, Homo sapiens
gcctgaagagtcctctga

SEQ ID NO: 6885943 - DNA, 14 bp, Homo sapiens
atgtgtcccagtga

SEQ ID NO: 6885944 - DNA, 19 bp, Homo sapiens
ctggagcccgagggcctga

SEQ ID NO: 6885945 - DNA, 14 bp, Homo sapiens
ccatccagcctcca

SEQ ID NO: 6885946 - DNA, 20 bp, Homo sapiens
gcactaagtctcttttttac

SEQ ID NO: 6885947 - DNA, 15 bp, Homo sapiens
tccccctctcacgcc

SEQ ID NO: 6885948 - DNA, 17 bp, Homo sapiens
aaaactttatgtactgc

SEQ ID NO: 6885949 - DNA, 17 bp, Homo sapiens
gtaatcgacctgcctcg

SEQ ID NO: 6885950 - DNA, 14 bp, Homo sapiens
tgccttcctcatcc

SEQ ID NO: 6885951 - DNA, 18 bp, Homo sapiens
gaatgccgctgtctctga

SEQ ID NO: 6885952 - DNA, 16 bp, Homo sapiens
gctgtggtctctttgt

SEQ ID NO: 6885953 - DNA, 16 bp, Homo sapiens
tgctctgcccatgcct

SEQ ID NO: 6885954 - DNA, 18 bp, Homo sapiens
cccacggtgcccaaacac

SEQ ID NO: 6885955 - DNA, 20 bp, Homo sapiens
ttcaagcgattcttctgcct

SEQ ID NO: 6885956 - DNA, 13 bp, Homo sapiens
ttcttcctgctgg

SEQ ID NO: 6885957 - DNA, 21 bp, Homo sapiens
catgttaacccctccactctt

SEQ ID NO: 6885958 - DNA, 17 bp, Homo sapiens
ctattcctgaccctccc

SEQ ID NO: 6885959 - DNA, 16 bp, Homo sapiens
tggcctcccctgctga

SEQ ID NO: 6885960 - DNA, 22 bp, Homo sapiens
cactgttgctgactactactct

SEQ ID NO: 6885961 - DNA, 23 bp, Homo sapiens
actgctgcaaggtggcctctgcc

SEQ ID NO: 6885962 - DNA, 19 bp, Homo sapiens
cttaaggcaataaaactag

SEQ ID NO: 6885963 - DNA, 19 bp, Homo sapiens
cggtcgccccgtgtttgcg

SEQ ID NO: 6885964 - DNA, 17 bp, Homo sapiens
gttttagaatacattgt

SEQ ID NO: 6885965 - DNA, 15 bp, Homo sapiens
ccacagcctccttct

SEQ ID NO: 6885966 - DNA, 22 bp, Homo sapiens
gaagtaacatgcatactttatt

SEQ ID NO: 6885967 - DNA, 14 bp, Homo sapiens
ccccagccccttcc

SEQ ID NO: 6885968 - DNA, 21 bp, Homo sapiens
tggtccacaagcttctgtcct

SEQ ID NO: 6885969 - DNA, 20 bp, Homo sapiens
aggccgctgttcacccacag

SEQ ID NO: 6885970 - DNA, 14 bp, Homo sapiens
caaagaaccaaaga

SEQ ID NO: 6885971 - DNA, 14 bp, Homo sapiens
cctgccaccctgcc

SEQ ID NO: 6885972 - DNA, 14 bp, Homo sapiens
ttgcaataacttct

SEQ ID NO: 6885973 - DNA, 19 bp, Homo sapiens
cttctcccccgccctgccc

SEQ ID NO: 6885974 - DNA, 13 bp, Homo sapiens
agcttgcctgcct

SEQ ID NO: 6885975 - DNA, 18 bp, Homo sapiens
tagtttacttcactttca

SEQ ID NO: 6885976 - DNA, 16 bp, Homo sapiens
tgacttctatcctgtt

SEQ ID NO: 6885977 - DNA, 17 bp, Homo sapiens
tgtccccgacccttgcc

SEQ ID NO: 6885978 - DNA, 13 bp, Homo sapiens
caaagtactgtaa

SEQ ID NO: 6885979 - DNA, 15 bp, Homo sapiens
cctctccactcttct

SEQ ID NO: 6885980 - DNA, 13 bp, Homo sapiens
ccagccactgccc

SEQ ID NO: 6885981 - DNA, 15 bp, Homo sapiens
taccctactggctgt

SEQ ID NO: 6885982 - DNA, 12 bp, Homo sapiens
ggctaggggagg

SEQ ID NO: 6885983 - DNA, 12 bp, Homo sapiens
tcagaacatgtt

SEQ ID NO: 6885984 - DNA, 22 bp, Homo sapiens
cacagtgacaaaaggctcggaa

SEQ ID NO: 6885985 - DNA, 18 bp, Homo sapiens
ctctagctggtggtttca

SEQ ID NO: 6885986 - DNA, 21 bp, Homo sapiens
acctctgggaccccagctgct

SEQ ID NO: 6885987 - DNA, 15 bp, Homo sapiens
cctcctggccttcct

SEQ ID NO: 6885988 - DNA, 15 bp, Homo sapiens
ctcttctcctctggc

SEQ ID NO: 6885989 - DNA, 20 bp, Homo sapiens
tgctgctgacccctgtgtga

SEQ ID NO: 6885990 - DNA, 16 bp, Homo sapiens
agagctgttcgctcct

SEQ ID NO: 6885991 - DNA, 16 bp, Homo sapiens
tcgtgatgacatatca

SEQ ID NO: 6885992 - DNA, 15 bp, Homo sapiens
attattcaccatgta

SEQ ID NO: 6885993 - DNA, 18 bp, Homo sapiens
ctctgacacacagctctg

SEQ ID NO: 6885994 - DNA, 17 bp, Homo sapiens
gccaacttgtctctgta

SEQ ID NO: 6885995 - DNA, 14 bp, Homo sapiens
cattccttctttga

SEQ ID NO: 6885996 - DNA, 14 bp, Homo sapiens
ttgtaaaactgtga

SEQ ID NO: 6885997 - DNA, 13 bp, Homo sapiens
ataaagcatttaa

SEQ ID NO: 6885998 - DNA, 18 bp, Homo sapiens
agccctgttctcgttgcc

SEQ ID NO: 6885999 - DNA, 16 bp, Homo sapiens
attagggtacatttat

SEQ ID NO: 6886000 - DNA, 19 bp, Homo sapiens
aggtcctctgtcagtcaca

SEQ ID NO: 6886001 - DNA, 18 bp, Homo sapiens
cctagccacctcccaccc

SEQ ID NO: 6886002 - DNA, 12 bp, Homo sapiens
aaactgtgaatg

SEQ ID NO: 6886003 - DNA, 20 bp, Homo sapiens
aatttatagtaatgagttta

SEQ ID NO: 6886004 - DNA, 13 bp, Homo sapiens
cagcacctggagc

SEQ ID NO: 6886005 - DNA, 15 bp, Homo sapiens
tctgtttcctgtgtc

SEQ ID NO: 6886006 - DNA, 14 bp, Homo sapiens
tgggaacactggcc

SEQ ID NO: 6886007 - DNA, 23 bp, Homo sapiens
gagcagaaaacccttgggccaga

SEQ ID NO: 6886008 - DNA, 18 bp, Homo sapiens
ctcaactctacccctgct

SEQ ID NO: 6886009 - DNA, 23 bp, Homo sapiens
catctggttttattactctcacc

SEQ ID NO: 6886010 - DNA, 16 bp, Homo sapiens
cagtgcatctcagccc

SEQ ID NO: 6886011 - DNA, 14 bp, Homo sapiens
cactgtattttcat

SEQ ID NO: 6886012 - DNA, 19 bp, Homo sapiens
cccagggcaaatgtttaca

SEQ ID NO: 6886013 - DNA, 20 bp, Homo sapiens
gctgattttattcttgatca

SEQ ID NO: 6886014 - DNA, 15 bp, Homo sapiens
ccttgtcccctgcct

SEQ ID NO: 6886015 - DNA, 13 bp, Homo sapiens
agacttactgcat

SEQ ID NO: 6886016 - DNA, 16 bp, Homo sapiens
ctgggtatgcgtttca

SEQ ID NO: 6886017 - DNA, 14 bp, Homo sapiens
ccgtctgcccacca

SEQ ID NO: 6886018 - DNA, 12 bp, Homo sapiens
cctattgttgat

SEQ ID NO: 6886019 - DNA, 19 bp, Homo sapiens
tgaggctctttctgggcca

SEQ ID NO: 6886020 - DNA, 11 bp, Homo sapiens
gctctggctga

SEQ ID NO: 6886021 - DNA, 15 bp, Homo sapiens
tcaatgtactgtatt

SEQ ID NO: 6886022 - DNA, 17 bp, Homo sapiens
atgcctccaccgctgcc

SEQ ID NO: 6886023 - DNA, 20 bp, Homo sapiens
ctcaggccacccctcctcct

SEQ ID NO: 6886024 - DNA, 15 bp, Homo sapiens
gtacaggtactttgt

SEQ ID NO: 6886025 - DNA, 13 bp, Homo sapiens
ctttccaattcca

SEQ ID NO: 6886026 - DNA, 17 bp, Homo sapiens
tgatgcgaaaacttgaa

SEQ ID NO: 6886027 - DNA, 22 bp, Homo sapiens
gccctccctgttccccagagaa

SEQ ID NO: 6886028 - DNA, 15 bp, Homo sapiens
cagttggcctctgcc

SEQ ID NO: 6886029 - DNA, 14 bp, Homo sapiens
cccaatcactgcct

SEQ ID NO: 6886030 - DNA, 19 bp, Homo sapiens
taaaagtgatgtgatttat

SEQ ID NO: 6886031 - DNA, 16 bp, Homo sapiens
cttgtgattggctgca

SEQ ID NO: 6886032 - DNA, 16 bp, Homo sapiens
ctggtaggaaagcacc

SEQ ID NO: 6886033 - DNA, 15 bp, Homo sapiens
caagtctgtacctca

SEQ ID NO: 6886034 - DNA, 18 bp, Homo sapiens
ctgctttctgcctctcct

SEQ ID NO: 6886035 - DNA, 15 bp, Homo sapiens
agctgctctgagcca

SEQ ID NO: 6886036 - DNA, 20 bp, Homo sapiens
cagagcctgacgctcagccc

SEQ ID NO: 6886037 - DNA, 21 bp, Homo sapiens
tgctatccccatctccctgcc

SEQ ID NO: 6886038 - DNA, 22 bp, Homo sapiens
ctcagagggataaggcagttga

SEQ ID NO: 6886039 - DNA, 19 bp, Homo sapiens
ccctcctcgtcccctgcct

SEQ ID NO: 6886040 - DNA, 22 bp, Homo sapiens
cttgagctgcctgctctgcagc

SEQ ID NO: 6886041 - DNA, 12 bp, Homo sapiens
aaaatacattta

SEQ ID NO: 6886042 - DNA, 16 bp, Homo sapiens
gaaattatctttagtt

SEQ ID NO: 6886043 - DNA, 16 bp, Homo sapiens
ccatggggcagcctcc

SEQ ID NO: 6886044 - DNA, 19 bp, Homo sapiens
ccagcctggcctcctgcct

SEQ ID NO: 6886045 - DNA, 15 bp, Homo sapiens
catgccaccctctcc

SEQ ID NO: 6886046 - DNA, 18 bp, Homo sapiens
ctcaagggggactgtctt

SEQ ID NO: 6886047 - DNA, 16 bp, Homo sapiens
ggcctgtaacatatct

SEQ ID NO: 6886048 - DNA, 20 bp, Homo sapiens
ttagtttgttaattgattaa

SEQ ID NO: 6886049 - DNA, 22 bp, Homo sapiens
gtgtccctgccttcactgtgct

SEQ ID NO: 6886050 - DNA, 12 bp, Homo sapiens
atgccctcctgg

SEQ ID NO: 6886051 - DNA, 23 bp, Homo sapiens
tgcagcagattggaaggagacac

SEQ ID NO: 6886052 - DNA, 15 bp, Homo sapiens
ctggggcgtggggag

SEQ ID NO: 6886053 - DNA, 14 bp, Homo sapiens
cactttgaagcaaa

SEQ ID NO: 6886054 - DNA, 14 bp, Homo sapiens
aatcccattattca

SEQ ID NO: 6886055 - DNA, 23 bp, Homo sapiens
ccatctgaagccacctctctgcc

SEQ ID NO: 6886056 - DNA, 21 bp, Homo sapiens
atacatgtcacatttagctgt

SEQ ID NO: 6886057 - DNA, 20 bp, Homo sapiens
ttctcgaactcctgacctca

SEQ ID NO: 6886058 - DNA, 14 bp, Homo sapiens
cagctgctgctgga

SEQ ID NO: 6886059 - DNA, 18 bp, Homo sapiens
ctgcccgcaccctggcct

SEQ ID NO: 6886060 - DNA, 19 bp, Homo sapiens
cctgccttaacctgggacc

SEQ ID NO: 6886061 - DNA, 22 bp, Homo sapiens
agggtaataaccagacacaaac

SEQ ID NO: 6886062 - DNA, 14 bp, Homo sapiens
gcataggctgccca

SEQ ID NO: 6886063 - DNA, 15 bp, Homo sapiens
ccaacctgttaccta

SEQ ID NO: 6886064 - DNA, 15 bp, Homo sapiens
gcctgggctgtgagg

SEQ ID NO: 6886065 - DNA, 22 bp, Homo sapiens
caccctggctgggatcagagca

SEQ ID NO: 6886066 - DNA, 14 bp, Homo sapiens
gctcctggctgcca

SEQ ID NO: 6886067 - DNA, 18 bp, Homo sapiens
ctgcaaaccttcctggga

SEQ ID NO: 6886068 - DNA, 14 bp, Homo sapiens
agggcacacactgt

SEQ ID NO: 6886069 - DNA, 16 bp, Homo sapiens
tctgctctatactgtg

SEQ ID NO: 6886070 - DNA, 22 bp, Homo sapiens
gctcattccatgactctgccta

SEQ ID NO: 6886071 - DNA, 16 bp, Homo sapiens
ctaaagttgtagtgaa

SEQ ID NO: 6886072 - DNA, 22 bp, Homo sapiens
acttccctgggttagactgcca

SEQ ID NO: 6886073 - DNA, 12 bp, Homo sapiens
cctccccttccc

SEQ ID NO: 6886074 - DNA, 12 bp, Homo sapiens
ccttcccttcct

SEQ ID NO: 6886075 - DNA, 21 bp, Homo sapiens
cccggcccagagaccccttcc

SEQ ID NO: 6886076 - DNA, 23 bp, Homo sapiens
aaatccgccagtgtttctgaatg

SEQ ID NO: 6886077 - DNA, 12 bp, Homo sapiens
atgcactgtgaa

SEQ ID NO: 6886078 - DNA, 13 bp, Homo sapiens
cagattgtgtaca

SEQ ID NO: 6886079 - DNA, 12 bp, Homo sapiens
cctcccactctt

SEQ ID NO: 6886080 - DNA, 19 bp, Homo sapiens
ctttgcggggcctgtctca

SEQ ID NO: 6886081 - DNA, 23 bp, Homo sapiens
ccaatttggtaaaaatgctgctc

SEQ ID NO: 6886082 - DNA, 16 bp, Homo sapiens
ttcctggcagctgctg

SEQ ID NO: 6886083 - DNA, 19 bp, Homo sapiens
ctgccccggacctacctcc

SEQ ID NO: 6886084 - DNA, 22 bp, Homo sapiens
gtatattttatttcaatgtaat

SEQ ID NO: 6886085 - DNA, 12 bp, Homo sapiens
ctggaggggaga

SEQ ID NO: 6886086 - DNA, 14 bp, Homo sapiens
aacacccactggcc

SEQ ID NO: 6886087 - DNA, 16 bp, Homo sapiens
gcccacggccacccac

SEQ ID NO: 6886088 - DNA, 19 bp, Homo sapiens
ataatttatacaggtcata

SEQ ID NO: 6886089 - DNA, 16 bp, Homo sapiens
ctctctccctgcctca

SEQ ID NO: 6886090 - DNA, 19 bp, Homo sapiens
tgcatgctcctctgcctgt

SEQ ID NO: 6886091 - DNA, 22 bp, Homo sapiens
caaccaggaggggtctgcctcc

SEQ ID NO: 6886092 - DNA, 19 bp, Homo sapiens
cagcgcagagtagctgctt

SEQ ID NO: 6886093 - DNA, 23 bp, Homo sapiens
ccagcactggaggggcccaccca

SEQ ID NO: 6886094 - DNA, 20 bp, Homo sapiens
agaattccagggtatggcca

SEQ ID NO: 6886095 - DNA, 14 bp, Homo sapiens
ataataaaggctga

SEQ ID NO: 6886096 - DNA, 21 bp, Homo sapiens
atgtttacatggcgccctgcc

SEQ ID NO: 6886097 - DNA, 18 bp, Homo sapiens
acacagtgagactgtaca

SEQ ID NO: 6886098 - DNA, 18 bp, Homo sapiens
ccagccttatgtgttaca

SEQ ID NO: 6886099 - DNA, 16 bp, Homo sapiens
tccagcatcccagcct

SEQ ID NO: 6886100 - DNA, 18 bp, Homo sapiens
ccttagcatcccctgtga

SEQ ID NO: 6886101 - DNA, 20 bp, Homo sapiens
gtcagcatcactgatgggaa

SEQ ID NO: 6886102 - DNA, 16 bp, Homo sapiens
gccctgtcccaggccg

SEQ ID NO: 6886103 - DNA, 19 bp, Homo sapiens
acccttcctcatctgtgcc

SEQ ID NO: 6886104 - DNA, 17 bp, Homo sapiens
aagggtcaggcctttga

SEQ ID NO: 6886105 - DNA, 18 bp, Homo sapiens
cacatcttgaaaatgcca

SEQ ID NO: 6886106 - DNA, 13 bp, Homo sapiens
atctctcctggcc

SEQ ID NO: 6886107 - DNA, 22 bp, Homo sapiens
gctgtgagatggatgtatttgt

SEQ ID NO: 6886108 - DNA, 17 bp, Homo sapiens
ggtgttactgcagttga

SEQ ID NO: 6886109 - DNA, 19 bp, Homo sapiens
agttctgttgacctgtgca

SEQ ID NO: 6886110 - DNA, 17 bp, Homo sapiens
agaaaatatatattttt

SEQ ID NO: 6886111 - DNA, 16 bp, Homo sapiens
catagagccctggcca

SEQ ID NO: 6886112 - DNA, 19 bp, Homo sapiens
agcagaaagtgcctttcag

SEQ ID NO: 6886113 - DNA, 17 bp, Homo sapiens
caggaagagatgctcta

SEQ ID NO: 6886114 - DNA, 18 bp, Homo sapiens
ctatgacattactgtatt

SEQ ID NO: 6886115 - DNA, 15 bp, Homo sapiens
aagctgcactgtgaa

SEQ ID NO: 6886116 - DNA, 17 bp, Homo sapiens
cgttctggactctgccc

SEQ ID NO: 6886117 - DNA, 19 bp, Homo sapiens
caatcttaaggggcagctt

SEQ ID NO: 6886118 - DNA, 18 bp, Homo sapiens
taaaattccattatctta

SEQ ID NO: 6886119 - DNA, 22 bp, Homo sapiens
tggaacactactcttacatgta

SEQ ID NO: 6886120 - DNA, 20 bp, Homo sapiens
agcctccctgacgtctgcca

SEQ ID NO: 6886121 - DNA, 20 bp, Homo sapiens
atggttccatgcctgagggt

SEQ ID NO: 6886122 - DNA, 15 bp, Homo sapiens
gcggaacctggctgc

SEQ ID NO: 6886123 - DNA, 14 bp, Homo sapiens
aacatatctctgcc

SEQ ID NO: 6886124 - DNA, 19 bp, Homo sapiens
acacttcaataattgtcca

SEQ ID NO: 6886125 - DNA, 13 bp, Homo sapiens
cagcactgtccct

SEQ ID NO: 6886126 - DNA, 21 bp, Homo sapiens
aagtataaagtcacttccagt

SEQ ID NO: 6886127 - DNA, 21 bp, Homo sapiens
cacagggttcaaaatgtctgt

SEQ ID NO: 6886128 - DNA, 19 bp, Homo sapiens
cgtggtatacatgtgtaca

SEQ ID NO: 6886129 - DNA, 14 bp, Homo sapiens
gatcacacagtgtt

SEQ ID NO: 6886130 - DNA, 19 bp, Homo sapiens
cgtttttgctggcttgcac

SEQ ID NO: 6886131 - DNA, 16 bp, Homo sapiens
gcctgctcagcagcca

SEQ ID NO: 6886132 - DNA, 16 bp, Homo sapiens
ccagattcccaggcca

SEQ ID NO: 6886133 - DNA, 15 bp, Homo sapiens
tttcctcctctgcct

SEQ ID NO: 6886134 - DNA, 20 bp, Homo sapiens
caggaatcacccctctgccc

SEQ ID NO: 6886135 - DNA, 15 bp, Homo sapiens
tattagatgttctct

SEQ ID NO: 6886136 - DNA, 20 bp, Homo sapiens
cactctgggcacactctgcc

SEQ ID NO: 6886137 - DNA, 23 bp, Homo sapiens
ttattgagtaatattacatttca

SEQ ID NO: 6886138 - DNA, 21 bp, Homo sapiens
tcaaggccgtgtccccttgtt

SEQ ID NO: 6886139 - DNA, 13 bp, Homo sapiens
atcctctttgtaa

SEQ ID NO: 6886140 - DNA, 22 bp, Homo sapiens
tgaagtccagtgaccctggagc

SEQ ID NO: 6886141 - DNA, 16 bp, Homo sapiens
gttggtcttactttgt

SEQ ID NO: 6886142 - DNA, 21 bp, Homo sapiens
atttgaggaaactcatacagt

SEQ ID NO: 6886143 - DNA, 14 bp, Homo sapiens
attttgtaaatgtt

SEQ ID NO: 6886144 - DNA, 15 bp, Homo sapiens
caggtgtgaccctga

SEQ ID NO: 6886145 - DNA, 16 bp, Homo sapiens
cactgtcactgtttct

SEQ ID NO: 6886146 - DNA, 17 bp, Homo sapiens
tggcccacccctcttcc

SEQ ID NO: 6886147 - DNA, 16 bp, Homo sapiens
gcccgtcttcagccta

SEQ ID NO: 6886148 - DNA, 19 bp, Homo sapiens
ctctccccttttccttcag

SEQ ID NO: 6886149 - DNA, 21 bp, Homo sapiens
tgtgcttgaaggccctgctga

SEQ ID NO: 6886150 - DNA, 22 bp, Homo sapiens
tagttttgatttaatgttttca

SEQ ID NO: 6886151 - DNA, 18 bp, Homo sapiens
ttttggtcccctccctcg

SEQ ID NO: 6886152 - DNA, 17 bp, Homo sapiens
tgagaatggcctggagc

SEQ ID NO: 6886153 - DNA, 21 bp, Homo sapiens
tgcctctccgcccctgagccc

SEQ ID NO: 6886154 - DNA, 16 bp, Homo sapiens
cctcccgtcttcctcc

SEQ ID NO: 6886155 - DNA, 19 bp, Homo sapiens
ctcactgtggtaaatgcca

SEQ ID NO: 6886156 - DNA, 23 bp, Homo sapiens
cactggggattgggcccctgcca

SEQ ID NO: 6886157 - DNA, 18 bp, Homo sapiens
ccatttatacaaattaga

SEQ ID NO: 6886158 - DNA, 16 bp, Homo sapiens
agccgtcccaggccac

SEQ ID NO: 6886159 - DNA, 23 bp, Homo sapiens
cagagagggtggtgacctctgcc

SEQ ID NO: 6886160 - DNA, 23 bp, Homo sapiens
ccagctggtgtcactctgcctct

SEQ ID NO: 6886161 - DNA, 21 bp, Homo sapiens
acctgccccggacctacctcc

SEQ ID NO: 6886162 - DNA, 23 bp, Homo sapiens
ctagccagagcccttcactgcca

SEQ ID NO: 6886163 - DNA, 16 bp, Homo sapiens
catagaaactgaggag

SEQ ID NO: 6886164 - DNA, 21 bp, Homo sapiens
cctaggtagccccctcttccc

SEQ ID NO: 6886165 - DNA, 16 bp, Homo sapiens
gtcctgacctgtctca

SEQ ID NO: 6886166 - DNA, 16 bp, Homo sapiens
tcacactcctcctgcc

SEQ ID NO: 6886167 - DNA, 17 bp, Homo sapiens
gcgtaatgggcctgccc

SEQ ID NO: 6886168 - DNA, 20 bp, Homo sapiens
agatgggggcttcttcctca

SEQ ID NO: 6886169 - DNA, 16 bp, Homo sapiens
ttctaagcaatgcaaa

SEQ ID NO: 6886170 - DNA, 16 bp, Homo sapiens
ctcctggacacggcct

SEQ ID NO: 6886171 - DNA, 16 bp, Homo sapiens
gactagggagccatgt

SEQ ID NO: 6886172 - DNA, 14 bp, Homo sapiens
cagagtctgagccc

SEQ ID NO: 6886173 - DNA, 15 bp, Homo sapiens
cccatctccctgcct

SEQ ID NO: 6886174 - DNA, 15 bp, Homo sapiens
cccatccccctgccc

SEQ ID NO: 6886175 - DNA, 15 bp, Homo sapiens
ctttccccccaaccc

SEQ ID NO: 6886176 - DNA, 19 bp, Homo sapiens
ctccagcccctcttggaga

SEQ ID NO: 6886177 - DNA, 13 bp, Homo sapiens
ccttccccactct

SEQ ID NO: 6886178 - DNA, 16 bp, Homo sapiens
aggtagcaagagagca

SEQ ID NO: 6886179 - DNA, 13 bp, Homo sapiens
ctttcacccatcc

SEQ ID NO: 6886180 - DNA, 19 bp, Homo sapiens
catctttgggagagttcat

SEQ ID NO: 6886181 - DNA, 17 bp, Homo sapiens
tgccgcactctggcggt

SEQ ID NO: 6886182 - DNA, 18 bp, Homo sapiens
ctctaataaagctcctct

SEQ ID NO: 6886183 - DNA, 14 bp, Homo sapiens
tgcactgcaaatac

SEQ ID NO: 6886184 - DNA, 18 bp, Homo sapiens
tatttctgctctggaata

SEQ ID NO: 6886185 - DNA, 17 bp, Homo sapiens
ccctgtttactggttct

SEQ ID NO: 6886186 - DNA, 21 bp, Homo sapiens
gcattatttgagaagctgctc

SEQ ID NO: 6886187 - DNA, 14 bp, Homo sapiens
cacagcccaggcct

SEQ ID NO: 6886188 - DNA, 15 bp, Homo sapiens
tgttttcctttctca

SEQ ID NO: 6886189 - DNA, 15 bp, Homo sapiens
ctcctgatttctctg

SEQ ID NO: 6886190 - DNA, 17 bp, Homo sapiens
agttcccagttggagct

SEQ ID NO: 6886191 - DNA, 19 bp, Homo sapiens
actacctctgtgccttgcc

SEQ ID NO: 6886192 - DNA, 18 bp, Homo sapiens
ctgccccggacctacctc

SEQ ID NO: 6886193 - DNA, 12 bp, Homo sapiens
ccagaagcctga

SEQ ID NO: 6886194 - DNA, 22 bp, Homo sapiens
ctcctgcccccacacctggccc

SEQ ID NO: 6886195 - DNA, 19 bp, Homo sapiens
agttctttgggccagacat

SEQ ID NO: 6886196 - DNA, 13 bp, Homo sapiens
cccacagactcaa

SEQ ID NO: 6886197 - DNA, 19 bp, Homo sapiens
cttctcccgccattggcct

SEQ ID NO: 6886198 - DNA, 16 bp, Homo sapiens
tcgtcctccccctgcc

SEQ ID NO: 6886199 - DNA, 15 bp, Homo sapiens
aagcagcactgtgag

SEQ ID NO: 6886200 - DNA, 13 bp, Homo sapiens
tgtactttctgtt

SEQ ID NO: 6886201 - DNA, 21 bp, Homo sapiens
caagccagggcccagagccct

SEQ ID NO: 6886202 - DNA, 16 bp, Homo sapiens
caggcaagggctctga

SEQ ID NO: 6886203 - DNA, 14 bp, Homo sapiens
ctccctctgcctca

SEQ ID NO: 6886204 - DNA, 14 bp, Homo sapiens
tggtgacctctgcc

SEQ ID NO: 6886205 - DNA, 17 bp, Homo sapiens
cacaaagccccccagct

SEQ ID NO: 6886206 - DNA, 13 bp, Homo sapiens
agcaggcccagga

SEQ ID NO: 6886207 - DNA, 13 bp, Homo sapiens
acacttgtgaata

SEQ ID NO: 6886208 - DNA, 17 bp, Homo sapiens
cctgctcatccactcta

SEQ ID NO: 6886209 - DNA, 15 bp, Homo sapiens
acaaggacaatgcct

SEQ ID NO: 6886210 - DNA, 14 bp, Homo sapiens
gaaggtgcccagga

SEQ ID NO: 6886211 - DNA, 21 bp, Homo sapiens
ctgcaaacagaacagggtcat

SEQ ID NO: 6886212 - DNA, 14 bp, Homo sapiens
caaagtggtaaata

SEQ ID NO: 6886213 - DNA, 21 bp, Homo sapiens
gtatattttatattactgaca

SEQ ID NO: 6886214 - DNA, 19 bp, Homo sapiens
acattaggaagctgaatta

SEQ ID NO: 6886215 - DNA, 17 bp, Homo sapiens
ggtgtcacttactgttt

SEQ ID NO: 6886216 - DNA, 14 bp, Homo sapiens
cttcccactgtatg

SEQ ID NO: 6886217 - DNA, 22 bp, Homo sapiens
agctttatccccgtttcttgca

SEQ ID NO: 6886218 - DNA, 14 bp, Homo sapiens
gagccggcactgca

SEQ ID NO: 6886219 - DNA, 14 bp, Homo sapiens
aactgatttctcac

SEQ ID NO: 6886220 - DNA, 22 bp, Homo sapiens
agacagtgcctatactgcctct

SEQ ID NO: 6886221 - DNA, 18 bp, Homo sapiens
taggaccactcagcccct

SEQ ID NO: 6886222 - DNA, 19 bp, Homo sapiens
cgtgggctcccctcttcct

SEQ ID NO: 6886223 - DNA, 23 bp, Homo sapiens
cagaaaaataaatgtcactgcca

SEQ ID NO: 6886224 - DNA, 22 bp, Homo sapiens
ccgtcccctgggccacccttca

SEQ ID NO: 6886225 - DNA, 23 bp, Homo sapiens
ccttcgtggttatagccctgccc

SEQ ID NO: 6886226 - DNA, 23 bp, Homo sapiens
tgcacaggagggggtcgtggaga

SEQ ID NO: 6886227 - DNA, 20 bp, Homo sapiens
tcttccagtttgctttgccc

SEQ ID NO: 6886228 - DNA, 17 bp, Homo sapiens
tctcctgggcatctggc

SEQ ID NO: 6886229 - DNA, 18 bp, Homo sapiens
caccagacttggcctcca

SEQ ID NO: 6886230 - DNA, 13 bp, Homo sapiens
tgatagcactttc

SEQ ID NO: 6886231 - DNA, 16 bp, Homo sapiens
gcccatgtagctggca

SEQ ID NO: 6886232 - DNA, 15 bp, Homo sapiens
cttctcgtttgctct

SEQ ID NO: 6886233 - DNA, 13 bp, Homo sapiens
tctattgtttact

SEQ ID NO: 6886234 - DNA, 15 bp, Homo sapiens
ctggcttcttatcct

SEQ ID NO: 6886235 - DNA, 16 bp, Homo sapiens
agacatgtgacattta

SEQ ID NO: 6886236 - DNA, 17 bp, Homo sapiens
tagcctggactgtttca

SEQ ID NO: 6886237 - DNA, 14 bp, Homo sapiens
acacccaggtctct

SEQ ID NO: 6886238 - DNA, 21 bp, Homo sapiens
ctcccccatgggctgtgtcct

SEQ ID NO: 6886239 - DNA, 22 bp, Homo sapiens
ccactggaagatcccctctcct

SEQ ID NO: 6886240 - DNA, 23 bp, Homo sapiens
gacccacccatcttcctgctgct

SEQ ID NO: 6886241 - DNA, 19 bp, Homo sapiens
cctctgaaagttgtacatg

SEQ ID NO: 6886242 - DNA, 19 bp, Homo sapiens
aaccccccagcactgagga

SEQ ID NO: 6886243 - DNA, 16 bp, Homo sapiens
ggtgccctccactgcc

SEQ ID NO: 6886244 - DNA, 15 bp, Homo sapiens
gtttttttgtctttc

SEQ ID NO: 6886245 - DNA, 14 bp, Homo sapiens
cagatataactgtc

SEQ ID NO: 6886246 - DNA, 15 bp, Homo sapiens
catttcaactccaga

SEQ ID NO: 6886247 - DNA, 22 bp, Homo sapiens
ctcaatagctccaagctgttaa

SEQ ID NO: 6886248 - DNA, 17 bp, Homo sapiens
cagttcgaccaaactca

SEQ ID NO: 6886249 - DNA, 14 bp, Homo sapiens
cacgatcctgccac

SEQ ID NO: 6886250 - DNA, 17 bp, Homo sapiens
tatggcgttttgtctgt

SEQ ID NO: 6886251 - DNA, 22 bp, Homo sapiens
accaatgattcataacaatgta

SEQ ID NO: 6886252 - DNA, 21 bp, Homo sapiens
tgttgtggaaagtagctgcta

SEQ ID NO: 6886253 - DNA, 21 bp, Homo sapiens
aacagaggaatctacctgtgg

SEQ ID NO: 6886254 - DNA, 16 bp, Homo sapiens
gaagtctagttttata

SEQ ID NO: 6886255 - DNA, 20 bp, Homo sapiens
aatagcttcaggatactgta

SEQ ID NO: 6886256 - DNA, 19 bp, Homo sapiens
tcctcctgaagcctctgcc

SEQ ID NO: 6886257 - DNA, 17 bp, Homo sapiens
ctctgacaaagtgtgtc

SEQ ID NO: 6886258 - DNA, 20 bp, Homo sapiens
actagccaggaagtacttcc

SEQ ID NO: 6886259 - DNA, 23 bp, Homo sapiens
aatgggggggcggctgagctcca

SEQ ID NO: 6886260 - DNA, 16 bp, Homo sapiens
caaggccacctctgcc

SEQ ID NO: 6886261 - DNA, 22 bp, Homo sapiens
ctgactctttttggactcagcc

SEQ ID NO: 6886262 - DNA, 21 bp, Homo sapiens
cctcccaactcaccccagccc

SEQ ID NO: 6886263 - DNA, 23 bp, Homo sapiens
ctggcagggccagggcaatgcca

SEQ ID NO: 6886264 - DNA, 21 bp, Homo sapiens
cttcagaggccctcgctgcca

SEQ ID NO: 6886265 - DNA, 14 bp, Homo sapiens
cttgagctgtctga

SEQ ID NO: 6886266 - DNA, 16 bp, Homo sapiens
cataggtgctcttcct

SEQ ID NO: 6886267 - DNA, 20 bp, Homo sapiens
tgctcagggtcactgaacca

SEQ ID NO: 6886268 - DNA, 22 bp, Homo sapiens
cctgtgcccatcatctctgcct

SEQ ID NO: 6886269 - DNA, 13 bp, Homo sapiens
atctgaactctca

SEQ ID NO: 6886270 - DNA, 19 bp, Homo sapiens
acactcagggcagctgcct

SEQ ID NO: 6886271 - DNA, 18 bp, Homo sapiens
cacccatgggctctgaca

SEQ ID NO: 6886272 - DNA, 18 bp, Homo sapiens
aactgtttccctgctgaa

SEQ ID NO: 6886273 - DNA, 16 bp, Homo sapiens
agcagaggccctgccc

SEQ ID NO: 6886274 - DNA, 23 bp, Homo sapiens
aggtcctgcttgaactgctgcca

SEQ ID NO: 6886275 - DNA, 19 bp, Homo sapiens
atgacagctgtccctgtca

SEQ ID NO: 6886276 - DNA, 17 bp, Homo sapiens
ttcctgtcaccctgagg

SEQ ID NO: 6886277 - DNA, 16 bp, Homo sapiens
cgtggatctccttccc

SEQ ID NO: 6886278 - DNA, 20 bp, Homo sapiens
gggagggccagggaggcaga

SEQ ID NO: 6886279 - DNA, 16 bp, Homo sapiens
aatgtgcccctggccc

SEQ ID NO: 6886280 - DNA, 23 bp, Homo sapiens
ctcttccgttggaaagaacattt

SEQ ID NO: 6886281 - DNA, 19 bp, Homo sapiens
atgatttcccccctccgcc

SEQ ID NO: 6886282 - DNA, 22 bp, Homo sapiens
tcccagtgagaagggcctgctc

SEQ ID NO: 6886283 - DNA, 20 bp, Homo sapiens
acttttttgcttaacttcca

SEQ ID NO: 6886284 - DNA, 19 bp, Homo sapiens
ctgtccatctgtctgtcct

SEQ ID NO: 6886285 - DNA, 14 bp, Homo sapiens
cgccctcctctgcc

SEQ ID NO: 6886286 - DNA, 16 bp, Homo sapiens
ctgagttagctgttta

SEQ ID NO: 6886287 - DNA, 15 bp, Homo sapiens
attaagaacatttta

SEQ ID NO: 6886288 - DNA, 15 bp, Homo sapiens
acctcagctgcctcc

SEQ ID NO: 6886289 - DNA, 21 bp, Homo sapiens
catttgtgtctgcctgcctca

SEQ ID NO: 6886290 - DNA, 15 bp, Homo sapiens
attttccctacctaa

SEQ ID NO: 6886291 - DNA, 15 bp, Homo sapiens
tctactcttcctgtc

SEQ ID NO: 6886292 - DNA, 16 bp, Homo sapiens
ggagcggctctcctga

SEQ ID NO: 6886293 - DNA, 16 bp, Homo sapiens
aagacaagtctgagta

SEQ ID NO: 6886294 - DNA, 20 bp, Homo sapiens
caagacttctctttgcctca

SEQ ID NO: 6886295 - DNA, 13 bp, Homo sapiens
cctttgcccttcc

SEQ ID NO: 6886296 - DNA, 12 bp, Homo sapiens
aaaaaagaacca

SEQ ID NO: 6886297 - DNA, 21 bp, Homo sapiens
tccacccagtgctgccatgcc

SEQ ID NO: 6886298 - DNA, 15 bp, Homo sapiens
cttttcatccttccc

SEQ ID NO: 6886299 - DNA, 23 bp, Homo sapiens
cagtgcagcaaccagagcactgt

SEQ ID NO: 6886300 - DNA, 12 bp, Homo sapiens
cttctctcctca

SEQ ID NO: 6886301 - DNA, 23 bp, Homo sapiens
cctttattctttaattgttgctt

SEQ ID NO: 6886302 - DNA, 14 bp, Homo sapiens
agagttctgctcta

SEQ ID NO: 6886303 - DNA, 14 bp, Homo sapiens
cttttctcctccgc

SEQ ID NO: 6886304 - DNA, 19 bp, Homo sapiens
tatactcagaactgtccca

SEQ ID NO: 6886305 - DNA, 14 bp, Homo sapiens
accttagtacttta

SEQ ID NO: 6886306 - DNA, 14 bp, Homo sapiens
ctttctgtctctct

SEQ ID NO: 6886307 - DNA, 14 bp, Homo sapiens
tctcatgtcctgct

SEQ ID NO: 6886308 - DNA, 20 bp, Homo sapiens
agagaaaccagcttccttca

SEQ ID NO: 6886309 - DNA, 20 bp, Homo sapiens
tgtttcaacccaactgacct

SEQ ID NO: 6886310 - DNA, 20 bp, Homo sapiens
taaactgaagcaacttgatg

SEQ ID NO: 6886311 - DNA, 20 bp, Homo sapiens
aggaaaaacagaacatttct

SEQ ID NO: 6886312 - DNA, 17 bp, Homo sapiens
ctggagttgatctggaa

SEQ ID NO: 6886313 - DNA, 15 bp, Homo sapiens
gatttacctttggaa

SEQ ID NO: 6886314 - DNA, 17 bp, Homo sapiens
ggaataaatttttgtct

SEQ ID NO: 6886315 - DNA, 22 bp, Homo sapiens
aggggcttctaatgacccagat

SEQ ID NO: 6886316 - DNA, 16 bp, Homo sapiens
catttccccctcctca

SEQ ID NO: 6886317 - DNA, 19 bp, Homo sapiens
aggccccgaggacccagac

SEQ ID NO: 6886318 - DNA, 15 bp, Homo sapiens
ggaccaggagccagg

SEQ ID NO: 6886319 - DNA, 15 bp, Homo sapiens
cagtgaagatgtgta

SEQ ID NO: 6886320 - DNA, 16 bp, Homo sapiens
attctctgcccagccg

SEQ ID NO: 6886321 - DNA, 17 bp, Homo sapiens
tgccatcttctccccga

SEQ ID NO: 6886322 - DNA, 15 bp, Homo sapiens
gacactaattctgtc

SEQ ID NO: 6886323 - DNA, 17 bp, Homo sapiens
ggcaggaccctgctgac

SEQ ID NO: 6886324 - DNA, 15 bp, Homo sapiens
tgcgactttctgcct

SEQ ID NO: 6886325 - DNA, 17 bp, Homo sapiens
taatttccttctgttaa

SEQ ID NO: 6886326 - DNA, 21 bp, Homo sapiens
agaactgctaaatactgtaca

SEQ ID NO: 6886327 - DNA, 19 bp, Homo sapiens
ctgcgcccagagctggcct

SEQ ID NO: 6886328 - DNA, 23 bp, Homo sapiens
gatcttccaaatattagccaaag

SEQ ID NO: 6886329 - DNA, 20 bp, Homo sapiens
ctgtagggaaaccttggaga

SEQ ID NO: 6886330 - DNA, 22 bp, Homo sapiens
aacatgtttttcttctccctca

SEQ ID NO: 6886331 - DNA, 16 bp, Homo sapiens
gcggatgggcacacac

SEQ ID NO: 6886332 - DNA, 12 bp, Homo sapiens
cccttcccgcct

SEQ ID NO: 6886333 - DNA, 21 bp, Homo sapiens
cttttttaagatttttctcaa

SEQ ID NO: 6886334 - DNA, 12 bp, Homo sapiens
ccttcctctgct

SEQ ID NO: 6886335 - DNA, 12 bp, Homo sapiens
cctccctctgcc

SEQ ID NO: 6886336 - DNA, 17 bp, Homo sapiens
agcaggctggcagctct

SEQ ID NO: 6886337 - DNA, 22 bp, Homo sapiens
cccgtgtaaataatttattaca

SEQ ID NO: 6886338 - DNA, 19 bp, Homo sapiens
ggttcagcccctcctctgc

SEQ ID NO: 6886339 - DNA, 16 bp, Homo sapiens
tatggaaatacattta

SEQ ID NO: 6886340 - DNA, 22 bp, Homo sapiens
agctgtgcaattactgcctgca

SEQ ID NO: 6886341 - DNA, 14 bp, Homo sapiens
aacagacactgtaa

SEQ ID NO: 6886342 - DNA, 17 bp, Homo sapiens
agactctgtctacctgg

SEQ ID NO: 6886343 - DNA, 15 bp, Homo sapiens
tcttcttcacatcca

SEQ ID NO: 6886344 - DNA, 14 bp, Homo sapiens
cattcattctgagc

SEQ ID NO: 6886345 - DNA, 22 bp, Homo sapiens
ccgtacccccgtggtctttgaa

SEQ ID NO: 6886346 - DNA, 20 bp, Homo sapiens
tgcatcccgatacctcagcc

SEQ ID NO: 6886347 - DNA, 22 bp, Homo sapiens
gcccctgggcttggcctgctgt

SEQ ID NO: 6886348 - DNA, 12 bp, Homo sapiens
tatctgtctttc

SEQ ID NO: 6886349 - DNA, 13 bp, Homo sapiens
tgccatgtcttta

SEQ ID NO: 6886350 - DNA, 21 bp, Homo sapiens
tgtcgtgggtgtgtgtagcca

SEQ ID NO: 6886351 - DNA, 13 bp, Homo sapiens
actcttctctcct

SEQ ID NO: 6886352 - DNA, 13 bp, Homo sapiens
aatattttaagta

SEQ ID NO: 6886353 - DNA, 16 bp, Homo sapiens
gaagcaggttcttgat

SEQ ID NO: 6886354 - DNA, 13 bp, Homo sapiens
ccttccccttccc

SEQ ID NO: 6886355 - DNA, 18 bp, Homo sapiens
ggtgcctgccatagccag

SEQ ID NO: 6886356 - DNA, 14 bp, Homo sapiens
ctctccaactgcct

SEQ ID NO: 6886357 - DNA, 22 bp, Homo sapiens
acttagaaacaaaaagagcttt

SEQ ID NO: 6886358 - DNA, 19 bp, Homo sapiens
acctatttctctttcttta

SEQ ID NO: 6886359 - DNA, 18 bp, Homo sapiens
ccatggcttaatgcttct

SEQ ID NO: 6886360 - DNA, 13 bp, Homo sapiens
agcagcctctgat

SEQ ID NO: 6886361 - DNA, 17 bp, Homo sapiens
tgcacattctcccttga

SEQ ID NO: 6886362 - DNA, 21 bp, Homo sapiens
cctccagcccctgtcccaccc

SEQ ID NO: 6886363 - DNA, 18 bp, Homo sapiens
cacagcctcacccctgcc

SEQ ID NO: 6886364 - DNA, 14 bp, Homo sapiens
tgcccccagcctca

SEQ ID NO: 6886365 - DNA, 14 bp, Homo sapiens
cattatgaaaatct

SEQ ID NO: 6886366 - DNA, 14 bp, Homo sapiens
cacctccccctgcg

SEQ ID NO: 6886367 - DNA, 16 bp, Homo sapiens
aattgtatagagatat

SEQ ID NO: 6886368 - DNA, 22 bp, Homo sapiens
gagaaactccaaagtccacaca

SEQ ID NO: 6886369 - DNA, 18 bp, Homo sapiens
cctctgctgacctgctga

SEQ ID NO: 6886370 - DNA, 12 bp, Homo sapiens
ccaaccttccca

SEQ ID NO: 6886371 - DNA, 20 bp, Homo sapiens
tcagggcagtggccaagcct

SEQ ID NO: 6886372 - DNA, 20 bp, Homo sapiens
ttacgtagtgtagatttgtt

SEQ ID NO: 6886373 - DNA, 18 bp, Homo sapiens
catccagcagtctctgcc

SEQ ID NO: 6886374 - DNA, 13 bp, Homo sapiens
cttcccacggcca

SEQ ID NO: 6886375 - DNA, 16 bp, Homo sapiens
ccagtcctgcccgcca

SEQ ID NO: 6886376 - DNA, 22 bp, Homo sapiens
ctcctagcacaaggagtgcccg

SEQ ID NO: 6886377 - DNA, 19 bp, Homo sapiens
ctggtctgtgtgtgttctt

SEQ ID NO: 6886378 - DNA, 15 bp, Homo sapiens
ctgcaggcagacacg

SEQ ID NO: 6886379 - DNA, 22 bp, Homo sapiens
gaaattgttgtatatcactaaa

SEQ ID NO: 6886380 - DNA, 15 bp, Homo sapiens
ccctccttccctcct

SEQ ID NO: 6886381 - DNA, 17 bp, Homo sapiens
cttccgagacaccacaa

SEQ ID NO: 6886382 - DNA, 15 bp, Homo sapiens
cactcagccaggcct

SEQ ID NO: 6886383 - DNA, 14 bp, Homo sapiens
cgtagaagctcttg

SEQ ID NO: 6886384 - DNA, 15 bp, Homo sapiens
atactctgttgcctc

SEQ ID NO: 6886385 - DNA, 21 bp, Homo sapiens
tttcaagtttttcatactgta

SEQ ID NO: 6886386 - DNA, 22 bp, Homo sapiens
tggctgaaaggaagctgtgcgt

SEQ ID NO: 6886387 - DNA, 14 bp, Homo sapiens
cacccactcagcca

SEQ ID NO: 6886388 - DNA, 21 bp, Homo sapiens
gctgctgtaactgctgagcca

SEQ ID NO: 6886389 - DNA, 19 bp, Homo sapiens
aagagtccaactcacttcc

SEQ ID NO: 6886390 - DNA, 17 bp, Homo sapiens
tttttgtgtgtatttgc

SEQ ID NO: 6886391 - DNA, 16 bp, Homo sapiens
cagccagccctggagg

SEQ ID NO: 6886392 - DNA, 17 bp, Homo sapiens
caagactaacctttgtt

SEQ ID NO: 6886393 - DNA, 16 bp, Homo sapiens
acttccgttgctgcca

SEQ ID NO: 6886394 - DNA, 16 bp, Homo sapiens
cttctgccacttccca

SEQ ID NO: 6886395 - DNA, 15 bp, Homo sapiens
cacgcctcctggcca

SEQ ID NO: 6886396 - DNA, 19 bp, Homo sapiens
caaagtattaagcatatat

SEQ ID NO: 6886397 - DNA, 21 bp, Homo sapiens
gagaaatagctgaaaagggca

SEQ ID NO: 6886398 - DNA, 21 bp, Homo sapiens
caatgctatggactgcacaaa

SEQ ID NO: 6886399 - DNA, 18 bp, Homo sapiens
ctgttgctgctactgtct

SEQ ID NO: 6886400 - DNA, 19 bp, Homo sapiens
tgatccacccacctcagcc

SEQ ID NO: 6886401 - DNA, 20 bp, Homo sapiens
catttttgttttgaaagttt

SEQ ID NO: 6886402 - DNA, 14 bp, Homo sapiens
tcccacctcagcct

SEQ ID NO: 6886403 - DNA, 17 bp, Homo sapiens
gagctagggctgctgct

SEQ ID NO: 6886404 - DNA, 21 bp, Homo sapiens
cattgcctcatttcttcctct

SEQ ID NO: 6886405 - DNA, 18 bp, Homo sapiens
ctccatatttgatttcta

SEQ ID NO: 6886406 - DNA, 20 bp, Homo sapiens
gtttgagctctgcagcccag

SEQ ID NO: 6886407 - DNA, 20 bp, Homo sapiens
ttccagcaattctcctgcct

SEQ ID NO: 6886408 - DNA, 19 bp, Homo sapiens
ccaggaggggtctgcctcc

SEQ ID NO: 6886409 - DNA, 21 bp, Homo sapiens
gggatcctggagcccctgtgt

SEQ ID NO: 6886410 - DNA, 17 bp, Homo sapiens
ctttttatggcctgtga

SEQ ID NO: 6886411 - DNA, 14 bp, Homo sapiens
agggcttgtgaaca

SEQ ID NO: 6886412 - DNA, 17 bp, Homo sapiens
gctgtgtctgagcccaa

SEQ ID NO: 6886413 - DNA, 16 bp, Homo sapiens
tccgtgtgcctcctgt

SEQ ID NO: 6886414 - DNA, 19 bp, Homo sapiens
ctctttgattatttgcatg

SEQ ID NO: 6886415 - DNA, 21 bp, Homo sapiens
ctgctgcacaggccctgggga

SEQ ID NO: 6886416 - DNA, 12 bp, Homo sapiens
acttctgtctcc

SEQ ID NO: 6886417 - DNA, 13 bp, Homo sapiens
tgttgctgcctca

SEQ ID NO: 6886418 - DNA, 13 bp, Homo sapiens
cttccctctctcc

SEQ ID NO: 6886419 - DNA, 15 bp, Homo sapiens
tagttccctctgcct

SEQ ID NO: 6886420 - DNA, 13 bp, Homo sapiens
ctatggcctgtgg

SEQ ID NO: 6886421 - DNA, 15 bp, Homo sapiens
ccctctcccctgccc

SEQ ID NO: 6886422 - DNA, 16 bp, Homo sapiens
gcatgcacagctgctt

SEQ ID NO: 6886423 - DNA, 12 bp, Homo sapiens
ataaactgtgag

SEQ ID NO: 6886424 - DNA, 15 bp, Homo sapiens
acaatcatctattga

SEQ ID NO: 6886425 - DNA, 19 bp, Homo sapiens
tcttgtgattgactttttg

SEQ ID NO: 6886426 - DNA, 21 bp, Homo sapiens
atactgtttcttgcactgaat

SEQ ID NO: 6886427 - DNA, 15 bp, Homo sapiens
cccacctccctgccc

SEQ ID NO: 6886428 - DNA, 14 bp, Homo sapiens
tcaagattcagcta

SEQ ID NO: 6886429 - DNA, 22 bp, Homo sapiens
aagaatatttaagaaaagcact

SEQ ID NO: 6886430 - DNA, 16 bp, Homo sapiens
cacacttttgcacata

SEQ ID NO: 6886431 - DNA, 23 bp, Homo sapiens
ctacacagtctgcaagattctga

SEQ ID NO: 6886432 - DNA, 18 bp, Homo sapiens
taggcaccttttactgtg

SEQ ID NO: 6886433 - DNA, 22 bp, Homo sapiens
gctgctaatattttcctcctga

SEQ ID NO: 6886434 - DNA, 14 bp, Homo sapiens
gccatgcttcttgc

SEQ ID NO: 6886435 - DNA, 13 bp, Homo sapiens
cgagccctggaga

SEQ ID NO: 6886436 - DNA, 17 bp, Homo sapiens
ggcgctcaggacccagg

SEQ ID NO: 6886437 - DNA, 17 bp, Homo sapiens
cccggccggccctggct

SEQ ID NO: 6886438 - DNA, 15 bp, Homo sapiens
cataattcttccaaa

SEQ ID NO: 6886439 - DNA, 19 bp, Homo sapiens
cctcgccctgtccctccca

SEQ ID NO: 6886440 - DNA, 15 bp, Homo sapiens
caattccctctctca

SEQ ID NO: 6886441 - DNA, 16 bp, Homo sapiens
tacattagtgagattt

SEQ ID NO: 6886442 - DNA, 22 bp, Homo sapiens
gttttactcttgttgcccaggc

SEQ ID NO: 6886443 - DNA, 17 bp, Homo sapiens
caccggaggtcactcca

SEQ ID NO: 6886444 - DNA, 13 bp, Homo sapiens
aatcccttcctct

SEQ ID NO: 6886445 - DNA, 11 bp, Homo sapiens
cttctgtgcct

SEQ ID NO: 6886446 - DNA, 15 bp, Homo sapiens
cttcctcccacctca

SEQ ID NO: 6886447 - DNA, 13 bp, Homo sapiens
cctttccccagca

SEQ ID NO: 6886448 - DNA, 12 bp, Homo sapiens
cctcattctgaa

SEQ ID NO: 6886449 - DNA, 22 bp, Homo sapiens
ttgcgttccatgatgctgggat

SEQ ID NO: 6886450 - DNA, 20 bp, Homo sapiens
acaatgcgtggcacatctaa

SEQ ID NO: 6886451 - DNA, 13 bp, Homo sapiens
catttttaatgta

SEQ ID NO: 6886452 - DNA, 22 bp, Homo sapiens
agtgttgtacaattactgtgag

SEQ ID NO: 6886453 - DNA, 21 bp, Homo sapiens
ttaattgaaaagaagtagtgt

SEQ ID NO: 6886454 - DNA, 13 bp, Homo sapiens
ccagatcatgccg

SEQ ID NO: 6886455 - DNA, 14 bp, Homo sapiens
ccctcgctgcttct

SEQ ID NO: 6886456 - DNA, 16 bp, Homo sapiens
cacacagctctgtcct

SEQ ID NO: 6886457 - DNA, 14 bp, Homo sapiens
cgcccgcctctgcc

SEQ ID NO: 6886458 - DNA, 17 bp, Homo sapiens
aagaaattgtccttgaa

SEQ ID NO: 6886459 - DNA, 20 bp, Homo sapiens
gctcgccctcctttctgtgc

SEQ ID NO: 6886460 - DNA, 19 bp, Homo sapiens
cctggcggagatgcttcta

SEQ ID NO: 6886461 - DNA, 20 bp, Homo sapiens
cactggcctctccccaggaa

SEQ ID NO: 6886462 - DNA, 16 bp, Homo sapiens
caactgatcctgctcc

SEQ ID NO: 6886463 - DNA, 19 bp, Homo sapiens
cagggctatagctcaggac

SEQ ID NO: 6886464 - DNA, 16 bp, Homo sapiens
accttggtccctctca

SEQ ID NO: 6886465 - DNA, 16 bp, Homo sapiens
agtgtttcctttttgg

SEQ ID NO: 6886466 - DNA, 13 bp, Homo sapiens
gctacctgatttc

SEQ ID NO: 6886467 - DNA, 17 bp, Homo sapiens
tagtggcttcagcccct

SEQ ID NO: 6886468 - DNA, 22 bp, Homo sapiens
ttttcttctagctttgttgtcc

SEQ ID NO: 6886469 - DNA, 17 bp, Homo sapiens
cctttcttcaatacaaa

SEQ ID NO: 6886470 - DNA, 21 bp, Homo sapiens
ccctcagacagccccctgccc

SEQ ID NO: 6886471 - DNA, 14 bp, Homo sapiens
cagctctttcctcc

SEQ ID NO: 6886472 - DNA, 16 bp, Homo sapiens
gaacacccactggcca

SEQ ID NO: 6886473 - DNA, 14 bp, Homo sapiens
cagcacagtgtgtg

SEQ ID NO: 6886474 - DNA, 22 bp, Homo sapiens
ctccctggttgcctctcttgcc

SEQ ID NO: 6886475 - DNA, 17 bp, Homo sapiens
atgttgaaatatgcata

SEQ ID NO: 6886476 - DNA, 13 bp, Homo sapiens
gtctgtagtgttt

SEQ ID NO: 6886477 - DNA, 13 bp, Homo sapiens
ctgaggacagctg

SEQ ID NO: 6886478 - DNA, 12 bp, Homo sapiens
ttttcctcccca

SEQ ID NO: 6886479 - DNA, 12 bp, Homo sapiens
tcatctgtgtga

SEQ ID NO: 6886480 - DNA, 22 bp, Homo sapiens
caccctttccggcacactgcca

SEQ ID NO: 6886481 - DNA, 19 bp, Homo sapiens
gcacaatttgagactgaaa

SEQ ID NO: 6886482 - DNA, 15 bp, Homo sapiens
gactcagcctctgct

SEQ ID NO: 6886483 - DNA, 13 bp, Homo sapiens
gagggcccagagc

SEQ ID NO: 6886484 - DNA, 18 bp, Homo sapiens
cagcctggggctccctct

SEQ ID NO: 6886485 - DNA, 14 bp, Homo sapiens
tggtctctggctct

SEQ ID NO: 6886486 - DNA, 19 bp, Homo sapiens
ctttgcagctgcttttgca

SEQ ID NO: 6886487 - DNA, 16 bp, Homo sapiens
actttctacatgcaaa

SEQ ID NO: 6886488 - DNA, 16 bp, Homo sapiens
tggcttgtgtgtttca

SEQ ID NO: 6886489 - DNA, 14 bp, Homo sapiens
cccccgcccggcct

SEQ ID NO: 6886490 - DNA, 20 bp, Homo sapiens
agggagttttgtctgtctcc

SEQ ID NO: 6886491 - DNA, 13 bp, Homo sapiens
ctgagcactgcca

SEQ ID NO: 6886492 - DNA, 21 bp, Homo sapiens
ccatgactgcacccagctcca

SEQ ID NO: 6886493 - DNA, 23 bp, Homo sapiens
tgccagttgggctcgcactgccc

SEQ ID NO: 6886494 - DNA, 21 bp, Homo sapiens
tgcattttaaaaatgaaattt

SEQ ID NO: 6886495 - DNA, 20 bp, Homo sapiens
gtccagcccctcctccctca

SEQ ID NO: 6886496 - DNA, 16 bp, Homo sapiens
ctgtcttcctgcattc

SEQ ID NO: 6886497 - DNA, 17 bp, Homo sapiens
gattatgttcctgctgt

SEQ ID NO: 6886498 - DNA, 16 bp, Homo sapiens
acagagggaagccatg

SEQ ID NO: 6886499 - DNA, 21 bp, Homo sapiens
taaagtgtttcagctaaggga

SEQ ID NO: 6886500 - DNA, 15 bp, Homo sapiens
cacctttggtgcaga

SEQ ID NO: 6886501 - DNA, 16 bp, Homo sapiens
cattccatgactctgc

SEQ ID NO: 6886502 - DNA, 14 bp, Homo sapiens
tattcaattcctct

SEQ ID NO: 6886503 - DNA, 17 bp, Homo sapiens
ccatggggttcgagact

SEQ ID NO: 6886504 - DNA, 23 bp, Homo sapiens
tcagcctcgcaggcctccctgcc

SEQ ID NO: 6886505 - DNA, 14 bp, Homo sapiens
aaaatcctgcccaa

SEQ ID NO: 6886506 - DNA, 23 bp, Homo sapiens
gctgccgagacagaccctctgcc

SEQ ID NO: 6886507 - DNA, 14 bp, Homo sapiens
cctgcagctcctct

SEQ ID NO: 6886508 - DNA, 21 bp, Homo sapiens
aggagcccccaacacaggcaa

SEQ ID NO: 6886509 - DNA, 12 bp, Homo sapiens
agttttgttgcc

SEQ ID NO: 6886510 - DNA, 23 bp, Homo sapiens
ctctgggctgagcctactgtctc

SEQ ID NO: 6886511 - DNA, 20 bp, Homo sapiens
atctgtctgtgcacatgcct

SEQ ID NO: 6886512 - DNA, 14 bp, Homo sapiens
ccacgctgtctcca

SEQ ID NO: 6886513 - DNA, 23 bp, Homo sapiens
ctacagcactactgggtgtcatt

SEQ ID NO: 6886514 - DNA, 16 bp, Homo sapiens
gctgtgccctcttgat

SEQ ID NO: 6886515 - DNA, 15 bp, Homo sapiens
aggaacagcccagca

SEQ ID NO: 6886516 - DNA, 17 bp, Homo sapiens
acgcaggcccctctcct

SEQ ID NO: 6886517 - DNA, 22 bp, Homo sapiens
tatttaagcaataaaactgcta

SEQ ID NO: 6886518 - DNA, 17 bp, Homo sapiens
cagaaatactgctctga

SEQ ID NO: 6886519 - DNA, 20 bp, Homo sapiens
tgcattatctagatactgta

SEQ ID NO: 6886520 - DNA, 10 bp, Homo sapiens
cagaaaattt

SEQ ID NO: 6886521 - DNA, 15 bp, Homo sapiens
ctggacacccctgct

SEQ ID NO: 6886522 - DNA, 23 bp, Homo sapiens
tggtgacctgggtatcccctgcc

SEQ ID NO: 6886523 - DNA, 21 bp, Homo sapiens
cctgctctgtagccacctcct

SEQ ID NO: 6886524 - DNA, 13 bp, Homo sapiens
ttcctgagctgtc

SEQ ID NO: 6886525 - DNA, 18 bp, Homo sapiens
tatttttggttgtcaata

SEQ ID NO: 6886526 - DNA, 14 bp, Homo sapiens
agcctcgcctgtca

SEQ ID NO: 6886527 - DNA, 21 bp, Homo sapiens
agagtgcaagcccctgctcca

SEQ ID NO: 6886528 - DNA, 15 bp, Homo sapiens
ccataccccctgccc

SEQ ID NO: 6886529 - DNA, 15 bp, Homo sapiens
tcgatttctacctca

SEQ ID NO: 6886530 - DNA, 17 bp, Homo sapiens
ctggaggtttgtttaga

SEQ ID NO: 6886531 - DNA, 20 bp, Homo sapiens
cctctcccaccctcttccta

SEQ ID NO: 6886532 - DNA, 18 bp, Homo sapiens
catcttgctaccagtatt

SEQ ID NO: 6886533 - DNA, 17 bp, Homo sapiens
aactcacagcttctcca

SEQ ID NO: 6886534 - DNA, 21 bp, Homo sapiens
atctgtccatcctcctctcca

SEQ ID NO: 6886535 - DNA, 19 bp, Homo sapiens
aatctttgaaagacttcca

SEQ ID NO: 6886536 - DNA, 17 bp, Homo sapiens
gaccccccgtgggctcc

SEQ ID NO: 6886537 - DNA, 21 bp, Homo sapiens
cccttccctcacaccctgcct

SEQ ID NO: 6886538 - DNA, 24 bp, Homo sapiens
aaactatgtgctatcacatgtgaa

SEQ ID NO: 6886539 - DNA, 12 bp, Homo sapiens
ccctcctgctgc

SEQ ID NO: 6886540 - DNA, 21 bp, Homo sapiens
ctagaatgtctgaagtacaaa

SEQ ID NO: 6886541 - DNA, 22 bp, Homo sapiens
ccaaagtgcatgtcacatgcca

SEQ ID NO: 6886542 - DNA, 14 bp, Homo sapiens
tgcccacacctgcc

SEQ ID NO: 6886543 - DNA, 12 bp, Homo sapiens
cagcctacctct

SEQ ID NO: 6886544 - DNA, 18 bp, Homo sapiens
cactctggattcagcctt

SEQ ID NO: 6886545 - DNA, 12 bp, Homo sapiens
gagaaaagggaa

SEQ ID NO: 6886546 - DNA, 18 bp, Homo sapiens
ccttccactgcctctgcc

SEQ ID NO: 6886547 - DNA, 18 bp, Homo sapiens
cacctgacaatggcagct

SEQ ID NO: 6886548 - DNA, 18 bp, Homo sapiens
ctgggtttgggagccagg

SEQ ID NO: 6886549 - DNA, 22 bp, Homo sapiens
atccccagcccctcctccctca

SEQ ID NO: 6886550 - DNA, 15 bp, Homo sapiens
ctcgctgttgctgaa

SEQ ID NO: 6886551 - DNA, 18 bp, Homo sapiens
catgccgcgtccctgccc

SEQ ID NO: 6886552 - DNA, 12 bp, Homo sapiens
catccctggccc

SEQ ID NO: 6886553 - DNA, 23 bp, Homo sapiens
agagttctttaggtgcctcctgt

SEQ ID NO: 6886554 - DNA, 17 bp, Homo sapiens
ccttcttcacccagcta

SEQ ID NO: 6886555 - DNA, 19 bp, Homo sapiens
acccagtgctgccatgcca

SEQ ID NO: 6886556 - DNA, 17 bp, Homo sapiens
ctggacatgcctgtcct

SEQ ID NO: 6886557 - DNA, 15 bp, Homo sapiens
accttcccttcctca

SEQ ID NO: 6886558 - DNA, 18 bp, Homo sapiens
atctaaaaaataactgtg

SEQ ID NO: 6886559 - DNA, 18 bp, Homo sapiens
cattaagcacacacatct

SEQ ID NO: 6886560 - DNA, 22 bp, Homo sapiens
gtgtttgcttggaaattccttg

SEQ ID NO: 6886561 - DNA, 11 bp, Homo sapiens
tacactttatt

SEQ ID NO: 6886562 - DNA, 18 bp, Homo sapiens
gacattttcatgcttcca

SEQ ID NO: 6886563 - DNA, 22 bp, Homo sapiens
ctgtctttagaatcgctttcct

SEQ ID NO: 6886564 - DNA, 17 bp, Homo sapiens
gccaaaaggaaaaagct

SEQ ID NO: 6886565 - DNA, 15 bp, Homo sapiens
agcccttatctgtgc

SEQ ID NO: 6886566 - DNA, 13 bp, Homo sapiens
cctctcagcttct

SEQ ID NO: 6886567 - DNA, 16 bp, Homo sapiens
ccaggcacctcttcct

SEQ ID NO: 6886568 - DNA, 20 bp, Homo sapiens
atataataactttattgcat

SEQ ID NO: 6886569 - DNA, 14 bp, Homo sapiens
aagtgggctcctga

SEQ ID NO: 6886570 - DNA, 16 bp, Homo sapiens
actactgttatcagta

SEQ ID NO: 6886571 - DNA, 19 bp, Homo sapiens
ctttgtccccacacagcct

SEQ ID NO: 6886572 - DNA, 20 bp, Homo sapiens
aaggtgggaggatgtgaatt

SEQ ID NO: 6886573 - DNA, 13 bp, Homo sapiens
caagcggccctga

SEQ ID NO: 6886574 - DNA, 17 bp, Homo sapiens
ccatcccatcccatccc

SEQ ID NO: 6886575 - DNA, 14 bp, Homo sapiens
ctgccgctacctcc

SEQ ID NO: 6886576 - DNA, 17 bp, Homo sapiens
ccaactcaccccagccc

SEQ ID NO: 6886577 - DNA, 13 bp, Homo sapiens
tgtataaatgtct

SEQ ID NO: 6886578 - DNA, 18 bp, Homo sapiens
cccatcctggcccagcct

SEQ ID NO: 6886579 - DNA, 13 bp, Homo sapiens
cactcctcaggaa

SEQ ID NO: 6886580 - DNA, 22 bp, Homo sapiens
cttcttggggcccagtgcatgg

SEQ ID NO: 6886581 - DNA, 15 bp, Homo sapiens
actcttcattttgag

SEQ ID NO: 6886582 - DNA, 15 bp, Homo sapiens
taaggaggtttgtat

SEQ ID NO: 6886583 - DNA, 14 bp, Homo sapiens
tcttccaacatgtg

SEQ ID NO: 6886584 - DNA, 17 bp, Homo sapiens
tggtttacactttatgc

SEQ ID NO: 6886585 - DNA, 13 bp, Homo sapiens
tttcccctggcct

SEQ ID NO: 6886586 - DNA, 21 bp, Homo sapiens
cataatgtttttcctttctta

SEQ ID NO: 6886587 - DNA, 16 bp, Homo sapiens
ccagcagagcccacca

SEQ ID NO: 6886588 - DNA, 15 bp, Homo sapiens
aattccactctgata

SEQ ID NO: 6886589 - DNA, 14 bp, Homo sapiens
attacccttcctca

SEQ ID NO: 6886590 - DNA, 19 bp, Homo sapiens
agttccagaaaacctctcc

SEQ ID NO: 6886591 - DNA, 14 bp, Homo sapiens
ggatgattgaagaa

SEQ ID NO: 6886592 - DNA, 23 bp, Homo sapiens
tgcacacggctggtcactctgcc

SEQ ID NO: 6886593 - DNA, 23 bp, Homo sapiens
caaattgaaagcttccatgttta

SEQ ID NO: 6886594 - DNA, 13 bp, Homo sapiens
aatattttgaata

SEQ ID NO: 6886595 - DNA, 13 bp, Homo sapiens
gcctgggcctgct

SEQ ID NO: 6886596 - DNA, 21 bp, Homo sapiens
ctcttgctaatcagtgtctca

SEQ ID NO: 6886597 - DNA, 15 bp, Homo sapiens
taatggtaacttttg

SEQ ID NO: 6886598 - DNA, 16 bp, Homo sapiens
gcctctctcaggccaa

SEQ ID NO: 6886599 - DNA, 19 bp, Homo sapiens
caggctggccctgccctgg

SEQ ID NO: 6886600 - DNA, 20 bp, Homo sapiens
cacagactccctcccctgcc

SEQ ID NO: 6886601 - DNA, 16 bp, Homo sapiens
ccggtccaccccgtcc

SEQ ID NO: 6886602 - DNA, 19 bp, Homo sapiens
aacctgtgcagtcccgtgg

SEQ ID NO: 6886603 - DNA, 22 bp, Homo sapiens
agaactgctttatcccacggaa

SEQ ID NO: 6886604 - DNA, 12 bp, Homo sapiens
actggcagtgca

SEQ ID NO: 6886605 - DNA, 17 bp, Homo sapiens
agccaggctctgtgctg

SEQ ID NO: 6886606 - DNA, 16 bp, Homo sapiens
tctttcttcctctgct

SEQ ID NO: 6886607 - DNA, 16 bp, Homo sapiens
ttccagcgtctgctgt

SEQ ID NO: 6886608 - DNA, 18 bp, Homo sapiens
tccgggacccccaggaca

SEQ ID NO: 6886609 - DNA, 22 bp, Homo sapiens
cattcttttcagcttgtttcta

SEQ ID NO: 6886610 - DNA, 17 bp, Homo sapiens
cctgctccgctgctcct

SEQ ID NO: 6886611 - DNA, 19 bp, Homo sapiens
tgttcgttcttgttctgtt

SEQ ID NO: 6886612 - DNA, 19 bp, Homo sapiens
ttgaatatagcctgcctca

SEQ ID NO: 6886613 - DNA, 23 bp, Homo sapiens
aaggagtttctttagctgacaga

SEQ ID NO: 6886614 - DNA, 20 bp, Homo sapiens
agttctttcctccccctgca

SEQ ID NO: 6886615 - DNA, 16 bp, Homo sapiens
cagcaaacacagtcac

SEQ ID NO: 6886616 - DNA, 14 bp, Homo sapiens
gtcctcctgtgcta

SEQ ID NO: 6886617 - DNA, 18 bp, Homo sapiens
tctccctcacaagcgctc

SEQ ID NO: 6886618 - DNA, 13 bp, Homo sapiens
aagctctgctcct

SEQ ID NO: 6886619 - DNA, 18 bp, Homo sapiens
ccacatgggagcagtcca

SEQ ID NO: 6886620 - DNA, 16 bp, Homo sapiens
tacataaggatgactt

SEQ ID NO: 6886621 - DNA, 20 bp, Homo sapiens
cacagcgtccctagcagtga

SEQ ID NO: 6886622 - DNA, 16 bp, Homo sapiens
ccccagaccccatcca

SEQ ID NO: 6886623 - DNA, 18 bp, Homo sapiens
ctgctctccttgccctgg

SEQ ID NO: 6886624 - DNA, 20 bp, Homo sapiens
gtgactcagcagcctgcgct

SEQ ID NO: 6886625 - DNA, 18 bp, Homo sapiens
atcatttataatactgtt

SEQ ID NO: 6886626 - DNA, 17 bp, Homo sapiens
cctgggctgtgctgctt

SEQ ID NO: 6886627 - DNA, 12 bp, Homo sapiens
gcatcctgctgg

SEQ ID NO: 6886628 - DNA, 18 bp, Homo sapiens
caataaaattatttgcag

SEQ ID NO: 6886629 - DNA, 22 bp, Homo sapiens
aactatgcatggtgccccagga

SEQ ID NO: 6886630 - DNA, 13 bp, Homo sapiens
ctcaaatcttcta

SEQ ID NO: 6886631 - DNA, 22 bp, Homo sapiens
tgttccccagcaactctggcct

SEQ ID NO: 6886632 - DNA, 14 bp, Homo sapiens
cagtgcccattcct

SEQ ID NO: 6886633 - DNA, 14 bp, Homo sapiens
cttgagggcccaga

SEQ ID NO: 6886634 - DNA, 16 bp, Homo sapiens
tagacttgtgtgcatg

SEQ ID NO: 6886635 - DNA, 20 bp, Homo sapiens
tttcaatcaactttactgta

SEQ ID NO: 6886636 - DNA, 17 bp, Homo sapiens
ttctattgcctctgaga

SEQ ID NO: 6886637 - DNA, 21 bp, Homo sapiens
cataatttgtttaaaattctc

SEQ ID NO: 6886638 - DNA, 23 bp, Homo sapiens
acccacccctcctgggcccaggc

SEQ ID NO: 6886639 - DNA, 19 bp, Homo sapiens
ttaaatctagacattcttt

SEQ ID NO: 6886640 - DNA, 20 bp, Homo sapiens
agcaactgacctgagcggca

SEQ ID NO: 6886641 - DNA, 14 bp, Homo sapiens
ctctgatatgtcta

SEQ ID NO: 6886642 - DNA, 23 bp, Homo sapiens
caattttgtcttaagtgtttctc

SEQ ID NO: 6886643 - DNA, 20 bp, Homo sapiens
caagcttcagagcctagcca

SEQ ID NO: 6886644 - DNA, 23 bp, Homo sapiens
cagaccacctgcttctgaactca

SEQ ID NO: 6886645 - DNA, 11 bp, Homo sapiens
ctccccttcct

SEQ ID NO: 6886646 - DNA, 19 bp, Homo sapiens
tgaatgtaaaacagagcca

SEQ ID NO: 6886647 - DNA, 20 bp, Homo sapiens
tacaaaacatacccagtgtt

SEQ ID NO: 6886648 - DNA, 15 bp, Homo sapiens
ggtgggtcagcccag

SEQ ID NO: 6886649 - DNA, 16 bp, Homo sapiens
ataactttctctgtga

SEQ ID NO: 6886650 - DNA, 16 bp, Homo sapiens
ccttcagtgcccacca

SEQ ID NO: 6886651 - DNA, 17 bp, Homo sapiens
aatcatgatgctagcca

SEQ ID NO: 6886652 - DNA, 23 bp, Homo sapiens
caaagggaatgggtctgcacaga

SEQ ID NO: 6886653 - DNA, 16 bp, Homo sapiens
ccctcccgccccttcc

SEQ ID NO: 6886654 - DNA, 21 bp, Homo sapiens
cgtgcccacgagggtctcccc

SEQ ID NO: 6886655 - DNA, 14 bp, Homo sapiens
tccctgtgtctttt

SEQ ID NO: 6886656 - DNA, 22 bp, Homo sapiens
ctacagagaaaccagcttcctt

SEQ ID NO: 6886657 - DNA, 19 bp, Homo sapiens
tgcttgggtggagaagcca

SEQ ID NO: 6886658 - DNA, 14 bp, Homo sapiens
gacttctgctggca

SEQ ID NO: 6886659 - DNA, 20 bp, Homo sapiens
cgtcaggcacgtctcctgct

SEQ ID NO: 6886660 - DNA, 17 bp, Homo sapiens
ccttaccctcctctgct

SEQ ID NO: 6886661 - DNA, 17 bp, Homo sapiens
gaacatgcagctctgca

SEQ ID NO: 6886662 - DNA, 17 bp, Homo sapiens
tagaaagacatctgcct

SEQ ID NO: 6886663 - DNA, 15 bp, Homo sapiens
tcactggccatccct

SEQ ID NO: 6886664 - DNA, 15 bp, Homo sapiens
tgcccccgctctgcc

SEQ ID NO: 6886665 - DNA, 15 bp, Homo sapiens
ctggctaacagtcta

SEQ ID NO: 6886666 - DNA, 20 bp, Homo sapiens
cactactcaatactacctct

SEQ ID NO: 6886667 - DNA, 15 bp, Homo sapiens
cgtgaccctgtgccc

SEQ ID NO: 6886668 - DNA, 16 bp, Homo sapiens
tctactttttccttcc

SEQ ID NO: 6886669 - DNA, 21 bp, Homo sapiens
cattttccccccactctcccc

SEQ ID NO: 6886670 - DNA, 17 bp, Homo sapiens
ctatgtaataatgtaca

SEQ ID NO: 6886671 - DNA, 19 bp, Homo sapiens
ttgtctagggtgttctgta

SEQ ID NO: 6886672 - DNA, 22 bp, Homo sapiens
ctgatggcgattccctctcacc

SEQ ID NO: 6886673 - DNA, 22 bp, Homo sapiens
tcggtggccatgcttcttgccc

SEQ ID NO: 6886674 - DNA, 11 bp, Homo sapiens
catactgtaca

SEQ ID NO: 6886675 - DNA, 18 bp, Homo sapiens
aactctggtggcacagga

SEQ ID NO: 6886676 - DNA, 13 bp, Homo sapiens
ccaagcctggagt

SEQ ID NO: 6886677 - DNA, 15 bp, Homo sapiens
tgctgggctctgcct

SEQ ID NO: 6886678 - DNA, 12 bp, Homo sapiens
ccctcccctcct

SEQ ID NO: 6886679 - DNA, 21 bp, Homo sapiens
ctgggtttggaccccagctgg

SEQ ID NO: 6886680 - DNA, 16 bp, Homo sapiens
catgatctccctgccg

SEQ ID NO: 6886681 - DNA, 14 bp, Homo sapiens
ggtccggcctctcc

SEQ ID NO: 6886682 - DNA, 15 bp, Homo sapiens
gtaaacactcagctg

SEQ ID NO: 6886683 - DNA, 20 bp, Homo sapiens
catccacgtggcctctctct

SEQ ID NO: 6886684 - DNA, 11 bp, Homo sapiens
aggctgcagtg

SEQ ID NO: 6886685 - DNA, 16 bp, Homo sapiens
ggagttttctgtgtgg

SEQ ID NO: 6886686 - DNA, 22 bp, Homo sapiens
tggcctcttgagttcctctgca

SEQ ID NO: 6886687 - DNA, 17 bp, Homo sapiens
cacttgttccagctctt

SEQ ID NO: 6886688 - DNA, 17 bp, Homo sapiens
agtcagatggatgtaga

SEQ ID NO: 6886689 - DNA, 22 bp, Homo sapiens
attgtaaaaaaaaatgcctttg

SEQ ID NO: 6886690 - DNA, 18 bp, Homo sapiens
cagatcaagcctgcctca

SEQ ID NO: 6886691 - DNA, 17 bp, Homo sapiens
cttagcagtccccttcc

SEQ ID NO: 6886692 - DNA, 22 bp, Homo sapiens
actatcacacactttctcttca

SEQ ID NO: 6886693 - DNA, 21 bp, Homo sapiens
cgcccaccagacctgttctga

SEQ ID NO: 6886694 - DNA, 17 bp, Homo sapiens
actgtgagaactgtgaa

SEQ ID NO: 6886695 - DNA, 11 bp, Homo sapiens
ccatctgtctg

SEQ ID NO: 6886696 - DNA, 15 bp, Homo sapiens
acacctcctctcact

SEQ ID NO: 6886697 - DNA, 20 bp, Homo sapiens
tgactccagagtctgagccc

SEQ ID NO: 6886698 - DNA, 16 bp, Homo sapiens
taacaaaccaacatct

SEQ ID NO: 6886699 - DNA, 18 bp, Homo sapiens
gtgatattgaccatgtga

SEQ ID NO: 6886700 - DNA, 16 bp, Homo sapiens
cctcccgccccttccc

SEQ ID NO: 6886701 - DNA, 14 bp, Homo sapiens
ctgctcctccctcc

SEQ ID NO: 6886702 - DNA, 16 bp, Homo sapiens
ctggaagccctggaga

SEQ ID NO: 6886703 - DNA, 14 bp, Homo sapiens
cagagcacttgaga

SEQ ID NO: 6886704 - DNA, 16 bp, Homo sapiens
cagcaggttctctcct

SEQ ID NO: 6886705 - DNA, 18 bp, Homo sapiens
agcaaagcagactatgca

SEQ ID NO: 6886706 - DNA, 15 bp, Homo sapiens
acattcatgagattg

SEQ ID NO: 6886707 - DNA, 13 bp, Homo sapiens
accacccagccct

SEQ ID NO: 6886708 - DNA, 16 bp, Homo sapiens
cgatgtccctgtcccc

SEQ ID NO: 6886709 - DNA, 16 bp, Homo sapiens
ggagaggagagccaga

SEQ ID NO: 6886710 - DNA, 20 bp, Homo sapiens
cctcttttcttactcctcct

SEQ ID NO: 6886711 - DNA, 20 bp, Homo sapiens
ctagagcagactacagctgg

SEQ ID NO: 6886712 - DNA, 23 bp, Homo sapiens
gcagagtcttgctacctcagtca

SEQ ID NO: 6886713 - DNA, 12 bp, Homo sapiens
tacccactgcca

SEQ ID NO: 6886714 - DNA, 22 bp, Homo sapiens
gcctactggacgctgccctgca

SEQ ID NO: 6886715 - DNA, 13 bp, Homo sapiens
ccaaatctgtcta

SEQ ID NO: 6886716 - DNA, 19 bp, Homo sapiens
cacccgccctttccttgcc

SEQ ID NO: 6886717 - DNA, 18 bp, Homo sapiens
ccaacaccccgcctgcct

SEQ ID NO: 6886718 - DNA, 21 bp, Homo sapiens
ctcaaaacacttccagtctgg

SEQ ID NO: 6886719 - DNA, 14 bp, Homo sapiens
aggatagtattttt

SEQ ID NO: 6886720 - DNA, 18 bp, Homo sapiens
ctacccgtgcctgggccc

SEQ ID NO: 6886721 - DNA, 23 bp, Homo sapiens
aacatgtaattaagtactatgta

SEQ ID NO: 6886722 - DNA, 19 bp, Homo sapiens
gcatagtcagtgtcgttta

SEQ ID NO: 6886723 - DNA, 16 bp, Homo sapiens
cttggacctctgctct

SEQ ID NO: 6886724 - DNA, 22 bp, Homo sapiens
gactgggaagataggctctgca

SEQ ID NO: 6886725 - DNA, 18 bp, Homo sapiens
taactccctcctcacact

SEQ ID NO: 6886726 - DNA, 16 bp, Homo sapiens
tgtaccacaccctgcc

SEQ ID NO: 6886727 - DNA, 22 bp, Homo sapiens
ctccccgtagccactctctgcc

SEQ ID NO: 6886728 - DNA, 12 bp, Homo sapiens
acagaaattggt

SEQ ID NO: 6886729 - DNA, 23 bp, Homo sapiens
tgttcaccttctgtgcatctggc

SEQ ID NO: 6886730 - DNA, 19 bp, Homo sapiens
cctccgtctgaccctctgc

SEQ ID NO: 6886731 - DNA, 15 bp, Homo sapiens
tgcacttaatttgtt

SEQ ID NO: 6886732 - DNA, 16 bp, Homo sapiens
ccgaccggccctgccc

SEQ ID NO: 6886733 - DNA, 17 bp, Homo sapiens
tgtagattttatagtgt

SEQ ID NO: 6886734 - DNA, 17 bp, Homo sapiens
cttcaaaagtaatgcct

SEQ ID NO: 6886735 - DNA, 17 bp, Homo sapiens
caggagtcaccatgcaa

SEQ ID NO: 6886736 - DNA, 18 bp, Homo sapiens
tggtacttattactgcta

SEQ ID NO: 6886737 - DNA, 13 bp, Homo sapiens
caggtcatgcagt

SEQ ID NO: 6886738 - DNA, 13 bp, Homo sapiens
agaggaggagaaa

SEQ ID NO: 6886739 - DNA, 21 bp, Homo sapiens
atccccttgaggtctcagccc

SEQ ID NO: 6886740 - DNA, 22 bp, Homo sapiens
ccctgatttattctggtgtcta

SEQ ID NO: 6886741 - DNA, 14 bp, Homo sapiens
cccaacctcttcct

SEQ ID NO: 6886742 - DNA, 18 bp, Homo sapiens
ctgtcagggccttggccc

SEQ ID NO: 6886743 - DNA, 17 bp, Homo sapiens
cagcggggacagctcct

SEQ ID NO: 6886744 - DNA, 15 bp, Homo sapiens
attcccttcctgcca

SEQ ID NO: 6886745 - DNA, 17 bp, Homo sapiens
aataccgctcagtattt

SEQ ID NO: 6886746 - DNA, 14 bp, Homo sapiens
tccatccctgctct

SEQ ID NO: 6886747 - DNA, 14 bp, Homo sapiens
cgtattccccttcc

SEQ ID NO: 6886748 - DNA, 19 bp, Homo sapiens
accactgagctctgcctca

SEQ ID NO: 6886749 - DNA, 21 bp, Homo sapiens
gtaacttcttatggaattgat

SEQ ID NO: 6886750 - DNA, 18 bp, Homo sapiens
tctttactatgtttctca

SEQ ID NO: 6886751 - DNA, 16 bp, Homo sapiens
agagctggtgcccgga

SEQ ID NO: 6886752 - DNA, 15 bp, Homo sapiens
gctgtatttctttgt

SEQ ID NO: 6886753 - DNA, 18 bp, Homo sapiens
ctgaagggggacactcca

SEQ ID NO: 6886754 - DNA, 17 bp, Homo sapiens
agtcccctactccctct

SEQ ID NO: 6886755 - DNA, 17 bp, Homo sapiens
cttctgccctcctgcca

SEQ ID NO: 6886756 - DNA, 22 bp, Homo sapiens
tccccggcggggtgcctgctgt

SEQ ID NO: 6886757 - DNA, 21 bp, Homo sapiens
tttacatggcgccctgcctcc

SEQ ID NO: 6886758 - DNA, 19 bp, Homo sapiens
ctgcagctggaatgtgcca

SEQ ID NO: 6886759 - DNA, 18 bp, Homo sapiens
ttgaaatgtgtttctgta

SEQ ID NO: 6886760 - DNA, 12 bp, Homo sapiens
gcttcctctgct

SEQ ID NO: 6886761 - DNA, 16 bp, Homo sapiens
cttctcaggctctgcc

SEQ ID NO: 6886762 - DNA, 17 bp, Homo sapiens
tcccaccttggcctccc

SEQ ID NO: 6886763 - DNA, 22 bp, Homo sapiens
cacactgtaaacccctgggtaa

SEQ ID NO: 6886764 - DNA, 13 bp, Homo sapiens
tatcatatatgct

SEQ ID NO: 6886765 - DNA, 21 bp, Homo sapiens
ccttgtcagggtctccttcct

SEQ ID NO: 6886766 - DNA, 20 bp, Homo sapiens
attagtctcagtgaagacta

SEQ ID NO: 6886767 - DNA, 17 bp, Homo sapiens
agcctagaacaagccag

SEQ ID NO: 6886768 - DNA, 14 bp, Homo sapiens
tcctccctccctct

SEQ ID NO: 6886769 - DNA, 21 bp, Homo sapiens
tttccatccaaacctacctta

SEQ ID NO: 6886770 - DNA, 13 bp, Homo sapiens
aagatattattca

SEQ ID NO: 6886771 - DNA, 18 bp, Homo sapiens
gatccagcagattattca

SEQ ID NO: 6886772 - DNA, 16 bp, Homo sapiens
ccatggactctgtcct

SEQ ID NO: 6886773 - DNA, 20 bp, Homo sapiens
cagatgctactggacttgaa

SEQ ID NO: 6886774 - DNA, 18 bp, Homo sapiens
tgtgctacaggggccaga

SEQ ID NO: 6886775 - DNA, 17 bp, Homo sapiens
ctgctcccatcctcacc

SEQ ID NO: 6886776 - DNA, 14 bp, Homo sapiens
aagtaatgaatttt

SEQ ID NO: 6886777 - DNA, 18 bp, Homo sapiens
ctttacatctgtgttcta

SEQ ID NO: 6886778 - DNA, 19 bp, Homo sapiens
cacagtggtactctgtgtc

SEQ ID NO: 6886779 - DNA, 14 bp, Homo sapiens
atgatctccctgcc

SEQ ID NO: 6886780 - DNA, 16 bp, Homo sapiens
ggccggggcctctgcc

SEQ ID NO: 6886781 - DNA, 16 bp, Homo sapiens
ccctcttcccccttcc

SEQ ID NO: 6886782 - DNA, 14 bp, Homo sapiens
cttcctcttagcct

SEQ ID NO: 6886783 - DNA, 18 bp, Homo sapiens
agaacattcagctctgga

SEQ ID NO: 6886784 - DNA, 17 bp, Homo sapiens
ttctaatgtttactata

SEQ ID NO: 6886785 - DNA, 15 bp, Homo sapiens
ctttcttcctctgct

SEQ ID NO: 6886786 - DNA, 14 bp, Homo sapiens
ccctgcctgcctct

SEQ ID NO: 6886787 - DNA, 20 bp, Homo sapiens
tcttacaaaaagaaatgtca

SEQ ID NO: 6886788 - DNA, 12 bp, Homo sapiens
ctatccctggac

SEQ ID NO: 6886789 - DNA, 17 bp, Homo sapiens
acaacactaatacacta

SEQ ID NO: 6886790 - DNA, 18 bp, Homo sapiens
aatagtcatttgtgaatt

SEQ ID NO: 6886791 - DNA, 17 bp, Homo sapiens
gttccccttggcttcct

SEQ ID NO: 6886792 - DNA, 18 bp, Homo sapiens
tcaaattaattgtgtgaa

SEQ ID NO: 6886793 - DNA, 14 bp, Homo sapiens
ctcacactcctcct

SEQ ID NO: 6886794 - DNA, 17 bp, Homo sapiens
gcaacttttttatgtct

SEQ ID NO: 6886795 - DNA, 14 bp, Homo sapiens
agttccttgcctta

SEQ ID NO: 6886796 - DNA, 20 bp, Homo sapiens
atttcataatttgtttccag

SEQ ID NO: 6886797 - DNA, 12 bp, Homo sapiens
ctttctaactca

SEQ ID NO: 6886798 - DNA, 14 bp, Homo sapiens
aatacaaatctgta

SEQ ID NO: 6886799 - DNA, 15 bp, Homo sapiens
aagtgccctctccca

SEQ ID NO: 6886800 - DNA, 18 bp, Homo sapiens
ccacccaaaccccttccc

SEQ ID NO: 6886801 - DNA, 20 bp, Homo sapiens
agactctaggttatacaata

SEQ ID NO: 6886802 - DNA, 20 bp, Homo sapiens
agcagctgaagccagctccc

SEQ ID NO: 6886803 - DNA, 12 bp, Homo sapiens
tttttttgtacg

SEQ ID NO: 6886804 - DNA, 15 bp, Homo sapiens
agccttgccagagat

SEQ ID NO: 6886805 - DNA, 16 bp, Homo sapiens
tccagaccacctgcca

SEQ ID NO: 6886806 - DNA, 18 bp, Homo sapiens
accaaaggagacatatca

SEQ ID NO: 6886807 - DNA, 10 bp, Homo sapiens
ccctacctca

SEQ ID NO: 6886808 - DNA, 20 bp, Homo sapiens
cctgctggctctctcttcct

SEQ ID NO: 6886809 - DNA, 17 bp, Homo sapiens
gcatgctgcctgcctcc

SEQ ID NO: 6886810 - DNA, 17 bp, Homo sapiens
gaccatctgctgcagtt

SEQ ID NO: 6886811 - DNA, 18 bp, Homo sapiens
aatgctgggactcagcct

SEQ ID NO: 6886812 - DNA, 16 bp, Homo sapiens
ctcactgtcatctgcc

SEQ ID NO: 6886813 - DNA, 17 bp, Homo sapiens
cagtcagcctctctccc

SEQ ID NO: 6886814 - DNA, 14 bp, Homo sapiens
ctgtggctgtctgg

SEQ ID NO: 6886815 - DNA, 21 bp, Homo sapiens
ctgcctggagccccactgccc

SEQ ID NO: 6886816 - DNA, 21 bp, Homo sapiens
acatttatttattactgtccc

SEQ ID NO: 6886817 - DNA, 18 bp, Homo sapiens
tctctgtctaccatctcc

SEQ ID NO: 6886818 - DNA, 20 bp, Homo sapiens
aggtcccttcccgacccagc

SEQ ID NO: 6886819 - DNA, 22 bp, Homo sapiens
catcccaataaagtcctcttcc

SEQ ID NO: 6886820 - DNA, 16 bp, Homo sapiens
catctagagcttgatg

SEQ ID NO: 6886821 - DNA, 17 bp, Homo sapiens
agaaatatgtattctgt

SEQ ID NO: 6886822 - DNA, 16 bp, Homo sapiens
tagagcgccagctcct

SEQ ID NO: 6886823 - DNA, 17 bp, Homo sapiens
actgagcctagctacct

SEQ ID NO: 6886824 - DNA, 13 bp, Homo sapiens
caccactgccaat

SEQ ID NO: 6886825 - DNA, 14 bp, Homo sapiens
cagaattactgtaa

SEQ ID NO: 6886826 - DNA, 13 bp, Homo sapiens
ctctttcccctcc

SEQ ID NO: 6886827 - DNA, 16 bp, Homo sapiens
tccggcacactgccaa

SEQ ID NO: 6886828 - DNA, 16 bp, Homo sapiens
attttttagtgactaa

SEQ ID NO: 6886829 - DNA, 22 bp, Homo sapiens
gcagctctaaaacatagactga

SEQ ID NO: 6886830 - DNA, 15 bp, Homo sapiens
cagctcatgtgtacc

SEQ ID NO: 6886831 - DNA, 19 bp, Homo sapiens
ctcctgacaccccacttag

SEQ ID NO: 6886832 - DNA, 17 bp, Homo sapiens
cattgccattccctgcc

SEQ ID NO: 6886833 - DNA, 16 bp, Homo sapiens
aagctgctctccttca

SEQ ID NO: 6886834 - DNA, 16 bp, Homo sapiens
accctgcccactccca

SEQ ID NO: 6886835 - DNA, 18 bp, Homo sapiens
ctggaagcctggactcta

SEQ ID NO: 6886836 - DNA, 18 bp, Homo sapiens
cctcctaagtcccttcct

SEQ ID NO: 6886837 - DNA, 20 bp, Homo sapiens
tatatatttgtaacattgta

SEQ ID NO: 6886838 - DNA, 17 bp, Homo sapiens
tgtacataattgcatga

SEQ ID NO: 6886839 - DNA, 18 bp, Homo sapiens
ctgaaggaggcggggctc

SEQ ID NO: 6886840 - DNA, 21 bp, Homo sapiens
cagttaacgtattagttgcca

SEQ ID NO: 6886841 - DNA, 22 bp, Homo sapiens
catctccagggagtcccctccc

SEQ ID NO: 6886842 - DNA, 20 bp, Homo sapiens
ctacctgtcccctatgccac

SEQ ID NO: 6886843 - DNA, 16 bp, Homo sapiens
gccagttgcccagagc

SEQ ID NO: 6886844 - DNA, 22 bp, Homo sapiens
caattctaggatgaacaatgta

SEQ ID NO: 6886845 - DNA, 16 bp, Homo sapiens
attaaagaagacctga

SEQ ID NO: 6886846 - DNA, 13 bp, Homo sapiens
tagaggctagctt

SEQ ID NO: 6886847 - DNA, 17 bp, Homo sapiens
cgcgtcctttcctctcc

SEQ ID NO: 6886848 - DNA, 14 bp, Homo sapiens
acctccaccctgca

SEQ ID NO: 6886849 - DNA, 17 bp, Homo sapiens
cctcgggggctcttccc

SEQ ID NO: 6886850 - DNA, 17 bp, Homo sapiens
gcttagacctcagcctg

SEQ ID NO: 6886851 - DNA, 12 bp, Homo sapiens
accccagcctca

SEQ ID NO: 6886852 - DNA, 19 bp, Homo sapiens
cctgtcccacccccttccc

SEQ ID NO: 6886853 - DNA, 15 bp, Homo sapiens
acccctcaccttgca

SEQ ID NO: 6886854 - DNA, 17 bp, Homo sapiens
ccaacctcaggctccta

SEQ ID NO: 6886855 - DNA, 16 bp, Homo sapiens
ccttttcttgtatctg

SEQ ID NO: 6886856 - DNA, 12 bp, Homo sapiens
cactgtgaaatt

SEQ ID NO: 6886857 - DNA, 17 bp, Homo sapiens
tgtcctataattctatt

SEQ ID NO: 6886858 - DNA, 19 bp, Homo sapiens
ccctaatcagctcccttcc

SEQ ID NO: 6886859 - DNA, 13 bp, Homo sapiens
tttcttcacctca

SEQ ID NO: 6886860 - DNA, 17 bp, Homo sapiens
cagtgtgttactcatct

SEQ ID NO: 6886861 - DNA, 20 bp, Homo sapiens
cacctacacccctgtgctcc

SEQ ID NO: 6886862 - DNA, 21 bp, Homo sapiens
cacaggatgccagcccctgcc

SEQ ID NO: 6886863 - DNA, 13 bp, Homo sapiens
tgaaatgccaaga

SEQ ID NO: 6886864 - DNA, 18 bp, Homo sapiens
tgcctcggctcctgctgc

SEQ ID NO: 6886865 - DNA, 14 bp, Homo sapiens
tgatgggcttctgt

SEQ ID NO: 6886866 - DNA, 20 bp, Homo sapiens
ggtcaggcctttgagctcag

SEQ ID NO: 6886867 - DNA, 22 bp, Homo sapiens
cctccaagaagccctccttgcc

SEQ ID NO: 6886868 - DNA, 14 bp, Homo sapiens
ctttcctctttctg

SEQ ID NO: 6886869 - DNA, 22 bp, Homo sapiens
cctgcccccgcatcccctgcct

SEQ ID NO: 6886870 - DNA, 14 bp, Homo sapiens
agccccgcctgtca

SEQ ID NO: 6886871 - DNA, 20 bp, Homo sapiens
ttcaagttaccaatgtaaca

SEQ ID NO: 6886872 - DNA, 17 bp, Homo sapiens
tggccgcacgcctctcc

SEQ ID NO: 6886873 - DNA, 21 bp, Homo sapiens
atttttcttactggaaaagtt

SEQ ID NO: 6886874 - DNA, 20 bp, Homo sapiens
atgtagtatgctatgattaa

SEQ ID NO: 6886875 - DNA, 14 bp, Homo sapiens
ctctctccctgcct

SEQ ID NO: 6886876 - DNA, 16 bp, Homo sapiens
tctcagggctcctgcc

SEQ ID NO: 6886877 - DNA, 13 bp, Homo sapiens
ttcctcctgctgt

SEQ ID NO: 6886878 - DNA, 12 bp, Homo sapiens
cccttccctcct

SEQ ID NO: 6886879 - DNA, 13 bp, Homo sapiens
ccagagctgtgcc

SEQ ID NO: 6886880 - DNA, 16 bp, Homo sapiens
gtactgctgtcttcca

SEQ ID NO: 6886881 - DNA, 12 bp, Homo sapiens
ctctactctgct

SEQ ID NO: 6886882 - DNA, 19 bp, Homo sapiens
cagcagcacaattctgtcc

SEQ ID NO: 6886883 - DNA, 20 bp, Homo sapiens
gttttatctccatactttgg

SEQ ID NO: 6886884 - DNA, 15 bp, Homo sapiens
cccgcccgccctcct

SEQ ID NO: 6886885 - DNA, 22 bp, Homo sapiens
tgtggtgaagtgtggctggtgt

SEQ ID NO: 6886886 - DNA, 18 bp, Homo sapiens
caatattctctgtacata

SEQ ID NO: 6886887 - DNA, 16 bp, Homo sapiens
ctgggtctttcatggg

SEQ ID NO: 6886888 - DNA, 13 bp, Homo sapiens
ctgactcttgcct

SEQ ID NO: 6886889 - DNA, 13 bp, Homo sapiens
ttccaatgtttca

SEQ ID NO: 6886890 - DNA, 15 bp, Homo sapiens
atgttttaaaagttt

SEQ ID NO: 6886891 - DNA, 13 bp, Homo sapiens
aactctctctgcc

SEQ ID NO: 6886892 - DNA, 19 bp, Homo sapiens
gacagtttactttgccaac

SEQ ID NO: 6886893 - DNA, 14 bp, Homo sapiens
gttgttgttttata

SEQ ID NO: 6886894 - DNA, 12 bp, Homo sapiens
cattccctctcc

SEQ ID NO: 6886895 - DNA, 16 bp, Homo sapiens
gtctcaggctgcctga

SEQ ID NO: 6886896 - DNA, 22 bp, Homo sapiens
tacagaagagtttcttaactta

SEQ ID NO: 6886897 - DNA, 16 bp, Homo sapiens
agccaacaactctgcc

SEQ ID NO: 6886898 - DNA, 21 bp, Homo sapiens
acctgcccctctgttctctcc

SEQ ID NO: 6886899 - DNA, 14 bp, Homo sapiens
attacagaaaattt

SEQ ID NO: 6886900 - DNA, 15 bp, Homo sapiens
ccagtgtccccacca

SEQ ID NO: 6886901 - DNA, 14 bp, Homo sapiens
catccattctctct

SEQ ID NO: 6886902 - DNA, 13 bp, Homo sapiens
cttttcaatgcaa

SEQ ID NO: 6886903 - DNA, 14 bp, Homo sapiens
atgatactgtctct

SEQ ID NO: 6886904 - DNA, 14 bp, Homo sapiens
catccttaactgtc

SEQ ID NO: 6886905 - DNA, 24 bp, Homo sapiens
cccttctctgttggtctgccttct

SEQ ID NO: 6886906 - DNA, 14 bp, Homo sapiens
aatttttaactgta

SEQ ID NO: 6886907 - DNA, 13 bp, Homo sapiens
acccttttctcag

SEQ ID NO: 6886908 - DNA, 15 bp, Homo sapiens
gtgtcaccccagagc

SEQ ID NO: 6886909 - DNA, 13 bp, Homo sapiens
cttcagtgcctta

SEQ ID NO: 6886910 - DNA, 17 bp, Homo sapiens
ctctgaaagctgcttct

SEQ ID NO: 6886911 - DNA, 21 bp, Homo sapiens
gaaatttcagattcccagagc

SEQ ID NO: 6886912 - DNA, 15 bp, Homo sapiens
gattattgaatgtta

SEQ ID NO: 6886913 - DNA, 24 bp, Homo sapiens
taagggtcatatgtttgcttgtat

SEQ ID NO: 6886914 - DNA, 15 bp, Homo sapiens
atctggccctgctgc

SEQ ID NO: 6886915 - DNA, 14 bp, Homo sapiens
cattgtactccagc

SEQ ID NO: 6886916 - DNA, 15 bp, Homo sapiens
ctccaagaatgctga

SEQ ID NO: 6886917 - DNA, 16 bp, Homo sapiens
cgctccccttggacct

SEQ ID NO: 6886918 - DNA, 22 bp, Homo sapiens
ttctcaggacacaggcctgtgt

SEQ ID NO: 6886919 - DNA, 15 bp, Homo sapiens
attccacacatttcc

SEQ ID NO: 6886920 - DNA, 15 bp, Homo sapiens
aagctccactgtcac

SEQ ID NO: 6886921 - DNA, 18 bp, Homo sapiens
ctctcacgggccctgccc

SEQ ID NO: 6886922 - DNA, 19 bp, Homo sapiens
tcccgcttagcctgcctca

SEQ ID NO: 6886923 - DNA, 17 bp, Homo sapiens
cctgcttccccttccta

SEQ ID NO: 6886924 - DNA, 23 bp, Homo sapiens
atctatgcaaagcactctctgca

SEQ ID NO: 6886925 - DNA, 13 bp, Homo sapiens
cttgtcatctttt

SEQ ID NO: 6886926 - DNA, 19 bp, Homo sapiens
gaaatcaatagttgaatta

SEQ ID NO: 6886927 - DNA, 16 bp, Homo sapiens
agcacagaccctgccc

SEQ ID NO: 6886928 - DNA, 19 bp, Homo sapiens
acgttcgatttctacctca

SEQ ID NO: 6886929 - DNA, 15 bp, Homo sapiens
tcctcaaacactgca

SEQ ID NO: 6886930 - DNA, 21 bp, Homo sapiens
ctgccacagcctcccctgcca

SEQ ID NO: 6886931 - DNA, 16 bp, Homo sapiens
agcaatttatatcttt

SEQ ID NO: 6886932 - DNA, 19 bp, Homo sapiens
tcaatatttactgagactt

SEQ ID NO: 6886933 - DNA, 12 bp, Homo sapiens
tgcacctgctgc

SEQ ID NO: 6886934 - DNA, 14 bp, Homo sapiens
aattaaactgaaga

SEQ ID NO: 6886935 - DNA, 13 bp, Homo sapiens
aaatctgtattgc

SEQ ID NO: 6886936 - DNA, 18 bp, Homo sapiens
cagggcctggctccagtc

SEQ ID NO: 6886937 - DNA, 12 bp, Homo sapiens
ctccaccctgct

SEQ ID NO: 6886938 - DNA, 18 bp, Homo sapiens
ctggtccctgccctcccc

SEQ ID NO: 6886939 - DNA, 18 bp, Homo sapiens
taagatggcttatttgta

SEQ ID NO: 6886940 - DNA, 16 bp, Homo sapiens
agctgtgacctgctga

SEQ ID NO: 6886941 - DNA, 15 bp, Homo sapiens
atgattcaagccatt

SEQ ID NO: 6886942 - DNA, 20 bp, Homo sapiens
acaggctcttagcagcttcc

SEQ ID NO: 6886943 - DNA, 17 bp, Homo sapiens
cctaattgttaaattta

SEQ ID NO: 6886944 - DNA, 16 bp, Homo sapiens
cacaagactgcacatc

SEQ ID NO: 6886945 - DNA, 14 bp, Homo sapiens
acctccctgcctcc

SEQ ID NO: 6886946 - DNA, 14 bp, Homo sapiens
acctctctgcctct

SEQ ID NO: 6886947 - DNA, 23 bp, Homo sapiens
ggctgtggagcaaaaggcagctc

SEQ ID NO: 6886948 - DNA, 16 bp, Homo sapiens
ttcgatttctacctca

SEQ ID NO: 6886949 - DNA, 13 bp, Homo sapiens
acttaactgaaga

SEQ ID NO: 6886950 - DNA, 14 bp, Homo sapiens
caacacctgcctct

SEQ ID NO: 6886951 - DNA, 16 bp, Homo sapiens
caggaaactagctttt

SEQ ID NO: 6886952 - DNA, 21 bp, Homo sapiens
cctaagggtcgaaagctctag

SEQ ID NO: 6886953 - DNA, 14 bp, Homo sapiens
cacctgcctgcgtc

SEQ ID NO: 6886954 - DNA, 21 bp, Homo sapiens
catacacccccacctcctgca

SEQ ID NO: 6886955 - DNA, 16 bp, Homo sapiens
ctgcccctgctgtgct

SEQ ID NO: 6886956 - DNA, 21 bp, Homo sapiens
aaccaggaggggtctgcctcc

SEQ ID NO: 6886957 - DNA, 22 bp, Homo sapiens
cacctctgacctatcacttcca

SEQ ID NO: 6886958 - DNA, 19 bp, Homo sapiens
ccctctgagcaactgtgca

SEQ ID NO: 6886959 - DNA, 20 bp, Homo sapiens
acttttaaatggcagtattt

SEQ ID NO: 6886960 - DNA, 16 bp, Homo sapiens
ccagtcctctgcctcc

SEQ ID NO: 6886961 - DNA, 20 bp, Homo sapiens
cagctgctgaagttctgagc

SEQ ID NO: 6886962 - DNA, 16 bp, Homo sapiens
atatacacatatacct

SEQ ID NO: 6886963 - DNA, 20 bp, Homo sapiens
gaggggccctccatgcgcag

SEQ ID NO: 6886964 - DNA, 19 bp, Homo sapiens
atcatttgttcaaagctgt

SEQ ID NO: 6886965 - DNA, 14 bp, Homo sapiens
agctccctcctgca

SEQ ID NO: 6886966 - DNA, 22 bp, Homo sapiens
tgttgcctcctctctccctgcc

SEQ ID NO: 6886967 - DNA, 21 bp, Homo sapiens
atttcccccgagctcttggcc

SEQ ID NO: 6886968 - DNA, 12 bp, Homo sapiens
tgggtaaattca

SEQ ID NO: 6886969 - DNA, 16 bp, Homo sapiens
ctcaggctgcagctgg

SEQ ID NO: 6886970 - DNA, 12 bp, Homo sapiens
aaactctctgaa

SEQ ID NO: 6886971 - DNA, 14 bp, Homo sapiens
actaaccaccattt

SEQ ID NO: 6886972 - DNA, 15 bp, Homo sapiens
cattaccctctgcag

SEQ ID NO: 6886973 - DNA, 20 bp, Homo sapiens
tctcaaacaaggggctgtta

SEQ ID NO: 6886974 - DNA, 18 bp, Homo sapiens
tcagtaaaattatactgt

SEQ ID NO: 6886975 - DNA, 19 bp, Homo sapiens
tctggtatgcattctttat

SEQ ID NO: 6886976 - DNA, 16 bp, Homo sapiens
tcagcagagtgcttta

SEQ ID NO: 6886977 - DNA, 20 bp, Homo sapiens
cctgtgcctggccccagcct

SEQ ID NO: 6886978 - DNA, 22 bp, Homo sapiens
gatgagggtgtcggctgtgagg

SEQ ID NO: 6886979 - DNA, 18 bp, Homo sapiens
ccatggaggcgccttcct

SEQ ID NO: 6886980 - DNA, 14 bp, Homo sapiens
acagtgcctgctga

SEQ ID NO: 6886981 - DNA, 14 bp, Homo sapiens
aggagtggccctga

SEQ ID NO: 6886982 - DNA, 13 bp, Homo sapiens
cagctcttctgcc

SEQ ID NO: 6886983 - DNA, 17 bp, Homo sapiens
catctcctgaccctccc

SEQ ID NO: 6886984 - DNA, 13 bp, Homo sapiens
cctaccccagcca

SEQ ID NO: 6886985 - DNA, 21 bp, Homo sapiens
ccacctccccctccccggcca

SEQ ID NO: 6886986 - DNA, 18 bp, Homo sapiens
ttacttgaatagtattgt

SEQ ID NO: 6886987 - DNA, 18 bp, Homo sapiens
aagaaacaagctgtgcag

SEQ ID NO: 6886988 - DNA, 22 bp, Homo sapiens
atctgttcccttcctctgtgcc

SEQ ID NO: 6886989 - DNA, 24 bp, Homo sapiens
caaagggtacttccactgatggaa

SEQ ID NO: 6886990 - DNA, 15 bp, Homo sapiens
ggggctcctgagtgt

SEQ ID NO: 6886991 - DNA, 19 bp, Homo sapiens
ctctccaaaggccctacca

SEQ ID NO: 6886992 - DNA, 23 bp, Homo sapiens
aggccgggcttgggccctgcaca

SEQ ID NO: 6886993 - DNA, 12 bp, Homo sapiens
aatatgctttac

SEQ ID NO: 6886994 - DNA, 23 bp, Homo sapiens
acggttgtggtgaagtttgtcag

SEQ ID NO: 6886995 - DNA, 23 bp, Homo sapiens
gagctggaaataaacctggagat

SEQ ID NO: 6886996 - DNA, 16 bp, Homo sapiens
cctgcctgaccatccc

SEQ ID NO: 6886997 - DNA, 20 bp, Homo sapiens
gcttctgtgatgagctgatc

SEQ ID NO: 6886998 - DNA, 15 bp, Homo sapiens
ccttgtttctttctg

SEQ ID NO: 6886999 - DNA, 16 bp, Homo sapiens
gataatatctgtgagg

SEQ ID NO: 6887000 - DNA, 16 bp, Homo sapiens
tgggctggactggcca

SEQ ID NO: 6887001 - DNA, 20 bp, Homo sapiens
tcatttttgtttctacctcc

SEQ ID NO: 6887002 - DNA, 14 bp, Homo sapiens
aaggcaggcctccg

SEQ ID NO: 6887003 - DNA, 20 bp, Homo sapiens
cccttggtgtttcccttcct

SEQ ID NO: 6887004 - DNA, 17 bp, Homo sapiens
catcttggtcctgtcac

SEQ ID NO: 6887005 - DNA, 12 bp, Homo sapiens
gtagctcagtca

SEQ ID NO: 6887006 - DNA, 12 bp, Homo sapiens
tatttgctttag

SEQ ID NO: 6887007 - DNA, 18 bp, Homo sapiens
agtataaattcgctgtga

SEQ ID NO: 6887008 - DNA, 14 bp, Homo sapiens
ctctgacctctgct

SEQ ID NO: 6887009 - DNA, 13 bp, Homo sapiens
cagctcaaagact

SEQ ID NO: 6887010 - DNA, 15 bp, Homo sapiens
tatactgagctgcta

SEQ ID NO: 6887011 - DNA, 13 bp, Homo sapiens
acatcctcctgcc

SEQ ID NO: 6887012 - DNA, 17 bp, Homo sapiens
ccttccagcctgggaca

SEQ ID NO: 6887013 - DNA, 18 bp, Homo sapiens
ctgccaaaggatgtgata

SEQ ID NO: 6887014 - DNA, 22 bp, Homo sapiens
tccagtgaggctctgcccttgg

SEQ ID NO: 6887015 - DNA, 16 bp, Homo sapiens
cagagcaggggctcca

SEQ ID NO: 6887016 - DNA, 19 bp, Homo sapiens
cttcccctcccccactcct

SEQ ID NO: 6887017 - DNA, 14 bp, Homo sapiens
actctggtgttcta

SEQ ID NO: 6887018 - DNA, 19 bp, Homo sapiens
cagatccacctgcacaaac

SEQ ID NO: 6887019 - DNA, 14 bp, Homo sapiens
agctcctctgagcc

SEQ ID NO: 6887020 - DNA, 15 bp, Homo sapiens
tggctccccctctgc

SEQ ID NO: 6887021 - DNA, 15 bp, Homo sapiens
acataactgccttga

SEQ ID NO: 6887022 - DNA, 17 bp, Homo sapiens
cagtcctgcctcagcct

SEQ ID NO: 6887023 - DNA, 15 bp, Homo sapiens
tcattaatgacttta

SEQ ID NO: 6887024 - DNA, 14 bp, Homo sapiens
cttttcccccaccc

SEQ ID NO: 6887025 - DNA, 22 bp, Homo sapiens
attacatttcatttatactgta

SEQ ID NO: 6887026 - DNA, 19 bp, Homo sapiens
ctgcctcttggcttctcag

SEQ ID NO: 6887027 - DNA, 22 bp, Homo sapiens
cgtttccatcaggttccatccc

SEQ ID NO: 6887028 - DNA, 17 bp, Homo sapiens
cctcacagactcttcca

SEQ ID NO: 6887029 - DNA, 16 bp, Homo sapiens
aggattgtgatatttt

SEQ ID NO: 6887030 - DNA, 16 bp, Homo sapiens
aaactgaagtctgaaa

SEQ ID NO: 6887031 - DNA, 19 bp, Homo sapiens
cattgccagtgtctttctt

SEQ ID NO: 6887032 - DNA, 13 bp, Homo sapiens
aacatgcctgcca

SEQ ID NO: 6887033 - DNA, 21 bp, Homo sapiens
gcctgggttttctaactgtaa

SEQ ID NO: 6887034 - DNA, 17 bp, Homo sapiens
ccatcagtgctccctca

SEQ ID NO: 6887035 - DNA, 16 bp, Homo sapiens
ttgtagcacaatccta

SEQ ID NO: 6887036 - DNA, 13 bp, Homo sapiens
ccagccagtgcca

SEQ ID NO: 6887037 - DNA, 19 bp, Homo sapiens
ccggctgtgattgctgcca

SEQ ID NO: 6887038 - DNA, 17 bp, Homo sapiens
attttgtttttactgta

SEQ ID NO: 6887039 - DNA, 23 bp, Homo sapiens
aggcggcccggccagcgggcaca

SEQ ID NO: 6887040 - DNA, 18 bp, Homo sapiens
accgcatatgcatgccag

SEQ ID NO: 6887041 - DNA, 17 bp, Homo sapiens
ttcctcaaatgttgaca

SEQ ID NO: 6887042 - DNA, 15 bp, Homo sapiens
cccccaaaccctgct

SEQ ID NO: 6887043 - DNA, 18 bp, Homo sapiens
tgctccctgcctcctgcc

SEQ ID NO: 6887044 - DNA, 12 bp, Homo sapiens
gggactgtgtgt

SEQ ID NO: 6887045 - DNA, 20 bp, Homo sapiens
tcacataggcaatatcttta

SEQ ID NO: 6887046 - DNA, 14 bp, Homo sapiens
agcttcttgtttcc

SEQ ID NO: 6887047 - DNA, 21 bp, Homo sapiens
gaaggatcctggaaccactga

SEQ ID NO: 6887048 - DNA, 18 bp, Homo sapiens
caccagtaataaaaagcc

SEQ ID NO: 6887049 - DNA, 14 bp, Homo sapiens
ttcaatgtactgta

SEQ ID NO: 6887050 - DNA, 16 bp, Homo sapiens
catgtgaaatcattca

SEQ ID NO: 6887051 - DNA, 23 bp, Homo sapiens
gggcctttgccagcagagccagg

SEQ ID NO: 6887052 - DNA, 22 bp, Homo sapiens
tgcactttttccttactgtgca

SEQ ID NO: 6887053 - DNA, 16 bp, Homo sapiens
cacattgctggctgcc

SEQ ID NO: 6887054 - DNA, 20 bp, Homo sapiens
gctgtccgtgtgcctcctgt

SEQ ID NO: 6887055 - DNA, 21 bp, Homo sapiens
tttccctactgaaccctgcct

SEQ ID NO: 6887056 - DNA, 16 bp, Homo sapiens
agtgatggagttcctt

SEQ ID NO: 6887057 - DNA, 13 bp, Homo sapiens
gccaggtgccttg

SEQ ID NO: 6887058 - DNA, 19 bp, Homo sapiens
ccagtccccacccctgccc

SEQ ID NO: 6887059 - DNA, 18 bp, Homo sapiens
gaattgtttttgaattta

SEQ ID NO: 6887060 - DNA, 14 bp, Homo sapiens
aagcgctgccctgt

SEQ ID NO: 6887061 - DNA, 21 bp, Homo sapiens
ccctcaccccaatccctgcca

SEQ ID NO: 6887062 - DNA, 17 bp, Homo sapiens
cacctttactgtgctta

SEQ ID NO: 6887063 - DNA, 22 bp, Homo sapiens
tctccgaagaaaagatatgtat

SEQ ID NO: 6887064 - DNA, 19 bp, Homo sapiens
aggaggggcccccctgccc

SEQ ID NO: 6887065 - DNA, 18 bp, Homo sapiens
cattataaaatctttcca

SEQ ID NO: 6887066 - DNA, 13 bp, Homo sapiens
tattggttttatg

SEQ ID NO: 6887067 - DNA, 19 bp, Homo sapiens
acatgcactgacccttcca

SEQ ID NO: 6887068 - DNA, 14 bp, Homo sapiens
atttcccacttcca

SEQ ID NO: 6887069 - DNA, 14 bp, Homo sapiens
agtttgcctctgca

SEQ ID NO: 6887070 - DNA, 17 bp, Homo sapiens
tcagcgcccccaggcct

SEQ ID NO: 6887071 - DNA, 16 bp, Homo sapiens
ccttccatgtggagaa

SEQ ID NO: 6887072 - DNA, 13 bp, Homo sapiens
cagcagtcacagg

SEQ ID NO: 6887073 - DNA, 14 bp, Homo sapiens
cctctgagctgtta

SEQ ID NO: 6887074 - DNA, 11 bp, Homo sapiens
cacccctgcct

SEQ ID NO: 6887075 - DNA, 22 bp, Homo sapiens
tggtggccactgagctggctga

SEQ ID NO: 6887076 - DNA, 15 bp, Homo sapiens
cactgcgccactgcc

SEQ ID NO: 6887077 - DNA, 15 bp, Homo sapiens
cctttcacccctctt

SEQ ID NO: 6887078 - DNA, 15 bp, Homo sapiens
ccccagccccatcct

SEQ ID NO: 6887079 - DNA, 11 bp, Homo sapiens
aattgctgctt

SEQ ID NO: 6887080 - DNA, 22 bp, Homo sapiens
cactaggaattctttgcattcc

SEQ ID NO: 6887081 - DNA, 17 bp, Homo sapiens
aagttcaccagccctga

SEQ ID NO: 6887082 - DNA, 15 bp, Homo sapiens
taatcccagctactc

SEQ ID NO: 6887083 - DNA, 20 bp, Homo sapiens
actgagaaggcaggcctccg

SEQ ID NO: 6887084 - DNA, 21 bp, Homo sapiens
gcaattgtatatatatgtgaa

SEQ ID NO: 6887085 - DNA, 13 bp, Homo sapiens
cccttgcccttcc

SEQ ID NO: 6887086 - DNA, 19 bp, Homo sapiens
ctgattaatgctaaatgta

SEQ ID NO: 6887087 - DNA, 13 bp, Homo sapiens
agtgggagccctg

SEQ ID NO: 6887088 - DNA, 21 bp, Homo sapiens
aagagtttcttgtaagccatc

SEQ ID NO: 6887089 - DNA, 17 bp, Homo sapiens
taatctctaaaattcta

SEQ ID NO: 6887090 - DNA, 16 bp, Homo sapiens
taaaatagcatactgt

SEQ ID NO: 6887091 - DNA, 15 bp, Homo sapiens
ctcagggctgtccca

SEQ ID NO: 6887092 - DNA, 15 bp, Homo sapiens
ttccttaaactgtgt

SEQ ID NO: 6887093 - DNA, 17 bp, Homo sapiens
agcagactccagcccct

SEQ ID NO: 6887094 - DNA, 13 bp, Homo sapiens
cagtactgacaga

SEQ ID NO: 6887095 - DNA, 17 bp, Homo sapiens
ccttcacataccctccc

SEQ ID NO: 6887096 - DNA, 12 bp, Homo sapiens
aaatatactgta

SEQ ID NO: 6887097 - DNA, 14 bp, Homo sapiens
catttagcatgagt

SEQ ID NO: 6887098 - DNA, 13 bp, Homo sapiens
ctttgctgtgcca

SEQ ID NO: 6887099 - DNA, 14 bp, Homo sapiens
tctgcagctggtgt

SEQ ID NO: 6887100 - DNA, 13 bp, Homo sapiens
aagagctctggtg

SEQ ID NO: 6887101 - DNA, 23 bp, Homo sapiens
tcttcgttaatagattatttcat

SEQ ID NO: 6887102 - DNA, 19 bp, Homo sapiens
ctggttgcctctcttgccc

SEQ ID NO: 6887103 - DNA, 15 bp, Homo sapiens
ctcttggcctctgct

SEQ ID NO: 6887104 - DNA, 20 bp, Homo sapiens
cagactttagtgccctgccc

SEQ ID NO: 6887105 - DNA, 12 bp, Homo sapiens
agcctgctgcat

SEQ ID NO: 6887106 - DNA, 17 bp, Homo sapiens
cacacagcacctcctct

SEQ ID NO: 6887107 - DNA, 15 bp, Homo sapiens
cactaagctcctcct

SEQ ID NO: 6887108 - DNA, 20 bp, Homo sapiens
catcagggtgggccactctc

SEQ ID NO: 6887109 - DNA, 14 bp, Homo sapiens
tgggcccctcagcc

SEQ ID NO: 6887110 - DNA, 17 bp, Homo sapiens
gtcactcacactggcca

SEQ ID NO: 6887111 - DNA, 14 bp, Homo sapiens
ataatacattccga

SEQ ID NO: 6887112 - DNA, 13 bp, Homo sapiens
ctgccatagccag

SEQ ID NO: 6887113 - DNA, 16 bp, Homo sapiens
agccccgggcctgcct

SEQ ID NO: 6887114 - DNA, 14 bp, Homo sapiens
attccaacagttta

SEQ ID NO: 6887115 - DNA, 20 bp, Homo sapiens
tcaagcagtcgtgcctgtgt

SEQ ID NO: 6887116 - DNA, 20 bp, Homo sapiens
aatctctgttatgtactgta

SEQ ID NO: 6887117 - DNA, 21 bp, Homo sapiens
cctctgctgcatccccttcca

SEQ ID NO: 6887118 - DNA, 20 bp, Homo sapiens
tttggggggttttcttgcct

SEQ ID NO: 6887119 - DNA, 14 bp, Homo sapiens
cgatttctacctca

SEQ ID NO: 6887120 - DNA, 15 bp, Homo sapiens
tgacgcaccactgcc

SEQ ID NO: 6887121 - DNA, 16 bp, Homo sapiens
caaataattttagtgt

SEQ ID NO: 6887122 - DNA, 13 bp, Homo sapiens
ctgtaagctcctt

SEQ ID NO: 6887123 - DNA, 20 bp, Homo sapiens
cttaaaaaaaaaaaaaagct

SEQ ID NO: 6887124 - DNA, 13 bp, Homo sapiens
ccttgcccagcct

SEQ ID NO: 6887125 - DNA, 17 bp, Homo sapiens
tgacatctacctcccga

SEQ ID NO: 6887126 - DNA, 19 bp, Homo sapiens
ctcaagtgattctcctgcc

SEQ ID NO: 6887127 - DNA, 12 bp, Homo sapiens
cttcctcctgca

SEQ ID NO: 6887128 - DNA, 20 bp, Homo sapiens
ccttgtcagggtctccttcc

SEQ ID NO: 6887129 - DNA, 16 bp, Homo sapiens
caaaggtccctgagct

SEQ ID NO: 6887130 - DNA, 18 bp, Homo sapiens
cagaagacaccagagcag

SEQ ID NO: 6887131 - DNA, 20 bp, Homo sapiens
agtgctcttcccactccagc

SEQ ID NO: 6887132 - DNA, 17 bp, Homo sapiens
tactaagaatgtcctta

SEQ ID NO: 6887133 - DNA, 19 bp, Homo sapiens
cctgcaaaatctgttctaa

SEQ ID NO: 6887134 - DNA, 23 bp, Homo sapiens
tccctgggccacctcctacccct

SEQ ID NO: 6887135 - DNA, 17 bp, Homo sapiens
tagctgtgacctgctga

SEQ ID NO: 6887136 - DNA, 22 bp, Homo sapiens
cctagcttatctccctgcttca

SEQ ID NO: 6887137 - DNA, 14 bp, Homo sapiens
ttcaggatactgta

SEQ ID NO: 6887138 - DNA, 16 bp, Homo sapiens
ctcctggtctgtgctg

SEQ ID NO: 6887139 - DNA, 15 bp, Homo sapiens
attgacttgcaaaga

SEQ ID NO: 6887140 - DNA, 18 bp, Homo sapiens
acttcaaaaggaatgaac

SEQ ID NO: 6887141 - DNA, 15 bp, Homo sapiens
cttccccatggaaca

SEQ ID NO: 6887142 - DNA, 18 bp, Homo sapiens
aggtatacctcagttcca

SEQ ID NO: 6887143 - DNA, 22 bp, Homo sapiens
taagcatgacagaaaatatgta

SEQ ID NO: 6887144 - DNA, 18 bp, Homo sapiens
ccgatgatactgtttctt

SEQ ID NO: 6887145 - DNA, 18 bp, Homo sapiens
cagttcctgctgcctgca

SEQ ID NO: 6887146 - DNA, 15 bp, Homo sapiens
atgtgcatctggcct

SEQ ID NO: 6887147 - DNA, 15 bp, Homo sapiens
aacctgcctttgtat

SEQ ID NO: 6887148 - DNA, 14 bp, Homo sapiens
agcatgtctctgct

SEQ ID NO: 6887149 - DNA, 15 bp, Homo sapiens
cgggtggcaggtgga

SEQ ID NO: 6887150 - DNA, 14 bp, Homo sapiens
tatggaatattcat

SEQ ID NO: 6887151 - DNA, 14 bp, Homo sapiens
tgcaacctcgctga

SEQ ID NO: 6887152 - DNA, 14 bp, Homo sapiens
cacccttccctgcc

SEQ ID NO: 6887153 - DNA, 13 bp, Homo sapiens
cggacctacctcc

SEQ ID NO: 6887154 - DNA, 17 bp, Homo sapiens
gaaaataactgaatttg

SEQ ID NO: 6887155 - DNA, 23 bp, Homo sapiens
agcgagaactacgcacagctgcc

SEQ ID NO: 6887156 - DNA, 15 bp, Homo sapiens
cagacaacattatga

SEQ ID NO: 6887157 - DNA, 14 bp, Homo sapiens
tcctcccatggcct

SEQ ID NO: 6887158 - DNA, 14 bp, Homo sapiens
gagaaacccaggga

SEQ ID NO: 6887159 - DNA, 15 bp, Homo sapiens
tctcatcactcccct

SEQ ID NO: 6887160 - DNA, 23 bp, Homo sapiens
cctcatcctgctcttttgtgatg

SEQ ID NO: 6887161 - DNA, 12 bp, Homo sapiens
cttagcctgcct

SEQ ID NO: 6887162 - DNA, 12 bp, Homo sapiens
aagacactgcct

SEQ ID NO: 6887163 - DNA, 15 bp, Homo sapiens
tgaacaaaatctgtt

SEQ ID NO: 6887164 - DNA, 13 bp, Homo sapiens
ataattcatttaa

SEQ ID NO: 6887165 - DNA, 18 bp, Homo sapiens
agtgccacagcctgctgg

SEQ ID NO: 6887166 - DNA, 15 bp, Homo sapiens
ctcaggcactagcct

SEQ ID NO: 6887167 - DNA, 21 bp, Homo sapiens
cccttctcccttgccctccct

SEQ ID NO: 6887168 - DNA, 15 bp, Homo sapiens
agatgcatctgtggc

SEQ ID NO: 6887169 - DNA, 18 bp, Homo sapiens
tagtcaattagtacagta

SEQ ID NO: 6887170 - DNA, 20 bp, Homo sapiens
ttagatagccctgtcctggt

SEQ ID NO: 6887171 - DNA, 15 bp, Homo sapiens
gcagaggtgagcaga

SEQ ID NO: 6887172 - DNA, 14 bp, Homo sapiens
actctgtaattgca

SEQ ID NO: 6887173 - DNA, 21 bp, Homo sapiens
tatttttgtagttagacaata

SEQ ID NO: 6887174 - DNA, 15 bp, Homo sapiens
tccaattatgtgaca

SEQ ID NO: 6887175 - DNA, 16 bp, Homo sapiens
tgtgcctcctgtgtgt

SEQ ID NO: 6887176 - DNA, 14 bp, Homo sapiens
ccagccacaggacc

SEQ ID NO: 6887177 - DNA, 18 bp, Homo sapiens
aggcctcatgcctgctga

SEQ ID NO: 6887178 - DNA, 14 bp, Homo sapiens
ccaggccccagaca

SEQ ID NO: 6887179 - DNA, 12 bp, Homo sapiens
cactctgagact

SEQ ID NO: 6887180 - DNA, 17 bp, Homo sapiens
ctctgcttaaacaaagc

SEQ ID NO: 6887181 - DNA, 17 bp, Homo sapiens
ccgtgtcaagctgctct

SEQ ID NO: 6887182 - DNA, 15 bp, Homo sapiens
gcctgcctctgccac

SEQ ID NO: 6887183 - DNA, 13 bp, Homo sapiens
gagaactccatca

SEQ ID NO: 6887184 - DNA, 17 bp, Homo sapiens
acaagccaaacattctt

SEQ ID NO: 6887185 - DNA, 23 bp, Homo sapiens
tatatattctacacatatatgta

SEQ ID NO: 6887186 - DNA, 20 bp, Homo sapiens
ccaggcatcctccacaatag

SEQ ID NO: 6887187 - DNA, 16 bp, Homo sapiens
ctgatataaattctgt

SEQ ID NO: 6887188 - DNA, 14 bp, Homo sapiens
tgccatccctgaga

SEQ ID NO: 6887189 - DNA, 22 bp, Homo sapiens
tagacaatgtggaattacataa

SEQ ID NO: 6887190 - DNA, 16 bp, Homo sapiens
gtcactcacactggcc

SEQ ID NO: 6887191 - DNA, 20 bp, Homo sapiens
ctggtaagactgctggttga

SEQ ID NO: 6887192 - DNA, 17 bp, Homo sapiens
cacctgccctgccctgc

SEQ ID NO: 6887193 - DNA, 15 bp, Homo sapiens
tccccagccagccct

SEQ ID NO: 6887194 - DNA, 15 bp, Homo sapiens
gataaaactgtgtaa

SEQ ID NO: 6887195 - DNA, 16 bp, Homo sapiens
gccgcaccctggctgg

SEQ ID NO: 6887196 - DNA, 15 bp, Homo sapiens
ttcctttatactgtg

SEQ ID NO: 6887197 - DNA, 13 bp, Homo sapiens
agtaagtgccttc

SEQ ID NO: 6887198 - DNA, 21 bp, Homo sapiens
atttgggcctgctccagacct

SEQ ID NO: 6887199 - DNA, 23 bp, Homo sapiens
caggattaatctctaaaattcta

SEQ ID NO: 6887200 - DNA, 12 bp, Homo sapiens
cactccactctg

SEQ ID NO: 6887201 - DNA, 20 bp, Homo sapiens
cccgctcccaacccccctcc

SEQ ID NO: 6887202 - DNA, 19 bp, Homo sapiens
aggcaaaaactgtactgtg

SEQ ID NO: 6887203 - DNA, 20 bp, Homo sapiens
ctctgccacccactcaggat

SEQ ID NO: 6887204 - DNA, 18 bp, Homo sapiens
ctcatccagaactgtctt

SEQ ID NO: 6887205 - DNA, 21 bp, Homo sapiens
aacggagcttcggggcctcct

SEQ ID NO: 6887206 - DNA, 22 bp, Homo sapiens
attttcatacttttgatatgat

SEQ ID NO: 6887207 - DNA, 14 bp, Homo sapiens
gatgaaaagccata

SEQ ID NO: 6887208 - DNA, 23 bp, Homo sapiens
tataatgaagctttatacgtgta

SEQ ID NO: 6887209 - DNA, 20 bp, Homo sapiens
aaaaatcagtttttgactga

SEQ ID NO: 6887210 - DNA, 17 bp, Homo sapiens
tacttgcttattacatt

SEQ ID NO: 6887211 - DNA, 13 bp, Homo sapiens
atcccactccact

SEQ ID NO: 6887212 - DNA, 18 bp, Homo sapiens
ttcaggtgacctcctgca

SEQ ID NO: 6887213 - DNA, 18 bp, Homo sapiens
attcttccagaatgctga

SEQ ID NO: 6887214 - DNA, 20 bp, Homo sapiens
atctgtcaaaacactgtgga

SEQ ID NO: 6887215 - DNA, 16 bp, Homo sapiens
ccttccagcccatcca

SEQ ID NO: 6887216 - DNA, 14 bp, Homo sapiens
accgctcagtatta

SEQ ID NO: 6887217 - DNA, 18 bp, Homo sapiens
cccaggcaggccctgcct

SEQ ID NO: 6887218 - DNA, 15 bp, Homo sapiens
ccatttctgcacaca

SEQ ID NO: 6887219 - DNA, 12 bp, Homo sapiens
cctttcccaccc

SEQ ID NO: 6887220 - DNA, 22 bp, Homo sapiens
acctggggttttgacttgccac

SEQ ID NO: 6887221 - DNA, 15 bp, Homo sapiens
cccattctccctcca

SEQ ID NO: 6887222 - DNA, 17 bp, Homo sapiens
cctaaaagcacactcat

SEQ ID NO: 6887223 - DNA, 20 bp, Homo sapiens
tctgggcttatatctggcct

SEQ ID NO: 6887224 - DNA, 13 bp, Homo sapiens
acgcccagctccg

SEQ ID NO: 6887225 - DNA, 15 bp, Homo sapiens
actagtgctgaagct

SEQ ID NO: 6887226 - DNA, 19 bp, Homo sapiens
ccctggctacttcccttcc

SEQ ID NO: 6887227 - DNA, 17 bp, Homo sapiens
atccctgggcctgctgc

SEQ ID NO: 6887228 - DNA, 18 bp, Homo sapiens
agacaatttgatacataa

SEQ ID NO: 6887229 - DNA, 16 bp, Homo sapiens
ctggtgcttgggagag

SEQ ID NO: 6887230 - DNA, 20 bp, Homo sapiens
tccgcaccagctgctctgcc

SEQ ID NO: 6887231 - DNA, 15 bp, Homo sapiens
ctcccggccctgcct

SEQ ID NO: 6887232 - DNA, 22 bp, Homo sapiens
cccagctggtgtcactctgcct

SEQ ID NO: 6887233 - DNA, 20 bp, Homo sapiens
ccaaagaagatagctctctg

SEQ ID NO: 6887234 - DNA, 14 bp, Homo sapiens
tgccctccactgcc

SEQ ID NO: 6887235 - DNA, 22 bp, Homo sapiens
aatatttttatgtgaaggtgtt

SEQ ID NO: 6887236 - DNA, 20 bp, Homo sapiens
cacgtcacgtgtagtgtcca

SEQ ID NO: 6887237 - DNA, 22 bp, Homo sapiens
gcttgccccactctgcctgcct

SEQ ID NO: 6887238 - DNA, 22 bp, Homo sapiens
atagagtttaacagatatttaa

SEQ ID NO: 6887239 - DNA, 17 bp, Homo sapiens
cccagggccctgctcag

SEQ ID NO: 6887240 - DNA, 20 bp, Homo sapiens
aagagcacttgagctgtctg

SEQ ID NO: 6887241 - DNA, 23 bp, Homo sapiens
catcatggatcaaccaagttaca

SEQ ID NO: 6887242 - DNA, 17 bp, Homo sapiens
ccctctcttaccccgtc

SEQ ID NO: 6887243 - DNA, 13 bp, Homo sapiens
cactccttcccta

SEQ ID NO: 6887244 - DNA, 23 bp, Homo sapiens
cactgccttctcctctctgggcc

SEQ ID NO: 6887245 - DNA, 20 bp, Homo sapiens
gtcttgggctactggcagct

SEQ ID NO: 6887246 - DNA, 16 bp, Homo sapiens
gattttgccctcctgc

SEQ ID NO: 6887247 - DNA, 18 bp, Homo sapiens
ccaagattgagctctctg

SEQ ID NO: 6887248 - DNA, 17 bp, Homo sapiens
cccataggcccacacac

SEQ ID NO: 6887249 - DNA, 17 bp, Homo sapiens
gcccccaagcctctgcc

SEQ ID NO: 6887250 - DNA, 13 bp, Homo sapiens
agcaggctctcag

SEQ ID NO: 6887251 - DNA, 13 bp, Homo sapiens
ggctgggcagcta

SEQ ID NO: 6887252 - DNA, 19 bp, Homo sapiens
gagactgccctgcccaggt

SEQ ID NO: 6887253 - DNA, 19 bp, Homo sapiens
ctttgttcttgtcatcagt

SEQ ID NO: 6887254 - DNA, 20 bp, Homo sapiens
cctttcagatgtcttctgcc

SEQ ID NO: 6887255 - DNA, 14 bp, Homo sapiens
ccctgctctaccca

SEQ ID NO: 6887256 - DNA, 21 bp, Homo sapiens
aagtgatatcacctctcttca

SEQ ID NO: 6887257 - DNA, 22 bp, Homo sapiens
ggttccagaacagccctcggcc

SEQ ID NO: 6887258 - DNA, 11 bp, Homo sapiens
gtagccctggc

SEQ ID NO: 6887259 - DNA, 15 bp, Homo sapiens
ttcccttctccccct

SEQ ID NO: 6887260 - DNA, 14 bp, Homo sapiens
ccctttccctgcat

SEQ ID NO: 6887261 - DNA, 14 bp, Homo sapiens
aaagatgcttctca

SEQ ID NO: 6887262 - DNA, 17 bp, Homo sapiens
ccatgtataaatgtgat

SEQ ID NO: 6887263 - DNA, 17 bp, Homo sapiens
tacacagtgagactgta

SEQ ID NO: 6887264 - DNA, 19 bp, Homo sapiens
ttcgaactgtgctcccacg

SEQ ID NO: 6887265 - DNA, 13 bp, Homo sapiens
tccgcccctgcct

SEQ ID NO: 6887266 - DNA, 14 bp, Homo sapiens
ccggctctttcctt

SEQ ID NO: 6887267 - DNA, 17 bp, Homo sapiens
cactctcttcctttcat

SEQ ID NO: 6887268 - DNA, 17 bp, Homo sapiens
ctttcctgccctgtcca

SEQ ID NO: 6887269 - DNA, 14 bp, Homo sapiens
aatagcatactgtg

SEQ ID NO: 6887270 - DNA, 17 bp, Homo sapiens
caggctgagcccagcca

SEQ ID NO: 6887271 - DNA, 20 bp, Homo sapiens
ttgctgtcctgatctgtgat

SEQ ID NO: 6887272 - DNA, 14 bp, Homo sapiens
ctccagtctgttct

SEQ ID NO: 6887273 - DNA, 17 bp, Homo sapiens
gttgggtttgagacaga

SEQ ID NO: 6887274 - DNA, 16 bp, Homo sapiens
gcaacactgctgtcca

SEQ ID NO: 6887275 - DNA, 21 bp, Homo sapiens
cctgtgggagtccactttcct

SEQ ID NO: 6887276 - DNA, 15 bp, Homo sapiens
ccatcgtccagccct

SEQ ID NO: 6887277 - DNA, 20 bp, Homo sapiens
agccaagcttcaaccctcag

SEQ ID NO: 6887278 - DNA, 15 bp, Homo sapiens
acccttcagggccag

SEQ ID NO: 6887279 - DNA, 15 bp, Homo sapiens
ggtccacgcctctgc

SEQ ID NO: 6887280 - DNA, 21 bp, Homo sapiens
cggtgctgggggcacagctgt

SEQ ID NO: 6887281 - DNA, 20 bp, Homo sapiens
tccgactctaagctgtgtgc

SEQ ID NO: 6887282 - DNA, 14 bp, Homo sapiens
tgtcctcctgctct

SEQ ID NO: 6887283 - DNA, 14 bp, Homo sapiens
cttcccccctctcc

SEQ ID NO: 6887284 - DNA, 15 bp, Homo sapiens
gcggagagagccaag

SEQ ID NO: 6887285 - DNA, 21 bp, Homo sapiens
aagccagctgcagctgggctg

SEQ ID NO: 6887286 - DNA, 22 bp, Homo sapiens
caatgacatctcaggggccaga

SEQ ID NO: 6887287 - DNA, 13 bp, Homo sapiens
atcagcactgaaa

SEQ ID NO: 6887288 - DNA, 18 bp, Homo sapiens
gtcccaccttggagcatt

SEQ ID NO: 6887289 - DNA, 17 bp, Homo sapiens
tgggttagggtgtgtgt

SEQ ID NO: 6887290 - DNA, 14 bp, Homo sapiens
tcctgttcctgcct

SEQ ID NO: 6887291 - DNA, 11 bp, Homo sapiens
gtggtctttga

SEQ ID NO: 6887292 - DNA, 18 bp, Homo sapiens
attgttgacaactgtgac

SEQ ID NO: 6887293 - DNA, 15 bp, Homo sapiens
gtagacttggagctg

SEQ ID NO: 6887294 - DNA, 15 bp, Homo sapiens
ctaggctctgtctgg

SEQ ID NO: 6887295 - DNA, 15 bp, Homo sapiens
ctcttgtcctcttct

SEQ ID NO: 6887296 - DNA, 22 bp, Homo sapiens
tatggcagtccagccagctcct

SEQ ID NO: 6887297 - DNA, 18 bp, Homo sapiens
acaagccacaagtcttcc

SEQ ID NO: 6887298 - DNA, 15 bp, Homo sapiens
tcacatcctcctgcc

SEQ ID NO: 6887299 - DNA, 14 bp, Homo sapiens
ccagattgtgtaca

SEQ ID NO: 6887300 - DNA, 14 bp, Homo sapiens
cagcacctttctct

SEQ ID NO: 6887301 - DNA, 21 bp, Homo sapiens
ggttccatccaccaccttgcc

SEQ ID NO: 6887302 - DNA, 22 bp, Homo sapiens
ctccaagcccagcccatggaga

SEQ ID NO: 6887303 - DNA, 15 bp, Homo sapiens
aattcaaaaagtgtt

SEQ ID NO: 6887304 - DNA, 19 bp, Homo sapiens
cacgtgtccgtccaccctt

SEQ ID NO: 6887305 - DNA, 17 bp, Homo sapiens
ccaggccgcgcccagca

SEQ ID NO: 6887306 - DNA, 16 bp, Homo sapiens
tatatatagatatgta

SEQ ID NO: 6887307 - DNA, 15 bp, Homo sapiens
agctgccccagccag

SEQ ID NO: 6887308 - DNA, 17 bp, Homo sapiens
cccagcctcgcatgcca

SEQ ID NO: 6887309 - DNA, 14 bp, Homo sapiens
cacgggccctgccc

SEQ ID NO: 6887310 - DNA, 16 bp, Homo sapiens
cagagtcattgttaca

SEQ ID NO: 6887311 - DNA, 13 bp, Homo sapiens
gctcccctctgcc

SEQ ID NO: 6887312 - DNA, 19 bp, Homo sapiens
ccttcagtgagcccctccc

SEQ ID NO: 6887313 - DNA, 17 bp, Homo sapiens
caaggccacctctgcct

SEQ ID NO: 6887314 - DNA, 17 bp, Homo sapiens
cagtcaccacccagccc

SEQ ID NO: 6887315 - DNA, 23 bp, Homo sapiens
ccgcagcccgtgaagcagtgcct

SEQ ID NO: 6887316 - DNA, 18 bp, Homo sapiens
cactgttgatgtatctga

SEQ ID NO: 6887317 - DNA, 15 bp, Homo sapiens
caaaatattttatct

SEQ ID NO: 6887318 - DNA, 12 bp, Homo sapiens
tcataaattggc

SEQ ID NO: 6887319 - DNA, 15 bp, Homo sapiens
ccaattgccctgcca

SEQ ID NO: 6887320 - DNA, 19 bp, Homo sapiens
ctccctgtctccagctgcc

SEQ ID NO: 6887321 - DNA, 12 bp, Homo sapiens
acctgtctgtgc

SEQ ID NO: 6887322 - DNA, 14 bp, Homo sapiens
agattacctcctga

SEQ ID NO: 6887323 - DNA, 18 bp, Homo sapiens
gtaacaatacaaatggat

SEQ ID NO: 6887324 - DNA, 14 bp, Homo sapiens
agcagttctctgcc

SEQ ID NO: 6887325 - DNA, 14 bp, Homo sapiens
ttatcagtacaatt

SEQ ID NO: 6887326 - DNA, 19 bp, Homo sapiens
ccactttcaagctgcactg

SEQ ID NO: 6887327 - DNA, 23 bp, Homo sapiens
cctcatgggtcctagcccttccc

SEQ ID NO: 6887328 - DNA, 18 bp, Homo sapiens
agctgcctgtgcctgcca

SEQ ID NO: 6887329 - DNA, 12 bp, Homo sapiens
accaccctgcct

SEQ ID NO: 6887330 - DNA, 15 bp, Homo sapiens
gactctcctgcctca

SEQ ID NO: 6887331 - DNA, 16 bp, Homo sapiens
cttctccccccatccc

SEQ ID NO: 6887332 - DNA, 19 bp, Homo sapiens
acttgtaggtttctctgcc

SEQ ID NO: 6887333 - DNA, 20 bp, Homo sapiens
ccgggacgcttccagaccac

SEQ ID NO: 6887334 - DNA, 17 bp, Homo sapiens
atggtactaaggagaat

SEQ ID NO: 6887335 - DNA, 18 bp, Homo sapiens
caatcctgggcaatcaga

SEQ ID NO: 6887336 - DNA, 19 bp, Homo sapiens
ctaaaatgtagaaattcta

SEQ ID NO: 6887337 - DNA, 18 bp, Homo sapiens
ccttccccctgctgatca

SEQ ID NO: 6887338 - DNA, 12 bp, Homo sapiens
atgcaagatatt

SEQ ID NO: 6887339 - DNA, 17 bp, Homo sapiens
ctctcctggctgggcca

SEQ ID NO: 6887340 - DNA, 18 bp, Homo sapiens
aggtggccaggcctgcca

SEQ ID NO: 6887341 - DNA, 19 bp, Homo sapiens
tccactctggattcagcct

SEQ ID NO: 6887342 - DNA, 22 bp, Homo sapiens
cagcagtgtgagggtgcaggga

SEQ ID NO: 6887343 - DNA, 18 bp, Homo sapiens
ctgtctctgctcttgcct

SEQ ID NO: 6887344 - DNA, 22 bp, Homo sapiens
attgttcttgtaaaactgtgac

SEQ ID NO: 6887345 - DNA, 21 bp, Homo sapiens
tcaagcgattctcctgcctca

SEQ ID NO: 6887346 - DNA, 23 bp, Homo sapiens
taccagacggttcaccagcctct

SEQ ID NO: 6887347 - DNA, 17 bp, Homo sapiens
cagctcctgaccaaaga

SEQ ID NO: 6887348 - DNA, 13 bp, Homo sapiens
cagtttgtttaca

SEQ ID NO: 6887349 - DNA, 18 bp, Homo sapiens
gaatgcacaagaatggat

SEQ ID NO: 6887350 - DNA, 22 bp, Homo sapiens
agccgctcctgtctgccagcca

SEQ ID NO: 6887351 - DNA, 23 bp, Homo sapiens
tacatgtaaaatagggctttgta

SEQ ID NO: 6887352 - DNA, 12 bp, Homo sapiens
actgcctctgcc

SEQ ID NO: 6887353 - DNA, 18 bp, Homo sapiens
cctccaagaagccctcct

SEQ ID NO: 6887354 - DNA, 18 bp, Homo sapiens
ctcccagtctcatctcct

SEQ ID NO: 6887355 - DNA, 17 bp, Homo sapiens
tgctctggcggcttcct

SEQ ID NO: 6887356 - DNA, 14 bp, Homo sapiens
atctgctcctccca

SEQ ID NO: 6887357 - DNA, 17 bp, Homo sapiens
atggtaaataactgtga

SEQ ID NO: 6887358 - DNA, 18 bp, Homo sapiens
tcccagcagacatcctca

SEQ ID NO: 6887359 - DNA, 23 bp, Homo sapiens
tcagatctgacatgattccttcc

SEQ ID NO: 6887360 - DNA, 12 bp, Homo sapiens
atttctacctca

SEQ ID NO: 6887361 - DNA, 22 bp, Homo sapiens
agcatagaacaggacctctgct

SEQ ID NO: 6887362 - DNA, 14 bp, Homo sapiens
atgtagacatttta

SEQ ID NO: 6887363 - DNA, 19 bp, Homo sapiens
ccttccctcttccctctcc

SEQ ID NO: 6887364 - DNA, 16 bp, Homo sapiens
tggccttaactggccc

SEQ ID NO: 6887365 - DNA, 18 bp, Homo sapiens
aatgagtttgtattatta

SEQ ID NO: 6887366 - DNA, 13 bp, Homo sapiens
cacctgtctgtgc

SEQ ID NO: 6887367 - DNA, 13 bp, Homo sapiens
ggacacactgtaa

SEQ ID NO: 6887368 - DNA, 12 bp, Homo sapiens
cacttgtgccag

SEQ ID NO: 6887369 - DNA, 22 bp, Homo sapiens
caaacctttctataattttaca

SEQ ID NO: 6887370 - DNA, 16 bp, Homo sapiens
cagtcctgcctggcca

SEQ ID NO: 6887371 - DNA, 14 bp, Homo sapiens
atttcttcctctgc

SEQ ID NO: 6887372 - DNA, 19 bp, Homo sapiens
tgaaaatcctatatctgtt

SEQ ID NO: 6887373 - DNA, 17 bp, Homo sapiens
cagtgactgtacagtta

SEQ ID NO: 6887374 - DNA, 16 bp, Homo sapiens
tgtgcattgtggctgt

SEQ ID NO: 6887375 - DNA, 21 bp, Homo sapiens
gggcccccaataaaccagtgt

SEQ ID NO: 6887376 - DNA, 22 bp, Homo sapiens
agtgaggctctattgagccaag

SEQ ID NO: 6887377 - DNA, 13 bp, Homo sapiens
cacacgctgctct

SEQ ID NO: 6887378 - DNA, 23 bp, Homo sapiens
acaactgatcatttgcagctgct

SEQ ID NO: 6887379 - DNA, 21 bp, Homo sapiens
tcgtagttggcaggagctcct

SEQ ID NO: 6887380 - DNA, 19 bp, Homo sapiens
ctgaatcaaagacatttca

SEQ ID NO: 6887381 - DNA, 14 bp, Homo sapiens
cttcctactcctca

SEQ ID NO: 6887382 - DNA, 20 bp, Homo sapiens
ctctgcagtcgcttgccaaa

SEQ ID NO: 6887383 - DNA, 16 bp, Homo sapiens
gcctcagctcagcctc

SEQ ID NO: 6887384 - DNA, 17 bp, Homo sapiens
ctcttcaaaaactgttt

SEQ ID NO: 6887385 - DNA, 19 bp, Homo sapiens
aggaactgtccagagagca

SEQ ID NO: 6887386 - DNA, 22 bp, Homo sapiens
aatagatgttttaacttattta

SEQ ID NO: 6887387 - DNA, 14 bp, Homo sapiens
ccatgccactgcca

SEQ ID NO: 6887388 - DNA, 22 bp, Homo sapiens
cagtcttctaccaaatgtgtaa

SEQ ID NO: 6887389 - DNA, 21 bp, Homo sapiens
cctcctctcactccccagcct

SEQ ID NO: 6887390 - DNA, 14 bp, Homo sapiens
tatagcctgcctca

SEQ ID NO: 6887391 - DNA, 15 bp, Homo sapiens
gtaccgcaatgtgac

SEQ ID NO: 6887392 - DNA, 18 bp, Homo sapiens
catttccttttctctgcc

SEQ ID NO: 6887393 - DNA, 20 bp, Homo sapiens
cctgggcctttcctgtgcca

SEQ ID NO: 6887394 - DNA, 20 bp, Homo sapiens
ctgcagcatggtccctgcct

SEQ ID NO: 6887395 - DNA, 18 bp, Homo sapiens
tatagttattattgctgt

SEQ ID NO: 6887396 - DNA, 20 bp, Homo sapiens
tccggcctctccctgcctgt

SEQ ID NO: 6887397 - DNA, 22 bp, Homo sapiens
tcatgataccacctttactgtg

SEQ ID NO: 6887398 - DNA, 18 bp, Homo sapiens
tgtcccctatcctcccct

SEQ ID NO: 6887399 - DNA, 20 bp, Homo sapiens
aaatttaaaacacagtattg

SEQ ID NO: 6887400 - DNA, 14 bp, Homo sapiens
gctctaagcagcca

SEQ ID NO: 6887401 - DNA, 17 bp, Homo sapiens
caccaacctcactgccc

SEQ ID NO: 6887402 - DNA, 14 bp, Homo sapiens
accctgccctgtgg

SEQ ID NO: 6887403 - DNA, 23 bp, Homo sapiens
ttgcagaaggcaaggccctgccc

SEQ ID NO: 6887404 - DNA, 23 bp, Homo sapiens
actacacggttcaaacctgtgaa

SEQ ID NO: 6887405 - DNA, 17 bp, Homo sapiens
atctgaccatctgtgac

SEQ ID NO: 6887406 - DNA, 16 bp, Homo sapiens
tccttcttggcttcct

SEQ ID NO: 6887407 - DNA, 16 bp, Homo sapiens
acagcctctggctcca

SEQ ID NO: 6887408 - DNA, 13 bp, Homo sapiens
caaaaacacaaat

SEQ ID NO: 6887409 - DNA, 23 bp, Homo sapiens
agatctgtcctcagccttgccag

SEQ ID NO: 6887410 - DNA, 13 bp, Homo sapiens
ccaaacccttgct

SEQ ID NO: 6887411 - DNA, 21 bp, Homo sapiens
gtggccttctgctgcccaggc

SEQ ID NO: 6887412 - DNA, 14 bp, Homo sapiens
agaaaatattctct

SEQ ID NO: 6887413 - DNA, 18 bp, Homo sapiens
caagcatctcctgaggat

SEQ ID NO: 6887414 - DNA, 13 bp, Homo sapiens
ccgtcccctctcc

SEQ ID NO: 6887415 - DNA, 18 bp, Homo sapiens
attccatacttctctcag

SEQ ID NO: 6887416 - DNA, 22 bp, Homo sapiens
caggtcttgactcatggcagct

SEQ ID NO: 6887417 - DNA, 15 bp, Homo sapiens
taaatttaactgcat

SEQ ID NO: 6887418 - DNA, 22 bp, Homo sapiens
caggtggctcccacctgtagtc

SEQ ID NO: 6887419 - DNA, 21 bp, Homo sapiens
tcctgagaaacgtccatctct

SEQ ID NO: 6887420 - DNA, 17 bp, Homo sapiens
tatgagaatatacctta

SEQ ID NO: 6887421 - DNA, 21 bp, Homo sapiens
cacaatgacacatttgttgca

SEQ ID NO: 6887422 - DNA, 13 bp, Homo sapiens
gtcctcaccacat

SEQ ID NO: 6887423 - DNA, 16 bp, Homo sapiens
aagtttctcagctccc

SEQ ID NO: 6887424 - DNA, 14 bp, Homo sapiens
ctaaccctctgtca

SEQ ID NO: 6887425 - DNA, 13 bp, Homo sapiens
tctggctcctcct

SEQ ID NO: 6887426 - DNA, 16 bp, Homo sapiens
ggcatgggtcgggaga

SEQ ID NO: 6887427 - DNA, 22 bp, Homo sapiens
aagtttcaggtgacatgtgaaa

SEQ ID NO: 6887428 - DNA, 14 bp, Homo sapiens
cttcagctggtgga

SEQ ID NO: 6887429 - DNA, 14 bp, Homo sapiens
cttatcctctgatc

SEQ ID NO: 6887430 - DNA, 19 bp, Homo sapiens
cactgcgcaggtctcttct

SEQ ID NO: 6887431 - DNA, 18 bp, Homo sapiens
cacacatgcatacttaca

SEQ ID NO: 6887432 - DNA, 17 bp, Homo sapiens
catgtttaaactttgtg

SEQ ID NO: 6887433 - DNA, 14 bp, Homo sapiens
agttacttgaaata

SEQ ID NO: 6887434 - DNA, 23 bp, Homo sapiens
cattttggggtacccactgctct

SEQ ID NO: 6887435 - DNA, 21 bp, Homo sapiens
gagcctcgtgtcctgctagct

SEQ ID NO: 6887436 - DNA, 20 bp, Homo sapiens
gccggtctgcaagtcagagg

SEQ ID NO: 6887437 - DNA, 13 bp, Homo sapiens
cggttccctgcct

SEQ ID NO: 6887438 - DNA, 17 bp, Homo sapiens
cagtccccacccctgcc

SEQ ID NO: 6887439 - DNA, 15 bp, Homo sapiens
gccagcagagccagg

SEQ ID NO: 6887440 - DNA, 13 bp, Homo sapiens
ctgtctcatcccc

SEQ ID NO: 6887441 - DNA, 13 bp, Homo sapiens
atgagtgtgaatg

SEQ ID NO: 6887442 - DNA, 18 bp, Homo sapiens
ctgcttctccacctcccc

SEQ ID NO: 6887443 - DNA, 17 bp, Homo sapiens
attttccctctcttgcc

SEQ ID NO: 6887444 - DNA, 14 bp, Homo sapiens
aacacagccttcct

SEQ ID NO: 6887445 - DNA, 16 bp, Homo sapiens
ccctttcccctcttcc

SEQ ID NO: 6887446 - DNA, 13 bp, Homo sapiens
ctgtctcctccct

SEQ ID NO: 6887447 - DNA, 16 bp, Homo sapiens
tgccaccccttcctca

SEQ ID NO: 6887448 - DNA, 22 bp, Homo sapiens
agtagagatttcatagctattt

SEQ ID NO: 6887449 - DNA, 23 bp, Homo sapiens
gtctggatgcgggcatggcagcc

SEQ ID NO: 6887450 - DNA, 15 bp, Homo sapiens
gctccagcctctgcc

SEQ ID NO: 6887451 - DNA, 21 bp, Homo sapiens
aggaagggccgaggaatgtga

SEQ ID NO: 6887452 - DNA, 15 bp, Homo sapiens
cacccctctctgcat

SEQ ID NO: 6887453 - DNA, 23 bp, Homo sapiens
ccaaatggaaatgggcagagcag

SEQ ID NO: 6887454 - DNA, 18 bp, Homo sapiens
gtattatcagtgaatata

SEQ ID NO: 6887455 - DNA, 21 bp, Homo sapiens
caagatggcgaccaccaaagt

SEQ ID NO: 6887456 - DNA, 14 bp, Homo sapiens
catgaacagctctg

SEQ ID NO: 6887457 - DNA, 14 bp, Homo sapiens
catagcccctgccc

SEQ ID NO: 6887458 - DNA, 12 bp, Homo sapiens
ctgtcccatccc

SEQ ID NO: 6887459 - DNA, 21 bp, Homo sapiens
cctttctgactgtccctgcca

SEQ ID NO: 6887460 - DNA, 15 bp, Homo sapiens
tctccctctcatgtc

SEQ ID NO: 6887461 - DNA, 15 bp, Homo sapiens
cacattgaaactgta

SEQ ID NO: 6887462 - DNA, 21 bp, Homo sapiens
aggacagctcctggaccaggc

SEQ ID NO: 6887463 - DNA, 14 bp, Homo sapiens
agcccagcctgccc

SEQ ID NO: 6887464 - DNA, 14 bp, Homo sapiens
tgtggtccatgccc

SEQ ID NO: 6887465 - DNA, 14 bp, Homo sapiens
cctccctccctcca

SEQ ID NO: 6887466 - DNA, 14 bp, Homo sapiens
cgtctctgccctgg

SEQ ID NO: 6887467 - DNA, 12 bp, Homo sapiens
cagccccatcct

SEQ ID NO: 6887468 - DNA, 21 bp, Homo sapiens
tcagagacaccaaactgccaa

SEQ ID NO: 6887469 - DNA, 14 bp, Homo sapiens
tctaacatcttaga

SEQ ID NO: 6887470 - DNA, 22 bp, Homo sapiens
tttacaaattgtttttactgtc

SEQ ID NO: 6887471 - DNA, 15 bp, Homo sapiens
tctggggcttgtcct

SEQ ID NO: 6887472 - DNA, 16 bp, Homo sapiens
tggctactctgtgcca

SEQ ID NO: 6887473 - DNA, 17 bp, Homo sapiens
ctgggcagctcctccct

SEQ ID NO: 6887474 - DNA, 13 bp, Homo sapiens
tagccctcccact

SEQ ID NO: 6887475 - DNA, 23 bp, Homo sapiens
agacaccctaactcttgctcact

SEQ ID NO: 6887476 - DNA, 19 bp, Homo sapiens
cccagcctggccccggcct

SEQ ID NO: 6887477 - DNA, 21 bp, Homo sapiens
caggcgcagaggtcccagccc

SEQ ID NO: 6887478 - DNA, 15 bp, Homo sapiens
gccgcctgctcctca

SEQ ID NO: 6887479 - DNA, 19 bp, Homo sapiens
tctgtctctgctcttgcct

SEQ ID NO: 6887480 - DNA, 17 bp, Homo sapiens
tgcaacctgtggctcag

SEQ ID NO: 6887481 - DNA, 13 bp, Homo sapiens
cctttccctgccg

SEQ ID NO: 6887482 - DNA, 18 bp, Homo sapiens
tgctcccccatcctcccc

SEQ ID NO: 6887483 - DNA, 15 bp, Homo sapiens
catcccctccctgcc

SEQ ID NO: 6887484 - DNA, 12 bp, Homo sapiens
atggcaggggaa

SEQ ID NO: 6887485 - DNA, 19 bp, Homo sapiens
caattctcctgcctcagcc

SEQ ID NO: 6887486 - DNA, 17 bp, Homo sapiens
cctgaattaaagtctac

SEQ ID NO: 6887487 - DNA, 13 bp, Homo sapiens
ctttctctgcctg

SEQ ID NO: 6887488 - DNA, 20 bp, Homo sapiens
tattttttatgatggagcaa

SEQ ID NO: 6887489 - DNA, 16 bp, Homo sapiens
ccaagctaatctgcct

SEQ ID NO: 6887490 - DNA, 18 bp, Homo sapiens
ttccagaacgccctgtgt

SEQ ID NO: 6887491 - DNA, 13 bp, Homo sapiens
aatgaagatgcat

SEQ ID NO: 6887492 - DNA, 21 bp, Homo sapiens
ttttccaaaaaaatactgcca

SEQ ID NO: 6887493 - DNA, 17 bp, Homo sapiens
aagtctctctgtgaata

SEQ ID NO: 6887494 - DNA, 13 bp, Homo sapiens
cctctaaagcaga

SEQ ID NO: 6887495 - DNA, 16 bp, Homo sapiens
tcctgattaaatgtct

SEQ ID NO: 6887496 - DNA, 17 bp, Homo sapiens
aagttgttgactgtgat

SEQ ID NO: 6887497 - DNA, 19 bp, Homo sapiens
aacaacatgaaactgccta

SEQ ID NO: 6887498 - DNA, 22 bp, Homo sapiens
tagaattccttttataagattt

SEQ ID NO: 6887499 - DNA, 19 bp, Homo sapiens
ctaaggctctatgagtcta

SEQ ID NO: 6887500 - DNA, 13 bp, Homo sapiens
cctgccccatcct

SEQ ID NO: 6887501 - DNA, 15 bp, Homo sapiens
cctttaccccatccc

SEQ ID NO: 6887502 - DNA, 16 bp, Homo sapiens
tgagggagcttagcca

SEQ ID NO: 6887503 - DNA, 17 bp, Homo sapiens
tgtaataaaaatttgtt

SEQ ID NO: 6887504 - DNA, 15 bp, Homo sapiens
atttgtattaatgta

SEQ ID NO: 6887505 - DNA, 19 bp, Homo sapiens
atggtgcaatgacctttca

SEQ ID NO: 6887506 - DNA, 13 bp, Homo sapiens
ccggcccccttcc

SEQ ID NO: 6887507 - DNA, 13 bp, Homo sapiens
attcccctctgct

SEQ ID NO: 6887508 - DNA, 15 bp, Homo sapiens
aggctgcccctctca

SEQ ID NO: 6887509 - DNA, 13 bp, Homo sapiens
ccacacctcctct

SEQ ID NO: 6887510 - DNA, 16 bp, Homo sapiens
ttccactgcctctgcc

SEQ ID NO: 6887511 - DNA, 14 bp, Homo sapiens
ccctacctgcttca

SEQ ID NO: 6887512 - DNA, 12 bp, Homo sapiens
cctccccctcct

SEQ ID NO: 6887513 - DNA, 21 bp, Homo sapiens
tgggagctcctctcctggagg

SEQ ID NO: 6887514 - DNA, 19 bp, Homo sapiens
caaagaaatgaacattcca

SEQ ID NO: 6887515 - DNA, 18 bp, Homo sapiens
ctgtcgagacacttgcct

SEQ ID NO: 6887516 - DNA, 21 bp, Homo sapiens
ccggatctccaggcccagcct

SEQ ID NO: 6887517 - DNA, 14 bp, Homo sapiens
cactggtcagggca

SEQ ID NO: 6887518 - DNA, 22 bp, Homo sapiens
accccctgagatcccctgagcc

SEQ ID NO: 6887519 - DNA, 22 bp, Homo sapiens
gagtctgaggactgtcctccca

SEQ ID NO: 6887520 - DNA, 19 bp, Homo sapiens
cccttgccgccccgtgcct

SEQ ID NO: 6887521 - DNA, 23 bp, Homo sapiens
tgggggaaagggaactagataac

SEQ ID NO: 6887522 - DNA, 21 bp, Homo sapiens
ccttcctgggaccccctcgcc

SEQ ID NO: 6887523 - DNA, 20 bp, Homo sapiens
tggctgaggttcctctgcct

SEQ ID NO: 6887524 - DNA, 21 bp, Homo sapiens
gctcagagtgaagagtgaaga

SEQ ID NO: 6887525 - DNA, 16 bp, Homo sapiens
cctccaacccctcgcc

SEQ ID NO: 6887526 - DNA, 17 bp, Homo sapiens
tccctggaccagcctcc

SEQ ID NO: 6887527 - DNA, 13 bp, Homo sapiens
aaatatgaaatta

SEQ ID NO: 6887528 - DNA, 12 bp, Homo sapiens
cccttgcagcct

SEQ ID NO: 6887529 - DNA, 17 bp, Homo sapiens
tgttccttccctgtgcc

SEQ ID NO: 6887530 - DNA, 24 bp, Homo sapiens
cctcaccccacttatccctctcca

SEQ ID NO: 6887531 - DNA, 17 bp, Homo sapiens
ctgctagctgtctctct

SEQ ID NO: 6887532 - DNA, 19 bp, Homo sapiens
agaagccttcaagctctga

SEQ ID NO: 6887533 - DNA, 13 bp, Homo sapiens
cataaaaaggaca

SEQ ID NO: 6887534 - DNA, 20 bp, Homo sapiens
ctcacaggcagctctgagcc

SEQ ID NO: 6887535 - DNA, 16 bp, Homo sapiens
ccagaccccccagccc

SEQ ID NO: 6887536 - DNA, 21 bp, Homo sapiens
aggaagcacaaaagacaagca

SEQ ID NO: 6887537 - DNA, 17 bp, Homo sapiens
gagaagacactgcagtg

SEQ ID NO: 6887538 - DNA, 13 bp, Homo sapiens
ctggttcttgcct

SEQ ID NO: 6887539 - DNA, 14 bp, Homo sapiens
agaatcaatcagta

SEQ ID NO: 6887540 - DNA, 21 bp, Homo sapiens
tctgattagagatatagatat

SEQ ID NO: 6887541 - DNA, 16 bp, Homo sapiens
tggtggcactgagccc

SEQ ID NO: 6887542 - DNA, 16 bp, Homo sapiens
ctatgaccctgtgcct

SEQ ID NO: 6887543 - DNA, 19 bp, Homo sapiens
tccttcccatttctctaca

SEQ ID NO: 6887544 - DNA, 15 bp, Homo sapiens
ccttttttgagattt

SEQ ID NO: 6887545 - DNA, 16 bp, Homo sapiens
aaagcttctctctgag

SEQ ID NO: 6887546 - DNA, 14 bp, Homo sapiens
atgcaacctctgcc

SEQ ID NO: 6887547 - DNA, 20 bp, Homo sapiens
aacagctgtgagccatgcct

SEQ ID NO: 6887548 - DNA, 22 bp, Homo sapiens
gcacatctgtaaatctacacac

SEQ ID NO: 6887549 - DNA, 14 bp, Homo sapiens
tttccatctctgcc

SEQ ID NO: 6887550 - DNA, 23 bp, Homo sapiens
gattctagatcagatgctccaag

SEQ ID NO: 6887551 - DNA, 16 bp, Homo sapiens
tcactgtgcactgccc

SEQ ID NO: 6887552 - DNA, 16 bp, Homo sapiens
caaatactcatgtgta

SEQ ID NO: 6887553 - DNA, 21 bp, Homo sapiens
catctctgtgtacccactcct

SEQ ID NO: 6887554 - DNA, 14 bp, Homo sapiens
ctggagagagattc

SEQ ID NO: 6887555 - DNA, 18 bp, Homo sapiens
aggaatcacccctctgcc

SEQ ID NO: 6887556 - DNA, 20 bp, Homo sapiens
ataaatgatatataatttaa

SEQ ID NO: 6887557 - DNA, 14 bp, Homo sapiens
acgtgaccctgtgc

SEQ ID NO: 6887558 - DNA, 15 bp, Homo sapiens
agcctctttctgtcc

SEQ ID NO: 6887559 - DNA, 13 bp, Homo sapiens
cgtaatgcttaga

SEQ ID NO: 6887560 - DNA, 19 bp, Homo sapiens
tcctattgtgatttgactg

SEQ ID NO: 6887561 - DNA, 14 bp, Homo sapiens
cctcagcctcttct

SEQ ID NO: 6887562 - DNA, 15 bp, Homo sapiens
tgctaaggcagctga

SEQ ID NO: 6887563 - DNA, 17 bp, Homo sapiens
agaggtgctagctctta

SEQ ID NO: 6887564 - DNA, 16 bp, Homo sapiens
ccctcttctctcctca

SEQ ID NO: 6887565 - DNA, 19 bp, Homo sapiens
tgaagtgaccccagctcca

SEQ ID NO: 6887566 - DNA, 12 bp, Homo sapiens
gctgctctgcgt

SEQ ID NO: 6887567 - DNA, 21 bp, Homo sapiens
cagttcagaatggcagtcctg

SEQ ID NO: 6887568 - DNA, 13 bp, Homo sapiens
cttagcagctcag

SEQ ID NO: 6887569 - DNA, 13 bp, Homo sapiens
agtcccagagccc

SEQ ID NO: 6887570 - DNA, 15 bp, Homo sapiens
gacaagataaaggaa

SEQ ID NO: 6887571 - DNA, 12 bp, Homo sapiens
tagccctggccc

SEQ ID NO: 6887572 - DNA, 14 bp, Homo sapiens
catttctctgagca

SEQ ID NO: 6887573 - DNA, 13 bp, Homo sapiens
agtctgttttatg

SEQ ID NO: 6887574 - DNA, 17 bp, Homo sapiens
aatgtagcacttacgta

SEQ ID NO: 6887575 - DNA, 16 bp, Homo sapiens
cttctcccacactgct

SEQ ID NO: 6887576 - DNA, 14 bp, Homo sapiens
cttactctactgct

SEQ ID NO: 6887577 - DNA, 14 bp, Homo sapiens
taaaggcagcattt

SEQ ID NO: 6887578 - DNA, 12 bp, Homo sapiens
agttcctctgca

SEQ ID NO: 6887579 - DNA, 15 bp, Homo sapiens
acttccgcctcctgt

SEQ ID NO: 6887580 - DNA, 15 bp, Homo sapiens
accttgggtttgtat

SEQ ID NO: 6887581 - DNA, 17 bp, Homo sapiens
catgccgcgtccctgcc

SEQ ID NO: 6887582 - DNA, 15 bp, Homo sapiens
catctggcctggcca

SEQ ID NO: 6887583 - DNA, 19 bp, Homo sapiens
gttcgagaccagtctggcc

SEQ ID NO: 6887584 - DNA, 15 bp, Homo sapiens
catcttgtgcatgca

SEQ ID NO: 6887585 - DNA, 13 bp, Homo sapiens
ttaaaaactgtgt

SEQ ID NO: 6887586 - DNA, 19 bp, Homo sapiens
tggggagagagcccttccc

SEQ ID NO: 6887587 - DNA, 22 bp, Homo sapiens
cctttcacttctttcccttcct

SEQ ID NO: 6887588 - DNA, 14 bp, Homo sapiens
ctcagctcactgca

SEQ ID NO: 6887589 - DNA, 13 bp, Homo sapiens
gtccccctaccca

SEQ ID NO: 6887590 - DNA, 13 bp, Homo sapiens
caggaaagccaca

SEQ ID NO: 6887591 - DNA, 22 bp, Homo sapiens
tccagtctaaaaatatctgtct

SEQ ID NO: 6887592 - DNA, 24 bp, Homo sapiens
agccagcaatgatgtccagaagaa

SEQ ID NO: 6887593 - DNA, 19 bp, Homo sapiens
tcctgcagcaaacactcca

SEQ ID NO: 6887594 - DNA, 20 bp, Homo sapiens
cagacccaggagtccagccc

SEQ ID NO: 6887595 - DNA, 12 bp, Homo sapiens
cttccctctcct

SEQ ID NO: 6887596 - DNA, 16 bp, Homo sapiens
cctgctggcctgctct

SEQ ID NO: 6887597 - DNA, 17 bp, Homo sapiens
catatacacctggaaca

SEQ ID NO: 6887598 - DNA, 19 bp, Homo sapiens
agtgtctcagtccacctga

SEQ ID NO: 6887599 - DNA, 12 bp, Homo sapiens
tctaccatctcc

SEQ ID NO: 6887600 - DNA, 16 bp, Homo sapiens
ctatatttgtcttccg

SEQ ID NO: 6887601 - DNA, 23 bp, Homo sapiens
ctgaaacttatttttttctgatt

SEQ ID NO: 6887602 - DNA, 23 bp, Homo sapiens
tcacaccccagacgatgtcttca

SEQ ID NO: 6887603 - DNA, 19 bp, Homo sapiens
cagcctcaagtcactccca

SEQ ID NO: 6887604 - DNA, 23 bp, Homo sapiens
cctccctgctgtcccctcttgcc

SEQ ID NO: 6887605 - DNA, 22 bp, Homo sapiens
caggagtccaggcccccagccc

SEQ ID NO: 6887606 - DNA, 23 bp, Homo sapiens
tatctatatagtacctttgctct

SEQ ID NO: 6887607 - DNA, 20 bp, Homo sapiens
taatgttctgtcacgtgaaa

SEQ ID NO: 6887608 - DNA, 18 bp, Homo sapiens
cttgaccctttcctcccc

SEQ ID NO: 6887609 - DNA, 17 bp, Homo sapiens
tcctctcccctaccact

SEQ ID NO: 6887610 - DNA, 15 bp, Homo sapiens
ctatccacactgtca

SEQ ID NO: 6887611 - DNA, 15 bp, Homo sapiens
ctcaaaaccatctct

SEQ ID NO: 6887612 - DNA, 14 bp, Homo sapiens
ctggggagctcctg

SEQ ID NO: 6887613 - DNA, 14 bp, Homo sapiens
ctcctgaccaaaga

SEQ ID NO: 6887614 - DNA, 16 bp, Homo sapiens
cttccatgtgcctttc

SEQ ID NO: 6887615 - DNA, 17 bp, Homo sapiens
gcacattcgggaccaat

SEQ ID NO: 6887616 - DNA, 15 bp, Homo sapiens
taaaggatgagattt

SEQ ID NO: 6887617 - DNA, 22 bp, Homo sapiens
ctatagaaagtgttctgttaca

SEQ ID NO: 6887618 - DNA, 13 bp, Homo sapiens
cctcctccctcct

SEQ ID NO: 6887619 - DNA, 14 bp, Homo sapiens
ttaaccattctgtc

SEQ ID NO: 6887620 - DNA, 21 bp, Homo sapiens
cttacaatcaaatctcctgct

SEQ ID NO: 6887621 - DNA, 14 bp, Homo sapiens
cagacacacacacg

SEQ ID NO: 6887622 - DNA, 12 bp, Homo sapiens
ttccagctgctg

SEQ ID NO: 6887623 - DNA, 15 bp, Homo sapiens
atatgtaaactttaa

SEQ ID NO: 6887624 - DNA, 22 bp, Homo sapiens
cacaggccctttcctcaggcaa

SEQ ID NO: 6887625 - DNA, 20 bp, Homo sapiens
ctccaggcttcacagtctgg

SEQ ID NO: 6887626 - DNA, 16 bp, Homo sapiens
ctcaacctacagtgga

SEQ ID NO: 6887627 - DNA, 15 bp, Homo sapiens
aggtcatattggaaa

SEQ ID NO: 6887628 - DNA, 16 bp, Homo sapiens
ctgcagtcctggtggg

SEQ ID NO: 6887629 - DNA, 16 bp, Homo sapiens
caatcggactgccaaa

SEQ ID NO: 6887630 - DNA, 17 bp, Homo sapiens
agctggaagcctgccga

SEQ ID NO: 6887631 - DNA, 17 bp, Homo sapiens
ctggtcccctccttccc

SEQ ID NO: 6887632 - DNA, 16 bp, Homo sapiens
ctaactgattcagggc

SEQ ID NO: 6887633 - DNA, 17 bp, Homo sapiens
tgcctttcttctgccct

SEQ ID NO: 6887634 - DNA, 23 bp, Homo sapiens
agatgttggtcttggtcatttgc

SEQ ID NO: 6887635 - DNA, 18 bp, Homo sapiens
tgaaagacatcaatgaaa

SEQ ID NO: 6887636 - DNA, 21 bp, Homo sapiens
taatacttaacattgatttat

SEQ ID NO: 6887637 - DNA, 19 bp, Homo sapiens
agtgttcacaaactgtgaa

SEQ ID NO: 6887638 - DNA, 17 bp, Homo sapiens
ttctaagactttactta

SEQ ID NO: 6887639 - DNA, 14 bp, Homo sapiens
ctctcccacttcct

SEQ ID NO: 6887640 - DNA, 14 bp, Homo sapiens
cctttgcccttcct

SEQ ID NO: 6887641 - DNA, 16 bp, Homo sapiens
ccgtagctctgctgct

SEQ ID NO: 6887642 - DNA, 15 bp, Homo sapiens
cacccagtgctgcca

SEQ ID NO: 6887643 - DNA, 22 bp, Homo sapiens
ttcagtctctgaatacacagta

SEQ ID NO: 6887644 - DNA, 23 bp, Homo sapiens
cttacagctgggtggcactgcca

SEQ ID NO: 6887645 - DNA, 18 bp, Homo sapiens
atcagtatattttctgta

SEQ ID NO: 6887646 - DNA, 21 bp, Homo sapiens
aacactaacaaaatttgaata

SEQ ID NO: 6887647 - DNA, 21 bp, Homo sapiens
tcccaggggagccagctgctt

SEQ ID NO: 6887648 - DNA, 14 bp, Homo sapiens
tcattgcctgtgta

SEQ ID NO: 6887649 - DNA, 19 bp, Homo sapiens
atgcaaatgagatttcttt

SEQ ID NO: 6887650 - DNA, 13 bp, Homo sapiens
gtgccgcctgccc

SEQ ID NO: 6887651 - DNA, 18 bp, Homo sapiens
cccacataatacattcca

SEQ ID NO: 6887652 - DNA, 19 bp, Homo sapiens
taaggattttatgctttaa

SEQ ID NO: 6887653 - DNA, 19 bp, Homo sapiens
ttgctcctacccctgtcct

SEQ ID NO: 6887654 - DNA, 13 bp, Homo sapiens
tggcttctggcca

SEQ ID NO: 6887655 - DNA, 18 bp, Homo sapiens
tctcccagcactgcctcc

SEQ ID NO: 6887656 - DNA, 18 bp, Homo sapiens
cgaggcgaggctgcctct

SEQ ID NO: 6887657 - DNA, 14 bp, Homo sapiens
cacggaccctgtgt

SEQ ID NO: 6887658 - DNA, 13 bp, Homo sapiens
gtccatggtgcta

SEQ ID NO: 6887659 - DNA, 22 bp, Homo sapiens
cccccaggagcagctggcactg

SEQ ID NO: 6887660 - DNA, 18 bp, Homo sapiens
tgcatttgttcagctccc

SEQ ID NO: 6887661 - DNA, 18 bp, Homo sapiens
gtccctcttctctcctca

SEQ ID NO: 6887662 - DNA, 15 bp, Homo sapiens
tctcatgagaagcca

SEQ ID NO: 6887663 - DNA, 20 bp, Homo sapiens
aatatttgtcgatatttcca

SEQ ID NO: 6887664 - DNA, 21 bp, Homo sapiens
cagtaggatattggcatttgt

SEQ ID NO: 6887665 - DNA, 21 bp, Homo sapiens
cgtcaaaacagattgtttgca

SEQ ID NO: 6887666 - DNA, 16 bp, Homo sapiens
tctgcccaagttgctc

SEQ ID NO: 6887667 - DNA, 15 bp, Homo sapiens
ccccagcctacctct

SEQ ID NO: 6887668 - DNA, 18 bp, Homo sapiens
ctctgccccaagcagcca

SEQ ID NO: 6887669 - DNA, 14 bp, Homo sapiens
agcatactgtgtat

SEQ ID NO: 6887670 - DNA, 23 bp, Homo sapiens
ctgtggaagagattcctattact

SEQ ID NO: 6887671 - DNA, 18 bp, Homo sapiens
cttagataacttcttgaa

SEQ ID NO: 6887672 - DNA, 14 bp, Homo sapiens
ctgtggctcctgcc

SEQ ID NO: 6887673 - DNA, 18 bp, Homo sapiens
gccttggtggagcagcca

SEQ ID NO: 6887674 - DNA, 12 bp, Homo sapiens
agcctcttgccc

SEQ ID NO: 6887675 - DNA, 15 bp, Homo sapiens
atcccaacactgcca

SEQ ID NO: 6887676 - DNA, 20 bp, Homo sapiens
atatctgttagatgctacta

SEQ ID NO: 6887677 - DNA, 21 bp, Homo sapiens
cagactttctttttctacatg

SEQ ID NO: 6887678 - DNA, 14 bp, Homo sapiens
ttccacacatttcc

SEQ ID NO: 6887679 - DNA, 18 bp, Homo sapiens
tgcccaccccctcaagcc

SEQ ID NO: 6887680 - DNA, 16 bp, Homo sapiens
aatgagacttgctctc

SEQ ID NO: 6887681 - DNA, 15 bp, Homo sapiens
aatttattaaattta

SEQ ID NO: 6887682 - DNA, 16 bp, Homo sapiens
tatactattatttgtt

SEQ ID NO: 6887683 - DNA, 16 bp, Homo sapiens
tggcaggcctgaccca

SEQ ID NO: 6887684 - DNA, 17 bp, Homo sapiens
ctcctgtttcagaccag

SEQ ID NO: 6887685 - DNA, 17 bp, Homo sapiens
ttgtaagaaatactgta

SEQ ID NO: 6887686 - DNA, 16 bp, Homo sapiens
tcccacctcagcctcc

SEQ ID NO: 6887687 - DNA, 22 bp, Homo sapiens
gaaatgccaaaggaagttttaa

SEQ ID NO: 6887688 - DNA, 15 bp, Homo sapiens
ttccttttgtgtaca

SEQ ID NO: 6887689 - DNA, 14 bp, Homo sapiens
tctccttcctgtgt

SEQ ID NO: 6887690 - DNA, 17 bp, Homo sapiens
agagttgttctcagggg

SEQ ID NO: 6887691 - DNA, 21 bp, Homo sapiens
ctgctcccccaccccctcccc

SEQ ID NO: 6887692 - DNA, 20 bp, Homo sapiens
tagctcccctcctctcccct

SEQ ID NO: 6887693 - DNA, 20 bp, Homo sapiens
ctcagcctggtgggcctcct

SEQ ID NO: 6887694 - DNA, 17 bp, Homo sapiens
caggccctgcccagcca

SEQ ID NO: 6887695 - DNA, 18 bp, Homo sapiens
caggggaaaactgttacc

SEQ ID NO: 6887696 - DNA, 20 bp, Homo sapiens
agctcctctccccagcccag

SEQ ID NO: 6887697 - DNA, 21 bp, Homo sapiens
tcacagctcacggcagcctca

SEQ ID NO: 6887698 - DNA, 22 bp, Homo sapiens
cattttctagccctctccctca

SEQ ID NO: 6887699 - DNA, 20 bp, Homo sapiens
cctgccccggacctacctcc

SEQ ID NO: 6887700 - DNA, 18 bp, Homo sapiens
acataccttgcttcttca

SEQ ID NO: 6887701 - DNA, 17 bp, Homo sapiens
aagaacttgatttgcat

SEQ ID NO: 6887702 - DNA, 17 bp, Homo sapiens
tgtactagtactgtgta

SEQ ID NO: 6887703 - DNA, 22 bp, Homo sapiens
actgagaggaggggtaaatata

SEQ ID NO: 6887704 - DNA, 23 bp, Homo sapiens
atgcactttttccttactgtgca

SEQ ID NO: 6887705 - DNA, 18 bp, Homo sapiens
cattaccacgccttgacc

SEQ ID NO: 6887706 - DNA, 21 bp, Homo sapiens
ctctagaacacccactggcca

SEQ ID NO: 6887707 - DNA, 18 bp, Homo sapiens
caggtttaacatttgcct

SEQ ID NO: 6887708 - DNA, 15 bp, Homo sapiens
cagacagaacttgaa

SEQ ID NO: 6887709 - DNA, 12 bp, Homo sapiens
gcagctgcctcc

SEQ ID NO: 6887710 - DNA, 15 bp, Homo sapiens
ttcagacccctgcct

SEQ ID NO: 6887711 - DNA, 21 bp, Homo sapiens
catcttgcctccaggtgcaga

SEQ ID NO: 6887712 - DNA, 15 bp, Homo sapiens
tttgtgctctttcct

SEQ ID NO: 6887713 - DNA, 17 bp, Homo sapiens
cctgcacacacctgcct

SEQ ID NO: 6887714 - DNA, 21 bp, Homo sapiens
agcctcttattccaggagaag

SEQ ID NO: 6887715 - DNA, 17 bp, Homo sapiens
ctggacagtcactgcca

SEQ ID NO: 6887716 - DNA, 13 bp, Homo sapiens
tctgcccatgcct

SEQ ID NO: 6887717 - DNA, 14 bp, Homo sapiens
tccacgccactgcc

SEQ ID NO: 6887718 - DNA, 20 bp, Homo sapiens
tggagactggtcctgtgtgc

SEQ ID NO: 6887719 - DNA, 19 bp, Homo sapiens
tggcaaatcaggggccaga

SEQ ID NO: 6887720 - DNA, 16 bp, Homo sapiens
tatatatacatatgta

SEQ ID NO: 6887721 - DNA, 12 bp, Homo sapiens
ccagttgaagtg

SEQ ID NO: 6887722 - DNA, 20 bp, Homo sapiens
ctccatacctgcccctgcct

SEQ ID NO: 6887723 - DNA, 13 bp, Homo sapiens
cttgccactgcct

SEQ ID NO: 6887724 - DNA, 22 bp, Homo sapiens
tatgagtttttgatagctttat

SEQ ID NO: 6887725 - DNA, 13 bp, Homo sapiens
agcatcttcctct

SEQ ID NO: 6887726 - DNA, 22 bp, Homo sapiens
tggtacttttatgatgtatatt

SEQ ID NO: 6887727 - DNA, 23 bp, Homo sapiens
actctgcagatagtgcctctgca

SEQ ID NO: 6887728 - DNA, 19 bp, Homo sapiens
tcctctatactttgttctg

SEQ ID NO: 6887729 - DNA, 13 bp, Homo sapiens
ctgcctctgctcc

SEQ ID NO: 6887730 - DNA, 16 bp, Homo sapiens
tcactggctcatgccc

SEQ ID NO: 6887731 - DNA, 18 bp, Homo sapiens
cggcccttctgactgttt

SEQ ID NO: 6887732 - DNA, 14 bp, Homo sapiens
aaattaatgtaata

SEQ ID NO: 6887733 - DNA, 17 bp, Homo sapiens
ttagaggttctgcctct

SEQ ID NO: 6887734 - DNA, 17 bp, Homo sapiens
agtccaggagctcagga

SEQ ID NO: 6887735 - DNA, 16 bp, Homo sapiens
cactctgggtctggcc

SEQ ID NO: 6887736 - DNA, 22 bp, Homo sapiens
ttggtcagagtaagctgctttt

SEQ ID NO: 6887737 - DNA, 21 bp, Homo sapiens
tgtacttaaatgagttactta

SEQ ID NO: 6887738 - DNA, 16 bp, Homo sapiens
taattagaaacgtgat

SEQ ID NO: 6887739 - DNA, 15 bp, Homo sapiens
gcatgctgtccctta

SEQ ID NO: 6887740 - DNA, 21 bp, Homo sapiens
cagagtccagtgctctgcctc

SEQ ID NO: 6887741 - DNA, 12 bp, Homo sapiens
agctctgagccg

SEQ ID NO: 6887742 - DNA, 15 bp, Homo sapiens
actggcttctgtgca

SEQ ID NO: 6887743 - DNA, 14 bp, Homo sapiens
tgtctccagctgcc

SEQ ID NO: 6887744 - DNA, 20 bp, Homo sapiens
tttcctctaactcactgcct

SEQ ID NO: 6887745 - DNA, 17 bp, Homo sapiens
cccacctcacccggcct

SEQ ID NO: 6887746 - DNA, 22 bp, Homo sapiens
agctcttttattttcctgctgg

SEQ ID NO: 6887747 - DNA, 22 bp, Homo sapiens
cagaggaaaaatgggagccagg

SEQ ID NO: 6887748 - DNA, 21 bp, Homo sapiens
cctcagcctgcaccctcttct

SEQ ID NO: 6887749 - DNA, 13 bp, Homo sapiens
tctttattgtctg

SEQ ID NO: 6887750 - DNA, 23 bp, Homo sapiens
ccaagacatgtctgttctacata

SEQ ID NO: 6887751 - DNA, 15 bp, Homo sapiens
taattccaatatgat

SEQ ID NO: 6887752 - DNA, 21 bp, Homo sapiens
cagagaccagggctccagccc

SEQ ID NO: 6887753 - DNA, 17 bp, Homo sapiens
cactccagtccactcct

SEQ ID NO: 6887754 - DNA, 14 bp, Homo sapiens
accctccctgctgt

SEQ ID NO: 6887755 - DNA, 19 bp, Homo sapiens
ccacagtagaactgtctgt

SEQ ID NO: 6887756 - DNA, 16 bp, Homo sapiens
tctctggctcagctgt

SEQ ID NO: 6887757 - DNA, 14 bp, Homo sapiens
tagtcaactgctgt

SEQ ID NO: 6887758 - DNA, 17 bp, Homo sapiens
cagtccggtgccttcca

SEQ ID NO: 6887759 - DNA, 14 bp, Homo sapiens
ctctaactccctcc

SEQ ID NO: 6887760 - DNA, 14 bp, Homo sapiens
actcagcctctgct

SEQ ID NO: 6887761 - DNA, 21 bp, Homo sapiens
attttcaggaaatctacttcc

SEQ ID NO: 6887762 - DNA, 15 bp, Homo sapiens
aggctgtctggccag

SEQ ID NO: 6887763 - DNA, 17 bp, Homo sapiens
cgccagcctcagtgcca

SEQ ID NO: 6887764 - DNA, 18 bp, Homo sapiens
taagcattccaactatct

SEQ ID NO: 6887765 - DNA, 15 bp, Homo sapiens
cacgttctctctgcc

SEQ ID NO: 6887766 - DNA, 21 bp, Homo sapiens
cccttcccctgcgccctccct

SEQ ID NO: 6887767 - DNA, 16 bp, Homo sapiens
cctcttgccccaaccc

SEQ ID NO: 6887768 - DNA, 15 bp, Homo sapiens
atacataacattcaa

SEQ ID NO: 6887769 - DNA, 19 bp, Homo sapiens
gtaatatactgagctgcta

SEQ ID NO: 6887770 - DNA, 21 bp, Homo sapiens
ctctcctttgaaacctgctct

SEQ ID NO: 6887771 - DNA, 21 bp, Homo sapiens
tctttccaaaggttgtacata

SEQ ID NO: 6887772 - DNA, 23 bp, Homo sapiens
attcaggtcccagttgctgtcac

SEQ ID NO: 6887773 - DNA, 12 bp, Homo sapiens
tctgccttgcct

SEQ ID NO: 6887774 - DNA, 20 bp, Homo sapiens
cctcccgaatagctgggact

SEQ ID NO: 6887775 - DNA, 19 bp, Homo sapiens
cttcctagcttatctccct

SEQ ID NO: 6887776 - DNA, 16 bp, Homo sapiens
caaaatcccctcagcc

SEQ ID NO: 6887777 - DNA, 13 bp, Homo sapiens
tcctggcagctgc

SEQ ID NO: 6887778 - DNA, 17 bp, Homo sapiens
cagaccattgtcttcca

SEQ ID NO: 6887779 - DNA, 15 bp, Homo sapiens
ttctgcagcccttgg

SEQ ID NO: 6887780 - DNA, 23 bp, Homo sapiens
tggctcaggcaagcccctcagcc

SEQ ID NO: 6887781 - DNA, 19 bp, Homo sapiens
gagatcccaacactgccag

SEQ ID NO: 6887782 - DNA, 16 bp, Homo sapiens
acatcctgtgcctcca

SEQ ID NO: 6887783 - DNA, 21 bp, Homo sapiens
cctaattttaaataatttcta

SEQ ID NO: 6887784 - DNA, 16 bp, Homo sapiens
ctccatggccctgcca

SEQ ID NO: 6887785 - DNA, 14 bp, Homo sapiens
ccttcagctcctga

SEQ ID NO: 6887786 - DNA, 22 bp, Homo sapiens
tcataagagccacaggtcttta

SEQ ID NO: 6887787 - DNA, 20 bp, Homo sapiens
cacccatcttcctgctgctg

SEQ ID NO: 6887788 - DNA, 14 bp, Homo sapiens
aagatcctcttgcc

SEQ ID NO: 6887789 - DNA, 21 bp, Homo sapiens
ccttccatgacctcccctccc

SEQ ID NO: 6887790 - DNA, 16 bp, Homo sapiens
caccctgccctggcct

SEQ ID NO: 6887791 - DNA, 22 bp, Homo sapiens
cccttcagcccccagcccctcc

SEQ ID NO: 6887792 - DNA, 17 bp, Homo sapiens
cctccagaactcttcct

SEQ ID NO: 6887793 - DNA, 16 bp, Homo sapiens
aattgttttgcacttt

SEQ ID NO: 6887794 - DNA, 20 bp, Homo sapiens
agtggcaggcagaggcccag

SEQ ID NO: 6887795 - DNA, 15 bp, Homo sapiens
tactagctctttgag

SEQ ID NO: 6887796 - DNA, 15 bp, Homo sapiens
gcccctccctctgcc

SEQ ID NO: 6887797 - DNA, 20 bp, Homo sapiens
tctgggatgcaggcatgctt

SEQ ID NO: 6887798 - DNA, 12 bp, Homo sapiens
cctggctgccca

SEQ ID NO: 6887799 - DNA, 14 bp, Homo sapiens
tgtatttattcttt

SEQ ID NO: 6887800 - DNA, 19 bp, Homo sapiens
gcttgcccactgcctgcct

SEQ ID NO: 6887801 - DNA, 23 bp, Homo sapiens
ctgctgcccggggtggggtgcac

SEQ ID NO: 6887802 - DNA, 14 bp, Homo sapiens
aaaattatgctgca

SEQ ID NO: 6887803 - DNA, 17 bp, Homo sapiens
aagagaaatacagctgg

SEQ ID NO: 6887804 - DNA, 22 bp, Homo sapiens
tataattgtatcgtatagctgt

SEQ ID NO: 6887805 - DNA, 21 bp, Homo sapiens
cacctcccactcctgctgcac

SEQ ID NO: 6887806 - DNA, 12 bp, Homo sapiens
ccaggcagctgg

SEQ ID NO: 6887807 - DNA, 13 bp, Homo sapiens
ggcttttctgatc

SEQ ID NO: 6887808 - DNA, 23 bp, Homo sapiens
ttcccgggagctgggccctgcct

SEQ ID NO: 6887809 - DNA, 15 bp, Homo sapiens
agcagctcttgctaa

SEQ ID NO: 6887810 - DNA, 15 bp, Homo sapiens
ctcccaaagtgctga

SEQ ID NO: 6887811 - DNA, 13 bp, Homo sapiens
acccccagcctcc

SEQ ID NO: 6887812 - DNA, 20 bp, Homo sapiens
acagctccttactctgagga

SEQ ID NO: 6887813 - DNA, 14 bp, Homo sapiens
ccctggccatctct

SEQ ID NO: 6887814 - DNA, 20 bp, Homo sapiens
ggtcaataaagcagagccaa

SEQ ID NO: 6887815 - DNA, 21 bp, Homo sapiens
cactacccttctcctttcctt

SEQ ID NO: 6887816 - DNA, 14 bp, Homo sapiens
caccaccctgtctt

SEQ ID NO: 6887817 - DNA, 19 bp, Homo sapiens
ctactgccatcctggccca

SEQ ID NO: 6887818 - DNA, 15 bp, Homo sapiens
cctccggttcttcct

SEQ ID NO: 6887819 - DNA, 12 bp, Homo sapiens
atttgaaaattg

SEQ ID NO: 6887820 - DNA, 17 bp, Homo sapiens
ctgatttactaacagta

SEQ ID NO: 6887821 - DNA, 17 bp, Homo sapiens
cagggctgtcccagccc

SEQ ID NO: 6887822 - DNA, 19 bp, Homo sapiens
ccattggggctcccagcca

SEQ ID NO: 6887823 - DNA, 19 bp, Homo sapiens
ctgtgtcagagcccagccc

SEQ ID NO: 6887824 - DNA, 15 bp, Homo sapiens
cctgccctcagggat

SEQ ID NO: 6887825 - DNA, 13 bp, Homo sapiens
agatgctgctgaa

SEQ ID NO: 6887826 - DNA, 12 bp, Homo sapiens
cttatgtttctt

SEQ ID NO: 6887827 - DNA, 15 bp, Homo sapiens
tgtctttaattctgt

SEQ ID NO: 6887828 - DNA, 14 bp, Homo sapiens
cccgctgcacacag

SEQ ID NO: 6887829 - DNA, 17 bp, Homo sapiens
tgccgggcctggactgt

SEQ ID NO: 6887830 - DNA, 14 bp, Homo sapiens
cttcagttctgctt

SEQ ID NO: 6887831 - DNA, 16 bp, Homo sapiens
ggcttgtttttcttca

SEQ ID NO: 6887832 - DNA, 22 bp, Homo sapiens
cctgccacctggacccctgcat

SEQ ID NO: 6887833 - DNA, 15 bp, Homo sapiens
aatttaactaattta

SEQ ID NO: 6887834 - DNA, 17 bp, Homo sapiens
acttcctgcttcctcag

SEQ ID NO: 6887835 - DNA, 21 bp, Homo sapiens
cagcaggggggctgtgccaac

SEQ ID NO: 6887836 - DNA, 16 bp, Homo sapiens
gctctgataggccaag

SEQ ID NO: 6887837 - DNA, 20 bp, Homo sapiens
caatgtgatataaacagctt

SEQ ID NO: 6887838 - DNA, 15 bp, Homo sapiens
agaaagaggtctccc

SEQ ID NO: 6887839 - DNA, 14 bp, Homo sapiens
actcttaagccatc

SEQ ID NO: 6887840 - DNA, 19 bp, Homo sapiens
ccctgtccttccctgttct

SEQ ID NO: 6887841 - DNA, 17 bp, Homo sapiens
accagtcttctccctgt

SEQ ID NO: 6887842 - DNA, 15 bp, Homo sapiens
acccttcccagccct

SEQ ID NO: 6887843 - DNA, 15 bp, Homo sapiens
cagtgtcccctgccc

SEQ ID NO: 6887844 - DNA, 19 bp, Homo sapiens
tggtcctgcctaaatttca

SEQ ID NO: 6887845 - DNA, 17 bp, Homo sapiens
acggcacgcacttgcct

SEQ ID NO: 6887846 - DNA, 17 bp, Homo sapiens
cagggcagcaggccaga

SEQ ID NO: 6887847 - DNA, 13 bp, Homo sapiens
catgcccactgct

SEQ ID NO: 6887848 - DNA, 18 bp, Homo sapiens
agtaggggtctgtctttt

SEQ ID NO: 6887849 - DNA, 22 bp, Homo sapiens
ccaacgttcgatttctacctca

SEQ ID NO: 6887850 - DNA, 23 bp, Homo sapiens
tggcttccagcgggccctctgcc

SEQ ID NO: 6887851 - DNA, 18 bp, Homo sapiens
tcagccccgggcctgcct

SEQ ID NO: 6887852 - DNA, 17 bp, Homo sapiens
agcccacctgcacccag

SEQ ID NO: 6887853 - DNA, 17 bp, Homo sapiens
ccctcaggccagtgcca

SEQ ID NO: 6887854 - DNA, 18 bp, Homo sapiens
cctgatgcttttgtctaa

SEQ ID NO: 6887855 - DNA, 17 bp, Homo sapiens
caattcaaccctttgcc

SEQ ID NO: 6887856 - DNA, 17 bp, Homo sapiens
accaatcttactttgta

SEQ ID NO: 6887857 - DNA, 13 bp, Homo sapiens
cctccccgatccc

SEQ ID NO: 6887858 - DNA, 13 bp, Homo sapiens
atttccccagcca

SEQ ID NO: 6887859 - DNA, 17 bp, Homo sapiens
ttatttaataaatgaca

SEQ ID NO: 6887860 - DNA, 13 bp, Homo sapiens
actcttgatttca

SEQ ID NO: 6887861 - DNA, 21 bp, Homo sapiens
gggactcatccttgcccaggt

SEQ ID NO: 6887862 - DNA, 23 bp, Homo sapiens
caggctgggcttcagtggcagct

SEQ ID NO: 6887863 - DNA, 16 bp, Homo sapiens
ctgtcctcctggtggg

SEQ ID NO: 6887864 - DNA, 17 bp, Homo sapiens
actttgcgggatattta

SEQ ID NO: 6887865 - DNA, 16 bp, Homo sapiens
agcaaaaatgctaata

SEQ ID NO: 6887866 - DNA, 23 bp, Homo sapiens
gaattttatactttccctaccct

SEQ ID NO: 6887867 - DNA, 19 bp, Homo sapiens
ccatgatttgtcccagcct

SEQ ID NO: 6887868 - DNA, 18 bp, Homo sapiens
tacctagtttgcactata

SEQ ID NO: 6887869 - DNA, 17 bp, Homo sapiens
ctgtaaacatagatagt

SEQ ID NO: 6887870 - DNA, 13 bp, Homo sapiens
cctccccctttca

SEQ ID NO: 6887871 - DNA, 15 bp, Homo sapiens
ttccaacacatttca

SEQ ID NO: 6887872 - DNA, 18 bp, Homo sapiens
ccaagggggctgctgctc

SEQ ID NO: 6887873 - DNA, 19 bp, Homo sapiens
catatgacaaatgtttcta

SEQ ID NO: 6887874 - DNA, 23 bp, Homo sapiens
gcctctttcaagcagtcgtgcct

SEQ ID NO: 6887875 - DNA, 17 bp, Homo sapiens
cctgcctgggtgggaca

SEQ ID NO: 6887876 - DNA, 14 bp, Homo sapiens
ctcacctcatgccc

SEQ ID NO: 6887877 - DNA, 14 bp, Homo sapiens
ctatgtcccagccc

SEQ ID NO: 6887878 - DNA, 18 bp, Homo sapiens
agccctgaggacctctca

SEQ ID NO: 6887879 - DNA, 16 bp, Homo sapiens
gggccagacatgccac

SEQ ID NO: 6887880 - DNA, 16 bp, Homo sapiens
agaacatgcagtttga

SEQ ID NO: 6887881 - DNA, 17 bp, Homo sapiens
ctattttactgtcttaa

SEQ ID NO: 6887882 - DNA, 16 bp, Homo sapiens
tgtaccgcaatgtgac

SEQ ID NO: 6887883 - DNA, 21 bp, Homo sapiens
tgtattttattgtaacagaca

SEQ ID NO: 6887884 - DNA, 22 bp, Homo sapiens
aagacgctgtgctgccctgccc

SEQ ID NO: 6887885 - DNA, 12 bp, Homo sapiens
tcactgtctttg

SEQ ID NO: 6887886 - DNA, 22 bp, Homo sapiens
tgttctggggggacccagtgca

SEQ ID NO: 6887887 - DNA, 13 bp, Homo sapiens
ctccatttgctct

SEQ ID NO: 6887888 - DNA, 19 bp, Homo sapiens
cacccagcccacttctgcc

SEQ ID NO: 6887889 - DNA, 13 bp, Homo sapiens
catccctccctcc

SEQ ID NO: 6887890 - DNA, 21 bp, Homo sapiens
ccactcagcactctggactcc

SEQ ID NO: 6887891 - DNA, 14 bp, Homo sapiens
ccactgcttaccta

SEQ ID NO: 6887892 - DNA, 13 bp, Homo sapiens
caatactacctct

SEQ ID NO: 6887893 - DNA, 12 bp, Homo sapiens
ctgaaaaactaa

SEQ ID NO: 6887894 - DNA, 17 bp, Homo sapiens
cccacccaagccctcct

SEQ ID NO: 6887895 - DNA, 16 bp, Homo sapiens
agcagacagagccagg

SEQ ID NO: 6887896 - DNA, 15 bp, Homo sapiens
cattccagctctgcc

SEQ ID NO: 6887897 - DNA, 18 bp, Homo sapiens
caagtgctggcccaccca

SEQ ID NO: 6887898 - DNA, 16 bp, Homo sapiens
cacctctgctgcccac

SEQ ID NO: 6887899 - DNA, 16 bp, Homo sapiens
ccttttgtatcttcct

SEQ ID NO: 6887900 - DNA, 21 bp, Homo sapiens
cccttccccctttctctgcct

SEQ ID NO: 6887901 - DNA, 21 bp, Homo sapiens
ccagctccccccgcccaccca

SEQ ID NO: 6887902 - DNA, 15 bp, Homo sapiens
cattcccactgcact

SEQ ID NO: 6887903 - DNA, 18 bp, Homo sapiens
cctcctgctctgcttcct

SEQ ID NO: 6887904 - DNA, 21 bp, Homo sapiens
atgctgcccaccccctgctgg

SEQ ID NO: 6887905 - DNA, 18 bp, Homo sapiens
gagataggaaactgaagc

SEQ ID NO: 6887906 - DNA, 14 bp, Homo sapiens
acccagtctttctt

SEQ ID NO: 6887907 - DNA, 21 bp, Homo sapiens
ccataaagacaatcactgcca

SEQ ID NO: 6887908 - DNA, 16 bp, Homo sapiens
tgccatcatgtttaca

SEQ ID NO: 6887909 - DNA, 14 bp, Homo sapiens
tctgactcttgcct

SEQ ID NO: 6887910 - DNA, 23 bp, Homo sapiens
cccttgccccacctcccccttcc

SEQ ID NO: 6887911 - DNA, 16 bp, Homo sapiens
cactgagctctgcctc

SEQ ID NO: 6887912 - DNA, 20 bp, Homo sapiens
tatccaagtaccaatgctgt

SEQ ID NO: 6887913 - DNA, 21 bp, Homo sapiens
ccttcagagtacgtcctgcct

SEQ ID NO: 6887914 - DNA, 14 bp, Homo sapiens
ctctaggacttcaa

SEQ ID NO: 6887915 - DNA, 16 bp, Homo sapiens
cccagtttctgcctct

SEQ ID NO: 6887916 - DNA, 19 bp, Homo sapiens
ccatggctttgtgctgctg

SEQ ID NO: 6887917 - DNA, 19 bp, Homo sapiens
agggttaggaatctcttca

SEQ ID NO: 6887918 - DNA, 14 bp, Homo sapiens
cccacccccctcct

SEQ ID NO: 6887919 - DNA, 18 bp, Homo sapiens
ctccagggccacgtgcca

SEQ ID NO: 6887920 - DNA, 17 bp, Homo sapiens
ttcaagttgatgtgaca

SEQ ID NO: 6887921 - DNA, 12 bp, Homo sapiens
acctctgtctca

SEQ ID NO: 6887922 - DNA, 21 bp, Homo sapiens
tcaaaacacactactacctct

SEQ ID NO: 6887923 - DNA, 15 bp, Homo sapiens
ccagttcttgcaata

SEQ ID NO: 6887924 - DNA, 18 bp, Homo sapiens
aagcatcacctcaggcca

SEQ ID NO: 6887925 - DNA, 17 bp, Homo sapiens
gcctctgccgctgccat

SEQ ID NO: 6887926 - DNA, 21 bp, Homo sapiens
tggccagacgctgccgctgcc

SEQ ID NO: 6887927 - DNA, 18 bp, Homo sapiens
catttaaaaaacatttta

SEQ ID NO: 6887928 - DNA, 18 bp, Homo sapiens
acccacctccctgcctcc

SEQ ID NO: 6887929 - DNA, 17 bp, Homo sapiens
tggtgctaactgtatgt

SEQ ID NO: 6887930 - DNA, 17 bp, Homo sapiens
ctgaatgtttgtgtctg

SEQ ID NO: 6887931 - DNA, 17 bp, Homo sapiens
cccttcctgtcctgcct

SEQ ID NO: 6887932 - DNA, 22 bp, Homo sapiens
cccactactcaatactacctct

SEQ ID NO: 6887933 - DNA, 22 bp, Homo sapiens
accctgggtcgggacagaccag

SEQ ID NO: 6887934 - DNA, 22 bp, Homo sapiens
tcaattccgtagccagctgctc

SEQ ID NO: 6887935 - DNA, 22 bp, Homo sapiens
ttcaggaacctcgagtactgtg

SEQ ID NO: 6887936 - DNA, 16 bp, Homo sapiens
atactgctatatttaa

SEQ ID NO: 6887937 - DNA, 15 bp, Homo sapiens
ggtggaagtgcccag

SEQ ID NO: 6887938 - DNA, 11 bp, Homo sapiens
caggcctgtgc

SEQ ID NO: 6887939 - DNA, 18 bp, Homo sapiens
tgcgaatccaagctccct

SEQ ID NO: 6887940 - DNA, 17 bp, Homo sapiens
ttcagcggcagtgtgtc

SEQ ID NO: 6887941 - DNA, 14 bp, Homo sapiens
ctacctctctgtcc

SEQ ID NO: 6887942 - DNA, 18 bp, Homo sapiens
tacccaatgtctcccaca

SEQ ID NO: 6887943 - DNA, 21 bp, Homo sapiens
agatctgaacccagctgtgcc

SEQ ID NO: 6887944 - DNA, 15 bp, Homo sapiens
cgtaagaacatgtta

SEQ ID NO: 6887945 - DNA, 19 bp, Homo sapiens
tctgtccgcgtcctttcct

SEQ ID NO: 6887946 - DNA, 21 bp, Homo sapiens
tcccatgacccacccctgtgc

SEQ ID NO: 6887947 - DNA, 23 bp, Homo sapiens
atggcacaggcccgccctctgcc

SEQ ID NO: 6887948 - DNA, 20 bp, Homo sapiens
agttccctgaaaacccagag

SEQ ID NO: 6887949 - DNA, 20 bp, Homo sapiens
acagatcctttttccatcat

SEQ ID NO: 6887950 - DNA, 15 bp, Homo sapiens
agtcctctgcctcca

SEQ ID NO: 6887951 - DNA, 14 bp, Homo sapiens
caccaccccttgcc

SEQ ID NO: 6887952 - DNA, 19 bp, Homo sapiens
cactaacgacttcagggca

SEQ ID NO: 6887953 - DNA, 21 bp, Homo sapiens
ccaaggccctgcatctgtctg

SEQ ID NO: 6887954 - DNA, 21 bp, Homo sapiens
ctttcccttgtagctcctccc

SEQ ID NO: 6887955 - DNA, 21 bp, Homo sapiens
ccagtgcaaaccacttctcca

SEQ ID NO: 6887956 - DNA, 21 bp, Homo sapiens
acatttgtgatatatgtatta

SEQ ID NO: 6887957 - DNA, 12 bp, Homo sapiens
taaacaatgaat

SEQ ID NO: 6887958 - DNA, 14 bp, Homo sapiens
ccttccccactccc

SEQ ID NO: 6887959 - DNA, 20 bp, Homo sapiens
gtgtacagaaacaactgcca

SEQ ID NO: 6887960 - DNA, 15 bp, Homo sapiens
aatggaattactcca

SEQ ID NO: 6887961 - DNA, 12 bp, Homo sapiens
ccagcccctgca

SEQ ID NO: 6887962 - DNA, 12 bp, Homo sapiens
cttgcccttccc

SEQ ID NO: 6887963 - DNA, 15 bp, Homo sapiens
cactctgcctctgcc

SEQ ID NO: 6887964 - DNA, 16 bp, Homo sapiens
acccagagaatatata

SEQ ID NO: 6887965 - DNA, 22 bp, Homo sapiens
attctgcctgcctcctccctcc

SEQ ID NO: 6887966 - DNA, 14 bp, Homo sapiens
tgaggcctgtctgt

SEQ ID NO: 6887967 - DNA, 13 bp, Homo sapiens
tataaactgtatt

SEQ ID NO: 6887968 - DNA, 19 bp, Homo sapiens
tccctctgacctgcaggcc

SEQ ID NO: 6887969 - DNA, 22 bp, Homo sapiens
atgacaccatcttttattcttt

SEQ ID NO: 6887970 - DNA, 13 bp, Homo sapiens
catctctgtccca

SEQ ID NO: 6887971 - DNA, 16 bp, Homo sapiens
ttgtccacaaatgtcc

SEQ ID NO: 6887972 - DNA, 17 bp, Homo sapiens
caccttgcactcctcac

SEQ ID NO: 6887973 - DNA, 14 bp, Homo sapiens
atttttttctgcac

SEQ ID NO: 6887974 - DNA, 18 bp, Homo sapiens
tcagttatctgtttgtta

SEQ ID NO: 6887975 - DNA, 14 bp, Homo sapiens
agcctgcctctgcc

SEQ ID NO: 6887976 - DNA, 22 bp, Homo sapiens
gagaggaaggagattccacaca

SEQ ID NO: 6887977 - DNA, 17 bp, Homo sapiens
catttctgatcagaggt

SEQ ID NO: 6887978 - DNA, 18 bp, Homo sapiens
ccagtgcaacagcactgg

SEQ ID NO: 6887979 - DNA, 19 bp, Homo sapiens
ttgagttttcttctgtgat

SEQ ID NO: 6887980 - DNA, 12 bp, Homo sapiens
ctccctgcctca

SEQ ID NO: 6887981 - DNA, 13 bp, Homo sapiens
cttccctggtcac

SEQ ID NO: 6887982 - DNA, 22 bp, Homo sapiens
ggtctccagaaagccccaccca

SEQ ID NO: 6887983 - DNA, 14 bp, Homo sapiens
ccgctcctgcttcc

SEQ ID NO: 6887984 - DNA, 18 bp, Homo sapiens
ctattaaaagactcatcc

SEQ ID NO: 6887985 - DNA, 14 bp, Homo sapiens
accactaccagcca

SEQ ID NO: 6887986 - DNA, 15 bp, Homo sapiens
tagcatttgccactt

SEQ ID NO: 6887987 - DNA, 11 bp, Homo sapiens
gctctctgtct

SEQ ID NO: 6887988 - DNA, 18 bp, Homo sapiens
cacctgtcttggcctccc

SEQ ID NO: 6887989 - DNA, 15 bp, Homo sapiens
tcacttcatcttctc

SEQ ID NO: 6887990 - DNA, 13 bp, Homo sapiens
cagtcccccacca

SEQ ID NO: 6887991 - DNA, 20 bp, Homo sapiens
cacagggcatgccccggcca

SEQ ID NO: 6887992 - DNA, 12 bp, Homo sapiens
gccctgggctcc

SEQ ID NO: 6887993 - DNA, 15 bp, Homo sapiens
gaacagcctgagccg

SEQ ID NO: 6887994 - DNA, 16 bp, Homo sapiens
tatacagattcctgtt

SEQ ID NO: 6887995 - DNA, 19 bp, Homo sapiens
tgattcctaaaactctgcc

SEQ ID NO: 6887996 - DNA, 17 bp, Homo sapiens
ctactgtctccttccca

SEQ ID NO: 6887997 - DNA, 20 bp, Homo sapiens
ttcaatacttacatatctga

SEQ ID NO: 6887998 - DNA, 15 bp, Homo sapiens
tgaacatctgtgtgt

SEQ ID NO: 6887999 - DNA, 16 bp, Homo sapiens
catcttccctttcctc

SEQ ID NO: 6888000 - DNA, 16 bp, Homo sapiens
tgaaatgactgtctaa

SEQ ID NO: 6888001 - DNA, 14 bp, Homo sapiens
acatgtgacattta

SEQ ID NO: 6888002 - DNA, 19 bp, Homo sapiens
tttggtccccagcattgca

SEQ ID NO: 6888003 - DNA, 20 bp, Homo sapiens
ttggaaaaacaattcctgta

SEQ ID NO: 6888004 - DNA, 14 bp, Homo sapiens
gccccaggaccaag

SEQ ID NO: 6888005 - DNA, 15 bp, Homo sapiens
ctcaatatgcttaca

SEQ ID NO: 6888006 - DNA, 15 bp, Homo sapiens
gctgtaacctgctgg

SEQ ID NO: 6888007 - DNA, 13 bp, Homo sapiens
caggtcctttcct

SEQ ID NO: 6888008 - DNA, 22 bp, Homo sapiens
atagtgtgaaatatattactta

SEQ ID NO: 6888009 - DNA, 16 bp, Homo sapiens
cccttctactgcttct

SEQ ID NO: 6888010 - DNA, 14 bp, Homo sapiens
ctctcctccctcct

SEQ ID NO: 6888011 - DNA, 13 bp, Homo sapiens
catgtgtgcatgt

SEQ ID NO: 6888012 - DNA, 19 bp, Homo sapiens
cccttgccttcccctgtct

SEQ ID NO: 6888013 - DNA, 20 bp, Homo sapiens
agctactctgtccaggccac

SEQ ID NO: 6888014 - DNA, 14 bp, Homo sapiens
cagaataaagcaat

SEQ ID NO: 6888015 - DNA, 23 bp, Homo sapiens
ccttgtataaggagctttgctct

SEQ ID NO: 6888016 - DNA, 13 bp, Homo sapiens
cacacacagacac

SEQ ID NO: 6888017 - DNA, 21 bp, Homo sapiens
ccagaaacacccctctgtcta

SEQ ID NO: 6888018 - DNA, 17 bp, Homo sapiens
agtaatattacatttca

SEQ ID NO: 6888019 - DNA, 16 bp, Homo sapiens
agatggtactgctgag

SEQ ID NO: 6888020 - DNA, 14 bp, Homo sapiens
cgggggctgcttct

SEQ ID NO: 6888021 - DNA, 20 bp, Homo sapiens
tgtattgtgtcttttgcatg

SEQ ID NO: 6888022 - DNA, 14 bp, Homo sapiens
gtcagtagactgtg

SEQ ID NO: 6888023 - DNA, 16 bp, Homo sapiens
tacagagcagctcccc

SEQ ID NO: 6888024 - DNA, 12 bp, Homo sapiens
tttgacatttca

SEQ ID NO: 6888025 - DNA, 18 bp, Homo sapiens
aagatggaagtgtattgg

SEQ ID NO: 6888026 - DNA, 15 bp, Homo sapiens
cccccactcccgcct

SEQ ID NO: 6888027 - DNA, 16 bp, Homo sapiens
cagtgaagatgtgtaa

SEQ ID NO: 6888028 - DNA, 12 bp, Homo sapiens
ttaactctgtct

SEQ ID NO: 6888029 - DNA, 19 bp, Homo sapiens
atattgctaaaagcatgta

SEQ ID NO: 6888030 - DNA, 14 bp, Homo sapiens
ccatgcctgctctc

SEQ ID NO: 6888031 - DNA, 20 bp, Homo sapiens
ttaagagaacaagcaaatat

SEQ ID NO: 6888032 - DNA, 15 bp, Homo sapiens
cctccctccctccct

SEQ ID NO: 6888033 - DNA, 15 bp, Homo sapiens
ccagccacccagcca

SEQ ID NO: 6888034 - DNA, 14 bp, Homo sapiens
cacttgacattcct

SEQ ID NO: 6888035 - DNA, 20 bp, Homo sapiens
ccatggctaagaccacagac

SEQ ID NO: 6888036 - DNA, 20 bp, Homo sapiens
cttcattccagcagctgcac

SEQ ID NO: 6888037 - DNA, 15 bp, Homo sapiens
gcatcccctgcctcc

SEQ ID NO: 6888038 - DNA, 22 bp, Homo sapiens
agtactgtattggctctgtgaa

SEQ ID NO: 6888039 - DNA, 16 bp, Homo sapiens
ctctcctttctttcta

SEQ ID NO: 6888040 - DNA, 18 bp, Homo sapiens
ataacataaatctgtgaa

SEQ ID NO: 6888041 - DNA, 20 bp, Homo sapiens
aggccaagcagtgcctgcct

SEQ ID NO: 6888042 - DNA, 13 bp, Homo sapiens
tgatatcacctct

SEQ ID NO: 6888043 - DNA, 12 bp, Homo sapiens
tcagtatttatg

SEQ ID NO: 6888044 - DNA, 16 bp, Homo sapiens
agcttctgtcctgccc

SEQ ID NO: 6888045 - DNA, 12 bp, Homo sapiens
agagcctgctgg

SEQ ID NO: 6888046 - DNA, 20 bp, Homo sapiens
gttgctgattttattcttga

SEQ ID NO: 6888047 - DNA, 20 bp, Homo sapiens
caagtgttttagatgttact

SEQ ID NO: 6888048 - DNA, 14 bp, Homo sapiens
tatttctgttgtca

SEQ ID NO: 6888049 - DNA, 19 bp, Homo sapiens
ccatccgactgcccctgct

SEQ ID NO: 6888050 - DNA, 14 bp, Homo sapiens
accctcctgctgag

SEQ ID NO: 6888051 - DNA, 21 bp, Homo sapiens
aaaatctatatttgtcttccg

SEQ ID NO: 6888052 - DNA, 16 bp, Homo sapiens
ttccatcatcactgta

SEQ ID NO: 6888053 - DNA, 16 bp, Homo sapiens
atgccagtaactgtgc

SEQ ID NO: 6888054 - DNA, 19 bp, Homo sapiens
cttttatgtgaaacatgtt

SEQ ID NO: 6888055 - DNA, 14 bp, Homo sapiens
gccgccccacccag

SEQ ID NO: 6888056 - DNA, 22 bp, Homo sapiens
gtgccttccaccctgccctggc

SEQ ID NO: 6888057 - DNA, 17 bp, Homo sapiens
acgtttcttctttctag

SEQ ID NO: 6888058 - DNA, 22 bp, Homo sapiens
agatgggcaaaccctggtgctt

SEQ ID NO: 6888059 - DNA, 17 bp, Homo sapiens
cagtattctgacatgta

SEQ ID NO: 6888060 - DNA, 20 bp, Homo sapiens
tctgggcccggccatgtcct

SEQ ID NO: 6888061 - DNA, 12 bp, Homo sapiens
gacactgagcca

SEQ ID NO: 6888062 - DNA, 14 bp, Homo sapiens
aagtattaagcata

SEQ ID NO: 6888063 - DNA, 22 bp, Homo sapiens
taacctgcaagttgctctgacc

SEQ ID NO: 6888064 - DNA, 21 bp, Homo sapiens
cttgtttgagtttttcctccc

SEQ ID NO: 6888065 - DNA, 22 bp, Homo sapiens
ttcagaaatgctgcctgcctgt

SEQ ID NO: 6888066 - DNA, 22 bp, Homo sapiens
cctggctgaggttcctctgcct

SEQ ID NO: 6888067 - DNA, 13 bp, Homo sapiens
tggtgctgtgtgc

SEQ ID NO: 6888068 - DNA, 16 bp, Homo sapiens
aattctagtgctgctg

SEQ ID NO: 6888069 - DNA, 14 bp, Homo sapiens
tcaagcctgcctca

SEQ ID NO: 6888070 - DNA, 21 bp, Homo sapiens
tcatggtgcaatttgtctttg

SEQ ID NO: 6888071 - DNA, 19 bp, Homo sapiens
ctccccgccaaccctgcct

SEQ ID NO: 6888072 - DNA, 19 bp, Homo sapiens
cccttctgggtccagggag

SEQ ID NO: 6888073 - DNA, 17 bp, Homo sapiens
tagtttttaacaatcta

SEQ ID NO: 6888074 - DNA, 21 bp, Homo sapiens
ctcgagatcccaacactgcca

SEQ ID NO: 6888075 - DNA, 14 bp, Homo sapiens
caccctcgctgcca

SEQ ID NO: 6888076 - DNA, 14 bp, Homo sapiens
actgcactctagcc

SEQ ID NO: 6888077 - DNA, 20 bp, Homo sapiens
catcccgcttagcctgcctc

SEQ ID NO: 6888078 - DNA, 18 bp, Homo sapiens
agaagcccgatccacatt

SEQ ID NO: 6888079 - DNA, 16 bp, Homo sapiens
gatgattcaagccatt

SEQ ID NO: 6888080 - DNA, 14 bp, Homo sapiens
caaactgcacatct

SEQ ID NO: 6888081 - DNA, 18 bp, Homo sapiens
ccatgaatgtatcaggaa

SEQ ID NO: 6888082 - DNA, 15 bp, Homo sapiens
agctctccaggccag

SEQ ID NO: 6888083 - DNA, 17 bp, Homo sapiens
aaaacaaaaaatgtgct

SEQ ID NO: 6888084 - DNA, 22 bp, Homo sapiens
agaagtttgggctaacatttag

SEQ ID NO: 6888085 - DNA, 18 bp, Homo sapiens
gcttctgttgctgcctca

SEQ ID NO: 6888086 - DNA, 12 bp, Homo sapiens
agtgcctctgca

SEQ ID NO: 6888087 - DNA, 17 bp, Homo sapiens
gtaatgtatcttattta

SEQ ID NO: 6888088 - DNA, 12 bp, Homo sapiens
cgcatatgcatg

SEQ ID NO: 6888089 - DNA, 23 bp, Homo sapiens
ctgtagtcccagctactcaggag

SEQ ID NO: 6888090 - DNA, 18 bp, Homo sapiens
cagttcccagctcccccc

SEQ ID NO: 6888091 - DNA, 20 bp, Homo sapiens
ctctgcatgctcctctgcct

SEQ ID NO: 6888092 - DNA, 22 bp, Homo sapiens
ttcagaagttaacatcaagcca

SEQ ID NO: 6888093 - DNA, 12 bp, Homo sapiens
ccagagctcctc

SEQ ID NO: 6888094 - DNA, 18 bp, Homo sapiens
gaggggccaggcccaggc

SEQ ID NO: 6888095 - DNA, 24 bp, Homo sapiens
acatctcatcatgtctattgtcca

SEQ ID NO: 6888096 - DNA, 18 bp, Homo sapiens
actgtcctgttttcttag

SEQ ID NO: 6888097 - DNA, 13 bp, Homo sapiens
gcagtcctggagg

SEQ ID NO: 6888098 - DNA, 13 bp, Homo sapiens
atctagaagatgc

SEQ ID NO: 6888099 - DNA, 15 bp, Homo sapiens
ccagcaacacagcct

SEQ ID NO: 6888100 - DNA, 13 bp, Homo sapiens
acctgtccctcca

SEQ ID NO: 6888101 - DNA, 19 bp, Homo sapiens
gcgctcagacggcggccag

SEQ ID NO: 6888102 - DNA, 13 bp, Homo sapiens
cccttccccttca

SEQ ID NO: 6888103 - DNA, 13 bp, Homo sapiens
aggtgctctgtgt

SEQ ID NO: 6888104 - DNA, 15 bp, Homo sapiens
agggtgggccctgga

SEQ ID NO: 6888105 - DNA, 20 bp, Homo sapiens
aggccacacgctgcccaggc

SEQ ID NO: 6888106 - DNA, 18 bp, Homo sapiens
tcccagccacgcagggcc

SEQ ID NO: 6888107 - DNA, 20 bp, Homo sapiens
acggctccgagggcggccag

SEQ ID NO: 6888108 - DNA, 21 bp, Homo sapiens
cactgcggagaaccttgtgcc

SEQ ID NO: 6888109 - DNA, 15 bp, Homo sapiens
tatgaaacatatcat

SEQ ID NO: 6888110 - DNA, 20 bp, Homo sapiens
catcattacttgggaaattt

SEQ ID NO: 6888111 - DNA, 21 bp, Homo sapiens
tcgggcagtggaggctgctgt

SEQ ID NO: 6888112 - DNA, 16 bp, Homo sapiens
aatatttgcttattta

SEQ ID NO: 6888113 - DNA, 18 bp, Homo sapiens
ctcgagggccgcctgcct

SEQ ID NO: 6888114 - DNA, 19 bp, Homo sapiens
ggctggatggacagacacc

SEQ ID NO: 6888115 - DNA, 15 bp, Homo sapiens
acaagtaatgtatta

SEQ ID NO: 6888116 - DNA, 15 bp, Homo sapiens
cctcctagcctctcc

SEQ ID NO: 6888117 - DNA, 18 bp, Homo sapiens
caaattctttagtactca

SEQ ID NO: 6888118 - DNA, 19 bp, Homo sapiens
tccttgaagcttgtatctg

SEQ ID NO: 6888119 - DNA, 24 bp, Homo sapiens
caccctacttcattttcagagtga

SEQ ID NO: 6888120 - DNA, 19 bp, Homo sapiens
catttgttcagctccccca

SEQ ID NO: 6888121 - DNA, 12 bp, Homo sapiens
gtgtgccctggg

SEQ ID NO: 6888122 - DNA, 13 bp, Homo sapiens
caaagctcaggaa

SEQ ID NO: 6888123 - DNA, 15 bp, Homo sapiens
ctcttccctccttcc

SEQ ID NO: 6888124 - DNA, 23 bp, Homo sapiens
agcctgccctcactccctctgca

SEQ ID NO: 6888125 - DNA, 20 bp, Homo sapiens
gcttcagggagggttagcct

SEQ ID NO: 6888126 - DNA, 13 bp, Homo sapiens
acctcccctgcca

SEQ ID NO: 6888127 - DNA, 17 bp, Homo sapiens
ccaggcccgccctgccc

SEQ ID NO: 6888128 - DNA, 17 bp, Homo sapiens
ttgaggattagtttaga

SEQ ID NO: 6888129 - DNA, 14 bp, Homo sapiens
cttccacatgtaca

SEQ ID NO: 6888130 - DNA, 14 bp, Homo sapiens
agtgttctgagccc

SEQ ID NO: 6888131 - DNA, 15 bp, Homo sapiens
agctttccctgtgcc

SEQ ID NO: 6888132 - DNA, 23 bp, Homo sapiens
cactcgggtgcgtgtgtttgtat

SEQ ID NO: 6888133 - DNA, 16 bp, Homo sapiens
atttcaaagccctgcc

SEQ ID NO: 6888134 - DNA, 16 bp, Homo sapiens
tggcctatccgctgcc

SEQ ID NO: 6888135 - DNA, 17 bp, Homo sapiens
aaacctcagctagctct

SEQ ID NO: 6888136 - DNA, 13 bp, Homo sapiens
ctctgcttcctca

SEQ ID NO: 6888137 - DNA, 13 bp, Homo sapiens
catccagctcctc

SEQ ID NO: 6888138 - DNA, 18 bp, Homo sapiens
ttgtaaaacttctgctcg

SEQ ID NO: 6888139 - DNA, 14 bp, Homo sapiens
caaaactgcactgt

SEQ ID NO: 6888140 - DNA, 20 bp, Homo sapiens
acagctgggtggcactgcca

SEQ ID NO: 6888141 - DNA, 16 bp, Homo sapiens
acctgcctgttctcca

SEQ ID NO: 6888142 - DNA, 21 bp, Homo sapiens
taagatgagcaaccacattta

SEQ ID NO: 6888143 - DNA, 12 bp, Homo sapiens
ctcaggcctccc

SEQ ID NO: 6888144 - DNA, 16 bp, Homo sapiens
cagatcagaacatgaa

SEQ ID NO: 6888145 - DNA, 20 bp, Homo sapiens
ctttgaacgtgcttctttgt

SEQ ID NO: 6888146 - DNA, 14 bp, Homo sapiens
tatcagctactgta

SEQ ID NO: 6888147 - DNA, 19 bp, Homo sapiens
ttcatctcctgagtatgta

SEQ ID NO: 6888148 - DNA, 17 bp, Homo sapiens
ctgcagtcggcatgcca

SEQ ID NO: 6888149 - DNA, 18 bp, Homo sapiens
tccggaggagcagcctcg

SEQ ID NO: 6888150 - DNA, 21 bp, Homo sapiens
agctgtcctttttcctctcca

SEQ ID NO: 6888151 - DNA, 22 bp, Homo sapiens
aagcagtagaaataatatgcat

SEQ ID NO: 6888152 - DNA, 21 bp, Homo sapiens
aactgaaccaaattgcactga

SEQ ID NO: 6888153 - DNA, 15 bp, Homo sapiens
cagtttgcctctgca

SEQ ID NO: 6888154 - DNA, 13 bp, Homo sapiens
taataatacctca

SEQ ID NO: 6888155 - DNA, 18 bp, Homo sapiens
ggatatgacccacactgc

SEQ ID NO: 6888156 - DNA, 16 bp, Homo sapiens
ctttcccctctctgcc

SEQ ID NO: 6888157 - DNA, 17 bp, Homo sapiens
cagaatgtatctgtgaa

SEQ ID NO: 6888158 - DNA, 18 bp, Homo sapiens
gctgtgatgctgtgtgcc

SEQ ID NO: 6888159 - DNA, 17 bp, Homo sapiens
caaggagttctcttccg

SEQ ID NO: 6888160 - DNA, 16 bp, Homo sapiens
tgctgccccctggctt

SEQ ID NO: 6888161 - DNA, 17 bp, Homo sapiens
cagtgctggatttgatg

SEQ ID NO: 6888162 - DNA, 14 bp, Homo sapiens
ccccaccccttccc

SEQ ID NO: 6888163 - DNA, 22 bp, Homo sapiens
ctaagtgatcctcccacctcag

SEQ ID NO: 6888164 - DNA, 12 bp, Homo sapiens
cctggctgtcca

SEQ ID NO: 6888165 - DNA, 15 bp, Homo sapiens
cttgctgtctctgct

SEQ ID NO: 6888166 - DNA, 15 bp, Homo sapiens
cctgccctctgctct

SEQ ID NO: 6888167 - DNA, 16 bp, Homo sapiens
gaagctgttctctgct

SEQ ID NO: 6888168 - DNA, 16 bp, Homo sapiens
ctctggctctgcctca

SEQ ID NO: 6888169 - DNA, 23 bp, Homo sapiens
ttcctggttttgtacactgctgt

SEQ ID NO: 6888170 - DNA, 20 bp, Homo sapiens
tggccccaggacctggctgc

SEQ ID NO: 6888171 - DNA, 14 bp, Homo sapiens
agctgccctctcct

SEQ ID NO: 6888172 - DNA, 20 bp, Homo sapiens
agtgctgggaccagagccag

SEQ ID NO: 6888173 - DNA, 17 bp, Homo sapiens
ggcccccgccctctgcc

SEQ ID NO: 6888174 - DNA, 14 bp, Homo sapiens
aaggaagacttcat

SEQ ID NO: 6888175 - DNA, 12 bp, Homo sapiens
ccaatctgggaa

SEQ ID NO: 6888176 - DNA, 22 bp, Homo sapiens
cagctgctgccactctgctgcc

SEQ ID NO: 6888177 - DNA, 21 bp, Homo sapiens
cgtgttttgtttggacttcac

SEQ ID NO: 6888178 - DNA, 15 bp, Homo sapiens
acctcatcttcttca

SEQ ID NO: 6888179 - DNA, 15 bp, Homo sapiens
atcttaaacaatgta

SEQ ID NO: 6888180 - DNA, 19 bp, Homo sapiens
aatgtcataaattactgtt

SEQ ID NO: 6888181 - DNA, 22 bp, Homo sapiens
agatcccagaaggacctcctga

SEQ ID NO: 6888182 - DNA, 13 bp, Homo sapiens
caggttgcattgg

SEQ ID NO: 6888183 - DNA, 18 bp, Homo sapiens
ccaaacccagcccctgcg

SEQ ID NO: 6888184 - DNA, 18 bp, Homo sapiens
agccagagagaacaacag

SEQ ID NO: 6888185 - DNA, 20 bp, Homo sapiens
caagaaatggcgtctgctct

SEQ ID NO: 6888186 - DNA, 20 bp, Homo sapiens
gaaattgggtgtgccctggc

SEQ ID NO: 6888187 - DNA, 19 bp, Homo sapiens
gagagcaaaggagaaatct

SEQ ID NO: 6888188 - DNA, 20 bp, Homo sapiens
tgtgtcccagtgtctggccc

SEQ ID NO: 6888189 - DNA, 16 bp, Homo sapiens
ctgcgtccctgctcag

SEQ ID NO: 6888190 - DNA, 15 bp, Homo sapiens
ctcttgcacccgcct

SEQ ID NO: 6888191 - DNA, 15 bp, Homo sapiens
aactgggttcctgca

SEQ ID NO: 6888192 - DNA, 14 bp, Homo sapiens
atcaaaacatatca

SEQ ID NO: 6888193 - DNA, 15 bp, Homo sapiens
agaccactgtctcca

SEQ ID NO: 6888194 - DNA, 19 bp, Homo sapiens
ttaatcatgagcctgttta

SEQ ID NO: 6888195 - DNA, 21 bp, Homo sapiens
gcacctccccgctctccctgt

SEQ ID NO: 6888196 - DNA, 17 bp, Homo sapiens
agctgtcgctgcctcca

SEQ ID NO: 6888197 - DNA, 12 bp, Homo sapiens
gactctgagcca

SEQ ID NO: 6888198 - DNA, 13 bp, Homo sapiens
gccaccctctgca

SEQ ID NO: 6888199 - DNA, 15 bp, Homo sapiens
ctctgtagcaaattt

SEQ ID NO: 6888200 - DNA, 14 bp, Homo sapiens
ctcatagggtgctc

SEQ ID NO: 6888201 - DNA, 12 bp, Homo sapiens
cctgctgtcccc

SEQ ID NO: 6888202 - DNA, 22 bp, Homo sapiens
agctctgttcttcctcagccag

SEQ ID NO: 6888203 - DNA, 21 bp, Homo sapiens
agttactttagatggcaagca

SEQ ID NO: 6888204 - DNA, 13 bp, Homo sapiens
tcccctctctgcc

SEQ ID NO: 6888205 - DNA, 20 bp, Homo sapiens
ctgccaggctgcctcctgcc

SEQ ID NO: 6888206 - DNA, 20 bp, Homo sapiens
ccctgtccctgtccccctcc

SEQ ID NO: 6888207 - DNA, 17 bp, Homo sapiens
ctcagttcccttggcct

SEQ ID NO: 6888208 - DNA, 14 bp, Homo sapiens
agtattttgaagtt

SEQ ID NO: 6888209 - DNA, 16 bp, Homo sapiens
ccagttgatctgctct

SEQ ID NO: 6888210 - DNA, 18 bp, Homo sapiens
atctccatggcttcctcc

SEQ ID NO: 6888211 - DNA, 13 bp, Homo sapiens
aggcttggctcct

SEQ ID NO: 6888212 - DNA, 15 bp, Homo sapiens
cgagactctgtctca

SEQ ID NO: 6888213 - DNA, 16 bp, Homo sapiens
caattttcctgtggaa

SEQ ID NO: 6888214 - DNA, 14 bp, Homo sapiens
tgcaaagtactgta

SEQ ID NO: 6888215 - DNA, 21 bp, Homo sapiens
ggcaggaagtcaggagccagc

SEQ ID NO: 6888216 - DNA, 22 bp, Homo sapiens
agccaccgaagccgcctgtgga

SEQ ID NO: 6888217 - DNA, 17 bp, Homo sapiens
cagcccctcctccctca

SEQ ID NO: 6888218 - DNA, 13 bp, Homo sapiens
catagcacttccc

SEQ ID NO: 6888219 - DNA, 21 bp, Homo sapiens
cttgattctaaaggggacaga

SEQ ID NO: 6888220 - DNA, 15 bp, Homo sapiens
caaattctgtttctt

SEQ ID NO: 6888221 - DNA, 23 bp, Homo sapiens
tgttcgaaatagatatcctctcc

SEQ ID NO: 6888222 - DNA, 19 bp, Homo sapiens
tcaggccgggtgcagtggc

SEQ ID NO: 6888223 - DNA, 15 bp, Homo sapiens
tcctgaagctgctgt

SEQ ID NO: 6888224 - DNA, 17 bp, Homo sapiens
tcatctttgttggctca

SEQ ID NO: 6888225 - DNA, 21 bp, Homo sapiens
gcagattttacaaaagatgta

SEQ ID NO: 6888226 - DNA, 23 bp, Homo sapiens
cctgccctcatggcccctctgac

SEQ ID NO: 6888227 - DNA, 20 bp, Homo sapiens
tgttcagtggtttccctgcc

SEQ ID NO: 6888228 - DNA, 14 bp, Homo sapiens
cctgtgcctgctgg

SEQ ID NO: 6888229 - DNA, 21 bp, Homo sapiens
actgttctgtagattcatgca

SEQ ID NO: 6888230 - DNA, 13 bp, Homo sapiens
ccaggctcttcct

SEQ ID NO: 6888231 - DNA, 19 bp, Homo sapiens
tggccccgggctctggcca

SEQ ID NO: 6888232 - DNA, 21 bp, Homo sapiens
ccctctcgccccatccctgct

SEQ ID NO: 6888233 - DNA, 16 bp, Homo sapiens
tcatcccaactgtctt

SEQ ID NO: 6888234 - DNA, 16 bp, Homo sapiens
agcacccttctgctgt

SEQ ID NO: 6888235 - DNA, 18 bp, Homo sapiens
atgcttctctccttgccc

SEQ ID NO: 6888236 - DNA, 17 bp, Homo sapiens
atgctcaaccactgtgg

SEQ ID NO: 6888237 - DNA, 20 bp, Homo sapiens
caatttaaatgtttactata

SEQ ID NO: 6888238 - DNA, 13 bp, Homo sapiens
ccgctctcttcct

SEQ ID NO: 6888239 - DNA, 16 bp, Homo sapiens
acctcttgctgtctct

SEQ ID NO: 6888240 - DNA, 18 bp, Homo sapiens
cacttgttccagctcttt

SEQ ID NO: 6888241 - DNA, 17 bp, Homo sapiens
cttcctattctcctgcc

SEQ ID NO: 6888242 - DNA, 15 bp, Homo sapiens
cttctttctcttccc

SEQ ID NO: 6888243 - DNA, 16 bp, Homo sapiens
acagaagcttgtatta

SEQ ID NO: 6888244 - DNA, 21 bp, Homo sapiens
gtcttcccgcaaggcctctca

SEQ ID NO: 6888245 - DNA, 19 bp, Homo sapiens
aacctggcaggccctgccc

SEQ ID NO: 6888246 - DNA, 18 bp, Homo sapiens
tggtcacaggactctgcc

SEQ ID NO: 6888247 - DNA, 14 bp, Homo sapiens
ttccaccttggcgc

SEQ ID NO: 6888248 - DNA, 18 bp, Homo sapiens
gagggggcttgaagccaa

SEQ ID NO: 6888249 - DNA, 19 bp, Homo sapiens
acaggcccgccctctgcct

SEQ ID NO: 6888250 - DNA, 16 bp, Homo sapiens
acagtgctctgcctct

SEQ ID NO: 6888251 - DNA, 17 bp, Homo sapiens
ctctccctgcactccct

SEQ ID NO: 6888252 - DNA, 17 bp, Homo sapiens
tgcagaccccttggcca

SEQ ID NO: 6888253 - DNA, 19 bp, Homo sapiens
cagattctttcctgaggct

SEQ ID NO: 6888254 - DNA, 23 bp, Homo sapiens
cttcccttccactgcctctgcct

SEQ ID NO: 6888255 - DNA, 20 bp, Homo sapiens
agccctgcctatcctctgta

SEQ ID NO: 6888256 - DNA, 16 bp, Homo sapiens
actgggggcctctgcc

SEQ ID NO: 6888257 - DNA, 17 bp, Homo sapiens
cccttgtattttgttaa

SEQ ID NO: 6888258 - DNA, 16 bp, Homo sapiens
cacagcatctcagctc

SEQ ID NO: 6888259 - DNA, 22 bp, Homo sapiens
tttccgtaataacacccttcct

SEQ ID NO: 6888260 - DNA, 14 bp, Homo sapiens
cgctggcccagccg

SEQ ID NO: 6888261 - DNA, 18 bp, Homo sapiens
actccttatctctttcca

SEQ ID NO: 6888262 - DNA, 16 bp, Homo sapiens
tacaaattataatgta

SEQ ID NO: 6888263 - DNA, 14 bp, Homo sapiens
caatttgcacaata

SEQ ID NO: 6888264 - DNA, 19 bp, Homo sapiens
cggtcccagtccggtgcct

SEQ ID NO: 6888265 - DNA, 14 bp, Homo sapiens
tcactgcagcctca

SEQ ID NO: 6888266 - DNA, 20 bp, Homo sapiens
taatgaagttattcttgaca

SEQ ID NO: 6888267 - DNA, 18 bp, Homo sapiens
tactgaatttttttgtaa

SEQ ID NO: 6888268 - DNA, 18 bp, Homo sapiens
ttctttttcttcttccct

SEQ ID NO: 6888269 - DNA, 13 bp, Homo sapiens
agctggctgctga

SEQ ID NO: 6888270 - DNA, 20 bp, Homo sapiens
tggctgtgtctaaactgcat

SEQ ID NO: 6888271 - DNA, 16 bp, Homo sapiens
acccttgcccggctgt

SEQ ID NO: 6888272 - DNA, 16 bp, Homo sapiens
agactcagcctctgct

SEQ ID NO: 6888273 - DNA, 13 bp, Homo sapiens
tatcatgaagcct

SEQ ID NO: 6888274 - DNA, 15 bp, Homo sapiens
cccagctcagtgcca

SEQ ID NO: 6888275 - DNA, 13 bp, Homo sapiens
taagtgtacaatt

SEQ ID NO: 6888276 - DNA, 11 bp, Homo sapiens
atttgctgctg

SEQ ID NO: 6888277 - DNA, 22 bp, Homo sapiens
tccttttgtcttctctgtctca

SEQ ID NO: 6888278 - DNA, 13 bp, Homo sapiens
ataactacattaa

SEQ ID NO: 6888279 - DNA, 19 bp, Homo sapiens
ccggcacagggtctgctct

SEQ ID NO: 6888280 - DNA, 12 bp, Homo sapiens
caataaagcact

SEQ ID NO: 6888281 - DNA, 22 bp, Homo sapiens
gagttatcttctttattattcc

SEQ ID NO: 6888282 - DNA, 19 bp, Homo sapiens
caatgtggagtctccctct

SEQ ID NO: 6888283 - DNA, 16 bp, Homo sapiens
aggtctccacccctca

SEQ ID NO: 6888284 - DNA, 17 bp, Homo sapiens
cggtatcctccctgccc

SEQ ID NO: 6888285 - DNA, 18 bp, Homo sapiens
tcacttgctggctgtgaa

SEQ ID NO: 6888286 - DNA, 15 bp, Homo sapiens
caacccatgccctgc

SEQ ID NO: 6888287 - DNA, 21 bp, Homo sapiens
gatgtgcccagagtagcccag

SEQ ID NO: 6888288 - DNA, 17 bp, Homo sapiens
ccctggccctgcctcac

SEQ ID NO: 6888289 - DNA, 19 bp, Homo sapiens
cttctcctgacccagtccc

SEQ ID NO: 6888290 - DNA, 14 bp, Homo sapiens
atgctgccctgtga

SEQ ID NO: 6888291 - DNA, 21 bp, Homo sapiens
tgaatagtttatttctgtgaa

SEQ ID NO: 6888292 - DNA, 17 bp, Homo sapiens
agcactacttacttaga

SEQ ID NO: 6888293 - DNA, 20 bp, Homo sapiens
gcacactttgcactgatata

SEQ ID NO: 6888294 - DNA, 22 bp, Homo sapiens
tgcacgtcaccctcctgagcct

SEQ ID NO: 6888295 - DNA, 19 bp, Homo sapiens
agggagttttgtctgtctc

SEQ ID NO: 6888296 - DNA, 21 bp, Homo sapiens
tgcttcaaggatcctgagcca

SEQ ID NO: 6888297 - DNA, 22 bp, Homo sapiens
ctgaagtcattgtcgctcagca

SEQ ID NO: 6888298 - DNA, 14 bp, Homo sapiens
cgggctgggcagct

SEQ ID NO: 6888299 - DNA, 20 bp, Homo sapiens
ctccctccccagatctgtcc

SEQ ID NO: 6888300 - DNA, 16 bp, Homo sapiens
cagttctgaactggaa

SEQ ID NO: 6888301 - DNA, 14 bp, Homo sapiens
atcaaatactttaa

SEQ ID NO: 6888302 - DNA, 22 bp, Homo sapiens
agctgcctatgcccagcctcca

SEQ ID NO: 6888303 - DNA, 16 bp, Homo sapiens
aatcagtcccctccca

SEQ ID NO: 6888304 - DNA, 22 bp, Homo sapiens
cgtttctttaaccttgtataaa

SEQ ID NO: 6888305 - DNA, 15 bp, Homo sapiens
ctgttatgtactgta

SEQ ID NO: 6888306 - DNA, 12 bp, Homo sapiens
cgacctggctgc

SEQ ID NO: 6888307 - DNA, 21 bp, Homo sapiens
acccttctcctttccttccca

SEQ ID NO: 6888308 - DNA, 17 bp, Homo sapiens
gccattctcctgcctca

SEQ ID NO: 6888309 - DNA, 17 bp, Homo sapiens
ctgtcccttctgtccct

SEQ ID NO: 6888310 - DNA, 15 bp, Homo sapiens
atatggcatttgcag

SEQ ID NO: 6888311 - DNA, 14 bp, Homo sapiens
ttctcctctcccct

SEQ ID NO: 6888312 - DNA, 14 bp, Homo sapiens
tattctcagtgctc

SEQ ID NO: 6888313 - DNA, 22 bp, Homo sapiens
tttctggggaaagacactgcct

SEQ ID NO: 6888314 - DNA, 17 bp, Homo sapiens
cacgcttgcctggtcac

SEQ ID NO: 6888315 - DNA, 19 bp, Homo sapiens
ctttatacgtgtagctata

SEQ ID NO: 6888316 - DNA, 17 bp, Homo sapiens
ctcaggttcctttttca

SEQ ID NO: 6888317 - DNA, 15 bp, Homo sapiens
cagttgccctagccc

SEQ ID NO: 6888318 - DNA, 18 bp, Homo sapiens
gccattagactgaattta

SEQ ID NO: 6888319 - DNA, 17 bp, Homo sapiens
caacccctcctccctca

SEQ ID NO: 6888320 - DNA, 15 bp, Homo sapiens
ctagcctgctctgcc

SEQ ID NO: 6888321 - DNA, 17 bp, Homo sapiens
atctggaaataatatca

SEQ ID NO: 6888322 - DNA, 13 bp, Homo sapiens
cgtatgcatgtga

SEQ ID NO: 6888323 - DNA, 17 bp, Homo sapiens
tgggcctttcctgtgcc

SEQ ID NO: 6888324 - DNA, 23 bp, Homo sapiens
cctgcctggacttggcccctgcc

SEQ ID NO: 6888325 - DNA, 13 bp, Homo sapiens
agcacatacatta

SEQ ID NO: 6888326 - DNA, 11 bp, Homo sapiens
ggaaaaaagca

SEQ ID NO: 6888327 - DNA, 19 bp, Homo sapiens
ttatcttgaaaaagtattg

SEQ ID NO: 6888328 - DNA, 22 bp, Homo sapiens
cagcaaagaggggcgctgtcct

SEQ ID NO: 6888329 - DNA, 23 bp, Homo sapiens
gaggagggacctactgaacccag

SEQ ID NO: 6888330 - DNA, 15 bp, Homo sapiens
gcctgggctcactgt

SEQ ID NO: 6888331 - DNA, 17 bp, Homo sapiens
cgtctgtgctctgtcct

SEQ ID NO: 6888332 - DNA, 23 bp, Homo sapiens
catattagcgacaacagattgga

SEQ ID NO: 6888333 - DNA, 22 bp, Homo sapiens
atcctttcttttaatgatgcca

SEQ ID NO: 6888334 - DNA, 22 bp, Homo sapiens
cctctcgctcctcaacccctcc

SEQ ID NO: 6888335 - DNA, 20 bp, Homo sapiens
agccctgctgctgcctgcct

SEQ ID NO: 6888336 - DNA, 22 bp, Homo sapiens
gccctaaagtgtatttttttac

SEQ ID NO: 6888337 - DNA, 16 bp, Homo sapiens
agttcctgctctctgc

SEQ ID NO: 6888338 - DNA, 19 bp, Homo sapiens
ctccagaattacccttcct

SEQ ID NO: 6888339 - DNA, 11 bp, Homo sapiens
gtttctagcct

SEQ ID NO: 6888340 - DNA, 17 bp, Homo sapiens
caatgtccccctcaccc

SEQ ID NO: 6888341 - DNA, 21 bp, Homo sapiens
tgcttcctgtgtaacatctgc

SEQ ID NO: 6888342 - DNA, 14 bp, Homo sapiens
acttggtctgtgag

SEQ ID NO: 6888343 - DNA, 21 bp, Homo sapiens
tcccgcatgctgcctgcctcc

SEQ ID NO: 6888344 - DNA, 15 bp, Homo sapiens
cctcctaccctccca

SEQ ID NO: 6888345 - DNA, 15 bp, Homo sapiens
cagaagcctgtttca

SEQ ID NO: 6888346 - DNA, 14 bp, Homo sapiens
ctatttctatgtca

SEQ ID NO: 6888347 - DNA, 16 bp, Homo sapiens
agacaacagcccaggc

SEQ ID NO: 6888348 - DNA, 20 bp, Homo sapiens
cctcccagacaggccctccc

SEQ ID NO: 6888349 - DNA, 21 bp, Homo sapiens
ctttgcacccctttcctcccc

SEQ ID NO: 6888350 - DNA, 22 bp, Homo sapiens
ccctgctcctcctgccctgtcc

SEQ ID NO: 6888351 - DNA, 17 bp, Homo sapiens
caataaaccagtgtgaa

SEQ ID NO: 6888352 - DNA, 21 bp, Homo sapiens
tccaggcccccgttgaagccg

SEQ ID NO: 6888353 - DNA, 14 bp, Homo sapiens
tctgacttactgtc

SEQ ID NO: 6888354 - DNA, 16 bp, Homo sapiens
tgaggaaactgagtca

SEQ ID NO: 6888355 - DNA, 21 bp, Homo sapiens
cactacattataaatgtctct

SEQ ID NO: 6888356 - DNA, 13 bp, Homo sapiens
agagccccactct

SEQ ID NO: 6888357 - DNA, 17 bp, Homo sapiens
ccttttcttcccctcct

SEQ ID NO: 6888358 - DNA, 22 bp, Homo sapiens
ccagcggccccccgcacagcca

SEQ ID NO: 6888359 - DNA, 14 bp, Homo sapiens
ctgctgcactgccc

SEQ ID NO: 6888360 - DNA, 21 bp, Homo sapiens
gctgttactgcttctctttgt

SEQ ID NO: 6888361 - DNA, 15 bp, Homo sapiens
gatcatagttttatt

SEQ ID NO: 6888362 - DNA, 17 bp, Homo sapiens
taccaccctcgctgcca

SEQ ID NO: 6888363 - DNA, 18 bp, Homo sapiens
cagctggaagtctacctg

SEQ ID NO: 6888364 - DNA, 14 bp, Homo sapiens
gccttgctgccaag

SEQ ID NO: 6888365 - DNA, 17 bp, Homo sapiens
tctcctgggcagctgcc

SEQ ID NO: 6888366 - DNA, 19 bp, Homo sapiens
atagcccacttacatttac

SEQ ID NO: 6888367 - DNA, 14 bp, Homo sapiens
ttattattactgtt

SEQ ID NO: 6888368 - DNA, 16 bp, Homo sapiens
ccaattaagtgttgaa

SEQ ID NO: 6888369 - DNA, 14 bp, Homo sapiens
cacacttttgcaca

SEQ ID NO: 6888370 - DNA, 15 bp, Homo sapiens
ctctgtgtctgctct

SEQ ID NO: 6888371 - DNA, 23 bp, Homo sapiens
aactgccaaataaaatgtttaca

SEQ ID NO: 6888372 - DNA, 20 bp, Homo sapiens
ctctgccgctacctccctcc

SEQ ID NO: 6888373 - DNA, 13 bp, Homo sapiens
ccacttctctcca

SEQ ID NO: 6888374 - DNA, 18 bp, Homo sapiens
ataactttattgcatata

SEQ ID NO: 6888375 - DNA, 19 bp, Homo sapiens
ctgtgatctctgctgggga

SEQ ID NO: 6888376 - DNA, 23 bp, Homo sapiens
cagagctctttgatcgcttttaa

SEQ ID NO: 6888377 - DNA, 23 bp, Homo sapiens
catattgctgagagaaatatgga

SEQ ID NO: 6888378 - DNA, 22 bp, Homo sapiens
cccgccggcaggggcccctcct

SEQ ID NO: 6888379 - DNA, 13 bp, Homo sapiens
aactgactttatc

SEQ ID NO: 6888380 - DNA, 18 bp, Homo sapiens
cttcctttctttctctct

SEQ ID NO: 6888381 - DNA, 19 bp, Homo sapiens
ctctgacgcaccactgcca

SEQ ID NO: 6888382 - DNA, 20 bp, Homo sapiens
tagtcaactgctgttttatg

SEQ ID NO: 6888383 - DNA, 16 bp, Homo sapiens
ccctgggaactctcct

SEQ ID NO: 6888384 - DNA, 14 bp, Homo sapiens
ccccgccctctgcg

SEQ ID NO: 6888385 - DNA, 16 bp, Homo sapiens
cctgcctcccctgcct

SEQ ID NO: 6888386 - DNA, 21 bp, Homo sapiens
tatacagttgtataaactgta

SEQ ID NO: 6888387 - DNA, 20 bp, Homo sapiens
cattgtccagagctgcttcc

SEQ ID NO: 6888388 - DNA, 20 bp, Homo sapiens
ctgccaggcaccatctgcca

SEQ ID NO: 6888389 - DNA, 13 bp, Homo sapiens
agccaccctgcca

SEQ ID NO: 6888390 - DNA, 17 bp, Homo sapiens
ctcactgaaaacatctg

SEQ ID NO: 6888391 - DNA, 15 bp, Homo sapiens
tcagctgctcccaca

SEQ ID NO: 6888392 - DNA, 19 bp, Homo sapiens
ccttgtaaattccccttcc

SEQ ID NO: 6888393 - DNA, 14 bp, Homo sapiens
caattcccctctgc

SEQ ID NO: 6888394 - DNA, 20 bp, Homo sapiens
cacctgccctgccctgccac

SEQ ID NO: 6888395 - DNA, 18 bp, Homo sapiens
actgccagtccccctgcc

SEQ ID NO: 6888396 - DNA, 22 bp, Homo sapiens
tggaattttcaaaaattgtgtt

SEQ ID NO: 6888397 - DNA, 12 bp, Homo sapiens
cccggctttcct

SEQ ID NO: 6888398 - DNA, 19 bp, Homo sapiens
gactcctacctgccctgga

SEQ ID NO: 6888399 - DNA, 20 bp, Homo sapiens
agccccgggcctgcctctga

SEQ ID NO: 6888400 - DNA, 13 bp, Homo sapiens
ccggaagctcctg

SEQ ID NO: 6888401 - DNA, 18 bp, Homo sapiens
tactgtaataatacctca

SEQ ID NO: 6888402 - DNA, 17 bp, Homo sapiens
aaccaccgcatatgcat

SEQ ID NO: 6888403 - DNA, 14 bp, Homo sapiens
aattcacctcagcc

SEQ ID NO: 6888404 - DNA, 14 bp, Homo sapiens
acccttaactgaca

SEQ ID NO: 6888405 - DNA, 21 bp, Homo sapiens
cccttcctccgctcccctttc

SEQ ID NO: 6888406 - DNA, 17 bp, Homo sapiens
actcttaagtttctcag

SEQ ID NO: 6888407 - DNA, 12 bp, Homo sapiens
ttgcagctgtca

SEQ ID NO: 6888408 - DNA, 14 bp, Homo sapiens
ctaactaattctgt

SEQ ID NO: 6888409 - DNA, 13 bp, Homo sapiens
tgcttccctctgc

SEQ ID NO: 6888410 - DNA, 21 bp, Homo sapiens
atattctatacacaccctgcc

SEQ ID NO: 6888411 - DNA, 15 bp, Homo sapiens
taagtaaacagattt

SEQ ID NO: 6888412 - DNA, 14 bp, Homo sapiens
aggcaggattgaaa

SEQ ID NO: 6888413 - DNA, 18 bp, Homo sapiens
ctttctagtggtctttgt

SEQ ID NO: 6888414 - DNA, 18 bp, Homo sapiens
cagtgccgccgcctcgcc

SEQ ID NO: 6888415 - DNA, 19 bp, Homo sapiens
gtaatagagcaaaattgat

SEQ ID NO: 6888416 - DNA, 17 bp, Homo sapiens
cctctcttccccttccc

SEQ ID NO: 6888417 - DNA, 13 bp, Homo sapiens
ctgagcttggccc

SEQ ID NO: 6888418 - DNA, 19 bp, Homo sapiens
caccagcgcccccactcct

SEQ ID NO: 6888419 - DNA, 12 bp, Homo sapiens
caccccactcta

SEQ ID NO: 6888420 - DNA, 18 bp, Homo sapiens
tttctgtatatttgtcat

SEQ ID NO: 6888421 - DNA, 22 bp, Homo sapiens
ttgcagatgggtgatatataat

SEQ ID NO: 6888422 - DNA, 16 bp, Homo sapiens
tgctgaggctctgacc

SEQ ID NO: 6888423 - DNA, 19 bp, Homo sapiens
agcttcaggatactgtagt

SEQ ID NO: 6888424 - DNA, 13 bp, Homo sapiens
cctggcctgctgg

SEQ ID NO: 6888425 - DNA, 16 bp, Homo sapiens
gtgtttggtttcttca

SEQ ID NO: 6888426 - DNA, 12 bp, Homo sapiens
gatatcacctct

SEQ ID NO: 6888427 - DNA, 12 bp, Homo sapiens
cttccccatccc

SEQ ID NO: 6888428 - DNA, 20 bp, Homo sapiens
tgggaaatatttagcaaata

SEQ ID NO: 6888429 - DNA, 19 bp, Homo sapiens
gacgtaagctctatctgca

SEQ ID NO: 6888430 - DNA, 13 bp, Homo sapiens
cagactctctcct

SEQ ID NO: 6888431 - DNA, 16 bp, Homo sapiens
agcctgagcctctgct

SEQ ID NO: 6888432 - DNA, 17 bp, Homo sapiens
cctggcctcccctgcca

SEQ ID NO: 6888433 - DNA, 14 bp, Homo sapiens
cacgaaacttgtta

SEQ ID NO: 6888434 - DNA, 21 bp, Homo sapiens
caaaaatgcatcaagtctcca

SEQ ID NO: 6888435 - DNA, 18 bp, Homo sapiens
ctgttcccttcctcaccc

SEQ ID NO: 6888436 - DNA, 16 bp, Homo sapiens
cccgtcggccctgcgt

SEQ ID NO: 6888437 - DNA, 20 bp, Homo sapiens
cctcctagaaaacccttccc

SEQ ID NO: 6888438 - DNA, 22 bp, Homo sapiens
caagtcaacactcttcttgagc

SEQ ID NO: 6888439 - DNA, 23 bp, Homo sapiens
ctgggcatgaggggttcctcccc

SEQ ID NO: 6888440 - DNA, 15 bp, Homo sapiens
acaaaccactgtgaa

SEQ ID NO: 6888441 - DNA, 18 bp, Homo sapiens
cacacttgagaggatgaa

SEQ ID NO: 6888442 - DNA, 18 bp, Homo sapiens
tccccaacacctgcctct

SEQ ID NO: 6888443 - DNA, 18 bp, Homo sapiens
cgccggagtccactccca

SEQ ID NO: 6888444 - DNA, 16 bp, Homo sapiens
gcccctccctacctca

SEQ ID NO: 6888445 - DNA, 14 bp, Homo sapiens
ccttcctctgtgcc

SEQ ID NO: 6888446 - DNA, 23 bp, Homo sapiens
ggatatgttatactgaaccaggc

SEQ ID NO: 6888447 - DNA, 15 bp, Homo sapiens
ctccacactgctgct

SEQ ID NO: 6888448 - DNA, 14 bp, Homo sapiens
gcttgtgatttcca

SEQ ID NO: 6888449 - DNA, 18 bp, Homo sapiens
ccttttactggttgcatg

SEQ ID NO: 6888450 - DNA, 15 bp, Homo sapiens
acacactcaccattt

SEQ ID NO: 6888451 - DNA, 18 bp, Homo sapiens
tggtcctaagtccctgcc

SEQ ID NO: 6888452 - DNA, 20 bp, Homo sapiens
cctgcaatgcgtcttgtgaa

SEQ ID NO: 6888453 - DNA, 17 bp, Homo sapiens
tgtgaactgggcacaga

SEQ ID NO: 6888454 - DNA, 14 bp, Homo sapiens
caggtgacatgtga

SEQ ID NO: 6888455 - DNA, 16 bp, Homo sapiens
acaggtgcctgaacta

SEQ ID NO: 6888456 - DNA, 17 bp, Homo sapiens
cagagtatatatgtaca

SEQ ID NO: 6888457 - DNA, 20 bp, Homo sapiens
caagacctcatctgcctgca

SEQ ID NO: 6888458 - DNA, 18 bp, Homo sapiens
tgactatttttgttttta

SEQ ID NO: 6888459 - DNA, 19 bp, Homo sapiens
cagtattgagacactgtca

SEQ ID NO: 6888460 - DNA, 17 bp, Homo sapiens
ctgtgtccaactccagt

SEQ ID NO: 6888461 - DNA, 14 bp, Homo sapiens
cacgcttctggagg

SEQ ID NO: 6888462 - DNA, 22 bp, Homo sapiens
tgcctgggttttctaactgtaa

SEQ ID NO: 6888463 - DNA, 14 bp, Homo sapiens
cttggcctcctgct

SEQ ID NO: 6888464 - DNA, 14 bp, Homo sapiens
agccttgctgtaga

SEQ ID NO: 6888465 - DNA, 12 bp, Homo sapiens
tccccagcctct

SEQ ID NO: 6888466 - DNA, 17 bp, Homo sapiens
cctttgctgaccctccc

SEQ ID NO: 6888467 - DNA, 19 bp, Homo sapiens
atgctttatttgtaaattt

SEQ ID NO: 6888468 - DNA, 18 bp, Homo sapiens
tgccagctggtgaatcca

SEQ ID NO: 6888469 - DNA, 16 bp, Homo sapiens
taaagaaaagatgaaa

SEQ ID NO: 6888470 - DNA, 14 bp, Homo sapiens
gctgtgcctctgcc

SEQ ID NO: 6888471 - DNA, 21 bp, Homo sapiens
tggccctttcacccctcttcc

SEQ ID NO: 6888472 - DNA, 21 bp, Homo sapiens
caaccttctgccctcctgcca

SEQ ID NO: 6888473 - DNA, 14 bp, Homo sapiens
cccaccgccctcct

SEQ ID NO: 6888474 - DNA, 18 bp, Homo sapiens
gcctcttttacctgctgc

SEQ ID NO: 6888475 - DNA, 15 bp, Homo sapiens
atcaataaaatgtga

SEQ ID NO: 6888476 - DNA, 17 bp, Homo sapiens
aacccaagtccctgtca

SEQ ID NO: 6888477 - DNA, 14 bp, Homo sapiens
ctccagctcctgcc

SEQ ID NO: 6888478 - DNA, 20 bp, Homo sapiens
cgccagcgacctctctgcct

SEQ ID NO: 6888479 - DNA, 20 bp, Homo sapiens
ggactggttctgaggccaga

SEQ ID NO: 6888480 - DNA, 16 bp, Homo sapiens
acctgctcctgcccac

SEQ ID NO: 6888481 - DNA, 16 bp, Homo sapiens
gtcttccaggcactca

SEQ ID NO: 6888482 - DNA, 16 bp, Homo sapiens
cattccagccaggccc

SEQ ID NO: 6888483 - DNA, 18 bp, Homo sapiens
acacacagtcacattcga

SEQ ID NO: 6888484 - DNA, 19 bp, Homo sapiens
cttgcacagtcactgctct

SEQ ID NO: 6888485 - DNA, 17 bp, Homo sapiens
cagattgctctgcccca

SEQ ID NO: 6888486 - DNA, 18 bp, Homo sapiens
acaacatgaaactgccta

SEQ ID NO: 6888487 - DNA, 14 bp, Homo sapiens
ccctccctacctca

SEQ ID NO: 6888488 - DNA, 16 bp, Homo sapiens
ccatgtcttctgctgt

SEQ ID NO: 6888489 - DNA, 21 bp, Homo sapiens
tttgtctgtacatactggcct

SEQ ID NO: 6888490 - DNA, 15 bp, Homo sapiens
ttccttccctgctgt

SEQ ID NO: 6888491 - DNA, 14 bp, Homo sapiens
cctcctgttctgaa

SEQ ID NO: 6888492 - DNA, 22 bp, Homo sapiens
ctggaagatcccctctcctgcc

SEQ ID NO: 6888493 - DNA, 18 bp, Homo sapiens
cagggaagctacaggtta

SEQ ID NO: 6888494 - DNA, 17 bp, Homo sapiens
tcacccaggcctatgtt

SEQ ID NO: 6888495 - DNA, 12 bp, Homo sapiens
cttgagcatgcc

SEQ ID NO: 6888496 - DNA, 21 bp, Homo sapiens
taaacttcctattttcttgag

SEQ ID NO: 6888497 - DNA, 17 bp, Homo sapiens
cagaactctgcctgccc

SEQ ID NO: 6888498 - DNA, 12 bp, Homo sapiens
ataaaacattaa

SEQ ID NO: 6888499 - DNA, 16 bp, Homo sapiens
tactttgtatgatatt

SEQ ID NO: 6888500 - DNA, 13 bp, Homo sapiens
taaacattgtgat

SEQ ID NO: 6888501 - DNA, 21 bp, Homo sapiens
gagttcgtaccgcttccttag

SEQ ID NO: 6888502 - DNA, 14 bp, Homo sapiens
ccctccccctgccc

SEQ ID NO: 6888503 - DNA, 17 bp, Homo sapiens
ggaaactgaggcccaga

SEQ ID NO: 6888504 - DNA, 16 bp, Homo sapiens
ctgtcttcctctgcaa

SEQ ID NO: 6888505 - DNA, 16 bp, Homo sapiens
atatctatatatgtat

SEQ ID NO: 6888506 - DNA, 18 bp, Homo sapiens
tcctggctgggccatcct

SEQ ID NO: 6888507 - DNA, 17 bp, Homo sapiens
ccctgtgctccgtgcct

SEQ ID NO: 6888508 - DNA, 22 bp, Homo sapiens
tctggctggtcttcactttcct

SEQ ID NO: 6888509 - DNA, 12 bp, Homo sapiens
cacctgcacatt

SEQ ID NO: 6888510 - DNA, 18 bp, Homo sapiens
cctatctccttcccaccc

SEQ ID NO: 6888511 - DNA, 15 bp, Homo sapiens
gacctgaactctgca

SEQ ID NO: 6888512 - DNA, 16 bp, Homo sapiens
ctcagcaccactcaag

SEQ ID NO: 6888513 - DNA, 19 bp, Homo sapiens
cactcagcagccccctgcc

SEQ ID NO: 6888514 - DNA, 15 bp, Homo sapiens
catgagctgcactga

SEQ ID NO: 6888515 - DNA, 23 bp, Homo sapiens
caaaatatttctcatctgcacta

SEQ ID NO: 6888516 - DNA, 17 bp, Homo sapiens
accaccctgcctgtgga

SEQ ID NO: 6888517 - DNA, 12 bp, Homo sapiens
caaagtactgta

SEQ ID NO: 6888518 - DNA, 19 bp, Homo sapiens
tactgcttggagctgagca

SEQ ID NO: 6888519 - DNA, 23 bp, Homo sapiens
caggccgacaggaggccatgccc

SEQ ID NO: 6888520 - DNA, 15 bp, Homo sapiens
ccgtggccccagcct

SEQ ID NO: 6888521 - DNA, 18 bp, Homo sapiens
agagattcttagctcttg

SEQ ID NO: 6888522 - DNA, 21 bp, Homo sapiens
actggttcagaaatagctcct

SEQ ID NO: 6888523 - DNA, 20 bp, Homo sapiens
ctattctgtgaaactaatca

SEQ ID NO: 6888524 - DNA, 19 bp, Homo sapiens
atgatctaagaagctacag

SEQ ID NO: 6888525 - DNA, 21 bp, Homo sapiens
cctggctgaggttcctctgcc

SEQ ID NO: 6888526 - DNA, 19 bp, Homo sapiens
tgatattgtttgctgttgg

SEQ ID NO: 6888527 - DNA, 15 bp, Homo sapiens
cttcagttctgcttg

SEQ ID NO: 6888528 - DNA, 15 bp, Homo sapiens
gaggcttgcccagga

SEQ ID NO: 6888529 - DNA, 14 bp, Homo sapiens
cccaggcattgcca

SEQ ID NO: 6888530 - DNA, 14 bp, Homo sapiens
gcactcgcactgca

SEQ ID NO: 6888531 - DNA, 13 bp, Homo sapiens
cctaactcttgct

SEQ ID NO: 6888532 - DNA, 20 bp, Homo sapiens
tgtggactctctgcctgctt

SEQ ID NO: 6888533 - DNA, 18 bp, Homo sapiens
cttgctggaaaactgcca

SEQ ID NO: 6888534 - DNA, 21 bp, Homo sapiens
aattcaacacattacttgcac

SEQ ID NO: 6888535 - DNA, 12 bp, Homo sapiens
cagctcctcccc

SEQ ID NO: 6888536 - DNA, 21 bp, Homo sapiens
caccttcatttaactctttga

SEQ ID NO: 6888537 - DNA, 16 bp, Homo sapiens
ctccacagtgctgctt

SEQ ID NO: 6888538 - DNA, 17 bp, Homo sapiens
acatatgcagatactta

SEQ ID NO: 6888539 - DNA, 21 bp, Homo sapiens
taaattccactgaaaatttaa

SEQ ID NO: 6888540 - DNA, 17 bp, Homo sapiens
catacctgcccctgcct

SEQ ID NO: 6888541 - DNA, 12 bp, Homo sapiens
aggatgccactt

SEQ ID NO: 6888542 - DNA, 19 bp, Homo sapiens
accagcagatcccagctca

SEQ ID NO: 6888543 - DNA, 15 bp, Homo sapiens
gaaaagttgaatttt

SEQ ID NO: 6888544 - DNA, 15 bp, Homo sapiens
cctcttggcagtcac

SEQ ID NO: 6888545 - DNA, 14 bp, Homo sapiens
ttacacttactgtt

SEQ ID NO: 6888546 - DNA, 21 bp, Homo sapiens
ctccctgcctcacatctccct

SEQ ID NO: 6888547 - DNA, 18 bp, Homo sapiens
aggccatgtggcctgccc

SEQ ID NO: 6888548 - DNA, 17 bp, Homo sapiens
actttcacttcttccta

SEQ ID NO: 6888549 - DNA, 22 bp, Homo sapiens
ggaccctgtgccctccttccca

SEQ ID NO: 6888550 - DNA, 20 bp, Homo sapiens
ctgaatgctgagctgaagaa

SEQ ID NO: 6888551 - DNA, 12 bp, Homo sapiens
gccccactggct

SEQ ID NO: 6888552 - DNA, 19 bp, Homo sapiens
atgacccacccctgtgctc

SEQ ID NO: 6888553 - DNA, 14 bp, Homo sapiens
cggaaaccttgcag

SEQ ID NO: 6888554 - DNA, 15 bp, Homo sapiens
tgcctggactgacca

SEQ ID NO: 6888555 - DNA, 16 bp, Homo sapiens
caatgtatgtacaata

SEQ ID NO: 6888556 - DNA, 19 bp, Homo sapiens
cttttctcctgcatgtgta

SEQ ID NO: 6888557 - DNA, 13 bp, Homo sapiens
catccgcctgtgg

SEQ ID NO: 6888558 - DNA, 20 bp, Homo sapiens
gctgctaccctccctgctgt

SEQ ID NO: 6888559 - DNA, 16 bp, Homo sapiens
cattcgaatctctgcc

SEQ ID NO: 6888560 - DNA, 22 bp, Homo sapiens
ccttcctggactggcccttgcc

SEQ ID NO: 6888561 - DNA, 20 bp, Homo sapiens
aaggaacacccggaaagact

SEQ ID NO: 6888562 - DNA, 13 bp, Homo sapiens
attaatggcactg

SEQ ID NO: 6888563 - DNA, 20 bp, Homo sapiens
ctgaagaaacacagcatgca

SEQ ID NO: 6888564 - DNA, 21 bp, Homo sapiens
cagattgcatgtgactctgaa

SEQ ID NO: 6888565 - DNA, 16 bp, Homo sapiens
tgagttcctctgcagt

SEQ ID NO: 6888566 - DNA, 15 bp, Homo sapiens
ctttcctctccctca

SEQ ID NO: 6888567 - DNA, 12 bp, Homo sapiens
aatgtactgcat

SEQ ID NO: 6888568 - DNA, 23 bp, Homo sapiens
tatcacatgtcagccactgtgat

SEQ ID NO: 6888569 - DNA, 21 bp, Homo sapiens
gcaggaggctttctgggctct

SEQ ID NO: 6888570 - DNA, 13 bp, Homo sapiens
ccctctcctgcct

SEQ ID NO: 6888571 - DNA, 14 bp, Homo sapiens
tgggctctgaccca

SEQ ID NO: 6888572 - DNA, 15 bp, Homo sapiens
ccccagccccttcca

SEQ ID NO: 6888573 - DNA, 13 bp, Homo sapiens
ttcagtcactgct

SEQ ID NO: 6888574 - DNA, 19 bp, Homo sapiens
taattttatattcagtgaa

SEQ ID NO: 6888575 - DNA, 22 bp, Homo sapiens
gccagattacaggaatgaagaa

SEQ ID NO: 6888576 - DNA, 18 bp, Homo sapiens
cattacttgttgcctata

SEQ ID NO: 6888577 - DNA, 15 bp, Homo sapiens
agcctgtttattgcc

SEQ ID NO: 6888578 - DNA, 15 bp, Homo sapiens
cattgcactctagcc

SEQ ID NO: 6888579 - DNA, 17 bp, Homo sapiens
ctgagttatcaggtgca

SEQ ID NO: 6888580 - DNA, 12 bp, Homo sapiens
gtcctgtgaatg

SEQ ID NO: 6888581 - DNA, 23 bp, Homo sapiens
ctgaatgaaacccccacacacac

SEQ ID NO: 6888582 - DNA, 15 bp, Homo sapiens
gtgccagctgcttct

SEQ ID NO: 6888583 - DNA, 15 bp, Homo sapiens
gccagcgggcacagg

SEQ ID NO: 6888584 - DNA, 21 bp, Homo sapiens
gctttgccatgggcctgctgc

SEQ ID NO: 6888585 - DNA, 16 bp, Homo sapiens
ctgtccctctttgcct

SEQ ID NO: 6888586 - DNA, 18 bp, Homo sapiens
caaatcacacctctgggc

SEQ ID NO: 6888587 - DNA, 14 bp, Homo sapiens
cctcccctcaagga

SEQ ID NO: 6888588 - DNA, 22 bp, Homo sapiens
acgtgctccgtagctctgctgc

SEQ ID NO: 6888589 - DNA, 19 bp, Homo sapiens
caggttccccaagggccct

SEQ ID NO: 6888590 - DNA, 14 bp, Homo sapiens
ttcattaatctgtt

SEQ ID NO: 6888591 - DNA, 12 bp, Homo sapiens
ccttcagctcca

SEQ ID NO: 6888592 - DNA, 12 bp, Homo sapiens
agaggcccaggg

SEQ ID NO: 6888593 - DNA, 17 bp, Homo sapiens
agcctccccttcttccc

SEQ ID NO: 6888594 - DNA, 17 bp, Homo sapiens
cacttctccatgctgca

SEQ ID NO: 6888595 - DNA, 15 bp, Homo sapiens
caagaccctgtctct

SEQ ID NO: 6888596 - DNA, 20 bp, Homo sapiens
cattgtgtgatccagccctg

SEQ ID NO: 6888597 - DNA, 23 bp, Homo sapiens
agcagtgagagttcctctttgcc

SEQ ID NO: 6888598 - DNA, 13 bp, Homo sapiens
aaccaggacatta

SEQ ID NO: 6888599 - DNA, 18 bp, Homo sapiens
gcctgcaaatctagtgcc

SEQ ID NO: 6888600 - DNA, 19 bp, Homo sapiens
cttccagtgaggctctgcc

SEQ ID NO: 6888601 - DNA, 22 bp, Homo sapiens
acctctaacaccacactgacca

SEQ ID NO: 6888602 - DNA, 15 bp, Homo sapiens
actccctcccctgcc

SEQ ID NO: 6888603 - DNA, 12 bp, Homo sapiens
caccgcattcca

SEQ ID NO: 6888604 - DNA, 15 bp, Homo sapiens
tcagctccagctcac

SEQ ID NO: 6888605 - DNA, 13 bp, Homo sapiens
ctctatactttgt

SEQ ID NO: 6888606 - DNA, 23 bp, Homo sapiens
agtaaaccaattttttattcatt

SEQ ID NO: 6888607 - DNA, 17 bp, Homo sapiens
ggaattggtgtgcctta

SEQ ID NO: 6888608 - DNA, 20 bp, Homo sapiens
cctgctaaggaacaatgccg

SEQ ID NO: 6888609 - DNA, 23 bp, Homo sapiens
agattgcctcaaaattgtgtcca

SEQ ID NO: 6888610 - DNA, 18 bp, Homo sapiens
aggtgcctggcttgctgt

SEQ ID NO: 6888611 - DNA, 18 bp, Homo sapiens
accttcccttcctcagca

SEQ ID NO: 6888612 - DNA, 14 bp, Homo sapiens
gtacctcctctcag

SEQ ID NO: 6888613 - DNA, 13 bp, Homo sapiens
attcttttttcag

SEQ ID NO: 6888614 - DNA, 15 bp, Homo sapiens
tcctctgtctgccct

SEQ ID NO: 6888615 - DNA, 16 bp, Homo sapiens
tcctgtactactgcct

SEQ ID NO: 6888616 - DNA, 19 bp, Homo sapiens
tcttcctctgcaagtgctc

SEQ ID NO: 6888617 - DNA, 13 bp, Homo sapiens
taaagttgctttt

SEQ ID NO: 6888618 - DNA, 18 bp, Homo sapiens
tgagtggcagccatgcct

SEQ ID NO: 6888619 - DNA, 16 bp, Homo sapiens
atatgtaacagtttaa

SEQ ID NO: 6888620 - DNA, 18 bp, Homo sapiens
tccctacctccctcctca

SEQ ID NO: 6888621 - DNA, 19 bp, Homo sapiens
ttggacttcagtcttgcct

SEQ ID NO: 6888622 - DNA, 13 bp, Homo sapiens
aaaatatcattca

SEQ ID NO: 6888623 - DNA, 18 bp, Homo sapiens
cccagaggttatctgcct

SEQ ID NO: 6888624 - DNA, 16 bp, Homo sapiens
tgaaatgtaacatgaa

SEQ ID NO: 6888625 - DNA, 19 bp, Homo sapiens
gatgtggaggaagagccac

SEQ ID NO: 6888626 - DNA, 16 bp, Homo sapiens
ccctgcgcccctgccc

SEQ ID NO: 6888627 - DNA, 14 bp, Homo sapiens
aattcatgtttctt

SEQ ID NO: 6888628 - DNA, 17 bp, Homo sapiens
gccctgcctgcagccag

SEQ ID NO: 6888629 - DNA, 18 bp, Homo sapiens
ctaggaggatgctgtgcc

SEQ ID NO: 6888630 - DNA, 17 bp, Homo sapiens
gccctgttcagctactc

SEQ ID NO: 6888631 - DNA, 22 bp, Homo sapiens
gacatccgtcattgctgctgct

SEQ ID NO: 6888632 - DNA, 20 bp, Homo sapiens
cttggagactcctggtctgt

SEQ ID NO: 6888633 - DNA, 14 bp, Homo sapiens
atgttacctctgaa

SEQ ID NO: 6888634 - DNA, 16 bp, Homo sapiens
atggaagacacattga

SEQ ID NO: 6888635 - DNA, 21 bp, Homo sapiens
gtttttacctaccacagtgtc

SEQ ID NO: 6888636 - DNA, 21 bp, Homo sapiens
caagccaccagatgtgacagt

SEQ ID NO: 6888637 - DNA, 16 bp, Homo sapiens
cctttccttccatccc

SEQ ID NO: 6888638 - DNA, 15 bp, Homo sapiens
tgtctcttcatgtct

SEQ ID NO: 6888639 - DNA, 22 bp, Homo sapiens
cgtccctcgagctctgtagcct

SEQ ID NO: 6888640 - DNA, 13 bp, Homo sapiens
cctgtgtggagag

SEQ ID NO: 6888641 - DNA, 13 bp, Homo sapiens
tcctttatgtgat

SEQ ID NO: 6888642 - DNA, 21 bp, Homo sapiens
atatgtactgtataacattaa

SEQ ID NO: 6888643 - DNA, 14 bp, Homo sapiens
ataattactatgtc

SEQ ID NO: 6888644 - DNA, 16 bp, Homo sapiens
ccctgctccctgcttt

SEQ ID NO: 6888645 - DNA, 20 bp, Homo sapiens
taccacttcctgaggcctca

SEQ ID NO: 6888646 - DNA, 22 bp, Homo sapiens
aggctcctggctgtgcccagca

SEQ ID NO: 6888647 - DNA, 16 bp, Homo sapiens
tatacatcaatatgta

SEQ ID NO: 6888648 - DNA, 21 bp, Homo sapiens
cagccccacccctaagtgccc

SEQ ID NO: 6888649 - DNA, 21 bp, Homo sapiens
cccaggactctggcacttcca

SEQ ID NO: 6888650 - DNA, 15 bp, Homo sapiens
caattaaggatttta

SEQ ID NO: 6888651 - DNA, 16 bp, Homo sapiens
cactgctgtcctctcc

SEQ ID NO: 6888652 - DNA, 10 bp, Homo sapiens
gaactgccca

SEQ ID NO: 6888653 - DNA, 24 bp, Homo sapiens
ctgtcacggggttccctcctagct

SEQ ID NO: 6888654 - DNA, 16 bp, Homo sapiens
gcttatcaatttgtca

SEQ ID NO: 6888655 - DNA, 15 bp, Homo sapiens
tgtacctcccctgcc

SEQ ID NO: 6888656 - DNA, 16 bp, Homo sapiens
gcctgctgcctgctga

SEQ ID NO: 6888657 - DNA, 14 bp, Homo sapiens
ctgcattgtaaata

SEQ ID NO: 6888658 - DNA, 18 bp, Homo sapiens
agcatatgtgttacttca

SEQ ID NO: 6888659 - DNA, 15 bp, Homo sapiens
acacagcttgtctct

SEQ ID NO: 6888660 - DNA, 23 bp, Homo sapiens
gaggcccccgcacgcaagcctca

SEQ ID NO: 6888661 - DNA, 18 bp, Homo sapiens
aaagaaacaccagtgtta

SEQ ID NO: 6888662 - DNA, 14 bp, Homo sapiens
aatcctcttcctct

SEQ ID NO: 6888663 - DNA, 17 bp, Homo sapiens
tcactcactgtttataa

SEQ ID NO: 6888664 - DNA, 22 bp, Homo sapiens
cccagctgtaccggccactgca

SEQ ID NO: 6888665 - DNA, 12 bp, Homo sapiens
ccttccctctcc

SEQ ID NO: 6888666 - DNA, 19 bp, Homo sapiens
caatcaactttactgtaat

SEQ ID NO: 6888667 - DNA, 18 bp, Homo sapiens
tcattccagcagctgcac

SEQ ID NO: 6888668 - DNA, 19 bp, Homo sapiens
atggcccagccactgcagc

SEQ ID NO: 6888669 - DNA, 19 bp, Homo sapiens
tgataccacctttactgtg

SEQ ID NO: 6888670 - DNA, 20 bp, Homo sapiens
ctgttccccaccgccctgcc

SEQ ID NO: 6888671 - DNA, 14 bp, Homo sapiens
accccttcgctcct

SEQ ID NO: 6888672 - DNA, 17 bp, Homo sapiens
tcatattctaacttatt

SEQ ID NO: 6888673 - DNA, 16 bp, Homo sapiens
ggccgggactgctgct

SEQ ID NO: 6888674 - DNA, 22 bp, Homo sapiens
tgccagttgggctcgcactgcc

SEQ ID NO: 6888675 - DNA, 19 bp, Homo sapiens
atattatgtataaaatgta

SEQ ID NO: 6888676 - DNA, 12 bp, Homo sapiens
aggaggacccag

SEQ ID NO: 6888677 - DNA, 23 bp, Homo sapiens
cttcgggtgtgatcatatatcat

SEQ ID NO: 6888678 - DNA, 13 bp, Homo sapiens
taccagacttcaa

SEQ ID NO: 6888679 - DNA, 18 bp, Homo sapiens
cttcctgtggctccctct

SEQ ID NO: 6888680 - DNA, 13 bp, Homo sapiens
ggccaactgcaaa

SEQ ID NO: 6888681 - DNA, 21 bp, Homo sapiens
cagtatgctttccctgaggaa

SEQ ID NO: 6888682 - DNA, 15 bp, Homo sapiens
ctcaggtctcagcta

SEQ ID NO: 6888683 - DNA, 21 bp, Homo sapiens
cgctgcccggcgccctctgtc

SEQ ID NO: 6888684 - DNA, 14 bp, Homo sapiens
cccttccccctgct

SEQ ID NO: 6888685 - DNA, 17 bp, Homo sapiens
cacagccatcccagcct

SEQ ID NO: 6888686 - DNA, 22 bp, Homo sapiens
gcactaagagaaaattgcacta

SEQ ID NO: 6888687 - DNA, 19 bp, Homo sapiens
ctcgagaccatcctggccc

SEQ ID NO: 6888688 - DNA, 15 bp, Homo sapiens
ttcggggcctgctgg

SEQ ID NO: 6888689 - DNA, 15 bp, Homo sapiens
ctgtgcccactccct

SEQ ID NO: 6888690 - DNA, 16 bp, Homo sapiens
agagtggttgttgcca

SEQ ID NO: 6888691 - DNA, 13 bp, Homo sapiens
ccttcccctccct

SEQ ID NO: 6888692 - DNA, 13 bp, Homo sapiens
cgtaaactatgac

SEQ ID NO: 6888693 - DNA, 18 bp, Homo sapiens
cacatcccggcctcttcc

SEQ ID NO: 6888694 - DNA, 11 bp, Homo sapiens
tttaaatgtct

SEQ ID NO: 6888695 - DNA, 15 bp, Homo sapiens
catgcacagtacaat

SEQ ID NO: 6888696 - DNA, 22 bp, Homo sapiens
acctttgatgaattcttcctct

SEQ ID NO: 6888697 - DNA, 21 bp, Homo sapiens
ccagggaccactgggtgagag

SEQ ID NO: 6888698 - DNA, 15 bp, Homo sapiens
ggttctttcctccca

SEQ ID NO: 6888699 - DNA, 16 bp, Homo sapiens
agtcacaggcccagga

SEQ ID NO: 6888700 - DNA, 19 bp, Homo sapiens
tcctaggaaaccagctcgt

SEQ ID NO: 6888701 - DNA, 15 bp, Homo sapiens
ttcttgcactgtcca

SEQ ID NO: 6888702 - DNA, 15 bp, Homo sapiens
gcctttgagactgtt

SEQ ID NO: 6888703 - DNA, 21 bp, Homo sapiens
ccctgctgcccctccctgcct

SEQ ID NO: 6888704 - DNA, 13 bp, Homo sapiens
gtggctcctcccg

SEQ ID NO: 6888705 - DNA, 22 bp, Homo sapiens
caggcagtccaggcctctctct

SEQ ID NO: 6888706 - DNA, 16 bp, Homo sapiens
agatgaatgccgtgga

SEQ ID NO: 6888707 - DNA, 22 bp, Homo sapiens
ctctcccatggtgcccgtgcct

SEQ ID NO: 6888708 - DNA, 14 bp, Homo sapiens
taccacttacctca

SEQ ID NO: 6888709 - DNA, 18 bp, Homo sapiens
gtaatctctctgcagctg

SEQ ID NO: 6888710 - DNA, 18 bp, Homo sapiens
cttccagtctcactgaca

SEQ ID NO: 6888711 - DNA, 15 bp, Homo sapiens
ccttcaggccttgcc

SEQ ID NO: 6888712 - DNA, 14 bp, Homo sapiens
actggactcaggat

SEQ ID NO: 6888713 - DNA, 18 bp, Homo sapiens
ctctgccgaccgcctgct

SEQ ID NO: 6888714 - DNA, 22 bp, Homo sapiens
tcctagagctcctgtccctacc

SEQ ID NO: 6888715 - DNA, 17 bp, Homo sapiens
acccattaggcatgcct

SEQ ID NO: 6888716 - DNA, 16 bp, Homo sapiens
gctgttattcttgtta

SEQ ID NO: 6888717 - DNA, 19 bp, Homo sapiens
aacctccctgggcctgtct

SEQ ID NO: 6888718 - DNA, 17 bp, Homo sapiens
gtgtagactggccatgc

SEQ ID NO: 6888719 - DNA, 18 bp, Homo sapiens
cccttcctgttccctcct

SEQ ID NO: 6888720 - DNA, 15 bp, Homo sapiens
tacatttgtttgtat

SEQ ID NO: 6888721 - DNA, 23 bp, Homo sapiens
cccagggcctgcttccccttcct

SEQ ID NO: 6888722 - DNA, 23 bp, Homo sapiens
taaatattcttgtccacattcta

SEQ ID NO: 6888723 - DNA, 16 bp, Homo sapiens
catgtgttgcagctgt

SEQ ID NO: 6888724 - DNA, 18 bp, Homo sapiens
aaaccctaagtgtggatg

SEQ ID NO: 6888725 - DNA, 17 bp, Homo sapiens
tgcttttgcctctgccc

SEQ ID NO: 6888726 - DNA, 13 bp, Homo sapiens
gccgcttcgccat

SEQ ID NO: 6888727 - DNA, 15 bp, Homo sapiens
agagacttgggaatg

SEQ ID NO: 6888728 - DNA, 16 bp, Homo sapiens
gcgtggtcactgctgt

SEQ ID NO: 6888729 - DNA, 13 bp, Homo sapiens
caaatggtacaaa

SEQ ID NO: 6888730 - DNA, 15 bp, Homo sapiens
caggggccctgcagc

SEQ ID NO: 6888731 - DNA, 16 bp, Homo sapiens
tttccctctccttcca

SEQ ID NO: 6888732 - DNA, 19 bp, Homo sapiens
gagcccttcactgccatga

SEQ ID NO: 6888733 - DNA, 20 bp, Homo sapiens
tacttgcttattacatttaa

SEQ ID NO: 6888734 - DNA, 22 bp, Homo sapiens
acagccttgcagcggctcctgc

SEQ ID NO: 6888735 - DNA, 14 bp, Homo sapiens
ccaaagcccagccc

SEQ ID NO: 6888736 - DNA, 23 bp, Homo sapiens
cagtaaatacttgcagttgtgat

SEQ ID NO: 6888737 - DNA, 16 bp, Homo sapiens
cagcaagcaattctgc

SEQ ID NO: 6888738 - DNA, 15 bp, Homo sapiens
tcgatctgtactgta

SEQ ID NO: 6888739 - DNA, 12 bp, Homo sapiens
cctgggcctcca

SEQ ID NO: 6888740 - DNA, 16 bp, Homo sapiens
cttctgtttttctcaa

SEQ ID NO: 6888741 - DNA, 21 bp, Homo sapiens
ctggtgtcagcccctcttccc

SEQ ID NO: 6888742 - DNA, 17 bp, Homo sapiens
ctggcacttgcctgctg

SEQ ID NO: 6888743 - DNA, 16 bp, Homo sapiens
gactgctcctgagccc

SEQ ID NO: 6888744 - DNA, 14 bp, Homo sapiens
gcctggttcgtgcc

SEQ ID NO: 6888745 - DNA, 20 bp, Homo sapiens
caatgttggctagtctgtgc

SEQ ID NO: 6888746 - DNA, 20 bp, Homo sapiens
acctgtcttattaagactgg

SEQ ID NO: 6888747 - DNA, 23 bp, Homo sapiens
ccacctcttctcttcctgtaaca

SEQ ID NO: 6888748 - DNA, 17 bp, Homo sapiens
acacctgagctgctgca

SEQ ID NO: 6888749 - DNA, 16 bp, Homo sapiens
ggagccactcctctga

SEQ ID NO: 6888750 - DNA, 23 bp, Homo sapiens
gaggtgtgggtgccttccatact

SEQ ID NO: 6888751 - DNA, 18 bp, Homo sapiens
cacctttctgaatggaaa

SEQ ID NO: 6888752 - DNA, 20 bp, Homo sapiens
ctgtaccttttgaggagccc

SEQ ID NO: 6888753 - DNA, 16 bp, Homo sapiens
ccatgctcctcttccc

SEQ ID NO: 6888754 - DNA, 13 bp, Homo sapiens
cttcctctgctcc

SEQ ID NO: 6888755 - DNA, 23 bp, Homo sapiens
accactctgtggccagcctggca

SEQ ID NO: 6888756 - DNA, 17 bp, Homo sapiens
cattatagcgcctgtat

SEQ ID NO: 6888757 - DNA, 12 bp, Homo sapiens
acagcagtattg

SEQ ID NO: 6888758 - DNA, 14 bp, Homo sapiens
tggcctggcctcca

SEQ ID NO: 6888759 - DNA, 13 bp, Homo sapiens
gtaaatattcttg

SEQ ID NO: 6888760 - DNA, 19 bp, Homo sapiens
tcctctagccatcccttgg

SEQ ID NO: 6888761 - DNA, 16 bp, Homo sapiens
cactgaaacctctgcc

SEQ ID NO: 6888762 - DNA, 17 bp, Homo sapiens
gctctgccttgcactgt

SEQ ID NO: 6888763 - DNA, 20 bp, Homo sapiens
gagggtttgtaatggtgctt

SEQ ID NO: 6888764 - DNA, 20 bp, Homo sapiens
aagattccaaaaagcacata

SEQ ID NO: 6888765 - DNA, 15 bp, Homo sapiens
gcccctgcctgctgg

SEQ ID NO: 6888766 - DNA, 14 bp, Homo sapiens
ccagcgtcactcca

SEQ ID NO: 6888767 - DNA, 21 bp, Homo sapiens
tctgcctgggatgggctccca

SEQ ID NO: 6888768 - DNA, 16 bp, Homo sapiens
tattgagacactgtca

SEQ ID NO: 6888769 - DNA, 21 bp, Homo sapiens
ttttaattgcaacaatgcaaa

SEQ ID NO: 6888770 - DNA, 15 bp, Homo sapiens
gtgaagatactttgt

SEQ ID NO: 6888771 - DNA, 19 bp, Homo sapiens
ccattcatccttccatcca

SEQ ID NO: 6888772 - DNA, 15 bp, Homo sapiens
ctaaatccttgttaa

SEQ ID NO: 6888773 - DNA, 16 bp, Homo sapiens
aagatgccacattcaa

SEQ ID NO: 6888774 - DNA, 20 bp, Homo sapiens
agttgatctggaacccagac

SEQ ID NO: 6888775 - DNA, 18 bp, Homo sapiens
cttctgcctcccactcca

SEQ ID NO: 6888776 - DNA, 22 bp, Homo sapiens
tccagtggcctggctccgctgt

SEQ ID NO: 6888777 - DNA, 19 bp, Homo sapiens
attaatgagacacacttaa

SEQ ID NO: 6888778 - DNA, 16 bp, Homo sapiens
caggcagtgcatgtga

SEQ ID NO: 6888779 - DNA, 13 bp, Homo sapiens
cctcccccaaccc

SEQ ID NO: 6888780 - DNA, 20 bp, Homo sapiens
tgggtgcgaccccatctgcc

SEQ ID NO: 6888781 - DNA, 23 bp, Homo sapiens
ggctccgctgtgcccgccctggg

SEQ ID NO: 6888782 - DNA, 18 bp, Homo sapiens
attagtgtcaacttttaa

SEQ ID NO: 6888783 - DNA, 20 bp, Homo sapiens
ccctgcccaccctccctcca

SEQ ID NO: 6888784 - DNA, 22 bp, Homo sapiens
cacgtggctgcgtgcccctgct

SEQ ID NO: 6888785 - DNA, 15 bp, Homo sapiens
cagcagaactgaagt

SEQ ID NO: 6888786 - DNA, 22 bp, Homo sapiens
tgcagaatggcatttgcaataa

SEQ ID NO: 6888787 - DNA, 23 bp, Homo sapiens
ccgtcctgggcgtgacccgtcca

SEQ ID NO: 6888788 - DNA, 17 bp, Homo sapiens
cttgagtagatctgctt

SEQ ID NO: 6888789 - DNA, 14 bp, Homo sapiens
cataatctctggaa

SEQ ID NO: 6888790 - DNA, 22 bp, Homo sapiens
taacttggttatacatgacact

SEQ ID NO: 6888791 - DNA, 19 bp, Homo sapiens
ctcccagtgaactcctgcc

SEQ ID NO: 6888792 - DNA, 12 bp, Homo sapiens
gcacagctggcc

SEQ ID NO: 6888793 - DNA, 14 bp, Homo sapiens
tatgcactgctcac

SEQ ID NO: 6888794 - DNA, 20 bp, Homo sapiens
aatgctgggcccctgctcaa

SEQ ID NO: 6888795 - DNA, 18 bp, Homo sapiens
tcagaacattcagctctg

SEQ ID NO: 6888796 - DNA, 13 bp, Homo sapiens
tcatttcactgta

SEQ ID NO: 6888797 - DNA, 17 bp, Homo sapiens
tcaagccgcaagctctc

SEQ ID NO: 6888798 - DNA, 18 bp, Homo sapiens
agttctgtgtattttcag

SEQ ID NO: 6888799 - DNA, 23 bp, Homo sapiens
ccggggcagcagcagccctgccc

SEQ ID NO: 6888800 - DNA, 13 bp, Homo sapiens
tcaaggcactcta

SEQ ID NO: 6888801 - DNA, 20 bp, Homo sapiens
ctcctgggtgctcaccgcct

SEQ ID NO: 6888802 - DNA, 16 bp, Homo sapiens
cactcagtgcttctct

SEQ ID NO: 6888803 - DNA, 22 bp, Homo sapiens
ccaggtagttggaactttctgt

SEQ ID NO: 6888804 - DNA, 13 bp, Homo sapiens
agcatcaggccag

SEQ ID NO: 6888805 - DNA, 16 bp, Homo sapiens
ctgtccatcctcctct

SEQ ID NO: 6888806 - DNA, 19 bp, Homo sapiens
ttccccagaggctcccaat

SEQ ID NO: 6888807 - DNA, 15 bp, Homo sapiens
cactagcctccctct

SEQ ID NO: 6888808 - DNA, 17 bp, Homo sapiens
ttgtggcgtctccctcg

SEQ ID NO: 6888809 - DNA, 19 bp, Homo sapiens
actattcttaagcactttg

SEQ ID NO: 6888810 - DNA, 17 bp, Homo sapiens
atctccccaggcctcca

SEQ ID NO: 6888811 - DNA, 21 bp, Homo sapiens
atcaaggaaaggctcatttaa

SEQ ID NO: 6888812 - DNA, 19 bp, Homo sapiens
tctacttacacatcttcca

SEQ ID NO: 6888813 - DNA, 19 bp, Homo sapiens
ctcctgggcagctgcctcc

SEQ ID NO: 6888814 - DNA, 16 bp, Homo sapiens
cagaatgacctggccg

SEQ ID NO: 6888815 - DNA, 17 bp, Homo sapiens
attacaggctcctgcca

SEQ ID NO: 6888816 - DNA, 23 bp, Homo sapiens
cgagctgtgctcgggtgctgcca

SEQ ID NO: 6888817 - DNA, 21 bp, Homo sapiens
cacacactgtctggggcccca

SEQ ID NO: 6888818 - DNA, 15 bp, Homo sapiens
gctgtatcactgcct

SEQ ID NO: 6888819 - DNA, 19 bp, Homo sapiens
cctatcaggtgcccctctt

SEQ ID NO: 6888820 - DNA, 23 bp, Homo sapiens
aacaacatttaagggaatgtgag

SEQ ID NO: 6888821 - DNA, 18 bp, Homo sapiens
cttctttctgctggctga

SEQ ID NO: 6888822 - DNA, 23 bp, Homo sapiens
ccaggccgggcctgtacagtctg

SEQ ID NO: 6888823 - DNA, 18 bp, Homo sapiens
catatgtgtgtgtgtgca

SEQ ID NO: 6888824 - DNA, 18 bp, Homo sapiens
agactgctgtggccagga

SEQ ID NO: 6888825 - DNA, 13 bp, Homo sapiens
cgtgcatcccccc

SEQ ID NO: 6888826 - DNA, 14 bp, Homo sapiens
aagctgctgtctct

SEQ ID NO: 6888827 - DNA, 14 bp, Homo sapiens
atttctccagaccc

SEQ ID NO: 6888828 - DNA, 19 bp, Homo sapiens
ggattctaaatacatgcca

SEQ ID NO: 6888829 - DNA, 23 bp, Homo sapiens
agctgctatgctaaacctcctgc

SEQ ID NO: 6888830 - DNA, 22 bp, Homo sapiens
aaggacttccacatttttgcac

SEQ ID NO: 6888831 - DNA, 18 bp, Homo sapiens
tttcccaaagtcctctgc

SEQ ID NO: 6888832 - DNA, 22 bp, Homo sapiens
tcctgttaaccctccacctcct

SEQ ID NO: 6888833 - DNA, 15 bp, Homo sapiens
aggtttcgatattta

SEQ ID NO: 6888834 - DNA, 23 bp, Homo sapiens
cttccagtagttgaacactgtca

SEQ ID NO: 6888835 - DNA, 20 bp, Homo sapiens
gtctgcctggagtgctgtgc

SEQ ID NO: 6888836 - DNA, 20 bp, Homo sapiens
cagtgaagcagcactgtgag

SEQ ID NO: 6888837 - DNA, 14 bp, Homo sapiens
cttgccccccaccc

SEQ ID NO: 6888838 - DNA, 16 bp, Homo sapiens
gactcaggatgcccag

SEQ ID NO: 6888839 - DNA, 12 bp, Homo sapiens
aagcaatgcaag

SEQ ID NO: 6888840 - DNA, 13 bp, Homo sapiens
cagtgtgctaacc

SEQ ID NO: 6888841 - DNA, 15 bp, Homo sapiens
agtccactgcctcca

SEQ ID NO: 6888842 - DNA, 15 bp, Homo sapiens
ggataaagccactga

SEQ ID NO: 6888843 - DNA, 15 bp, Homo sapiens
taaatgtatactata

SEQ ID NO: 6888844 - DNA, 16 bp, Homo sapiens
ctcactgtctcctggt

SEQ ID NO: 6888845 - DNA, 17 bp, Homo sapiens
cacccatggcctcagcc

SEQ ID NO: 6888846 - DNA, 19 bp, Homo sapiens
caaactgagtaaattggaa

SEQ ID NO: 6888847 - DNA, 19 bp, Homo sapiens
aatgtattttgaaaacact

SEQ ID NO: 6888848 - DNA, 20 bp, Homo sapiens
agatataagtgctgtataaa

SEQ ID NO: 6888849 - DNA, 20 bp, Homo sapiens
ctcctgtgtgtctgcagaca

SEQ ID NO: 6888850 - DNA, 22 bp, Homo sapiens
agccccaaaactctcctctgct

SEQ ID NO: 6888851 - DNA, 14 bp, Homo sapiens
aaaccctggtgctt

SEQ ID NO: 6888852 - DNA, 17 bp, Homo sapiens
actcctaaacctttgcc

SEQ ID NO: 6888853 - DNA, 17 bp, Homo sapiens
atgctccctcccctgcc

SEQ ID NO: 6888854 - DNA, 20 bp, Homo sapiens
tgacttagcgtcaagacatt

SEQ ID NO: 6888855 - DNA, 16 bp, Homo sapiens
accaattgccctgcca

SEQ ID NO: 6888856 - DNA, 20 bp, Homo sapiens
cttgccgctccccttggacc

SEQ ID NO: 6888857 - DNA, 23 bp, Homo sapiens
ctggaaaggggagagcctgctgg

SEQ ID NO: 6888858 - DNA, 14 bp, Homo sapiens
atctgctttgttaa

SEQ ID NO: 6888859 - DNA, 13 bp, Homo sapiens
ttaattgtgaaca

SEQ ID NO: 6888860 - DNA, 22 bp, Homo sapiens
ctggcatcgcaccattctgact

SEQ ID NO: 6888861 - DNA, 21 bp, Homo sapiens
ttgcaaagtatccctactgta

SEQ ID NO: 6888862 - DNA, 21 bp, Homo sapiens
aatatgttgactttatttctg

SEQ ID NO: 6888863 - DNA, 14 bp, Homo sapiens
attttcataactta

SEQ ID NO: 6888864 - DNA, 18 bp, Homo sapiens
ccagcaattctcctgcct

SEQ ID NO: 6888865 - DNA, 13 bp, Homo sapiens
agctgtgtctgag

SEQ ID NO: 6888866 - DNA, 14 bp, Homo sapiens
atgatcactgtgaa

SEQ ID NO: 6888867 - DNA, 17 bp, Homo sapiens
acagatgtgcccagagt

SEQ ID NO: 6888868 - DNA, 19 bp, Homo sapiens
ccttcttgcatccttccta

SEQ ID NO: 6888869 - DNA, 17 bp, Homo sapiens
ctttccatctgcttgta

SEQ ID NO: 6888870 - DNA, 17 bp, Homo sapiens
acctgcaggctgagcca

SEQ ID NO: 6888871 - DNA, 12 bp, Homo sapiens
aaccctcttgcc

SEQ ID NO: 6888872 - DNA, 17 bp, Homo sapiens
ctgcctgtcacctggga

SEQ ID NO: 6888873 - DNA, 21 bp, Homo sapiens
cctcacctgggttccccaccc

SEQ ID NO: 6888874 - DNA, 19 bp, Homo sapiens
agacttttatgtgagattt

SEQ ID NO: 6888875 - DNA, 14 bp, Homo sapiens
catgtccccttccc

SEQ ID NO: 6888876 - DNA, 12 bp, Homo sapiens
gccacctgctgc

SEQ ID NO: 6888877 - DNA, 18 bp, Homo sapiens
caataatggtcccatcca

SEQ ID NO: 6888878 - DNA, 21 bp, Homo sapiens
tcctctcccccttcagctcct

SEQ ID NO: 6888879 - DNA, 18 bp, Homo sapiens
tcttctgaagtgctgctc

SEQ ID NO: 6888880 - DNA, 12 bp, Homo sapiens
caccagctgctc

SEQ ID NO: 6888881 - DNA, 19 bp, Homo sapiens
cctgcttgaactgctgcca

SEQ ID NO: 6888882 - DNA, 14 bp, Homo sapiens
cctctactcttcct

SEQ ID NO: 6888883 - DNA, 21 bp, Homo sapiens
ccacagcggaggagctccgct

SEQ ID NO: 6888884 - DNA, 19 bp, Homo sapiens
aatgcctgttgtatttatg

SEQ ID NO: 6888885 - DNA, 21 bp, Homo sapiens
cacataaactttataaattca

SEQ ID NO: 6888886 - DNA, 19 bp, Homo sapiens
ccagtataagatttttgaa

SEQ ID NO: 6888887 - DNA, 17 bp, Homo sapiens
ctcgagcgccctgcaga

SEQ ID NO: 6888888 - DNA, 22 bp, Homo sapiens
tccctggctgtgagcagcctcc

SEQ ID NO: 6888889 - DNA, 19 bp, Homo sapiens
cccgtcccatatcctgcct

SEQ ID NO: 6888890 - DNA, 17 bp, Homo sapiens
catcagaaacaccctca

SEQ ID NO: 6888891 - DNA, 17 bp, Homo sapiens
tggcctcagctgcctca

SEQ ID NO: 6888892 - DNA, 19 bp, Homo sapiens
tgacagctggtccctgcct

SEQ ID NO: 6888893 - DNA, 23 bp, Homo sapiens
tgaactgagaaggcaggcctccg

SEQ ID NO: 6888894 - DNA, 13 bp, Homo sapiens
aggttccctttga

SEQ ID NO: 6888895 - DNA, 14 bp, Homo sapiens
acccccattgtgaa

SEQ ID NO: 6888896 - DNA, 18 bp, Homo sapiens
atgtctggtgtttgtcat

SEQ ID NO: 6888897 - DNA, 16 bp, Homo sapiens
gcatcctctggagcca

SEQ ID NO: 6888898 - DNA, 22 bp, Homo sapiens
agtgctggctccacgccctggg

SEQ ID NO: 6888899 - DNA, 16 bp, Homo sapiens
ctctgatagactttgt

SEQ ID NO: 6888900 - DNA, 14 bp, Homo sapiens
cacagaccctgccc

SEQ ID NO: 6888901 - DNA, 16 bp, Homo sapiens
ccaaggggcagtctgg

SEQ ID NO: 6888902 - DNA, 13 bp, Homo sapiens
catggctgtctgc

SEQ ID NO: 6888903 - DNA, 21 bp, Homo sapiens
cttacccatctctctactgct

SEQ ID NO: 6888904 - DNA, 22 bp, Homo sapiens
ccatgcccgagtccgcccatcc

SEQ ID NO: 6888905 - DNA, 17 bp, Homo sapiens
tggattgacagtaactt

SEQ ID NO: 6888906 - DNA, 15 bp, Homo sapiens
cagtcaaatctgggc

SEQ ID NO: 6888907 - DNA, 15 bp, Homo sapiens
ccttccccccatctc

SEQ ID NO: 6888908 - DNA, 17 bp, Homo sapiens
atattaaaatatggcta

SEQ ID NO: 6888909 - DNA, 22 bp, Homo sapiens
tgatcccgttttccccatgaca

SEQ ID NO: 6888910 - DNA, 16 bp, Homo sapiens
tgcccagggctcagcc

SEQ ID NO: 6888911 - DNA, 12 bp, Homo sapiens
catagcctatat

SEQ ID NO: 6888912 - DNA, 15 bp, Homo sapiens
actctcttcttctca

SEQ ID NO: 6888913 - DNA, 17 bp, Homo sapiens
ttccactcccactgcca

SEQ ID NO: 6888914 - DNA, 14 bp, Homo sapiens
actaataattgcag

SEQ ID NO: 6888915 - DNA, 16 bp, Homo sapiens
aatgtgaaatgctttt

SEQ ID NO: 6888916 - DNA, 13 bp, Homo sapiens
agctgcctctgct

SEQ ID NO: 6888917 - DNA, 21 bp, Homo sapiens
taaaataattatataactgta

SEQ ID NO: 6888918 - DNA, 20 bp, Homo sapiens
cagataaatagaactatctg

SEQ ID NO: 6888919 - DNA, 16 bp, Homo sapiens
cctcctgttcctgcct

SEQ ID NO: 6888920 - DNA, 23 bp, Homo sapiens
cagtgccaaggacctcctcttcc

SEQ ID NO: 6888921 - DNA, 11 bp, Homo sapiens
cctctcttccc

SEQ ID NO: 6888922 - DNA, 19 bp, Homo sapiens
catgggagccagctgcttt

SEQ ID NO: 6888923 - DNA, 15 bp, Homo sapiens
cctgcccgccctccc

SEQ ID NO: 6888924 - DNA, 17 bp, Homo sapiens
aactatcagggcaagct

SEQ ID NO: 6888925 - DNA, 20 bp, Homo sapiens
gactaaactatctgtattta

SEQ ID NO: 6888926 - DNA, 19 bp, Homo sapiens
tcctgtggcaggcagcgcc

SEQ ID NO: 6888927 - DNA, 15 bp, Homo sapiens
cttcccgctcagccc

SEQ ID NO: 6888928 - DNA, 19 bp, Homo sapiens
cctctctgtttaccctccc

SEQ ID NO: 6888929 - DNA, 16 bp, Homo sapiens
ttcctttgtgtttata

SEQ ID NO: 6888930 - DNA, 21 bp, Homo sapiens
aggaagaaaccccaagcagca

SEQ ID NO: 6888931 - DNA, 14 bp, Homo sapiens
ctcagccctggagg

SEQ ID NO: 6888932 - DNA, 12 bp, Homo sapiens
ccctccctgcca

SEQ ID NO: 6888933 - DNA, 20 bp, Homo sapiens
cttcctttctctttctctct

SEQ ID NO: 6888934 - DNA, 19 bp, Homo sapiens
caatgtggacgtgcactga

SEQ ID NO: 6888935 - DNA, 20 bp, Homo sapiens
ataacagggtaaattattca

SEQ ID NO: 6888936 - DNA, 19 bp, Homo sapiens
acttatctgatcttcctca

SEQ ID NO: 6888937 - DNA, 17 bp, Homo sapiens
gatttgcgtggaaatct

SEQ ID NO: 6888938 - DNA, 16 bp, Homo sapiens
ccgagctggtgcatta

SEQ ID NO: 6888939 - DNA, 21 bp, Homo sapiens
ggtcccgcttagttcttgaat

SEQ ID NO: 6888940 - DNA, 15 bp, Homo sapiens
ttccagtgtctgtct

SEQ ID NO: 6888941 - DNA, 19 bp, Homo sapiens
aggaaggtctcatgcctga

SEQ ID NO: 6888942 - DNA, 18 bp, Homo sapiens
gccatgggagagtccagg

SEQ ID NO: 6888943 - DNA, 15 bp, Homo sapiens
acagattggatttta

SEQ ID NO: 6888944 - DNA, 15 bp, Homo sapiens
ccatttcccacttcc

SEQ ID NO: 6888945 - DNA, 12 bp, Homo sapiens
taattgtgtaca

SEQ ID NO: 6888946 - DNA, 19 bp, Homo sapiens
ccatgcccacgcccctccc

SEQ ID NO: 6888947 - DNA, 14 bp, Homo sapiens
tctagaatcctgct

SEQ ID NO: 6888948 - DNA, 14 bp, Homo sapiens
agcttcttctgccc

SEQ ID NO: 6888949 - DNA, 14 bp, Homo sapiens
tggaccttcctgcc

SEQ ID NO: 6888950 - DNA, 16 bp, Homo sapiens
tggaatcacctggagg

SEQ ID NO: 6888951 - DNA, 14 bp, Homo sapiens
agctgcaaagtgtt

SEQ ID NO: 6888952 - DNA, 21 bp, Homo sapiens
ccacaaggtccactccctgct

SEQ ID NO: 6888953 - DNA, 20 bp, Homo sapiens
cctttgcatcgtcccctccc

SEQ ID NO: 6888954 - DNA, 22 bp, Homo sapiens
tgcacgcaggcacagcagctgc

SEQ ID NO: 6888955 - DNA, 18 bp, Homo sapiens
cttcctcaagtcttgaca

SEQ ID NO: 6888956 - DNA, 21 bp, Homo sapiens
ctgtactgctcaggctgcagc

SEQ ID NO: 6888957 - DNA, 15 bp, Homo sapiens
cttcagccctggcca

SEQ ID NO: 6888958 - DNA, 20 bp, Homo sapiens
cctcggtggcatttgctgaa

SEQ ID NO: 6888959 - DNA, 16 bp, Homo sapiens
tgtgcaagtcttgtca

SEQ ID NO: 6888960 - DNA, 15 bp, Homo sapiens
agtgggacagcccag

SEQ ID NO: 6888961 - DNA, 23 bp, Homo sapiens
caacatagtgggaccctgtctct

SEQ ID NO: 6888962 - DNA, 19 bp, Homo sapiens
ctcttcctaggccacgtcc

SEQ ID NO: 6888963 - DNA, 15 bp, Homo sapiens
catgcacagctgctt

SEQ ID NO: 6888964 - DNA, 15 bp, Homo sapiens
ggtatcctccctgcc

SEQ ID NO: 6888965 - DNA, 22 bp, Homo sapiens
cacagcctttcgttctgctgac

SEQ ID NO: 6888966 - DNA, 11 bp, Homo sapiens
ctcctccctct

SEQ ID NO: 6888967 - DNA, 11 bp, Homo sapiens
cacctgttact

SEQ ID NO: 6888968 - DNA, 15 bp, Homo sapiens
tctttcttggtgcat

SEQ ID NO: 6888969 - DNA, 17 bp, Homo sapiens
ccaggagcagcagccag

SEQ ID NO: 6888970 - DNA, 13 bp, Homo sapiens
ctctttctctgcc

SEQ ID NO: 6888971 - DNA, 14 bp, Homo sapiens
gatcctgagccaga

SEQ ID NO: 6888972 - DNA, 16 bp, Homo sapiens
cctcggatccccttcc

SEQ ID NO: 6888973 - DNA, 15 bp, Homo sapiens
acctccccctgctgc

SEQ ID NO: 6888974 - DNA, 16 bp, Homo sapiens
tctgttttctacctcc

SEQ ID NO: 6888975 - DNA, 16 bp, Homo sapiens
cagtgggctgtttctg

SEQ ID NO: 6888976 - DNA, 19 bp, Homo sapiens
tccatctcaacctacctcg

SEQ ID NO: 6888977 - DNA, 23 bp, Homo sapiens
cagccttgtaaatgggaaaatat

SEQ ID NO: 6888978 - DNA, 21 bp, Homo sapiens
atctgaagccacctctctgcc

SEQ ID NO: 6888979 - DNA, 15 bp, Homo sapiens
ctgcagcctctgcct

SEQ ID NO: 6888980 - DNA, 16 bp, Homo sapiens
cactgcccaccaaagg

SEQ ID NO: 6888981 - DNA, 18 bp, Homo sapiens
tgccaccctctccatgcc

SEQ ID NO: 6888982 - DNA, 15 bp, Homo sapiens
ctgcactgactctgg

SEQ ID NO: 6888983 - DNA, 17 bp, Homo sapiens
tgcttagatttctagca

SEQ ID NO: 6888984 - DNA, 14 bp, Homo sapiens
tattggtgctttgt

SEQ ID NO: 6888985 - DNA, 18 bp, Homo sapiens
cattctcctgcctcagcc

SEQ ID NO: 6888986 - DNA, 19 bp, Homo sapiens
cctggcaggtcccctgccc

SEQ ID NO: 6888987 - DNA, 15 bp, Homo sapiens
gctctaagcccagga

SEQ ID NO: 6888988 - DNA, 18 bp, Homo sapiens
cccagagagaccctgcca

SEQ ID NO: 6888989 - DNA, 22 bp, Homo sapiens
ataagattccaaaaagcacata

SEQ ID NO: 6888990 - DNA, 11 bp, Homo sapiens
atttggtgcta

SEQ ID NO: 6888991 - DNA, 18 bp, Homo sapiens
caccagcatcacctgcct

SEQ ID NO: 6888992 - DNA, 14 bp, Homo sapiens
caataaattttgaa

SEQ ID NO: 6888993 - DNA, 19 bp, Homo sapiens
attgtctgtctacatttct

SEQ ID NO: 6888994 - DNA, 23 bp, Homo sapiens
cctttcctacatgccccctccct

SEQ ID NO: 6888995 - DNA, 20 bp, Homo sapiens
cactgggcttggggaccaga

SEQ ID NO: 6888996 - DNA, 14 bp, Homo sapiens
agtctggcctgcca

SEQ ID NO: 6888997 - DNA, 19 bp, Homo sapiens
aatggcgtctgctctggtg

SEQ ID NO: 6888998 - DNA, 22 bp, Homo sapiens
gtaatgttttgtatatacagtt

SEQ ID NO: 6888999 - DNA, 16 bp, Homo sapiens
cttccaagcccttccc

SEQ ID NO: 6889000 - DNA, 14 bp, Homo sapiens
attctgcctctcct

SEQ ID NO: 6889001 - DNA, 19 bp, Homo sapiens
ctacaatgtgaactttatt

SEQ ID NO: 6889002 - DNA, 19 bp, Homo sapiens
ctaccccccgtctcctgcc

SEQ ID NO: 6889003 - DNA, 15 bp, Homo sapiens
catttgcagctgctg

SEQ ID NO: 6889004 - DNA, 13 bp, Homo sapiens
accagcctgtcac

SEQ ID NO: 6889005 - DNA, 21 bp, Homo sapiens
ctttctgccagggatggcagt

SEQ ID NO: 6889006 - DNA, 17 bp, Homo sapiens
cctccctagcccttcca

SEQ ID NO: 6889007 - DNA, 14 bp, Homo sapiens
cattatcatgtgta

SEQ ID NO: 6889008 - DNA, 23 bp, Homo sapiens
cgtgatccgcctgcctctgcctc

SEQ ID NO: 6889009 - DNA, 16 bp, Homo sapiens
agcagcttcaccagag

SEQ ID NO: 6889010 - DNA, 15 bp, Homo sapiens
cttgctgctgtgcct

SEQ ID NO: 6889011 - DNA, 19 bp, Homo sapiens
gctgtcagccctgctgtca

SEQ ID NO: 6889012 - DNA, 17 bp, Homo sapiens
tgactctggaccatgct

SEQ ID NO: 6889013 - DNA, 20 bp, Homo sapiens
catagaacaggacctctgct

SEQ ID NO: 6889014 - DNA, 15 bp, Homo sapiens
gcctcagctgcctca

SEQ ID NO: 6889015 - DNA, 11 bp, Homo sapiens
agactcagcca

SEQ ID NO: 6889016 - DNA, 23 bp, Homo sapiens
tatccttggagagcagctggctc

SEQ ID NO: 6889017 - DNA, 16 bp, Homo sapiens
agacagtgtatgtaga

SEQ ID NO: 6889018 - DNA, 18 bp, Homo sapiens
acgcaactcacacctcct

SEQ ID NO: 6889019 - DNA, 23 bp, Homo sapiens
cggtctcccttccgtccatcccc

SEQ ID NO: 6889020 - DNA, 22 bp, Homo sapiens
aggattttagctaggatttgaa

SEQ ID NO: 6889021 - DNA, 21 bp, Homo sapiens
agagccacctgcaagatggac

SEQ ID NO: 6889022 - DNA, 15 bp, Homo sapiens
tgtaaagcccttgca

SEQ ID NO: 6889023 - DNA, 17 bp, Homo sapiens
atgaattcttcctctcc

SEQ ID NO: 6889024 - DNA, 18 bp, Homo sapiens
caggaggggtctgcctcc

SEQ ID NO: 6889025 - DNA, 14 bp, Homo sapiens
cagctgtttgtcat

SEQ ID NO: 6889026 - DNA, 13 bp, Homo sapiens
tcccagcactttg

SEQ ID NO: 6889027 - DNA, 12 bp, Homo sapiens
ccccctgtgcct

SEQ ID NO: 6889028 - DNA, 14 bp, Homo sapiens
cattctgcctgccc

SEQ ID NO: 6889029 - DNA, 21 bp, Homo sapiens
ccaccaaagctgcccactgtt

SEQ ID NO: 6889030 - DNA, 16 bp, Homo sapiens
tctccaaatcttgcca

SEQ ID NO: 6889031 - DNA, 16 bp, Homo sapiens
ccggctccaggctcct

SEQ ID NO: 6889032 - DNA, 22 bp, Homo sapiens
tatgagaaatacagtgctttat

SEQ ID NO: 6889033 - DNA, 14 bp, Homo sapiens
agcgcccaggcctg

SEQ ID NO: 6889034 - DNA, 14 bp, Homo sapiens
gcatgggccaccac

SEQ ID NO: 6889035 - DNA, 14 bp, Homo sapiens
ccctttccttgcct

SEQ ID NO: 6889036 - DNA, 13 bp, Homo sapiens
agttaatgaaata

SEQ ID NO: 6889037 - DNA, 17 bp, Homo sapiens
ctacagctggggtgcag

SEQ ID NO: 6889038 - DNA, 21 bp, Homo sapiens
gacatcacagcagaatgaaga

SEQ ID NO: 6889039 - DNA, 23 bp, Homo sapiens
ccccactactcaatactacctct

SEQ ID NO: 6889040 - DNA, 20 bp, Homo sapiens
tccccaccagagctgcctcc

SEQ ID NO: 6889041 - DNA, 17 bp, Homo sapiens
agtctttcatgtgtgcc

SEQ ID NO: 6889042 - DNA, 21 bp, Homo sapiens
agctgagttaggtgtctgtcc

SEQ ID NO: 6889043 - DNA, 16 bp, Homo sapiens
cctgccaccccttcct

SEQ ID NO: 6889044 - DNA, 14 bp, Homo sapiens
cttcaggctcttct

SEQ ID NO: 6889045 - DNA, 23 bp, Homo sapiens
gaaacccataggcccacacacag

SEQ ID NO: 6889046 - DNA, 23 bp, Homo sapiens
ttccttcctagaagcccctgtcg

SEQ ID NO: 6889047 - DNA, 15 bp, Homo sapiens
cacacacacacacaa

SEQ ID NO: 6889048 - DNA, 20 bp, Homo sapiens
aaattctgatgtttctgtga

SEQ ID NO: 6889049 - DNA, 18 bp, Homo sapiens
tctgcttttcctgtctgt

SEQ ID NO: 6889050 - DNA, 20 bp, Homo sapiens
ttctttatactctcttccct

SEQ ID NO: 6889051 - DNA, 12 bp, Homo sapiens
ttgcctggctgt

SEQ ID NO: 6889052 - DNA, 21 bp, Homo sapiens
accagcaggctcctcagccct

SEQ ID NO: 6889053 - DNA, 18 bp, Homo sapiens
ctctcgggctctctcacc

SEQ ID NO: 6889054 - DNA, 21 bp, Homo sapiens
gacaaaaacaagactgcctcc

SEQ ID NO: 6889055 - DNA, 21 bp, Homo sapiens
ccctttcccatcaccccttcc

SEQ ID NO: 6889056 - DNA, 23 bp, Homo sapiens
ctgagattctgggaaaggtgctc

SEQ ID NO: 6889057 - DNA, 20 bp, Homo sapiens
ccaccacacacacccttccc

SEQ ID NO: 6889058 - DNA, 20 bp, Homo sapiens
agttgccccgtctctgttcc

SEQ ID NO: 6889059 - DNA, 22 bp, Homo sapiens
cttcctgggcacacgctgctct

SEQ ID NO: 6889060 - DNA, 18 bp, Homo sapiens
aggagattaacacactga

SEQ ID NO: 6889061 - DNA, 17 bp, Homo sapiens
gccttggtatgtgccag

SEQ ID NO: 6889062 - DNA, 20 bp, Homo sapiens
atccagtgtgagatactgtg

SEQ ID NO: 6889063 - DNA, 21 bp, Homo sapiens
cagaccccccagcccctcctc

SEQ ID NO: 6889064 - DNA, 14 bp, Homo sapiens
gaaatcactgtgaa

SEQ ID NO: 6889065 - DNA, 19 bp, Homo sapiens
ttaaaatgattgaaaataa

SEQ ID NO: 6889066 - DNA, 16 bp, Homo sapiens
aaacactggtgccaac

SEQ ID NO: 6889067 - DNA, 21 bp, Homo sapiens
tgacagcatgtgccctcctga

SEQ ID NO: 6889068 - DNA, 17 bp, Homo sapiens
gatcagagctgcagcca

SEQ ID NO: 6889069 - DNA, 20 bp, Homo sapiens
tttacacagaaacactgcct

SEQ ID NO: 6889070 - DNA, 22 bp, Homo sapiens
acttccacaaaattatgctgca

SEQ ID NO: 6889071 - DNA, 21 bp, Homo sapiens
caggctgtaagcattctgagc

SEQ ID NO: 6889072 - DNA, 14 bp, Homo sapiens
aggccccagggaca

SEQ ID NO: 6889073 - DNA, 16 bp, Homo sapiens
cagtagctcttagact

SEQ ID NO: 6889074 - DNA, 16 bp, Homo sapiens
ccacagaccacctgct

SEQ ID NO: 6889075 - DNA, 17 bp, Homo sapiens
gacattcacctgcccca

SEQ ID NO: 6889076 - DNA, 22 bp, Homo sapiens
cctcatggcagcctactctcct

SEQ ID NO: 6889077 - DNA, 19 bp, Homo sapiens
tagctgtaagggcagtgcc

SEQ ID NO: 6889078 - DNA, 14 bp, Homo sapiens
aggtgatctcctgt

SEQ ID NO: 6889079 - DNA, 14 bp, Homo sapiens
cttgccacatttct

SEQ ID NO: 6889080 - DNA, 20 bp, Homo sapiens
cctgcccacctggcctctgc

SEQ ID NO: 6889081 - DNA, 20 bp, Homo sapiens
acccagaggtggccctccca

SEQ ID NO: 6889082 - DNA, 23 bp, Homo sapiens
ccatccccaccctgtcttccaca

SEQ ID NO: 6889083 - DNA, 17 bp, Homo sapiens
cttactttatctgggct

SEQ ID NO: 6889084 - DNA, 21 bp, Homo sapiens
ctattgcatgtaaaatgcagt

SEQ ID NO: 6889085 - DNA, 23 bp, Homo sapiens
acctgtctaggtctcctcagggt

SEQ ID NO: 6889086 - DNA, 22 bp, Homo sapiens
tattcaagaaagccagtcttaa

SEQ ID NO: 6889087 - DNA, 14 bp, Homo sapiens
gattctactttaag

SEQ ID NO: 6889088 - DNA, 17 bp, Homo sapiens
taaaccagaaaggtgat

SEQ ID NO: 6889089 - DNA, 18 bp, Homo sapiens
caatttcaaaatgcatgt

SEQ ID NO: 6889090 - DNA, 13 bp, Homo sapiens
aaatatactgtaa

SEQ ID NO: 6889091 - DNA, 20 bp, Homo sapiens
catcctgtgggacctgggcc

SEQ ID NO: 6889092 - DNA, 23 bp, Homo sapiens
tgggaaaacatatttgcaaatca

SEQ ID NO: 6889093 - DNA, 20 bp, Homo sapiens
cttaggtgatccactcgcct

SEQ ID NO: 6889094 - DNA, 20 bp, Homo sapiens
agcctcccaagtagctggga

SEQ ID NO: 6889095 - DNA, 15 bp, Homo sapiens
cttccgcccctgcct

SEQ ID NO: 6889096 - DNA, 16 bp, Homo sapiens
tggccactgctcccta

SEQ ID NO: 6889097 - DNA, 17 bp, Homo sapiens
caggcttgtggcagcct

SEQ ID NO: 6889098 - DNA, 15 bp, Homo sapiens
agttgtctctcttca

SEQ ID NO: 6889099 - DNA, 18 bp, Homo sapiens
ctccccagcccacctgct

SEQ ID NO: 6889100 - DNA, 14 bp, Homo sapiens
caattaaagacatt

SEQ ID NO: 6889101 - DNA, 17 bp, Homo sapiens
tcattgatttcctgtgt

SEQ ID NO: 6889102 - DNA, 18 bp, Homo sapiens
agttgtctattctgagcc

SEQ ID NO: 6889103 - DNA, 19 bp, Homo sapiens
gtatttgatgtacattaca

SEQ ID NO: 6889104 - DNA, 22 bp, Homo sapiens
gccctctcccctgccccctgca

SEQ ID NO: 6889105 - DNA, 16 bp, Homo sapiens
acattagtgagattta

SEQ ID NO: 6889106 - DNA, 21 bp, Homo sapiens
agagtcatctccatcagctgt

SEQ ID NO: 6889107 - DNA, 21 bp, Homo sapiens
catcaggtgatccacctgcct

SEQ ID NO: 6889108 - DNA, 22 bp, Homo sapiens
aggaaagcaccgcagcatgtgg

SEQ ID NO: 6889109 - DNA, 21 bp, Homo sapiens
aatttggtaaaaatgctgctc

SEQ ID NO: 6889110 - DNA, 18 bp, Homo sapiens
aagcatgaaatgtgaatt

SEQ ID NO: 6889111 - DNA, 17 bp, Homo sapiens
caggatagagactggaa

SEQ ID NO: 6889112 - DNA, 17 bp, Homo sapiens
tatcaaataatattcat

SEQ ID NO: 6889113 - DNA, 22 bp, Homo sapiens
cagccagtgccattccactcca

SEQ ID NO: 6889114 - DNA, 16 bp, Homo sapiens
cactgcggctgtctcc

SEQ ID NO: 6889115 - DNA, 21 bp, Homo sapiens
cttctgatggtgtcatctgct

SEQ ID NO: 6889116 - DNA, 14 bp, Homo sapiens
cagcgcctccctcc

SEQ ID NO: 6889117 - DNA, 21 bp, Homo sapiens
agggtctggcagagcctctga

SEQ ID NO: 6889118 - DNA, 21 bp, Homo sapiens
acagaaaacatcccactgact

SEQ ID NO: 6889119 - DNA, 19 bp, Homo sapiens
gcctgcgcctcctcctgca

SEQ ID NO: 6889120 - DNA, 16 bp, Homo sapiens
acgatgtggccctggc

SEQ ID NO: 6889121 - DNA, 20 bp, Homo sapiens
tgcactcatcatattttgtt

SEQ ID NO: 6889122 - DNA, 20 bp, Homo sapiens
gctagaaaatgaactgtata

SEQ ID NO: 6889123 - DNA, 13 bp, Homo sapiens
aactaaaattctg

SEQ ID NO: 6889124 - DNA, 14 bp, Homo sapiens
aatcagactatgaa

SEQ ID NO: 6889125 - DNA, 18 bp, Homo sapiens
caatttacaaagtgtgta

SEQ ID NO: 6889126 - DNA, 12 bp, Homo sapiens
caaagactctga

SEQ ID NO: 6889127 - DNA, 19 bp, Homo sapiens
agctgcatttcacatgcct

SEQ ID NO: 6889128 - DNA, 23 bp, Homo sapiens
agccgggtccggcctctccctgc

SEQ ID NO: 6889129 - DNA, 18 bp, Homo sapiens
tcctgcagacctggctgg

SEQ ID NO: 6889130 - DNA, 18 bp, Homo sapiens
cttaaaatacaagactgc

SEQ ID NO: 6889131 - DNA, 15 bp, Homo sapiens
gagatggcctgagaa

SEQ ID NO: 6889132 - DNA, 12 bp, Homo sapiens
gaatagcaatta

SEQ ID NO: 6889133 - DNA, 22 bp, Homo sapiens
atccctcccccccatgcactgt

SEQ ID NO: 6889134 - DNA, 22 bp, Homo sapiens
acccactaaagagtgaatgcca

SEQ ID NO: 6889135 - DNA, 10 bp, Homo sapiens
ccctgtccct

SEQ ID NO: 6889136 - DNA, 22 bp, Homo sapiens
tgtccccaacgtcccctccgcc

SEQ ID NO: 6889137 - DNA, 18 bp, Homo sapiens
tatggtagaaaaatttca

SEQ ID NO: 6889138 - DNA, 21 bp, Homo sapiens
tgtctctgtccctcactgcct

SEQ ID NO: 6889139 - DNA, 16 bp, Homo sapiens
agaagtcttcatgaaa

SEQ ID NO: 6889140 - DNA, 18 bp, Homo sapiens
tagttttgtcacaattat

SEQ ID NO: 6889141 - DNA, 15 bp, Homo sapiens
ctatattgtgccaag

SEQ ID NO: 6889142 - DNA, 18 bp, Homo sapiens
ctttcccaccctcctgcc

SEQ ID NO: 6889143 - DNA, 14 bp, Homo sapiens
ttgttgttctgcct

SEQ ID NO: 6889144 - DNA, 23 bp, Homo sapiens
ttaaaagaatatctggcaaatta

SEQ ID NO: 6889145 - DNA, 15 bp, Homo sapiens
gggccaggagaatct

SEQ ID NO: 6889146 - DNA, 18 bp, Homo sapiens
agaaaacagagcctgcct

SEQ ID NO: 6889147 - DNA, 13 bp, Homo sapiens
tctcatctgtgat

SEQ ID NO: 6889148 - DNA, 16 bp, Homo sapiens
aagttgttgactgtga

SEQ ID NO: 6889149 - DNA, 15 bp, Homo sapiens
aactcgatgcactga

SEQ ID NO: 6889150 - DNA, 21 bp, Homo sapiens
tctttctccttagtcttctca

SEQ ID NO: 6889151 - DNA, 21 bp, Homo sapiens
aatgtatcagccagccttccc

SEQ ID NO: 6889152 - DNA, 18 bp, Homo sapiens
caagtcccaccctcttcc

SEQ ID NO: 6889153 - DNA, 14 bp, Homo sapiens
cctccacccagccc

SEQ ID NO: 6889154 - DNA, 16 bp, Homo sapiens
atagactttgcctttt

SEQ ID NO: 6889155 - DNA, 15 bp, Homo sapiens
caacactcactgcct

SEQ ID NO: 6889156 - DNA, 19 bp, Homo sapiens
agactgggcacccctgcct

SEQ ID NO: 6889157 - DNA, 17 bp, Homo sapiens
attctgaatttgcaaag

SEQ ID NO: 6889158 - DNA, 13 bp, Homo sapiens
acaaatattattt

SEQ ID NO: 6889159 - DNA, 20 bp, Homo sapiens
tatttacagctgtgctccac

SEQ ID NO: 6889160 - DNA, 19 bp, Homo sapiens
cacactgtctggggcccca

SEQ ID NO: 6889161 - DNA, 15 bp, Homo sapiens
tgaaagttgccatta

SEQ ID NO: 6889162 - DNA, 16 bp, Homo sapiens
ctccagctgtcgtctg

SEQ ID NO: 6889163 - DNA, 12 bp, Homo sapiens
aactcctggcct

SEQ ID NO: 6889164 - DNA, 15 bp, Homo sapiens
tttgcttaacttcca

SEQ ID NO: 6889165 - DNA, 10 bp, Homo sapiens
gctgcttcca

SEQ ID NO: 6889166 - DNA, 17 bp, Homo sapiens
accgtggacaggcccag

SEQ ID NO: 6889167 - DNA, 15 bp, Homo sapiens
gatctttgagcccat

SEQ ID NO: 6889168 - DNA, 22 bp, Homo sapiens
agtctcattctgttgcccaggc

SEQ ID NO: 6889169 - DNA, 23 bp, Homo sapiens
tcacagagtgagactccatctca

SEQ ID NO: 6889170 - DNA, 14 bp, Homo sapiens
gcggatcctgctgg

SEQ ID NO: 6889171 - DNA, 19 bp, Homo sapiens
tacaatagtatacatttta

SEQ ID NO: 6889172 - DNA, 18 bp, Homo sapiens
actcccttctacctgcca

SEQ ID NO: 6889173 - DNA, 20 bp, Homo sapiens
cagcagagccgttcctggga

SEQ ID NO: 6889174 - DNA, 23 bp, Homo sapiens
ccaaagttttcaaactgctgcat

SEQ ID NO: 6889175 - DNA, 20 bp, Homo sapiens
cgctggcccccactggctgt

SEQ ID NO: 6889176 - DNA, 14 bp, Homo sapiens
cctgaactgggatg

SEQ ID NO: 6889177 - DNA, 17 bp, Homo sapiens
caagtcacacagctagt

SEQ ID NO: 6889178 - DNA, 22 bp, Homo sapiens
tcaaagctgagttacttgtctg

SEQ ID NO: 6889179 - DNA, 17 bp, Homo sapiens
actataaactactgtaa

SEQ ID NO: 6889180 - DNA, 11 bp, Homo sapiens
atgactttatt

SEQ ID NO: 6889181 - DNA, 14 bp, Homo sapiens
taatctactgtatc

SEQ ID NO: 6889182 - DNA, 18 bp, Homo sapiens
atttcctttatgtgaatt

SEQ ID NO: 6889183 - DNA, 20 bp, Homo sapiens
tccaagtccaacctgcctgt

SEQ ID NO: 6889184 - DNA, 18 bp, Homo sapiens
gcactgcattcctgtgcc

SEQ ID NO: 6889185 - DNA, 18 bp, Homo sapiens
gaacctctaagtgctgct

SEQ ID NO: 6889186 - DNA, 16 bp, Homo sapiens
tccctccactaccgct

SEQ ID NO: 6889187 - DNA, 15 bp, Homo sapiens
tacctccctccctct

SEQ ID NO: 6889188 - DNA, 18 bp, Homo sapiens
ttcatacctaagtactgt

SEQ ID NO: 6889189 - DNA, 18 bp, Homo sapiens
ctacacattgctacctca

SEQ ID NO: 6889190 - DNA, 19 bp, Homo sapiens
aggcccttttctggctcct

SEQ ID NO: 6889191 - DNA, 18 bp, Homo sapiens
ccagcccctcctccctca

SEQ ID NO: 6889192 - DNA, 22 bp, Homo sapiens
aaatgctatggaaatacattta

SEQ ID NO: 6889193 - DNA, 15 bp, Homo sapiens
actctgccctctgct

SEQ ID NO: 6889194 - DNA, 20 bp, Homo sapiens
accacagcctccccttccca

SEQ ID NO: 6889195 - DNA, 19 bp, Homo sapiens
cactttcagtgaaagcatc

SEQ ID NO: 6889196 - DNA, 17 bp, Homo sapiens
tcgtgttcgctggctga

SEQ ID NO: 6889197 - DNA, 15 bp, Homo sapiens
gatgaaaagccatat

SEQ ID NO: 6889198 - DNA, 14 bp, Homo sapiens
agctgtactcagag

SEQ ID NO: 6889199 - DNA, 23 bp, Homo sapiens
aatcaaaacacactactacctct

SEQ ID NO: 6889200 - DNA, 15 bp, Homo sapiens
cctcctctccctccc

SEQ ID NO: 6889201 - DNA, 16 bp, Homo sapiens
cactgaagagctcttg

SEQ ID NO: 6889202 - DNA, 14 bp, Homo sapiens
cgagagtctgtctc

SEQ ID NO: 6889203 - DNA, 12 bp, Homo sapiens
cccttctgcttt

SEQ ID NO: 6889204 - DNA, 16 bp, Homo sapiens
tcatcattgttgtgta

SEQ ID NO: 6889205 - DNA, 16 bp, Homo sapiens
agaaagccatattttt

SEQ ID NO: 6889206 - DNA, 20 bp, Homo sapiens
ctccctggctgccctggccc

SEQ ID NO: 6889207 - DNA, 14 bp, Homo sapiens
agatctgtcctggg

SEQ ID NO: 6889208 - DNA, 15 bp, Homo sapiens
tggaccagcctctcc

SEQ ID NO: 6889209 - DNA, 20 bp, Homo sapiens
tgttgttaatgaaaatgtca

SEQ ID NO: 6889210 - DNA, 13 bp, Homo sapiens
ctagtcagtgtag

SEQ ID NO: 6889211 - DNA, 13 bp, Homo sapiens
acaactattttca

SEQ ID NO: 6889212 - DNA, 16 bp, Homo sapiens
ctatttcagaatattt

SEQ ID NO: 6889213 - DNA, 21 bp, Homo sapiens
caaaacaaacaacctgccaca

SEQ ID NO: 6889214 - DNA, 23 bp, Homo sapiens
cttcagctgcatttcacatgcct

SEQ ID NO: 6889215 - DNA, 15 bp, Homo sapiens
tacaaggactttcca

SEQ ID NO: 6889216 - DNA, 20 bp, Homo sapiens
cactctaaaaggttcaggga

SEQ ID NO: 6889217 - DNA, 21 bp, Homo sapiens
ctattttacttttctgccaaa

SEQ ID NO: 6889218 - DNA, 20 bp, Homo sapiens
cagccatttccccctcctca

SEQ ID NO: 6889219 - DNA, 22 bp, Homo sapiens
cagggcaaatgacatgcactga

SEQ ID NO: 6889220 - DNA, 21 bp, Homo sapiens
aaatattgttgacaactgtga

SEQ ID NO: 6889221 - DNA, 15 bp, Homo sapiens
tgagaaacagctcag

SEQ ID NO: 6889222 - DNA, 16 bp, Homo sapiens
gtaagagcttgctcca

SEQ ID NO: 6889223 - DNA, 19 bp, Homo sapiens
cactgcaccccctcctgct

SEQ ID NO: 6889224 - DNA, 15 bp, Homo sapiens
atccgcccacctcag

SEQ ID NO: 6889225 - DNA, 18 bp, Homo sapiens
tacctttttgtatgtgaa

SEQ ID NO: 6889226 - DNA, 18 bp, Homo sapiens
agagaactgtcaccctga

SEQ ID NO: 6889227 - DNA, 22 bp, Homo sapiens
gtcaggcacgtctcctgctgcg

SEQ ID NO: 6889228 - DNA, 16 bp, Homo sapiens
gtttcttattcccccc

SEQ ID NO: 6889229 - DNA, 17 bp, Homo sapiens
atacctgggatactgtg

SEQ ID NO: 6889230 - DNA, 15 bp, Homo sapiens
accagcttccttcag

SEQ ID NO: 6889231 - DNA, 16 bp, Homo sapiens
agtaacgtgctgctca

SEQ ID NO: 6889232 - DNA, 23 bp, Homo sapiens
ctccacagcgagggcagctgcta

SEQ ID NO: 6889233 - DNA, 16 bp, Homo sapiens
ccacttgtttgcactg

SEQ ID NO: 6889234 - DNA, 21 bp, Homo sapiens
aaggcctatgccacctgcagc

SEQ ID NO: 6889235 - DNA, 16 bp, Homo sapiens
ttcagattgtcttgca

SEQ ID NO: 6889236 - DNA, 12 bp, Homo sapiens
aggttgtgaatg

SEQ ID NO: 6889237 - DNA, 14 bp, Homo sapiens
ctgccatcatgcct

SEQ ID NO: 6889238 - DNA, 15 bp, Homo sapiens
ctgtctgtcctaccc

SEQ ID NO: 6889239 - DNA, 19 bp, Homo sapiens
cagttaggctagagacaga

SEQ ID NO: 6889240 - DNA, 13 bp, Homo sapiens
ctttccttcctcc

SEQ ID NO: 6889241 - DNA, 16 bp, Homo sapiens
ctttattttgtgtaaa

SEQ ID NO: 6889242 - DNA, 23 bp, Homo sapiens
ctttgccttccacgctgtctcca

SEQ ID NO: 6889243 - DNA, 20 bp, Homo sapiens
gtgactccagcctgccctca

SEQ ID NO: 6889244 - DNA, 13 bp, Homo sapiens
ctccgtcactcca

SEQ ID NO: 6889245 - DNA, 20 bp, Homo sapiens
ctgtgaaccctggggcctga

SEQ ID NO: 6889246 - DNA, 17 bp, Homo sapiens
cccagagacctttgccc

SEQ ID NO: 6889247 - DNA, 20 bp, Homo sapiens
ccttcgtgacaatgtttaca

SEQ ID NO: 6889248 - DNA, 16 bp, Homo sapiens
tcgattcaaactgctc

SEQ ID NO: 6889249 - DNA, 19 bp, Homo sapiens
aaatacacgtgtatatgag

SEQ ID NO: 6889250 - DNA, 17 bp, Homo sapiens
tgcccccttctcccaca

SEQ ID NO: 6889251 - DNA, 23 bp, Homo sapiens
acagatcccatccatcagctccc

SEQ ID NO: 6889252 - DNA, 14 bp, Homo sapiens
ctgggcctgtctca

SEQ ID NO: 6889253 - DNA, 22 bp, Homo sapiens
ttacagtaaataaattgtttga

SEQ ID NO: 6889254 - DNA, 19 bp, Homo sapiens
cctccagcaatgcctgcct

SEQ ID NO: 6889255 - DNA, 15 bp, Homo sapiens
aaatagatttagtct

SEQ ID NO: 6889256 - DNA, 17 bp, Homo sapiens
ctgttatgtactgtact

SEQ ID NO: 6889257 - DNA, 20 bp, Homo sapiens
caccatccctttttgaagtg

SEQ ID NO: 6889258 - DNA, 18 bp, Homo sapiens
tctacaccaattaatgta

SEQ ID NO: 6889259 - DNA, 17 bp, Homo sapiens
ctttttcctccctttcc

SEQ ID NO: 6889260 - DNA, 18 bp, Homo sapiens
tgttccagtcacattgcc

SEQ ID NO: 6889261 - DNA, 13 bp, Homo sapiens
aggcacctgctgg

SEQ ID NO: 6889262 - DNA, 17 bp, Homo sapiens
ctcttaccttcccgcct

SEQ ID NO: 6889263 - DNA, 16 bp, Homo sapiens
tctgtccgtctgtcct

SEQ ID NO: 6889264 - DNA, 16 bp, Homo sapiens
gctcgggtgcccagga

SEQ ID NO: 6889265 - DNA, 14 bp, Homo sapiens
agccttcctcctca

SEQ ID NO: 6889266 - DNA, 22 bp, Homo sapiens
agcatgcacatgctgtctggcc

SEQ ID NO: 6889267 - DNA, 16 bp, Homo sapiens
gacagtgcctcttcca

SEQ ID NO: 6889268 - DNA, 13 bp, Homo sapiens
aatgtttactgta

SEQ ID NO: 6889269 - DNA, 20 bp, Homo sapiens
tacttcccagtataagattt

SEQ ID NO: 6889270 - DNA, 21 bp, Homo sapiens
tacatatgtgctggaattcta

SEQ ID NO: 6889271 - DNA, 18 bp, Homo sapiens
ctacctggggactcctca

SEQ ID NO: 6889272 - DNA, 19 bp, Homo sapiens
aggagcccccaacacaggc

SEQ ID NO: 6889273 - DNA, 20 bp, Homo sapiens
aagctcaagatgacagctct

SEQ ID NO: 6889274 - DNA, 16 bp, Homo sapiens
ttcacagagcacgcct

SEQ ID NO: 6889275 - DNA, 19 bp, Homo sapiens
atatgtttcaccctgtccc

SEQ ID NO: 6889276 - DNA, 15 bp, Homo sapiens
caaatcctatgtgat

SEQ ID NO: 6889277 - DNA, 20 bp, Homo sapiens
attatgcccagtttctgcct

SEQ ID NO: 6889278 - DNA, 18 bp, Homo sapiens
gaactcctgtgtgtggaa

SEQ ID NO: 6889279 - DNA, 23 bp, Homo sapiens
ccaacagcgacatagcccatccc

SEQ ID NO: 6889280 - DNA, 15 bp, Homo sapiens
ccttcctccccgcct

SEQ ID NO: 6889281 - DNA, 13 bp, Homo sapiens
tcaacctccctgg

SEQ ID NO: 6889282 - DNA, 23 bp, Homo sapiens
gcactgagacccccatggtaatg

SEQ ID NO: 6889283 - DNA, 23 bp, Homo sapiens
tgggtccaggaaggcagctgctc

SEQ ID NO: 6889284 - DNA, 14 bp, Homo sapiens
cctacctccctccc

SEQ ID NO: 6889285 - DNA, 23 bp, Homo sapiens
ttatttgaggagataacatttca

SEQ ID NO: 6889286 - DNA, 21 bp, Homo sapiens
gaaccctggggcctgactgct

SEQ ID NO: 6889287 - DNA, 15 bp, Homo sapiens
cttctgcttgtccca

SEQ ID NO: 6889288 - DNA, 17 bp, Homo sapiens
tatatccagttcctgct

SEQ ID NO: 6889289 - DNA, 13 bp, Homo sapiens
ctcagcactgcct

SEQ ID NO: 6889290 - DNA, 12 bp, Homo sapiens
agacctcagcct

SEQ ID NO: 6889291 - DNA, 18 bp, Homo sapiens
cctgggtatcccctgcct

SEQ ID NO: 6889292 - DNA, 18 bp, Homo sapiens
cctctcctgacccctgcc

SEQ ID NO: 6889293 - DNA, 15 bp, Homo sapiens
ctgttcgctcctccc

SEQ ID NO: 6889294 - DNA, 15 bp, Homo sapiens
cccaagaccctgccc

SEQ ID NO: 6889295 - DNA, 17 bp, Homo sapiens
tttgtgtggtatgtcac

SEQ ID NO: 6889296 - DNA, 13 bp, Homo sapiens
ccactccagccct

SEQ ID NO: 6889297 - DNA, 15 bp, Homo sapiens
ctctgcctctcttct

SEQ ID NO: 6889298 - DNA, 18 bp, Homo sapiens
atgaatctctgcctctcc

SEQ ID NO: 6889299 - DNA, 13 bp, Homo sapiens
tgtaagatttgtt

SEQ ID NO: 6889300 - DNA, 21 bp, Homo sapiens
cagtgatacatgtactccaga

SEQ ID NO: 6889301 - DNA, 18 bp, Homo sapiens
agcagatcgtgccgtgga

SEQ ID NO: 6889302 - DNA, 19 bp, Homo sapiens
tgaacaatcccctaacaca

SEQ ID NO: 6889303 - DNA, 22 bp, Homo sapiens
ctcccatggctttgtgctgctg

SEQ ID NO: 6889304 - DNA, 12 bp, Homo sapiens
cctctctcttct

SEQ ID NO: 6889305 - DNA, 23 bp, Homo sapiens
cttgactgaagcgaacatcttca

SEQ ID NO: 6889306 - DNA, 15 bp, Homo sapiens
aagacatcaatgaaa

SEQ ID NO: 6889307 - DNA, 14 bp, Homo sapiens
cacgtgacacaaac

SEQ ID NO: 6889308 - DNA, 23 bp, Homo sapiens
cacgtggcctctctctctctcct

SEQ ID NO: 6889309 - DNA, 22 bp, Homo sapiens
catacttacctagtgaaacttt

SEQ ID NO: 6889310 - DNA, 13 bp, Homo sapiens
gcccgcctctgcc

SEQ ID NO: 6889311 - DNA, 15 bp, Homo sapiens
aggaaatcaccgaaa

SEQ ID NO: 6889312 - DNA, 13 bp, Homo sapiens
tcctccagctcct

SEQ ID NO: 6889313 - DNA, 18 bp, Homo sapiens
cttccttgcccctgctct

SEQ ID NO: 6889314 - DNA, 17 bp, Homo sapiens
atcccttcctctcccat

SEQ ID NO: 6889315 - DNA, 18 bp, Homo sapiens
tcctgcccaggactgcat

SEQ ID NO: 6889316 - DNA, 15 bp, Homo sapiens
agcagttctcccacc

SEQ ID NO: 6889317 - DNA, 17 bp, Homo sapiens
cgcttcacccctgcact

SEQ ID NO: 6889318 - DNA, 14 bp, Homo sapiens
ctgccacctggacc

SEQ ID NO: 6889319 - DNA, 13 bp, Homo sapiens
cagtgactccagg

SEQ ID NO: 6889320 - DNA, 22 bp, Homo sapiens
actctgtgtcagcatctttgcc

SEQ ID NO: 6889321 - DNA, 22 bp, Homo sapiens
gcgatggctgtcttttcttgac

SEQ ID NO: 6889322 - DNA, 21 bp, Homo sapiens
catttctcaatcagtgcagtg

SEQ ID NO: 6889323 - DNA, 21 bp, Homo sapiens
gtgccacgcgctctgcatgct

SEQ ID NO: 6889324 - DNA, 21 bp, Homo sapiens
actgttctctattagacttta

SEQ ID NO: 6889325 - DNA, 16 bp, Homo sapiens
aacctacctgtgaatc

SEQ ID NO: 6889326 - DNA, 13 bp, Homo sapiens
tgcataatgcaat

SEQ ID NO: 6889327 - DNA, 18 bp, Homo sapiens
caggctgttctgcactga

SEQ ID NO: 6889328 - DNA, 19 bp, Homo sapiens
catgtgcgtttcatgtgtt

SEQ ID NO: 6889329 - DNA, 16 bp, Homo sapiens
tgttcaccttatgtat

SEQ ID NO: 6889330 - DNA, 14 bp, Homo sapiens
acagtccctcctgt

SEQ ID NO: 6889331 - DNA, 14 bp, Homo sapiens
gcctgggccacacc

SEQ ID NO: 6889332 - DNA, 17 bp, Homo sapiens
ccaggagaccctgtctt

SEQ ID NO: 6889333 - DNA, 20 bp, Homo sapiens
cctgtccctgtccccctccc

SEQ ID NO: 6889334 - DNA, 23 bp, Homo sapiens
ctttaccaaatgaaatgccaaag

SEQ ID NO: 6889335 - DNA, 15 bp, Homo sapiens
cctgaccaccctccc

SEQ ID NO: 6889336 - DNA, 14 bp, Homo sapiens
actcaaactgagga

SEQ ID NO: 6889337 - DNA, 15 bp, Homo sapiens
cctccgggtcttcct

SEQ ID NO: 6889338 - DNA, 14 bp, Homo sapiens
catcctcctcagcc

SEQ ID NO: 6889339 - DNA, 22 bp, Homo sapiens
atgccttccgacaccactggga

SEQ ID NO: 6889340 - DNA, 20 bp, Homo sapiens
taaactggcttaacttagta

SEQ ID NO: 6889341 - DNA, 14 bp, Homo sapiens
gaatgtattctgta

SEQ ID NO: 6889342 - DNA, 18 bp, Homo sapiens
cgtcactgcccaccaaag

SEQ ID NO: 6889343 - DNA, 19 bp, Homo sapiens
cttcccctgcacctggcct

SEQ ID NO: 6889344 - DNA, 20 bp, Homo sapiens
aacagctcttcactcagcca

SEQ ID NO: 6889345 - DNA, 12 bp, Homo sapiens
cctgcctgctgg

SEQ ID NO: 6889346 - DNA, 17 bp, Homo sapiens
aatcatagttactgtgt

SEQ ID NO: 6889347 - DNA, 14 bp, Homo sapiens
cccacaccccgtct

SEQ ID NO: 6889348 - DNA, 18 bp, Homo sapiens
ctgctccacccttggcct

SEQ ID NO: 6889349 - DNA, 23 bp, Homo sapiens
aggagctttctcaatgtcttccc

SEQ ID NO: 6889350 - DNA, 23 bp, Homo sapiens
ctgtcccagggccctcccagccc

SEQ ID NO: 6889351 - DNA, 19 bp, Homo sapiens
aacatcccattgccctggt

SEQ ID NO: 6889352 - DNA, 13 bp, Homo sapiens
tagtgacatttaa

SEQ ID NO: 6889353 - DNA, 16 bp, Homo sapiens
ctgtcctgcctcctca

SEQ ID NO: 6889354 - DNA, 21 bp, Homo sapiens
gtactgatactattcaatgca

SEQ ID NO: 6889355 - DNA, 23 bp, Homo sapiens
catgccccacccccctcctcccc

SEQ ID NO: 6889356 - DNA, 21 bp, Homo sapiens
ctgttctgtggttcctctgct

SEQ ID NO: 6889357 - DNA, 23 bp, Homo sapiens
cttgtccaggttgatcttgaact

SEQ ID NO: 6889358 - DNA, 17 bp, Homo sapiens
caagtgcatttctgggc

SEQ ID NO: 6889359 - DNA, 22 bp, Homo sapiens
agactctttttgtacctggtga

SEQ ID NO: 6889360 - DNA, 13 bp, Homo sapiens
agttgtctttctt

SEQ ID NO: 6889361 - DNA, 17 bp, Homo sapiens
cttacccttctgtgccc

SEQ ID NO: 6889362 - DNA, 21 bp, Homo sapiens
agcccaggccaggactctgca

SEQ ID NO: 6889363 - DNA, 14 bp, Homo sapiens
caccactcctgcca

SEQ ID NO: 6889364 - DNA, 14 bp, Homo sapiens
ggcggccaggcaca

SEQ ID NO: 6889365 - DNA, 20 bp, Homo sapiens
actgctgcttaaaatgcaag

SEQ ID NO: 6889366 - DNA, 18 bp, Homo sapiens
tgcctcccctcctctgct

SEQ ID NO: 6889367 - DNA, 15 bp, Homo sapiens
cataatggttgtgaa

SEQ ID NO: 6889368 - DNA, 16 bp, Homo sapiens
agaatgatcatctgta

SEQ ID NO: 6889369 - DNA, 21 bp, Homo sapiens
tgccaaaaccaggcctctgct

SEQ ID NO: 6889370 - DNA, 15 bp, Homo sapiens
cagaaagatttggaa

SEQ ID NO: 6889371 - DNA, 16 bp, Homo sapiens
cgaagccccttggaga

SEQ ID NO: 6889372 - DNA, 14 bp, Homo sapiens
tagtagaaatgcca

SEQ ID NO: 6889373 - DNA, 20 bp, Homo sapiens
tggcaaacagggcctctgcg

SEQ ID NO: 6889374 - DNA, 17 bp, Homo sapiens
tgtctctgctcttgcct

SEQ ID NO: 6889375 - DNA, 14 bp, Homo sapiens
aaatttacatttat

SEQ ID NO: 6889376 - DNA, 20 bp, Homo sapiens
ccgtcccagaggccgctgcc

SEQ ID NO: 6889377 - DNA, 23 bp, Homo sapiens
cacttctcttaaacttgtgaatg

SEQ ID NO: 6889378 - DNA, 13 bp, Homo sapiens
tggaagtatacct

SEQ ID NO: 6889379 - DNA, 13 bp, Homo sapiens
agaaatcatgtta

SEQ ID NO: 6889380 - DNA, 14 bp, Homo sapiens
gcctgccctctgcc

SEQ ID NO: 6889381 - DNA, 14 bp, Homo sapiens
tcccttccatgccc

SEQ ID NO: 6889382 - DNA, 13 bp, Homo sapiens
ccgtccctctgcc

SEQ ID NO: 6889383 - DNA, 11 bp, Homo sapiens
ctcttgttgag

SEQ ID NO: 6889384 - DNA, 17 bp, Homo sapiens
agttgtttaactgtgca

SEQ ID NO: 6889385 - DNA, 19 bp, Homo sapiens
agtcctgggttgtttccag

SEQ ID NO: 6889386 - DNA, 12 bp, Homo sapiens
acttgaggattt

SEQ ID NO: 6889387 - DNA, 18 bp, Homo sapiens
tatcctgcaccctctgct

SEQ ID NO: 6889388 - DNA, 15 bp, Homo sapiens
gaggaaggcccaggg

SEQ ID NO: 6889389 - DNA, 14 bp, Homo sapiens
gcccctcctctgcc

SEQ ID NO: 6889390 - DNA, 14 bp, Homo sapiens
accagtcacatgac

SEQ ID NO: 6889391 - DNA, 17 bp, Homo sapiens
ctccattggtgttgaca

SEQ ID NO: 6889392 - DNA, 23 bp, Homo sapiens
gctgcaaaaccggcaacctgtaa

SEQ ID NO: 6889393 - DNA, 13 bp, Homo sapiens
agtactgtgaatc

SEQ ID NO: 6889394 - DNA, 18 bp, Homo sapiens
tgaatctgtttctatgtc

SEQ ID NO: 6889395 - DNA, 22 bp, Homo sapiens
tgggcctctcctgccctctgct

SEQ ID NO: 6889396 - DNA, 14 bp, Homo sapiens
gctcgggcccaggc

SEQ ID NO: 6889397 - DNA, 14 bp, Homo sapiens
ctccccactcctct

SEQ ID NO: 6889398 - DNA, 15 bp, Homo sapiens
cctccaaccctgccg

SEQ ID NO: 6889399 - DNA, 13 bp, Homo sapiens
ccccgagtgccta

SEQ ID NO: 6889400 - DNA, 13 bp, Homo sapiens
cccaggcactgca

SEQ ID NO: 6889401 - DNA, 13 bp, Homo sapiens
agctctctgctga

SEQ ID NO: 6889402 - DNA, 16 bp, Homo sapiens
ggcagctgcctctgct

SEQ ID NO: 6889403 - DNA, 10 bp, Homo sapiens
ttctgggaca

SEQ ID NO: 6889404 - DNA, 13 bp, Homo sapiens
cttgttctgctct

SEQ ID NO: 6889405 - DNA, 20 bp, Homo sapiens
ttggaccagaggaagcccct

SEQ ID NO: 6889406 - DNA, 17 bp, Homo sapiens
gaatcattctcgattta

SEQ ID NO: 6889407 - DNA, 19 bp, Homo sapiens
cctccacagtcccccaccc

SEQ ID NO: 6889408 - DNA, 21 bp, Homo sapiens
gctccctggcccagccagcca

SEQ ID NO: 6889409 - DNA, 15 bp, Homo sapiens
ctctgtctctgctct

SEQ ID NO: 6889410 - DNA, 21 bp, Homo sapiens
cagaatagcaaggtgctcaca

SEQ ID NO: 6889411 - DNA, 15 bp, Homo sapiens
tgcttttgcaaataa

SEQ ID NO: 6889412 - DNA, 19 bp, Homo sapiens
caattcttctcgacttcag

SEQ ID NO: 6889413 - DNA, 18 bp, Homo sapiens
ggtggggtgatggccaga

SEQ ID NO: 6889414 - DNA, 12 bp, Homo sapiens
aggtgcccagga

SEQ ID NO: 6889415 - DNA, 20 bp, Homo sapiens
acaatggaaaacctggggga

SEQ ID NO: 6889416 - DNA, 22 bp, Homo sapiens
ccatttgctgagtttcccttcc

SEQ ID NO: 6889417 - DNA, 22 bp, Homo sapiens
tatttctaatccttttccttat

SEQ ID NO: 6889418 - DNA, 17 bp, Homo sapiens
ccagatgcaccagccct

SEQ ID NO: 6889419 - DNA, 17 bp, Homo sapiens
aattgggtgtgccctgg

SEQ ID NO: 6889420 - DNA, 16 bp, Homo sapiens
ttcctctttctgctct

SEQ ID NO: 6889421 - DNA, 13 bp, Homo sapiens
ctgcacctctcca

SEQ ID NO: 6889422 - DNA, 20 bp, Homo sapiens
tcaggcacgtctcctgctgc

SEQ ID NO: 6889423 - DNA, 14 bp, Homo sapiens
aggtttttcttggg

SEQ ID NO: 6889424 - DNA, 15 bp, Homo sapiens
ccttccgtccatccc

SEQ ID NO: 6889425 - DNA, 17 bp, Homo sapiens
gtgacagtggctgctct

SEQ ID NO: 6889426 - DNA, 11 bp, Homo sapiens
gtgctgctgct

SEQ ID NO: 6889427 - DNA, 16 bp, Homo sapiens
actttatttttctaag

SEQ ID NO: 6889428 - DNA, 20 bp, Homo sapiens
ttatgtgcagcgacccttgg

SEQ ID NO: 6889429 - DNA, 19 bp, Homo sapiens
taattaggaattactttat

SEQ ID NO: 6889430 - DNA, 17 bp, Homo sapiens
actcgcgacaatgcaaa

SEQ ID NO: 6889431 - DNA, 23 bp, Homo sapiens
cagtgtgtaaataatttgcactg

SEQ ID NO: 6889432 - DNA, 23 bp, Homo sapiens
cctgtacccagccaccttcctga

SEQ ID NO: 6889433 - DNA, 18 bp, Homo sapiens
ctcctgcccagctcctca

SEQ ID NO: 6889434 - DNA, 14 bp, Homo sapiens
agaactgcactttt

SEQ ID NO: 6889435 - DNA, 23 bp, Homo sapiens
ttgtgcattatctagatactgta

SEQ ID NO: 6889436 - DNA, 12 bp, Homo sapiens
agagcctcctgg

SEQ ID NO: 6889437 - DNA, 19 bp, Homo sapiens
agccagatccccagggcag

SEQ ID NO: 6889438 - DNA, 17 bp, Homo sapiens
ctttgtattaccaaagc

SEQ ID NO: 6889439 - DNA, 13 bp, Homo sapiens
aatcactgtgtat

SEQ ID NO: 6889440 - DNA, 22 bp, Homo sapiens
ctttcagtgatatctttctcat

SEQ ID NO: 6889441 - DNA, 18 bp, Homo sapiens
acagttcctcgccctggg

SEQ ID NO: 6889442 - DNA, 14 bp, Homo sapiens
gctgacagctgctc

SEQ ID NO: 6889443 - DNA, 14 bp, Homo sapiens
ccactcagcttcct

SEQ ID NO: 6889444 - DNA, 15 bp, Homo sapiens
ctccctggttgcctc

SEQ ID NO: 6889445 - DNA, 18 bp, Homo sapiens
ccagcgacctctctgcct

SEQ ID NO: 6889446 - DNA, 21 bp, Homo sapiens
catagaaaaatgatgtcttta

SEQ ID NO: 6889447 - DNA, 14 bp, Homo sapiens
ctgcctgcctggga

SEQ ID NO: 6889448 - DNA, 20 bp, Homo sapiens
agcttgtatagtgtaaaata

SEQ ID NO: 6889449 - DNA, 16 bp, Homo sapiens
ccgtgtggccccttca

SEQ ID NO: 6889450 - DNA, 13 bp, Homo sapiens
attaaacacctga

SEQ ID NO: 6889451 - DNA, 12 bp, Homo sapiens
cacattcaggaa

SEQ ID NO: 6889452 - DNA, 18 bp, Homo sapiens
cttcttctcctatgtgta

SEQ ID NO: 6889453 - DNA, 19 bp, Homo sapiens
aattgtataccaatgtgtt

SEQ ID NO: 6889454 - DNA, 12 bp, Homo sapiens
ctcttcctcccc

SEQ ID NO: 6889455 - DNA, 18 bp, Homo sapiens
caggccaggccctctgcc

SEQ ID NO: 6889456 - DNA, 20 bp, Homo sapiens
tcctgatgtttttctgtgtt

SEQ ID NO: 6889457 - DNA, 14 bp, Homo sapiens
cacagcccctggca

SEQ ID NO: 6889458 - DNA, 19 bp, Homo sapiens
ctgtcctcccgagctcctc

SEQ ID NO: 6889459 - DNA, 18 bp, Homo sapiens
gctacagagaagccttca

SEQ ID NO: 6889460 - DNA, 16 bp, Homo sapiens
aggagctgcctggacc

SEQ ID NO: 6889461 - DNA, 22 bp, Homo sapiens
agcactgaaaatagtgttccca

SEQ ID NO: 6889462 - DNA, 17 bp, Homo sapiens
cttccttggttcatgct

SEQ ID NO: 6889463 - DNA, 23 bp, Homo sapiens
ctgagcttttgatgccaggtgca

SEQ ID NO: 6889464 - DNA, 15 bp, Homo sapiens
gcctgggacacacac

SEQ ID NO: 6889465 - DNA, 15 bp, Homo sapiens
ccaatgtgttttctg

SEQ ID NO: 6889466 - DNA, 18 bp, Homo sapiens
ttaatggctagtactgta

SEQ ID NO: 6889467 - DNA, 19 bp, Homo sapiens
cagctgcctcccctcctct

SEQ ID NO: 6889468 - DNA, 19 bp, Homo sapiens
aaatgcctctgccttgatg

SEQ ID NO: 6889469 - DNA, 16 bp, Homo sapiens
caagctcttgtttctg

SEQ ID NO: 6889470 - DNA, 14 bp, Homo sapiens
actgccccctctgc

SEQ ID NO: 6889471 - DNA, 20 bp, Homo sapiens
ctgggcccctccctacctca

SEQ ID NO: 6889472 - DNA, 15 bp, Homo sapiens
ttggctgcttggcct

SEQ ID NO: 6889473 - DNA, 17 bp, Homo sapiens
cgggtccccagctcccc

SEQ ID NO: 6889474 - DNA, 21 bp, Homo sapiens
tattgtttatgccaaatgtta

SEQ ID NO: 6889475 - DNA, 23 bp, Homo sapiens
ctgctggccgacccactgaccca

SEQ ID NO: 6889476 - DNA, 21 bp, Homo sapiens
agtgcccagtggagcctgccg

SEQ ID NO: 6889477 - DNA, 14 bp, Homo sapiens
agaaaccatgacaa

SEQ ID NO: 6889478 - DNA, 13 bp, Homo sapiens
cagttgtgatata

SEQ ID NO: 6889479 - DNA, 13 bp, Homo sapiens
acctcctgtggaa

SEQ ID NO: 6889480 - DNA, 17 bp, Homo sapiens
ccaggcaggcccagcct

SEQ ID NO: 6889481 - DNA, 15 bp, Homo sapiens
cttttcccccttccc

SEQ ID NO: 6889482 - DNA, 17 bp, Homo sapiens
ccttgagaccctcttct

SEQ ID NO: 6889483 - DNA, 13 bp, Homo sapiens
caggccccagcca

SEQ ID NO: 6889484 - DNA, 13 bp, Homo sapiens
ctgtgccccttct

SEQ ID NO: 6889485 - DNA, 17 bp, Homo sapiens
tcacatcctcctgccca

SEQ ID NO: 6889486 - DNA, 18 bp, Homo sapiens
ctcttgctgatggctgct

SEQ ID NO: 6889487 - DNA, 14 bp, Homo sapiens
aaatctagaattta

SEQ ID NO: 6889488 - DNA, 20 bp, Homo sapiens
ctgagcctgtgtcctgaaga

SEQ ID NO: 6889489 - DNA, 21 bp, Homo sapiens
tcctgtgctttctgcatgctt

SEQ ID NO: 6889490 - DNA, 18 bp, Homo sapiens
ctgttcacttttcctccc

SEQ ID NO: 6889491 - DNA, 11 bp, Homo sapiens
ccaactgctcc

SEQ ID NO: 6889492 - DNA, 21 bp, Homo sapiens
ctgggcctgatggagaggaga

SEQ ID NO: 6889493 - DNA, 12 bp, Homo sapiens
tgaaactaatca

SEQ ID NO: 6889494 - DNA, 23 bp, Homo sapiens
cattccccgacactgccaagcca

SEQ ID NO: 6889495 - DNA, 19 bp, Homo sapiens
aattgacagatcaagctgt

SEQ ID NO: 6889496 - DNA, 23 bp, Homo sapiens
cctgagcattcaggcagcactga

SEQ ID NO: 6889497 - DNA, 19 bp, Homo sapiens
ctggtccctcttctctcct

SEQ ID NO: 6889498 - DNA, 15 bp, Homo sapiens
ctctgcccctgcagc

SEQ ID NO: 6889499 - DNA, 21 bp, Homo sapiens
tcttccttgaccaaagctctc

SEQ ID NO: 6889500 - DNA, 17 bp, Homo sapiens
ctttctctctccacccc

SEQ ID NO: 6889501 - DNA, 22 bp, Homo sapiens
ccagcccctcctccctcagacc

SEQ ID NO: 6889502 - DNA, 17 bp, Homo sapiens
tagagattgtacattta

SEQ ID NO: 6889503 - DNA, 18 bp, Homo sapiens
ctctcctgtctccctcct

SEQ ID NO: 6889504 - DNA, 21 bp, Homo sapiens
ccatttctaaaggcctcttcc

SEQ ID NO: 6889505 - DNA, 21 bp, Homo sapiens
ctgtgaaagtctcctgtatca

SEQ ID NO: 6889506 - DNA, 22 bp, Homo sapiens
cctgtctggctcggacccaccc

SEQ ID NO: 6889507 - DNA, 20 bp, Homo sapiens
aaatattctatatgaattta

SEQ ID NO: 6889508 - DNA, 23 bp, Homo sapiens
acctgagtcaccctacctgtgcc

SEQ ID NO: 6889509 - DNA, 15 bp, Homo sapiens
caacctcactgccct

SEQ ID NO: 6889510 - DNA, 13 bp, Homo sapiens
catctttgccata

SEQ ID NO: 6889511 - DNA, 13 bp, Homo sapiens
cctccaccctgcc

SEQ ID NO: 6889512 - DNA, 23 bp, Homo sapiens
cttccccactctgctcccagccc

SEQ ID NO: 6889513 - DNA, 17 bp, Homo sapiens
attctcctgcctcagcc

SEQ ID NO: 6889514 - DNA, 20 bp, Homo sapiens
aagaactccacccccagagg

SEQ ID NO: 6889515 - DNA, 21 bp, Homo sapiens
ccagttgggctcgcactgccc

SEQ ID NO: 6889516 - DNA, 17 bp, Homo sapiens
tgggactgagtgctgag

SEQ ID NO: 6889517 - DNA, 15 bp, Homo sapiens
aaggtgcactacagt

SEQ ID NO: 6889518 - DNA, 20 bp, Homo sapiens
aatactatttaagatgtgaa

SEQ ID NO: 6889519 - DNA, 18 bp, Homo sapiens
ctgccactaacctgtaga

SEQ ID NO: 6889520 - DNA, 12 bp, Homo sapiens
ctagagctcctc

SEQ ID NO: 6889521 - DNA, 18 bp, Homo sapiens
ccaggggagttgtgtctg

SEQ ID NO: 6889522 - DNA, 20 bp, Homo sapiens
gcctggggacggagcactgt

SEQ ID NO: 6889523 - DNA, 21 bp, Homo sapiens
cctccgcacctgaccgctgcc

SEQ ID NO: 6889524 - DNA, 16 bp, Homo sapiens
ccattctcttgcattg

SEQ ID NO: 6889525 - DNA, 20 bp, Homo sapiens
gggacctccccagcccagga

SEQ ID NO: 6889526 - DNA, 19 bp, Homo sapiens
aataaacgatgttgtgatg

SEQ ID NO: 6889527 - DNA, 14 bp, Homo sapiens
tggcctcccctgcc

SEQ ID NO: 6889528 - DNA, 14 bp, Homo sapiens
ctttctcctcccca

SEQ ID NO: 6889529 - DNA, 20 bp, Homo sapiens
cctttcctgccgtccctcct

SEQ ID NO: 6889530 - DNA, 20 bp, Homo sapiens
tgtgtgttgatactgttgca

SEQ ID NO: 6889531 - DNA, 18 bp, Homo sapiens
tattgcctgggcagtgcc

SEQ ID NO: 6889532 - DNA, 16 bp, Homo sapiens
ggcattaatattcttt

SEQ ID NO: 6889533 - DNA, 21 bp, Homo sapiens
cttcccctgcgccctccctcc

SEQ ID NO: 6889534 - DNA, 13 bp, Homo sapiens
aagcttgtaaata

SEQ ID NO: 6889535 - DNA, 14 bp, Homo sapiens
ccagcactgaggaa

SEQ ID NO: 6889536 - DNA, 21 bp, Homo sapiens
tggccctcaaggcctcccaca

SEQ ID NO: 6889537 - DNA, 20 bp, Homo sapiens
ataactaaatttgatactta

SEQ ID NO: 6889538 - DNA, 19 bp, Homo sapiens
agctgctgggccagtggca

SEQ ID NO: 6889539 - DNA, 13 bp, Homo sapiens
cttactggcactg

SEQ ID NO: 6889540 - DNA, 17 bp, Homo sapiens
agcccttcccaggccag

SEQ ID NO: 6889541 - DNA, 13 bp, Homo sapiens
ccgtttcccctcc

SEQ ID NO: 6889542 - DNA, 22 bp, Homo sapiens
atcttcccacgtgggcctccca

SEQ ID NO: 6889543 - DNA, 13 bp, Homo sapiens
attaaaagactca

SEQ ID NO: 6889544 - DNA, 19 bp, Homo sapiens
acattaatagcagcctttc

SEQ ID NO: 6889545 - DNA, 16 bp, Homo sapiens
gctccacacacacaaa

SEQ ID NO: 6889546 - DNA, 15 bp, Homo sapiens
aacaactgctgggaa

SEQ ID NO: 6889547 - DNA, 22 bp, Homo sapiens
aggctggccagcaaggcaggtt

SEQ ID NO: 6889548 - DNA, 17 bp, Homo sapiens
tcctgcgttcagcccct

SEQ ID NO: 6889549 - DNA, 19 bp, Homo sapiens
catactttatatatgtaca

SEQ ID NO: 6889550 - DNA, 22 bp, Homo sapiens
cactggtgccaaaaccaggcct

SEQ ID NO: 6889551 - DNA, 13 bp, Homo sapiens
ctggtctcctccc

SEQ ID NO: 6889552 - DNA, 15 bp, Homo sapiens
accactgccctgcct

SEQ ID NO: 6889553 - DNA, 14 bp, Homo sapiens
aggacgccacccag

SEQ ID NO: 6889554 - DNA, 16 bp, Homo sapiens
ctctcgcatcttccca

SEQ ID NO: 6889555 - DNA, 17 bp, Homo sapiens
tgtgtgccctggactgt

SEQ ID NO: 6889556 - DNA, 20 bp, Homo sapiens
gtatacctctaactgtgcaa

SEQ ID NO: 6889557 - DNA, 14 bp, Homo sapiens
aagatgtactgaga

SEQ ID NO: 6889558 - DNA, 23 bp, Homo sapiens
ccacctttcctcaaatgttgaca

SEQ ID NO: 6889559 - DNA, 20 bp, Homo sapiens
tgctatgctgaagacattca

SEQ ID NO: 6889560 - DNA, 17 bp, Homo sapiens
agaacgccagtctccca

SEQ ID NO: 6889561 - DNA, 12 bp, Homo sapiens
cccttgcacatg

SEQ ID NO: 6889562 - DNA, 22 bp, Homo sapiens
ttctggtaggaatagcatgtca

SEQ ID NO: 6889563 - DNA, 17 bp, Homo sapiens
catcccgtacctcttcc

SEQ ID NO: 6889564 - DNA, 16 bp, Homo sapiens
tggctccccctctgct

SEQ ID NO: 6889565 - DNA, 16 bp, Homo sapiens
cgatggtctctctccc

SEQ ID NO: 6889566 - DNA, 13 bp, Homo sapiens
tgttccctctggc

SEQ ID NO: 6889567 - DNA, 22 bp, Homo sapiens
ctgctgctttgttgttctgcct

SEQ ID NO: 6889568 - DNA, 23 bp, Homo sapiens
accttcaaggctcttcttcctca

SEQ ID NO: 6889569 - DNA, 22 bp, Homo sapiens
ccttgccctgacctcccagccc

SEQ ID NO: 6889570 - DNA, 14 bp, Homo sapiens
cctttctccagcca

SEQ ID NO: 6889571 - DNA, 13 bp, Homo sapiens
actcttatctcag

SEQ ID NO: 6889572 - DNA, 19 bp, Homo sapiens
gaaacaaaccttgccttga

SEQ ID NO: 6889573 - DNA, 14 bp, Homo sapiens
acctgcccctgcct

SEQ ID NO: 6889574 - DNA, 18 bp, Homo sapiens
cactgccctccctcggcc

SEQ ID NO: 6889575 - DNA, 23 bp, Homo sapiens
actaagggggtagaagtagtttt

SEQ ID NO: 6889576 - DNA, 14 bp, Homo sapiens
cagccaccctgcca

SEQ ID NO: 6889577 - DNA, 15 bp, Homo sapiens
caaagactgtactgg

SEQ ID NO: 6889578 - DNA, 17 bp, Homo sapiens
cagcctgctgagagccc

SEQ ID NO: 6889579 - DNA, 21 bp, Homo sapiens
gatatttaaggatagtgtgaa

SEQ ID NO: 6889580 - DNA, 14 bp, Homo sapiens
acggcccaggccag

SEQ ID NO: 6889581 - DNA, 20 bp, Homo sapiens
ggcccgctgcagcctctgcc

SEQ ID NO: 6889582 - DNA, 19 bp, Homo sapiens
tggctttcgatgcgtgtgt

SEQ ID NO: 6889583 - DNA, 20 bp, Homo sapiens
cagagctaagggtgggtgct

SEQ ID NO: 6889584 - DNA, 14 bp, Homo sapiens
aactgaggcccaga

SEQ ID NO: 6889585 - DNA, 21 bp, Homo sapiens
tgcagctgtgagtgcgtgtgt

SEQ ID NO: 6889586 - DNA, 19 bp, Homo sapiens
acgagggaggaacacctga

SEQ ID NO: 6889587 - DNA, 16 bp, Homo sapiens
agccacacagcccaga

SEQ ID NO: 6889588 - DNA, 15 bp, Homo sapiens
gcctcagactgcacc

SEQ ID NO: 6889589 - DNA, 14 bp, Homo sapiens
cagaaatgctgctg

SEQ ID NO: 6889590 - DNA, 19 bp, Homo sapiens
accaaggtctcacactcct

SEQ ID NO: 6889591 - DNA, 15 bp, Homo sapiens
agtggtggtctttgg

SEQ ID NO: 6889592 - DNA, 23 bp, Homo sapiens
ctgtccttagactccttctcccc

SEQ ID NO: 6889593 - DNA, 17 bp, Homo sapiens
caggcccagcctctgcc

SEQ ID NO: 6889594 - DNA, 13 bp, Homo sapiens
cattcccactgcc

SEQ ID NO: 6889595 - DNA, 22 bp, Homo sapiens
gttcagtgctttttccttttca

SEQ ID NO: 6889596 - DNA, 13 bp, Homo sapiens
ctgcaccctggaa

SEQ ID NO: 6889597 - DNA, 14 bp, Homo sapiens
caacttttgtgtaa

SEQ ID NO: 6889598 - DNA, 22 bp, Homo sapiens
acctgccaccctgggcctggca

SEQ ID NO: 6889599 - DNA, 15 bp, Homo sapiens
gacatgctcacctct

SEQ ID NO: 6889600 - DNA, 16 bp, Homo sapiens
ctgacggtgcagtctg

SEQ ID NO: 6889601 - DNA, 19 bp, Homo sapiens
tcctctttccatctaccct

SEQ ID NO: 6889602 - DNA, 19 bp, Homo sapiens
cattttcctcctctgccta

SEQ ID NO: 6889603 - DNA, 19 bp, Homo sapiens
ccagccctgcagcccacca

SEQ ID NO: 6889604 - DNA, 13 bp, Homo sapiens
aaacgctacctct

SEQ ID NO: 6889605 - DNA, 15 bp, Homo sapiens
gagggcagcagccag

SEQ ID NO: 6889606 - DNA, 13 bp, Homo sapiens
cgaagctcagccc

SEQ ID NO: 6889607 - DNA, 20 bp, Homo sapiens
aggggtgggacaccctgtga

SEQ ID NO: 6889608 - DNA, 22 bp, Homo sapiens
cgtcctcctctacctctctcct

SEQ ID NO: 6889609 - DNA, 15 bp, Homo sapiens
tactttattgtacag

SEQ ID NO: 6889610 - DNA, 20 bp, Homo sapiens
aactgccccatctcctccca

SEQ ID NO: 6889611 - DNA, 14 bp, Homo sapiens
aaagattgcaaagg

SEQ ID NO: 6889612 - DNA, 16 bp, Homo sapiens
atcatgttttaatgta

SEQ ID NO: 6889613 - DNA, 17 bp, Homo sapiens
gaagaatgaacccaaga

SEQ ID NO: 6889614 - DNA, 16 bp, Homo sapiens
agctgcctgcagcaca

SEQ ID NO: 6889615 - DNA, 12 bp, Homo sapiens
ctctgctgccca

SEQ ID NO: 6889616 - DNA, 21 bp, Homo sapiens
gttctacgacccttttgagcc

SEQ ID NO: 6889617 - DNA, 14 bp, Homo sapiens
tatggacaacttat

SEQ ID NO: 6889618 - DNA, 23 bp, Homo sapiens
cacttctctccaggctgtttctt

SEQ ID NO: 6889619 - DNA, 19 bp, Homo sapiens
catgtgttagtgtatgtga

SEQ ID NO: 6889620 - DNA, 13 bp, Homo sapiens
ccagccccttccc

SEQ ID NO: 6889621 - DNA, 23 bp, Homo sapiens
aagctaatttgcattaaattcac

SEQ ID NO: 6889622 - DNA, 21 bp, Homo sapiens
atcatgtgtagatattatgta

SEQ ID NO: 6889623 - DNA, 11 bp, Homo sapiens
cctgtggagac

SEQ ID NO: 6889624 - DNA, 16 bp, Homo sapiens
taaaattatagctcta

SEQ ID NO: 6889625 - DNA, 16 bp, Homo sapiens
ttcacactgatacata

SEQ ID NO: 6889626 - DNA, 21 bp, Homo sapiens
ggtgcatgcctgtagtctcag

SEQ ID NO: 6889627 - DNA, 19 bp, Homo sapiens
tcggacatgcttttctgcc

SEQ ID NO: 6889628 - DNA, 16 bp, Homo sapiens
taaggacagcagctgg

SEQ ID NO: 6889629 - DNA, 16 bp, Homo sapiens
cagcaaggccacctct

SEQ ID NO: 6889630 - DNA, 19 bp, Homo sapiens
cagttggactgtggcctca

SEQ ID NO: 6889631 - DNA, 19 bp, Homo sapiens
tgcccacctggcctctgca

SEQ ID NO: 6889632 - DNA, 15 bp, Homo sapiens
ggtttctgccctgcc

SEQ ID NO: 6889633 - DNA, 15 bp, Homo sapiens
caccaaaactgctcc

SEQ ID NO: 6889634 - DNA, 18 bp, Homo sapiens
caaaaccaggcctctgct

SEQ ID NO: 6889635 - DNA, 18 bp, Homo sapiens
cagtcctttgtctttctt

SEQ ID NO: 6889636 - DNA, 22 bp, Homo sapiens
ttacatttaaagcattgctgtt

SEQ ID NO: 6889637 - DNA, 18 bp, Homo sapiens
gctctggaagcctgctga

SEQ ID NO: 6889638 - DNA, 20 bp, Homo sapiens
ctgtctggctgaggatttca

SEQ ID NO: 6889639 - DNA, 21 bp, Homo sapiens
ctggtccctcttctctcctca

SEQ ID NO: 6889640 - DNA, 17 bp, Homo sapiens
gaaataaaggatgtgat

SEQ ID NO: 6889641 - DNA, 21 bp, Homo sapiens
gtagattgcagaaaattctgt

SEQ ID NO: 6889642 - DNA, 19 bp, Homo sapiens
ccccaggactctggcactt

SEQ ID NO: 6889643 - DNA, 17 bp, Homo sapiens
ataaatgttcactttaa

SEQ ID NO: 6889644 - DNA, 21 bp, Homo sapiens
ctttccccagcatcactcccc

SEQ ID NO: 6889645 - DNA, 16 bp, Homo sapiens
taccataatcttagag

SEQ ID NO: 6889646 - DNA, 16 bp, Homo sapiens
cattataataaaattt

SEQ ID NO: 6889647 - DNA, 20 bp, Homo sapiens
aactgccccctctgccctgc

SEQ ID NO: 6889648 - DNA, 14 bp, Homo sapiens
acacatcatctgta

SEQ ID NO: 6889649 - DNA, 14 bp, Homo sapiens
caattttgtattta

SEQ ID NO: 6889650 - DNA, 17 bp, Homo sapiens
atgattgtgcctctgcc

SEQ ID NO: 6889651 - DNA, 12 bp, Homo sapiens
cacatttctgga

SEQ ID NO: 6889652 - DNA, 15 bp, Homo sapiens
tcaccatctttctaa

SEQ ID NO: 6889653 - DNA, 20 bp, Homo sapiens
catcttgacagagcctgccc

SEQ ID NO: 6889654 - DNA, 19 bp, Homo sapiens
tgtgccagctgcttctgcc

SEQ ID NO: 6889655 - DNA, 17 bp, Homo sapiens
cagccaggtggcacctg

SEQ ID NO: 6889656 - DNA, 14 bp, Homo sapiens
gccttgcctcctca

SEQ ID NO: 6889657 - DNA, 23 bp, Homo sapiens
gacagaaaaaaaaatgttttatg

SEQ ID NO: 6889658 - DNA, 14 bp, Homo sapiens
taacgcctgagccc

SEQ ID NO: 6889659 - DNA, 11 bp, Homo sapiens
caaccctgcct

SEQ ID NO: 6889660 - DNA, 15 bp, Homo sapiens
agcacatgtctgtcc

SEQ ID NO: 6889661 - DNA, 15 bp, Homo sapiens
ctcgtggacacctgc

SEQ ID NO: 6889662 - DNA, 19 bp, Homo sapiens
aaattgtacaaggtattta

SEQ ID NO: 6889663 - DNA, 18 bp, Homo sapiens
tccctgctgtgccatgct

SEQ ID NO: 6889664 - DNA, 18 bp, Homo sapiens
ggtgcagaggtgagcaga

SEQ ID NO: 6889665 - DNA, 16 bp, Homo sapiens
gagaaggaacagggaa

SEQ ID NO: 6889666 - DNA, 20 bp, Homo sapiens
tcccaggcatgcagctgcct

SEQ ID NO: 6889667 - DNA, 13 bp, Homo sapiens
tcacttttaggga

SEQ ID NO: 6889668 - DNA, 22 bp, Homo sapiens
tttccaatgccaattcatctca

SEQ ID NO: 6889669 - DNA, 17 bp, Homo sapiens
cagatgtctcccctgcc

SEQ ID NO: 6889670 - DNA, 22 bp, Homo sapiens
cagtaagctggtttacagatgt

SEQ ID NO: 6889671 - DNA, 18 bp, Homo sapiens
gacacctaccatgctgct

SEQ ID NO: 6889672 - DNA, 15 bp, Homo sapiens
cacagctgctgtgcc

SEQ ID NO: 6889673 - DNA, 20 bp, Homo sapiens
cccactccgactccccctcc

SEQ ID NO: 6889674 - DNA, 20 bp, Homo sapiens
caggagtttatctatcggaa

SEQ ID NO: 6889675 - DNA, 18 bp, Homo sapiens
aagttgtttaactgtgca

SEQ ID NO: 6889676 - DNA, 13 bp, Homo sapiens
caggtttgttaca

SEQ ID NO: 6889677 - DNA, 23 bp, Homo sapiens
cagattcactttgtttatgcata

SEQ ID NO: 6889678 - DNA, 17 bp, Homo sapiens
cagtttgaagcctgtgc

SEQ ID NO: 6889679 - DNA, 17 bp, Homo sapiens
gctgggactgagccagt

SEQ ID NO: 6889680 - DNA, 22 bp, Homo sapiens
tcccagggagtgagcagctact

SEQ ID NO: 6889681 - DNA, 17 bp, Homo sapiens
tcctatgtggcagctgg

SEQ ID NO: 6889682 - DNA, 13 bp, Homo sapiens
tactgtgtctttg

SEQ ID NO: 6889683 - DNA, 13 bp, Homo sapiens
tactttgtctttt

SEQ ID NO: 6889684 - DNA, 21 bp, Homo sapiens
cagatcccagcccaccctgcc

SEQ ID NO: 6889685 - DNA, 22 bp, Homo sapiens
caaatacatacctactgactga

SEQ ID NO: 6889686 - DNA, 14 bp, Homo sapiens
atagagatatttaa

SEQ ID NO: 6889687 - DNA, 21 bp, Homo sapiens
catactctccaggattgtcca

SEQ ID NO: 6889688 - DNA, 18 bp, Homo sapiens
aagcagggtaccctttgg

SEQ ID NO: 6889689 - DNA, 18 bp, Homo sapiens
ccctaggttccctgttct

SEQ ID NO: 6889690 - DNA, 14 bp, Homo sapiens
ctctaacagctcag

SEQ ID NO: 6889691 - DNA, 17 bp, Homo sapiens
cagttctgctcctctcc

SEQ ID NO: 6889692 - DNA, 12 bp, Homo sapiens
ctgagtggtcca

SEQ ID NO: 6889693 - DNA, 14 bp, Homo sapiens
tatctgcctggcct

SEQ ID NO: 6889694 - DNA, 18 bp, Homo sapiens
attattttagtgtgtaaa

SEQ ID NO: 6889695 - DNA, 15 bp, Homo sapiens
atgtgttcctcctgc

SEQ ID NO: 6889696 - DNA, 19 bp, Homo sapiens
ctgaactgctctactttga

SEQ ID NO: 6889697 - DNA, 18 bp, Homo sapiens
ctgaattcactccagtca

SEQ ID NO: 6889698 - DNA, 14 bp, Homo sapiens
tcccgccccagcct

SEQ ID NO: 6889699 - DNA, 22 bp, Homo sapiens
cctgctcttctctccccagccc

SEQ ID NO: 6889700 - DNA, 16 bp, Homo sapiens
tgaagtatacatttag

SEQ ID NO: 6889701 - DNA, 18 bp, Homo sapiens
cctccagcctcccctccc

SEQ ID NO: 6889702 - DNA, 22 bp, Homo sapiens
aggtctccaggggcctgcagaa

SEQ ID NO: 6889703 - DNA, 20 bp, Homo sapiens
cctgtcccagggccctccca

SEQ ID NO: 6889704 - DNA, 23 bp, Homo sapiens
ccaggcacgaacccacctgctga

SEQ ID NO: 6889705 - DNA, 19 bp, Homo sapiens
attgctgtgaattagctca

SEQ ID NO: 6889706 - DNA, 17 bp, Homo sapiens
ctgttagcactgttgat

SEQ ID NO: 6889707 - DNA, 22 bp, Homo sapiens
acactgtgacaatgactaagcc

SEQ ID NO: 6889708 - DNA, 14 bp, Homo sapiens
agccaccttcctga

SEQ ID NO: 6889709 - DNA, 20 bp, Homo sapiens
acttgcaaagacctacctcc

SEQ ID NO: 6889710 - DNA, 16 bp, Homo sapiens
ccttttcacccttcta

SEQ ID NO: 6889711 - DNA, 21 bp, Homo sapiens
ctcggcccctgtctgttccca

SEQ ID NO: 6889712 - DNA, 17 bp, Homo sapiens
ctccggccatactgcct

SEQ ID NO: 6889713 - DNA, 13 bp, Homo sapiens
cttgcctgtagtc

SEQ ID NO: 6889714 - DNA, 19 bp, Homo sapiens
cctttgcgcagccctacct

SEQ ID NO: 6889715 - DNA, 20 bp, Homo sapiens
cagtgcccccactgaccaga

SEQ ID NO: 6889716 - DNA, 16 bp, Homo sapiens
ggcccctccctctgcc

SEQ ID NO: 6889717 - DNA, 15 bp, Homo sapiens
cactcagtgcctcca

SEQ ID NO: 6889718 - DNA, 14 bp, Homo sapiens
cttcctgtcctgcc

SEQ ID NO: 6889719 - DNA, 23 bp, Homo sapiens
ctttggagagctcagtacagggc

SEQ ID NO: 6889720 - DNA, 22 bp, Homo sapiens
tcatccttttctcctatcttca

SEQ ID NO: 6889721 - DNA, 20 bp, Homo sapiens
acaaatttcattgcactttc

SEQ ID NO: 6889722 - DNA, 15 bp, Homo sapiens
taacttagttttgca

SEQ ID NO: 6889723 - DNA, 19 bp, Homo sapiens
catcctgatggacctgccc

SEQ ID NO: 6889724 - DNA, 21 bp, Homo sapiens
aaactgttcccacctgctgga

SEQ ID NO: 6889725 - DNA, 16 bp, Homo sapiens
attttaaaaaatcaaa

SEQ ID NO: 6889726 - DNA, 16 bp, Homo sapiens
aggctgccccaggccg

SEQ ID NO: 6889727 - DNA, 22 bp, Homo sapiens
agtaaaaccttgttctattttt

SEQ ID NO: 6889728 - DNA, 19 bp, Homo sapiens
acctcatccatgcacttta

SEQ ID NO: 6889729 - DNA, 23 bp, Homo sapiens
acacctcacgcaggctgagtcca

SEQ ID NO: 6889730 - DNA, 20 bp, Homo sapiens
ccctgcacccacccctgccc

SEQ ID NO: 6889731 - DNA, 15 bp, Homo sapiens
attcatatattgcat

SEQ ID NO: 6889732 - DNA, 15 bp, Homo sapiens
ccctccgccccgtcc

SEQ ID NO: 6889733 - DNA, 15 bp, Homo sapiens
caaatcaccacaaac

SEQ ID NO: 6889734 - DNA, 16 bp, Homo sapiens
cagcactgctgcctca

SEQ ID NO: 6889735 - DNA, 16 bp, Homo sapiens
cactgtggcactgcca

SEQ ID NO: 6889736 - DNA, 21 bp, Homo sapiens
atgattggattattcatttaa

SEQ ID NO: 6889737 - DNA, 14 bp, Homo sapiens
ctcttgctggtgca

SEQ ID NO: 6889738 - DNA, 12 bp, Homo sapiens
atggaggggaga

SEQ ID NO: 6889739 - DNA, 19 bp, Homo sapiens
cacaatctgttctactctt

SEQ ID NO: 6889740 - DNA, 19 bp, Homo sapiens
tgtaacaaattgatctgtt

SEQ ID NO: 6889741 - DNA, 17 bp, Homo sapiens
cagtaaaggccatgtga

SEQ ID NO: 6889742 - DNA, 14 bp, Homo sapiens
cagaccccttggct

SEQ ID NO: 6889743 - DNA, 22 bp, Homo sapiens
tttctcagcgggagtctcctca

SEQ ID NO: 6889744 - DNA, 17 bp, Homo sapiens
gcagtgatattctttgt

SEQ ID NO: 6889745 - DNA, 16 bp, Homo sapiens
cacttcctcctacctg

SEQ ID NO: 6889746 - DNA, 11 bp, Homo sapiens
ttgcctctgcc

SEQ ID NO: 6889747 - DNA, 18 bp, Homo sapiens
tgtaaatacaattttgtt

SEQ ID NO: 6889748 - DNA, 12 bp, Homo sapiens
ctcccactgccc

SEQ ID NO: 6889749 - DNA, 12 bp, Homo sapiens
ctctcactgcct

SEQ ID NO: 6889750 - DNA, 13 bp, Homo sapiens
cagtgctggattt

SEQ ID NO: 6889751 - DNA, 22 bp, Homo sapiens
tagtccgtgctgacagctgctc

SEQ ID NO: 6889752 - DNA, 20 bp, Homo sapiens
gacatagccgattctctgcc

SEQ ID NO: 6889753 - DNA, 19 bp, Homo sapiens
tctttctagttcagctgcc

SEQ ID NO: 6889754 - DNA, 14 bp, Homo sapiens
ctgtctgtacctaa

SEQ ID NO: 6889755 - DNA, 20 bp, Homo sapiens
actgattgggtgccatgtgg

SEQ ID NO: 6889756 - DNA, 19 bp, Homo sapiens
ttcccctcttgtctcccct

SEQ ID NO: 6889757 - DNA, 20 bp, Homo sapiens
ccaggagaagacccctgccc

SEQ ID NO: 6889758 - DNA, 23 bp, Homo sapiens
actaatgttagaattgatttcca

SEQ ID NO: 6889759 - DNA, 15 bp, Homo sapiens
gaggctactcttgac

SEQ ID NO: 6889760 - DNA, 21 bp, Homo sapiens
ctcttctgactgccccctcct

SEQ ID NO: 6889761 - DNA, 19 bp, Homo sapiens
gcccaggagtttggccaga

SEQ ID NO: 6889762 - DNA, 19 bp, Homo sapiens
tatttattatgctttattg

SEQ ID NO: 6889763 - DNA, 18 bp, Homo sapiens
agaagcaggctacactga

SEQ ID NO: 6889764 - DNA, 13 bp, Homo sapiens
gcttccctgttga

SEQ ID NO: 6889765 - DNA, 22 bp, Homo sapiens
agtagattgatctaaggcatgc

SEQ ID NO: 6889766 - DNA, 14 bp, Homo sapiens
aaaaagtctgtatg

SEQ ID NO: 6889767 - DNA, 15 bp, Homo sapiens
aattactgccttgaa

SEQ ID NO: 6889768 - DNA, 23 bp, Homo sapiens
ctgtccctcccacctctgtgacc

SEQ ID NO: 6889769 - DNA, 16 bp, Homo sapiens
acaaacagtgaattta

SEQ ID NO: 6889770 - DNA, 18 bp, Homo sapiens
ttctagtcccttctctct

SEQ ID NO: 6889771 - DNA, 13 bp, Homo sapiens
ggtgcgtggctgt

SEQ ID NO: 6889772 - DNA, 15 bp, Homo sapiens
ctcagagctctctct

SEQ ID NO: 6889773 - DNA, 14 bp, Homo sapiens
tcctgcatctctgt

SEQ ID NO: 6889774 - DNA, 22 bp, Homo sapiens
taccagccctggggctgggccc

SEQ ID NO: 6889775 - DNA, 18 bp, Homo sapiens
cctcgccctgtccctccc

SEQ ID NO: 6889776 - DNA, 14 bp, Homo sapiens
tcttgatacattca

SEQ ID NO: 6889777 - DNA, 15 bp, Homo sapiens
cagatagaaagcatt

SEQ ID NO: 6889778 - DNA, 16 bp, Homo sapiens
aggctggacatgctga

SEQ ID NO: 6889779 - DNA, 21 bp, Homo sapiens
cactgctccctaagccagcct

SEQ ID NO: 6889780 - DNA, 11 bp, Homo sapiens
catctcagcct

SEQ ID NO: 6889781 - DNA, 22 bp, Homo sapiens
atgaaggcatatttccaataac

SEQ ID NO: 6889782 - DNA, 16 bp, Homo sapiens
cctgtccaccctgcca

SEQ ID NO: 6889783 - DNA, 21 bp, Homo sapiens
ctcaggacagcatcccttccc

SEQ ID NO: 6889784 - DNA, 20 bp, Homo sapiens
acagacttcacacagcacct

SEQ ID NO: 6889785 - DNA, 17 bp, Homo sapiens
catctccagctggatcc

SEQ ID NO: 6889786 - DNA, 12 bp, Homo sapiens
cttcactgtata

SEQ ID NO: 6889787 - DNA, 17 bp, Homo sapiens
tttcccaccctcctgcc

SEQ ID NO: 6889788 - DNA, 20 bp, Homo sapiens
ctaaacttccccatcttcta

SEQ ID NO: 6889789 - DNA, 22 bp, Homo sapiens
tctgacgcaaaaccactttcct

SEQ ID NO: 6889790 - DNA, 16 bp, Homo sapiens
ccaagtcctagctcct

SEQ ID NO: 6889791 - DNA, 14 bp, Homo sapiens
cgtgtcctctcccc

SEQ ID NO: 6889792 - DNA, 20 bp, Homo sapiens
tgttcagaacttcatctgcc

SEQ ID NO: 6889793 - DNA, 18 bp, Homo sapiens
gcaacacagcctgggccc

SEQ ID NO: 6889794 - DNA, 23 bp, Homo sapiens
atttcaatgtaattaaactgtta

SEQ ID NO: 6889795 - DNA, 15 bp, Homo sapiens
ctgttcttgctgcta

SEQ ID NO: 6889796 - DNA, 13 bp, Homo sapiens
acccacctgctga

SEQ ID NO: 6889797 - DNA, 19 bp, Homo sapiens
cttacgcccaacccttccc

SEQ ID NO: 6889798 - DNA, 16 bp, Homo sapiens
ctctgatgtattttgt

SEQ ID NO: 6889799 - DNA, 17 bp, Homo sapiens
acgcgcgagtgtgctgt

SEQ ID NO: 6889800 - DNA, 19 bp, Homo sapiens
ccctcaaacctcctcttct

SEQ ID NO: 6889801 - DNA, 20 bp, Homo sapiens
tcattcatggaccactgttt

SEQ ID NO: 6889802 - DNA, 20 bp, Homo sapiens
tgccacgtcccgctgcctcc

SEQ ID NO: 6889803 - DNA, 12 bp, Homo sapiens
tccctttgctcc

SEQ ID NO: 6889804 - DNA, 14 bp, Homo sapiens
agctgcactgtgaa

SEQ ID NO: 6889805 - DNA, 19 bp, Homo sapiens
tgtctgagagaccatctcc

SEQ ID NO: 6889806 - DNA, 15 bp, Homo sapiens
ccagcctctggggca

SEQ ID NO: 6889807 - DNA, 22 bp, Homo sapiens
ctcttctgcacagctcctcccc

SEQ ID NO: 6889808 - DNA, 16 bp, Homo sapiens
cgggcagcgggccagg

SEQ ID NO: 6889809 - DNA, 20 bp, Homo sapiens
ccattcctggtacccagcca

SEQ ID NO: 6889810 - DNA, 16 bp, Homo sapiens
actatggtttgttgcc

SEQ ID NO: 6889811 - DNA, 17 bp, Homo sapiens
ctccggggtctgtgctg

SEQ ID NO: 6889812 - DNA, 12 bp, Homo sapiens
aggcaaatgtcc

SEQ ID NO: 6889813 - DNA, 14 bp, Homo sapiens
gtgcctgccctgga

SEQ ID NO: 6889814 - DNA, 20 bp, Homo sapiens
ctgaattcactccagtcaac

SEQ ID NO: 6889815 - DNA, 20 bp, Homo sapiens
gctgctggggcatgtgtgcc

SEQ ID NO: 6889816 - DNA, 14 bp, Homo sapiens
ccctacccctggct

SEQ ID NO: 6889817 - DNA, 17 bp, Homo sapiens
atccataccccctgccc

SEQ ID NO: 6889818 - DNA, 16 bp, Homo sapiens
tgtggtcaacatttct

SEQ ID NO: 6889819 - DNA, 14 bp, Homo sapiens
ccaactcccagcca

SEQ ID NO: 6889820 - DNA, 17 bp, Homo sapiens
ctgtgctggtgtcctga

SEQ ID NO: 6889821 - DNA, 21 bp, Homo sapiens
catgcaagacttcactgcagc

SEQ ID NO: 6889822 - DNA, 18 bp, Homo sapiens
actgatgggtcctgctgc

SEQ ID NO: 6889823 - DNA, 21 bp, Homo sapiens
tacatgtattgcacattgtaa

SEQ ID NO: 6889824 - DNA, 12 bp, Homo sapiens
gtccctgcctca

SEQ ID NO: 6889825 - DNA, 22 bp, Homo sapiens
caaatattgttgacaactgtga

SEQ ID NO: 6889826 - DNA, 22 bp, Homo sapiens
ctctggtctgggtgccccgtcc

SEQ ID NO: 6889827 - DNA, 14 bp, Homo sapiens
cttccctcctccca

SEQ ID NO: 6889828 - DNA, 16 bp, Homo sapiens
ccctgacccccttcct

SEQ ID NO: 6889829 - DNA, 18 bp, Homo sapiens
gctgttggacagctgctt

SEQ ID NO: 6889830 - DNA, 17 bp, Homo sapiens
ccatgcaaaccatgcct

SEQ ID NO: 6889831 - DNA, 12 bp, Homo sapiens
tgaacattccta

SEQ ID NO: 6889832 - DNA, 15 bp, Homo sapiens
agggaggcatctgca

SEQ ID NO: 6889833 - DNA, 23 bp, Homo sapiens
gaactagttgagagagtagtttt

SEQ ID NO: 6889834 - DNA, 23 bp, Homo sapiens
ctctacagagcttccctgactca

SEQ ID NO: 6889835 - DNA, 16 bp, Homo sapiens
cacagaccctgcccac

SEQ ID NO: 6889836 - DNA, 17 bp, Homo sapiens
cagacctggcctctgcc

SEQ ID NO: 6889837 - DNA, 14 bp, Homo sapiens
ccttggcccatccc

SEQ ID NO: 6889838 - DNA, 16 bp, Homo sapiens
ctcagggcagctgcct

SEQ ID NO: 6889839 - DNA, 22 bp, Homo sapiens
cccatgccacgttccacagttg

SEQ ID NO: 6889840 - DNA, 19 bp, Homo sapiens
catgttctgcccccagccc

SEQ ID NO: 6889841 - DNA, 21 bp, Homo sapiens
agcctaaagtatacaactgcc

SEQ ID NO: 6889842 - DNA, 23 bp, Homo sapiens
cttacccgaaagcatcactgcct

SEQ ID NO: 6889843 - DNA, 20 bp, Homo sapiens
tcagaactgcccttgctgcc

SEQ ID NO: 6889844 - DNA, 20 bp, Homo sapiens
accctcgtggacacctgccc

SEQ ID NO: 6889845 - DNA, 16 bp, Homo sapiens
cagagtgagactccat

SEQ ID NO: 6889846 - DNA, 13 bp, Homo sapiens
tgtccctcccact

SEQ ID NO: 6889847 - DNA, 20 bp, Homo sapiens
caagcagtctaccctgtcct

SEQ ID NO: 6889848 - DNA, 18 bp, Homo sapiens
tcttcccaagtcctcgcc

SEQ ID NO: 6889849 - DNA, 22 bp, Homo sapiens
gatatgtctagggtgtgattta

SEQ ID NO: 6889850 - DNA, 23 bp, Homo sapiens
ctatttatgcaagttagggtcta

SEQ ID NO: 6889851 - DNA, 15 bp, Homo sapiens
catcccgcttagcct

SEQ ID NO: 6889852 - DNA, 20 bp, Homo sapiens
agaccaccagggtcccagga

SEQ ID NO: 6889853 - DNA, 15 bp, Homo sapiens
aggaggagacagtca

SEQ ID NO: 6889854 - DNA, 12 bp, Homo sapiens
gacttctctgaa

SEQ ID NO: 6889855 - DNA, 17 bp, Homo sapiens
caatgccagtcctgcag

SEQ ID NO: 6889856 - DNA, 15 bp, Homo sapiens
agccacaagctgcac

SEQ ID NO: 6889857 - DNA, 21 bp, Homo sapiens
tgccctgcctccaccgagcca

SEQ ID NO: 6889858 - DNA, 19 bp, Homo sapiens
caccactgccaatgctgta

SEQ ID NO: 6889859 - DNA, 20 bp, Homo sapiens
cctttccctcaccccctccc

SEQ ID NO: 6889860 - DNA, 21 bp, Homo sapiens
ccagctccctagactgcatcc

SEQ ID NO: 6889861 - DNA, 22 bp, Homo sapiens
gagaggagaaaaaaaaagtgaa

SEQ ID NO: 6889862 - DNA, 18 bp, Homo sapiens
agctcacctctcccttgg

SEQ ID NO: 6889863 - DNA, 15 bp, Homo sapiens
catgcccttctgatt

SEQ ID NO: 6889864 - DNA, 19 bp, Homo sapiens
acctgtcatgcccccctca

SEQ ID NO: 6889865 - DNA, 22 bp, Homo sapiens
ttctcaagatactgctactgta

SEQ ID NO: 6889866 - DNA, 21 bp, Homo sapiens
cggctgggtcggccctgccca

SEQ ID NO: 6889867 - DNA, 22 bp, Homo sapiens
gtgtaggggccacctcctcccc

SEQ ID NO: 6889868 - DNA, 21 bp, Homo sapiens
acaacctgccacaatgtgata

SEQ ID NO: 6889869 - DNA, 22 bp, Homo sapiens
caccaagctgttccacttctct

SEQ ID NO: 6889870 - DNA, 12 bp, Homo sapiens
caaggaaaacag

SEQ ID NO: 6889871 - DNA, 19 bp, Homo sapiens
cagttactccctacactga

SEQ ID NO: 6889872 - DNA, 14 bp, Homo sapiens
cccagttctgctcc

SEQ ID NO: 6889873 - DNA, 13 bp, Homo sapiens
cagtatactgtgt

SEQ ID NO: 6889874 - DNA, 14 bp, Homo sapiens
agcagcactgtgag

SEQ ID NO: 6889875 - DNA, 21 bp, Homo sapiens
cctttaagatatccatctttt

SEQ ID NO: 6889876 - DNA, 19 bp, Homo sapiens
agccccacagcacccaggc

SEQ ID NO: 6889877 - DNA, 21 bp, Homo sapiens
cctacccccttgtctgctgct

SEQ ID NO: 6889878 - DNA, 14 bp, Homo sapiens
ctgctgccagtgca

SEQ ID NO: 6889879 - DNA, 14 bp, Homo sapiens
agctcactgctgat

SEQ ID NO: 6889880 - DNA, 18 bp, Homo sapiens
ccattttaacgctgccta

SEQ ID NO: 6889881 - DNA, 15 bp, Homo sapiens
ttcacgtcactgcca

SEQ ID NO: 6889882 - DNA, 13 bp, Homo sapiens
acctgaagactga

SEQ ID NO: 6889883 - DNA, 16 bp, Homo sapiens
tccctgcacagcctct

SEQ ID NO: 6889884 - DNA, 13 bp, Homo sapiens
tcatgttgagcca

SEQ ID NO: 6889885 - DNA, 23 bp, Homo sapiens
ctcctgcctcctcagctttgctt

SEQ ID NO: 6889886 - DNA, 23 bp, Homo sapiens
gtgcctgctctccttgccctggg

SEQ ID NO: 6889887 - DNA, 18 bp, Homo sapiens
aaagttctttactggtga

SEQ ID NO: 6889888 - DNA, 17 bp, Homo sapiens
aatcactaaactttatt

SEQ ID NO: 6889889 - DNA, 15 bp, Homo sapiens
catttaatttgttat

SEQ ID NO: 6889890 - DNA, 22 bp, Homo sapiens
catatagcattgataatcttca

SEQ ID NO: 6889891 - DNA, 15 bp, Homo sapiens
atgctggctgaagag

SEQ ID NO: 6889892 - DNA, 15 bp, Homo sapiens
tgccagcttctctct

SEQ ID NO: 6889893 - DNA, 21 bp, Homo sapiens
ttaattaaaccagactctgtt

SEQ ID NO: 6889894 - DNA, 21 bp, Homo sapiens
taaacatatttttatacttta

SEQ ID NO: 6889895 - DNA, 13 bp, Homo sapiens
ctcagttctgcct

SEQ ID NO: 6889896 - DNA, 20 bp, Homo sapiens
ctagtactgtgtactgtata

SEQ ID NO: 6889897 - DNA, 16 bp, Homo sapiens
caattctcctgcctca

SEQ ID NO: 6889898 - DNA, 15 bp, Homo sapiens
cccccaccctgcact

SEQ ID NO: 6889899 - DNA, 14 bp, Homo sapiens
tttggaacatttct

SEQ ID NO: 6889900 - DNA, 19 bp, Homo sapiens
cccttgtgtgtaccacacc

SEQ ID NO: 6889901 - DNA, 14 bp, Homo sapiens
cataatcctagccc

SEQ ID NO: 6889902 - DNA, 15 bp, Homo sapiens
cacagcacagtacac

SEQ ID NO: 6889903 - DNA, 14 bp, Homo sapiens
acctggcctctgcc

SEQ ID NO: 6889904 - DNA, 19 bp, Homo sapiens
ccctgatcccaccccctcc

SEQ ID NO: 6889905 - DNA, 16 bp, Homo sapiens
ctggcaggacctgcct

SEQ ID NO: 6889906 - DNA, 18 bp, Homo sapiens
atcctccccttccctgca

SEQ ID NO: 6889907 - DNA, 16 bp, Homo sapiens
ccaaggccctgtctct

SEQ ID NO: 6889908 - DNA, 17 bp, Homo sapiens
ctgcattgagaactgca

SEQ ID NO: 6889909 - DNA, 19 bp, Homo sapiens
tcacctgtaaaactttatt

SEQ ID NO: 6889910 - DNA, 20 bp, Homo sapiens
ccacatccttctcactgcca

SEQ ID NO: 6889911 - DNA, 13 bp, Homo sapiens
ctgctctgctgct

SEQ ID NO: 6889912 - DNA, 23 bp, Homo sapiens
tgaaatgaaatttaaacattaaa

SEQ ID NO: 6889913 - DNA, 9 bp, Homo sapiens
aaatgcctc

SEQ ID NO: 6889914 - DNA, 22 bp, Homo sapiens
caggactgggagcccccagcct

SEQ ID NO: 6889915 - DNA, 21 bp, Homo sapiens
cttaaaataaacagttgtgaa

SEQ ID NO: 6889916 - DNA, 23 bp, Homo sapiens
cctgctgcaggggctctggagag

SEQ ID NO: 6889917 - DNA, 17 bp, Homo sapiens
tccccaggtccagctct

SEQ ID NO: 6889918 - DNA, 19 bp, Homo sapiens
ctccaccgggcgcatgcct

SEQ ID NO: 6889919 - DNA, 21 bp, Homo sapiens
acccacccttctcccctgccc

SEQ ID NO: 6889920 - DNA, 14 bp, Homo sapiens
tgactctacctgca

SEQ ID NO: 6889921 - DNA, 20 bp, Homo sapiens
tagttgagtcttcacattta

SEQ ID NO: 6889922 - DNA, 19 bp, Homo sapiens
cggtgggccttgctgggga

SEQ ID NO: 6889923 - DNA, 23 bp, Homo sapiens
ctctgaggcaaggcccagacctg

SEQ ID NO: 6889924 - DNA, 20 bp, Homo sapiens
ctataagtgttcagtgttga

SEQ ID NO: 6889925 - DNA, 18 bp, Homo sapiens
acagtatattttatttca

SEQ ID NO: 6889926 - DNA, 14 bp, Homo sapiens
tttcattacctgta

SEQ ID NO: 6889927 - DNA, 13 bp, Homo sapiens
ttccatgatgcac

SEQ ID NO: 6889928 - DNA, 15 bp, Homo sapiens
ctgtgctcgggtgct

SEQ ID NO: 6889929 - DNA, 22 bp, Homo sapiens
aagagctcttcggtttctgagc

SEQ ID NO: 6889930 - DNA, 16 bp, Homo sapiens
tcttctgtttttctca

SEQ ID NO: 6889931 - DNA, 13 bp, Homo sapiens
gtcatttgccaac

SEQ ID NO: 6889932 - DNA, 19 bp, Homo sapiens
acctttcccacctctctcc

SEQ ID NO: 6889933 - DNA, 20 bp, Homo sapiens
aggctgctggcgcctctgca

SEQ ID NO: 6889934 - DNA, 18 bp, Homo sapiens
ccttagcctctcccaccc

SEQ ID NO: 6889935 - DNA, 21 bp, Homo sapiens
cctctgtcagtcacagccacc

SEQ ID NO: 6889936 - DNA, 12 bp, Homo sapiens
aacgtgctgact

SEQ ID NO: 6889937 - DNA, 15 bp, Homo sapiens
atattaaaatagcat

SEQ ID NO: 6889938 - DNA, 12 bp, Homo sapiens
atctcttcctca

SEQ ID NO: 6889939 - DNA, 15 bp, Homo sapiens
ggagctggcccaggg

SEQ ID NO: 6889940 - DNA, 13 bp, Homo sapiens
agcccctcccacc

SEQ ID NO: 6889941 - DNA, 14 bp, Homo sapiens
ccatccatctgtcc

SEQ ID NO: 6889942 - DNA, 17 bp, Homo sapiens
tagtaagttcagcactt

SEQ ID NO: 6889943 - DNA, 13 bp, Homo sapiens
cctgcccccttct

SEQ ID NO: 6889944 - DNA, 19 bp, Homo sapiens
ttaaaaaaaatgtgaaatt

SEQ ID NO: 6889945 - DNA, 18 bp, Homo sapiens
catccagagtccctgcct

SEQ ID NO: 6889946 - DNA, 20 bp, Homo sapiens
cctacattccctctcctgcc

SEQ ID NO: 6889947 - DNA, 22 bp, Homo sapiens
ccttcgtggttatagccctgcc

SEQ ID NO: 6889948 - DNA, 13 bp, Homo sapiens
gcccacacttgag

SEQ ID NO: 6889949 - DNA, 15 bp, Homo sapiens
cctgccctcctctcc

SEQ ID NO: 6889950 - DNA, 15 bp, Homo sapiens
ccgactgcccagcca

SEQ ID NO: 6889951 - DNA, 21 bp, Homo sapiens
tgcgcctgagtgagtgtgtgt

SEQ ID NO: 6889952 - DNA, 19 bp, Homo sapiens
gtcacaggactctgcctcc

SEQ ID NO: 6889953 - DNA, 13 bp, Homo sapiens
ctctcccccaccc

SEQ ID NO: 6889954 - DNA, 19 bp, Homo sapiens
gattctgctggcctctgcg

SEQ ID NO: 6889955 - DNA, 20 bp, Homo sapiens
cacagtattacttctgctac

SEQ ID NO: 6889956 - DNA, 17 bp, Homo sapiens
tcacttaaactttgtca

SEQ ID NO: 6889957 - DNA, 16 bp, Homo sapiens
actgccctgcctgccc

SEQ ID NO: 6889958 - DNA, 17 bp, Homo sapiens
agaaattcgcatgttta

SEQ ID NO: 6889959 - DNA, 22 bp, Homo sapiens
ctagagctcctgtccctaccca

SEQ ID NO: 6889960 - DNA, 19 bp, Homo sapiens
cgtggccccagcctggccc

SEQ ID NO: 6889961 - DNA, 17 bp, Homo sapiens
cctccttagccctgtct

SEQ ID NO: 6889962 - DNA, 16 bp, Homo sapiens
tcctcacacttactgt

SEQ ID NO: 6889963 - DNA, 15 bp, Homo sapiens
agatggacagagaac

SEQ ID NO: 6889964 - DNA, 20 bp, Homo sapiens
actccggtgtgcctgcagcc

SEQ ID NO: 6889965 - DNA, 15 bp, Homo sapiens
ctcaatactacctct

SEQ ID NO: 6889966 - DNA, 14 bp, Homo sapiens
taccccctgcccca

SEQ ID NO: 6889967 - DNA, 21 bp, Homo sapiens
agtgctgtctgatctgtgctt

SEQ ID NO: 6889968 - DNA, 18 bp, Homo sapiens
agacgggaggcctggcct

SEQ ID NO: 6889969 - DNA, 15 bp, Homo sapiens
ccaggcccccagccc

SEQ ID NO: 6889970 - DNA, 15 bp, Homo sapiens
ccaggctcccagcct

SEQ ID NO: 6889971 - DNA, 15 bp, Homo sapiens
gtgtgcatgtgctgt

SEQ ID NO: 6889972 - DNA, 20 bp, Homo sapiens
ctattagcggctcctcgccc

SEQ ID NO: 6889973 - DNA, 12 bp, Homo sapiens
aagaatttgcat

SEQ ID NO: 6889974 - DNA, 19 bp, Homo sapiens
tttggttttctccttccca

SEQ ID NO: 6889975 - DNA, 21 bp, Homo sapiens
gccctgcacgtatacacccag

SEQ ID NO: 6889976 - DNA, 21 bp, Homo sapiens
agctgaggccattccctgtag

SEQ ID NO: 6889977 - DNA, 18 bp, Homo sapiens
cagagcagcctctgtcct

SEQ ID NO: 6889978 - DNA, 14 bp, Homo sapiens
tcgggtgcgtgtgt

SEQ ID NO: 6889979 - DNA, 21 bp, Homo sapiens
ccatgtttggtgtttgtctgt

SEQ ID NO: 6889980 - DNA, 21 bp, Homo sapiens
gaacatggtgtgtgtctctga

SEQ ID NO: 6889981 - DNA, 13 bp, Homo sapiens
cctcccttcctcc

SEQ ID NO: 6889982 - DNA, 13 bp, Homo sapiens
gttatcttgttat

SEQ ID NO: 6889983 - DNA, 18 bp, Homo sapiens
caaggccacctctgcctc

SEQ ID NO: 6889984 - DNA, 17 bp, Homo sapiens
cctcagcaccccttcca

SEQ ID NO: 6889985 - DNA, 24 bp, Homo sapiens
cctgtatgtctacctctgacttct

SEQ ID NO: 6889986 - DNA, 19 bp, Homo sapiens
ggaggaccccgagggctga

SEQ ID NO: 6889987 - DNA, 18 bp, Homo sapiens
ctaattcttacactgcct

SEQ ID NO: 6889988 - DNA, 13 bp, Homo sapiens
tgtactgtttgct

SEQ ID NO: 6889989 - DNA, 16 bp, Homo sapiens
actatgatctcaggag

SEQ ID NO: 6889990 - DNA, 19 bp, Homo sapiens
gaatgaaacccccacacac

SEQ ID NO: 6889991 - DNA, 13 bp, Homo sapiens
atgtaaactgcca

SEQ ID NO: 6889992 - DNA, 18 bp, Homo sapiens
cctgcccaggcccctgcc

SEQ ID NO: 6889993 - DNA, 21 bp, Homo sapiens
ggggctgccagcgtctgttgt

SEQ ID NO: 6889994 - DNA, 15 bp, Homo sapiens
gccaaacaagcctta

SEQ ID NO: 6889995 - DNA, 14 bp, Homo sapiens
tgggggcctctgcc

SEQ ID NO: 6889996 - DNA, 15 bp, Homo sapiens
cctttcctccctccc

SEQ ID NO: 6889997 - DNA, 18 bp, Homo sapiens
gattgtccttttgcaaag

SEQ ID NO: 6889998 - DNA, 20 bp, Homo sapiens
atatctatctatatatacat

SEQ ID NO: 6889999 - DNA, 19 bp, Homo sapiens
cttcccctctaactggaca

SEQ ID NO: 6890000 - DNA, 18 bp, Homo sapiens
tgcccggtgccatcttcc

SEQ ID NO: 6890001 - DNA, 18 bp, Homo sapiens
tgatgcaatcttggctca

SEQ ID NO: 6890002 - DNA, 19 bp, Homo sapiens
caaagaattccaaagcaaa

SEQ ID NO: 6890003 - DNA, 16 bp, Homo sapiens
acctgtcctgtctttg

SEQ ID NO: 6890004 - DNA, 15 bp, Homo sapiens
tgagtacctggtcat

SEQ ID NO: 6890005 - DNA, 15 bp, Homo sapiens
aggacggccctgcct

SEQ ID NO: 6890006 - DNA, 22 bp, Homo sapiens
caaactgatgcgaaaacttgaa

SEQ ID NO: 6890007 - DNA, 14 bp, Homo sapiens
ctttgtagctccta

SEQ ID NO: 6890008 - DNA, 17 bp, Homo sapiens
cagaacttcatctgcca

SEQ ID NO: 6890009 - DNA, 19 bp, Homo sapiens
taaatttaatatactgcat

SEQ ID NO: 6890010 - DNA, 16 bp, Homo sapiens
agtctccggcctctcc

SEQ ID NO: 6890011 - DNA, 11 bp, Homo sapiens
tgccctctcca

SEQ ID NO: 6890012 - DNA, 15 bp, Homo sapiens
gctcttcaagctgtc

SEQ ID NO: 6890013 - DNA, 16 bp, Homo sapiens
aatgtaagctgtttat

SEQ ID NO: 6890014 - DNA, 18 bp, Homo sapiens
gaccaccctgcctgtgga

SEQ ID NO: 6890015 - DNA, 16 bp, Homo sapiens
tggctgaaccctgtgc

SEQ ID NO: 6890016 - DNA, 16 bp, Homo sapiens
attttaaacaaaattt

SEQ ID NO: 6890017 - DNA, 18 bp, Homo sapiens
cacatgaggccatctcag

SEQ ID NO: 6890018 - DNA, 18 bp, Homo sapiens
cctacccatatccctccc

SEQ ID NO: 6890019 - DNA, 21 bp, Homo sapiens
ccctgacatgtaccccctttc

SEQ ID NO: 6890020 - DNA, 18 bp, Homo sapiens
ctggtggctgggctgctc

SEQ ID NO: 6890021 - DNA, 19 bp, Homo sapiens
cacatgagcatcaggccag

SEQ ID NO: 6890022 - DNA, 13 bp, Homo sapiens
acccttccctgca

SEQ ID NO: 6890023 - DNA, 17 bp, Homo sapiens
cccagcacactgcttct

SEQ ID NO: 6890024 - DNA, 12 bp, Homo sapiens
cgacctcagcct

SEQ ID NO: 6890025 - DNA, 16 bp, Homo sapiens
ttcaatttatacctca

SEQ ID NO: 6890026 - DNA, 17 bp, Homo sapiens
caggaatgggggtcaga

SEQ ID NO: 6890027 - DNA, 15 bp, Homo sapiens
caggagatgatgtga

SEQ ID NO: 6890028 - DNA, 19 bp, Homo sapiens
agcatcttttccatcctga

SEQ ID NO: 6890029 - DNA, 13 bp, Homo sapiens
ctcgagcatgcct

SEQ ID NO: 6890030 - DNA, 15 bp, Homo sapiens
ctataacccctgcct

SEQ ID NO: 6890031 - DNA, 19 bp, Homo sapiens
ccttctcccttgccctccc

SEQ ID NO: 6890032 - DNA, 20 bp, Homo sapiens
cttcctgtcctgcctcctca

SEQ ID NO: 6890033 - DNA, 17 bp, Homo sapiens
tgttcctgaagctgctg

SEQ ID NO: 6890034 - DNA, 18 bp, Homo sapiens
ctgtgcctggctccctga

SEQ ID NO: 6890035 - DNA, 16 bp, Homo sapiens
aagcatgaaatgtgaa

SEQ ID NO: 6890036 - DNA, 16 bp, Homo sapiens
cactgcatcctccgcc

SEQ ID NO: 6890037 - DNA, 21 bp, Homo sapiens
acaaaaaaacctttattcttt

SEQ ID NO: 6890038 - DNA, 18 bp, Homo sapiens
gtatatatctattattca

SEQ ID NO: 6890039 - DNA, 20 bp, Homo sapiens
gccaactgtttccctgctga

SEQ ID NO: 6890040 - DNA, 17 bp, Homo sapiens
cttctgtgcccagctca

SEQ ID NO: 6890041 - DNA, 16 bp, Homo sapiens
ccctcagccctggcct

SEQ ID NO: 6890042 - DNA, 19 bp, Homo sapiens
ccaacagcacctccccgct

SEQ ID NO: 6890043 - DNA, 15 bp, Homo sapiens
cactgctctcagcct

SEQ ID NO: 6890044 - DNA, 15 bp, Homo sapiens
cctccggccctgccc

SEQ ID NO: 6890045 - DNA, 23 bp, Homo sapiens
accctccattgggcacagtccag

SEQ ID NO: 6890046 - DNA, 22 bp, Homo sapiens
acttcttggaaaaaaattacaa

SEQ ID NO: 6890047 - DNA, 15 bp, Homo sapiens
atatttgattatgta

SEQ ID NO: 6890048 - DNA, 20 bp, Homo sapiens
atcaatttttatacatatca

SEQ ID NO: 6890049 - DNA, 14 bp, Homo sapiens
accacaccctgcct

SEQ ID NO: 6890050 - DNA, 11 bp, Homo sapiens
aaaaaagcaca

SEQ ID NO: 6890051 - DNA, 13 bp, Homo sapiens
gtgatttcttgct

SEQ ID NO: 6890052 - DNA, 15 bp, Homo sapiens
ctcttgacagtctga

SEQ ID NO: 6890053 - DNA, 13 bp, Homo sapiens
ataaaggttgtga

SEQ ID NO: 6890054 - DNA, 13 bp, Homo sapiens
agcccgcctgccg

SEQ ID NO: 6890055 - DNA, 19 bp, Homo sapiens
accgagccacgcagtgcct

SEQ ID NO: 6890056 - DNA, 21 bp, Homo sapiens
gccttctcaccagctgcaaag

SEQ ID NO: 6890057 - DNA, 21 bp, Homo sapiens
ctgaagctcgcatccagacag

SEQ ID NO: 6890058 - DNA, 12 bp, Homo sapiens
ccctctttcctg

SEQ ID NO: 6890059 - DNA, 14 bp, Homo sapiens
ctgcacacacctgc

SEQ ID NO: 6890060 - DNA, 13 bp, Homo sapiens
gccggcctctgct

SEQ ID NO: 6890061 - DNA, 16 bp, Homo sapiens
aaggtctgatttgcag

SEQ ID NO: 6890062 - DNA, 17 bp, Homo sapiens
gaaaacgatttaattta

SEQ ID NO: 6890063 - DNA, 16 bp, Homo sapiens
tctgcttttctgccct

SEQ ID NO: 6890064 - DNA, 13 bp, Homo sapiens
gcatgtacttgaa

SEQ ID NO: 6890065 - DNA, 17 bp, Homo sapiens
caaagctagaatgtgaa

SEQ ID NO: 6890066 - DNA, 13 bp, Homo sapiens
tggtctctgccat

SEQ ID NO: 6890067 - DNA, 22 bp, Homo sapiens
cataccctggccgccccctgcc

SEQ ID NO: 6890068 - DNA, 19 bp, Homo sapiens
ctttcgtttgtttgtttca

SEQ ID NO: 6890069 - DNA, 19 bp, Homo sapiens
tgcctttgctgccttctgt

SEQ ID NO: 6890070 - DNA, 22 bp, Homo sapiens
tgacaaaatgactggctcctga

SEQ ID NO: 6890071 - DNA, 16 bp, Homo sapiens
ctgtctcaactactca

SEQ ID NO: 6890072 - DNA, 22 bp, Homo sapiens
cctttcctcggtctcccttccg

SEQ ID NO: 6890073 - DNA, 18 bp, Homo sapiens
cttacctactttcttcag

SEQ ID NO: 6890074 - DNA, 20 bp, Homo sapiens
ccaaggagccattctgtgtg

SEQ ID NO: 6890075 - DNA, 15 bp, Homo sapiens
ctgatggctgctgga

SEQ ID NO: 6890076 - DNA, 12 bp, Homo sapiens
agcccctgcaga

SEQ ID NO: 6890077 - DNA, 15 bp, Homo sapiens
gctgttgagctgttt

SEQ ID NO: 6890078 - DNA, 13 bp, Homo sapiens
catcccactgctc

SEQ ID NO: 6890079 - DNA, 15 bp, Homo sapiens
tcttccccttgccct

SEQ ID NO: 6890080 - DNA, 17 bp, Homo sapiens
agaactactagctacaa

SEQ ID NO: 6890081 - DNA, 16 bp, Homo sapiens
ccctctggccctgcct

SEQ ID NO: 6890082 - DNA, 19 bp, Homo sapiens
ccagattggctcacactga

SEQ ID NO: 6890083 - DNA, 16 bp, Homo sapiens
gacttcatttgtgcca

SEQ ID NO: 6890084 - DNA, 13 bp, Homo sapiens
ttgtctcttgcct

SEQ ID NO: 6890085 - DNA, 17 bp, Homo sapiens
cagggacctcaggggca

SEQ ID NO: 6890086 - DNA, 13 bp, Homo sapiens
attcccactgccg

SEQ ID NO: 6890087 - DNA, 15 bp, Homo sapiens
cacaaggccatctgg

SEQ ID NO: 6890088 - DNA, 19 bp, Homo sapiens
cagtctttttctgttgtaa

SEQ ID NO: 6890089 - DNA, 13 bp, Homo sapiens
accaccctcccct

SEQ ID NO: 6890090 - DNA, 18 bp, Homo sapiens
cataacgtttttccttta

SEQ ID NO: 6890091 - DNA, 16 bp, Homo sapiens
tatatgtatatctata

SEQ ID NO: 6890092 - DNA, 12 bp, Homo sapiens
gaaaatttgaat

SEQ ID NO: 6890093 - DNA, 14 bp, Homo sapiens
agattcccactgcc

SEQ ID NO: 6890094 - DNA, 20 bp, Homo sapiens
gtcactgcatggcttctgaa

SEQ ID NO: 6890095 - DNA, 16 bp, Homo sapiens
cagcctccctgtctcc

SEQ ID NO: 6890096 - DNA, 18 bp, Homo sapiens
caggagacactggtctca

SEQ ID NO: 6890097 - DNA, 14 bp, Homo sapiens
ctaaatactgtaca

SEQ ID NO: 6890098 - DNA, 17 bp, Homo sapiens
ttgagtccagctttcct

SEQ ID NO: 6890099 - DNA, 23 bp, Homo sapiens
tcactccctttgtggactttatt

SEQ ID NO: 6890100 - DNA, 21 bp, Homo sapiens
ttcctgggccttctcagctct

SEQ ID NO: 6890101 - DNA, 15 bp, Homo sapiens
tcttcccccctctcc

SEQ ID NO: 6890102 - DNA, 16 bp, Homo sapiens
tagctctggacgtgaa

SEQ ID NO: 6890103 - DNA, 19 bp, Homo sapiens
tgccaaaaggccccttccc

SEQ ID NO: 6890104 - DNA, 22 bp, Homo sapiens
ccctgtagccctggcccggtcc

SEQ ID NO: 6890105 - DNA, 23 bp, Homo sapiens
caggcagagtggcgtggcctccc

SEQ ID NO: 6890106 - DNA, 18 bp, Homo sapiens
catttggcttcctctgct

SEQ ID NO: 6890107 - DNA, 16 bp, Homo sapiens
gtccccaaaatgtgat

SEQ ID NO: 6890108 - DNA, 22 bp, Homo sapiens
cttgctttctttgacctcttct

SEQ ID NO: 6890109 - DNA, 20 bp, Homo sapiens
tcatctctggttttcttgcc

SEQ ID NO: 6890110 - DNA, 14 bp, Homo sapiens
gccaccgcagctgc

SEQ ID NO: 6890111 - DNA, 17 bp, Homo sapiens
agaaaccttttattttt

SEQ ID NO: 6890112 - DNA, 15 bp, Homo sapiens
actggatcctgctgc

SEQ ID NO: 6890113 - DNA, 17 bp, Homo sapiens
tcaaatcaagaaaataa

SEQ ID NO: 6890114 - DNA, 15 bp, Homo sapiens
gaagtaatgaatttt

SEQ ID NO: 6890115 - DNA, 13 bp, Homo sapiens
agaggctgaggac

SEQ ID NO: 6890116 - DNA, 22 bp, Homo sapiens
gcctccccatttcccatctgca

SEQ ID NO: 6890117 - DNA, 16 bp, Homo sapiens
gttacagtaatgtcat

SEQ ID NO: 6890118 - DNA, 15 bp, Homo sapiens
cagaaacctatctca

SEQ ID NO: 6890119 - DNA, 14 bp, Homo sapiens
ccagcagtcacagg

SEQ ID NO: 6890120 - DNA, 20 bp, Homo sapiens
cctgccccgcaggcctgcct

SEQ ID NO: 6890121 - DNA, 19 bp, Homo sapiens
caccagcccggcctgctcc

SEQ ID NO: 6890122 - DNA, 22 bp, Homo sapiens
cactgccagcatttcccttcct

SEQ ID NO: 6890123 - DNA, 18 bp, Homo sapiens
ggccttctgcctgctgac

SEQ ID NO: 6890124 - DNA, 17 bp, Homo sapiens
cagtttcccaccacctt

SEQ ID NO: 6890125 - DNA, 17 bp, Homo sapiens
cattcccagcccagccc

SEQ ID NO: 6890126 - DNA, 16 bp, Homo sapiens
cttcaagtctgtgcct

SEQ ID NO: 6890127 - DNA, 23 bp, Homo sapiens
ctatacctgtgtttcttgcctca

SEQ ID NO: 6890128 - DNA, 16 bp, Homo sapiens
caaaggaacactgaca

SEQ ID NO: 6890129 - DNA, 23 bp, Homo sapiens
cttggcttacctgacctcttgct

SEQ ID NO: 6890130 - DNA, 21 bp, Homo sapiens
gcaaatcaccacaaactgtaa

SEQ ID NO: 6890131 - DNA, 21 bp, Homo sapiens
gatctgtgaggggctctctca

SEQ ID NO: 6890132 - DNA, 14 bp, Homo sapiens
taaaatttatctta

SEQ ID NO: 6890133 - DNA, 18 bp, Homo sapiens
ctctcctcgagccctccc

SEQ ID NO: 6890134 - DNA, 22 bp, Homo sapiens
agctatctgcactctaaactgc

SEQ ID NO: 6890135 - DNA, 14 bp, Homo sapiens
atgcagtgctgctt

SEQ ID NO: 6890136 - DNA, 15 bp, Homo sapiens
tgggaccccctcgcc

SEQ ID NO: 6890137 - DNA, 20 bp, Homo sapiens
ctggggcttcaccagtctgt

SEQ ID NO: 6890138 - DNA, 22 bp, Homo sapiens
tgatgcaggatttgttctctgt

SEQ ID NO: 6890139 - DNA, 17 bp, Homo sapiens
cttctgggctactgcca

SEQ ID NO: 6890140 - DNA, 13 bp, Homo sapiens
ttctttccctgga

SEQ ID NO: 6890141 - DNA, 15 bp, Homo sapiens
ccaatcccagggctg

SEQ ID NO: 6890142 - DNA, 15 bp, Homo sapiens
acccccctctgctgc

SEQ ID NO: 6890143 - DNA, 13 bp, Homo sapiens
acttctctgctgc

SEQ ID NO: 6890144 - DNA, 23 bp, Homo sapiens
ctcggaggctcctccctctgcct

SEQ ID NO: 6890145 - DNA, 20 bp, Homo sapiens
cataaagacaatcactgcca

SEQ ID NO: 6890146 - DNA, 13 bp, Homo sapiens
tgtcatctgccag

SEQ ID NO: 6890147 - DNA, 18 bp, Homo sapiens
tgggttcaggcctggcgt

SEQ ID NO: 6890148 - DNA, 20 bp, Homo sapiens
tatattgtaagaaatactgt

SEQ ID NO: 6890149 - DNA, 17 bp, Homo sapiens
tacaaccatccctgcca

SEQ ID NO: 6890150 - DNA, 18 bp, Homo sapiens
ctgcttctcggccagccc

SEQ ID NO: 6890151 - DNA, 17 bp, Homo sapiens
cctttcacccctcttcc

SEQ ID NO: 6890152 - DNA, 23 bp, Homo sapiens
cagtgtgccccccatcctggccc

SEQ ID NO: 6890153 - DNA, 23 bp, Homo sapiens
aggactaacataaaatctgtgaa

SEQ ID NO: 6890154 - DNA, 16 bp, Homo sapiens
agtgtttttgtgaatt

SEQ ID NO: 6890155 - DNA, 16 bp, Homo sapiens
tgctcacgtctctgcc

SEQ ID NO: 6890156 - DNA, 15 bp, Homo sapiens
gacagtaagagttta

SEQ ID NO: 6890157 - DNA, 19 bp, Homo sapiens
cttttatatggcccagcct

SEQ ID NO: 6890158 - DNA, 16 bp, Homo sapiens
tgtcttcaaccctgcc

SEQ ID NO: 6890159 - DNA, 21 bp, Homo sapiens
gaacccatttgccatgctgct

SEQ ID NO: 6890160 - DNA, 14 bp, Homo sapiens
cccagcccctgccc

SEQ ID NO: 6890161 - DNA, 14 bp, Homo sapiens
actattcaatgcaa

SEQ ID NO: 6890162 - DNA, 21 bp, Homo sapiens
gttcccgagggagctgctggc

SEQ ID NO: 6890163 - DNA, 19 bp, Homo sapiens
cagagagcaggcaggggca

SEQ ID NO: 6890164 - DNA, 20 bp, Homo sapiens
cctcctaaggctccccaccc

SEQ ID NO: 6890165 - DNA, 17 bp, Homo sapiens
ctttcccttcagtaccc

SEQ ID NO: 6890166 - DNA, 17 bp, Homo sapiens
gcagctgtgtctgagcc

SEQ ID NO: 6890167 - DNA, 14 bp, Homo sapiens
agtgaggtgcccag

SEQ ID NO: 6890168 - DNA, 15 bp, Homo sapiens
gcaggtgtgggctcc

SEQ ID NO: 6890169 - DNA, 14 bp, Homo sapiens
ctagttctcaatca

SEQ ID NO: 6890170 - DNA, 12 bp, Homo sapiens
cctactgtctcc

SEQ ID NO: 6890171 - DNA, 22 bp, Homo sapiens
tctctgtgaacttccctaccct

SEQ ID NO: 6890172 - DNA, 17 bp, Homo sapiens
agaatggggttcctgct

SEQ ID NO: 6890173 - DNA, 17 bp, Homo sapiens
catttttaactactgta

SEQ ID NO: 6890174 - DNA, 14 bp, Homo sapiens
aggcagctgcctct

SEQ ID NO: 6890175 - DNA, 13 bp, Homo sapiens
cctgcccccaccc

SEQ ID NO: 6890176 - DNA, 20 bp, Homo sapiens
ctctcaggaccaccctgcca

SEQ ID NO: 6890177 - DNA, 15 bp, Homo sapiens
cgtggactctgctag

SEQ ID NO: 6890178 - DNA, 21 bp, Homo sapiens
tgactgggggcctctgcctcc

SEQ ID NO: 6890179 - DNA, 23 bp, Homo sapiens
ttatgaagaaaaaatacatttta

SEQ ID NO: 6890180 - DNA, 17 bp, Homo sapiens
acaagctgcactgtgaa

SEQ ID NO: 6890181 - DNA, 23 bp, Homo sapiens
caataaaggcagctgcctctgct

SEQ ID NO: 6890182 - DNA, 13 bp, Homo sapiens
aggcaatatcttt

SEQ ID NO: 6890183 - DNA, 15 bp, Homo sapiens
tgcttctttgtaatg

SEQ ID NO: 6890184 - DNA, 20 bp, Homo sapiens
cttcccaggaccctgggtca

SEQ ID NO: 6890185 - DNA, 14 bp, Homo sapiens
aggcattgcactaa

SEQ ID NO: 6890186 - DNA, 23 bp, Homo sapiens
cctgcccccatctccccaggcct

SEQ ID NO: 6890187 - DNA, 16 bp, Homo sapiens
tctggctttttctgcc

SEQ ID NO: 6890188 - DNA, 18 bp, Homo sapiens
attgacaccaaaatgaac

SEQ ID NO: 6890189 - DNA, 22 bp, Homo sapiens
cattcacaagcctcctgtacct

SEQ ID NO: 6890190 - DNA, 13 bp, Homo sapiens
tcaaaccaaataa

SEQ ID NO: 6890191 - DNA, 21 bp, Homo sapiens
agcctttcacaggactctgca

SEQ ID NO: 6890192 - DNA, 17 bp, Homo sapiens
ttgtatacaagtactgg

SEQ ID NO: 6890193 - DNA, 19 bp, Homo sapiens
cttcccagctctctgctct

SEQ ID NO: 6890194 - DNA, 12 bp, Homo sapiens
ctctgcactcca

SEQ ID NO: 6890195 - DNA, 19 bp, Homo sapiens
ctcttaagaagactgcatt

SEQ ID NO: 6890196 - DNA, 22 bp, Homo sapiens
tatattactagcatatgagttt

SEQ ID NO: 6890197 - DNA, 18 bp, Homo sapiens
aagctgcccagccctggc

SEQ ID NO: 6890198 - DNA, 14 bp, Homo sapiens
attaacttttgtaa

SEQ ID NO: 6890199 - DNA, 22 bp, Homo sapiens
ttgtacagactgttttactgtt

SEQ ID NO: 6890200 - DNA, 11 bp, Homo sapiens
ccaagttcctc

SEQ ID NO: 6890201 - DNA, 14 bp, Homo sapiens
ttccccgctgccca

SEQ ID NO: 6890202 - DNA, 19 bp, Homo sapiens
caaggttgtcagctttgga

SEQ ID NO: 6890203 - DNA, 14 bp, Homo sapiens
tacgtgcaccaaac

SEQ ID NO: 6890204 - DNA, 19 bp, Homo sapiens
ccagccccacccccagcca

SEQ ID NO: 6890205 - DNA, 13 bp, Homo sapiens
ctgcccccatcca

SEQ ID NO: 6890206 - DNA, 11 bp, Homo sapiens
cctctctgcag

SEQ ID NO: 6890207 - DNA, 15 bp, Homo sapiens
taaattaatattgta

SEQ ID NO: 6890208 - DNA, 14 bp, Homo sapiens
ccggcacactgcca

SEQ ID NO: 6890209 - DNA, 13 bp, Homo sapiens
atgcctgctgctg

SEQ ID NO: 6890210 - DNA, 14 bp, Homo sapiens
gttcctcctgctgt

SEQ ID NO: 6890211 - DNA, 13 bp, Homo sapiens
agaagacatgttt

SEQ ID NO: 6890212 - DNA, 22 bp, Homo sapiens
ggaaatggaaccccaccactgt

SEQ ID NO: 6890213 - DNA, 15 bp, Homo sapiens
acatcctcctgccca

SEQ ID NO: 6890214 - DNA, 13 bp, Homo sapiens
ccggccccagcca

SEQ ID NO: 6890215 - DNA, 18 bp, Homo sapiens
cataccaaagctgctgca

SEQ ID NO: 6890216 - DNA, 13 bp, Homo sapiens
tggtttccctgcc

SEQ ID NO: 6890217 - DNA, 13 bp, Homo sapiens
taattgtgtttat

SEQ ID NO: 6890218 - DNA, 17 bp, Homo sapiens
ggtgccccctcctctcc

SEQ ID NO: 6890219 - DNA, 19 bp, Homo sapiens
tgagtagatactctcagca

SEQ ID NO: 6890220 - DNA, 14 bp, Homo sapiens
ccattctctctgcc

SEQ ID NO: 6890221 - DNA, 17 bp, Homo sapiens
ctttggtaatgttagca

SEQ ID NO: 6890222 - DNA, 20 bp, Homo sapiens
tagagcccattaatcttgat

SEQ ID NO: 6890223 - DNA, 14 bp, Homo sapiens
aatactgtgtggaa

SEQ ID NO: 6890224 - DNA, 15 bp, Homo sapiens
gtctcagcctcctga

SEQ ID NO: 6890225 - DNA, 15 bp, Homo sapiens
tcaccccggcaggcc

SEQ ID NO: 6890226 - DNA, 22 bp, Homo sapiens
accaaaaaccatgttgcgttca

SEQ ID NO: 6890227 - DNA, 21 bp, Homo sapiens
cctgtccggaccgccgatccc

SEQ ID NO: 6890228 - DNA, 20 bp, Homo sapiens
aaagttcttaaaacactaac

SEQ ID NO: 6890229 - DNA, 16 bp, Homo sapiens
cttagtcactgagaca

SEQ ID NO: 6890230 - DNA, 23 bp, Homo sapiens
aaacttattaacaactgtgaata

SEQ ID NO: 6890231 - DNA, 15 bp, Homo sapiens
acagcagctcaggca

SEQ ID NO: 6890232 - DNA, 20 bp, Homo sapiens
ccagcgtctgttgtggaaag

SEQ ID NO: 6890233 - DNA, 16 bp, Homo sapiens
attggtggctttcctt

SEQ ID NO: 6890234 - DNA, 17 bp, Homo sapiens
acaaaatgttatttccc

SEQ ID NO: 6890235 - DNA, 15 bp, Homo sapiens
atctttccttcctct

SEQ ID NO: 6890236 - DNA, 21 bp, Homo sapiens
ccctcaagccaatcccctcct

SEQ ID NO: 6890237 - DNA, 13 bp, Homo sapiens
cttggagtgcccc

SEQ ID NO: 6890238 - DNA, 13 bp, Homo sapiens
catcgtgtttgca

SEQ ID NO: 6890239 - DNA, 12 bp, Homo sapiens
cctgactgtcct

SEQ ID NO: 6890240 - DNA, 20 bp, Homo sapiens
cttgcagctggcccactgct

SEQ ID NO: 6890241 - DNA, 19 bp, Homo sapiens
gattctgggaaaggtgctc

SEQ ID NO: 6890242 - DNA, 17 bp, Homo sapiens
actgtccttccctgcca

SEQ ID NO: 6890243 - DNA, 12 bp, Homo sapiens
ctcccatttcta

SEQ ID NO: 6890244 - DNA, 19 bp, Homo sapiens
tgccttcgttaactgtgta

SEQ ID NO: 6890245 - DNA, 14 bp, Homo sapiens
cagtcctccatcca

SEQ ID NO: 6890246 - DNA, 18 bp, Homo sapiens
cttgtgaaacacagctgt

SEQ ID NO: 6890247 - DNA, 18 bp, Homo sapiens
cttgtggactctctgcct

SEQ ID NO: 6890248 - DNA, 13 bp, Homo sapiens
ccatccccagcga

SEQ ID NO: 6890249 - DNA, 16 bp, Homo sapiens
taggagagcactgcct

SEQ ID NO: 6890250 - DNA, 15 bp, Homo sapiens
cacctgacctctgca

SEQ ID NO: 6890251 - DNA, 13 bp, Homo sapiens
aagcaaatgtgaa

SEQ ID NO: 6890252 - DNA, 13 bp, Homo sapiens
atgcaaaatggaa

SEQ ID NO: 6890253 - DNA, 14 bp, Homo sapiens
tcagttctgtgtgg

SEQ ID NO: 6890254 - DNA, 17 bp, Homo sapiens
gaaatactgctctgaat

SEQ ID NO: 6890255 - DNA, 12 bp, Homo sapiens
ccgtgtacaata

SEQ ID NO: 6890256 - DNA, 13 bp, Homo sapiens
ctaattgcttatt

SEQ ID NO: 6890257 - DNA, 13 bp, Homo sapiens
ctagcctccctct

SEQ ID NO: 6890258 - DNA, 13 bp, Homo sapiens
catgccactgcca

SEQ ID NO: 6890259 - DNA, 23 bp, Homo sapiens
ttctaattgtacccttcttgtct

SEQ ID NO: 6890260 - DNA, 15 bp, Homo sapiens
agcctgtcaccagag

SEQ ID NO: 6890261 - DNA, 17 bp, Homo sapiens
tatgacccacactgcca

SEQ ID NO: 6890262 - DNA, 17 bp, Homo sapiens
tgaactggactagtgaa

SEQ ID NO: 6890263 - DNA, 21 bp, Homo sapiens
cagaatgaggcacatgacagt

SEQ ID NO: 6890264 - DNA, 16 bp, Homo sapiens
caataaaccagtgtga

SEQ ID NO: 6890265 - DNA, 18 bp, Homo sapiens
tctgccatgatgtttaca

SEQ ID NO: 6890266 - DNA, 15 bp, Homo sapiens
tccatgactctgcct

SEQ ID NO: 6890267 - DNA, 19 bp, Homo sapiens
acttgctctggacctgccc

SEQ ID NO: 6890268 - DNA, 16 bp, Homo sapiens
cctctgttcagtcgca

SEQ ID NO: 6890269 - DNA, 20 bp, Homo sapiens
cctcccaggcgccccttccc

SEQ ID NO: 6890270 - DNA, 16 bp, Homo sapiens
ctgccaagcctggagc

SEQ ID NO: 6890271 - DNA, 20 bp, Homo sapiens
acacgcacacacacacacag

SEQ ID NO: 6890272 - DNA, 16 bp, Homo sapiens
ccagcgcctgtgctga

SEQ ID NO: 6890273 - DNA, 16 bp, Homo sapiens
tcagttatattcttta

SEQ ID NO: 6890274 - DNA, 22 bp, Homo sapiens
aataagtgttgtaccatatgta

SEQ ID NO: 6890275 - DNA, 14 bp, Homo sapiens
ctgactccctgtgg

SEQ ID NO: 6890276 - DNA, 21 bp, Homo sapiens
ccctggggcatccaccttcct

SEQ ID NO: 6890277 - DNA, 18 bp, Homo sapiens
ccaacaccagcccctgcc

SEQ ID NO: 6890278 - DNA, 15 bp, Homo sapiens
aacattttatactgt

SEQ ID NO: 6890279 - DNA, 18 bp, Homo sapiens
ctgggtcagtctggtggg

SEQ ID NO: 6890280 - DNA, 23 bp, Homo sapiens
acatgcttaagggggtgtaatga

SEQ ID NO: 6890281 - DNA, 17 bp, Homo sapiens
ctcacttataccaaagg

SEQ ID NO: 6890282 - DNA, 23 bp, Homo sapiens
ccgtttgatttgtcactgcttca

SEQ ID NO: 6890283 - DNA, 15 bp, Homo sapiens
cctacaggcagtctc

SEQ ID NO: 6890284 - DNA, 22 bp, Homo sapiens
catgatccacccacctcagcct

SEQ ID NO: 6890285 - DNA, 22 bp, Homo sapiens
actcatggcagctgtttctcat

SEQ ID NO: 6890286 - DNA, 19 bp, Homo sapiens
ctccctgtaatgcactcct

SEQ ID NO: 6890287 - DNA, 16 bp, Homo sapiens
ctcactctgggtgcct

SEQ ID NO: 6890288 - DNA, 19 bp, Homo sapiens
tgcacaccaaattgctgag

SEQ ID NO: 6890289 - DNA, 22 bp, Homo sapiens
taaccaaagagtctctggctca

SEQ ID NO: 6890290 - DNA, 18 bp, Homo sapiens
actttcggagaaattctc

SEQ ID NO: 6890291 - DNA, 17 bp, Homo sapiens
aatcaagagtctctcca

SEQ ID NO: 6890292 - DNA, 20 bp, Homo sapiens
attgttctgctttttctgta

SEQ ID NO: 6890293 - DNA, 13 bp, Homo sapiens
tgttgcactgccc

SEQ ID NO: 6890294 - DNA, 14 bp, Homo sapiens
cacaaatgccttga

SEQ ID NO: 6890295 - DNA, 21 bp, Homo sapiens
ccctccttccttcttgcttct

SEQ ID NO: 6890296 - DNA, 21 bp, Homo sapiens
ctggaagctttgtcccctgct

SEQ ID NO: 6890297 - DNA, 12 bp, Homo sapiens
aatcactgtgaa

SEQ ID NO: 6890298 - DNA, 12 bp, Homo sapiens
gactctgtgctg

SEQ ID NO: 6890299 - DNA, 17 bp, Homo sapiens
caaaaactttcatgcct

SEQ ID NO: 6890300 - DNA, 16 bp, Homo sapiens
acctaccatgctgctt

SEQ ID NO: 6890301 - DNA, 14 bp, Homo sapiens
aattccacagctgc

SEQ ID NO: 6890302 - DNA, 19 bp, Homo sapiens
tgtgcagttgctgtttact

SEQ ID NO: 6890303 - DNA, 20 bp, Homo sapiens
aatgaaatataaactgtgag

SEQ ID NO: 6890304 - DNA, 18 bp, Homo sapiens
ctgtaatcggctcccgct

SEQ ID NO: 6890305 - DNA, 15 bp, Homo sapiens
ggccaggcctctgct

SEQ ID NO: 6890306 - DNA, 18 bp, Homo sapiens
cgcaggctggccctgccc

SEQ ID NO: 6890307 - DNA, 18 bp, Homo sapiens
caccatctgccaatgcca

SEQ ID NO: 6890308 - DNA, 12 bp, Homo sapiens
ctggggtgggag

SEQ ID NO: 6890309 - DNA, 14 bp, Homo sapiens
aataaatgccttta

SEQ ID NO: 6890310 - DNA, 16 bp, Homo sapiens
tacctgttagctccct

SEQ ID NO: 6890311 - DNA, 20 bp, Homo sapiens
ctcttcccttctcccttgcc

SEQ ID NO: 6890312 - DNA, 19 bp, Homo sapiens
agcaggtgcaagagacaga

SEQ ID NO: 6890313 - DNA, 21 bp, Homo sapiens
tcctagagtcttaaagcattt

SEQ ID NO: 6890314 - DNA, 16 bp, Homo sapiens
atttcatgtgatctat

SEQ ID NO: 6890315 - DNA, 18 bp, Homo sapiens
tgtgcatgtgctgtgtga

SEQ ID NO: 6890316 - DNA, 15 bp, Homo sapiens
cacactttctcttca

SEQ ID NO: 6890317 - DNA, 18 bp, Homo sapiens
ctttctttttttcccccc

SEQ ID NO: 6890318 - DNA, 14 bp, Homo sapiens
gagttggtgtgcta

SEQ ID NO: 6890319 - DNA, 19 bp, Homo sapiens
cctctccataaccccaccc

SEQ ID NO: 6890320 - DNA, 21 bp, Homo sapiens
cacttctgcgggctccctcct

SEQ ID NO: 6890321 - DNA, 14 bp, Homo sapiens
atattgtacagttt

SEQ ID NO: 6890322 - DNA, 19 bp, Homo sapiens
gtaaattttataatgtcat

SEQ ID NO: 6890323 - DNA, 15 bp, Homo sapiens
cactcgaggcctgca

SEQ ID NO: 6890324 - DNA, 20 bp, Homo sapiens
cactgcatttgcctgcttct

SEQ ID NO: 6890325 - DNA, 13 bp, Homo sapiens
ggtgcattgctgt

SEQ ID NO: 6890326 - DNA, 22 bp, Homo sapiens
agcctgcttcttcccctctgcg

SEQ ID NO: 6890327 - DNA, 22 bp, Homo sapiens
gtgacccggcaccccctgcagc

SEQ ID NO: 6890328 - DNA, 17 bp, Homo sapiens
ccaggctggcgcagcca

SEQ ID NO: 6890329 - DNA, 14 bp, Homo sapiens
gcactgaagagctc

SEQ ID NO: 6890330 - DNA, 22 bp, Homo sapiens
acttcctgcctggtctcctgcc

SEQ ID NO: 6890331 - DNA, 14 bp, Homo sapiens
attatatatttaca

SEQ ID NO: 6890332 - DNA, 22 bp, Homo sapiens
atgctccctcccctgccctggt

SEQ ID NO: 6890333 - DNA, 15 bp, Homo sapiens
ctccattaaagtctg

SEQ ID NO: 6890334 - DNA, 10 bp, Homo sapiens
agcctgctgg

SEQ ID NO: 6890335 - DNA, 16 bp, Homo sapiens
agtgctttgcccttga

SEQ ID NO: 6890336 - DNA, 23 bp, Homo sapiens
gctccagaagatgccagcttctc

SEQ ID NO: 6890337 - DNA, 17 bp, Homo sapiens
accctctgccaccagag

SEQ ID NO: 6890338 - DNA, 21 bp, Homo sapiens
ctcactgttctattcatctca

SEQ ID NO: 6890339 - DNA, 21 bp, Homo sapiens
accttctcccaggcctctgcc

SEQ ID NO: 6890340 - DNA, 18 bp, Homo sapiens
ccttccacacccccaccc

SEQ ID NO: 6890341 - DNA, 21 bp, Homo sapiens
cctgcaggcggggctcctcct

SEQ ID NO: 6890342 - DNA, 15 bp, Homo sapiens
cctctccaccctccc

SEQ ID NO: 6890343 - DNA, 22 bp, Homo sapiens
aattgctcctgcatgcaactaa

SEQ ID NO: 6890344 - DNA, 21 bp, Homo sapiens
ccatgcatggcctcccagcca

SEQ ID NO: 6890345 - DNA, 14 bp, Homo sapiens
ctccactctcctct

SEQ ID NO: 6890346 - DNA, 15 bp, Homo sapiens
atgtttgcctctgcc

SEQ ID NO: 6890347 - DNA, 22 bp, Homo sapiens
gcactgctgtgctgtgcccaag

SEQ ID NO: 6890348 - DNA, 14 bp, Homo sapiens
atcgacctgcctcg

SEQ ID NO: 6890349 - DNA, 16 bp, Homo sapiens
cagaacttaatctgga

SEQ ID NO: 6890350 - DNA, 16 bp, Homo sapiens
ctccatctccactcca

SEQ ID NO: 6890351 - DNA, 19 bp, Homo sapiens
tctcccaccccggcctcca

SEQ ID NO: 6890352 - DNA, 13 bp, Homo sapiens
ggactgctgtgaa

SEQ ID NO: 6890353 - DNA, 17 bp, Homo sapiens
tccaccgaccaactgcc

SEQ ID NO: 6890354 - DNA, 22 bp, Homo sapiens
cttccccactgcctgcccaccc

SEQ ID NO: 6890355 - DNA, 17 bp, Homo sapiens
ccctggcttccccttca

SEQ ID NO: 6890356 - DNA, 15 bp, Homo sapiens
aggaatttcccagga

SEQ ID NO: 6890357 - DNA, 15 bp, Homo sapiens
gccactgagctggct

SEQ ID NO: 6890358 - DNA, 22 bp, Homo sapiens
agggggccttgcggaagccata

SEQ ID NO: 6890359 - DNA, 13 bp, Homo sapiens
catgctgccctgt

SEQ ID NO: 6890360 - DNA, 21 bp, Homo sapiens
ccaggcagaaatagttgtctg

SEQ ID NO: 6890361 - DNA, 20 bp, Homo sapiens
cacttttggtctcctcttcc

SEQ ID NO: 6890362 - DNA, 12 bp, Homo sapiens
ctattgacaata

SEQ ID NO: 6890363 - DNA, 17 bp, Homo sapiens
ataatttttatatttaa

SEQ ID NO: 6890364 - DNA, 19 bp, Homo sapiens
aggaagcattcagagagca

SEQ ID NO: 6890365 - DNA, 23 bp, Homo sapiens
agacagagtcttcctctgtctcc

SEQ ID NO: 6890366 - DNA, 14 bp, Homo sapiens
aggtatactatgta

SEQ ID NO: 6890367 - DNA, 13 bp, Homo sapiens
ttgcaagccataa

SEQ ID NO: 6890368 - DNA, 13 bp, Homo sapiens
cacacccctgccc

SEQ ID NO: 6890369 - DNA, 20 bp, Homo sapiens
gccaggcccccaccacacat

SEQ ID NO: 6890370 - DNA, 13 bp, Homo sapiens
agcagccagccag

SEQ ID NO: 6890371 - DNA, 21 bp, Homo sapiens
tgacctaagatttattttgtt

SEQ ID NO: 6890372 - DNA, 14 bp, Homo sapiens
cgtcttgtgaaatt

SEQ ID NO: 6890373 - DNA, 23 bp, Homo sapiens
agaaattccttgattcacaatga

SEQ ID NO: 6890374 - DNA, 15 bp, Homo sapiens
ctctgtcctgcttct

SEQ ID NO: 6890375 - DNA, 15 bp, Homo sapiens
tgcttttcctctgcc

SEQ ID NO: 6890376 - DNA, 16 bp, Homo sapiens
agcagctcaggcgcag

SEQ ID NO: 6890377 - DNA, 17 bp, Homo sapiens
cttgctgtctctgctcg

SEQ ID NO: 6890378 - DNA, 18 bp, Homo sapiens
taatatttattgctttat

SEQ ID NO: 6890379 - DNA, 16 bp, Homo sapiens
tttgaagcctgtgcct

SEQ ID NO: 6890380 - DNA, 13 bp, Homo sapiens
gcttccctctgct

SEQ ID NO: 6890381 - DNA, 16 bp, Homo sapiens
catgcctcctcctgcc

SEQ ID NO: 6890382 - DNA, 19 bp, Homo sapiens
gtccctccctcctggctca

SEQ ID NO: 6890383 - DNA, 15 bp, Homo sapiens
tgtgccaccctctgc

SEQ ID NO: 6890384 - DNA, 24 bp, Homo sapiens
cacttcctgtttgggcccctctcc

SEQ ID NO: 6890385 - DNA, 22 bp, Homo sapiens
caaaattacagactgtctgaaa

SEQ ID NO: 6890386 - DNA, 13 bp, Homo sapiens
ctctgccccttct

SEQ ID NO: 6890387 - DNA, 13 bp, Homo sapiens
cataatgtcttta

SEQ ID NO: 6890388 - DNA, 16 bp, Homo sapiens
cccggccgcccctcct

SEQ ID NO: 6890389 - DNA, 14 bp, Homo sapiens
catcatgtaccaag

SEQ ID NO: 6890390 - DNA, 22 bp, Homo sapiens
caagtgaaataacaaaatggac

SEQ ID NO: 6890391 - DNA, 14 bp, Homo sapiens
ggaagagaagggaa

SEQ ID NO: 6890392 - DNA, 17 bp, Homo sapiens
ccttgcttttccctctt

SEQ ID NO: 6890393 - DNA, 19 bp, Homo sapiens
cctctctggcctcccaccc

SEQ ID NO: 6890394 - DNA, 21 bp, Homo sapiens
tatcaggactgtgaccaaagc

SEQ ID NO: 6890395 - DNA, 22 bp, Homo sapiens
aaatgtatatttaacttctagt

SEQ ID NO: 6890396 - DNA, 15 bp, Homo sapiens
gctggaggcccaggc

SEQ ID NO: 6890397 - DNA, 19 bp, Homo sapiens
cattatactctctgaaata

SEQ ID NO: 6890398 - DNA, 17 bp, Homo sapiens
cagcagacagagccagg

SEQ ID NO: 6890399 - DNA, 19 bp, Homo sapiens
ctagtctcctttgcactga

SEQ ID NO: 6890400 - DNA, 18 bp, Homo sapiens
ttcaggaccccatctgct

SEQ ID NO: 6890401 - DNA, 14 bp, Homo sapiens
tccaccagcctgca

SEQ ID NO: 6890402 - DNA, 12 bp, Homo sapiens
ctgtaaatggaa

SEQ ID NO: 6890403 - DNA, 16 bp, Homo sapiens
agcaccgttctgtgca

SEQ ID NO: 6890404 - DNA, 12 bp, Homo sapiens
caacttctccca

SEQ ID NO: 6890405 - DNA, 18 bp, Homo sapiens
tcctgggcagctgcctcc

SEQ ID NO: 6890406 - DNA, 13 bp, Homo sapiens
caccccgtctgcc

SEQ ID NO: 6890407 - DNA, 18 bp, Homo sapiens
agaaacttttttattttt

SEQ ID NO: 6890408 - DNA, 16 bp, Homo sapiens
tcataaggaaatgtgt

SEQ ID NO: 6890409 - DNA, 19 bp, Homo sapiens
cttgcaaagacctacctcc

SEQ ID NO: 6890410 - DNA, 15 bp, Homo sapiens
cccccgaccctgccc

SEQ ID NO: 6890411 - DNA, 11 bp, Homo sapiens
cacttctggga

SEQ ID NO: 6890412 - DNA, 22 bp, Homo sapiens
ccagatagttatattaaattta

SEQ ID NO: 6890413 - DNA, 14 bp, Homo sapiens
atgtaacttcctct

SEQ ID NO: 6890414 - DNA, 21 bp, Homo sapiens
caggaacccatcactgtgtct

SEQ ID NO: 6890415 - DNA, 13 bp, Homo sapiens
cccagccccttcc

SEQ ID NO: 6890416 - DNA, 15 bp, Homo sapiens
taaactgtagctgta

SEQ ID NO: 6890417 - DNA, 21 bp, Homo sapiens
ttcatcctcattgcctcctgt

SEQ ID NO: 6890418 - DNA, 22 bp, Homo sapiens
agccaggagaagacccctgccc

SEQ ID NO: 6890419 - DNA, 22 bp, Homo sapiens
ctttgtcattcagttctaggcc

SEQ ID NO: 6890420 - DNA, 13 bp, Homo sapiens
ctgtcattttgca

SEQ ID NO: 6890421 - DNA, 15 bp, Homo sapiens
cctcatcctcctcct

SEQ ID NO: 6890422 - DNA, 20 bp, Homo sapiens
agcccagagagaccctgcca

SEQ ID NO: 6890423 - DNA, 15 bp, Homo sapiens
ttggttactggtgat

SEQ ID NO: 6890424 - DNA, 18 bp, Homo sapiens
gatctttttttaagtgtt

SEQ ID NO: 6890425 - DNA, 15 bp, Homo sapiens
ataattttatctgta

SEQ ID NO: 6890426 - DNA, 19 bp, Homo sapiens
cacattaggcattgagact

SEQ ID NO: 6890427 - DNA, 20 bp, Homo sapiens
tctacccagcccatcttgcc

SEQ ID NO: 6890428 - DNA, 13 bp, Homo sapiens
ccagagcacttta

SEQ ID NO: 6890429 - DNA, 12 bp, Homo sapiens
ctacctcagcct

SEQ ID NO: 6890430 - DNA, 23 bp, Homo sapiens
catgttcgagcttacctactctt

SEQ ID NO: 6890431 - DNA, 21 bp, Homo sapiens
agaaggcaaactgaggcagca

SEQ ID NO: 6890432 - DNA, 12 bp, Homo sapiens
caggactccagc

SEQ ID NO: 6890433 - DNA, 13 bp, Homo sapiens
cttcttcctcccc

SEQ ID NO: 6890434 - DNA, 21 bp, Homo sapiens
cttcaccatttggcaatgcca

SEQ ID NO: 6890435 - DNA, 18 bp, Homo sapiens
cctggcccacgccctccc

SEQ ID NO: 6890436 - DNA, 18 bp, Homo sapiens
atggtctcgatctcctga

SEQ ID NO: 6890437 - DNA, 14 bp, Homo sapiens
cctggcccctgcct

SEQ ID NO: 6890438 - DNA, 14 bp, Homo sapiens
agctctccaggcca

SEQ ID NO: 6890439 - DNA, 16 bp, Homo sapiens
ggtaagatgactctga

SEQ ID NO: 6890440 - DNA, 14 bp, Homo sapiens
ttatatattttgtt

SEQ ID NO: 6890441 - DNA, 14 bp, Homo sapiens
ctcaacctcttctg

SEQ ID NO: 6890442 - DNA, 17 bp, Homo sapiens
tccccaagatctgccag

SEQ ID NO: 6890443 - DNA, 20 bp, Homo sapiens
ccaccagcaatgccctgcct

SEQ ID NO: 6890444 - DNA, 18 bp, Homo sapiens
ttataatattttaatgta

SEQ ID NO: 6890445 - DNA, 21 bp, Homo sapiens
cttgggatagtgttctgctcc

SEQ ID NO: 6890446 - DNA, 16 bp, Homo sapiens
agggagggcagagctg

SEQ ID NO: 6890447 - DNA, 16 bp, Homo sapiens
aatagcatactgtgta

SEQ ID NO: 6890448 - DNA, 20 bp, Homo sapiens
cctccctcagctctctggga

SEQ ID NO: 6890449 - DNA, 13 bp, Homo sapiens
ggccgtcctcccg

SEQ ID NO: 6890450 - DNA, 19 bp, Homo sapiens
ctcttgttcttactttcct

SEQ ID NO: 6890451 - DNA, 18 bp, Homo sapiens
ctgtaatgcactcctgcc

SEQ ID NO: 6890452 - DNA, 21 bp, Homo sapiens
agcctttgtgctttttgtcat

SEQ ID NO: 6890453 - DNA, 18 bp, Homo sapiens
caagttgttgactgtgat

SEQ ID NO: 6890454 - DNA, 17 bp, Homo sapiens
ccttctgtccccagccc

SEQ ID NO: 6890455 - DNA, 17 bp, Homo sapiens
ctcttcctttcattcta

SEQ ID NO: 6890456 - DNA, 17 bp, Homo sapiens
acaacagaaacttctca

SEQ ID NO: 6890457 - DNA, 21 bp, Homo sapiens
ctcctgaaccgcacagctcag

SEQ ID NO: 6890458 - DNA, 22 bp, Homo sapiens
aaccagccacagtacatatgta

SEQ ID NO: 6890459 - DNA, 21 bp, Homo sapiens
acccctccccacccaccaccg

SEQ ID NO: 6890460 - DNA, 14 bp, Homo sapiens
cccagctctgcttt

SEQ ID NO: 6890461 - DNA, 13 bp, Homo sapiens
cagtctcctcccc

SEQ ID NO: 6890462 - DNA, 19 bp, Homo sapiens
gaaaagcctgaactattta

SEQ ID NO: 6890463 - DNA, 19 bp, Homo sapiens
ccctggctttgcctcttct

SEQ ID NO: 6890464 - DNA, 18 bp, Homo sapiens
gttttgtgatgtttgtcc

SEQ ID NO: 6890465 - DNA, 23 bp, Homo sapiens
ttcctgtcttctttctcctgtgg

SEQ ID NO: 6890466 - DNA, 14 bp, Homo sapiens
cctccagcctctcc

SEQ ID NO: 6890467 - DNA, 20 bp, Homo sapiens
ccatgtggcctgcccagcct

SEQ ID NO: 6890468 - DNA, 19 bp, Homo sapiens
caacctcctgtgggcctca

SEQ ID NO: 6890469 - DNA, 18 bp, Homo sapiens
gacaacaatactacctca

SEQ ID NO: 6890470 - DNA, 21 bp, Homo sapiens
cccaggccgcagctcttgccc

SEQ ID NO: 6890471 - DNA, 22 bp, Homo sapiens
agacactgtgagagttgtctct

SEQ ID NO: 6890472 - DNA, 19 bp, Homo sapiens
cactgccccacatgcatgt

SEQ ID NO: 6890473 - DNA, 14 bp, Homo sapiens
ctgttgtcctcccc

SEQ ID NO: 6890474 - DNA, 15 bp, Homo sapiens
aacactgcctctgag

SEQ ID NO: 6890475 - DNA, 21 bp, Homo sapiens
gccaatgtacataccttgtta

SEQ ID NO: 6890476 - DNA, 16 bp, Homo sapiens
cctgcttctcccgcca

SEQ ID NO: 6890477 - DNA, 18 bp, Homo sapiens
tatcttctgtttttctca

SEQ ID NO: 6890478 - DNA, 21 bp, Homo sapiens
ccctttggggttgcccagcct

SEQ ID NO: 6890479 - DNA, 14 bp, Homo sapiens
agactgccctgccc

SEQ ID NO: 6890480 - DNA, 23 bp, Homo sapiens
ctcttaccatcccggtgcatgca

SEQ ID NO: 6890481 - DNA, 13 bp, Homo sapiens
aacgcccctgtgg

SEQ ID NO: 6890482 - DNA, 15 bp, Homo sapiens
tgggtcctgccagct

SEQ ID NO: 6890483 - DNA, 18 bp, Homo sapiens
ataatggtgaacatttta

SEQ ID NO: 6890484 - DNA, 14 bp, Homo sapiens
attctcatgcctca

SEQ ID NO: 6890485 - DNA, 17 bp, Homo sapiens
atgtgtcccccctgtgg

SEQ ID NO: 6890486 - DNA, 15 bp, Homo sapiens
tcctgtcctgcctcc

SEQ ID NO: 6890487 - DNA, 21 bp, Homo sapiens
aacctgtagaacacccctgtg

SEQ ID NO: 6890488 - DNA, 17 bp, Homo sapiens
tcttcgaagccttgcct

SEQ ID NO: 6890489 - DNA, 22 bp, Homo sapiens
ttgaataaaaaacatttgtaca

SEQ ID NO: 6890490 - DNA, 18 bp, Homo sapiens
cattgcttattcttgagc

SEQ ID NO: 6890491 - DNA, 20 bp, Homo sapiens
tctgggaagtcctagcccct

SEQ ID NO: 6890492 - DNA, 15 bp, Homo sapiens
aattacccttcctca

SEQ ID NO: 6890493 - DNA, 15 bp, Homo sapiens
aaagcaaagatgcat

SEQ ID NO: 6890494 - DNA, 12 bp, Homo sapiens
acatctgaggaa

SEQ ID NO: 6890495 - DNA, 15 bp, Homo sapiens
acctgtcaccctgca

SEQ ID NO: 6890496 - DNA, 22 bp, Homo sapiens
ctctttcttcaattaatggaaa

SEQ ID NO: 6890497 - DNA, 20 bp, Homo sapiens
acagatttccatcctagtca

SEQ ID NO: 6890498 - DNA, 12 bp, Homo sapiens
tgacttctgcct

SEQ ID NO: 6890499 - DNA, 15 bp, Homo sapiens
cctccaccgctgcct

SEQ ID NO: 6890500 - DNA, 19 bp, Homo sapiens
aatactatttttactgcca

SEQ ID NO: 6890501 - DNA, 16 bp, Homo sapiens
ttccatgactctgcct

SEQ ID NO: 6890502 - DNA, 18 bp, Homo sapiens
ttggacctcgtgctttaa

SEQ ID NO: 6890503 - DNA, 13 bp, Homo sapiens
aggttcctctgcc

SEQ ID NO: 6890504 - DNA, 21 bp, Homo sapiens
gccggcagccccagcctgcta

SEQ ID NO: 6890505 - DNA, 21 bp, Homo sapiens
tctcaataaaattatagctct

SEQ ID NO: 6890506 - DNA, 22 bp, Homo sapiens
tgggcccccagagacctttgcc

SEQ ID NO: 6890507 - DNA, 19 bp, Homo sapiens
ctggcacatttcagggaga

SEQ ID NO: 6890508 - DNA, 23 bp, Homo sapiens
caccaggggtgctcacctctgcc

SEQ ID NO: 6890509 - DNA, 14 bp, Homo sapiens
catgctcctctgcc

SEQ ID NO: 6890510 - DNA, 22 bp, Homo sapiens
ggacatgctaaataactatata

SEQ ID NO: 6890511 - DNA, 20 bp, Homo sapiens
caccctggagagtgcacatg

SEQ ID NO: 6890512 - DNA, 13 bp, Homo sapiens
cttttgagtggta

SEQ ID NO: 6890513 - DNA, 19 bp, Homo sapiens
tgtgccaagattctactct

SEQ ID NO: 6890514 - DNA, 17 bp, Homo sapiens
cctgggttccctttcct

SEQ ID NO: 6890515 - DNA, 19 bp, Homo sapiens
ccatgtcttctgctgttct

SEQ ID NO: 6890516 - DNA, 16 bp, Homo sapiens
gaaagcggctgcctcc

SEQ ID NO: 6890517 - DNA, 11 bp, Homo sapiens
ccgccctgcca

SEQ ID NO: 6890518 - DNA, 13 bp, Homo sapiens
ctgagctctgcct

SEQ ID NO: 6890519 - DNA, 19 bp, Homo sapiens
tgatcagaggtgtacacta

SEQ ID NO: 6890520 - DNA, 17 bp, Homo sapiens
ccgggtccccagctccc

SEQ ID NO: 6890521 - DNA, 22 bp, Homo sapiens
ctttacatatgattgtatttgt

SEQ ID NO: 6890522 - DNA, 13 bp, Homo sapiens
ccagtagtgacca

SEQ ID NO: 6890523 - DNA, 13 bp, Homo sapiens
aggcaggcattga

SEQ ID NO: 6890524 - DNA, 15 bp, Homo sapiens
ccgtgctcctctgcc

SEQ ID NO: 6890525 - DNA, 15 bp, Homo sapiens
actttttaatggcaa

SEQ ID NO: 6890526 - DNA, 14 bp, Homo sapiens
taatcattgcttat

SEQ ID NO: 6890527 - DNA, 14 bp, Homo sapiens
gtttctgttccaaa

SEQ ID NO: 6890528 - DNA, 19 bp, Homo sapiens
cagggcagcccctgcagac

SEQ ID NO: 6890529 - DNA, 21 bp, Homo sapiens
cctttttctccctctggatca

SEQ ID NO: 6890530 - DNA, 17 bp, Homo sapiens
tctgcaccaccatgccc

SEQ ID NO: 6890531 - DNA, 20 bp, Homo sapiens
ccctgtccttcccacggcca

SEQ ID NO: 6890532 - DNA, 19 bp, Homo sapiens
tagtttattatagtctgta

SEQ ID NO: 6890533 - DNA, 15 bp, Homo sapiens
ccactggccagtcct

SEQ ID NO: 6890534 - DNA, 17 bp, Homo sapiens
tggcctcatctctgcct

SEQ ID NO: 6890535 - DNA, 23 bp, Homo sapiens
ctagttctcaatcactgctcccc

SEQ ID NO: 6890536 - DNA, 23 bp, Homo sapiens
ccagtgggatgggctctacctct

SEQ ID NO: 6890537 - DNA, 20 bp, Homo sapiens
tcaactgagaagccaagcct

SEQ ID NO: 6890538 - DNA, 19 bp, Homo sapiens
aagcctggagcccctgtgt

SEQ ID NO: 6890539 - DNA, 20 bp, Homo sapiens
catcattcatgacaacatga

SEQ ID NO: 6890540 - DNA, 17 bp, Homo sapiens
cctcctctctccctgcc

SEQ ID NO: 6890541 - DNA, 22 bp, Homo sapiens
caaacatgtggcaacctgttct

SEQ ID NO: 6890542 - DNA, 19 bp, Homo sapiens
cacaccgctggtccctgcc

SEQ ID NO: 6890543 - DNA, 14 bp, Homo sapiens
atcttaatactgtt

SEQ ID NO: 6890544 - DNA, 17 bp, Homo sapiens
ccattctacttgctctg

SEQ ID NO: 6890545 - DNA, 13 bp, Homo sapiens
cagctcctcaccc

SEQ ID NO: 6890546 - DNA, 13 bp, Homo sapiens
ctccccctctgct

SEQ ID NO: 6890547 - DNA, 11 bp, Homo sapiens
cagcatgtgtg

SEQ ID NO: 6890548 - DNA, 17 bp, Homo sapiens
ctggaggggcccctgct

SEQ ID NO: 6890549 - DNA, 14 bp, Homo sapiens
ctggctctgggact

SEQ ID NO: 6890550 - DNA, 23 bp, Homo sapiens
cctgagctcaaatctctgttact

SEQ ID NO: 6890551 - DNA, 16 bp, Homo sapiens
actctgactctttgac

SEQ ID NO: 6890552 - DNA, 15 bp, Homo sapiens
cctccaacccaaccc

SEQ ID NO: 6890553 - DNA, 19 bp, Homo sapiens
cactcagtgagcctcctgt

SEQ ID NO: 6890554 - DNA, 22 bp, Homo sapiens
gtccgccccgtgctcctctgcc

SEQ ID NO: 6890555 - DNA, 16 bp, Homo sapiens
tatatataattctgta

SEQ ID NO: 6890556 - DNA, 11 bp, Homo sapiens
gagacatgaat

SEQ ID NO: 6890557 - DNA, 18 bp, Homo sapiens
accttatacatcacttcc

SEQ ID NO: 6890558 - DNA, 20 bp, Homo sapiens
cctgtgggtgttctttcctg

SEQ ID NO: 6890559 - DNA, 16 bp, Homo sapiens
ctgctgcccacggcca

SEQ ID NO: 6890560 - DNA, 21 bp, Homo sapiens
gcccctcaggggaagctgcta

SEQ ID NO: 6890561 - DNA, 16 bp, Homo sapiens
gctgattttattcttg

SEQ ID NO: 6890562 - DNA, 20 bp, Homo sapiens
gcaaggtttaaatttgttat

SEQ ID NO: 6890563 - DNA, 23 bp, Homo sapiens
gtgatctgggcattttcctcctc

SEQ ID NO: 6890564 - DNA, 18 bp, Homo sapiens
acagcgagggcagctgct

SEQ ID NO: 6890565 - DNA, 15 bp, Homo sapiens
aaatgcaaaatgaaa

SEQ ID NO: 6890566 - DNA, 19 bp, Homo sapiens
ttcagcccctcctctgcca

SEQ ID NO: 6890567 - DNA, 12 bp, Homo sapiens
gtgcgcccaggg

SEQ ID NO: 6890568 - DNA, 18 bp, Homo sapiens
caacttcctgtggcctga

SEQ ID NO: 6890569 - DNA, 17 bp, Homo sapiens
caatttaggaatgctca

SEQ ID NO: 6890570 - DNA, 22 bp, Homo sapiens
tctgtataatactttgtataca

SEQ ID NO: 6890571 - DNA, 16 bp, Homo sapiens
cagactggcctgagga

SEQ ID NO: 6890572 - DNA, 12 bp, Homo sapiens
cacttccttgcc

SEQ ID NO: 6890573 - DNA, 14 bp, Homo sapiens
ctggccatgcaagt

SEQ ID NO: 6890574 - DNA, 16 bp, Homo sapiens
gtgtcgtctgtgaatg

SEQ ID NO: 6890575 - DNA, 15 bp, Homo sapiens
ctctcttaaatgcaa

SEQ ID NO: 6890576 - DNA, 21 bp, Homo sapiens
aatgaaatcttcccagtatta

SEQ ID NO: 6890577 - DNA, 15 bp, Homo sapiens
caggatcatggtgta

SEQ ID NO: 6890578 - DNA, 16 bp, Homo sapiens
ctttgattccatctcc

SEQ ID NO: 6890579 - DNA, 22 bp, Homo sapiens
taccccttcctgtcctgcctcc

SEQ ID NO: 6890580 - DNA, 13 bp, Homo sapiens
ttctcgtcttcct

SEQ ID NO: 6890581 - DNA, 14 bp, Homo sapiens
ctgcactctgtgcc

SEQ ID NO: 6890582 - DNA, 19 bp, Homo sapiens
ccggtcctggccccagccc

SEQ ID NO: 6890583 - DNA, 19 bp, Homo sapiens
cttccccctttctctgcct

SEQ ID NO: 6890584 - DNA, 13 bp, Homo sapiens
tcaaaacattcca

SEQ ID NO: 6890585 - DNA, 14 bp, Homo sapiens
tcaccccagctccg

SEQ ID NO: 6890586 - DNA, 23 bp, Homo sapiens
ccgtgagagcccaatcactgcct

SEQ ID NO: 6890587 - DNA, 11 bp, Homo sapiens
ttgacatttat

SEQ ID NO: 6890588 - DNA, 20 bp, Homo sapiens
tgggaccacatgccactgcc

SEQ ID NO: 6890589 - DNA, 16 bp, Homo sapiens
atcacaaatgacttta

SEQ ID NO: 6890590 - DNA, 21 bp, Homo sapiens
cagcagcacaattctgtccct

SEQ ID NO: 6890591 - DNA, 22 bp, Homo sapiens
aggctgaatcaaagacatttca

SEQ ID NO: 6890592 - DNA, 14 bp, Homo sapiens
ctcttcctcctggt

SEQ ID NO: 6890593 - DNA, 14 bp, Homo sapiens
cctccgcccttccc

SEQ ID NO: 6890594 - DNA, 19 bp, Homo sapiens
tcaccatagttttgtttaa

SEQ ID NO: 6890595 - DNA, 15 bp, Homo sapiens
cagttcccttggcct

SEQ ID NO: 6890596 - DNA, 22 bp, Homo sapiens
atgacggtgttaattttgctaa

SEQ ID NO: 6890597 - DNA, 16 bp, Homo sapiens
cggtgctctggcggct

SEQ ID NO: 6890598 - DNA, 22 bp, Homo sapiens
aggttctccaacatcacagccc

SEQ ID NO: 6890599 - DNA, 16 bp, Homo sapiens
tatcagctactgtagt

SEQ ID NO: 6890600 - DNA, 15 bp, Homo sapiens
catgcggcccagcca

SEQ ID NO: 6890601 - DNA, 14 bp, Homo sapiens
cctctgccccaccc

SEQ ID NO: 6890602 - DNA, 20 bp, Homo sapiens
acagactcacaacctgaacc

SEQ ID NO: 6890603 - DNA, 20 bp, Homo sapiens
cactcccaagccactagccc

SEQ ID NO: 6890604 - DNA, 18 bp, Homo sapiens
atatctggtatatgtcat

SEQ ID NO: 6890605 - DNA, 15 bp, Homo sapiens
ccttgcttctcttct

SEQ ID NO: 6890606 - DNA, 13 bp, Homo sapiens
tcacccctctgcc

SEQ ID NO: 6890607 - DNA, 14 bp, Homo sapiens
catcaactgaatga

SEQ ID NO: 6890608 - DNA, 18 bp, Homo sapiens
atagtttatttctgtgaa

SEQ ID NO: 6890609 - DNA, 14 bp, Homo sapiens
cttgctgggccagg

SEQ ID NO: 6890610 - DNA, 15 bp, Homo sapiens
cccacctccctgcct

SEQ ID NO: 6890611 - DNA, 19 bp, Homo sapiens
gtgtgctggcttccgctgt

SEQ ID NO: 6890612 - DNA, 21 bp, Homo sapiens
ctgccttcgttaactgtgtat

SEQ ID NO: 6890613 - DNA, 13 bp, Homo sapiens
cccttctctgcct

SEQ ID NO: 6890614 - DNA, 15 bp, Homo sapiens
ggaggccctgcctga

SEQ ID NO: 6890615 - DNA, 19 bp, Homo sapiens
ctccgtgcttcctcagtta

SEQ ID NO: 6890616 - DNA, 22 bp, Homo sapiens
agtctccccgcagccctctcca

SEQ ID NO: 6890617 - DNA, 21 bp, Homo sapiens
cagacgttaggcatttcctgc

SEQ ID NO: 6890618 - DNA, 15 bp, Homo sapiens
caccactttgtctct

SEQ ID NO: 6890619 - DNA, 22 bp, Homo sapiens
tattttttggtgtgccctgtgt

SEQ ID NO: 6890620 - DNA, 21 bp, Homo sapiens
gctcctgaccagttgcagtca

SEQ ID NO: 6890621 - DNA, 19 bp, Homo sapiens
cctctgcgtcccccagccc

SEQ ID NO: 6890622 - DNA, 16 bp, Homo sapiens
taacattttgttctta

SEQ ID NO: 6890623 - DNA, 21 bp, Homo sapiens
actaaccaagctgagtttcct

SEQ ID NO: 6890624 - DNA, 19 bp, Homo sapiens
tggccaaatatgcactttc

SEQ ID NO: 6890625 - DNA, 14 bp, Homo sapiens
gatataagccatag

SEQ ID NO: 6890626 - DNA, 11 bp, Homo sapiens
ttttagataat

SEQ ID NO: 6890627 - DNA, 22 bp, Homo sapiens
aacctactttcatactgaagat

SEQ ID NO: 6890628 - DNA, 20 bp, Homo sapiens
tgcccggtgccatcttccat

SEQ ID NO: 6890629 - DNA, 22 bp, Homo sapiens
gcaaagatctgtcctcagcctt

SEQ ID NO: 6890630 - DNA, 17 bp, Homo sapiens
atattgtcagatatttt

SEQ ID NO: 6890631 - DNA, 18 bp, Homo sapiens
cactgcccttttcaggaa

SEQ ID NO: 6890632 - DNA, 15 bp, Homo sapiens
cagtgctctgcctct

SEQ ID NO: 6890633 - DNA, 22 bp, Homo sapiens
tcccttgtgttccttctgtgaa

SEQ ID NO: 6890634 - DNA, 23 bp, Homo sapiens
tccaccttccattttcccccact

SEQ ID NO: 6890635 - DNA, 21 bp, Homo sapiens
cacaaagccgtgcctttctct

SEQ ID NO: 6890636 - DNA, 18 bp, Homo sapiens
caaatcatgttttttctg

SEQ ID NO: 6890637 - DNA, 17 bp, Homo sapiens
actctacaccctctgcc

SEQ ID NO: 6890638 - DNA, 17 bp, Homo sapiens
agtatgtgggggcttca

SEQ ID NO: 6890639 - DNA, 22 bp, Homo sapiens
atgaaaatcagttatattcttt

SEQ ID NO: 6890640 - DNA, 12 bp, Homo sapiens
ataaaagagctt

SEQ ID NO: 6890641 - DNA, 17 bp, Homo sapiens
cacattaactccctcca

SEQ ID NO: 6890642 - DNA, 20 bp, Homo sapiens
ttaagtcccagtatacctca

SEQ ID NO: 6890643 - DNA, 11 bp, Homo sapiens
taccctgtgtc

SEQ ID NO: 6890644 - DNA, 14 bp, Homo sapiens
tgtaaacctggagg

SEQ ID NO: 6890645 - DNA, 13 bp, Homo sapiens
gcccccaccacac

SEQ ID NO: 6890646 - DNA, 21 bp, Homo sapiens
tcaggccggcagccccagcct

SEQ ID NO: 6890647 - DNA, 17 bp, Homo sapiens
gcgcaacagctgtgtgt

SEQ ID NO: 6890648 - DNA, 20 bp, Homo sapiens
agcgctgccgcaccccagag

SEQ ID NO: 6890649 - DNA, 22 bp, Homo sapiens
agtttctcagggtcactgtcct

SEQ ID NO: 6890650 - DNA, 14 bp, Homo sapiens
cctctgctcagcca

SEQ ID NO: 6890651 - DNA, 23 bp, Homo sapiens
attattgaattcttcacatgtaa

SEQ ID NO: 6890652 - DNA, 18 bp, Homo sapiens
atataaaagatcttgcag

SEQ ID NO: 6890653 - DNA, 15 bp, Homo sapiens
agaagtgctccctgg

SEQ ID NO: 6890654 - DNA, 12 bp, Homo sapiens
acttttgttcta

SEQ ID NO: 6890655 - DNA, 18 bp, Homo sapiens
cagaactcgatgcactga

SEQ ID NO: 6890656 - DNA, 14 bp, Homo sapiens
tagctaacagtgaa

SEQ ID NO: 6890657 - DNA, 18 bp, Homo sapiens
gtatttattttcctcccc

SEQ ID NO: 6890658 - DNA, 22 bp, Homo sapiens
aaagcaggttcttgttggtgca

SEQ ID NO: 6890659 - DNA, 20 bp, Homo sapiens
acatgggacatttgctcatg

SEQ ID NO: 6890660 - DNA, 19 bp, Homo sapiens
ctctcctgggcccctccct

SEQ ID NO: 6890661 - DNA, 19 bp, Homo sapiens
cctttccccttcccctccc

SEQ ID NO: 6890662 - DNA, 14 bp, Homo sapiens
cagctgtgcttatg

SEQ ID NO: 6890663 - DNA, 11 bp, Homo sapiens
gccactgaaga

SEQ ID NO: 6890664 - DNA, 14 bp, Homo sapiens
gggaatgagcccag

SEQ ID NO: 6890665 - DNA, 21 bp, Homo sapiens
acctaaaacccaaaggtggca

SEQ ID NO: 6890666 - DNA, 14 bp, Homo sapiens
gactcacctctgcc

SEQ ID NO: 6890667 - DNA, 14 bp, Homo sapiens
gtgccctcgctgct

SEQ ID NO: 6890668 - DNA, 22 bp, Homo sapiens
cactgaaacgtattcagagtta

SEQ ID NO: 6890669 - DNA, 19 bp, Homo sapiens
tggccacagcccccttgcc

SEQ ID NO: 6890670 - DNA, 23 bp, Homo sapiens
acttggctggtgtggtacagaga

SEQ ID NO: 6890671 - DNA, 16 bp, Homo sapiens
atctgaccacagacac

SEQ ID NO: 6890672 - DNA, 22 bp, Homo sapiens
tcatttaaactaaattactgtt

SEQ ID NO: 6890673 - DNA, 20 bp, Homo sapiens
ctcacagagaagctcctgct

SEQ ID NO: 6890674 - DNA, 14 bp, Homo sapiens
gccagcgtcccagg

SEQ ID NO: 6890675 - DNA, 15 bp, Homo sapiens
tatttaaaaatgtct

SEQ ID NO: 6890676 - DNA, 12 bp, Homo sapiens
ccagggtctcca

SEQ ID NO: 6890677 - DNA, 17 bp, Homo sapiens
ttccatttgcatttgtt

SEQ ID NO: 6890678 - DNA, 15 bp, Homo sapiens
tggaaaactaactca

SEQ ID NO: 6890679 - DNA, 19 bp, Homo sapiens
cttcagtgactcctgctgg

SEQ ID NO: 6890680 - DNA, 19 bp, Homo sapiens
taagaccctgtgtcctcca

SEQ ID NO: 6890681 - DNA, 14 bp, Homo sapiens
ctcccggcactcca

SEQ ID NO: 6890682 - DNA, 15 bp, Homo sapiens
catttattctgctca

SEQ ID NO: 6890683 - DNA, 13 bp, Homo sapiens
ctgtgctcttcct

SEQ ID NO: 6890684 - DNA, 18 bp, Homo sapiens
tactgtgagaactgtgaa

SEQ ID NO: 6890685 - DNA, 20 bp, Homo sapiens
atgcaaaagttctgacttga

SEQ ID NO: 6890686 - DNA, 20 bp, Homo sapiens
acttccctgcttttctccca

SEQ ID NO: 6890687 - DNA, 18 bp, Homo sapiens
cctaaaaattcccttcct

SEQ ID NO: 6890688 - DNA, 15 bp, Homo sapiens
cccgcccacccgcct

SEQ ID NO: 6890689 - DNA, 18 bp, Homo sapiens
cagtttaaaaaaattggt

SEQ ID NO: 6890690 - DNA, 23 bp, Homo sapiens
acctaagaatttcactgtctttt

SEQ ID NO: 6890691 - DNA, 22 bp, Homo sapiens
acgtctcctcctcgaagccatg

SEQ ID NO: 6890692 - DNA, 12 bp, Homo sapiens
aattttaatgta

SEQ ID NO: 6890693 - DNA, 18 bp, Homo sapiens
ttccatccacccctgcgt

SEQ ID NO: 6890694 - DNA, 19 bp, Homo sapiens
tgattctcctgcctcagcc

SEQ ID NO: 6890695 - DNA, 19 bp, Homo sapiens
tttaatcatagttactgtg

SEQ ID NO: 6890696 - DNA, 22 bp, Homo sapiens
cccggctgggtcggccctgccc

SEQ ID NO: 6890697 - DNA, 16 bp, Homo sapiens
cttctttgtgcctttg

SEQ ID NO: 6890698 - DNA, 20 bp, Homo sapiens
tcactaaactttatttgtaa

SEQ ID NO: 6890699 - DNA, 19 bp, Homo sapiens
tctcacgggccctgcccca

SEQ ID NO: 6890700 - DNA, 16 bp, Homo sapiens
caaaaggcactgtgaa

SEQ ID NO: 6890701 - DNA, 23 bp, Homo sapiens
tcataacagtgccattgtcttta

SEQ ID NO: 6890702 - DNA, 16 bp, Homo sapiens
atggtggcacattcct

SEQ ID NO: 6890703 - DNA, 15 bp, Homo sapiens
caggcaatgccctgc

SEQ ID NO: 6890704 - DNA, 15 bp, Homo sapiens
cagtacagcatgtgc

SEQ ID NO: 6890705 - DNA, 17 bp, Homo sapiens
accccagggcactgcca

SEQ ID NO: 6890706 - DNA, 21 bp, Homo sapiens
cctgcccttgaaccccctccc

SEQ ID NO: 6890707 - DNA, 19 bp, Homo sapiens
ctaaagggaccatctgctg

SEQ ID NO: 6890708 - DNA, 15 bp, Homo sapiens
gaagagaagctgctg

SEQ ID NO: 6890709 - DNA, 13 bp, Homo sapiens
aagcccagctcca

SEQ ID NO: 6890710 - DNA, 17 bp, Homo sapiens
tagacagggtctcccta

SEQ ID NO: 6890711 - DNA, 19 bp, Homo sapiens
cagggctccctcctggagc

SEQ ID NO: 6890712 - DNA, 23 bp, Homo sapiens
catatgcaccttgtgtctgtaca

SEQ ID NO: 6890713 - DNA, 12 bp, Homo sapiens
ctttgggccaga

SEQ ID NO: 6890714 - DNA, 18 bp, Homo sapiens
agaaatcttgtcttacca

SEQ ID NO: 6890715 - DNA, 18 bp, Homo sapiens
cactgcctgcacctttcg

SEQ ID NO: 6890716 - DNA, 15 bp, Homo sapiens
tctccatatgttaca

SEQ ID NO: 6890717 - DNA, 17 bp, Homo sapiens
ccacctccacccagccc

SEQ ID NO: 6890718 - DNA, 22 bp, Homo sapiens
cccaagacagtgagacagtctg

SEQ ID NO: 6890719 - DNA, 18 bp, Homo sapiens
agcataccagttcttgca

SEQ ID NO: 6890720 - DNA, 17 bp, Homo sapiens
tgcaatgcatatctgtt

SEQ ID NO: 6890721 - DNA, 21 bp, Homo sapiens
acccaggtcccccgactgcct

SEQ ID NO: 6890722 - DNA, 14 bp, Homo sapiens
ctcttgctcctgct

SEQ ID NO: 6890723 - DNA, 13 bp, Homo sapiens
gagacttgccaga

SEQ ID NO: 6890724 - DNA, 19 bp, Homo sapiens
tacatgggactatgctttt

SEQ ID NO: 6890725 - DNA, 13 bp, Homo sapiens
ggcttcctcctga

SEQ ID NO: 6890726 - DNA, 21 bp, Homo sapiens
cactctcaggaccaccctgcc

SEQ ID NO: 6890727 - DNA, 19 bp, Homo sapiens
aatattactctgcctgtca

SEQ ID NO: 6890728 - DNA, 14 bp, Homo sapiens
tgctgcctgagtca

SEQ ID NO: 6890729 - DNA, 18 bp, Homo sapiens
tgtcctgtaactgttaca

SEQ ID NO: 6890730 - DNA, 19 bp, Homo sapiens
cactttattgcaatgcaga

SEQ ID NO: 6890731 - DNA, 18 bp, Homo sapiens
caactttgtgctttcctg

SEQ ID NO: 6890732 - DNA, 19 bp, Homo sapiens
ctcggagccccccactcag

SEQ ID NO: 6890733 - DNA, 20 bp, Homo sapiens
ccatcccgcttagcctgcct

SEQ ID NO: 6890734 - DNA, 21 bp, Homo sapiens
ctaactcttgctcactcccta

SEQ ID NO: 6890735 - DNA, 22 bp, Homo sapiens
ctgctccccaacacctgcctct

SEQ ID NO: 6890736 - DNA, 13 bp, Homo sapiens
gcaattcaatgca

SEQ ID NO: 6890737 - DNA, 15 bp, Homo sapiens
tgatgggccgagcca

SEQ ID NO: 6890738 - DNA, 18 bp, Homo sapiens
cagtgacacaactcatcc

SEQ ID NO: 6890739 - DNA, 20 bp, Homo sapiens
cttagaaatgtaaactgcca

SEQ ID NO: 6890740 - DNA, 16 bp, Homo sapiens
cctgccacctgtctgt

SEQ ID NO: 6890741 - DNA, 18 bp, Homo sapiens
agcaggtctgcaggccac

SEQ ID NO: 6890742 - DNA, 15 bp, Homo sapiens
gggcagcaggccaga

SEQ ID NO: 6890743 - DNA, 21 bp, Homo sapiens
aaggctctatctgctgggctg

SEQ ID NO: 6890744 - DNA, 16 bp, Homo sapiens
caagcttcctgtgccc

SEQ ID NO: 6890745 - DNA, 20 bp, Homo sapiens
ccactccccagccccagccc

SEQ ID NO: 6890746 - DNA, 15 bp, Homo sapiens
cattgaatctgtatg

SEQ ID NO: 6890747 - DNA, 15 bp, Homo sapiens
gcccaccactggcca

SEQ ID NO: 6890748 - DNA, 13 bp, Homo sapiens
actctctgctcta

SEQ ID NO: 6890749 - DNA, 15 bp, Homo sapiens
aaatgcctgctgctg

SEQ ID NO: 6890750 - DNA, 23 bp, Homo sapiens
gcttagtaatgctacgtgtgatt

SEQ ID NO: 6890751 - DNA, 19 bp, Homo sapiens
agggcgtgactcacccaag

SEQ ID NO: 6890752 - DNA, 18 bp, Homo sapiens
gtgaatgattcatgttat

SEQ ID NO: 6890753 - DNA, 13 bp, Homo sapiens
actaacactggct

SEQ ID NO: 6890754 - DNA, 13 bp, Homo sapiens
agagccaggcaca

SEQ ID NO: 6890755 - DNA, 19 bp, Homo sapiens
acccaacccatgcccctga

SEQ ID NO: 6890756 - DNA, 19 bp, Homo sapiens
ccctccttcccactcttct

SEQ ID NO: 6890757 - DNA, 15 bp, Homo sapiens
gactttagtagtttg

SEQ ID NO: 6890758 - DNA, 14 bp, Homo sapiens
ccaggaagcacagg

SEQ ID NO: 6890759 - DNA, 13 bp, Homo sapiens
cagctacattcct

SEQ ID NO: 6890760 - DNA, 13 bp, Homo sapiens
ccagtcctgctgc

SEQ ID NO: 6890761 - DNA, 12 bp, Homo sapiens
ctgtgctgtgga

SEQ ID NO: 6890762 - DNA, 13 bp, Homo sapiens
catgctcacctct

SEQ ID NO: 6890763 - DNA, 16 bp, Homo sapiens
tatttaactggtgcac

SEQ ID NO: 6890764 - DNA, 17 bp, Homo sapiens
ttcgtgatgacatatca

SEQ ID NO: 6890765 - DNA, 23 bp, Homo sapiens
ccttcctgccccaactccttcca

SEQ ID NO: 6890766 - DNA, 13 bp, Homo sapiens
agaatttctggaa

SEQ ID NO: 6890767 - DNA, 18 bp, Homo sapiens
cgggaacagtgcatgtgc

SEQ ID NO: 6890768 - DNA, 20 bp, Homo sapiens
caatagtcattaaaaacata

SEQ ID NO: 6890769 - DNA, 21 bp, Homo sapiens
tcagctccccggcactgcagt

SEQ ID NO: 6890770 - DNA, 20 bp, Homo sapiens
caatggctattaacaattaa

SEQ ID NO: 6890771 - DNA, 17 bp, Homo sapiens
cagcgcccccagagccc

SEQ ID NO: 6890772 - DNA, 16 bp, Homo sapiens
gtgtcaagacatttct

SEQ ID NO: 6890773 - DNA, 20 bp, Homo sapiens
gtcttcttgtgtcctgatga

SEQ ID NO: 6890774 - DNA, 13 bp, Homo sapiens
tgcggctgtgtgt

SEQ ID NO: 6890775 - DNA, 14 bp, Homo sapiens
caagctctgaggga

SEQ ID NO: 6890776 - DNA, 18 bp, Homo sapiens
caaggagtcactgagacc

SEQ ID NO: 6890777 - DNA, 23 bp, Homo sapiens
gtgagggtgccccgcctgagtca

SEQ ID NO: 6890778 - DNA, 21 bp, Homo sapiens
ttcttgtctttgtccctgttg

SEQ ID NO: 6890779 - DNA, 12 bp, Homo sapiens
cacgtgtgcaga

SEQ ID NO: 6890780 - DNA, 14 bp, Homo sapiens
ccgtgtctcagcct

SEQ ID NO: 6890781 - DNA, 15 bp, Homo sapiens
acctagggaggacct

SEQ ID NO: 6890782 - DNA, 16 bp, Homo sapiens
cgacctcgtcctcccc

SEQ ID NO: 6890783 - DNA, 13 bp, Homo sapiens
cgtcccccagccc

SEQ ID NO: 6890784 - DNA, 11 bp, Homo sapiens
ctcccctgcct

SEQ ID NO: 6890785 - DNA, 11 bp, Homo sapiens
cttccctgccc

SEQ ID NO: 6890786 - DNA, 17 bp, Homo sapiens
ccggcctctccctgcct

SEQ ID NO: 6890787 - DNA, 13 bp, Homo sapiens
atgaggcttgctg

SEQ ID NO: 6890788 - DNA, 14 bp, Homo sapiens
gagcacagccatag

SEQ ID NO: 6890789 - DNA, 14 bp, Homo sapiens
tatttaatagctgt

SEQ ID NO: 6890790 - DNA, 15 bp, Homo sapiens
cagttgagtgaaatt

SEQ ID NO: 6890791 - DNA, 18 bp, Homo sapiens
acatcaagactatctaca

SEQ ID NO: 6890792 - DNA, 19 bp, Homo sapiens
ctccctgggcctgtctcag

SEQ ID NO: 6890793 - DNA, 19 bp, Homo sapiens
ctgtccaacccctccccca

SEQ ID NO: 6890794 - DNA, 19 bp, Homo sapiens
tttcccttccttcctctcc

SEQ ID NO: 6890795 - DNA, 16 bp, Homo sapiens
ctgcctggccactgct

SEQ ID NO: 6890796 - DNA, 17 bp, Homo sapiens
accctaagggcagccct

SEQ ID NO: 6890797 - DNA, 13 bp, Homo sapiens
gttttctcctccc

SEQ ID NO: 6890798 - DNA, 17 bp, Homo sapiens
taattttttggtacaaa

SEQ ID NO: 6890799 - DNA, 22 bp, Homo sapiens
ccctccatccctggccccctcc

SEQ ID NO: 6890800 - DNA, 12 bp, Homo sapiens
gaagccacatca

SEQ ID NO: 6890801 - DNA, 20 bp, Homo sapiens
gttttcagaacctcttcccc

SEQ ID NO: 6890802 - DNA, 15 bp, Homo sapiens
accagagctgcctcc

SEQ ID NO: 6890803 - DNA, 16 bp, Homo sapiens
caggccacggcagcct

SEQ ID NO: 6890804 - DNA, 15 bp, Homo sapiens
cttttcctcctccac

SEQ ID NO: 6890805 - DNA, 23 bp, Homo sapiens
tgagctgtgttttgtctgagcct

SEQ ID NO: 6890806 - DNA, 18 bp, Homo sapiens
tgaagtacaaacatgaaa

SEQ ID NO: 6890807 - DNA, 20 bp, Homo sapiens
caagtgcctagactgttact

SEQ ID NO: 6890808 - DNA, 12 bp, Homo sapiens
ctgccctctcct

SEQ ID NO: 6890809 - DNA, 14 bp, Homo sapiens
caatactactgtaa

SEQ ID NO: 6890810 - DNA, 13 bp, Homo sapiens
tcatcactacctt

SEQ ID NO: 6890811 - DNA, 21 bp, Homo sapiens
aataatgttttgggaaacact

SEQ ID NO: 6890812 - DNA, 18 bp, Homo sapiens
ggttctttcttcctctgc

SEQ ID NO: 6890813 - DNA, 17 bp, Homo sapiens
ccaaaaactaaaattca

SEQ ID NO: 6890814 - DNA, 20 bp, Homo sapiens
cacaataggtctttctctca

SEQ ID NO: 6890815 - DNA, 19 bp, Homo sapiens
gagaggatgagagcccaga

SEQ ID NO: 6890816 - DNA, 15 bp, Homo sapiens
gccatggcctctgca

SEQ ID NO: 6890817 - DNA, 11 bp, Homo sapiens
ctccttggcct

SEQ ID NO: 6890818 - DNA, 22 bp, Homo sapiens
actgtacaataagttacttgaa

SEQ ID NO: 6890819 - DNA, 12 bp, Homo sapiens
cagttggcactg

SEQ ID NO: 6890820 - DNA, 17 bp, Homo sapiens
atagctactatatgcat

SEQ ID NO: 6890821 - DNA, 20 bp, Homo sapiens
caataactactgtgttcctg

SEQ ID NO: 6890822 - DNA, 13 bp, Homo sapiens
ccttccctctcca

SEQ ID NO: 6890823 - DNA, 21 bp, Homo sapiens
tgtccctctttgcctgtgtga

SEQ ID NO: 6890824 - DNA, 20 bp, Homo sapiens
aatgttgctatgtgccttat

SEQ ID NO: 6890825 - DNA, 18 bp, Homo sapiens
cccagctgcaccccttcc

SEQ ID NO: 6890826 - DNA, 15 bp, Homo sapiens
agaaaatatactgta

SEQ ID NO: 6890827 - DNA, 15 bp, Homo sapiens
atctggttttgctat

SEQ ID NO: 6890828 - DNA, 17 bp, Homo sapiens
tctctcttctgctccac

SEQ ID NO: 6890829 - DNA, 15 bp, Homo sapiens
ccattaccccatacc

SEQ ID NO: 6890830 - DNA, 15 bp, Homo sapiens
gaatgtatctgtgaa

SEQ ID NO: 6890831 - DNA, 15 bp, Homo sapiens
cctcccggccctgcc

SEQ ID NO: 6890832 - DNA, 16 bp, Homo sapiens
tctcagagcatctggc

SEQ ID NO: 6890833 - DNA, 14 bp, Homo sapiens
ccttcccccagccc

SEQ ID NO: 6890834 - DNA, 18 bp, Homo sapiens
ccatacctgcccctgcct

SEQ ID NO: 6890835 - DNA, 13 bp, Homo sapiens
aaaattatctata

SEQ ID NO: 6890836 - DNA, 18 bp, Homo sapiens
tgtgcatagtgctgggat

SEQ ID NO: 6890837 - DNA, 15 bp, Homo sapiens
cttcaggctgcctaa

SEQ ID NO: 6890838 - DNA, 13 bp, Homo sapiens
tagagaagccata

SEQ ID NO: 6890839 - DNA, 16 bp, Homo sapiens
ctccagaatctgctgt

SEQ ID NO: 6890840 - DNA, 17 bp, Homo sapiens
ctttcccttggtgccct

SEQ ID NO: 6890841 - DNA, 15 bp, Homo sapiens
cacacctctgctcca

SEQ ID NO: 6890842 - DNA, 16 bp, Homo sapiens
cccagagaaactgcca

SEQ ID NO: 6890843 - DNA, 21 bp, Homo sapiens
ctgttcccagcccctcctccc

SEQ ID NO: 6890844 - DNA, 20 bp, Homo sapiens
cttcctggacagctgtgcct

SEQ ID NO: 6890845 - DNA, 14 bp, Homo sapiens
aagccaaatgaaac

SEQ ID NO: 6890846 - DNA, 17 bp, Homo sapiens
tgtccccaaaatgtgat

SEQ ID NO: 6890847 - DNA, 14 bp, Homo sapiens
cctttgcctctgct

SEQ ID NO: 6890848 - DNA, 18 bp, Homo sapiens
ctgctcccattcctccct

SEQ ID NO: 6890849 - DNA, 20 bp, Homo sapiens
tgccttgccgctccccttgg

SEQ ID NO: 6890850 - DNA, 14 bp, Homo sapiens
gagttaactgtgaa

SEQ ID NO: 6890851 - DNA, 12 bp, Homo sapiens
cctgcctctgcc

SEQ ID NO: 6890852 - DNA, 15 bp, Homo sapiens
gtctggtgaagctca

SEQ ID NO: 6890853 - DNA, 19 bp, Homo sapiens
accatcaagggtcatggca

SEQ ID NO: 6890854 - DNA, 19 bp, Homo sapiens
cagactctaaacacacaag

SEQ ID NO: 6890855 - DNA, 13 bp, Homo sapiens
gctgattttgtca

SEQ ID NO: 6890856 - DNA, 15 bp, Homo sapiens
cagggacccctgccc

SEQ ID NO: 6890857 - DNA, 19 bp, Homo sapiens
taactgttctttgcagtga

SEQ ID NO: 6890858 - DNA, 14 bp, Homo sapiens
gcccaccctctgcc

SEQ ID NO: 6890859 - DNA, 15 bp, Homo sapiens
ttcagacagctgcct

SEQ ID NO: 6890860 - DNA, 20 bp, Homo sapiens
aattcttacctcatttgcat

SEQ ID NO: 6890861 - DNA, 14 bp, Homo sapiens
gtcaggacccaggc

SEQ ID NO: 6890862 - DNA, 17 bp, Homo sapiens
cttcccctcgctgtcct

SEQ ID NO: 6890863 - DNA, 13 bp, Homo sapiens
cactgccctgcct

SEQ ID NO: 6890864 - DNA, 14 bp, Homo sapiens
aactgtaaaagtgt

SEQ ID NO: 6890865 - DNA, 20 bp, Homo sapiens
gtgtcctgaccaccctcccc

SEQ ID NO: 6890866 - DNA, 14 bp, Homo sapiens
actattcatggcta

SEQ ID NO: 6890867 - DNA, 24 bp, Homo sapiens
caggttatcgaaataacaatgtta

SEQ ID NO: 6890868 - DNA, 18 bp, Homo sapiens
ttgccatttgatacccct

SEQ ID NO: 6890869 - DNA, 19 bp, Homo sapiens
gcctgctccctgtctgtgt

SEQ ID NO: 6890870 - DNA, 14 bp, Homo sapiens
actacctcctctcc

SEQ ID NO: 6890871 - DNA, 16 bp, Homo sapiens
ttccttgtgcccgtgg

SEQ ID NO: 6890872 - DNA, 21 bp, Homo sapiens
ctgagccctccttcttgccct

SEQ ID NO: 6890873 - DNA, 12 bp, Homo sapiens
gatatattcttt

SEQ ID NO: 6890874 - DNA, 13 bp, Homo sapiens
cctttgaatattt

SEQ ID NO: 6890875 - DNA, 14 bp, Homo sapiens
tcacagcctcctct

SEQ ID NO: 6890876 - DNA, 14 bp, Homo sapiens
tcacagtgtctgta

SEQ ID NO: 6890877 - DNA, 22 bp, Homo sapiens
cctgaagaggcgggccagccag

SEQ ID NO: 6890878 - DNA, 23 bp, Homo sapiens
gaaaatataaatgcatgatttta

SEQ ID NO: 6890879 - DNA, 13 bp, Homo sapiens
cagtggtgttaca

SEQ ID NO: 6890880 - DNA, 19 bp, Homo sapiens
cttctgggtggctcctgcc

SEQ ID NO: 6890881 - DNA, 16 bp, Homo sapiens
acgaaatgttattttt

SEQ ID NO: 6890882 - DNA, 16 bp, Homo sapiens
ctccagccttctctct

SEQ ID NO: 6890883 - DNA, 19 bp, Homo sapiens
gccttctgacggccctgca

SEQ ID NO: 6890884 - DNA, 20 bp, Homo sapiens
ccgtgctgacagctgctcct

SEQ ID NO: 6890885 - DNA, 16 bp, Homo sapiens
cagaactctgcctgcc

SEQ ID NO: 6890886 - DNA, 16 bp, Homo sapiens
agattgttgtttgcca

SEQ ID NO: 6890887 - DNA, 13 bp, Homo sapiens
agaagctgaggat

SEQ ID NO: 6890888 - DNA, 22 bp, Homo sapiens
ctttcaattgcagatgccaaaa

SEQ ID NO: 6890889 - DNA, 22 bp, Homo sapiens
aattagagcagatgacccctcc

SEQ ID NO: 6890890 - DNA, 14 bp, Homo sapiens
gaaccacctacccc

SEQ ID NO: 6890891 - DNA, 14 bp, Homo sapiens
agggatccagagac

SEQ ID NO: 6890892 - DNA, 16 bp, Homo sapiens
cagatacccagtggaa

SEQ ID NO: 6890893 - DNA, 18 bp, Homo sapiens
ctttcatttactgtggct

SEQ ID NO: 6890894 - DNA, 19 bp, Homo sapiens
tctcaggaaaatctgtgat

SEQ ID NO: 6890895 - DNA, 17 bp, Homo sapiens
cttactctcctcttcta

SEQ ID NO: 6890896 - DNA, 18 bp, Homo sapiens
cttggctttcctgtttct

SEQ ID NO: 6890897 - DNA, 14 bp, Homo sapiens
cctcctaccctccc

SEQ ID NO: 6890898 - DNA, 23 bp, Homo sapiens
caagacggggagtgagactcctg

SEQ ID NO: 6890899 - DNA, 12 bp, Homo sapiens
cacactccctct

SEQ ID NO: 6890900 - DNA, 17 bp, Homo sapiens
ctttctctccccaaccc

SEQ ID NO: 6890901 - DNA, 15 bp, Homo sapiens
gcatgctcctctgcc

SEQ ID NO: 6890902 - DNA, 13 bp, Homo sapiens
cccccgccctgct

SEQ ID NO: 6890903 - DNA, 13 bp, Homo sapiens
cttacctgtgaca

SEQ ID NO: 6890904 - DNA, 15 bp, Homo sapiens
catcatacacttcct

SEQ ID NO: 6890905 - DNA, 13 bp, Homo sapiens
cagagctgcctcc

SEQ ID NO: 6890906 - DNA, 15 bp, Homo sapiens
ctctccctctttcta

SEQ ID NO: 6890907 - DNA, 15 bp, Homo sapiens
ctcaatctgcagcca

SEQ ID NO: 6890908 - DNA, 12 bp, Homo sapiens
ccaccccagcct

SEQ ID NO: 6890909 - DNA, 12 bp, Homo sapiens
ccatcccagccc

SEQ ID NO: 6890910 - DNA, 22 bp, Homo sapiens
ccccttctctgctccaccacat

SEQ ID NO: 6890911 - DNA, 23 bp, Homo sapiens
cactgccaccagcaatgccctgc

SEQ ID NO: 6890912 - DNA, 21 bp, Homo sapiens
cggtttttttctttggctgca

SEQ ID NO: 6890913 - DNA, 14 bp, Homo sapiens
acacggccctgccc

SEQ ID NO: 6890914 - DNA, 12 bp, Homo sapiens
atgaaattgcca

SEQ ID NO: 6890915 - DNA, 18 bp, Homo sapiens
agtgtagcatcttcctct

SEQ ID NO: 6890916 - DNA, 19 bp, Homo sapiens
cctgctgtcccctcttgcc

SEQ ID NO: 6890917 - DNA, 19 bp, Homo sapiens
tctcctcccagcgtgtgta

SEQ ID NO: 6890918 - DNA, 20 bp, Homo sapiens
tcccaccaactctctctgcc

SEQ ID NO: 6890919 - DNA, 13 bp, Homo sapiens
cttgcaagccata

SEQ ID NO: 6890920 - DNA, 13 bp, Homo sapiens
actgtcactgccg

SEQ ID NO: 6890921 - DNA, 15 bp, Homo sapiens
ttaacacactggcca

SEQ ID NO: 6890922 - DNA, 13 bp, Homo sapiens
ccagcctctgtcc

SEQ ID NO: 6890923 - DNA, 14 bp, Homo sapiens
ccctgttcccttcc

SEQ ID NO: 6890924 - DNA, 18 bp, Homo sapiens
cttctcccaactcagcct

SEQ ID NO: 6890925 - DNA, 15 bp, Homo sapiens
caggtgactgccacc

SEQ ID NO: 6890926 - DNA, 13 bp, Homo sapiens
agcctctggccag

SEQ ID NO: 6890927 - DNA, 12 bp, Homo sapiens
cacttgtgaata

SEQ ID NO: 6890928 - DNA, 15 bp, Homo sapiens
atgagtgtctgtgag

SEQ ID NO: 6890929 - DNA, 13 bp, Homo sapiens
cactgtgccctgg

SEQ ID NO: 6890930 - DNA, 17 bp, Homo sapiens
ccatcttcctgctgctg

SEQ ID NO: 6890931 - DNA, 13 bp, Homo sapiens
atgccaatttctc

SEQ ID NO: 6890932 - DNA, 15 bp, Homo sapiens
aattattgacactga

SEQ ID NO: 6890933 - DNA, 16 bp, Homo sapiens
atttagcacagtattt

SEQ ID NO: 6890934 - DNA, 22 bp, Homo sapiens
tgtaaagaaagagagaaaataa

SEQ ID NO: 6890935 - DNA, 13 bp, Homo sapiens
agcctcctctgga

SEQ ID NO: 6890936 - DNA, 16 bp, Homo sapiens
ccatgtatttcaggga

SEQ ID NO: 6890937 - DNA, 21 bp, Homo sapiens
catgctcagccttgctgctct

SEQ ID NO: 6890938 - DNA, 12 bp, Homo sapiens
acatcctcctgc

SEQ ID NO: 6890939 - DNA, 19 bp, Homo sapiens
tgtattttactttgtgcaa

SEQ ID NO: 6890940 - DNA, 21 bp, Homo sapiens
cttcctgggcacacgctgctc

SEQ ID NO: 6890941 - DNA, 17 bp, Homo sapiens
atattatattgtattta

SEQ ID NO: 6890942 - DNA, 15 bp, Homo sapiens
caagacccctgtctt

SEQ ID NO: 6890943 - DNA, 22 bp, Homo sapiens
ccttcatcatgagttctgctga

SEQ ID NO: 6890944 - DNA, 12 bp, Homo sapiens
tgctggcttccg

SEQ ID NO: 6890945 - DNA, 13 bp, Homo sapiens
ggaaggaccctga

SEQ ID NO: 6890946 - DNA, 14 bp, Homo sapiens
cacttgcctgtcac

SEQ ID NO: 6890947 - DNA, 19 bp, Homo sapiens
cactccccagagctgtgcc

SEQ ID NO: 6890948 - DNA, 22 bp, Homo sapiens
tatagcactttgaaatacctca

SEQ ID NO: 6890949 - DNA, 14 bp, Homo sapiens
atgtctctctgcca

SEQ ID NO: 6890950 - DNA, 21 bp, Homo sapiens
cttccatctcaacctacctcg

SEQ ID NO: 6890951 - DNA, 13 bp, Homo sapiens
ctctgctttcctt

SEQ ID NO: 6890952 - DNA, 18 bp, Homo sapiens
cccttcaaccccacttcc

SEQ ID NO: 6890953 - DNA, 14 bp, Homo sapiens
ctttcagcctgctt

SEQ ID NO: 6890954 - DNA, 21 bp, Homo sapiens
ctgtgtagttccctctgcctg

SEQ ID NO: 6890955 - DNA, 18 bp, Homo sapiens
atagaataggcactttaa

SEQ ID NO: 6890956 - DNA, 21 bp, Homo sapiens
gacttcaggttgttctgtata

SEQ ID NO: 6890957 - DNA, 21 bp, Homo sapiens
cacagctaacacacagctccc

SEQ ID NO: 6890958 - DNA, 21 bp, Homo sapiens
ccttggaaacagttggcactg

SEQ ID NO: 6890959 - DNA, 15 bp, Homo sapiens
accagctcaggacag

SEQ ID NO: 6890960 - DNA, 14 bp, Homo sapiens
gagtggcagcccag

SEQ ID NO: 6890961 - DNA, 17 bp, Homo sapiens
ttccttgcccctgctct

SEQ ID NO: 6890962 - DNA, 13 bp, Homo sapiens
aggctgcagccag

SEQ ID NO: 6890963 - DNA, 14 bp, Homo sapiens
cctgggcagctcct

SEQ ID NO: 6890964 - DNA, 16 bp, Homo sapiens
gaattacccttcctca

SEQ ID NO: 6890965 - DNA, 23 bp, Homo sapiens
cctccacagctgcagcccatcct

SEQ ID NO: 6890966 - DNA, 15 bp, Homo sapiens
gacaatatgatttta

SEQ ID NO: 6890967 - DNA, 16 bp, Homo sapiens
cactggtttctcagaa

SEQ ID NO: 6890968 - DNA, 15 bp, Homo sapiens
atcatctcttcctca

SEQ ID NO: 6890969 - DNA, 22 bp, Homo sapiens
ctgacttggctggtgtggtaca

SEQ ID NO: 6890970 - DNA, 18 bp, Homo sapiens
caatgatattgacactgt

SEQ ID NO: 6890971 - DNA, 19 bp, Homo sapiens
ctaacaaaggcagctgtgt

SEQ ID NO: 6890972 - DNA, 18 bp, Homo sapiens
tgttagtgtttagataat

SEQ ID NO: 6890973 - DNA, 13 bp, Homo sapiens
gctggtctgccag

SEQ ID NO: 6890974 - DNA, 22 bp, Homo sapiens
gtctgactccagagtctgagcc

SEQ ID NO: 6890975 - DNA, 13 bp, Homo sapiens
ctcccttctgcta

SEQ ID NO: 6890976 - DNA, 14 bp, Homo sapiens
cctttccccagccc

SEQ ID NO: 6890977 - DNA, 16 bp, Homo sapiens
tgttctgtcccttgcc

SEQ ID NO: 6890978 - DNA, 16 bp, Homo sapiens
accactgtccctacca

SEQ ID NO: 6890979 - DNA, 15 bp, Homo sapiens
actttaaaatgcgaa

SEQ ID NO: 6890980 - DNA, 21 bp, Homo sapiens
agttgtcactgcttttggcct

SEQ ID NO: 6890981 - DNA, 16 bp, Homo sapiens
ccttagccttgctcag

SEQ ID NO: 6890982 - DNA, 15 bp, Homo sapiens
ggaactgctgctgac

SEQ ID NO: 6890983 - DNA, 15 bp, Homo sapiens
ctctgggcagtgtgg

SEQ ID NO: 6890984 - DNA, 20 bp, Homo sapiens
caattatatttttgtaaata

SEQ ID NO: 6890985 - DNA, 16 bp, Homo sapiens
cgtcttccgtctcccc

SEQ ID NO: 6890986 - DNA, 18 bp, Homo sapiens
ctctgagtgtctctgcct

SEQ ID NO: 6890987 - DNA, 19 bp, Homo sapiens
ctctgattcacctcttcct

SEQ ID NO: 6890988 - DNA, 15 bp, Homo sapiens
cttttttttcttggt

SEQ ID NO: 6890989 - DNA, 16 bp, Homo sapiens
actgaaaacctctcct

SEQ ID NO: 6890990 - DNA, 14 bp, Homo sapiens
tagtatctggctgg

SEQ ID NO: 6890991 - DNA, 18 bp, Homo sapiens
acatggcgccctgcctcc

SEQ ID NO: 6890992 - DNA, 13 bp, Homo sapiens
ctcttctcccccc

SEQ ID NO: 6890993 - DNA, 16 bp, Homo sapiens
cagatgtggagccagg

SEQ ID NO: 6890994 - DNA, 16 bp, Homo sapiens
tgagtaaactgtttct

SEQ ID NO: 6890995 - DNA, 20 bp, Homo sapiens
gtggtatcctgtgacatgta

SEQ ID NO: 6890996 - DNA, 14 bp, Homo sapiens
aaacactcttgaaa

SEQ ID NO: 6890997 - DNA, 22 bp, Homo sapiens
aatctcttaatattgagaatca

SEQ ID NO: 6890998 - DNA, 17 bp, Homo sapiens
attactctacactgaaa

SEQ ID NO: 6890999 - DNA, 22 bp, Homo sapiens
actgcctagaaacaacactgta

SEQ ID NO: 6891000 - DNA, 21 bp, Homo sapiens
taattaaagaaaattgccaaa

SEQ ID NO: 6891001 - DNA, 17 bp, Homo sapiens
gaaatataaactgtgag

SEQ ID NO: 6891002 - DNA, 15 bp, Homo sapiens
tctctccctgcctca

SEQ ID NO: 6891003 - DNA, 14 bp, Homo sapiens
gagttagaggccag

SEQ ID NO: 6891004 - DNA, 15 bp, Homo sapiens
tcctgggccttctca

SEQ ID NO: 6891005 - DNA, 17 bp, Homo sapiens
ctgcaggtgttctgctg

SEQ ID NO: 6891006 - DNA, 13 bp, Homo sapiens
taaatcacttgta

SEQ ID NO: 6891007 - DNA, 21 bp, Homo sapiens
cccggtggttcttcctgttct

SEQ ID NO: 6891008 - DNA, 22 bp, Homo sapiens
cccatcccctcaacaccctgct

SEQ ID NO: 6891009 - DNA, 17 bp, Homo sapiens
attggtatctgatatct

SEQ ID NO: 6891010 - DNA, 23 bp, Homo sapiens
ccctgaaacatgtgcccctgcca

SEQ ID NO: 6891011 - DNA, 15 bp, Homo sapiens
agttccattcttggt

SEQ ID NO: 6891012 - DNA, 21 bp, Homo sapiens
gaaactccacatcctgtggga

SEQ ID NO: 6891013 - DNA, 21 bp, Homo sapiens
atcacattttaagtgcttcac

SEQ ID NO: 6891014 - DNA, 13 bp, Homo sapiens
ccagccccatccc

SEQ ID NO: 6891015 - DNA, 14 bp, Homo sapiens
gctctttctctgcc

SEQ ID NO: 6891016 - DNA, 19 bp, Homo sapiens
cggtggggggatgagatta

SEQ ID NO: 6891017 - DNA, 21 bp, Homo sapiens
cagctcccacaagcctctgcc

SEQ ID NO: 6891018 - DNA, 13 bp, Homo sapiens
tctgctcttgcct

SEQ ID NO: 6891019 - DNA, 16 bp, Homo sapiens
aactgttcttttgcat

SEQ ID NO: 6891020 - DNA, 22 bp, Homo sapiens
agattttggggttgtgttgtca

SEQ ID NO: 6891021 - DNA, 14 bp, Homo sapiens
ccagggcacaccta

SEQ ID NO: 6891022 - DNA, 14 bp, Homo sapiens
gtgtttattcttga

SEQ ID NO: 6891023 - DNA, 21 bp, Homo sapiens
tcagaagaaaaagaagctgag

SEQ ID NO: 6891024 - DNA, 22 bp, Homo sapiens
atgaattggaactgcaatgaaa

SEQ ID NO: 6891025 - DNA, 21 bp, Homo sapiens
aagcatttcaaagccctgcct

SEQ ID NO: 6891026 - DNA, 14 bp, Homo sapiens
aatttaatttgcaa

SEQ ID NO: 6891027 - DNA, 18 bp, Homo sapiens
caagtgcccgccctgccc

SEQ ID NO: 6891028 - DNA, 23 bp, Homo sapiens
gtattaagattataattgttgca

SEQ ID NO: 6891029 - DNA, 22 bp, Homo sapiens
ctgttgaggtgggtgggcctga

SEQ ID NO: 6891030 - DNA, 23 bp, Homo sapiens
gcatcctttagggttctgcctct

SEQ ID NO: 6891031 - DNA, 19 bp, Homo sapiens
cattctaggatgtggagct

SEQ ID NO: 6891032 - DNA, 19 bp, Homo sapiens
cacgccggcctctgctgcc

SEQ ID NO: 6891033 - DNA, 13 bp, Homo sapiens
tggcccctctgac

SEQ ID NO: 6891034 - DNA, 16 bp, Homo sapiens
atttaaaacaagctga

SEQ ID NO: 6891035 - DNA, 19 bp, Homo sapiens
ctttcagagcccccagccc

SEQ ID NO: 6891036 - DNA, 18 bp, Homo sapiens
cccagtcctcactgtcct

SEQ ID NO: 6891037 - DNA, 14 bp, Homo sapiens
ctgtccatctgtct

SEQ ID NO: 6891038 - DNA, 15 bp, Homo sapiens
taactttactaagta

SEQ ID NO: 6891039 - DNA, 12 bp, Homo sapiens
acctcttcctct

SEQ ID NO: 6891040 - DNA, 18 bp, Homo sapiens
aaactccacatctgcctt

SEQ ID NO: 6891041 - DNA, 20 bp, Homo sapiens
actggaaaacagaacactta

SEQ ID NO: 6891042 - DNA, 19 bp, Homo sapiens
tataaattaaatatatgta

SEQ ID NO: 6891043 - DNA, 14 bp, Homo sapiens
atctgagtcctgga

SEQ ID NO: 6891044 - DNA, 14 bp, Homo sapiens
ttaaaagcaaatca

SEQ ID NO: 6891045 - DNA, 22 bp, Homo sapiens
tataaatatctatttatctgtc

SEQ ID NO: 6891046 - DNA, 18 bp, Homo sapiens
agccctctccacccagag

SEQ ID NO: 6891047 - DNA, 12 bp, Homo sapiens
cctcgctgtgcc

SEQ ID NO: 6891048 - DNA, 19 bp, Homo sapiens
atgtggagaaactgtagtc

SEQ ID NO: 6891049 - DNA, 18 bp, Homo sapiens
cctccttctgcagtcaga

SEQ ID NO: 6891050 - DNA, 16 bp, Homo sapiens
aattgttacaagtgtt

SEQ ID NO: 6891051 - DNA, 17 bp, Homo sapiens
aatgcttctgacttcat

SEQ ID NO: 6891052 - DNA, 21 bp, Homo sapiens
aggcagggccttgcccagaga

SEQ ID NO: 6891053 - DNA, 15 bp, Homo sapiens
cctggaccccagcct

SEQ ID NO: 6891054 - DNA, 18 bp, Homo sapiens
aacccattaggcatgcct

SEQ ID NO: 6891055 - DNA, 13 bp, Homo sapiens
gggtcgtggagag

SEQ ID NO: 6891056 - DNA, 18 bp, Homo sapiens
cattagcctgagtagaaa

SEQ ID NO: 6891057 - DNA, 15 bp, Homo sapiens
acaagcaatgcaaga

SEQ ID NO: 6891058 - DNA, 19 bp, Homo sapiens
ccctctcccccccccctcc

SEQ ID NO: 6891059 - DNA, 15 bp, Homo sapiens
ctcagcacttggccc

SEQ ID NO: 6891060 - DNA, 12 bp, Homo sapiens
ccttcctgggca

SEQ ID NO: 6891061 - DNA, 23 bp, Homo sapiens
tcctgcagggagccttctgccac

SEQ ID NO: 6891062 - DNA, 13 bp, Homo sapiens
cttccctcctgct

SEQ ID NO: 6891063 - DNA, 13 bp, Homo sapiens
agcttcctgtgcc

SEQ ID NO: 6891064 - DNA, 19 bp, Homo sapiens
cacatagattcacctgtaa

SEQ ID NO: 6891065 - DNA, 15 bp, Homo sapiens
gacaagaagctgcta

SEQ ID NO: 6891066 - DNA, 19 bp, Homo sapiens
cagtggaaaccctgagagt

SEQ ID NO: 6891067 - DNA, 12 bp, Homo sapiens
caggcccagcct

SEQ ID NO: 6891068 - DNA, 17 bp, Homo sapiens
agagaggatacatttaa

SEQ ID NO: 6891069 - DNA, 15 bp, Homo sapiens
atattattacttgta

SEQ ID NO: 6891070 - DNA, 21 bp, Homo sapiens
ctttcagctgtgctttttgca

SEQ ID NO: 6891071 - DNA, 16 bp, Homo sapiens
cagagcaccccctgct

SEQ ID NO: 6891072 - DNA, 14 bp, Homo sapiens
ccattgaaaatgta

SEQ ID NO: 6891073 - DNA, 13 bp, Homo sapiens
ccttgctctccct

SEQ ID NO: 6891074 - DNA, 13 bp, Homo sapiens
agttcatgcagct

SEQ ID NO: 6891075 - DNA, 22 bp, Homo sapiens
atactgttctcaacatactgta

SEQ ID NO: 6891076 - DNA, 16 bp, Homo sapiens
actgtcctttctccag

SEQ ID NO: 6891077 - DNA, 23 bp, Homo sapiens
catgattatagttaagcaaattt

SEQ ID NO: 6891078 - DNA, 21 bp, Homo sapiens
cccttctccatggccctgcca

SEQ ID NO: 6891079 - DNA, 15 bp, Homo sapiens
tcatgtatttcttta

SEQ ID NO: 6891080 - DNA, 17 bp, Homo sapiens
tggcctgtgctgggcca

SEQ ID NO: 6891081 - DNA, 21 bp, Homo sapiens
taaaaacatgagaaatgtgaa

SEQ ID NO: 6891082 - DNA, 14 bp, Homo sapiens
acactactacctct

SEQ ID NO: 6891083 - DNA, 22 bp, Homo sapiens
gagtccagcccctcctccctca

SEQ ID NO: 6891084 - DNA, 19 bp, Homo sapiens
atcaatatcccaacattct

SEQ ID NO: 6891085 - DNA, 11 bp, Homo sapiens
cagccacagga

SEQ ID NO: 6891086 - DNA, 15 bp, Homo sapiens
ctgaaggggccatga

SEQ ID NO: 6891087 - DNA, 17 bp, Homo sapiens
ccctggctaacagtcta

SEQ ID NO: 6891088 - DNA, 22 bp, Homo sapiens
atcaaaacacactactacctct

SEQ ID NO: 6891089 - DNA, 13 bp, Homo sapiens
agaatgctgtaga

SEQ ID NO: 6891090 - DNA, 16 bp, Homo sapiens
cctgagattctgggaa

SEQ ID NO: 6891091 - DNA, 17 bp, Homo sapiens
gccatgaccctgcctct

SEQ ID NO: 6891092 - DNA, 14 bp, Homo sapiens
tgccagtgtctttc

SEQ ID NO: 6891093 - DNA, 21 bp, Homo sapiens
ggcccagacctggcctctgcc

SEQ ID NO: 6891094 - DNA, 14 bp, Homo sapiens
ctgtcctgtgaatg

SEQ ID NO: 6891095 - DNA, 15 bp, Homo sapiens
ggccctgcctgcagc

SEQ ID NO: 6891096 - DNA, 13 bp, Homo sapiens
gcagtcctgttca

SEQ ID NO: 6891097 - DNA, 23 bp, Homo sapiens
caattctgatgttactgagatgt

SEQ ID NO: 6891098 - DNA, 14 bp, Homo sapiens
gcgcttctgctgaa

SEQ ID NO: 6891099 - DNA, 17 bp, Homo sapiens
cttgtgcctcccttccc

SEQ ID NO: 6891100 - DNA, 17 bp, Homo sapiens
tatgagcgtcactgccc

SEQ ID NO: 6891101 - DNA, 17 bp, Homo sapiens
cctgccccaccccatcc

SEQ ID NO: 6891102 - DNA, 18 bp, Homo sapiens
ctgttcaccttatgtatt

SEQ ID NO: 6891103 - DNA, 21 bp, Homo sapiens
aacgcccctccaaacctccag

SEQ ID NO: 6891104 - DNA, 13 bp, Homo sapiens
actgtcatctgcc

SEQ ID NO: 6891105 - DNA, 14 bp, Homo sapiens
taatttgtgaattt

SEQ ID NO: 6891106 - DNA, 16 bp, Homo sapiens
cttcctcatctgtgcc

SEQ ID NO: 6891107 - DNA, 21 bp, Homo sapiens
ttctagagggatccaccgcca

SEQ ID NO: 6891108 - DNA, 18 bp, Homo sapiens
caggataaggagactgag

SEQ ID NO: 6891109 - DNA, 14 bp, Homo sapiens
gttaaggagcctaa

SEQ ID NO: 6891110 - DNA, 19 bp, Homo sapiens
tgggtctgaggcccctgcc

SEQ ID NO: 6891111 - DNA, 17 bp, Homo sapiens
agtttccctcctctgca

SEQ ID NO: 6891112 - DNA, 23 bp, Homo sapiens
tttttaggctgttccttgtactc

SEQ ID NO: 6891113 - DNA, 22 bp, Homo sapiens
ccctgtacccagccaccttcct

SEQ ID NO: 6891114 - DNA, 20 bp, Homo sapiens
ctttgttaccttaaaactag

SEQ ID NO: 6891115 - DNA, 15 bp, Homo sapiens
tgttaagctcaggat

SEQ ID NO: 6891116 - DNA, 23 bp, Homo sapiens
tgggcccctgaggagctttgtgt

SEQ ID NO: 6891117 - DNA, 22 bp, Homo sapiens
aacctcgaagctgttctctgct

SEQ ID NO: 6891118 - DNA, 20 bp, Homo sapiens
tggcatccagagtccctgcc

SEQ ID NO: 6891119 - DNA, 12 bp, Homo sapiens
gtacctgctgcc

SEQ ID NO: 6891120 - DNA, 18 bp, Homo sapiens
ttcagatacttgtgaaca

SEQ ID NO: 6891121 - DNA, 11 bp, Homo sapiens
actctctgacc

SEQ ID NO: 6891122 - DNA, 16 bp, Homo sapiens
ctgtggcctgccagtc

SEQ ID NO: 6891123 - DNA, 22 bp, Homo sapiens
ccttgggagctcatccctctca

SEQ ID NO: 6891124 - DNA, 20 bp, Homo sapiens
cagacacctccccctaccca

SEQ ID NO: 6891125 - DNA, 23 bp, Homo sapiens
ttccggggctgctggcctggccc

SEQ ID NO: 6891126 - DNA, 18 bp, Homo sapiens
caagttctttcccagcct

SEQ ID NO: 6891127 - DNA, 17 bp, Homo sapiens
aggatggttagacagca

SEQ ID NO: 6891128 - DNA, 19 bp, Homo sapiens
cagcttcatgcctttgtaa

SEQ ID NO: 6891129 - DNA, 22 bp, Homo sapiens
catttgtgggtttttatttcct

SEQ ID NO: 6891130 - DNA, 19 bp, Homo sapiens
gaaggccaatagttttaga

SEQ ID NO: 6891131 - DNA, 18 bp, Homo sapiens
tgttcctgttcggttcca

SEQ ID NO: 6891132 - DNA, 15 bp, Homo sapiens
ttatgtgcactgcct

SEQ ID NO: 6891133 - DNA, 19 bp, Homo sapiens
tattctaagaaatatctgt

SEQ ID NO: 6891134 - DNA, 16 bp, Homo sapiens
tatgccttgtttcata

SEQ ID NO: 6891135 - DNA, 14 bp, Homo sapiens
ctgttcccccttca

SEQ ID NO: 6891136 - DNA, 17 bp, Homo sapiens
ccctgaccaccctgcct

SEQ ID NO: 6891137 - DNA, 14 bp, Homo sapiens
cttggtctttctgt

SEQ ID NO: 6891138 - DNA, 16 bp, Homo sapiens
cccagcccaccctcct

SEQ ID NO: 6891139 - DNA, 13 bp, Homo sapiens
gactagcccagga

SEQ ID NO: 6891140 - DNA, 16 bp, Homo sapiens
taaatatctagtgcta

SEQ ID NO: 6891141 - DNA, 17 bp, Homo sapiens
tgctaacctcactgcct

SEQ ID NO: 6891142 - DNA, 19 bp, Homo sapiens
tggaagctagacacatgaa

SEQ ID NO: 6891143 - DNA, 12 bp, Homo sapiens
ccaccagggatc

SEQ ID NO: 6891144 - DNA, 15 bp, Homo sapiens
ccaggagcagccctg

SEQ ID NO: 6891145 - DNA, 21 bp, Homo sapiens
cctttcatggcaatgaaaatt

SEQ ID NO: 6891146 - DNA, 12 bp, Homo sapiens
aaagcagtgttt

SEQ ID NO: 6891147 - DNA, 15 bp, Homo sapiens
ctctgctatgtctgt

SEQ ID NO: 6891148 - DNA, 14 bp, Homo sapiens
gtccaaactgccta

SEQ ID NO: 6891149 - DNA, 16 bp, Homo sapiens
tgattgtgcctctgcc

SEQ ID NO: 6891150 - DNA, 13 bp, Homo sapiens
tggggtgcagctt

SEQ ID NO: 6891151 - DNA, 17 bp, Homo sapiens
gaagctgacaatttatg

SEQ ID NO: 6891152 - DNA, 20 bp, Homo sapiens
cacacagtattacttctgct

SEQ ID NO: 6891153 - DNA, 17 bp, Homo sapiens
tgtcttcccccctctcc

SEQ ID NO: 6891154 - DNA, 20 bp, Homo sapiens
cctctgctgctgtccctccc

SEQ ID NO: 6891155 - DNA, 17 bp, Homo sapiens
gctcctgtccctaccca

SEQ ID NO: 6891156 - DNA, 14 bp, Homo sapiens
ctgggaagcccttt

SEQ ID NO: 6891157 - DNA, 17 bp, Homo sapiens
gagtctcatttgggcta

SEQ ID NO: 6891158 - DNA, 17 bp, Homo sapiens
tgggcttggcctgctgt

SEQ ID NO: 6891159 - DNA, 14 bp, Homo sapiens
tggtggccctctcc

SEQ ID NO: 6891160 - DNA, 14 bp, Homo sapiens
catcccctttcctc

SEQ ID NO: 6891161 - DNA, 15 bp, Homo sapiens
ctatccacccagccc

SEQ ID NO: 6891162 - DNA, 13 bp, Homo sapiens
gcctgcctctgcc

SEQ ID NO: 6891163 - DNA, 16 bp, Homo sapiens
atcacctctactgtct

SEQ ID NO: 6891164 - DNA, 17 bp, Homo sapiens
cctagcctgctctgcca

SEQ ID NO: 6891165 - DNA, 16 bp, Homo sapiens
ctctcactctcttcct

SEQ ID NO: 6891166 - DNA, 19 bp, Homo sapiens
ctgcagcgcctcctggaca

SEQ ID NO: 6891167 - DNA, 18 bp, Homo sapiens
gtcccatttctcactgag

SEQ ID NO: 6891168 - DNA, 18 bp, Homo sapiens
tcactcgataataaagta

SEQ ID NO: 6891169 - DNA, 13 bp, Homo sapiens
ctctggttgcctc

SEQ ID NO: 6891170 - DNA, 22 bp, Homo sapiens
aggtggatgttatgaacagctg

SEQ ID NO: 6891171 - DNA, 16 bp, Homo sapiens
ttccttttccctgctt

SEQ ID NO: 6891172 - DNA, 17 bp, Homo sapiens
ctggccgcctgggtcca

SEQ ID NO: 6891173 - DNA, 14 bp, Homo sapiens
ctaccatctgcatg

SEQ ID NO: 6891174 - DNA, 23 bp, Homo sapiens
aggccctccctgttccccagaga

SEQ ID NO: 6891175 - DNA, 13 bp, Homo sapiens
ttccacactgtca

SEQ ID NO: 6891176 - DNA, 19 bp, Homo sapiens
ccatattacgttgtttctt

SEQ ID NO: 6891177 - DNA, 18 bp, Homo sapiens
tcaatctccagggctcca

SEQ ID NO: 6891178 - DNA, 19 bp, Homo sapiens
caatcctgttactctgtcc

SEQ ID NO: 6891179 - DNA, 14 bp, Homo sapiens
ccaatccccagcct

SEQ ID NO: 6891180 - DNA, 19 bp, Homo sapiens
tggcaagaacttgtttaca

SEQ ID NO: 6891181 - DNA, 13 bp, Homo sapiens
ataacagctcctt

SEQ ID NO: 6891182 - DNA, 22 bp, Homo sapiens
catgaccttttggcctttgtaa

SEQ ID NO: 6891183 - DNA, 22 bp, Homo sapiens
caaaataaggggcacctgggaa

SEQ ID NO: 6891184 - DNA, 16 bp, Homo sapiens
ccctcctccccttcct

SEQ ID NO: 6891185 - DNA, 13 bp, Homo sapiens
tctccctgcctca

SEQ ID NO: 6891186 - DNA, 16 bp, Homo sapiens
ctttgagggactgcct

SEQ ID NO: 6891187 - DNA, 22 bp, Homo sapiens
cctcttgccactgcctcttcct

SEQ ID NO: 6891188 - DNA, 12 bp, Homo sapiens
ctcagcccaggt

SEQ ID NO: 6891189 - DNA, 18 bp, Homo sapiens
ttgagttttgataaagta

SEQ ID NO: 6891190 - DNA, 21 bp, Homo sapiens
cagttaaggaccgtggccctg

SEQ ID NO: 6891191 - DNA, 21 bp, Homo sapiens
agatgtgaaaatatctgctca

SEQ ID NO: 6891192 - DNA, 18 bp, Homo sapiens
ctcggcttttctcagctg

SEQ ID NO: 6891193 - DNA, 12 bp, Homo sapiens
caccccctctcc

SEQ ID NO: 6891194 - DNA, 13 bp, Homo sapiens
tctcactttgtaa

SEQ ID NO: 6891195 - DNA, 14 bp, Homo sapiens
gtctattctgagcc

SEQ ID NO: 6891196 - DNA, 20 bp, Homo sapiens
agcctctcccctgcctgccc

SEQ ID NO: 6891197 - DNA, 13 bp, Homo sapiens
ccttccctttcta

SEQ ID NO: 6891198 - DNA, 20 bp, Homo sapiens
atccctttttttacatttca

SEQ ID NO: 6891199 - DNA, 17 bp, Homo sapiens
acatatacacaaagata

SEQ ID NO: 6891200 - DNA, 12 bp, Homo sapiens
tctgtctactgt

SEQ ID NO: 6891201 - DNA, 23 bp, Homo sapiens
tactttatatcttgtttacaata

SEQ ID NO: 6891202 - DNA, 22 bp, Homo sapiens
ctgtgaaccaacccccatctcc

SEQ ID NO: 6891203 - DNA, 16 bp, Homo sapiens
tcacgctttcatgacc

SEQ ID NO: 6891204 - DNA, 15 bp, Homo sapiens
aggtctaatcagtga

SEQ ID NO: 6891205 - DNA, 13 bp, Homo sapiens
tcctcctgcctca

SEQ ID NO: 6891206 - DNA, 23 bp, Homo sapiens
ccagggaaggtggggccctgccc

SEQ ID NO: 6891207 - DNA, 19 bp, Homo sapiens
cagagataaataaaagata

SEQ ID NO: 6891208 - DNA, 22 bp, Homo sapiens
ttcagcactttagaatatgcct

SEQ ID NO: 6891209 - DNA, 14 bp, Homo sapiens
tggcccctgtgtga

SEQ ID NO: 6891210 - DNA, 23 bp, Homo sapiens
gagaacaagtcacagctgcagct

SEQ ID NO: 6891211 - DNA, 16 bp, Homo sapiens
cactccaggccctgcc

SEQ ID NO: 6891212 - DNA, 16 bp, Homo sapiens
ccttgctctctgttct

SEQ ID NO: 6891213 - DNA, 13 bp, Homo sapiens
tcccatgaagcct

SEQ ID NO: 6891214 - DNA, 16 bp, Homo sapiens
tgtcaggccctctgcc

SEQ ID NO: 6891215 - DNA, 15 bp, Homo sapiens
aatgttcccttgacc

SEQ ID NO: 6891216 - DNA, 16 bp, Homo sapiens
caagaacttgtttaca

SEQ ID NO: 6891217 - DNA, 12 bp, Homo sapiens
cttcaagttgta

SEQ ID NO: 6891218 - DNA, 23 bp, Homo sapiens
cagcttttcattgctgtgacagt

SEQ ID NO: 6891219 - DNA, 19 bp, Homo sapiens
aagaactgtacattgtgag

SEQ ID NO: 6891220 - DNA, 18 bp, Homo sapiens
tgcccaaagtctgtgtga

SEQ ID NO: 6891221 - DNA, 14 bp, Homo sapiens
attgaaactgtatt

SEQ ID NO: 6891222 - DNA, 22 bp, Homo sapiens
cagaggttttaatgtctgttta

SEQ ID NO: 6891223 - DNA, 15 bp, Homo sapiens
agccacacagcccag

SEQ ID NO: 6891224 - DNA, 15 bp, Homo sapiens
cagggtcgtctttgt

SEQ ID NO: 6891225 - DNA, 20 bp, Homo sapiens
gccatctgatccccatgcct

SEQ ID NO: 6891226 - DNA, 13 bp, Homo sapiens
gtattgctattta

SEQ ID NO: 6891227 - DNA, 15 bp, Homo sapiens
tagctgccacttgaa

SEQ ID NO: 6891228 - DNA, 14 bp, Homo sapiens
cggttttggcagct

SEQ ID NO: 6891229 - DNA, 14 bp, Homo sapiens
gggcagcccagaga

SEQ ID NO: 6891230 - DNA, 21 bp, Homo sapiens
catctgcgggggcagtgctca

SEQ ID NO: 6891231 - DNA, 16 bp, Homo sapiens
gtcttaattgtgttta

SEQ ID NO: 6891232 - DNA, 18 bp, Homo sapiens
cgttcgatttctacctca

SEQ ID NO: 6891233 - DNA, 18 bp, Homo sapiens
atatttgtaacattgtaa

SEQ ID NO: 6891234 - DNA, 20 bp, Homo sapiens
gatagaatttggcccagaga

SEQ ID NO: 6891235 - DNA, 20 bp, Homo sapiens
caggctccccctgcctttga

SEQ ID NO: 6891236 - DNA, 17 bp, Homo sapiens
ttttcacattcttggct

SEQ ID NO: 6891237 - DNA, 20 bp, Homo sapiens
attctaagaaatatctgtga

SEQ ID NO: 6891238 - DNA, 16 bp, Homo sapiens
ttaatgaactgtgaca

SEQ ID NO: 6891239 - DNA, 21 bp, Homo sapiens
cactcaccagtggcctttcag

SEQ ID NO: 6891240 - DNA, 12 bp, Homo sapiens
cctcaccctgct

SEQ ID NO: 6891241 - DNA, 12 bp, Homo sapiens
tctcctggctgg

SEQ ID NO: 6891242 - DNA, 20 bp, Homo sapiens
tgggaccccctcgccagctt

SEQ ID NO: 6891243 - DNA, 19 bp, Homo sapiens
tgatccgcccgcctctgcc

SEQ ID NO: 6891244 - DNA, 20 bp, Homo sapiens
cagtcctcccaccttggcct

SEQ ID NO: 6891245 - DNA, 20 bp, Homo sapiens
tgtcctggtaattcctctcc

SEQ ID NO: 6891246 - DNA, 14 bp, Homo sapiens
ctgtcattgataat

SEQ ID NO: 6891247 - DNA, 13 bp, Homo sapiens
gacagagccagga

SEQ ID NO: 6891248 - DNA, 18 bp, Homo sapiens
ccatggtgtgatcgtctg

SEQ ID NO: 6891249 - DNA, 19 bp, Homo sapiens
cccagaactggctgggccc

SEQ ID NO: 6891250 - DNA, 22 bp, Homo sapiens
cctgcaccagcccttccctgct

SEQ ID NO: 6891251 - DNA, 14 bp, Homo sapiens
cctgaaatgttaca

SEQ ID NO: 6891252 - DNA, 23 bp, Homo sapiens
cttctcatgctatttctacctca

SEQ ID NO: 6891253 - DNA, 14 bp, Homo sapiens
ctctggctttccca

SEQ ID NO: 6891254 - DNA, 22 bp, Homo sapiens
cagtacccctaaaatcccacca

SEQ ID NO: 6891255 - DNA, 16 bp, Homo sapiens
cttctcaagtgcctta

SEQ ID NO: 6891256 - DNA, 15 bp, Homo sapiens
tcacaagcctcctgt

SEQ ID NO: 6891257 - DNA, 17 bp, Homo sapiens
taacttctaaaactgta

SEQ ID NO: 6891258 - DNA, 21 bp, Homo sapiens
ccaaggagccattctgtgtgt

SEQ ID NO: 6891259 - DNA, 15 bp, Homo sapiens
tcttcctcctctgct

SEQ ID NO: 6891260 - DNA, 17 bp, Homo sapiens
cctggcctccagctccc

SEQ ID NO: 6891261 - DNA, 17 bp, Homo sapiens
tgtccatcctcctctcc

SEQ ID NO: 6891262 - DNA, 18 bp, Homo sapiens
gccccggccacctctgcg

SEQ ID NO: 6891263 - DNA, 15 bp, Homo sapiens
atcaaagacatttca

SEQ ID NO: 6891264 - DNA, 19 bp, Homo sapiens
gagtgtgtattgttcccag

SEQ ID NO: 6891265 - DNA, 15 bp, Homo sapiens
gaacatcctgctgca

SEQ ID NO: 6891266 - DNA, 19 bp, Homo sapiens
ccaagctagactgtgtctg

SEQ ID NO: 6891267 - DNA, 20 bp, Homo sapiens
ctgtggcaaaaagagtcaga

SEQ ID NO: 6891268 - DNA, 15 bp, Homo sapiens
gtaccactgctaata

SEQ ID NO: 6891269 - DNA, 23 bp, Homo sapiens
cttccctggctacttcccttcct

SEQ ID NO: 6891270 - DNA, 20 bp, Homo sapiens
cttttctacacactcagcca

SEQ ID NO: 6891271 - DNA, 17 bp, Homo sapiens
gccattggcctctgtct

SEQ ID NO: 6891272 - DNA, 18 bp, Homo sapiens
ctttccctgtgccacttt

SEQ ID NO: 6891273 - DNA, 16 bp, Homo sapiens
aatgtgtttttctcca

SEQ ID NO: 6891274 - DNA, 22 bp, Homo sapiens
caccctgtgatggggccctgcc

SEQ ID NO: 6891275 - DNA, 14 bp, Homo sapiens
attaatgcactttc

SEQ ID NO: 6891276 - DNA, 14 bp, Homo sapiens
ttgaaagagtccta

SEQ ID NO: 6891277 - DNA, 21 bp, Homo sapiens
tggtctcttcctgtctggctt

SEQ ID NO: 6891278 - DNA, 18 bp, Homo sapiens
gggcccctcactggctgg

SEQ ID NO: 6891279 - DNA, 14 bp, Homo sapiens
gggggaaagggaac

SEQ ID NO: 6891280 - DNA, 14 bp, Homo sapiens
atgagcaaatggaa

SEQ ID NO: 6891281 - DNA, 15 bp, Homo sapiens
ctccacccttggcct

SEQ ID NO: 6891282 - DNA, 12 bp, Homo sapiens
tatttgtacaaa

SEQ ID NO: 6891283 - DNA, 17 bp, Homo sapiens
cactctcccctccctct

SEQ ID NO: 6891284 - DNA, 17 bp, Homo sapiens
tcatgcctcagtttccc

SEQ ID NO: 6891285 - DNA, 16 bp, Homo sapiens
tcttgttctgagattc

SEQ ID NO: 6891286 - DNA, 13 bp, Homo sapiens
accagttactgtt

SEQ ID NO: 6891287 - DNA, 18 bp, Homo sapiens
tggccatgaatctctgcc

SEQ ID NO: 6891288 - DNA, 23 bp, Homo sapiens
ttaaaaaataaaaaaatacagta

SEQ ID NO: 6891289 - DNA, 21 bp, Homo sapiens
tttaggctgttccttgtactc

SEQ ID NO: 6891290 - DNA, 21 bp, Homo sapiens
aatatcttttatgtttgaata

SEQ ID NO: 6891291 - DNA, 20 bp, Homo sapiens
cacaagtagatgcctgaact

SEQ ID NO: 6891292 - DNA, 16 bp, Homo sapiens
tctaaaatagcaataa

SEQ ID NO: 6891293 - DNA, 15 bp, Homo sapiens
actcgactctgtgcc

SEQ ID NO: 6891294 - DNA, 15 bp, Homo sapiens
accatccaccctgca

SEQ ID NO: 6891295 - DNA, 13 bp, Homo sapiens
ctccacctgctct

SEQ ID NO: 6891296 - DNA, 17 bp, Homo sapiens
gcctatttcagctgctt

SEQ ID NO: 6891297 - DNA, 20 bp, Homo sapiens
gtggatcttgccacatttct

SEQ ID NO: 6891298 - DNA, 14 bp, Homo sapiens
cttcttcacatcca

SEQ ID NO: 6891299 - DNA, 14 bp, Homo sapiens
cttggagccttcca

SEQ ID NO: 6891300 - DNA, 16 bp, Homo sapiens
tgcacacacagctcct

SEQ ID NO: 6891301 - DNA, 17 bp, Homo sapiens
gaactaagaaacttttg

SEQ ID NO: 6891302 - DNA, 21 bp, Homo sapiens
tgtggatcttgccacatttct

SEQ ID NO: 6891303 - DNA, 14 bp, Homo sapiens
cagtcctctgcctc

SEQ ID NO: 6891304 - DNA, 14 bp, Homo sapiens
ttactccttctgtt

SEQ ID NO: 6891305 - DNA, 18 bp, Homo sapiens
ctgaagcggtcagactgg

SEQ ID NO: 6891306 - DNA, 13 bp, Homo sapiens
atctctctggccc

SEQ ID NO: 6891307 - DNA, 13 bp, Homo sapiens
tcatttctgtctc

SEQ ID NO: 6891308 - DNA, 21 bp, Homo sapiens
gctctcctgagaggtgctgca

SEQ ID NO: 6891309 - DNA, 18 bp, Homo sapiens
ctctcctgacccctgcct

SEQ ID NO: 6891310 - DNA, 19 bp, Homo sapiens
cctctggtaacctcttact

SEQ ID NO: 6891311 - DNA, 21 bp, Homo sapiens
cttttaaagaaaaaaattgaa

SEQ ID NO: 6891312 - DNA, 13 bp, Homo sapiens
attatgaaaatta

SEQ ID NO: 6891313 - DNA, 18 bp, Homo sapiens
catcagctaaacaccacg

SEQ ID NO: 6891314 - DNA, 22 bp, Homo sapiens
tgtcctgaaagcggctgcctcc

SEQ ID NO: 6891315 - DNA, 23 bp, Homo sapiens
gatcttcatctgactatgacata

SEQ ID NO: 6891316 - DNA, 21 bp, Homo sapiens
ggttcatcatccctccctgcc

SEQ ID NO: 6891317 - DNA, 22 bp, Homo sapiens
aggccctccctgttccccagag

SEQ ID NO: 6891318 - DNA, 11 bp, Homo sapiens
cctcttcctcc

SEQ ID NO: 6891319 - DNA, 13 bp, Homo sapiens
agcgatctctcct

SEQ ID NO: 6891320 - DNA, 10 bp, Homo sapiens
gaaaaaagct

SEQ ID NO: 6891321 - DNA, 20 bp, Homo sapiens
gaggtcctgagcactgccag

SEQ ID NO: 6891322 - DNA, 15 bp, Homo sapiens
ttcagggtcttggct

SEQ ID NO: 6891323 - DNA, 15 bp, Homo sapiens
acagctttgctgctg

SEQ ID NO: 6891324 - DNA, 17 bp, Homo sapiens
cttagaacccttctgct

SEQ ID NO: 6891325 - DNA, 12 bp, Homo sapiens
agcttctctgca

SEQ ID NO: 6891326 - DNA, 14 bp, Homo sapiens
ggaagactggagaa

SEQ ID NO: 6891327 - DNA, 20 bp, Homo sapiens
gcctgccccagctgggctgt

SEQ ID NO: 6891328 - DNA, 16 bp, Homo sapiens
cactcccctccactct

SEQ ID NO: 6891329 - DNA, 13 bp, Homo sapiens
cacccactggcca

SEQ ID NO: 6891330 - DNA, 17 bp, Homo sapiens
ctctgcctgcactccct

SEQ ID NO: 6891331 - DNA, 12 bp, Homo sapiens
ctccatctctct

SEQ ID NO: 6891332 - DNA, 17 bp, Homo sapiens
ccagagacgcccagccc

SEQ ID NO: 6891333 - DNA, 21 bp, Homo sapiens
cctgcccaaactccccttccc

SEQ ID NO: 6891334 - DNA, 21 bp, Homo sapiens
tccaagtgtgcatattgtaca

SEQ ID NO: 6891335 - DNA, 13 bp, Homo sapiens
gtgctctgcctct

SEQ ID NO: 6891336 - DNA, 13 bp, Homo sapiens
attacctctgata

SEQ ID NO: 6891337 - DNA, 16 bp, Homo sapiens
taaaaatatatatgta

SEQ ID NO: 6891338 - DNA, 21 bp, Homo sapiens
ctgaggagacaaccagatcag

SEQ ID NO: 6891339 - DNA, 20 bp, Homo sapiens
ccttctttctcttccctcct

SEQ ID NO: 6891340 - DNA, 16 bp, Homo sapiens
cagacctccccagccc

SEQ ID NO: 6891341 - DNA, 18 bp, Homo sapiens
gtaatatttacaatgtat

SEQ ID NO: 6891342 - DNA, 14 bp, Homo sapiens
taaccgatgcttta

SEQ ID NO: 6891343 - DNA, 22 bp, Homo sapiens
aggtttcccagtgagcctctgc

SEQ ID NO: 6891344 - DNA, 16 bp, Homo sapiens
ccctcccccagctcct

SEQ ID NO: 6891345 - DNA, 19 bp, Homo sapiens
ctcagctctaggctgttct

SEQ ID NO: 6891346 - DNA, 17 bp, Homo sapiens
gctcctgcccaggccac

SEQ ID NO: 6891347 - DNA, 18 bp, Homo sapiens
gatctaataaactttatt

SEQ ID NO: 6891348 - DNA, 14 bp, Homo sapiens
gaataaagcaattt

SEQ ID NO: 6891349 - DNA, 14 bp, Homo sapiens
ccatttttctgggg

SEQ ID NO: 6891350 - DNA, 18 bp, Homo sapiens
ccagctcagccccggcca

SEQ ID NO: 6891351 - DNA, 18 bp, Homo sapiens
tccccagtccccagccct

SEQ ID NO: 6891352 - DNA, 20 bp, Homo sapiens
cacaataggatcccccttct

SEQ ID NO: 6891353 - DNA, 23 bp, Homo sapiens
gactaagccccgtctgaccccag

SEQ ID NO: 6891354 - DNA, 13 bp, Homo sapiens
ctttcccccaccc

SEQ ID NO: 6891355 - DNA, 15 bp, Homo sapiens
ctcccaccttggcct

SEQ ID NO: 6891356 - DNA, 22 bp, Homo sapiens
ctacagcactactgggtgtcat

SEQ ID NO: 6891357 - DNA, 21 bp, Homo sapiens
aacactgttctctgccctcca

SEQ ID NO: 6891358 - DNA, 19 bp, Homo sapiens
gcccccatgggctcctgcc

SEQ ID NO: 6891359 - DNA, 20 bp, Homo sapiens
cttcccacatgcctgcgcct

SEQ ID NO: 6891360 - DNA, 19 bp, Homo sapiens
tataagtggaggcacttta

SEQ ID NO: 6891361 - DNA, 14 bp, Homo sapiens
ccaaggacctgaga

SEQ ID NO: 6891362 - DNA, 21 bp, Homo sapiens
tatggtttctgcgtgctttat

SEQ ID NO: 6891363 - DNA, 12 bp, Homo sapiens
cccagcactttg

SEQ ID NO: 6891364 - DNA, 21 bp, Homo sapiens
gaattggcctgaacagatgta

SEQ ID NO: 6891365 - DNA, 14 bp, Homo sapiens
agagcatctctgcc

SEQ ID NO: 6891366 - DNA, 15 bp, Homo sapiens
ttcatggaactttca

SEQ ID NO: 6891367 - DNA, 21 bp, Homo sapiens
catcgttttctttgctgtgcc

SEQ ID NO: 6891368 - DNA, 22 bp, Homo sapiens
gaagccacggtgttctgtgata

SEQ ID NO: 6891369 - DNA, 23 bp, Homo sapiens
ctgcctggacttggcccctgcca

SEQ ID NO: 6891370 - DNA, 13 bp, Homo sapiens
gttcagcctgcct

SEQ ID NO: 6891371 - DNA, 15 bp, Homo sapiens
gaaaagctaccatca

SEQ ID NO: 6891372 - DNA, 20 bp, Homo sapiens
ctgtaaagagacctacctca

SEQ ID NO: 6891373 - DNA, 20 bp, Homo sapiens
tactatcctggctttgccca

SEQ ID NO: 6891374 - DNA, 13 bp, Homo sapiens
cctccccctgcca

SEQ ID NO: 6891375 - DNA, 17 bp, Homo sapiens
aatgtctctgtgagact

SEQ ID NO: 6891376 - DNA, 13 bp, Homo sapiens
cttttcctctgcc

SEQ ID NO: 6891377 - DNA, 22 bp, Homo sapiens
gcctttctcctccccacctgta

SEQ ID NO: 6891378 - DNA, 23 bp, Homo sapiens
agtcgtggggaacggaggaggac

SEQ ID NO: 6891379 - DNA, 13 bp, Homo sapiens
ccctcccgcttcc

SEQ ID NO: 6891380 - DNA, 21 bp, Homo sapiens
tcagggaggggctgagtctgg

SEQ ID NO: 6891381 - DNA, 22 bp, Homo sapiens
cactcctaggagagccaacctc

SEQ ID NO: 6891382 - DNA, 22 bp, Homo sapiens
ctgggtactgaggtgctatgaa

SEQ ID NO: 6891383 - DNA, 15 bp, Homo sapiens
gtccatatcacacac

SEQ ID NO: 6891384 - DNA, 19 bp, Homo sapiens
ctgactgaggcctgcttcc

SEQ ID NO: 6891385 - DNA, 21 bp, Homo sapiens
agggcatgcgcacaaggctga

SEQ ID NO: 6891386 - DNA, 15 bp, Homo sapiens
agccgccagctggga

SEQ ID NO: 6891387 - DNA, 19 bp, Homo sapiens
ctgccccctatcttgtcct

SEQ ID NO: 6891388 - DNA, 13 bp, Homo sapiens
ctgtccctaccca

SEQ ID NO: 6891389 - DNA, 21 bp, Homo sapiens
ccgtctccaggggctgcttcc

SEQ ID NO: 6891390 - DNA, 15 bp, Homo sapiens
ctcgtccccctccct

SEQ ID NO: 6891391 - DNA, 15 bp, Homo sapiens
ccatcttcctgagct

SEQ ID NO: 6891392 - DNA, 15 bp, Homo sapiens
catttgctgccctgg

SEQ ID NO: 6891393 - DNA, 21 bp, Homo sapiens
cccttcctctcactcctgcct

SEQ ID NO: 6891394 - DNA, 16 bp, Homo sapiens
cgcttccctcctgccc

SEQ ID NO: 6891395 - DNA, 16 bp, Homo sapiens
caagccattctgcctc

SEQ ID NO: 6891396 - DNA, 22 bp, Homo sapiens
agtcctcacacacggaggccag

SEQ ID NO: 6891397 - DNA, 22 bp, Homo sapiens
cactgaatttttatgtgtgatt

SEQ ID NO: 6891398 - DNA, 12 bp, Homo sapiens
ctcaccctgccc

SEQ ID NO: 6891399 - DNA, 20 bp, Homo sapiens
acattcctgagattctggga

SEQ ID NO: 6891400 - DNA, 19 bp, Homo sapiens
aggcaccagaagaacagta

SEQ ID NO: 6891401 - DNA, 18 bp, Homo sapiens
cctctatactttgttctg

SEQ ID NO: 6891402 - DNA, 11 bp, Homo sapiens
cattaactgtt

SEQ ID NO: 6891403 - DNA, 18 bp, Homo sapiens
cacgcttagggtctgtcc

SEQ ID NO: 6891404 - DNA, 13 bp, Homo sapiens
tgcctacagctgt

SEQ ID NO: 6891405 - DNA, 19 bp, Homo sapiens
tggcagataatcagcctct

SEQ ID NO: 6891406 - DNA, 16 bp, Homo sapiens
actcttggcctctgct

SEQ ID NO: 6891407 - DNA, 14 bp, Homo sapiens
ctccaagcctgcct

SEQ ID NO: 6891408 - DNA, 21 bp, Homo sapiens
acccttcccgcctccctctca

SEQ ID NO: 6891409 - DNA, 18 bp, Homo sapiens
attgttttgcaaaagtgt

SEQ ID NO: 6891410 - DNA, 14 bp, Homo sapiens
cctccctccctccc

SEQ ID NO: 6891411 - DNA, 13 bp, Homo sapiens
acatggacttgta

SEQ ID NO: 6891412 - DNA, 15 bp, Homo sapiens
agttccctcctgccc

SEQ ID NO: 6891413 - DNA, 12 bp, Homo sapiens
ttttcctctgcc

SEQ ID NO: 6891414 - DNA, 22 bp, Homo sapiens
aaccatcttttgttaagttcac

SEQ ID NO: 6891415 - DNA, 19 bp, Homo sapiens
tttgctgatggtctggtct

SEQ ID NO: 6891416 - DNA, 21 bp, Homo sapiens
tgaatgaaatataaactgtga

SEQ ID NO: 6891417 - DNA, 19 bp, Homo sapiens
cattcctgagattctggga

SEQ ID NO: 6891418 - DNA, 21 bp, Homo sapiens
tacataagtacctcagcattt

SEQ ID NO: 6891419 - DNA, 21 bp, Homo sapiens
tctttatgatgatacagtgtt

SEQ ID NO: 6891420 - DNA, 16 bp, Homo sapiens
ttcgtttctgtataca

SEQ ID NO: 6891421 - DNA, 22 bp, Homo sapiens
ccacagtgactcgggctcctgt

SEQ ID NO: 6891422 - DNA, 18 bp, Homo sapiens
attgtggttccatgcagc

SEQ ID NO: 6891423 - DNA, 19 bp, Homo sapiens
gcttccagaccacctgcca

SEQ ID NO: 6891424 - DNA, 14 bp, Homo sapiens
atatgactcaggag

SEQ ID NO: 6891425 - DNA, 12 bp, Homo sapiens
caggcccacatt

SEQ ID NO: 6891426 - DNA, 14 bp, Homo sapiens
cactacaccttgcc

SEQ ID NO: 6891427 - DNA, 12 bp, Homo sapiens
ccttcccttgcc

SEQ ID NO: 6891428 - DNA, 21 bp, Homo sapiens
acaaataaatgattatattca

SEQ ID NO: 6891429 - DNA, 21 bp, Homo sapiens
tagggtttgtttgctgctttt

SEQ ID NO: 6891430 - DNA, 13 bp, Homo sapiens
ctgttcccagccc

SEQ ID NO: 6891431 - DNA, 21 bp, Homo sapiens
gttcccctagtaagtgccttc

SEQ ID NO: 6891432 - DNA, 20 bp, Homo sapiens
tatagagcagaaattctgtt

SEQ ID NO: 6891433 - DNA, 12 bp, Homo sapiens
gcaatcttgtcc

SEQ ID NO: 6891434 - DNA, 19 bp, Homo sapiens
tgatctaataaactttatt

SEQ ID NO: 6891435 - DNA, 13 bp, Homo sapiens
cctctctctgcct

SEQ ID NO: 6891436 - DNA, 14 bp, Homo sapiens
cctgctcccatcct

SEQ ID NO: 6891437 - DNA, 12 bp, Homo sapiens
gaggctgagccc

SEQ ID NO: 6891438 - DNA, 15 bp, Homo sapiens
ctttctcctgtgccc

SEQ ID NO: 6891439 - DNA, 14 bp, Homo sapiens
ccaaattgccttca

SEQ ID NO: 6891440 - DNA, 13 bp, Homo sapiens
tcttccccttgcc

SEQ ID NO: 6891441 - DNA, 21 bp, Homo sapiens
gtttctgggtccctgctcccc

SEQ ID NO: 6891442 - DNA, 23 bp, Homo sapiens
acgtggattgtatttaagacata

SEQ ID NO: 6891443 - DNA, 16 bp, Homo sapiens
cctttcttccccaccc

SEQ ID NO: 6891444 - DNA, 19 bp, Homo sapiens
ccagaccacctgccagcca

SEQ ID NO: 6891445 - DNA, 16 bp, Homo sapiens
ccaagggtatctgctg

SEQ ID NO: 6891446 - DNA, 21 bp, Homo sapiens
ctggtcaccgagactcagcct

SEQ ID NO: 6891447 - DNA, 20 bp, Homo sapiens
catctccaaggatcctctcc

SEQ ID NO: 6891448 - DNA, 15 bp, Homo sapiens
acactccaccctcca

SEQ ID NO: 6891449 - DNA, 17 bp, Homo sapiens
atctcccttccacctca

SEQ ID NO: 6891450 - DNA, 13 bp, Homo sapiens
caatttgtttttg

SEQ ID NO: 6891451 - DNA, 23 bp, Homo sapiens
acatggtgcctatatctgagaga

SEQ ID NO: 6891452 - DNA, 16 bp, Homo sapiens
tcaatttttatacata

SEQ ID NO: 6891453 - DNA, 23 bp, Homo sapiens
tttccactttgttggcccttcca

SEQ ID NO: 6891454 - DNA, 19 bp, Homo sapiens
gttcctaagagtgctgggc

SEQ ID NO: 6891455 - DNA, 20 bp, Homo sapiens
aataaaatattttctgtgtg

SEQ ID NO: 6891456 - DNA, 16 bp, Homo sapiens
cagttaagaagccctg

SEQ ID NO: 6891457 - DNA, 14 bp, Homo sapiens
aggctcactgcagc

SEQ ID NO: 6891458 - DNA, 12 bp, Homo sapiens
agacctcagcca

SEQ ID NO: 6891459 - DNA, 19 bp, Homo sapiens
gtatgtctgccatgttgcc

SEQ ID NO: 6891460 - DNA, 14 bp, Homo sapiens
taccttcagcagtt

SEQ ID NO: 6891461 - DNA, 22 bp, Homo sapiens
gcctgctcccatcctcacccag

SEQ ID NO: 6891462 - DNA, 19 bp, Homo sapiens
tgtgctaacctcactgcct

SEQ ID NO: 6891463 - DNA, 16 bp, Homo sapiens
ctctgcttctctgact

SEQ ID NO: 6891464 - DNA, 18 bp, Homo sapiens
ctccagcccacagtgctc

SEQ ID NO: 6891465 - DNA, 21 bp, Homo sapiens
attcctcaacagtgttttcag

SEQ ID NO: 6891466 - DNA, 11 bp, Homo sapiens
tgtctgtgtgc

SEQ ID NO: 6891467 - DNA, 22 bp, Homo sapiens
tgcgtggccacgggggcagtgt

SEQ ID NO: 6891468 - DNA, 18 bp, Homo sapiens
ctagtaacagtatttcca

SEQ ID NO: 6891469 - DNA, 14 bp, Homo sapiens
cctgcacccttccc

SEQ ID NO: 6891470 - DNA, 23 bp, Homo sapiens
gtagtctttttataggttttata

SEQ ID NO: 6891471 - DNA, 19 bp, Homo sapiens
catatcacctcatggccta

SEQ ID NO: 6891472 - DNA, 15 bp, Homo sapiens
accccctcctgctgc

SEQ ID NO: 6891473 - DNA, 22 bp, Homo sapiens
ttccaagcctgggccactggca

SEQ ID NO: 6891474 - DNA, 11 bp, Homo sapiens
ctcctccctcc

SEQ ID NO: 6891475 - DNA, 19 bp, Homo sapiens
ccagggcaaggccccttcc

SEQ ID NO: 6891476 - DNA, 15 bp, Homo sapiens
taaccgatgctttac

SEQ ID NO: 6891477 - DNA, 13 bp, Homo sapiens
gataatacttgac

SEQ ID NO: 6891478 - DNA, 23 bp, Homo sapiens
ccctccccgcctcctccctgcct

SEQ ID NO: 6891479 - DNA, 17 bp, Homo sapiens
tgaccctgagctgacca

SEQ ID NO: 6891480 - DNA, 21 bp, Homo sapiens
cactcaaggcggtgcttgata

SEQ ID NO: 6891481 - DNA, 20 bp, Homo sapiens
ctcctgctcaccacctgcct

SEQ ID NO: 6891482 - DNA, 16 bp, Homo sapiens
atacattcatactgta

SEQ ID NO: 6891483 - DNA, 13 bp, Homo sapiens
acttgcctgctgc

SEQ ID NO: 6891484 - DNA, 16 bp, Homo sapiens
taacaaccctgttgag

SEQ ID NO: 6891485 - DNA, 14 bp, Homo sapiens
agatgccatagcat

SEQ ID NO: 6891486 - DNA, 14 bp, Homo sapiens
ctgccttctggcct

SEQ ID NO: 6891487 - DNA, 19 bp, Homo sapiens
catgttatgcagtgaacta

SEQ ID NO: 6891488 - DNA, 12 bp, Homo sapiens
ctcctctctgcc

SEQ ID NO: 6891489 - DNA, 15 bp, Homo sapiens
actctctttcttcca

SEQ ID NO: 6891490 - DNA, 23 bp, Homo sapiens
tcagggcacagctgccctgctgc

SEQ ID NO: 6891491 - DNA, 21 bp, Homo sapiens
aatacatatgataaatttgac

SEQ ID NO: 6891492 - DNA, 15 bp, Homo sapiens
agtgactcctgctgg

SEQ ID NO: 6891493 - DNA, 21 bp, Homo sapiens
ttatatctgaggaattctgta

SEQ ID NO: 6891494 - DNA, 23 bp, Homo sapiens
catctacctaaaggactattatg

SEQ ID NO: 6891495 - DNA, 22 bp, Homo sapiens
tagctccttcatgcttttctca

SEQ ID NO: 6891496 - DNA, 14 bp, Homo sapiens
gtcactctgcctct

SEQ ID NO: 6891497 - DNA, 20 bp, Homo sapiens
cctctctatcctctcttcct

SEQ ID NO: 6891498 - DNA, 12 bp, Homo sapiens
ttaaatattgta

SEQ ID NO: 6891499 - DNA, 19 bp, Homo sapiens
ctcccccgacactgctgca

SEQ ID NO: 6891500 - DNA, 17 bp, Homo sapiens
tcctcccgagctcctct

SEQ ID NO: 6891501 - DNA, 20 bp, Homo sapiens
cggtttcacgccccacactt

SEQ ID NO: 6891502 - DNA, 17 bp, Homo sapiens
cagtctgtctactgtgg

SEQ ID NO: 6891503 - DNA, 13 bp, Homo sapiens
ccttatcttgcac

SEQ ID NO: 6891504 - DNA, 16 bp, Homo sapiens
ctaaatgatggtgctt

SEQ ID NO: 6891505 - DNA, 20 bp, Homo sapiens
gtatttaaaaccttgattta

SEQ ID NO: 6891506 - DNA, 15 bp, Homo sapiens
aggcagaagaagctg

SEQ ID NO: 6891507 - DNA, 19 bp, Homo sapiens
taactcccagtgatgctgt

SEQ ID NO: 6891508 - DNA, 23 bp, Homo sapiens
ccccaggaagccgtgccctgccc

SEQ ID NO: 6891509 - DNA, 20 bp, Homo sapiens
tccccagcattccagcccct

SEQ ID NO: 6891510 - DNA, 17 bp, Homo sapiens
cttcacgcccttggcca

SEQ ID NO: 6891511 - DNA, 12 bp, Homo sapiens
caacttctgggc

SEQ ID NO: 6891512 - DNA, 17 bp, Homo sapiens
cttttgcacccctccca

SEQ ID NO: 6891513 - DNA, 13 bp, Homo sapiens
cacacaacatcaa

SEQ ID NO: 6891514 - DNA, 23 bp, Homo sapiens
acccttggtgtttcccttcctcg

SEQ ID NO: 6891515 - DNA, 15 bp, Homo sapiens
agaactgtctgtgaa

SEQ ID NO: 6891516 - DNA, 15 bp, Homo sapiens
cagccaggagtgccc

SEQ ID NO: 6891517 - DNA, 14 bp, Homo sapiens
ctgaaataaacact

SEQ ID NO: 6891518 - DNA, 12 bp, Homo sapiens
acaaactgtgaa

SEQ ID NO: 6891519 - DNA, 18 bp, Homo sapiens
acctctttactctctccg

SEQ ID NO: 6891520 - DNA, 17 bp, Homo sapiens
atgctgcaaaggagaag

SEQ ID NO: 6891521 - DNA, 23 bp, Homo sapiens
gcttcttgggctgagtgcagcca

SEQ ID NO: 6891522 - DNA, 13 bp, Homo sapiens
ctgattggctgct

SEQ ID NO: 6891523 - DNA, 18 bp, Homo sapiens
actgcctccctctcttcc

SEQ ID NO: 6891524 - DNA, 20 bp, Homo sapiens
ctccctccccgtctcattcc

SEQ ID NO: 6891525 - DNA, 17 bp, Homo sapiens
gtgcagtgtgcctgtca

SEQ ID NO: 6891526 - DNA, 13 bp, Homo sapiens
tcatattgatgaa

SEQ ID NO: 6891527 - DNA, 21 bp, Homo sapiens
tatatttattcataatgaatt

SEQ ID NO: 6891528 - DNA, 20 bp, Homo sapiens
cgcctggcacatttcaggga

SEQ ID NO: 6891529 - DNA, 16 bp, Homo sapiens
tgtaaaatattatgtt

SEQ ID NO: 6891530 - DNA, 14 bp, Homo sapiens
gcttcctctgctgc

SEQ ID NO: 6891531 - DNA, 15 bp, Homo sapiens
cactgtcatctgcca

SEQ ID NO: 6891532 - DNA, 16 bp, Homo sapiens
agcccttgtgtgtgcc

SEQ ID NO: 6891533 - DNA, 16 bp, Homo sapiens
aggatcggcttcctca

SEQ ID NO: 6891534 - DNA, 17 bp, Homo sapiens
ccgcagcaccagcctga

SEQ ID NO: 6891535 - DNA, 18 bp, Homo sapiens
cccgtggctttgtgctta

SEQ ID NO: 6891536 - DNA, 13 bp, Homo sapiens
tccgccagccaca

SEQ ID NO: 6891537 - DNA, 16 bp, Homo sapiens
acattgccctgagggg

SEQ ID NO: 6891538 - DNA, 21 bp, Homo sapiens
agactctaccagactgtgtat

SEQ ID NO: 6891539 - DNA, 20 bp, Homo sapiens
ctcaggaccctcgctggccc

SEQ ID NO: 6891540 - DNA, 23 bp, Homo sapiens
tgaagcatgctttgctgctatga

SEQ ID NO: 6891541 - DNA, 15 bp, Homo sapiens
tactttgtgtctttt

SEQ ID NO: 6891542 - DNA, 19 bp, Homo sapiens
tcttgcacagtcactgctc

SEQ ID NO: 6891543 - DNA, 22 bp, Homo sapiens
caccatgggaggtggggcctca

SEQ ID NO: 6891544 - DNA, 17 bp, Homo sapiens
aaaccccctttgtgctg

SEQ ID NO: 6891545 - DNA, 18 bp, Homo sapiens
tctttgattatttgcatg

SEQ ID NO: 6891546 - DNA, 20 bp, Homo sapiens
tacacacacacacacagcca

SEQ ID NO: 6891547 - DNA, 15 bp, Homo sapiens
aagagcatcatgcct

SEQ ID NO: 6891548 - DNA, 18 bp, Homo sapiens
ctcagaacttgctgctgt

SEQ ID NO: 6891549 - DNA, 21 bp, Homo sapiens
ccctcctgctcctccctgccc

SEQ ID NO: 6891550 - DNA, 22 bp, Homo sapiens
agctcctctccccagcccagag

SEQ ID NO: 6891551 - DNA, 17 bp, Homo sapiens
tcacactggtttggtca

SEQ ID NO: 6891552 - DNA, 17 bp, Homo sapiens
aaccatgggctcagggc

SEQ ID NO: 6891553 - DNA, 13 bp, Homo sapiens
cctccgccctgcc

SEQ ID NO: 6891554 - DNA, 18 bp, Homo sapiens
ccttctcattacccaccc

SEQ ID NO: 6891555 - DNA, 20 bp, Homo sapiens
gctgcaaggtggcctctgcc

SEQ ID NO: 6891556 - DNA, 14 bp, Homo sapiens
gcactgctgcctca

SEQ ID NO: 6891557 - DNA, 21 bp, Homo sapiens
atcagttacacatgatcataa

SEQ ID NO: 6891558 - DNA, 14 bp, Homo sapiens
ccagcttgtttaca

SEQ ID NO: 6891559 - DNA, 16 bp, Homo sapiens
gccttaatttgcacag

SEQ ID NO: 6891560 - DNA, 16 bp, Homo sapiens
tgtggctcacgtgtgt

SEQ ID NO: 6891561 - DNA, 14 bp, Homo sapiens
ctgctagctgtaga

SEQ ID NO: 6891562 - DNA, 15 bp, Homo sapiens
agggccagagccagg

SEQ ID NO: 6891563 - DNA, 13 bp, Homo sapiens
cactctgtgccca

SEQ ID NO: 6891564 - DNA, 21 bp, Homo sapiens
gactctttttgtacctggtga

SEQ ID NO: 6891565 - DNA, 14 bp, Homo sapiens
gtgaggctgctgcc

SEQ ID NO: 6891566 - DNA, 23 bp, Homo sapiens
gccagcgaggcgaggctgcctct

SEQ ID NO: 6891567 - DNA, 21 bp, Homo sapiens
catttgcttaaacctggaaca

SEQ ID NO: 6891568 - DNA, 15 bp, Homo sapiens
cctcccttccctccc

SEQ ID NO: 6891569 - DNA, 16 bp, Homo sapiens
tggccatgaccctgcc

SEQ ID NO: 6891570 - DNA, 22 bp, Homo sapiens
ctcacggctgcacctgcaggga

SEQ ID NO: 6891571 - DNA, 13 bp, Homo sapiens
tcatctgtttgta

SEQ ID NO: 6891572 - DNA, 19 bp, Homo sapiens
cactttcctgttgcactga

SEQ ID NO: 6891573 - DNA, 14 bp, Homo sapiens
ccagagctgcttct

SEQ ID NO: 6891574 - DNA, 18 bp, Homo sapiens
cacctgccagccatcaca

SEQ ID NO: 6891575 - DNA, 23 bp, Homo sapiens
tgtgtcccaaaatcccctcagcc

SEQ ID NO: 6891576 - DNA, 12 bp, Homo sapiens
aaaagacattta

SEQ ID NO: 6891577 - DNA, 13 bp, Homo sapiens
cacattctgcctt

SEQ ID NO: 6891578 - DNA, 17 bp, Homo sapiens
agattctgggtttgccc

SEQ ID NO: 6891579 - DNA, 17 bp, Homo sapiens
tgccagctgcttctgcc

SEQ ID NO: 6891580 - DNA, 23 bp, Homo sapiens
ggtttttgtatccagagctgttt

SEQ ID NO: 6891581 - DNA, 17 bp, Homo sapiens
atttggcttcctctgct

SEQ ID NO: 6891582 - DNA, 23 bp, Homo sapiens
cctctcggttgaaacctgtataa

SEQ ID NO: 6891583 - DNA, 13 bp, Homo sapiens
cctgcctgaggag

SEQ ID NO: 6891584 - DNA, 18 bp, Homo sapiens
gtatgagaagtactttgt

SEQ ID NO: 6891585 - DNA, 13 bp, Homo sapiens
atgcttccttgcc

SEQ ID NO: 6891586 - DNA, 16 bp, Homo sapiens
agtcacaatgttcttt

SEQ ID NO: 6891587 - DNA, 17 bp, Homo sapiens
taatttattgtctttat

SEQ ID NO: 6891588 - DNA, 17 bp, Homo sapiens
catttaggggccacttt

SEQ ID NO: 6891589 - DNA, 14 bp, Homo sapiens
cctcgctgctgcta

SEQ ID NO: 6891590 - DNA, 18 bp, Homo sapiens
cagagaccgtcctcaccc

SEQ ID NO: 6891591 - DNA, 20 bp, Homo sapiens
cactggactgggttttgtct

SEQ ID NO: 6891592 - DNA, 15 bp, Homo sapiens
aatactagctaacta

SEQ ID NO: 6891593 - DNA, 12 bp, Homo sapiens
aagacattttca

SEQ ID NO: 6891594 - DNA, 14 bp, Homo sapiens
ctgtccctgtccct

SEQ ID NO: 6891595 - DNA, 13 bp, Homo sapiens
ggggcactgtggt

SEQ ID NO: 6891596 - DNA, 19 bp, Homo sapiens
tgatccgcccacctcagcc

SEQ ID NO: 6891597 - DNA, 22 bp, Homo sapiens
cttcctgtcccacctcttctct

SEQ ID NO: 6891598 - DNA, 17 bp, Homo sapiens
gaacagtttatgcagtg

SEQ ID NO: 6891599 - DNA, 14 bp, Homo sapiens
taatttatgagttt

SEQ ID NO: 6891600 - DNA, 14 bp, Homo sapiens
taaattatgagatt

SEQ ID NO: 6891601 - DNA, 17 bp, Homo sapiens
cattaaaggtactttgc

SEQ ID NO: 6891602 - DNA, 23 bp, Homo sapiens
aatcagaaaagtaattttgtcac

SEQ ID NO: 6891603 - DNA, 16 bp, Homo sapiens
tcctacccacacctct

SEQ ID NO: 6891604 - DNA, 16 bp, Homo sapiens
agatgctactgtcagt

SEQ ID NO: 6891605 - DNA, 16 bp, Homo sapiens
ccactttgtctgtaca

SEQ ID NO: 6891606 - DNA, 18 bp, Homo sapiens
gccagcccccccacccac

SEQ ID NO: 6891607 - DNA, 19 bp, Homo sapiens
atgtcagactttgctgcat

SEQ ID NO: 6891608 - DNA, 19 bp, Homo sapiens
ccattgtccctctgcccca

SEQ ID NO: 6891609 - DNA, 16 bp, Homo sapiens
ttcactataatgtgaa

SEQ ID NO: 6891610 - DNA, 21 bp, Homo sapiens
ctttattgaattagaaaatta

SEQ ID NO: 6891611 - DNA, 16 bp, Homo sapiens
ctgctcttctctcccc

SEQ ID NO: 6891612 - DNA, 19 bp, Homo sapiens
ccctcctccaggcctgcct

SEQ ID NO: 6891613 - DNA, 14 bp, Homo sapiens
ctagtggctgtcca

SEQ ID NO: 6891614 - DNA, 17 bp, Homo sapiens
ccgtctgaccccagccc

SEQ ID NO: 6891615 - DNA, 21 bp, Homo sapiens
agaccaaggcagggcccagca

SEQ ID NO: 6891616 - DNA, 21 bp, Homo sapiens
atcacagcctcacccctgccc

SEQ ID NO: 6891617 - DNA, 16 bp, Homo sapiens
cctcgccgtccctccc

SEQ ID NO: 6891618 - DNA, 16 bp, Homo sapiens
agtcttgacctctcca

SEQ ID NO: 6891619 - DNA, 14 bp, Homo sapiens
tgctcacctctgcc

SEQ ID NO: 6891620 - DNA, 16 bp, Homo sapiens
caatcttactttgtaa

SEQ ID NO: 6891621 - DNA, 22 bp, Homo sapiens
cttcctccttttctttctctct

SEQ ID NO: 6891622 - DNA, 12 bp, Homo sapiens
gtggactttatt

SEQ ID NO: 6891623 - DNA, 18 bp, Homo sapiens
acgtgcaccaaactgcct

SEQ ID NO: 6891624 - DNA, 16 bp, Homo sapiens
ccctcttccagcttct

SEQ ID NO: 6891625 - DNA, 20 bp, Homo sapiens
taccactcgtgcatccctga

SEQ ID NO: 6891626 - DNA, 14 bp, Homo sapiens
aggctccctcctgt

SEQ ID NO: 6891627 - DNA, 15 bp, Homo sapiens
cacaactcagtctgt

SEQ ID NO: 6891628 - DNA, 12 bp, Homo sapiens
cctcactcctgt

SEQ ID NO: 6891629 - DNA, 22 bp, Homo sapiens
tggccatgccaccctgttttca

SEQ ID NO: 6891630 - DNA, 17 bp, Homo sapiens
cttccactaccctccct

SEQ ID NO: 6891631 - DNA, 15 bp, Homo sapiens
cgttcctcctcagcc

SEQ ID NO: 6891632 - DNA, 16 bp, Homo sapiens
ctcgggaagcagccag

SEQ ID NO: 6891633 - DNA, 21 bp, Homo sapiens
ctggcaggagcctcgtgtcct

SEQ ID NO: 6891634 - DNA, 12 bp, Homo sapiens
tcagccctgtgt

SEQ ID NO: 6891635 - DNA, 13 bp, Homo sapiens
ccagccagctcct

SEQ ID NO: 6891636 - DNA, 15 bp, Homo sapiens
ttgcagctgttttca

SEQ ID NO: 6891637 - DNA, 23 bp, Homo sapiens
atttgctctgtggtaagagatat

SEQ ID NO: 6891638 - DNA, 17 bp, Homo sapiens
tcacctgcttctctgcc

SEQ ID NO: 6891639 - DNA, 13 bp, Homo sapiens
attgaatactgtc

SEQ ID NO: 6891640 - DNA, 20 bp, Homo sapiens
ccctggggatagtccttcct

SEQ ID NO: 6891641 - DNA, 18 bp, Homo sapiens
agcccccagggcctccag

SEQ ID NO: 6891642 - DNA, 14 bp, Homo sapiens
ctccagcctctgcc

SEQ ID NO: 6891643 - DNA, 17 bp, Homo sapiens
gagggcatccataccag

SEQ ID NO: 6891644 - DNA, 17 bp, Homo sapiens
ctcagctgcacattcct

SEQ ID NO: 6891645 - DNA, 21 bp, Homo sapiens
cttgtaggtatgtctgtgcca

SEQ ID NO: 6891646 - DNA, 18 bp, Homo sapiens
taccaatagcctgaattt

SEQ ID NO: 6891647 - DNA, 14 bp, Homo sapiens
cttcccctgggatg

SEQ ID NO: 6891648 - DNA, 13 bp, Homo sapiens
acccctctctgca

SEQ ID NO: 6891649 - DNA, 16 bp, Homo sapiens
tctccaggggtttaca

SEQ ID NO: 6891650 - DNA, 16 bp, Homo sapiens
tgaattttcacatgaa

SEQ ID NO: 6891651 - DNA, 23 bp, Homo sapiens
gccatagagcccctcctggttga

SEQ ID NO: 6891652 - DNA, 15 bp, Homo sapiens
acctgcccatcacag

SEQ ID NO: 6891653 - DNA, 18 bp, Homo sapiens
ctcatcattctctgtctc

SEQ ID NO: 6891654 - DNA, 14 bp, Homo sapiens
ccctagctcttccc

SEQ ID NO: 6891655 - DNA, 22 bp, Homo sapiens
acatctgccttgctgcacctga

SEQ ID NO: 6891656 - DNA, 19 bp, Homo sapiens
cctctcccccccccctcca

SEQ ID NO: 6891657 - DNA, 21 bp, Homo sapiens
gactacattttgctctgtgaa

SEQ ID NO: 6891658 - DNA, 17 bp, Homo sapiens
gccatagaggcccaggc

SEQ ID NO: 6891659 - DNA, 23 bp, Homo sapiens
agcatcaggccaggccctctgcc

SEQ ID NO: 6891660 - DNA, 21 bp, Homo sapiens
gctcccctgcccagcctgctc

SEQ ID NO: 6891661 - DNA, 21 bp, Homo sapiens
ataaaatgtctcgagtcctaa

SEQ ID NO: 6891662 - DNA, 16 bp, Homo sapiens
acctgctccagatcct

SEQ ID NO: 6891663 - DNA, 18 bp, Homo sapiens
aatctatattaaagtgtt

SEQ ID NO: 6891664 - DNA, 16 bp, Homo sapiens
tgagttttctatttca

SEQ ID NO: 6891665 - DNA, 16 bp, Homo sapiens
cctgccctgccttgcc

SEQ ID NO: 6891666 - DNA, 19 bp, Homo sapiens
ccttccctctctccctgcc

SEQ ID NO: 6891667 - DNA, 16 bp, Homo sapiens
cagcccttgggcagtt

SEQ ID NO: 6891668 - DNA, 22 bp, Homo sapiens
tctaccccacctgacctctgca

SEQ ID NO: 6891669 - DNA, 13 bp, Homo sapiens
ccttgaccttcct

SEQ ID NO: 6891670 - DNA, 15 bp, Homo sapiens
cccaagctctgctcc

SEQ ID NO: 6891671 - DNA, 15 bp, Homo sapiens
ccacaggcccttcct

SEQ ID NO: 6891672 - DNA, 16 bp, Homo sapiens
tttccaaaacatttct

SEQ ID NO: 6891673 - DNA, 18 bp, Homo sapiens
aatcaaaaggtaatgcac

SEQ ID NO: 6891674 - DNA, 16 bp, Homo sapiens
cactcagccactgtca

SEQ ID NO: 6891675 - DNA, 18 bp, Homo sapiens
caggattcaggcctctga

SEQ ID NO: 6891676 - DNA, 12 bp, Homo sapiens
ccatcagctccc

SEQ ID NO: 6891677 - DNA, 19 bp, Homo sapiens
ttcccaggagttctgctca

SEQ ID NO: 6891678 - DNA, 21 bp, Homo sapiens
tggcccttacacactcaggcc

SEQ ID NO: 6891679 - DNA, 16 bp, Homo sapiens
tctctgacaaagtgtg

SEQ ID NO: 6891680 - DNA, 12 bp, Homo sapiens
cgctcctctgcc

SEQ ID NO: 6891681 - DNA, 13 bp, Homo sapiens
taatttgcactga

SEQ ID NO: 6891682 - DNA, 14 bp, Homo sapiens
acagtcacattcga

SEQ ID NO: 6891683 - DNA, 17 bp, Homo sapiens
ccagttaatgtgccaaa

SEQ ID NO: 6891684 - DNA, 17 bp, Homo sapiens
taagggaagacatttct

SEQ ID NO: 6891685 - DNA, 19 bp, Homo sapiens
ctctgtctttttccttcct

SEQ ID NO: 6891686 - DNA, 15 bp, Homo sapiens
tgttcttcctcagcc

SEQ ID NO: 6891687 - DNA, 12 bp, Homo sapiens
ctgtctccctcc

SEQ ID NO: 6891688 - DNA, 19 bp, Homo sapiens
gaaccttttgagtgcctta

SEQ ID NO: 6891689 - DNA, 13 bp, Homo sapiens
atcccctgcctct

SEQ ID NO: 6891690 - DNA, 15 bp, Homo sapiens
caagcccctcagccc

SEQ ID NO: 6891691 - DNA, 16 bp, Homo sapiens
attaaatgcccagccc

SEQ ID NO: 6891692 - DNA, 20 bp, Homo sapiens
aacaccttggggtccctcca

SEQ ID NO: 6891693 - DNA, 15 bp, Homo sapiens
aagatctcggtgctg

SEQ ID NO: 6891694 - DNA, 22 bp, Homo sapiens
caggaggaggattgtgctgatg

SEQ ID NO: 6891695 - DNA, 19 bp, Homo sapiens
tcttctccacgtctttcct

SEQ ID NO: 6891696 - DNA, 14 bp, Homo sapiens
ctatttgtacaatt

SEQ ID NO: 6891697 - DNA, 17 bp, Homo sapiens
ccttgacctttgtacag

SEQ ID NO: 6891698 - DNA, 23 bp, Homo sapiens
gtgctttgctggagtcctgttct

SEQ ID NO: 6891699 - DNA, 18 bp, Homo sapiens
cttccaggtgcctggccc

SEQ ID NO: 6891700 - DNA, 24 bp, Homo sapiens
aagtccctgagaagcctcatggga

SEQ ID NO: 6891701 - DNA, 17 bp, Homo sapiens
agtttgaagcctgtgcc

SEQ ID NO: 6891702 - DNA, 16 bp, Homo sapiens
ctgtccacgtggagag

SEQ ID NO: 6891703 - DNA, 16 bp, Homo sapiens
ccttacctcccctgcc

SEQ ID NO: 6891704 - DNA, 13 bp, Homo sapiens
cctgtccccaccc

SEQ ID NO: 6891705 - DNA, 14 bp, Homo sapiens
cttctcctgcgccc

SEQ ID NO: 6891706 - DNA, 14 bp, Homo sapiens
cgttttctcttcac

SEQ ID NO: 6891707 - DNA, 16 bp, Homo sapiens
gactctttgctgttga

SEQ ID NO: 6891708 - DNA, 21 bp, Homo sapiens
caaaaaccaaaagtgcattca

SEQ ID NO: 6891709 - DNA, 19 bp, Homo sapiens
cgtctgtggctttcagcct

SEQ ID NO: 6891710 - DNA, 20 bp, Homo sapiens
tccaggcctctctctgctcc

SEQ ID NO: 6891711 - DNA, 20 bp, Homo sapiens
gctagtgtgagtggcagcca

SEQ ID NO: 6891712 - DNA, 18 bp, Homo sapiens
agtttacattgtcctgta

SEQ ID NO: 6891713 - DNA, 20 bp, Homo sapiens
gagactccagaatctgctgt

SEQ ID NO: 6891714 - DNA, 15 bp, Homo sapiens
cttcagcctccctca

SEQ ID NO: 6891715 - DNA, 19 bp, Homo sapiens
gcacttaagtcttccttaa

SEQ ID NO: 6891716 - DNA, 14 bp, Homo sapiens
ccatcccttcccca

SEQ ID NO: 6891717 - DNA, 13 bp, Homo sapiens
cattctctctgcc

SEQ ID NO: 6891718 - DNA, 14 bp, Homo sapiens
agacccctgtctcc

SEQ ID NO: 6891719 - DNA, 21 bp, Homo sapiens
aatataaatcacagatttcca

SEQ ID NO: 6891720 - DNA, 21 bp, Homo sapiens
aagctaggatggttctgtgac

SEQ ID NO: 6891721 - DNA, 21 bp, Homo sapiens
agttccttatccctctcttcc

SEQ ID NO: 6891722 - DNA, 20 bp, Homo sapiens
ggtcccccagagcatctgcc

SEQ ID NO: 6891723 - DNA, 18 bp, Homo sapiens
ccaggcatggcccagcct

SEQ ID NO: 6891724 - DNA, 15 bp, Homo sapiens
cctgggaggtggagg

SEQ ID NO: 6891725 - DNA, 14 bp, Homo sapiens
cagactggcaataa

SEQ ID NO: 6891726 - DNA, 17 bp, Homo sapiens
gctgcccttcgctgcca

SEQ ID NO: 6891727 - DNA, 18 bp, Homo sapiens
ccctctcccttccctcct

SEQ ID NO: 6891728 - DNA, 23 bp, Homo sapiens
cacattgcattctattgccttct

SEQ ID NO: 6891729 - DNA, 22 bp, Homo sapiens
cataacagtgccattgtcttta

SEQ ID NO: 6891730 - DNA, 19 bp, Homo sapiens
tatattttctatatttgta

SEQ ID NO: 6891731 - DNA, 14 bp, Homo sapiens
accatcctgagcca

SEQ ID NO: 6891732 - DNA, 18 bp, Homo sapiens
tccaggggctcctgggtt

SEQ ID NO: 6891733 - DNA, 19 bp, Homo sapiens
atctctgagtgtctctgcc

SEQ ID NO: 6891734 - DNA, 21 bp, Homo sapiens
ctccagcctctgccgctgcca

SEQ ID NO: 6891735 - DNA, 21 bp, Homo sapiens
cacacacaaacctactgccca

SEQ ID NO: 6891736 - DNA, 15 bp, Homo sapiens
ccttgtaccccatcc

SEQ ID NO: 6891737 - DNA, 15 bp, Homo sapiens
tccagacctgggccc

SEQ ID NO: 6891738 - DNA, 14 bp, Homo sapiens
ctacctgctggaca

SEQ ID NO: 6891739 - DNA, 21 bp, Homo sapiens
ctgagcttgtcttttctgctg

SEQ ID NO: 6891740 - DNA, 17 bp, Homo sapiens
caccctcctgtcttccc

SEQ ID NO: 6891741 - DNA, 18 bp, Homo sapiens
gctgggagaaaagccaga

SEQ ID NO: 6891742 - DNA, 23 bp, Homo sapiens
ccattgcaaaaggttaagccata

SEQ ID NO: 6891743 - DNA, 18 bp, Homo sapiens
tcagcgggagtctcctca

SEQ ID NO: 6891744 - DNA, 17 bp, Homo sapiens
gctctggctctgcctca

SEQ ID NO: 6891745 - DNA, 21 bp, Homo sapiens
aacttttgtaagacaaaggtt

SEQ ID NO: 6891746 - DNA, 22 bp, Homo sapiens
cagtgagtcgagattgcactgc

SEQ ID NO: 6891747 - DNA, 17 bp, Homo sapiens
cctttaaatgtaaaata

SEQ ID NO: 6891748 - DNA, 20 bp, Homo sapiens
caaagtggtaaatactgtga

SEQ ID NO: 6891749 - DNA, 14 bp, Homo sapiens
ttcaatgtgtttaa

SEQ ID NO: 6891750 - DNA, 23 bp, Homo sapiens
agcaacttcatcccagctgctga

SEQ ID NO: 6891751 - DNA, 13 bp, Homo sapiens
ctttctcctgccc

SEQ ID NO: 6891752 - DNA, 21 bp, Homo sapiens
ccaaaccttactctgagctca

SEQ ID NO: 6891753 - DNA, 18 bp, Homo sapiens
cttgggctctgctgagtc

SEQ ID NO: 6891754 - DNA, 18 bp, Homo sapiens
actttgaactgaaacttt

SEQ ID NO: 6891755 - DNA, 16 bp, Homo sapiens
cttggcccctctctgt

SEQ ID NO: 6891756 - DNA, 18 bp, Homo sapiens
ctagtccgtcctggcaca

SEQ ID NO: 6891757 - DNA, 23 bp, Homo sapiens
tgccctagcagtttgcctctgca

SEQ ID NO: 6891758 - DNA, 14 bp, Homo sapiens
tgttacccactgcc

SEQ ID NO: 6891759 - DNA, 20 bp, Homo sapiens
gtttctgatctgtactttgt

SEQ ID NO: 6891760 - DNA, 17 bp, Homo sapiens
ctctctgtgtccctgct

SEQ ID NO: 6891761 - DNA, 20 bp, Homo sapiens
atggtctctctccctctgtc

SEQ ID NO: 6891762 - DNA, 22 bp, Homo sapiens
cacattgaatagtggaacattt

SEQ ID NO: 6891763 - DNA, 12 bp, Homo sapiens
ctacctccctcc

SEQ ID NO: 6891764 - DNA, 22 bp, Homo sapiens
gtaagtcttttttttttccaaa

SEQ ID NO: 6891765 - DNA, 22 bp, Homo sapiens
actggccagtcctagagctcct

SEQ ID NO: 6891766 - DNA, 17 bp, Homo sapiens
cttggagaatactgcca

SEQ ID NO: 6891767 - DNA, 16 bp, Homo sapiens
cgctgcagcctctgcc

SEQ ID NO: 6891768 - DNA, 19 bp, Homo sapiens
cagtaccagtgagtggccc

SEQ ID NO: 6891769 - DNA, 22 bp, Homo sapiens
ctagaaagaaaagaccctgaga

SEQ ID NO: 6891770 - DNA, 16 bp, Homo sapiens
agtgagctaccaggaa

SEQ ID NO: 6891771 - DNA, 16 bp, Homo sapiens
cccagcccaccctgct

SEQ ID NO: 6891772 - DNA, 16 bp, Homo sapiens
ctgcctggtcctccct

SEQ ID NO: 6891773 - DNA, 20 bp, Homo sapiens
aagtcaggctagctgtgctg

SEQ ID NO: 6891774 - DNA, 21 bp, Homo sapiens
ccagacagtcgctcagtctgt

SEQ ID NO: 6891775 - DNA, 23 bp, Homo sapiens
ctggtctcgaactcctgacctca

SEQ ID NO: 6891776 - DNA, 16 bp, Homo sapiens
gaatgtgaagccttcc

SEQ ID NO: 6891777 - DNA, 18 bp, Homo sapiens
cagggtatggactatctg

SEQ ID NO: 6891778 - DNA, 14 bp, Homo sapiens
tgattcagtatctt

SEQ ID NO: 6891779 - DNA, 20 bp, Homo sapiens
ggtcccttgagacctcagcc

SEQ ID NO: 6891780 - DNA, 13 bp, Homo sapiens
ctgtgccccttcc

SEQ ID NO: 6891781 - DNA, 12 bp, Homo sapiens
aatgtctggagt

SEQ ID NO: 6891782 - DNA, 12 bp, Homo sapiens
ctgcctgcagta

SEQ ID NO: 6891783 - DNA, 16 bp, Homo sapiens
tctacacatacatgta

SEQ ID NO: 6891784 - DNA, 19 bp, Homo sapiens
gctaatgtaaactttgtca

SEQ ID NO: 6891785 - DNA, 22 bp, Homo sapiens
tgaccccaagggggctgctgct

SEQ ID NO: 6891786 - DNA, 22 bp, Homo sapiens
ccttgtggtctttgctgctgct

SEQ ID NO: 6891787 - DNA, 17 bp, Homo sapiens
aagtgcctttctgcagt

SEQ ID NO: 6891788 - DNA, 22 bp, Homo sapiens
caaaactgaccttgactactca

SEQ ID NO: 6891789 - DNA, 15 bp, Homo sapiens
cccagatcgtctcca

SEQ ID NO: 6891790 - DNA, 17 bp, Homo sapiens
ctcttctaacctcagcc

SEQ ID NO: 6891791 - DNA, 16 bp, Homo sapiens
aattattgacactgaa

SEQ ID NO: 6891792 - DNA, 22 bp, Homo sapiens
gttgacctaagatttattttgt

SEQ ID NO: 6891793 - DNA, 14 bp, Homo sapiens
ttgtcacttttcct

SEQ ID NO: 6891794 - DNA, 16 bp, Homo sapiens
atgctggccctacagt

SEQ ID NO: 6891795 - DNA, 15 bp, Homo sapiens
ctttacgcccatctc

SEQ ID NO: 6891796 - DNA, 17 bp, Homo sapiens
cagttctcgtgccctta

SEQ ID NO: 6891797 - DNA, 18 bp, Homo sapiens
caatcctcaggatttcat

SEQ ID NO: 6891798 - DNA, 13 bp, Homo sapiens
ccagcctcagccc

SEQ ID NO: 6891799 - DNA, 13 bp, Homo sapiens
tcctgtcctgcct

SEQ ID NO: 6891800 - DNA, 21 bp, Homo sapiens
tcactattcttaagcactttg

SEQ ID NO: 6891801 - DNA, 21 bp, Homo sapiens
ccgtgctgacagctgctccta

SEQ ID NO: 6891802 - DNA, 21 bp, Homo sapiens
cacacaaaaagtgtctctgcc

SEQ ID NO: 6891803 - DNA, 22 bp, Homo sapiens
gcagctttttattccctgccca

SEQ ID NO: 6891804 - DNA, 15 bp, Homo sapiens
gtgacttctgctgct

SEQ ID NO: 6891805 - DNA, 19 bp, Homo sapiens
cctttcttccggcccctcc

SEQ ID NO: 6891806 - DNA, 14 bp, Homo sapiens
ctcctggactgcct

SEQ ID NO: 6891807 - DNA, 14 bp, Homo sapiens
tggcttcctctgct

SEQ ID NO: 6891808 - DNA, 19 bp, Homo sapiens
tggggccgcctgccctgcc

SEQ ID NO: 6891809 - DNA, 18 bp, Homo sapiens
tcactgccaggccagcct

SEQ ID NO: 6891810 - DNA, 12 bp, Homo sapiens
catactcagcct

SEQ ID NO: 6891811 - DNA, 15 bp, Homo sapiens
ccctcgccccagcct

SEQ ID NO: 6891812 - DNA, 16 bp, Homo sapiens
tataattttatctgta

SEQ ID NO: 6891813 - DNA, 13 bp, Homo sapiens
ctcggctgtctcc

SEQ ID NO: 6891814 - DNA, 21 bp, Homo sapiens
tggtgccagccttcctctgca

SEQ ID NO: 6891815 - DNA, 15 bp, Homo sapiens
agtcctttgtgaata

SEQ ID NO: 6891816 - DNA, 22 bp, Homo sapiens
tataaatgaagtattatctgta

SEQ ID NO: 6891817 - DNA, 18 bp, Homo sapiens
aagattagaagctgaaaa

SEQ ID NO: 6891818 - DNA, 20 bp, Homo sapiens
agcctctgtccctctttgcc

SEQ ID NO: 6891819 - DNA, 14 bp, Homo sapiens
cagactttctgtga

SEQ ID NO: 6891820 - DNA, 20 bp, Homo sapiens
ttcctgttggatttgtttaa

SEQ ID NO: 6891821 - DNA, 23 bp, Homo sapiens
tttcatccaaaatattttttgca

SEQ ID NO: 6891822 - DNA, 17 bp, Homo sapiens
gccggccttgttttatt

SEQ ID NO: 6891823 - DNA, 14 bp, Homo sapiens
aatgattatattca

SEQ ID NO: 6891824 - DNA, 11 bp, Homo sapiens
actctgcctct

SEQ ID NO: 6891825 - DNA, 22 bp, Homo sapiens
ccatcgccccaccgcagctact

SEQ ID NO: 6891826 - DNA, 12 bp, Homo sapiens
ctccctacctca

SEQ ID NO: 6891827 - DNA, 17 bp, Homo sapiens
tgttttcacttgtattg

SEQ ID NO: 6891828 - DNA, 18 bp, Homo sapiens
cctcatatcccatcctta

SEQ ID NO: 6891829 - DNA, 14 bp, Homo sapiens
cttattctcctccc

SEQ ID NO: 6891830 - DNA, 17 bp, Homo sapiens
tcagcagctctgagaca

SEQ ID NO: 6891831 - DNA, 20 bp, Homo sapiens
cactctcccctccctcttcc

SEQ ID NO: 6891832 - DNA, 13 bp, Homo sapiens
ctgtgctccctcg

SEQ ID NO: 6891833 - DNA, 17 bp, Homo sapiens
agagaaaattgcactaa

SEQ ID NO: 6891834 - DNA, 12 bp, Homo sapiens
aaacctgtgaag

SEQ ID NO: 6891835 - DNA, 21 bp, Homo sapiens
ctcctgccctctgctctgcct

SEQ ID NO: 6891836 - DNA, 23 bp, Homo sapiens
caatgtgtgccgagcccttgccc

SEQ ID NO: 6891837 - DNA, 14 bp, Homo sapiens
tatgttcctgctgt

SEQ ID NO: 6891838 - DNA, 16 bp, Homo sapiens
acctaaggcaacattt

SEQ ID NO: 6891839 - DNA, 14 bp, Homo sapiens
cccttggctggatc

SEQ ID NO: 6891840 - DNA, 22 bp, Homo sapiens
ctaccgcatggcagctgggccc

SEQ ID NO: 6891841 - DNA, 19 bp, Homo sapiens
agctctagacaaccctgca

SEQ ID NO: 6891842 - DNA, 13 bp, Homo sapiens
cacctcctctcac

SEQ ID NO: 6891843 - DNA, 16 bp, Homo sapiens
ctctacaccctctgcc

SEQ ID NO: 6891844 - DNA, 15 bp, Homo sapiens
tcacagggcagagcc

SEQ ID NO: 6891845 - DNA, 17 bp, Homo sapiens
taaataatttgcactga

SEQ ID NO: 6891846 - DNA, 15 bp, Homo sapiens
cacccttgaaaatat

SEQ ID NO: 6891847 - DNA, 20 bp, Homo sapiens
agcacccagcaactccaact

SEQ ID NO: 6891848 - DNA, 23 bp, Homo sapiens
ttagccaactgtttccctgctga

SEQ ID NO: 6891849 - DNA, 11 bp, Homo sapiens
aacaatgcaac

SEQ ID NO: 6891850 - DNA, 12 bp, Homo sapiens
aatgcctctccc

SEQ ID NO: 6891851 - DNA, 16 bp, Homo sapiens
agacctggcctctgcc

SEQ ID NO: 6891852 - DNA, 19 bp, Homo sapiens
gccaactatggcctgtgga

SEQ ID NO: 6891853 - DNA, 17 bp, Homo sapiens
ttgggagacatgtgaca

SEQ ID NO: 6891854 - DNA, 12 bp, Homo sapiens
ttttgttgtatg

SEQ ID NO: 6891855 - DNA, 12 bp, Homo sapiens
cccacatctttc

SEQ ID NO: 6891856 - DNA, 15 bp, Homo sapiens
caggtgagtgccacc

SEQ ID NO: 6891857 - DNA, 19 bp, Homo sapiens
ccctgcctgtggcccctcc

SEQ ID NO: 6891858 - DNA, 16 bp, Homo sapiens
aatttcattgcacttt

SEQ ID NO: 6891859 - DNA, 19 bp, Homo sapiens
tggcttggcatctgtgtgc

SEQ ID NO: 6891860 - DNA, 21 bp, Homo sapiens
cacatgtacataaactgtcac

SEQ ID NO: 6891861 - DNA, 23 bp, Homo sapiens
cgctccaccagcatcacctgcct

SEQ ID NO: 6891862 - DNA, 18 bp, Homo sapiens
tagccaggagtctgtgct

SEQ ID NO: 6891863 - DNA, 11 bp, Homo sapiens
tttacatttca

SEQ ID NO: 6891864 - DNA, 19 bp, Homo sapiens
cacaagcaaaccttctcag

SEQ ID NO: 6891865 - DNA, 19 bp, Homo sapiens
cttgtcctgccagctgcct

SEQ ID NO: 6891866 - DNA, 13 bp, Homo sapiens
cctccctacctca

SEQ ID NO: 6891867 - DNA, 13 bp, Homo sapiens
cccttgcagggtg

SEQ ID NO: 6891868 - DNA, 15 bp, Homo sapiens
tccaatatcatgtct

SEQ ID NO: 6891869 - DNA, 22 bp, Homo sapiens
cagaactgaagccacttggccc

SEQ ID NO: 6891870 - DNA, 11 bp, Homo sapiens
ctcctgcctca

SEQ ID NO: 6891871 - DNA, 20 bp, Homo sapiens
cactacctttgtccaggcct

SEQ ID NO: 6891872 - DNA, 22 bp, Homo sapiens
caaatgctgtgcaaacagtgta

SEQ ID NO: 6891873 - DNA, 19 bp, Homo sapiens
cgagcttagattctgtatg

SEQ ID NO: 6891874 - DNA, 19 bp, Homo sapiens
taaaaggcaaatgtgtaca

SEQ ID NO: 6891875 - DNA, 18 bp, Homo sapiens
agtgtcatttctcatcca

SEQ ID NO: 6891876 - DNA, 19 bp, Homo sapiens
taatcatgagcctgtttat

SEQ ID NO: 6891877 - DNA, 13 bp, Homo sapiens
cctctcttcccta

SEQ ID NO: 6891878 - DNA, 15 bp, Homo sapiens
ctggaagcaggtgct

SEQ ID NO: 6891879 - DNA, 14 bp, Homo sapiens
cagcctctctgcta

SEQ ID NO: 6891880 - DNA, 18 bp, Homo sapiens
taaggggcagcagttgag

SEQ ID NO: 6891881 - DNA, 18 bp, Homo sapiens
gtgcaacctgtggctcag

SEQ ID NO: 6891882 - DNA, 19 bp, Homo sapiens
tcattttaaaaactttatt

SEQ ID NO: 6891883 - DNA, 17 bp, Homo sapiens
gccgaaggtgcctcaga

SEQ ID NO: 6891884 - DNA, 23 bp, Homo sapiens
ctttcaccccagggcctgagcct

SEQ ID NO: 6891885 - DNA, 23 bp, Homo sapiens
aggactaacactcagaagcctgg

SEQ ID NO: 6891886 - DNA, 14 bp, Homo sapiens
tgctgggacttgaa

SEQ ID NO: 6891887 - DNA, 21 bp, Homo sapiens
cccttgtcttcccccctctcc

SEQ ID NO: 6891888 - DNA, 22 bp, Homo sapiens
tgagtctggcaaacatgtgcaa

SEQ ID NO: 6891889 - DNA, 15 bp, Homo sapiens
taaatttaaatttaa

SEQ ID NO: 6891890 - DNA, 19 bp, Homo sapiens
gctttctgctcagcttctc

SEQ ID NO: 6891891 - DNA, 14 bp, Homo sapiens
aacccccctcctgc

SEQ ID NO: 6891892 - DNA, 18 bp, Homo sapiens
atacttgtgaacatgcct

SEQ ID NO: 6891893 - DNA, 13 bp, Homo sapiens
ctgtgctcctgcc

SEQ ID NO: 6891894 - DNA, 16 bp, Homo sapiens
agtcgccctctgtgcc

SEQ ID NO: 6891895 - DNA, 17 bp, Homo sapiens
catccctctcctctgcc

SEQ ID NO: 6891896 - DNA, 14 bp, Homo sapiens
ctctccctgcctca

SEQ ID NO: 6891897 - DNA, 23 bp, Homo sapiens
gatttatggctgttcctgatttt

SEQ ID NO: 6891898 - DNA, 19 bp, Homo sapiens
accccggctccccctgcca

SEQ ID NO: 6891899 - DNA, 13 bp, Homo sapiens
cacgactgtctcc

SEQ ID NO: 6891900 - DNA, 15 bp, Homo sapiens
tatactctctccact

SEQ ID NO: 6891901 - DNA, 19 bp, Homo sapiens
gagctggggatgtctctca

SEQ ID NO: 6891902 - DNA, 19 bp, Homo sapiens
atccctgttacccagagaa

SEQ ID NO: 6891903 - DNA, 22 bp, Homo sapiens
caagagatctgtgtggctcctg

SEQ ID NO: 6891904 - DNA, 16 bp, Homo sapiens
ctcccaggcactgtct

SEQ ID NO: 6891905 - DNA, 14 bp, Homo sapiens
ctccatttctgtct

SEQ ID NO: 6891906 - DNA, 22 bp, Homo sapiens
atgattaggaatcattctgtaa

SEQ ID NO: 6891907 - DNA, 23 bp, Homo sapiens
atacattgtataggccatctgta

SEQ ID NO: 6891908 - DNA, 23 bp, Homo sapiens
ctccagcccgagtggtctcctct

SEQ ID NO: 6891909 - DNA, 19 bp, Homo sapiens
ccctctccacacccagcct

SEQ ID NO: 6891910 - DNA, 16 bp, Homo sapiens
ctggctatgcatttga

SEQ ID NO: 6891911 - DNA, 14 bp, Homo sapiens
agctgttatgctgt

SEQ ID NO: 6891912 - DNA, 18 bp, Homo sapiens
gccaaaggatgtgatata

SEQ ID NO: 6891913 - DNA, 23 bp, Homo sapiens
agagccttggttcatcagtgtta

SEQ ID NO: 6891914 - DNA, 21 bp, Homo sapiens
ttcgcacaatctacactgcct

SEQ ID NO: 6891915 - DNA, 23 bp, Homo sapiens
caagagtccccagactctgccta

SEQ ID NO: 6891916 - DNA, 14 bp, Homo sapiens
tccatgctgcctcc

SEQ ID NO: 6891917 - DNA, 14 bp, Homo sapiens
accagatctttctc

SEQ ID NO: 6891918 - DNA, 17 bp, Homo sapiens
ttactcagaatagctgt

SEQ ID NO: 6891919 - DNA, 14 bp, Homo sapiens
tccctctcttgcct

SEQ ID NO: 6891920 - DNA, 16 bp, Homo sapiens
gcacctgaaccactgt

SEQ ID NO: 6891921 - DNA, 19 bp, Homo sapiens
gcctagccgacctcagcct

SEQ ID NO: 6891922 - DNA, 23 bp, Homo sapiens
cattcaaaatagttctatttcta

SEQ ID NO: 6891923 - DNA, 12 bp, Homo sapiens
ctctccctgcct

SEQ ID NO: 6891924 - DNA, 19 bp, Homo sapiens
tgcctcctctctccctgcc

SEQ ID NO: 6891925 - DNA, 23 bp, Homo sapiens
gcctggcgggcagcccctgctgg

SEQ ID NO: 6891926 - DNA, 19 bp, Homo sapiens
aaggccctgcatctgtctg

SEQ ID NO: 6891927 - DNA, 21 bp, Homo sapiens
ctctttatttttctctttctc

SEQ ID NO: 6891928 - DNA, 13 bp, Homo sapiens
cctcttgattcct

SEQ ID NO: 6891929 - DNA, 18 bp, Homo sapiens
cctcttctacctcttcca

SEQ ID NO: 6891930 - DNA, 16 bp, Homo sapiens
tcagtggcagctgctt

SEQ ID NO: 6891931 - DNA, 18 bp, Homo sapiens
atatatgtgtgccctgga

SEQ ID NO: 6891932 - DNA, 16 bp, Homo sapiens
aggctggctgtgtata

SEQ ID NO: 6891933 - DNA, 16 bp, Homo sapiens
tgaacctcagtttcct

SEQ ID NO: 6891934 - DNA, 21 bp, Homo sapiens
cctcccctcacagcctctgac

SEQ ID NO: 6891935 - DNA, 14 bp, Homo sapiens
ccccgccctctgcc

SEQ ID NO: 6891936 - DNA, 16 bp, Homo sapiens
cacctcagctgcctcc

SEQ ID NO: 6891937 - DNA, 14 bp, Homo sapiens
ctcctagcctgctc

SEQ ID NO: 6891938 - DNA, 22 bp, Homo sapiens
ttccaaaccagtttattctgtg

SEQ ID NO: 6891939 - DNA, 21 bp, Homo sapiens
ccctttctcttttcccctttc

SEQ ID NO: 6891940 - DNA, 19 bp, Homo sapiens
ccttccccttccccgtccc

SEQ ID NO: 6891941 - DNA, 12 bp, Homo sapiens
acgactgtctcc

SEQ ID NO: 6891942 - DNA, 13 bp, Homo sapiens
aggctccctgagg

SEQ ID NO: 6891943 - DNA, 14 bp, Homo sapiens
cctttatgtgaatt

SEQ ID NO: 6891944 - DNA, 13 bp, Homo sapiens
acctccttcccca

SEQ ID NO: 6891945 - DNA, 21 bp, Homo sapiens
tcttccaaccccagctggcct

SEQ ID NO: 6891946 - DNA, 20 bp, Homo sapiens
atcccccttcttcctcccct

SEQ ID NO: 6891947 - DNA, 23 bp, Homo sapiens
atttccagttttttgccactgca

SEQ ID NO: 6891948 - DNA, 18 bp, Homo sapiens
ctccctgtctctgcatct

SEQ ID NO: 6891949 - DNA, 22 bp, Homo sapiens
aaaaattttgtatgtcaataac

SEQ ID NO: 6891950 - DNA, 16 bp, Homo sapiens
agaaatgaacattcca

SEQ ID NO: 6891951 - DNA, 13 bp, Homo sapiens
cctctccctgcct

SEQ ID NO: 6891952 - DNA, 18 bp, Homo sapiens
tcttcccttagcctctcc

SEQ ID NO: 6891953 - DNA, 19 bp, Homo sapiens
ttcaatgcttgatgttaca

SEQ ID NO: 6891954 - DNA, 19 bp, Homo sapiens
gccttcttggtttcagcca

SEQ ID NO: 6891955 - DNA, 18 bp, Homo sapiens
acttacacatcttccaca

SEQ ID NO: 6891956 - DNA, 22 bp, Homo sapiens
tacccatccccgcagtgtgcac

SEQ ID NO: 6891957 - DNA, 19 bp, Homo sapiens
cacctgcccccttctccca

SEQ ID NO: 6891958 - DNA, 20 bp, Homo sapiens
ccaaaatgtgagtggttgaa

SEQ ID NO: 6891959 - DNA, 21 bp, Homo sapiens
ctgcctccacccgtcctccct

SEQ ID NO: 6891960 - DNA, 14 bp, Homo sapiens
ttcagctcactgca

SEQ ID NO: 6891961 - DNA, 21 bp, Homo sapiens
tttccctggaactcctggcct

SEQ ID NO: 6891962 - DNA, 15 bp, Homo sapiens
accacagacactcct

SEQ ID NO: 6891963 - DNA, 17 bp, Homo sapiens
cactctgctaccttgcc

SEQ ID NO: 6891964 - DNA, 22 bp, Homo sapiens
ctcccacccccttctctgctcc

SEQ ID NO: 6891965 - DNA, 12 bp, Homo sapiens
cacactggctca

SEQ ID NO: 6891966 - DNA, 18 bp, Homo sapiens
aggaaggaggacccagga

SEQ ID NO: 6891967 - DNA, 17 bp, Homo sapiens
ctaccatggttctgcct

SEQ ID NO: 6891968 - DNA, 15 bp, Homo sapiens
ttctttcaatacaga

SEQ ID NO: 6891969 - DNA, 12 bp, Homo sapiens
ccagagcactgg

SEQ ID NO: 6891970 - DNA, 22 bp, Homo sapiens
gtcctcagcaccccactcctca

SEQ ID NO: 6891971 - DNA, 15 bp, Homo sapiens
atcaagcctgcctca

SEQ ID NO: 6891972 - DNA, 16 bp, Homo sapiens
tgacgcagcctgagaa

SEQ ID NO: 6891973 - DNA, 16 bp, Homo sapiens
tcccagcactgcctcc

SEQ ID NO: 6891974 - DNA, 16 bp, Homo sapiens
tgcatgctcctctgcc

SEQ ID NO: 6891975 - DNA, 17 bp, Homo sapiens
agaaattgtatattgta

SEQ ID NO: 6891976 - DNA, 18 bp, Homo sapiens
tgaaagttgtacatgaaa

SEQ ID NO: 6891977 - DNA, 17 bp, Homo sapiens
ctgttgacaatttgcca

SEQ ID NO: 6891978 - DNA, 19 bp, Homo sapiens
cagacttgagaacttgaca

SEQ ID NO: 6891979 - DNA, 14 bp, Homo sapiens
gtaccagctgcgct

SEQ ID NO: 6891980 - DNA, 21 bp, Homo sapiens
ggattgaaggggcttctaatg

SEQ ID NO: 6891981 - DNA, 13 bp, Homo sapiens
ccctcccctgcca

SEQ ID NO: 6891982 - DNA, 22 bp, Homo sapiens
caccatcttgaagtcattgtcc

SEQ ID NO: 6891983 - DNA, 15 bp, Homo sapiens
cttctgccttggccc

SEQ ID NO: 6891984 - DNA, 18 bp, Homo sapiens
agggctgtcatctgtgca

SEQ ID NO: 6891985 - DNA, 14 bp, Homo sapiens
tggctcgctgtggt

SEQ ID NO: 6891986 - DNA, 15 bp, Homo sapiens
tgaatgcacgtttca

SEQ ID NO: 6891987 - DNA, 21 bp, Homo sapiens
gacagtgaagcagcactgtga

SEQ ID NO: 6891988 - DNA, 18 bp, Homo sapiens
ctgtgttcgactcagcct

SEQ ID NO: 6891989 - DNA, 15 bp, Homo sapiens
cagctggctgctgac

SEQ ID NO: 6891990 - DNA, 17 bp, Homo sapiens
ctaccctggacttgcct

SEQ ID NO: 6891991 - DNA, 15 bp, Homo sapiens
ccagccctctgtggc

SEQ ID NO: 6891992 - DNA, 21 bp, Homo sapiens
ctgttcacagcttttcttgat

SEQ ID NO: 6891993 - DNA, 14 bp, Homo sapiens
gggtggaggagagc

SEQ ID NO: 6891994 - DNA, 18 bp, Homo sapiens
agcccccacccatgccag

SEQ ID NO: 6891995 - DNA, 15 bp, Homo sapiens
tgcggatcctgctgg

SEQ ID NO: 6891996 - DNA, 18 bp, Homo sapiens
agtgactcatcctcttga

SEQ ID NO: 6891997 - DNA, 15 bp, Homo sapiens
gcccctccagcacac

SEQ ID NO: 6891998 - DNA, 15 bp, Homo sapiens
gtgtcctcctgctct

SEQ ID NO: 6891999 - DNA, 18 bp, Homo sapiens
tgtcatttttgcagtaga

SEQ ID NO: 6892000 - DNA, 16 bp, Homo sapiens
gccttggtatgtgcca

SEQ ID NO: 6892001 - DNA, 23 bp, Homo sapiens
tataaacttcagagttctctgta

SEQ ID NO: 6892002 - DNA, 16 bp, Homo sapiens
cacaccgtccctctcc

SEQ ID NO: 6892003 - DNA, 20 bp, Homo sapiens
catgaattcttatgcttata

SEQ ID NO: 6892004 - DNA, 20 bp, Homo sapiens
aaatgcacccaactagctct

SEQ ID NO: 6892005 - DNA, 19 bp, Homo sapiens
cagctggagatactgatta

SEQ ID NO: 6892006 - DNA, 16 bp, Homo sapiens
tgacttgccactgcca

SEQ ID NO: 6892007 - DNA, 18 bp, Homo sapiens
cggttcagacccctgcct

SEQ ID NO: 6892008 - DNA, 22 bp, Homo sapiens
gcctttgggtgctgttttgcca

SEQ ID NO: 6892009 - DNA, 23 bp, Homo sapiens
agagccctgtggccgccacctga

SEQ ID NO: 6892010 - DNA, 13 bp, Homo sapiens
ccctggccaccac

SEQ ID NO: 6892011 - DNA, 15 bp, Homo sapiens
gccagtgctgtgagc

SEQ ID NO: 6892012 - DNA, 19 bp, Homo sapiens
acctgctgagagacccaag

SEQ ID NO: 6892013 - DNA, 19 bp, Homo sapiens
attttaattattattcttc

SEQ ID NO: 6892014 - DNA, 21 bp, Homo sapiens
tccttcccctgtggtcttgga

SEQ ID NO: 6892015 - DNA, 23 bp, Homo sapiens
gtcaccaaggaaacgctacctct

SEQ ID NO: 6892016 - DNA, 19 bp, Homo sapiens
gaagagaggagttcaatga

SEQ ID NO: 6892017 - DNA, 15 bp, Homo sapiens
atacatcacttcctg

SEQ ID NO: 6892018 - DNA, 19 bp, Homo sapiens
acttgctataaatagattt

SEQ ID NO: 6892019 - DNA, 12 bp, Homo sapiens
attatgatctaa

SEQ ID NO: 6892020 - DNA, 21 bp, Homo sapiens
atcaagttgttgactgtgatt

SEQ ID NO: 6892021 - DNA, 20 bp, Homo sapiens
ccttctcccaggcctctgcc

SEQ ID NO: 6892022 - DNA, 15 bp, Homo sapiens
aaatactatgcagta

SEQ ID NO: 6892023 - DNA, 21 bp, Homo sapiens
ccaggtcagccctgtgtctgt

SEQ ID NO: 6892024 - DNA, 22 bp, Homo sapiens
cttttaatgaatttaaggcaaa

SEQ ID NO: 6892025 - DNA, 17 bp, Homo sapiens
ctgacgcaccactgcca

SEQ ID NO: 6892026 - DNA, 15 bp, Homo sapiens
atagtcatgctgcta

SEQ ID NO: 6892027 - DNA, 19 bp, Homo sapiens
tcccgcagcaccagcctga

SEQ ID NO: 6892028 - DNA, 17 bp, Homo sapiens
tgtgaggcggcagctgg

SEQ ID NO: 6892029 - DNA, 22 bp, Homo sapiens
ctcaaccacacacacctgtctg

SEQ ID NO: 6892030 - DNA, 16 bp, Homo sapiens
gagtcaggcaattgat

SEQ ID NO: 6892031 - DNA, 15 bp, Homo sapiens
agaacaactacctga

SEQ ID NO: 6892032 - DNA, 19 bp, Homo sapiens
ccatgccctagaccctccc

SEQ ID NO: 6892033 - DNA, 20 bp, Homo sapiens
cctccgacagccccctctgc

SEQ ID NO: 6892034 - DNA, 20 bp, Homo sapiens
ctctggctgtaaggctctag

SEQ ID NO: 6892035 - DNA, 18 bp, Homo sapiens
ataaagggaacatgcagc

SEQ ID NO: 6892036 - DNA, 20 bp, Homo sapiens
cagctgaggaccctcagccc

SEQ ID NO: 6892037 - DNA, 21 bp, Homo sapiens
tcacgggcccgctcaacctct

SEQ ID NO: 6892038 - DNA, 20 bp, Homo sapiens
aggagaggctctgaaagctg

SEQ ID NO: 6892039 - DNA, 14 bp, Homo sapiens
ttctccagctgggc

SEQ ID NO: 6892040 - DNA, 17 bp, Homo sapiens
tctggtattaaatgcca

SEQ ID NO: 6892041 - DNA, 13 bp, Homo sapiens
aaagctactgaat

SEQ ID NO: 6892042 - DNA, 23 bp, Homo sapiens
atctctctactcctacctcagcc

SEQ ID NO: 6892043 - DNA, 18 bp, Homo sapiens
cagcactggctctctcca

SEQ ID NO: 6892044 - DNA, 15 bp, Homo sapiens
ccacagccagcacct

SEQ ID NO: 6892045 - DNA, 18 bp, Homo sapiens
gcccctgctctgtagcca

SEQ ID NO: 6892046 - DNA, 16 bp, Homo sapiens
aattttttggtacaaa

SEQ ID NO: 6892047 - DNA, 18 bp, Homo sapiens
cagccagaagcctctgcc

SEQ ID NO: 6892048 - DNA, 15 bp, Homo sapiens
cgcagacaggaccag

SEQ ID NO: 6892049 - DNA, 19 bp, Homo sapiens
aagttatgtgttaaattta

SEQ ID NO: 6892050 - DNA, 16 bp, Homo sapiens
gcatcaatcttgttac

SEQ ID NO: 6892051 - DNA, 15 bp, Homo sapiens
ctgcagaccctgcca

SEQ ID NO: 6892052 - DNA, 16 bp, Homo sapiens
acccttgcctgcctcc

SEQ ID NO: 6892053 - DNA, 23 bp, Homo sapiens
aatgtactatagatataactgta

SEQ ID NO: 6892054 - DNA, 18 bp, Homo sapiens
taatggttgtgaaatgta

SEQ ID NO: 6892055 - DNA, 16 bp, Homo sapiens
cacagaaacactgcct

SEQ ID NO: 6892056 - DNA, 18 bp, Homo sapiens
tactaatgccctatctta

SEQ ID NO: 6892057 - DNA, 22 bp, Homo sapiens
cagcctaatgagagtgcactgc

SEQ ID NO: 6892058 - DNA, 12 bp, Homo sapiens
attcctggaacc

SEQ ID NO: 6892059 - DNA, 23 bp, Homo sapiens
atttgtttggttatagtgcaata

SEQ ID NO: 6892060 - DNA, 15 bp, Homo sapiens
actgcagcacctcca

SEQ ID NO: 6892061 - DNA, 14 bp, Homo sapiens
ctgccttctgctga

SEQ ID NO: 6892062 - DNA, 12 bp, Homo sapiens
agtatattctta

SEQ ID NO: 6892063 - DNA, 16 bp, Homo sapiens
atcttagtttactgga

SEQ ID NO: 6892064 - DNA, 21 bp, Homo sapiens
cttccagtgaggctctgccct

SEQ ID NO: 6892065 - DNA, 14 bp, Homo sapiens
acttctttgaagtt

SEQ ID NO: 6892066 - DNA, 21 bp, Homo sapiens
attttacaagtataacagttt

SEQ ID NO: 6892067 - DNA, 18 bp, Homo sapiens
attatttttgtgtttcta

SEQ ID NO: 6892068 - DNA, 21 bp, Homo sapiens
cgaggcgggggatcctggagc

SEQ ID NO: 6892069 - DNA, 16 bp, Homo sapiens
ctgctctccttgccct

SEQ ID NO: 6892070 - DNA, 16 bp, Homo sapiens
tctaggggcagcctcc

SEQ ID NO: 6892071 - DNA, 19 bp, Homo sapiens
cttttcccccaccctccca

SEQ ID NO: 6892072 - DNA, 18 bp, Homo sapiens
tttgtttctccccctggg

SEQ ID NO: 6892073 - DNA, 19 bp, Homo sapiens
atttcaggaggaatactga

SEQ ID NO: 6892074 - DNA, 15 bp, Homo sapiens
ttccaaaacatttct

SEQ ID NO: 6892075 - DNA, 22 bp, Homo sapiens
cccttccccatgaaccctgccc

SEQ ID NO: 6892076 - DNA, 15 bp, Homo sapiens
tatcctccctgccca

SEQ ID NO: 6892077 - DNA, 23 bp, Homo sapiens
gaattatccattacgtgcattta

SEQ ID NO: 6892078 - DNA, 14 bp, Homo sapiens
cagtacctgagggt

SEQ ID NO: 6892079 - DNA, 23 bp, Homo sapiens
tgagggccaagagatctgtgtgg

SEQ ID NO: 6892080 - DNA, 17 bp, Homo sapiens
cattcatatcctccgcc

SEQ ID NO: 6892081 - DNA, 16 bp, Homo sapiens
accctgcacctgctgc

SEQ ID NO: 6892082 - DNA, 22 bp, Homo sapiens
aataaattgtttggcttcctcc

SEQ ID NO: 6892083 - DNA, 19 bp, Homo sapiens
cgggcggagggaggggagg

SEQ ID NO: 6892084 - DNA, 14 bp, Homo sapiens
aggacagcctgcct

SEQ ID NO: 6892085 - DNA, 14 bp, Homo sapiens
ccaggtccagctct

SEQ ID NO: 6892086 - DNA, 14 bp, Homo sapiens
ccccagtggcactg

SEQ ID NO: 6892087 - DNA, 14 bp, Homo sapiens
acctggaatatata

SEQ ID NO: 6892088 - DNA, 19 bp, Homo sapiens
aaaaccagttttgctgcta

SEQ ID NO: 6892089 - DNA, 18 bp, Homo sapiens
ccttgctctccctcttct

SEQ ID NO: 6892090 - DNA, 23 bp, Homo sapiens
tactgctgtcattgtccatgcct

SEQ ID NO: 6892091 - DNA, 17 bp, Homo sapiens
gctcctcagcggctcca

SEQ ID NO: 6892092 - DNA, 22 bp, Homo sapiens
cttaaagggtttgagatgtaca

SEQ ID NO: 6892093 - DNA, 11 bp, Homo sapiens
gagacactgag

SEQ ID NO: 6892094 - DNA, 21 bp, Homo sapiens
taaaacacctcagctgcctcc

SEQ ID NO: 6892095 - DNA, 15 bp, Homo sapiens
ccttacagaaaattg

SEQ ID NO: 6892096 - DNA, 15 bp, Homo sapiens
agcccctcctctgcc

SEQ ID NO: 6892097 - DNA, 13 bp, Homo sapiens
tgttctgcgctgt

SEQ ID NO: 6892098 - DNA, 17 bp, Homo sapiens
ctctgacctcttggcca

SEQ ID NO: 6892099 - DNA, 13 bp, Homo sapiens
cactagtgccaat

SEQ ID NO: 6892100 - DNA, 21 bp, Homo sapiens
atctttctttcttagaaattt

SEQ ID NO: 6892101 - DNA, 16 bp, Homo sapiens
cttctttcctcttccc

SEQ ID NO: 6892102 - DNA, 19 bp, Homo sapiens
cccttctcccacccctgcc

SEQ ID NO: 6892103 - DNA, 17 bp, Homo sapiens
accccatctgcccagga

SEQ ID NO: 6892104 - DNA, 17 bp, Homo sapiens
ccaaaaaatgcttgctt

SEQ ID NO: 6892105 - DNA, 18 bp, Homo sapiens
ccctgcccctgccccgtc

SEQ ID NO: 6892106 - DNA, 17 bp, Homo sapiens
atttccttttctctgcc

SEQ ID NO: 6892107 - DNA, 14 bp, Homo sapiens
tgtaacaatgtaat

SEQ ID NO: 6892108 - DNA, 16 bp, Homo sapiens
cattgatgtaaggact

SEQ ID NO: 6892109 - DNA, 15 bp, Homo sapiens
ctgacatcccttcct

SEQ ID NO: 6892110 - DNA, 19 bp, Homo sapiens
ctgatccctctgggggctc

SEQ ID NO: 6892111 - DNA, 15 bp, Homo sapiens
cggaagagcaggtga

SEQ ID NO: 6892112 - DNA, 18 bp, Homo sapiens
acagagccaagcactgct

SEQ ID NO: 6892113 - DNA, 19 bp, Homo sapiens
tcctaaggaaactgcttta

SEQ ID NO: 6892114 - DNA, 14 bp, Homo sapiens
atgtcttctgctgt

SEQ ID NO: 6892115 - DNA, 14 bp, Homo sapiens
ttgcactgtttgca

SEQ ID NO: 6892116 - DNA, 15 bp, Homo sapiens
catgatgcatggagt

SEQ ID NO: 6892117 - DNA, 16 bp, Homo sapiens
gcccaccttggctcaa

SEQ ID NO: 6892118 - DNA, 17 bp, Homo sapiens
actttcggagcctgcct

SEQ ID NO: 6892119 - DNA, 17 bp, Homo sapiens
ctccagcccctgtccca

SEQ ID NO: 6892120 - DNA, 21 bp, Homo sapiens
ctgcgggagccagactgtcca

SEQ ID NO: 6892121 - DNA, 17 bp, Homo sapiens
agaggctgaggcctgga

SEQ ID NO: 6892122 - DNA, 17 bp, Homo sapiens
cagtgcccccacccagt

SEQ ID NO: 6892123 - DNA, 23 bp, Homo sapiens
agggcaataaatgccctctctga

SEQ ID NO: 6892124 - DNA, 13 bp, Homo sapiens
tcacctcatgccc

SEQ ID NO: 6892125 - DNA, 23 bp, Homo sapiens
gctcccctccatccccatcggcc

SEQ ID NO: 6892126 - DNA, 19 bp, Homo sapiens
acatacagagattgtagta

SEQ ID NO: 6892127 - DNA, 16 bp, Homo sapiens
ccttgcaccccttcct

SEQ ID NO: 6892128 - DNA, 17 bp, Homo sapiens
tcacatgtgccctgcct

SEQ ID NO: 6892129 - DNA, 19 bp, Homo sapiens
gctcactgaaacctctgcc

SEQ ID NO: 6892130 - DNA, 16 bp, Homo sapiens
agaagattaagacaga

SEQ ID NO: 6892131 - DNA, 15 bp, Homo sapiens
tgccttatttctcat

SEQ ID NO: 6892132 - DNA, 15 bp, Homo sapiens
ctccagatctgcact

SEQ ID NO: 6892133 - DNA, 16 bp, Homo sapiens
ccaggtccacggtctg

SEQ ID NO: 6892134 - DNA, 15 bp, Homo sapiens
cacacatttctgcca

SEQ ID NO: 6892135 - DNA, 14 bp, Homo sapiens
cctccaccgctgcc

SEQ ID NO: 6892136 - DNA, 16 bp, Homo sapiens
aatactgttctttcca

SEQ ID NO: 6892137 - DNA, 18 bp, Homo sapiens
cttctcctctctgggcct

SEQ ID NO: 6892138 - DNA, 21 bp, Homo sapiens
tggccatgaatctctgcctct

SEQ ID NO: 6892139 - DNA, 21 bp, Homo sapiens
catcccggctgaccctgtgcc

SEQ ID NO: 6892140 - DNA, 15 bp, Homo sapiens
ttctggagcccttgg

SEQ ID NO: 6892141 - DNA, 17 bp, Homo sapiens
ccaaaggagacatatca

SEQ ID NO: 6892142 - DNA, 14 bp, Homo sapiens
ccttcccctgggaa

SEQ ID NO: 6892143 - DNA, 22 bp, Homo sapiens
gcaaggtgggggagcctggagc

SEQ ID NO: 6892144 - DNA, 21 bp, Homo sapiens
gtgccttctagaatacatatt

SEQ ID NO: 6892145 - DNA, 16 bp, Homo sapiens
cctctaagtgctgctg

SEQ ID NO: 6892146 - DNA, 21 bp, Homo sapiens
cacattgcccatggctgggaa

SEQ ID NO: 6892147 - DNA, 13 bp, Homo sapiens
ctccagtcctgct

SEQ ID NO: 6892148 - DNA, 15 bp, Homo sapiens
cttgagcccactcct

SEQ ID NO: 6892149 - DNA, 17 bp, Homo sapiens
acaagattcccagagac

SEQ ID NO: 6892150 - DNA, 12 bp, Homo sapiens
cgagtactgtgg

SEQ ID NO: 6892151 - DNA, 23 bp, Homo sapiens
gccatgttgtgcctccctggtga

SEQ ID NO: 6892152 - DNA, 14 bp, Homo sapiens
aatgagatatgcaa

SEQ ID NO: 6892153 - DNA, 13 bp, Homo sapiens
aagccctgtgctt

SEQ ID NO: 6892154 - DNA, 22 bp, Homo sapiens
tattgccaaaacccagctgcac

SEQ ID NO: 6892155 - DNA, 23 bp, Homo sapiens
cgtctggaggggcccctgcttct

SEQ ID NO: 6892156 - DNA, 15 bp, Homo sapiens
acaaccctggcctca

SEQ ID NO: 6892157 - DNA, 18 bp, Homo sapiens
ctgcctgtggccttgccc

SEQ ID NO: 6892158 - DNA, 19 bp, Homo sapiens
ccatttataaccccagcct

SEQ ID NO: 6892159 - DNA, 17 bp, Homo sapiens
gcctgtactgcctgctt

SEQ ID NO: 6892160 - DNA, 23 bp, Homo sapiens
aggcgtgtttgatgcgcttttaa

SEQ ID NO: 6892161 - DNA, 17 bp, Homo sapiens
cgaacctcctctgtgaa

SEQ ID NO: 6892162 - DNA, 13 bp, Homo sapiens
tagctctgagccc

SEQ ID NO: 6892163 - DNA, 19 bp, Homo sapiens
ctcaagcaatcctcctgcc

SEQ ID NO: 6892164 - DNA, 22 bp, Homo sapiens
atgttcagcactgtcccttgcc

SEQ ID NO: 6892165 - DNA, 23 bp, Homo sapiens
tgctgctttgttgttctgcctgt

SEQ ID NO: 6892166 - DNA, 11 bp, Homo sapiens
agacagaccac

SEQ ID NO: 6892167 - DNA, 17 bp, Homo sapiens
cttcagcgtaaaatggt

SEQ ID NO: 6892168 - DNA, 13 bp, Homo sapiens
tttggccatctct

SEQ ID NO: 6892169 - DNA, 15 bp, Homo sapiens
gaatcttttactgtg

SEQ ID NO: 6892170 - DNA, 16 bp, Homo sapiens
tctctgactcttgcct

SEQ ID NO: 6892171 - DNA, 14 bp, Homo sapiens
ccttcaccccttca

SEQ ID NO: 6892172 - DNA, 14 bp, Homo sapiens
tgcccacctgccca

SEQ ID NO: 6892173 - DNA, 14 bp, Homo sapiens
cctcctcccctcct

SEQ ID NO: 6892174 - DNA, 20 bp, Homo sapiens
gggccctccttccctcctgt

SEQ ID NO: 6892175 - DNA, 19 bp, Homo sapiens
atccagtgtggctcccaca

SEQ ID NO: 6892176 - DNA, 22 bp, Homo sapiens
tccttggggaggggtcagctct

SEQ ID NO: 6892177 - DNA, 14 bp, Homo sapiens
tgttatgtactgta

SEQ ID NO: 6892178 - DNA, 17 bp, Homo sapiens
ctctggggggttgcctc

SEQ ID NO: 6892179 - DNA, 20 bp, Homo sapiens
ctgcagtcacccctgtctgc

SEQ ID NO: 6892180 - DNA, 23 bp, Homo sapiens
tgccactgcctcttcctccctca

SEQ ID NO: 6892181 - DNA, 16 bp, Homo sapiens
gtacatcattattgta

SEQ ID NO: 6892182 - DNA, 19 bp, Homo sapiens
ccttccatgtcgcctctgc

SEQ ID NO: 6892183 - DNA, 14 bp, Homo sapiens
cctgttcccttcct

SEQ ID NO: 6892184 - DNA, 16 bp, Homo sapiens
actctagtactgtgaa

SEQ ID NO: 6892185 - DNA, 18 bp, Homo sapiens
agaactgtcttagtcata

SEQ ID NO: 6892186 - DNA, 16 bp, Homo sapiens
aggaagggaggcctga

SEQ ID NO: 6892187 - DNA, 14 bp, Homo sapiens
tgtttgcctctgcc

SEQ ID NO: 6892188 - DNA, 20 bp, Homo sapiens
cacctctcacgggccctgcc

SEQ ID NO: 6892189 - DNA, 14 bp, Homo sapiens
aatgactggctcct

SEQ ID NO: 6892190 - DNA, 17 bp, Homo sapiens
aggtcccagccccaggc

SEQ ID NO: 6892191 - DNA, 17 bp, Homo sapiens
tacaggaaaagctgctg

SEQ ID NO: 6892192 - DNA, 20 bp, Homo sapiens
ccaaagaaatgaacattcca

SEQ ID NO: 6892193 - DNA, 17 bp, Homo sapiens
aggaaactcttatctca

SEQ ID NO: 6892194 - DNA, 22 bp, Homo sapiens
tttactaaagaaagattactta

SEQ ID NO: 6892195 - DNA, 18 bp, Homo sapiens
tgagctcccctggagcca

SEQ ID NO: 6892196 - DNA, 13 bp, Homo sapiens
agtttgtttttgc

SEQ ID NO: 6892197 - DNA, 13 bp, Homo sapiens
cacaaactgtgaa

SEQ ID NO: 6892198 - DNA, 19 bp, Homo sapiens
attctgtacatagcctata

SEQ ID NO: 6892199 - DNA, 18 bp, Homo sapiens
gcctctatgccctgcaga

SEQ ID NO: 6892200 - DNA, 21 bp, Homo sapiens
tattttgatataattgtactg

SEQ ID NO: 6892201 - DNA, 18 bp, Homo sapiens
actcctgtcttctttctc

SEQ ID NO: 6892202 - DNA, 16 bp, Homo sapiens
cctgcaggacctgcct

SEQ ID NO: 6892203 - DNA, 20 bp, Homo sapiens
ccctgaccagctccccctcc

SEQ ID NO: 6892204 - DNA, 22 bp, Homo sapiens
cagattggctcacactgagaat

SEQ ID NO: 6892205 - DNA, 20 bp, Homo sapiens
caaattagggctacattgta

SEQ ID NO: 6892206 - DNA, 16 bp, Homo sapiens
atcagcagacactcca

SEQ ID NO: 6892207 - DNA, 16 bp, Homo sapiens
cacaccaagctgtgcc

SEQ ID NO: 6892208 - DNA, 23 bp, Homo sapiens
gtcagcagcctccctgaagacca

SEQ ID NO: 6892209 - DNA, 22 bp, Homo sapiens
ccagcccggcctgctcccagca

SEQ ID NO: 6892210 - DNA, 18 bp, Homo sapiens
cccttgcccccctggcct

SEQ ID NO: 6892211 - DNA, 22 bp, Homo sapiens
ttctgaccacacttcctgtcca

SEQ ID NO: 6892212 - DNA, 14 bp, Homo sapiens
ccgttcaaattctc

SEQ ID NO: 6892213 - DNA, 19 bp, Homo sapiens
gccttaagtcttactgttt

SEQ ID NO: 6892214 - DNA, 21 bp, Homo sapiens
agcacacctgaatcagctgga

SEQ ID NO: 6892215 - DNA, 18 bp, Homo sapiens
ataaccctgggctgtcca

SEQ ID NO: 6892216 - DNA, 16 bp, Homo sapiens
actgttcatacagttt

SEQ ID NO: 6892217 - DNA, 18 bp, Homo sapiens
attgttccacacatttaa

SEQ ID NO: 6892218 - DNA, 20 bp, Homo sapiens
cacaatctttccttgtctct

SEQ ID NO: 6892219 - DNA, 21 bp, Homo sapiens
ccttttgtttttggctttcct

SEQ ID NO: 6892220 - DNA, 19 bp, Homo sapiens
cctcctagcctgctctgcc

SEQ ID NO: 6892221 - DNA, 19 bp, Homo sapiens
ttaattgttttgcactttt

SEQ ID NO: 6892222 - DNA, 11 bp, Homo sapiens
tgccctctgct

SEQ ID NO: 6892223 - DNA, 17 bp, Homo sapiens
aaagagggtgagggcct

SEQ ID NO: 6892224 - DNA, 13 bp, Homo sapiens
cccctcctctgcc

SEQ ID NO: 6892225 - DNA, 11 bp, Homo sapiens
aaatgaatttt

SEQ ID NO: 6892226 - DNA, 18 bp, Homo sapiens
ctttgcctcgaaagtgtc

SEQ ID NO: 6892227 - DNA, 22 bp, Homo sapiens
cttttcccaaagcatccctctt

SEQ ID NO: 6892228 - DNA, 12 bp, Homo sapiens
ccttcctctgca

SEQ ID NO: 6892229 - DNA, 16 bp, Homo sapiens
tggttgtaccctctcc

SEQ ID NO: 6892230 - DNA, 15 bp, Homo sapiens
tgtccaaactgccta

SEQ ID NO: 6892231 - DNA, 22 bp, Homo sapiens
tggcctcaaccctccctcagcc

SEQ ID NO: 6892232 - DNA, 18 bp, Homo sapiens
atctattgtttgttgcac

SEQ ID NO: 6892233 - DNA, 21 bp, Homo sapiens
tgggactacaggctcatgcca

SEQ ID NO: 6892234 - DNA, 21 bp, Homo sapiens
gcatgtcagacagaacttgaa

SEQ ID NO: 6892235 - DNA, 21 bp, Homo sapiens
agtggtggtgtctcactcttt

SEQ ID NO: 6892236 - DNA, 19 bp, Homo sapiens
agtgaggctctgcccttgg

SEQ ID NO: 6892237 - DNA, 15 bp, Homo sapiens
taaatattgtctttt

SEQ ID NO: 6892238 - DNA, 18 bp, Homo sapiens
cactttgttggcccttcc

SEQ ID NO: 6892239 - DNA, 17 bp, Homo sapiens
atcagactgacagttta

SEQ ID NO: 6892240 - DNA, 15 bp, Homo sapiens
gccctgcccagccag

SEQ ID NO: 6892241 - DNA, 23 bp, Homo sapiens
gcagtgtcttaaggagactggta

SEQ ID NO: 6892242 - DNA, 15 bp, Homo sapiens
cagacacacacacgc

SEQ ID NO: 6892243 - DNA, 14 bp, Homo sapiens
actgtgaccaaagc

SEQ ID NO: 6892244 - DNA, 14 bp, Homo sapiens
taactgctgagcca

SEQ ID NO: 6892245 - DNA, 12 bp, Homo sapiens
agcacagtttga

SEQ ID NO: 6892246 - DNA, 14 bp, Homo sapiens
ctgtgtacacctca

SEQ ID NO: 6892247 - DNA, 20 bp, Homo sapiens
cctggggctgatctcaggga

SEQ ID NO: 6892248 - DNA, 19 bp, Homo sapiens
agactaaggggcagctcct

SEQ ID NO: 6892249 - DNA, 19 bp, Homo sapiens
taggggcaagctcttgccc

SEQ ID NO: 6892250 - DNA, 17 bp, Homo sapiens
cctggccagcccttcct

SEQ ID NO: 6892251 - DNA, 17 bp, Homo sapiens
ccttcccacctactgca

SEQ ID NO: 6892252 - DNA, 17 bp, Homo sapiens
ctttgcgctcctggccc

SEQ ID NO: 6892253 - DNA, 14 bp, Homo sapiens
cagaggccctgcca

SEQ ID NO: 6892254 - DNA, 20 bp, Homo sapiens
aaatatcccaaactgtgatg

SEQ ID NO: 6892255 - DNA, 14 bp, Homo sapiens
tgacctcaggtgat

SEQ ID NO: 6892256 - DNA, 18 bp, Homo sapiens
ttatataaagtattcttt

SEQ ID NO: 6892257 - DNA, 15 bp, Homo sapiens
acctaaacagatata

SEQ ID NO: 6892258 - DNA, 23 bp, Homo sapiens
cattcgttgtgttttttaagata

SEQ ID NO: 6892259 - DNA, 17 bp, Homo sapiens
caaacccttaactgaca

SEQ ID NO: 6892260 - DNA, 13 bp, Homo sapiens
cctaagcatctaa

SEQ ID NO: 6892261 - DNA, 13 bp, Homo sapiens
ttccatttctcaa

SEQ ID NO: 6892262 - DNA, 22 bp, Homo sapiens
cagagacccagcggacacacgc

SEQ ID NO: 6892263 - DNA, 13 bp, Homo sapiens
caacgtctcttca

SEQ ID NO: 6892264 - DNA, 12 bp, Homo sapiens
ctgcagctgctg

SEQ ID NO: 6892265 - DNA, 10 bp, Homo sapiens
ttctgtgtgt

SEQ ID NO: 6892266 - DNA, 24 bp, Homo sapiens
ccctgccccgcaggcctgccttct

SEQ ID NO: 6892267 - DNA, 12 bp, Homo sapiens
gaaactgatttc

SEQ ID NO: 6892268 - DNA, 15 bp, Homo sapiens
cctcctttctcttct

SEQ ID NO: 6892269 - DNA, 20 bp, Homo sapiens
cctcagctgcctcacttcct

SEQ ID NO: 6892270 - DNA, 13 bp, Homo sapiens
attccaacttgaa

SEQ ID NO: 6892271 - DNA, 16 bp, Homo sapiens
tgccttccaccctgcc

SEQ ID NO: 6892272 - DNA, 13 bp, Homo sapiens
aatatatgttttg

SEQ ID NO: 6892273 - DNA, 14 bp, Homo sapiens
ccttggtctctcct

SEQ ID NO: 6892274 - DNA, 22 bp, Homo sapiens
cagcaaatgccactctgggcag

SEQ ID NO: 6892275 - DNA, 22 bp, Homo sapiens
attttactgtgaaaaaaaattt

SEQ ID NO: 6892276 - DNA, 13 bp, Homo sapiens
ctatcctgggacc

SEQ ID NO: 6892277 - DNA, 14 bp, Homo sapiens
ctctcctctctgct

SEQ ID NO: 6892278 - DNA, 16 bp, Homo sapiens
cctgcgctcctctgca

SEQ ID NO: 6892279 - DNA, 20 bp, Homo sapiens
cagttcacagaggtctttca

SEQ ID NO: 6892280 - DNA, 13 bp, Homo sapiens
aactttctctgca

SEQ ID NO: 6892281 - DNA, 12 bp, Homo sapiens
tcctctgcctca

SEQ ID NO: 6892282 - DNA, 15 bp, Homo sapiens
ccagtccccccaccc

SEQ ID NO: 6892283 - DNA, 15 bp, Homo sapiens
actgacacaggccag

SEQ ID NO: 6892284 - DNA, 17 bp, Homo sapiens
cttggcctgatcagacc

SEQ ID NO: 6892285 - DNA, 17 bp, Homo sapiens
ttctacagtattatgta

SEQ ID NO: 6892286 - DNA, 17 bp, Homo sapiens
gaagtgacttgaatgta

SEQ ID NO: 6892287 - DNA, 14 bp, Homo sapiens
actctgctcttgca

SEQ ID NO: 6892288 - DNA, 13 bp, Homo sapiens
cttctacctgcca

SEQ ID NO: 6892289 - DNA, 19 bp, Homo sapiens
ctctcctcttgccactgcc

SEQ ID NO: 6892290 - DNA, 21 bp, Homo sapiens
acaccactgagctctgcctca

SEQ ID NO: 6892291 - DNA, 21 bp, Homo sapiens
ctaaacgagtcaatcccctca

SEQ ID NO: 6892292 - DNA, 20 bp, Homo sapiens
tttctgtgacatttatgtct

SEQ ID NO: 6892293 - DNA, 19 bp, Homo sapiens
cctacctggggactcctca

SEQ ID NO: 6892294 - DNA, 17 bp, Homo sapiens
ccctgaccactcagaga

SEQ ID NO: 6892295 - DNA, 16 bp, Homo sapiens
cctgtcctcccatccc

SEQ ID NO: 6892296 - DNA, 15 bp, Homo sapiens
ctcctagcctgctct

SEQ ID NO: 6892297 - DNA, 22 bp, Homo sapiens
cgtgttccagccaaagcatgcc

SEQ ID NO: 6892298 - DNA, 18 bp, Homo sapiens
agcatcctggcacccggc

SEQ ID NO: 6892299 - DNA, 13 bp, Homo sapiens
agccttgtgtata

SEQ ID NO: 6892300 - DNA, 13 bp, Homo sapiens
agtgtgcctgcta

SEQ ID NO: 6892301 - DNA, 15 bp, Homo sapiens
tctcatcatattgta

SEQ ID NO: 6892302 - DNA, 13 bp, Homo sapiens
cagggtcagtgta

SEQ ID NO: 6892303 - DNA, 22 bp, Homo sapiens
tatgtacaaataatattgcctt

SEQ ID NO: 6892304 - DNA, 18 bp, Homo sapiens
taaaaatgcaatatctga

SEQ ID NO: 6892305 - DNA, 14 bp, Homo sapiens
gaaagttactgtaa

SEQ ID NO: 6892306 - DNA, 16 bp, Homo sapiens
cattgcagaccctgcc

SEQ ID NO: 6892307 - DNA, 14 bp, Homo sapiens
tatggacactgcct

SEQ ID NO: 6892308 - DNA, 15 bp, Homo sapiens
atttattggttttgc

SEQ ID NO: 6892309 - DNA, 15 bp, Homo sapiens
tagtaaatgtctttg

SEQ ID NO: 6892310 - DNA, 13 bp, Homo sapiens
cttcccactgtcc

SEQ ID NO: 6892311 - DNA, 13 bp, Homo sapiens
actttcccttgcc

SEQ ID NO: 6892312 - DNA, 14 bp, Homo sapiens
gttgcatatgagcc

SEQ ID NO: 6892313 - DNA, 14 bp, Homo sapiens
cacttcaggagccc

SEQ ID NO: 6892314 - DNA, 16 bp, Homo sapiens
ggatgaccatactcag

SEQ ID NO: 6892315 - DNA, 11 bp, Homo sapiens
accactgtccc

SEQ ID NO: 6892316 - DNA, 20 bp, Homo sapiens
tcaatagctccaagctgtta

SEQ ID NO: 6892317 - DNA, 13 bp, Homo sapiens
cccctcaacctca

SEQ ID NO: 6892318 - DNA, 18 bp, Homo sapiens
gccctgccccctggctga

SEQ ID NO: 6892319 - DNA, 16 bp, Homo sapiens
ctcctctccatctcta

SEQ ID NO: 6892320 - DNA, 18 bp, Homo sapiens
accaaatctgacatatta

SEQ ID NO: 6892321 - DNA, 18 bp, Homo sapiens
tgtgcaacaaatacctcc

SEQ ID NO: 6892322 - DNA, 19 bp, Homo sapiens
cattctcctgcctcagcct

SEQ ID NO: 6892323 - DNA, 14 bp, Homo sapiens
ccaggcccagccag

SEQ ID NO: 6892324 - DNA, 21 bp, Homo sapiens
catgtccagagggactggaca

SEQ ID NO: 6892325 - DNA, 13 bp, Homo sapiens
tggggcctggctt

SEQ ID NO: 6892326 - DNA, 13 bp, Homo sapiens
ctactctgtgcca

SEQ ID NO: 6892327 - DNA, 17 bp, Homo sapiens
ccttagagcttggacag

SEQ ID NO: 6892328 - DNA, 16 bp, Homo sapiens
ctgccttttctggagt

SEQ ID NO: 6892329 - DNA, 16 bp, Homo sapiens
ctcctttgctcttgcc

SEQ ID NO: 6892330 - DNA, 14 bp, Homo sapiens
tggccggccctgcc

SEQ ID NO: 6892331 - DNA, 20 bp, Homo sapiens
gaatgtgggcactggcccag

SEQ ID NO: 6892332 - DNA, 19 bp, Homo sapiens
ctgcccctcaccttgggct

SEQ ID NO: 6892333 - DNA, 20 bp, Homo sapiens
ttagactcaaagaagtactg

SEQ ID NO: 6892334 - DNA, 14 bp, Homo sapiens
cccctttggcactg

SEQ ID NO: 6892335 - DNA, 15 bp, Homo sapiens
agagtgaatttcagt

SEQ ID NO: 6892336 - DNA, 21 bp, Homo sapiens
acttttagtagagacagtgtt

SEQ ID NO: 6892337 - DNA, 17 bp, Homo sapiens
ccctcccctcccctgct

SEQ ID NO: 6892338 - DNA, 14 bp, Homo sapiens
aacaaagacattta

SEQ ID NO: 6892339 - DNA, 22 bp, Homo sapiens
agctgctcttgcatctgggcca

SEQ ID NO: 6892340 - DNA, 22 bp, Homo sapiens
ataatccccacaggcacattaa

SEQ ID NO: 6892341 - DNA, 20 bp, Homo sapiens
gaaatatgaagaactgagga

SEQ ID NO: 6892342 - DNA, 17 bp, Homo sapiens
ctgccagccttgagccc

SEQ ID NO: 6892343 - DNA, 17 bp, Homo sapiens
tgctgccagggcttcct

SEQ ID NO: 6892344 - DNA, 23 bp, Homo sapiens
caatgttcattgtaatgttactg

SEQ ID NO: 6892345 - DNA, 13 bp, Homo sapiens
gtcctatgcctca

SEQ ID NO: 6892346 - DNA, 17 bp, Homo sapiens
acagtgcatctcagccc

SEQ ID NO: 6892347 - DNA, 17 bp, Homo sapiens
accacatgccactgcct

SEQ ID NO: 6892348 - DNA, 13 bp, Homo sapiens
ttaatgtatctta

SEQ ID NO: 6892349 - DNA, 22 bp, Homo sapiens
aggtccattttctaagggtaga

SEQ ID NO: 6892350 - DNA, 20 bp, Homo sapiens
tgttcattgtagattttgtt

SEQ ID NO: 6892351 - DNA, 20 bp, Homo sapiens
cttcaagtgatatatgtatt

SEQ ID NO: 6892352 - DNA, 19 bp, Homo sapiens
ctgaagtggccctccctca

SEQ ID NO: 6892353 - DNA, 21 bp, Homo sapiens
gcttccagcgggccctctgcc

SEQ ID NO: 6892354 - DNA, 21 bp, Homo sapiens
cattattcaaagttgcctaaa

SEQ ID NO: 6892355 - DNA, 21 bp, Homo sapiens
cccagagacctttgcccacac

SEQ ID NO: 6892356 - DNA, 15 bp, Homo sapiens
ctttagttctgctgt

SEQ ID NO: 6892357 - DNA, 14 bp, Homo sapiens
tggtactttctgta

SEQ ID NO: 6892358 - DNA, 17 bp, Homo sapiens
cttttcattctcctcct

SEQ ID NO: 6892359 - DNA, 23 bp, Homo sapiens
gtattggtttctgtttgaatttt

SEQ ID NO: 6892360 - DNA, 15 bp, Homo sapiens
atgatcaaaatgcat

SEQ ID NO: 6892361 - DNA, 17 bp, Homo sapiens
actgaaggggtgcaccc

SEQ ID NO: 6892362 - DNA, 20 bp, Homo sapiens
catcttccagaagtgtgatt

SEQ ID NO: 6892363 - DNA, 16 bp, Homo sapiens
tccctgggcctgctgc

SEQ ID NO: 6892364 - DNA, 22 bp, Homo sapiens
agaccataagagaaacctgcca

SEQ ID NO: 6892365 - DNA, 17 bp, Homo sapiens
cagtctccggcctctcc

SEQ ID NO: 6892366 - DNA, 16 bp, Homo sapiens
ttttggttttctactg

SEQ ID NO: 6892367 - DNA, 12 bp, Homo sapiens
tgcgaagtccta

SEQ ID NO: 6892368 - DNA, 17 bp, Homo sapiens
cttccctgacactgtct

SEQ ID NO: 6892369 - DNA, 20 bp, Homo sapiens
tttttactatcacacatgaa

SEQ ID NO: 6892370 - DNA, 16 bp, Homo sapiens
ctcctgaggacagctg

SEQ ID NO: 6892371 - DNA, 22 bp, Homo sapiens
aatactctgttgtactatggaa

SEQ ID NO: 6892372 - DNA, 20 bp, Homo sapiens
tccgtgggccgtatctgtca

SEQ ID NO: 6892373 - DNA, 22 bp, Homo sapiens
tcacttgtaggtttctctgcct

SEQ ID NO: 6892374 - DNA, 14 bp, Homo sapiens
aatgtaatactgga

SEQ ID NO: 6892375 - DNA, 18 bp, Homo sapiens
aattatatgatatgcatg

SEQ ID NO: 6892376 - DNA, 17 bp, Homo sapiens
atttctcaatcagtgca

SEQ ID NO: 6892377 - DNA, 18 bp, Homo sapiens
acaccaggctgtgggcct

SEQ ID NO: 6892378 - DNA, 17 bp, Homo sapiens
ctcgtcctccccctgcc

SEQ ID NO: 6892379 - DNA, 18 bp, Homo sapiens
accctgtgaccctctcac

SEQ ID NO: 6892380 - DNA, 16 bp, Homo sapiens
tcactgtttgttttta

SEQ ID NO: 6892381 - DNA, 15 bp, Homo sapiens
cccagagccacacat

SEQ ID NO: 6892382 - DNA, 16 bp, Homo sapiens
caagccaatgtgaatt

SEQ ID NO: 6892383 - DNA, 13 bp, Homo sapiens
agtgtacagtctt

SEQ ID NO: 6892384 - DNA, 21 bp, Homo sapiens
tccctcccccccatgcactgt

SEQ ID NO: 6892385 - DNA, 16 bp, Homo sapiens
cgtcttcctcctcccc

SEQ ID NO: 6892386 - DNA, 16 bp, Homo sapiens
acttggttctgaagcc

SEQ ID NO: 6892387 - DNA, 17 bp, Homo sapiens
gtgttccccactgtatc

SEQ ID NO: 6892388 - DNA, 17 bp, Homo sapiens
catttcctgcccttcct

SEQ ID NO: 6892389 - DNA, 17 bp, Homo sapiens
gccctggtggcctgccc

SEQ ID NO: 6892390 - DNA, 19 bp, Homo sapiens
cactctcctgggcccctcc

SEQ ID NO: 6892391 - DNA, 21 bp, Homo sapiens
tagtcaaaactatttttgtaa

SEQ ID NO: 6892392 - DNA, 15 bp, Homo sapiens
ttcagtgcctgctgt

SEQ ID NO: 6892393 - DNA, 23 bp, Homo sapiens
ctgagcagagtcttgctacctca

SEQ ID NO: 6892394 - DNA, 20 bp, Homo sapiens
catctggcccaggctggccc

SEQ ID NO: 6892395 - DNA, 20 bp, Homo sapiens
gcctccggcgtcagcctcca

SEQ ID NO: 6892396 - DNA, 19 bp, Homo sapiens
acttcttaaatatctttta

SEQ ID NO: 6892397 - DNA, 22 bp, Homo sapiens
ttatggatcccaattcatttca

SEQ ID NO: 6892398 - DNA, 20 bp, Homo sapiens
ctggacagctttgctccgct

SEQ ID NO: 6892399 - DNA, 19 bp, Homo sapiens
ctgctgatcaatctgcagt

SEQ ID NO: 6892400 - DNA, 16 bp, Homo sapiens
cgtgccccacctcccc

SEQ ID NO: 6892401 - DNA, 16 bp, Homo sapiens
taatcgacctgcctcg

SEQ ID NO: 6892402 - DNA, 17 bp, Homo sapiens
ctttttcatccccttac

SEQ ID NO: 6892403 - DNA, 15 bp, Homo sapiens
ctcccagacctgcct

SEQ ID NO: 6892404 - DNA, 14 bp, Homo sapiens
cagtctccccttcc

SEQ ID NO: 6892405 - DNA, 23 bp, Homo sapiens
agatgagggtgtcggctgtgagg

SEQ ID NO: 6892406 - DNA, 13 bp, Homo sapiens
tgcagtggtgcat

SEQ ID NO: 6892407 - DNA, 17 bp, Homo sapiens
taaataaaatgtgtaca

SEQ ID NO: 6892408 - DNA, 17 bp, Homo sapiens
gttaggctagagacaga

SEQ ID NO: 6892409 - DNA, 13 bp, Homo sapiens
acctcccttccca

SEQ ID NO: 6892410 - DNA, 19 bp, Homo sapiens
cctctgctgcccccttccc

SEQ ID NO: 6892411 - DNA, 16 bp, Homo sapiens
gcatttactttgtttc

SEQ ID NO: 6892412 - DNA, 16 bp, Homo sapiens
gaaaattagactgtga

SEQ ID NO: 6892413 - DNA, 21 bp, Homo sapiens
cctgttgcgtgacactctcct

SEQ ID NO: 6892414 - DNA, 20 bp, Homo sapiens
tccaggaaggcagctgctct

SEQ ID NO: 6892415 - DNA, 13 bp, Homo sapiens
ctaagactcatcc

SEQ ID NO: 6892416 - DNA, 18 bp, Homo sapiens
accagcgcccccactcct

SEQ ID NO: 6892417 - DNA, 21 bp, Homo sapiens
cccagaccccgcagcacgcct

SEQ ID NO: 6892418 - DNA, 16 bp, Homo sapiens
cccagccccactgccc

SEQ ID NO: 6892419 - DNA, 15 bp, Homo sapiens
ttaaaaatctgccac

SEQ ID NO: 6892420 - DNA, 15 bp, Homo sapiens
tccgcccccagccta

SEQ ID NO: 6892421 - DNA, 11 bp, Homo sapiens
ggcctgtgagc

SEQ ID NO: 6892422 - DNA, 15 bp, Homo sapiens
tagcccccacccact

SEQ ID NO: 6892423 - DNA, 15 bp, Homo sapiens
gtaggttattttata

SEQ ID NO: 6892424 - DNA, 13 bp, Homo sapiens
gtgaatcttgtct

SEQ ID NO: 6892425 - DNA, 17 bp, Homo sapiens
gtccatccgactgcccc

SEQ ID NO: 6892426 - DNA, 23 bp, Homo sapiens
agcccttctccatggccctgcca

SEQ ID NO: 6892427 - DNA, 15 bp, Homo sapiens
tcacctacttcctcc

SEQ ID NO: 6892428 - DNA, 11 bp, Homo sapiens
cctcctgctgc

SEQ ID NO: 6892429 - DNA, 15 bp, Homo sapiens
cattgtcagagatgt

SEQ ID NO: 6892430 - DNA, 13 bp, Homo sapiens
aactataaagttt

SEQ ID NO: 6892431 - DNA, 20 bp, Homo sapiens
tgtaaatgtttaatatctga

SEQ ID NO: 6892432 - DNA, 15 bp, Homo sapiens
catttcacccctccc

SEQ ID NO: 6892433 - DNA, 14 bp, Homo sapiens
gttcctgactgttc

SEQ ID NO: 6892434 - DNA, 14 bp, Homo sapiens
acttataatttcca

SEQ ID NO: 6892435 - DNA, 21 bp, Homo sapiens
cactgcgaagaccctcttgcc

SEQ ID NO: 6892436 - DNA, 13 bp, Homo sapiens
attttcctcccca

SEQ ID NO: 6892437 - DNA, 14 bp, Homo sapiens
aagtggactgtatt

SEQ ID NO: 6892438 - DNA, 17 bp, Homo sapiens
atttcctttatactgtg

SEQ ID NO: 6892439 - DNA, 15 bp, Homo sapiens
cctctgctaaattga

SEQ ID NO: 6892440 - DNA, 18 bp, Homo sapiens
ctgtgggtgtctccctcg

SEQ ID NO: 6892441 - DNA, 21 bp, Homo sapiens
caacgttcgatttctacctca

SEQ ID NO: 6892442 - DNA, 23 bp, Homo sapiens
tgccacggcagccaccctgccat

SEQ ID NO: 6892443 - DNA, 22 bp, Homo sapiens
gccgctccccttggacctccag

SEQ ID NO: 6892444 - DNA, 19 bp, Homo sapiens
tcaagtttttcatactgta

SEQ ID NO: 6892445 - DNA, 19 bp, Homo sapiens
cagtgtgccaccctctgca

SEQ ID NO: 6892446 - DNA, 20 bp, Homo sapiens
agaattgtctttctgtctct

SEQ ID NO: 6892447 - DNA, 18 bp, Homo sapiens
tgttcaagtttgctgcaa

SEQ ID NO: 6892448 - DNA, 13 bp, Homo sapiens
cactactacctct

SEQ ID NO: 6892449 - DNA, 11 bp, Homo sapiens
agacagtttgt

SEQ ID NO: 6892450 - DNA, 22 bp, Homo sapiens
atttcccctctgtgtcctctcc

SEQ ID NO: 6892451 - DNA, 17 bp, Homo sapiens
cccaacttccctgttct

SEQ ID NO: 6892452 - DNA, 14 bp, Homo sapiens
cagccttgctgacc

SEQ ID NO: 6892453 - DNA, 16 bp, Homo sapiens
aggcccagcctctgcc

SEQ ID NO: 6892454 - DNA, 14 bp, Homo sapiens
ccttcagtgcctta

SEQ ID NO: 6892455 - DNA, 21 bp, Homo sapiens
ctcttgcccgcacccctccct

SEQ ID NO: 6892456 - DNA, 21 bp, Homo sapiens
tcagactttggaaaatgcatt

SEQ ID NO: 6892457 - DNA, 12 bp, Homo sapiens
gaggctgtgagc

SEQ ID NO: 6892458 - DNA, 19 bp, Homo sapiens
cttcctcctccctcctgcc

SEQ ID NO: 6892459 - DNA, 20 bp, Homo sapiens
aagacattttcatgcttcca

SEQ ID NO: 6892460 - DNA, 22 bp, Homo sapiens
gacacatgctgaggttttgaat

SEQ ID NO: 6892461 - DNA, 18 bp, Homo sapiens
ataagccagtgttgccta

SEQ ID NO: 6892462 - DNA, 15 bp, Homo sapiens
gccattttcttgcct

SEQ ID NO: 6892463 - DNA, 12 bp, Homo sapiens
ggaagggccagt

SEQ ID NO: 6892464 - DNA, 17 bp, Homo sapiens
gaaccagtcctgctgcc

SEQ ID NO: 6892465 - DNA, 22 bp, Homo sapiens
cctttcctctaactcactgcct

SEQ ID NO: 6892466 - DNA, 21 bp, Homo sapiens
ttaatctatttagtatctgta

SEQ ID NO: 6892467 - DNA, 20 bp, Homo sapiens
ccagtcccagcagccagcca

SEQ ID NO: 6892468 - DNA, 13 bp, Homo sapiens
gcagacacacaac

SEQ ID NO: 6892469 - DNA, 15 bp, Homo sapiens
cctatgaccctgtgc

SEQ ID NO: 6892470 - DNA, 14 bp, Homo sapiens
ccaaagcaggtcag

SEQ ID NO: 6892471 - DNA, 16 bp, Homo sapiens
agaaaaattgtttcca

SEQ ID NO: 6892472 - DNA, 12 bp, Homo sapiens
gttgttgcattc

SEQ ID NO: 6892473 - DNA, 17 bp, Homo sapiens
ctagcggagcccagcct

SEQ ID NO: 6892474 - DNA, 13 bp, Homo sapiens
agggggccagctg

SEQ ID NO: 6892475 - DNA, 17 bp, Homo sapiens
tgactgacggctgtgta

SEQ ID NO: 6892476 - DNA, 17 bp, Homo sapiens
tatcacaatgtactata

SEQ ID NO: 6892477 - DNA, 13 bp, Homo sapiens
agcccagtagcca

SEQ ID NO: 6892478 - DNA, 15 bp, Homo sapiens
ctcctccgtctgacc

SEQ ID NO: 6892479 - DNA, 16 bp, Homo sapiens
ctgtaataatacctca

SEQ ID NO: 6892480 - DNA, 23 bp, Homo sapiens
gtatccgactctaagctgtgtgc

SEQ ID NO: 6892481 - DNA, 16 bp, Homo sapiens
tcatgcacacaattag

SEQ ID NO: 6892482 - DNA, 16 bp, Homo sapiens
cttctttattgcacta

SEQ ID NO: 6892483 - DNA, 20 bp, Homo sapiens
cctggaccattcctgtccct

SEQ ID NO: 6892484 - DNA, 20 bp, Homo sapiens
ttgtgcatgtatattactga

SEQ ID NO: 6892485 - DNA, 16 bp, Homo sapiens
acaacttggcatttct

SEQ ID NO: 6892486 - DNA, 14 bp, Homo sapiens
ctttgcaccaaaga

SEQ ID NO: 6892487 - DNA, 17 bp, Homo sapiens
aagcaattttccttgaa

SEQ ID NO: 6892488 - DNA, 15 bp, Homo sapiens
ccacgactgtctcca

SEQ ID NO: 6892489 - DNA, 15 bp, Homo sapiens
taatgactgagattt

SEQ ID NO: 6892490 - DNA, 14 bp, Homo sapiens
tggagactgcttcc

SEQ ID NO: 6892491 - DNA, 14 bp, Homo sapiens
tgtcccctcttgcc

SEQ ID NO: 6892492 - DNA, 21 bp, Homo sapiens
cttcccttgctaccacggcct

SEQ ID NO: 6892493 - DNA, 17 bp, Homo sapiens
aaatcttgtcatgtgta

SEQ ID NO: 6892494 - DNA, 14 bp, Homo sapiens
ctcctgctctgctt

SEQ ID NO: 6892495 - DNA, 23 bp, Homo sapiens
accctccctccgatccttcctcc

SEQ ID NO: 6892496 - DNA, 12 bp, Homo sapiens
cattttaatgta

SEQ ID NO: 6892497 - DNA, 21 bp, Homo sapiens
cccccaaaggcatcccagcct

SEQ ID NO: 6892498 - DNA, 23 bp, Homo sapiens
catatggattttctattgttact

SEQ ID NO: 6892499 - DNA, 21 bp, Homo sapiens
ttgtccatgcctacagataat

SEQ ID NO: 6892500 - DNA, 21 bp, Homo sapiens
ctgttttggtcccctccctcg

SEQ ID NO: 6892501 - DNA, 17 bp, Homo sapiens
aacatgtgcccctgcca

SEQ ID NO: 6892502 - DNA, 18 bp, Homo sapiens
atcctggagcccctgtgt

SEQ ID NO: 6892503 - DNA, 14 bp, Homo sapiens
ccattcgtctgtcc

SEQ ID NO: 6892504 - DNA, 19 bp, Homo sapiens
ggcattgtccctgtgccta

SEQ ID NO: 6892505 - DNA, 21 bp, Homo sapiens
cagcttgtttacatgcttatt

SEQ ID NO: 6892506 - DNA, 17 bp, Homo sapiens
aattttaaacaaaggtt

SEQ ID NO: 6892507 - DNA, 21 bp, Homo sapiens
gctcttgaactcctgacctca

SEQ ID NO: 6892508 - DNA, 13 bp, Homo sapiens
agactctgtctca

SEQ ID NO: 6892509 - DNA, 17 bp, Homo sapiens
ttgacaaaatatataat

SEQ ID NO: 6892510 - DNA, 12 bp, Homo sapiens
acaccctccact

SEQ ID NO: 6892511 - DNA, 18 bp, Homo sapiens
cactaaggccgtgtctct

SEQ ID NO: 6892512 - DNA, 18 bp, Homo sapiens
tccataaagaagcaataa

SEQ ID NO: 6892513 - DNA, 16 bp, Homo sapiens
cacgtttggccagtga

SEQ ID NO: 6892514 - DNA, 15 bp, Homo sapiens
accctgtttacggta

SEQ ID NO: 6892515 - DNA, 12 bp, Homo sapiens
acaagctaggaa

SEQ ID NO: 6892516 - DNA, 19 bp, Homo sapiens
tcccacccacacagctgcc

SEQ ID NO: 6892517 - DNA, 18 bp, Homo sapiens
tgaagacatttctgctct

SEQ ID NO: 6892518 - DNA, 18 bp, Homo sapiens
ctctccgccccccggcct

SEQ ID NO: 6892519 - DNA, 12 bp, Homo sapiens
aattcagtgcct

SEQ ID NO: 6892520 - DNA, 11 bp, Homo sapiens
agcctgtctct

SEQ ID NO: 6892521 - DNA, 19 bp, Homo sapiens
agcctgagggaaaggccag

SEQ ID NO: 6892522 - DNA, 16 bp, Homo sapiens
gcagaaaaatttagct

SEQ ID NO: 6892523 - DNA, 19 bp, Homo sapiens
tcccgcttcctggcctccc

SEQ ID NO: 6892524 - DNA, 21 bp, Homo sapiens
gtttgaaaatattatctttgt

SEQ ID NO: 6892525 - DNA, 19 bp, Homo sapiens
tactcagggttcatctgtc

SEQ ID NO: 6892526 - DNA, 18 bp, Homo sapiens
tgctgccatgccactgcc

SEQ ID NO: 6892527 - DNA, 20 bp, Homo sapiens
tggtgaagtgtggctggtgt

SEQ ID NO: 6892528 - DNA, 22 bp, Homo sapiens
ctgacttagaatccctgtgtta

SEQ ID NO: 6892529 - DNA, 18 bp, Homo sapiens
atcttgtttgttactgtc

SEQ ID NO: 6892530 - DNA, 17 bp, Homo sapiens
cactttaaccctctctt

SEQ ID NO: 6892531 - DNA, 22 bp, Homo sapiens
cctgcctgagggcccctctgcc

SEQ ID NO: 6892532 - DNA, 15 bp, Homo sapiens
aaaatgtgatatgta

SEQ ID NO: 6892533 - DNA, 19 bp, Homo sapiens
gcttaaagtgaaggaaata

SEQ ID NO: 6892534 - DNA, 22 bp, Homo sapiens
atcactgcattcattctgagcc

SEQ ID NO: 6892535 - DNA, 17 bp, Homo sapiens
ccactagccctctttct

SEQ ID NO: 6892536 - DNA, 17 bp, Homo sapiens
ctgctcagattcccccc

SEQ ID NO: 6892537 - DNA, 23 bp, Homo sapiens
agagctttgtgcttgtcattcca

SEQ ID NO: 6892538 - DNA, 13 bp, Homo sapiens
ctgtctccttccc

SEQ ID NO: 6892539 - DNA, 18 bp, Homo sapiens
gatctgctcagccctgga

SEQ ID NO: 6892540 - DNA, 18 bp, Homo sapiens
aatgtccaaatactctga

SEQ ID NO: 6892541 - DNA, 17 bp, Homo sapiens
cactgcctctatgccct

SEQ ID NO: 6892542 - DNA, 20 bp, Homo sapiens
aatgccacattttgctttat

SEQ ID NO: 6892543 - DNA, 18 bp, Homo sapiens
agcgaggtcaacagagaa

SEQ ID NO: 6892544 - DNA, 17 bp, Homo sapiens
ctctggcttccctgccc

SEQ ID NO: 6892545 - DNA, 21 bp, Homo sapiens
ctccacgcaaggctgtgctct

SEQ ID NO: 6892546 - DNA, 20 bp, Homo sapiens
gaatcttttataatgattca

SEQ ID NO: 6892547 - DNA, 12 bp, Homo sapiens
acctatccacaa

SEQ ID NO: 6892548 - DNA, 22 bp, Homo sapiens
atcataggcaccttttactgtg

SEQ ID NO: 6892549 - DNA, 14 bp, Homo sapiens
ctcacttttctcca

SEQ ID NO: 6892550 - DNA, 18 bp, Homo sapiens
gtattgaagcattttata

SEQ ID NO: 6892551 - DNA, 16 bp, Homo sapiens
ctattccttctggcct

SEQ ID NO: 6892552 - DNA, 20 bp, Homo sapiens
cagtgccctctggacagctt

SEQ ID NO: 6892553 - DNA, 14 bp, Homo sapiens
gtactactgtagaa

SEQ ID NO: 6892554 - DNA, 22 bp, Homo sapiens
gaagtaagcagagttctttgca

SEQ ID NO: 6892555 - DNA, 14 bp, Homo sapiens
gaacaaagctgtta

SEQ ID NO: 6892556 - DNA, 20 bp, Homo sapiens
tatatgaagcaagctgtgtt

SEQ ID NO: 6892557 - DNA, 20 bp, Homo sapiens
taacatctttacgtactgta

SEQ ID NO: 6892558 - DNA, 23 bp, Homo sapiens
gcggcccaagcccgacttgctgt

SEQ ID NO: 6892559 - DNA, 20 bp, Homo sapiens
ttagatgctgaatatctgtt

SEQ ID NO: 6892560 - DNA, 20 bp, Homo sapiens
tgggggactgggagtcagag

SEQ ID NO: 6892561 - DNA, 19 bp, Homo sapiens
tacccccttgtctgctgct

SEQ ID NO: 6892562 - DNA, 12 bp, Homo sapiens
cgaaaacctgac

SEQ ID NO: 6892563 - DNA, 17 bp, Homo sapiens
cacccctgcctcctgcc

SEQ ID NO: 6892564 - DNA, 22 bp, Homo sapiens
aatgcaaatgaaggaatgcaat

SEQ ID NO: 6892565 - DNA, 14 bp, Homo sapiens
ccagagaacaatca

SEQ ID NO: 6892566 - DNA, 15 bp, Homo sapiens
ctgcagatagcccag

SEQ ID NO: 6892567 - DNA, 16 bp, Homo sapiens
agccagctctcagcca

SEQ ID NO: 6892568 - DNA, 14 bp, Homo sapiens
ctgttccctgctgg

SEQ ID NO: 6892569 - DNA, 15 bp, Homo sapiens
ttgaagccactgcct

SEQ ID NO: 6892570 - DNA, 15 bp, Homo sapiens
tagtttttgttctta

SEQ ID NO: 6892571 - DNA, 14 bp, Homo sapiens
cgcccacctctgct

SEQ ID NO: 6892572 - DNA, 16 bp, Homo sapiens
cagatctgcctgggcc

SEQ ID NO: 6892573 - DNA, 15 bp, Homo sapiens
ctcaacatttgtctg

SEQ ID NO: 6892574 - DNA, 20 bp, Homo sapiens
cattgtgactttgctttgag

SEQ ID NO: 6892575 - DNA, 18 bp, Homo sapiens
acgcatcccatctctccc

SEQ ID NO: 6892576 - DNA, 15 bp, Homo sapiens
actctttatttctag

SEQ ID NO: 6892577 - DNA, 21 bp, Homo sapiens
ccctgtgctgatcctgctgac

SEQ ID NO: 6892578 - DNA, 16 bp, Homo sapiens
tgtaatatatcctgtt

SEQ ID NO: 6892579 - DNA, 14 bp, Homo sapiens
gcttctcctctgct

SEQ ID NO: 6892580 - DNA, 21 bp, Homo sapiens
ctgccttgaagccactgaagc

SEQ ID NO: 6892581 - DNA, 12 bp, Homo sapiens
ttggcctgctgt

SEQ ID NO: 6892582 - DNA, 10 bp, Homo sapiens
ttctgcttct

SEQ ID NO: 6892583 - DNA, 13 bp, Homo sapiens
tcttcccctctgc

SEQ ID NO: 6892584 - DNA, 17 bp, Homo sapiens
ccttcagcccccagccc

SEQ ID NO: 6892585 - DNA, 17 bp, Homo sapiens
ctttcctttcctttcat

SEQ ID NO: 6892586 - DNA, 14 bp, Homo sapiens
cagctccctctgcc

SEQ ID NO: 6892587 - DNA, 15 bp, Homo sapiens
ttaataaatattgta

SEQ ID NO: 6892588 - DNA, 18 bp, Homo sapiens
tgcctccccaaccctgcc

SEQ ID NO: 6892589 - DNA, 21 bp, Homo sapiens
acctctgacgcaccactgcca

SEQ ID NO: 6892590 - DNA, 17 bp, Homo sapiens
aatggctaactgatgaa

SEQ ID NO: 6892591 - DNA, 23 bp, Homo sapiens
tcctgtgcccatcatctctgcct

SEQ ID NO: 6892592 - DNA, 21 bp, Homo sapiens
catcaccctcttcctgtgatc

SEQ ID NO: 6892593 - DNA, 13 bp, Homo sapiens
ttcttctccctca

SEQ ID NO: 6892594 - DNA, 21 bp, Homo sapiens
agccccggccactccctgcca

SEQ ID NO: 6892595 - DNA, 22 bp, Homo sapiens
ccaaggccctgcatctgtctgc

SEQ ID NO: 6892596 - DNA, 18 bp, Homo sapiens
cggacagcccatctgcct

SEQ ID NO: 6892597 - DNA, 18 bp, Homo sapiens
aattgcatgctgctttaa

SEQ ID NO: 6892598 - DNA, 17 bp, Homo sapiens
tcctgaaagggcactta

SEQ ID NO: 6892599 - DNA, 13 bp, Homo sapiens
attaacctctgca

SEQ ID NO: 6892600 - DNA, 15 bp, Homo sapiens
attgtttaatgcaaa

SEQ ID NO: 6892601 - DNA, 16 bp, Homo sapiens
cttataataaaggact

SEQ ID NO: 6892602 - DNA, 18 bp, Homo sapiens
gcagatggtactgctgag

SEQ ID NO: 6892603 - DNA, 18 bp, Homo sapiens
tattacttgcctatctga

SEQ ID NO: 6892604 - DNA, 17 bp, Homo sapiens
ctgggggactgctttca

SEQ ID NO: 6892605 - DNA, 23 bp, Homo sapiens
tctgggactgtgcctggctccct

SEQ ID NO: 6892606 - DNA, 14 bp, Homo sapiens
ccccgccccatcct

SEQ ID NO: 6892607 - DNA, 23 bp, Homo sapiens
cagatataactgtcttgtttcag

SEQ ID NO: 6892608 - DNA, 15 bp, Homo sapiens
gatattctttgttaa

SEQ ID NO: 6892609 - DNA, 11 bp, Homo sapiens
gcccctctgcg

SEQ ID NO: 6892610 - DNA, 21 bp, Homo sapiens
tacagctgggtggcactgcca

SEQ ID NO: 6892611 - DNA, 18 bp, Homo sapiens
ctttccggcacactgcca

SEQ ID NO: 6892612 - DNA, 23 bp, Homo sapiens
actttgtttcttttgcttaggaa

SEQ ID NO: 6892613 - DNA, 13 bp, Homo sapiens
ccttcctttcctc

SEQ ID NO: 6892614 - DNA, 19 bp, Homo sapiens
ccaggctctgctgacttct

SEQ ID NO: 6892615 - DNA, 23 bp, Homo sapiens
ttctgagttcttgaagcatttca

SEQ ID NO: 6892616 - DNA, 22 bp, Homo sapiens
tactattatctgtgcttttgag

SEQ ID NO: 6892617 - DNA, 14 bp, Homo sapiens
cagtgccattgtct

SEQ ID NO: 6892618 - DNA, 21 bp, Homo sapiens
actttctggactcccactctt

SEQ ID NO: 6892619 - DNA, 15 bp, Homo sapiens
tgccatgatagctgg

SEQ ID NO: 6892620 - DNA, 14 bp, Homo sapiens
agctggtctttgag

SEQ ID NO: 6892621 - DNA, 21 bp, Homo sapiens
gctgtcccatagtccctgcca

SEQ ID NO: 6892622 - DNA, 15 bp, Homo sapiens
cccaggtgcagccag

SEQ ID NO: 6892623 - DNA, 21 bp, Homo sapiens
ctgtgctgggtgagctcttcc

SEQ ID NO: 6892624 - DNA, 20 bp, Homo sapiens
atgttgggggggaccctgcc

SEQ ID NO: 6892625 - DNA, 18 bp, Homo sapiens
cccagatcgttctgccac

SEQ ID NO: 6892626 - DNA, 13 bp, Homo sapiens
cccctctgcttct

SEQ ID NO: 6892627 - DNA, 23 bp, Homo sapiens
cacaggggccccagatctgcctg

SEQ ID NO: 6892628 - DNA, 21 bp, Homo sapiens
tatgaatctgagagatgctgt

SEQ ID NO: 6892629 - DNA, 20 bp, Homo sapiens
tacactgcctgtatacttta

SEQ ID NO: 6892630 - DNA, 15 bp, Homo sapiens
cccttgcaccccttc

SEQ ID NO: 6892631 - DNA, 18 bp, Homo sapiens
ccaaaaacaaagtgcaaa

SEQ ID NO: 6892632 - DNA, 18 bp, Homo sapiens
agggtccacgcctctgct

SEQ ID NO: 6892633 - DNA, 13 bp, Homo sapiens
gctgtcctgctgc

SEQ ID NO: 6892634 - DNA, 13 bp, Homo sapiens
gctgccctgctgt

SEQ ID NO: 6892635 - DNA, 13 bp, Homo sapiens
agatttggaagct

SEQ ID NO: 6892636 - DNA, 12 bp, Homo sapiens
cagctgctttga

SEQ ID NO: 6892637 - DNA, 18 bp, Homo sapiens
tcctatggaaacatttta

SEQ ID NO: 6892638 - DNA, 16 bp, Homo sapiens
tcaaaacactgtggaa

SEQ ID NO: 6892639 - DNA, 17 bp, Homo sapiens
actgaaagtggtttgaa

SEQ ID NO: 6892640 - DNA, 20 bp, Homo sapiens
agaggtccctgcttacctga

SEQ ID NO: 6892641 - DNA, 22 bp, Homo sapiens
tctgcttttccattctgggtgt

SEQ ID NO: 6892642 - DNA, 19 bp, Homo sapiens
tgcctcggctcctgctgca

SEQ ID NO: 6892643 - DNA, 14 bp, Homo sapiens
tcagcatctgtgat

SEQ ID NO: 6892644 - DNA, 18 bp, Homo sapiens
actatgtgtttttctcat

SEQ ID NO: 6892645 - DNA, 12 bp, Homo sapiens
ttgtctgcctcc

SEQ ID NO: 6892646 - DNA, 17 bp, Homo sapiens
ccctggcccctctccct

SEQ ID NO: 6892647 - DNA, 18 bp, Homo sapiens
cacttcaggtatacctca

SEQ ID NO: 6892648 - DNA, 13 bp, Homo sapiens
attggaaaggact

SEQ ID NO: 6892649 - DNA, 16 bp, Homo sapiens
tactaatatatctgta

SEQ ID NO: 6892650 - DNA, 22 bp, Homo sapiens
actggtgtaatctcaatgcaag

SEQ ID NO: 6892651 - DNA, 17 bp, Homo sapiens
ccagattcccaggccag

SEQ ID NO: 6892652 - DNA, 20 bp, Homo sapiens
actctcagagactcccagga

SEQ ID NO: 6892653 - DNA, 13 bp, Homo sapiens
aaaatgcatttaa

SEQ ID NO: 6892654 - DNA, 19 bp, Homo sapiens
cctgggctgtctgtcacca

SEQ ID NO: 6892655 - DNA, 14 bp, Homo sapiens
agtcttcacattta

SEQ ID NO: 6892656 - DNA, 13 bp, Homo sapiens
ctctctctttctc

SEQ ID NO: 6892657 - DNA, 22 bp, Homo sapiens
aactctggccttggttcctcca

SEQ ID NO: 6892658 - DNA, 18 bp, Homo sapiens
actgctcacgtctctgcc

SEQ ID NO: 6892659 - DNA, 17 bp, Homo sapiens
caaacaagccccctgcc

SEQ ID NO: 6892660 - DNA, 17 bp, Homo sapiens
tccagtgacctctctct

SEQ ID NO: 6892661 - DNA, 12 bp, Homo sapiens
gttgtgccaaat

SEQ ID NO: 6892662 - DNA, 18 bp, Homo sapiens
tgaatgttctgacattaa

SEQ ID NO: 6892663 - DNA, 14 bp, Homo sapiens
acagcaaagccata

SEQ ID NO: 6892664 - DNA, 14 bp, Homo sapiens
caacctgaaattta

SEQ ID NO: 6892665 - DNA, 21 bp, Homo sapiens
cattgctacctcagtgctcct

SEQ ID NO: 6892666 - DNA, 21 bp, Homo sapiens
gctgataaaagatacatttgt

SEQ ID NO: 6892667 - DNA, 16 bp, Homo sapiens
cagggctcacagggca

SEQ ID NO: 6892668 - DNA, 14 bp, Homo sapiens
aatgccaagtgcct

SEQ ID NO: 6892669 - DNA, 23 bp, Homo sapiens
gctcctggtggccttctgctgcc

SEQ ID NO: 6892670 - DNA, 19 bp, Homo sapiens
tataatgtgtgtatgtgta

SEQ ID NO: 6892671 - DNA, 16 bp, Homo sapiens
ctccggggtctgtgct

SEQ ID NO: 6892672 - DNA, 17 bp, Homo sapiens
catctttaaacagtatt

SEQ ID NO: 6892673 - DNA, 15 bp, Homo sapiens
tcgctcccctctgcc

SEQ ID NO: 6892674 - DNA, 12 bp, Homo sapiens
tcctcagctccc

SEQ ID NO: 6892675 - DNA, 18 bp, Homo sapiens
ccagggccctcccagccc

SEQ ID NO: 6892676 - DNA, 19 bp, Homo sapiens
cagtgccattgtctttata

SEQ ID NO: 6892677 - DNA, 23 bp, Homo sapiens
tctctattttacttttctgccaa

SEQ ID NO: 6892678 - DNA, 18 bp, Homo sapiens
tacttgaaaccagtattt

SEQ ID NO: 6892679 - DNA, 19 bp, Homo sapiens
cttatgagcgtcactgccc

SEQ ID NO: 6892680 - DNA, 15 bp, Homo sapiens
agaactcctacctga

SEQ ID NO: 6892681 - DNA, 18 bp, Homo sapiens
atataaaataaatatact

SEQ ID NO: 6892682 - DNA, 17 bp, Homo sapiens
aactcgaagcccttcca

SEQ ID NO: 6892683 - DNA, 16 bp, Homo sapiens
cactcagaactctcca

SEQ ID NO: 6892684 - DNA, 11 bp, Homo sapiens
gggcccagagc

SEQ ID NO: 6892685 - DNA, 12 bp, Homo sapiens
cacccccagcct

SEQ ID NO: 6892686 - DNA, 14 bp, Homo sapiens
tggcagctgtcccc

SEQ ID NO: 6892687 - DNA, 22 bp, Homo sapiens
cagagctagggctgctgcttct

SEQ ID NO: 6892688 - DNA, 16 bp, Homo sapiens
cagacccttcttgcct

SEQ ID NO: 6892689 - DNA, 15 bp, Homo sapiens
gaacttcatctgcca

SEQ ID NO: 6892690 - DNA, 13 bp, Homo sapiens
cagacccctgcct

SEQ ID NO: 6892691 - DNA, 15 bp, Homo sapiens
gctgtgacctgctga

SEQ ID NO: 6892692 - DNA, 23 bp, Homo sapiens
ctcccaacctcaatgccctgcca

SEQ ID NO: 6892693 - DNA, 21 bp, Homo sapiens
aaactgatgcgaaaacttgaa

SEQ ID NO: 6892694 - DNA, 19 bp, Homo sapiens
cactgcacataatttgcat

SEQ ID NO: 6892695 - DNA, 16 bp, Homo sapiens
ctagttgctcttgctt

SEQ ID NO: 6892696 - DNA, 21 bp, Homo sapiens
tgaatcactgtttttagacac

SEQ ID NO: 6892697 - DNA, 13 bp, Homo sapiens
tgcctgcagctga

SEQ ID NO: 6892698 - DNA, 15 bp, Homo sapiens
cactgaacatgccta

SEQ ID NO: 6892699 - DNA, 13 bp, Homo sapiens
ctccataatgcca

SEQ ID NO: 6892700 - DNA, 11 bp, Homo sapiens
ccgctgtctct

SEQ ID NO: 6892701 - DNA, 23 bp, Homo sapiens
caggatggtgttactgcagttga

SEQ ID NO: 6892702 - DNA, 18 bp, Homo sapiens
ccctgccctcctctccct

SEQ ID NO: 6892703 - DNA, 22 bp, Homo sapiens
ctcaggtggtgtccttcttcct

SEQ ID NO: 6892704 - DNA, 15 bp, Homo sapiens
ataaactagtttcca

SEQ ID NO: 6892705 - DNA, 16 bp, Homo sapiens
gaaaaatctgaatttc

SEQ ID NO: 6892706 - DNA, 23 bp, Homo sapiens
gagtctcattctgttgcccaggc

SEQ ID NO: 6892707 - DNA, 14 bp, Homo sapiens
aattgcctacaata

SEQ ID NO: 6892708 - DNA, 19 bp, Homo sapiens
attttcttgaggaaaatat

SEQ ID NO: 6892709 - DNA, 13 bp, Homo sapiens
aatgctctgtgcc

SEQ ID NO: 6892710 - DNA, 19 bp, Homo sapiens
acctcagctgcacattcct

SEQ ID NO: 6892711 - DNA, 19 bp, Homo sapiens
cttcttccccaaggcactg

SEQ ID NO: 6892712 - DNA, 19 bp, Homo sapiens
cttcccgctcagccctccc

SEQ ID NO: 6892713 - DNA, 15 bp, Homo sapiens
ggcagtggctgtgaa

SEQ ID NO: 6892714 - DNA, 17 bp, Homo sapiens
ctaatacagctgagcta

SEQ ID NO: 6892715 - DNA, 15 bp, Homo sapiens
cagaataaagcaatt

SEQ ID NO: 6892716 - DNA, 21 bp, Homo sapiens
gcccccaataaaggcagctgc

SEQ ID NO: 6892717 - DNA, 15 bp, Homo sapiens
ttatataattatgtt

SEQ ID NO: 6892718 - DNA, 16 bp, Homo sapiens
ctgttcagctccagct

SEQ ID NO: 6892719 - DNA, 16 bp, Homo sapiens
ttgtagagcacattta

SEQ ID NO: 6892720 - DNA, 20 bp, Homo sapiens
catactggcctcgcctggcc

SEQ ID NO: 6892721 - DNA, 14 bp, Homo sapiens
agtgtgaaatctca

SEQ ID NO: 6892722 - DNA, 21 bp, Homo sapiens
cctgaggagggccctgaggaa

SEQ ID NO: 6892723 - DNA, 18 bp, Homo sapiens
tctgcttttaccatgccc

SEQ ID NO: 6892724 - DNA, 19 bp, Homo sapiens
gacaaggaaccaccgaaga

SEQ ID NO: 6892725 - DNA, 13 bp, Homo sapiens
gcccccctctgcc

SEQ ID NO: 6892726 - DNA, 13 bp, Homo sapiens
tcccacagcctcc

SEQ ID NO: 6892727 - DNA, 14 bp, Homo sapiens
ccacagtgctgctt

SEQ ID NO: 6892728 - DNA, 22 bp, Homo sapiens
ccctgcatgcctggcccctcct

SEQ ID NO: 6892729 - DNA, 23 bp, Homo sapiens
cactccatgcttagtcactgcct

SEQ ID NO: 6892730 - DNA, 14 bp, Homo sapiens
cgcgcccctctgcg

SEQ ID NO: 6892731 - DNA, 19 bp, Homo sapiens
catttgcagagtcctgcac

SEQ ID NO: 6892732 - DNA, 18 bp, Homo sapiens
catcttcccgcctcagcc

SEQ ID NO: 6892733 - DNA, 19 bp, Homo sapiens
cagagagtacactgtgtct

SEQ ID NO: 6892734 - DNA, 15 bp, Homo sapiens
atcaacttgcttatc

SEQ ID NO: 6892735 - DNA, 22 bp, Homo sapiens
aacttagcttttgatgtctcca

SEQ ID NO: 6892736 - DNA, 17 bp, Homo sapiens
tccagcagcacacctca

SEQ ID NO: 6892737 - DNA, 15 bp, Homo sapiens
ctccattcactccca

SEQ ID NO: 6892738 - DNA, 21 bp, Homo sapiens
cactgtctgtacctaaagcaa

SEQ ID NO: 6892739 - DNA, 18 bp, Homo sapiens
cctccctctttcccaccc

SEQ ID NO: 6892740 - DNA, 20 bp, Homo sapiens
gcctgcttttcactgctgca

SEQ ID NO: 6892741 - DNA, 19 bp, Homo sapiens
catgcgtgtgtcagggatg

SEQ ID NO: 6892742 - DNA, 22 bp, Homo sapiens
ctctcatcagtgtcctcttgct

SEQ ID NO: 6892743 - DNA, 16 bp, Homo sapiens
aacattttatactgta

SEQ ID NO: 6892744 - DNA, 12 bp, Homo sapiens
gccttcatgcca

SEQ ID NO: 6892745 - DNA, 15 bp, Homo sapiens
aggatgagacccagc

SEQ ID NO: 6892746 - DNA, 17 bp, Homo sapiens
gcaattctcctgcctca

SEQ ID NO: 6892747 - DNA, 15 bp, Homo sapiens
ttccgtcacccttgg

SEQ ID NO: 6892748 - DNA, 16 bp, Homo sapiens
agaccattgtcttcca

SEQ ID NO: 6892749 - DNA, 18 bp, Homo sapiens
cctagcccctcacttcca

SEQ ID NO: 6892750 - DNA, 23 bp, Homo sapiens
gcttcctgagcagtccctgctta

SEQ ID NO: 6892751 - DNA, 22 bp, Homo sapiens
acctattctgaaaaagacataa

SEQ ID NO: 6892752 - DNA, 20 bp, Homo sapiens
cagaagatgccagcttctct

SEQ ID NO: 6892753 - DNA, 19 bp, Homo sapiens
ctctgctatttctcttgct

SEQ ID NO: 6892754 - DNA, 15 bp, Homo sapiens
gctttctgttccaaa

SEQ ID NO: 6892755 - DNA, 15 bp, Homo sapiens
agctcctggccagga

SEQ ID NO: 6892756 - DNA, 12 bp, Homo sapiens
taccagctgctg

SEQ ID NO: 6892757 - DNA, 12 bp, Homo sapiens
atacagctggct

SEQ ID NO: 6892758 - DNA, 22 bp, Homo sapiens
cagacagaacttgaatgtgtca

SEQ ID NO: 6892759 - DNA, 19 bp, Homo sapiens
tgctcacccgcctcttgcc

SEQ ID NO: 6892760 - DNA, 15 bp, Homo sapiens
agaaattgtgccaaa

SEQ ID NO: 6892761 - DNA, 12 bp, Homo sapiens
cttccctctgct

SEQ ID NO: 6892762 - DNA, 16 bp, Homo sapiens
aatttcaagtcttcct

SEQ ID NO: 6892763 - DNA, 16 bp, Homo sapiens
ctccacgccctgggga

SEQ ID NO: 6892764 - DNA, 15 bp, Homo sapiens
tgccatctctgctcc

SEQ ID NO: 6892765 - DNA, 13 bp, Homo sapiens
cttccctctgcct

SEQ ID NO: 6892766 - DNA, 22 bp, Homo sapiens
gcacatcagcacgatttctgtt

SEQ ID NO: 6892767 - DNA, 17 bp, Homo sapiens
tgcccaatcctccctgg

SEQ ID NO: 6892768 - DNA, 19 bp, Homo sapiens
tgggcttccatttgtgtgt

SEQ ID NO: 6892769 - DNA, 20 bp, Homo sapiens
caagcttctgccttctggaa

SEQ ID NO: 6892770 - DNA, 20 bp, Homo sapiens
cagttcaaagtgtatattta

SEQ ID NO: 6892771 - DNA, 20 bp, Homo sapiens
tccgtagctcccctggctgg

SEQ ID NO: 6892772 - DNA, 19 bp, Homo sapiens
ccctgtcccacccccttcc

SEQ ID NO: 6892773 - DNA, 17 bp, Homo sapiens
ttctgcatttagctgta

SEQ ID NO: 6892774 - DNA, 19 bp, Homo sapiens
caacaacctcaactgccta

SEQ ID NO: 6892775 - DNA, 18 bp, Homo sapiens
cagggaagcccagctcca

SEQ ID NO: 6892776 - DNA, 16 bp, Homo sapiens
caccctagccctctcc

SEQ ID NO: 6892777 - DNA, 12 bp, Homo sapiens
gttacctgttcc

SEQ ID NO: 6892778 - DNA, 15 bp, Homo sapiens
aataaagtctgagtg

SEQ ID NO: 6892779 - DNA, 13 bp, Homo sapiens
acgtctctctgcc

SEQ ID NO: 6892780 - DNA, 16 bp, Homo sapiens
tgcttaattcaaataa

SEQ ID NO: 6892781 - DNA, 19 bp, Homo sapiens
ccctgcatctgtctgctct

SEQ ID NO: 6892782 - DNA, 21 bp, Homo sapiens
tgggtcatgtgcatctggtgt

SEQ ID NO: 6892783 - DNA, 19 bp, Homo sapiens
cccggcgcctgccctgccc

SEQ ID NO: 6892784 - DNA, 15 bp, Homo sapiens
aactttgtcacttct

SEQ ID NO: 6892785 - DNA, 12 bp, Homo sapiens
agaatacttgaa

SEQ ID NO: 6892786 - DNA, 13 bp, Homo sapiens
acagccagcacct

SEQ ID NO: 6892787 - DNA, 18 bp, Homo sapiens
aggttggaagctagctcc

SEQ ID NO: 6892788 - DNA, 13 bp, Homo sapiens
atgctcctctgcc

SEQ ID NO: 6892789 - DNA, 14 bp, Homo sapiens
tcctggagatttca

SEQ ID NO: 6892790 - DNA, 14 bp, Homo sapiens
cagggaaatgtgta

SEQ ID NO: 6892791 - DNA, 17 bp, Homo sapiens
ttatggaaaacatttca

SEQ ID NO: 6892792 - DNA, 18 bp, Homo sapiens
aatgtgagtcattatgta

SEQ ID NO: 6892793 - DNA, 15 bp, Homo sapiens
caaatgcaatgtgaa

SEQ ID NO: 6892794 - DNA, 16 bp, Homo sapiens
cccacgtctctctgcc

SEQ ID NO: 6892795 - DNA, 22 bp, Homo sapiens
cctctttgttcttcctgtctcc

SEQ ID NO: 6892796 - DNA, 21 bp, Homo sapiens
cattaatggcatatggtccta

SEQ ID NO: 6892797 - DNA, 15 bp, Homo sapiens
ccgaaatgctgtctt

SEQ ID NO: 6892798 - DNA, 23 bp, Homo sapiens
agtttgaaagttgtacatgataa

SEQ ID NO: 6892799 - DNA, 15 bp, Homo sapiens
atttgcaacatttac

SEQ ID NO: 6892800 - DNA, 14 bp, Homo sapiens
ctgtcctcactgct

SEQ ID NO: 6892801 - DNA, 12 bp, Homo sapiens
atccccctgccc

SEQ ID NO: 6892802 - DNA, 21 bp, Homo sapiens
gcactggaggggcccacccac

SEQ ID NO: 6892803 - DNA, 13 bp, Homo sapiens
ctctcagctgctg

SEQ ID NO: 6892804 - DNA, 21 bp, Homo sapiens
gccacctcccactcctgctgc

SEQ ID NO: 6892805 - DNA, 17 bp, Homo sapiens
acatgccaccctctcca

SEQ ID NO: 6892806 - DNA, 20 bp, Homo sapiens
accaaggaaacgctacctct

SEQ ID NO: 6892807 - DNA, 18 bp, Homo sapiens
cagccctcaattgtgaaa

SEQ ID NO: 6892808 - DNA, 21 bp, Homo sapiens
gaggataccccaaagtccagg

SEQ ID NO: 6892809 - DNA, 15 bp, Homo sapiens
tcccaccctcctgcc

SEQ ID NO: 6892810 - DNA, 14 bp, Homo sapiens
taaagccagcctga

SEQ ID NO: 6892811 - DNA, 20 bp, Homo sapiens
ccatggttttggctctccca

SEQ ID NO: 6892812 - DNA, 17 bp, Homo sapiens
ctcagggggccagctgg

SEQ ID NO: 6892813 - DNA, 13 bp, Homo sapiens
aatgcaatgcaat

SEQ ID NO: 6892814 - DNA, 20 bp, Homo sapiens
gtcctgggaggctgcagcca

SEQ ID NO: 6892815 - DNA, 19 bp, Homo sapiens
ccatccactctaccctccc

SEQ ID NO: 6892816 - DNA, 23 bp, Homo sapiens
cttggtttgtggcgtctccctcg

SEQ ID NO: 6892817 - DNA, 15 bp, Homo sapiens
cccaccgccctgcct

SEQ ID NO: 6892818 - DNA, 17 bp, Homo sapiens
cagcctcagctcagcct

SEQ ID NO: 6892819 - DNA, 15 bp, Homo sapiens
acactgcaccctcca

SEQ ID NO: 6892820 - DNA, 14 bp, Homo sapiens
ataaaacctttcaa

SEQ ID NO: 6892821 - DNA, 16 bp, Homo sapiens
ccctgccctcactcca

SEQ ID NO: 6892822 - DNA, 18 bp, Homo sapiens
cacatgttttcaaatgga

SEQ ID NO: 6892823 - DNA, 22 bp, Homo sapiens
cattttcctcttgtcctggccc

SEQ ID NO: 6892824 - DNA, 12 bp, Homo sapiens
tggctcttgcct

SEQ ID NO: 6892825 - DNA, 22 bp, Homo sapiens
ccttcctcctgaagcctctgcc

SEQ ID NO: 6892826 - DNA, 15 bp, Homo sapiens
ataataaaatgcaaa

SEQ ID NO: 6892827 - DNA, 19 bp, Homo sapiens
cagaccagcaggctggcct

SEQ ID NO: 6892828 - DNA, 23 bp, Homo sapiens
actttgggcttagtatttctcag

SEQ ID NO: 6892829 - DNA, 18 bp, Homo sapiens
ccgcttgcctcggctcct

SEQ ID NO: 6892830 - DNA, 17 bp, Homo sapiens
gtaaggcagctctgtcg

SEQ ID NO: 6892831 - DNA, 19 bp, Homo sapiens
ccttggcctgtctcatccc

SEQ ID NO: 6892832 - DNA, 22 bp, Homo sapiens
ttacgtcttgagaaatactata

SEQ ID NO: 6892833 - DNA, 14 bp, Homo sapiens
gatacaatcagctg

SEQ ID NO: 6892834 - DNA, 15 bp, Homo sapiens
cccatcctccccttc

SEQ ID NO: 6892835 - DNA, 16 bp, Homo sapiens
ctccccaccctcctct

SEQ ID NO: 6892836 - DNA, 11 bp, Homo sapiens
cctcccatccc

SEQ ID NO: 6892837 - DNA, 11 bp, Homo sapiens
ctaacatttcc

SEQ ID NO: 6892838 - DNA, 13 bp, Homo sapiens
atatcatatgtat

SEQ ID NO: 6892839 - DNA, 14 bp, Homo sapiens
ttctacactctcct

SEQ ID NO: 6892840 - DNA, 20 bp, Homo sapiens
gcaaagagccagcaccctga

SEQ ID NO: 6892841 - DNA, 19 bp, Homo sapiens
cctatctggggagctcctg

SEQ ID NO: 6892842 - DNA, 19 bp, Homo sapiens
ctctcctgggcagctgcct

SEQ ID NO: 6892843 - DNA, 18 bp, Homo sapiens
cagaaataaaagtatgaa

SEQ ID NO: 6892844 - DNA, 21 bp, Homo sapiens
tctggcaggctactctgccca

SEQ ID NO: 6892845 - DNA, 16 bp, Homo sapiens
ccagcccctcccacca

SEQ ID NO: 6892846 - DNA, 19 bp, Homo sapiens
gcccttcctggactggccc

SEQ ID NO: 6892847 - DNA, 12 bp, Homo sapiens
aacagacatgta

SEQ ID NO: 6892848 - DNA, 15 bp, Homo sapiens
acgtcctgcctggca

SEQ ID NO: 6892849 - DNA, 17 bp, Homo sapiens
tgggccaccgccttgcc

SEQ ID NO: 6892850 - DNA, 19 bp, Homo sapiens
cccgtccctttccctgcat

SEQ ID NO: 6892851 - DNA, 23 bp, Homo sapiens
tgacatttttgataaattatgtt

SEQ ID NO: 6892852 - DNA, 16 bp, Homo sapiens
ctcctgccactgacct

SEQ ID NO: 6892853 - DNA, 13 bp, Homo sapiens
atcatctgcagtt

SEQ ID NO: 6892854 - DNA, 15 bp, Homo sapiens
cccggccccagccag

SEQ ID NO: 6892855 - DNA, 20 bp, Homo sapiens
ccttccgacaccactgggaa

SEQ ID NO: 6892856 - DNA, 16 bp, Homo sapiens
ccttaagaaagctata

SEQ ID NO: 6892857 - DNA, 13 bp, Homo sapiens
tgtcagactggct

SEQ ID NO: 6892858 - DNA, 14 bp, Homo sapiens
taatgaagctttat

SEQ ID NO: 6892859 - DNA, 21 bp, Homo sapiens
acatgctggtgaatattttca

SEQ ID NO: 6892860 - DNA, 14 bp, Homo sapiens
ttcattgcactttc

SEQ ID NO: 6892861 - DNA, 23 bp, Homo sapiens
ctcgccgtgtctcagcctctgcc

SEQ ID NO: 6892862 - DNA, 24 bp, Homo sapiens
ggggcgtgcgtgtaactgtagtgt

SEQ ID NO: 6892863 - DNA, 20 bp, Homo sapiens
acaggccctttcctcaggca

SEQ ID NO: 6892864 - DNA, 20 bp, Homo sapiens
ctgggtttgcccagtcctgg

SEQ ID NO: 6892865 - DNA, 22 bp, Homo sapiens
agtgtacctcctctcagtgttt

SEQ ID NO: 6892866 - DNA, 21 bp, Homo sapiens
ccttctgtcgtccccagacca

SEQ ID NO: 6892867 - DNA, 13 bp, Homo sapiens
gcctgccaccacg

SEQ ID NO: 6892868 - DNA, 15 bp, Homo sapiens
tcccgcccagcctca

SEQ ID NO: 6892869 - DNA, 14 bp, Homo sapiens
tcagaccctggagg

SEQ ID NO: 6892870 - DNA, 18 bp, Homo sapiens
ctctggggatttctggga

SEQ ID NO: 6892871 - DNA, 16 bp, Homo sapiens
actgtagtctcaggac

SEQ ID NO: 6892872 - DNA, 19 bp, Homo sapiens
gcaagagtgattgcagctt

SEQ ID NO: 6892873 - DNA, 21 bp, Homo sapiens
tattcatgctgcctgccatgt

SEQ ID NO: 6892874 - DNA, 19 bp, Homo sapiens
ccttataaaccaatcttaa

SEQ ID NO: 6892875 - DNA, 22 bp, Homo sapiens
gctccagcgatggtgctgccca

SEQ ID NO: 6892876 - DNA, 14 bp, Homo sapiens
gatatgctgcttta

SEQ ID NO: 6892877 - DNA, 11 bp, Homo sapiens
ctttggcactc

SEQ ID NO: 6892878 - DNA, 18 bp, Homo sapiens
tgtttgccaggacatgca

SEQ ID NO: 6892879 - DNA, 14 bp, Homo sapiens
ctgcaagtgctcag

SEQ ID NO: 6892880 - DNA, 10 bp, Homo sapiens
tttctgagcg

SEQ ID NO: 6892881 - DNA, 18 bp, Homo sapiens
gaaaaagcatgatgggaa

SEQ ID NO: 6892882 - DNA, 16 bp, Homo sapiens
cccttgaaccccctcc

SEQ ID NO: 6892883 - DNA, 19 bp, Homo sapiens
gcctccctctcctctgtcc

SEQ ID NO: 6892884 - DNA, 23 bp, Homo sapiens
cctccccgtagccactctctgcc

SEQ ID NO: 6892885 - DNA, 18 bp, Homo sapiens
actgttcccacctgctgg

SEQ ID NO: 6892886 - DNA, 19 bp, Homo sapiens
tggctgcagatgactggaa

SEQ ID NO: 6892887 - DNA, 20 bp, Homo sapiens
tcagccccgggcctgcctct

SEQ ID NO: 6892888 - DNA, 17 bp, Homo sapiens
cttgtcctggcccttca

SEQ ID NO: 6892889 - DNA, 19 bp, Homo sapiens
caccttcccttgccacttt

SEQ ID NO: 6892890 - DNA, 16 bp, Homo sapiens
ctgtggagctcagccc

SEQ ID NO: 6892891 - DNA, 17 bp, Homo sapiens
tgctcctccctggctgc

SEQ ID NO: 6892892 - DNA, 18 bp, Homo sapiens
cagtttcaattcagtgct

SEQ ID NO: 6892893 - DNA, 14 bp, Homo sapiens
ccctgcctggttct

SEQ ID NO: 6892894 - DNA, 14 bp, Homo sapiens
cccatctccctgct

SEQ ID NO: 6892895 - DNA, 16 bp, Homo sapiens
cagaggcccccagccc

SEQ ID NO: 6892896 - DNA, 19 bp, Homo sapiens
agacacatcgcactgtgga

SEQ ID NO: 6892897 - DNA, 19 bp, Homo sapiens
gacatctggaatctggaga

SEQ ID NO: 6892898 - DNA, 14 bp, Homo sapiens
aatctcctgctgat

SEQ ID NO: 6892899 - DNA, 21 bp, Homo sapiens
agacgtggaacctctgtctca

SEQ ID NO: 6892900 - DNA, 20 bp, Homo sapiens
caagcactgctcacgtctct

SEQ ID NO: 6892901 - DNA, 15 bp, Homo sapiens
ctcccttccacctca

SEQ ID NO: 6892902 - DNA, 15 bp, Homo sapiens
catctgtctgtccta

SEQ ID NO: 6892903 - DNA, 16 bp, Homo sapiens
ctaggaagagtctacc

SEQ ID NO: 6892904 - DNA, 19 bp, Homo sapiens
caccctaactcttgctcac

SEQ ID NO: 6892905 - DNA, 21 bp, Homo sapiens
cgaggcgggggagcctggagc

SEQ ID NO: 6892906 - DNA, 14 bp, Homo sapiens
ctcattgctgtctt

SEQ ID NO: 6892907 - DNA, 14 bp, Homo sapiens
cagatccccagccc

SEQ ID NO: 6892908 - DNA, 23 bp, Homo sapiens
ctcttgtacagttaactctccca

SEQ ID NO: 6892909 - DNA, 18 bp, Homo sapiens
gtccccatttctgcctcg

SEQ ID NO: 6892910 - DNA, 22 bp, Homo sapiens
caaaagtaatgcctctgtctag

SEQ ID NO: 6892911 - DNA, 15 bp, Homo sapiens
caaacaattctgatg

SEQ ID NO: 6892912 - DNA, 22 bp, Homo sapiens
acacgtatttgaatggccttca

SEQ ID NO: 6892913 - DNA, 14 bp, Homo sapiens
catcccccactgcc

SEQ ID NO: 6892914 - DNA, 21 bp, Homo sapiens
acactggatgtttctcatgta

SEQ ID NO: 6892915 - DNA, 23 bp, Homo sapiens
agtgcccggtgcagggcctggca

SEQ ID NO: 6892916 - DNA, 14 bp, Homo sapiens
cagaacagtatgaa

SEQ ID NO: 6892917 - DNA, 13 bp, Homo sapiens
tccgtccctctgt

SEQ ID NO: 6892918 - DNA, 22 bp, Homo sapiens
ctattctttgtattaccaaagc

SEQ ID NO: 6892919 - DNA, 13 bp, Homo sapiens
cagggctcagcct

SEQ ID NO: 6892920 - DNA, 14 bp, Homo sapiens
acctggcctctgca

SEQ ID NO: 6892921 - DNA, 19 bp, Homo sapiens
gcctctcctgccctctgct

SEQ ID NO: 6892922 - DNA, 17 bp, Homo sapiens
ctgctgcttctgggcct

SEQ ID NO: 6892923 - DNA, 14 bp, Homo sapiens
cacctccccttgcc

SEQ ID NO: 6892924 - DNA, 19 bp, Homo sapiens
ccatgcccccttcgctcct

SEQ ID NO: 6892925 - DNA, 18 bp, Homo sapiens
tcccattagctgaggttt

SEQ ID NO: 6892926 - DNA, 15 bp, Homo sapiens
agcgacctctctgcc

SEQ ID NO: 6892927 - DNA, 20 bp, Homo sapiens
aagttaagagaaactttata

SEQ ID NO: 6892928 - DNA, 17 bp, Homo sapiens
ctgccatcatgtttaca

SEQ ID NO: 6892929 - DNA, 16 bp, Homo sapiens
atccctctcctctgcc

SEQ ID NO: 6892930 - DNA, 21 bp, Homo sapiens
ggcggcccttctgactgttta

SEQ ID NO: 6892931 - DNA, 14 bp, Homo sapiens
cagcattccagccc

SEQ ID NO: 6892932 - DNA, 22 bp, Homo sapiens
ctcctgatggagtgtgcagaca

SEQ ID NO: 6892933 - DNA, 18 bp, Homo sapiens
ctccagctgtcagcctgg

SEQ ID NO: 6892934 - DNA, 22 bp, Homo sapiens
gtcagactgctgggactggcca

SEQ ID NO: 6892935 - DNA, 19 bp, Homo sapiens
tggcaagaggcctcatgcc

SEQ ID NO: 6892936 - DNA, 17 bp, Homo sapiens
agcttcaaccctcagcc

SEQ ID NO: 6892937 - DNA, 23 bp, Homo sapiens
acatgccctcggtcactgagtct

SEQ ID NO: 6892938 - DNA, 19 bp, Homo sapiens
tctagaaccacttcctgct

SEQ ID NO: 6892939 - DNA, 19 bp, Homo sapiens
ctttttccatatccctctt

SEQ ID NO: 6892940 - DNA, 13 bp, Homo sapiens
cctagatctgcag

SEQ ID NO: 6892941 - DNA, 18 bp, Homo sapiens
cctctttactcccttcct

SEQ ID NO: 6892942 - DNA, 19 bp, Homo sapiens
tgtcctaattcttctgtcc

SEQ ID NO: 6892943 - DNA, 19 bp, Homo sapiens
attggcctgtgtctggccc

SEQ ID NO: 6892944 - DNA, 19 bp, Homo sapiens
ctcttccctctcgctcccc

SEQ ID NO: 6892945 - DNA, 14 bp, Homo sapiens
gctgtgtctctgta

SEQ ID NO: 6892946 - DNA, 12 bp, Homo sapiens
ctttctccctca

SEQ ID NO: 6892947 - DNA, 21 bp, Homo sapiens
agccctggctctgcccctcag

SEQ ID NO: 6892948 - DNA, 22 bp, Homo sapiens
cacttctccccgcagcccgcct

SEQ ID NO: 6892949 - DNA, 20 bp, Homo sapiens
agacgggttgaaagacatca

SEQ ID NO: 6892950 - DNA, 22 bp, Homo sapiens
aagacagtgtacaaaactgtaa

SEQ ID NO: 6892951 - DNA, 21 bp, Homo sapiens
cagctccgacctctctcagcc

SEQ ID NO: 6892952 - DNA, 22 bp, Homo sapiens
cataaatttgttgtcatgtgta

SEQ ID NO: 6892953 - DNA, 13 bp, Homo sapiens
ttgaaatacctca

SEQ ID NO: 6892954 - DNA, 20 bp, Homo sapiens
gtcatttgctaatgaatttt

SEQ ID NO: 6892955 - DNA, 16 bp, Homo sapiens
agccattttgtgaatg

SEQ ID NO: 6892956 - DNA, 17 bp, Homo sapiens
aagctgcctgcttttca

SEQ ID NO: 6892957 - DNA, 16 bp, Homo sapiens
agcttcctctgagccg

SEQ ID NO: 6892958 - DNA, 20 bp, Homo sapiens
atccttagaggtcctctgga

SEQ ID NO: 6892959 - DNA, 22 bp, Homo sapiens
catcactatccatgcaccaaac

SEQ ID NO: 6892960 - DNA, 16 bp, Homo sapiens
cttcctgccactgccg

SEQ ID NO: 6892961 - DNA, 19 bp, Homo sapiens
ctataagtgttcagtgttg

SEQ ID NO: 6892962 - DNA, 13 bp, Homo sapiens
cttggcaccaaag

SEQ ID NO: 6892963 - DNA, 17 bp, Homo sapiens
cacctccacatcctcca

SEQ ID NO: 6892964 - DNA, 16 bp, Homo sapiens
tgtctgaaacatttca

SEQ ID NO: 6892965 - DNA, 16 bp, Homo sapiens
ccctgttcctgctgct

SEQ ID NO: 6892966 - DNA, 14 bp, Homo sapiens
gccaggctccctga

SEQ ID NO: 6892967 - DNA, 15 bp, Homo sapiens
ctggcagcaccgcct

SEQ ID NO: 6892968 - DNA, 18 bp, Homo sapiens
taaatttatcacattgaa

SEQ ID NO: 6892969 - DNA, 17 bp, Homo sapiens
ctcccgggttcacgcca

SEQ ID NO: 6892970 - DNA, 16 bp, Homo sapiens
ttcagttctgtgtaca

SEQ ID NO: 6892971 - DNA, 16 bp, Homo sapiens
caagaaggccactggt

SEQ ID NO: 6892972 - DNA, 18 bp, Homo sapiens
cccccgacagcccagcct

SEQ ID NO: 6892973 - DNA, 16 bp, Homo sapiens
tgcctggcctctgcct

SEQ ID NO: 6892974 - DNA, 20 bp, Homo sapiens
cattctattgccttctttga

SEQ ID NO: 6892975 - DNA, 23 bp, Homo sapiens
gttttgtacaaagttttcctttg

SEQ ID NO: 6892976 - DNA, 16 bp, Homo sapiens
aggcctgagacccagg

SEQ ID NO: 6892977 - DNA, 17 bp, Homo sapiens
tgctgcacccctggtgt

SEQ ID NO: 6892978 - DNA, 16 bp, Homo sapiens
aatcactgggcccaga

SEQ ID NO: 6892979 - DNA, 12 bp, Homo sapiens
tcaagcaaatat

SEQ ID NO: 6892980 - DNA, 18 bp, Homo sapiens
aaaagacctggcctttca

SEQ ID NO: 6892981 - DNA, 20 bp, Homo sapiens
ccctcaccctgagccccttc

SEQ ID NO: 6892982 - DNA, 19 bp, Homo sapiens
caaatttttacttgaagta

SEQ ID NO: 6892983 - DNA, 21 bp, Homo sapiens
tatcatcacgtatgttataca

SEQ ID NO: 6892984 - DNA, 21 bp, Homo sapiens
aggtgcttgggcttctgcggt

SEQ ID NO: 6892985 - DNA, 22 bp, Homo sapiens
cagtggatcttcagaactgccc

SEQ ID NO: 6892986 - DNA, 18 bp, Homo sapiens
tgactctggaaccatcct

SEQ ID NO: 6892987 - DNA, 22 bp, Homo sapiens
agagtgtgtttttgcactgtct

SEQ ID NO: 6892988 - DNA, 15 bp, Homo sapiens
ccactgcctctgcct

SEQ ID NO: 6892989 - DNA, 12 bp, Homo sapiens
tgtttcttgcct

SEQ ID NO: 6892990 - DNA, 18 bp, Homo sapiens
ccactccaagcccagccc

SEQ ID NO: 6892991 - DNA, 12 bp, Homo sapiens
cagcccccttcg

SEQ ID NO: 6892992 - DNA, 22 bp, Homo sapiens
cctcttcctctgaggctggatc

SEQ ID NO: 6892993 - DNA, 22 bp, Homo sapiens
gtttctttttacattcatatct

SEQ ID NO: 6892994 - DNA, 20 bp, Homo sapiens
aggtcacaacccttctctgt

SEQ ID NO: 6892995 - DNA, 13 bp, Homo sapiens
ttggttgctttaa

SEQ ID NO: 6892996 - DNA, 17 bp, Homo sapiens
tgcctcccagccctgcc

SEQ ID NO: 6892997 - DNA, 18 bp, Homo sapiens
cttcccagctctccctct

SEQ ID NO: 6892998 - DNA, 15 bp, Homo sapiens
tccctttacatatat

SEQ ID NO: 6892999 - DNA, 14 bp, Homo sapiens
ccctttccccttcc

SEQ ID NO: 6893000 - DNA, 19 bp, Homo sapiens
catcttcccgcctcagcct

SEQ ID NO: 6893001 - DNA, 18 bp, Homo sapiens
ccctgccccaccccatcc

SEQ ID NO: 6893002 - DNA, 12 bp, Homo sapiens
ccagatcaggaa

SEQ ID NO: 6893003 - DNA, 18 bp, Homo sapiens
ctctccgtgcaggcgatg

SEQ ID NO: 6893004 - DNA, 16 bp, Homo sapiens
ctgtccacatctgcct

SEQ ID NO: 6893005 - DNA, 21 bp, Homo sapiens
cattatgtgtgcatgtgtgta

SEQ ID NO: 6893006 - DNA, 16 bp, Homo sapiens
catctggagtcttcct

SEQ ID NO: 6893007 - DNA, 13 bp, Homo sapiens
ccatgtcacctca

SEQ ID NO: 6893008 - DNA, 18 bp, Homo sapiens
gagagctcttagttttta

SEQ ID NO: 6893009 - DNA, 13 bp, Homo sapiens
tataatgtgtgta

SEQ ID NO: 6893010 - DNA, 23 bp, Homo sapiens
cctcagcctgcccacctctccct

SEQ ID NO: 6893011 - DNA, 22 bp, Homo sapiens
gaacctgtgagtaaatattgag

SEQ ID NO: 6893012 - DNA, 17 bp, Homo sapiens
tccagaacgccctgtgt

SEQ ID NO: 6893013 - DNA, 19 bp, Homo sapiens
ccttctccatggccctgcc

SEQ ID NO: 6893014 - DNA, 19 bp, Homo sapiens
agttcacatgtgccctgcc

SEQ ID NO: 6893015 - DNA, 15 bp, Homo sapiens
tggtaatttagtgta

SEQ ID NO: 6893016 - DNA, 19 bp, Homo sapiens
cctctcccaccctcttcct

SEQ ID NO: 6893017 - DNA, 16 bp, Homo sapiens
tcttgccactgcctct

SEQ ID NO: 6893018 - DNA, 14 bp, Homo sapiens
ctatacctgtgcct

SEQ ID NO: 6893019 - DNA, 15 bp, Homo sapiens
taggtagagtctgag

SEQ ID NO: 6893020 - DNA, 16 bp, Homo sapiens
tctcatactcacctca

SEQ ID NO: 6893021 - DNA, 16 bp, Homo sapiens
tcagttatatgatatt

SEQ ID NO: 6893022 - DNA, 21 bp, Homo sapiens
caggtccgtgggccgtatctg

SEQ ID NO: 6893023 - DNA, 12 bp, Homo sapiens
ctgggggccagc

SEQ ID NO: 6893024 - DNA, 19 bp, Homo sapiens
atgcaaaccatcattgaaa

SEQ ID NO: 6893025 - DNA, 20 bp, Homo sapiens
tcactctgccagggcagtgc

SEQ ID NO: 6893026 - DNA, 16 bp, Homo sapiens
atttttcaaaatcaaa

SEQ ID NO: 6893027 - DNA, 19 bp, Homo sapiens
ctttgggaagcctttactg

SEQ ID NO: 6893028 - DNA, 12 bp, Homo sapiens
tctatgtttact

SEQ ID NO: 6893029 - DNA, 17 bp, Homo sapiens
ctgcaccaggggtgcac

SEQ ID NO: 6893030 - DNA, 21 bp, Homo sapiens
ctcccagctcctttctcctgt

SEQ ID NO: 6893031 - DNA, 16 bp, Homo sapiens
ctgttctctggtttca

SEQ ID NO: 6893032 - DNA, 17 bp, Homo sapiens
gatcccatgtcacctca

SEQ ID NO: 6893033 - DNA, 22 bp, Homo sapiens
caacgcttaaaggtgtcttcct

SEQ ID NO: 6893034 - DNA, 17 bp, Homo sapiens
cacttttaaaaaaattt

SEQ ID NO: 6893035 - DNA, 16 bp, Homo sapiens
ttttccagcctcagcc

SEQ ID NO: 6893036 - DNA, 21 bp, Homo sapiens
cattcgggccccacctgcagc

SEQ ID NO: 6893037 - DNA, 21 bp, Homo sapiens
agttgatctggaacccagact

SEQ ID NO: 6893038 - DNA, 13 bp, Homo sapiens
cctttccttccca

SEQ ID NO: 6893039 - DNA, 21 bp, Homo sapiens
actgcagtgtggagttcacct

SEQ ID NO: 6893040 - DNA, 14 bp, Homo sapiens
tccagccagctcct

SEQ ID NO: 6893041 - DNA, 16 bp, Homo sapiens
gtgctctttccacccc

SEQ ID NO: 6893042 - DNA, 19 bp, Homo sapiens
atttttgttttgaaagttt

SEQ ID NO: 6893043 - DNA, 18 bp, Homo sapiens
gactctggaccatgctga

SEQ ID NO: 6893044 - DNA, 18 bp, Homo sapiens
actggaggttgaagccaa

SEQ ID NO: 6893045 - DNA, 14 bp, Homo sapiens
tattgaatactgtc

SEQ ID NO: 6893046 - DNA, 16 bp, Homo sapiens
gtcttcgccctctgaa

SEQ ID NO: 6893047 - DNA, 22 bp, Homo sapiens
gctctacattctgctctgccca

SEQ ID NO: 6893048 - DNA, 21 bp, Homo sapiens
ccagcccctggccccaggacc

SEQ ID NO: 6893049 - DNA, 23 bp, Homo sapiens
cttacacactcaggcctgtgccc

SEQ ID NO: 6893050 - DNA, 18 bp, Homo sapiens
ttcacaacctcaccaaac

SEQ ID NO: 6893051 - DNA, 18 bp, Homo sapiens
ctaatgagagtgcactgc

SEQ ID NO: 6893052 - DNA, 13 bp, Homo sapiens
aagacctacctcc

SEQ ID NO: 6893053 - DNA, 12 bp, Homo sapiens
acacttgtgcca

SEQ ID NO: 6893054 - DNA, 16 bp, Homo sapiens
gatgcgagcttggcct

SEQ ID NO: 6893055 - DNA, 19 bp, Homo sapiens
cccaggaatctctgttcct

SEQ ID NO: 6893056 - DNA, 22 bp, Homo sapiens
acttttccatgtatctacctca

SEQ ID NO: 6893057 - DNA, 11 bp, Homo sapiens
accagctgcta

SEQ ID NO: 6893058 - DNA, 20 bp, Homo sapiens
ctaatctcatacctctgacc

SEQ ID NO: 6893059 - DNA, 21 bp, Homo sapiens
aagctccactgtcaccctcca

SEQ ID NO: 6893060 - DNA, 15 bp, Homo sapiens
aatattatgccttga

SEQ ID NO: 6893061 - DNA, 12 bp, Homo sapiens
ccaggcagtcgg

SEQ ID NO: 6893062 - DNA, 22 bp, Homo sapiens
ctctgcctgcactccctggcct

SEQ ID NO: 6893063 - DNA, 21 bp, Homo sapiens
acgtaggttccccagagagca

SEQ ID NO: 6893064 - DNA, 18 bp, Homo sapiens
attctgctggcctctgcg

SEQ ID NO: 6893065 - DNA, 18 bp, Homo sapiens
ccttctcccactctccta

SEQ ID NO: 6893066 - DNA, 15 bp, Homo sapiens
tccctctgctcagcc

SEQ ID NO: 6893067 - DNA, 15 bp, Homo sapiens
acaagaatgcattga

SEQ ID NO: 6893068 - DNA, 21 bp, Homo sapiens
cctcctacccctcccagctga

SEQ ID NO: 6893069 - DNA, 13 bp, Homo sapiens
tatcacctcccct

SEQ ID NO: 6893070 - DNA, 17 bp, Homo sapiens
agcaacttgttcgtggg

SEQ ID NO: 6893071 - DNA, 17 bp, Homo sapiens
cctggcaggccctgccc

SEQ ID NO: 6893072 - DNA, 17 bp, Homo sapiens
aagctgattactgtcaa

SEQ ID NO: 6893073 - DNA, 16 bp, Homo sapiens
cagacacctggactga

SEQ ID NO: 6893074 - DNA, 22 bp, Homo sapiens
ccagtaggaaattgattttgaa

SEQ ID NO: 6893075 - DNA, 22 bp, Homo sapiens
tgtgttttaattttctttatgg

SEQ ID NO: 6893076 - DNA, 22 bp, Homo sapiens
agccatcccgcttagcctgcct

SEQ ID NO: 6893077 - DNA, 13 bp, Homo sapiens
cattaaatgcaaa

SEQ ID NO: 6893078 - DNA, 19 bp, Homo sapiens
tccacccacctcagcctcc

SEQ ID NO: 6893079 - DNA, 13 bp, Homo sapiens
acatgctgcccac

SEQ ID NO: 6893080 - DNA, 19 bp, Homo sapiens
tttccatgggcccgctgcc

SEQ ID NO: 6893081 - DNA, 18 bp, Homo sapiens
gagttgactttcctccca

SEQ ID NO: 6893082 - DNA, 15 bp, Homo sapiens
gtctctccagcctca

SEQ ID NO: 6893083 - DNA, 12 bp, Homo sapiens
ttatctgtccca

SEQ ID NO: 6893084 - DNA, 15 bp, Homo sapiens
actattacagtattg

SEQ ID NO: 6893085 - DNA, 15 bp, Homo sapiens
tgcctggctccctga

SEQ ID NO: 6893086 - DNA, 14 bp, Homo sapiens
atagatgagtcctg

SEQ ID NO: 6893087 - DNA, 16 bp, Homo sapiens
cctcagtccctcttct

SEQ ID NO: 6893088 - DNA, 15 bp, Homo sapiens
gggtctcactgtgtt

SEQ ID NO: 6893089 - DNA, 16 bp, Homo sapiens
agagtggcctgtgagc

SEQ ID NO: 6893090 - DNA, 20 bp, Homo sapiens
acagtggggtttttttgtct

SEQ ID NO: 6893091 - DNA, 13 bp, Homo sapiens
tcacaatactgtt

SEQ ID NO: 6893092 - DNA, 17 bp, Homo sapiens
cagccgaggcctggcca

SEQ ID NO: 6893093 - DNA, 20 bp, Homo sapiens
ccctcattccaagcacttta

SEQ ID NO: 6893094 - DNA, 21 bp, Homo sapiens
ctccctccccaaatggctgct

SEQ ID NO: 6893095 - DNA, 16 bp, Homo sapiens
atatatctattattca

SEQ ID NO: 6893096 - DNA, 17 bp, Homo sapiens
aggtgtcaccctgcaga

SEQ ID NO: 6893097 - DNA, 18 bp, Homo sapiens
agccatggctcaggcaag

SEQ ID NO: 6893098 - DNA, 23 bp, Homo sapiens
gttctgcctgccagctgcactga

SEQ ID NO: 6893099 - DNA, 14 bp, Homo sapiens
ataattgcatgaaa

SEQ ID NO: 6893100 - DNA, 21 bp, Homo sapiens
ccaggttctccgttagctcct

SEQ ID NO: 6893101 - DNA, 12 bp, Homo sapiens
tctttttgactg

SEQ ID NO: 6893102 - DNA, 15 bp, Homo sapiens
tccggcacactgcca

SEQ ID NO: 6893103 - DNA, 18 bp, Homo sapiens
aatagtttatttctgtga

SEQ ID NO: 6893104 - DNA, 15 bp, Homo sapiens
cacactccactgaca

SEQ ID NO: 6893105 - DNA, 22 bp, Homo sapiens
tggtgacctcacacacctctgc

SEQ ID NO: 6893106 - DNA, 18 bp, Homo sapiens
tcctctaagatcttgcct

SEQ ID NO: 6893107 - DNA, 16 bp, Homo sapiens
tggtcctgtctgtcct

SEQ ID NO: 6893108 - DNA, 15 bp, Homo sapiens
gggagaagagccctg

SEQ ID NO: 6893109 - DNA, 15 bp, Homo sapiens
ttgtcattgctttac

SEQ ID NO: 6893110 - DNA, 23 bp, Homo sapiens
gatagataggtcagtgcaaatac

SEQ ID NO: 6893111 - DNA, 14 bp, Homo sapiens
caagccccctgccc

SEQ ID NO: 6893112 - DNA, 17 bp, Homo sapiens
ccagtcaccttctgggc

SEQ ID NO: 6893113 - DNA, 15 bp, Homo sapiens
cactagagctgggaa

SEQ ID NO: 6893114 - DNA, 17 bp, Homo sapiens
catgcgccaccatgccc

SEQ ID NO: 6893115 - DNA, 17 bp, Homo sapiens
aggagtgggacagacag

SEQ ID NO: 6893116 - DNA, 16 bp, Homo sapiens
cacttcatcaatcaaa

SEQ ID NO: 6893117 - DNA, 13 bp, Homo sapiens
catgttcttgtca

SEQ ID NO: 6893118 - DNA, 12 bp, Homo sapiens
ccaccagctcca

SEQ ID NO: 6893119 - DNA, 13 bp, Homo sapiens
agacagcttctct

SEQ ID NO: 6893120 - DNA, 19 bp, Homo sapiens
acatttatttattactgtc

SEQ ID NO: 6893121 - DNA, 15 bp, Homo sapiens
atgttggttgatata

SEQ ID NO: 6893122 - DNA, 15 bp, Homo sapiens
cgtcctgccctgccc

SEQ ID NO: 6893123 - DNA, 16 bp, Homo sapiens
ctgggccccactggac

SEQ ID NO: 6893124 - DNA, 22 bp, Homo sapiens
atgtttttactgaatgatctat

SEQ ID NO: 6893125 - DNA, 14 bp, Homo sapiens
tggaacctccctgg

SEQ ID NO: 6893126 - DNA, 20 bp, Homo sapiens
tgatacatttatcttctgtt

SEQ ID NO: 6893127 - DNA, 16 bp, Homo sapiens
gcaggtagcctgctgg

SEQ ID NO: 6893128 - DNA, 21 bp, Homo sapiens
tatttattttcagtatactgt

SEQ ID NO: 6893129 - DNA, 21 bp, Homo sapiens
acactgaaattgcctgaaacc

SEQ ID NO: 6893130 - DNA, 14 bp, Homo sapiens
agctcttcacttcc

SEQ ID NO: 6893131 - DNA, 18 bp, Homo sapiens
tatgtagtccgtgctgac

SEQ ID NO: 6893132 - DNA, 13 bp, Homo sapiens
tgggggccagctg

SEQ ID NO: 6893133 - DNA, 22 bp, Homo sapiens
tttatctactaattgagccatt

SEQ ID NO: 6893134 - DNA, 22 bp, Homo sapiens
tgttcagaacttcatctgccac

SEQ ID NO: 6893135 - DNA, 12 bp, Homo sapiens
cagtaccaaaga

SEQ ID NO: 6893136 - DNA, 22 bp, Homo sapiens
ctgtgaggaatgctctgtgcca

SEQ ID NO: 6893137 - DNA, 19 bp, Homo sapiens
agggccaagagatctgtgt

SEQ ID NO: 6893138 - DNA, 16 bp, Homo sapiens
cacccacctccctgcc

SEQ ID NO: 6893139 - DNA, 11 bp, Homo sapiens
cagctggtggc

SEQ ID NO: 6893140 - DNA, 19 bp, Homo sapiens
ccatgcctgctccctgtct

SEQ ID NO: 6893141 - DNA, 13 bp, Homo sapiens
ccaaggacactga

SEQ ID NO: 6893142 - DNA, 13 bp, Homo sapiens
cagttcctcgccc

SEQ ID NO: 6893143 - DNA, 21 bp, Homo sapiens
ccatgactgccccttgcttct

SEQ ID NO: 6893144 - DNA, 18 bp, Homo sapiens
ccttggtggagcagccag

SEQ ID NO: 6893145 - DNA, 12 bp, Homo sapiens
cctcccctgccg

SEQ ID NO: 6893146 - DNA, 20 bp, Homo sapiens
agattttgtgtttattcttg

SEQ ID NO: 6893147 - DNA, 17 bp, Homo sapiens
cagctgtttctcatgaa

SEQ ID NO: 6893148 - DNA, 14 bp, Homo sapiens
cctgcccctttcag

SEQ ID NO: 6893149 - DNA, 17 bp, Homo sapiens
agcccctcctccctcag

SEQ ID NO: 6893150 - DNA, 17 bp, Homo sapiens
actaaatgagctcctgc

SEQ ID NO: 6893151 - DNA, 23 bp, Homo sapiens
atccctgcttgcccgctcccaca

SEQ ID NO: 6893152 - DNA, 20 bp, Homo sapiens
cctccccggcaccctctggc

SEQ ID NO: 6893153 - DNA, 14 bp, Homo sapiens
ctgtcacctggcct

SEQ ID NO: 6893154 - DNA, 16 bp, Homo sapiens
cttggggccagactgg

SEQ ID NO: 6893155 - DNA, 16 bp, Homo sapiens
cctcattgcctcctgt

SEQ ID NO: 6893156 - DNA, 17 bp, Homo sapiens
cttcctctccactgcct

SEQ ID NO: 6893157 - DNA, 21 bp, Homo sapiens
cctccccaaggccccctgcct

SEQ ID NO: 6893158 - DNA, 12 bp, Homo sapiens
cagcactgtgag

SEQ ID NO: 6893159 - DNA, 18 bp, Homo sapiens
gcccatggcccccaataa

SEQ ID NO: 6893160 - DNA, 22 bp, Homo sapiens
aagatgggcatcttttgtatta

SEQ ID NO: 6893161 - DNA, 17 bp, Homo sapiens
caaactgatgctgagga

SEQ ID NO: 6893162 - DNA, 18 bp, Homo sapiens
ctccttccccccatctct

SEQ ID NO: 6893163 - DNA, 18 bp, Homo sapiens
cccagaaagcctctctct

SEQ ID NO: 6893164 - DNA, 16 bp, Homo sapiens
gtgttttttttccaaa

SEQ ID NO: 6893165 - DNA, 19 bp, Homo sapiens
ctaaggctctgagagtcta

SEQ ID NO: 6893166 - DNA, 17 bp, Homo sapiens
ctcactgtcatctgcca

SEQ ID NO: 6893167 - DNA, 20 bp, Homo sapiens
cacaccgctggtccctgccc

SEQ ID NO: 6893168 - DNA, 11 bp, Homo sapiens
tgcttactgtg

SEQ ID NO: 6893169 - DNA, 15 bp, Homo sapiens
acagcccactgagaa

SEQ ID NO: 6893170 - DNA, 22 bp, Homo sapiens
gcccgctctacatcttctgcct

SEQ ID NO: 6893171 - DNA, 15 bp, Homo sapiens
cattttactgtctgt

SEQ ID NO: 6893172 - DNA, 22 bp, Homo sapiens
caccattcgtacataatactga

SEQ ID NO: 6893173 - DNA, 13 bp, Homo sapiens
ccaaacccagcca

SEQ ID NO: 6893174 - DNA, 18 bp, Homo sapiens
agtaaactggatactgta

SEQ ID NO: 6893175 - DNA, 19 bp, Homo sapiens
aatgttttctttgcaaagt

SEQ ID NO: 6893176 - DNA, 18 bp, Homo sapiens
ccagaggtaacagaacag

SEQ ID NO: 6893177 - DNA, 22 bp, Homo sapiens
agagccttgggagccactgcca

SEQ ID NO: 6893178 - DNA, 18 bp, Homo sapiens
tacagtgaattgtctttt

SEQ ID NO: 6893179 - DNA, 18 bp, Homo sapiens
agctcctgtccctaccca

SEQ ID NO: 6893180 - DNA, 20 bp, Homo sapiens
caaggccagggcacagctgg

SEQ ID NO: 6893181 - DNA, 14 bp, Homo sapiens
ccatctgtctgtcc

SEQ ID NO: 6893182 - DNA, 14 bp, Homo sapiens
actcaggcctgcca

SEQ ID NO: 6893183 - DNA, 17 bp, Homo sapiens
ttcttaggtttactgtg

SEQ ID NO: 6893184 - DNA, 18 bp, Homo sapiens
tcacctttgtaagacatt

SEQ ID NO: 6893185 - DNA, 20 bp, Homo sapiens
tagcagggggggaaatgcat

SEQ ID NO: 6893186 - DNA, 14 bp, Homo sapiens
atgtcgcctctgca

SEQ ID NO: 6893187 - DNA, 15 bp, Homo sapiens
taccctccctgctgt

SEQ ID NO: 6893188 - DNA, 23 bp, Homo sapiens
aacacaccaggctgtgggcctca

SEQ ID NO: 6893189 - DNA, 15 bp, Homo sapiens
cagacttccttgaga

SEQ ID NO: 6893190 - DNA, 14 bp, Homo sapiens
gcaaacaacctgaa

SEQ ID NO: 6893191 - DNA, 18 bp, Homo sapiens
acccgctggagcccacag

SEQ ID NO: 6893192 - DNA, 16 bp, Homo sapiens
attccaacacctgcca

SEQ ID NO: 6893193 - DNA, 20 bp, Homo sapiens
accacgggcctcagtttccc

SEQ ID NO: 6893194 - DNA, 13 bp, Homo sapiens
tcttagtttactg

SEQ ID NO: 6893195 - DNA, 16 bp, Homo sapiens
tctccccaggcctcca

SEQ ID NO: 6893196 - DNA, 19 bp, Homo sapiens
agcaggttctctcctgtga

SEQ ID NO: 6893197 - DNA, 13 bp, Homo sapiens
gcctgccctgcta

SEQ ID NO: 6893198 - DNA, 15 bp, Homo sapiens
catcctctttttcca

SEQ ID NO: 6893199 - DNA, 21 bp, Homo sapiens
ctgtgtcttgcaatggcagcc

SEQ ID NO: 6893200 - DNA, 18 bp, Homo sapiens
tgctcccatcctgtgtgt

SEQ ID NO: 6893201 - DNA, 13 bp, Homo sapiens
cggtatcctccct

SEQ ID NO: 6893202 - DNA, 13 bp, Homo sapiens
catccctggagca

SEQ ID NO: 6893203 - DNA, 11 bp, Homo sapiens
cccccatctct

SEQ ID NO: 6893204 - DNA, 19 bp, Homo sapiens
agtttttcatttgttttgc

SEQ ID NO: 6893205 - DNA, 17 bp, Homo sapiens
aggaggtttgcctgtga

SEQ ID NO: 6893206 - DNA, 11 bp, Homo sapiens
ctccccctgca

SEQ ID NO: 6893207 - DNA, 23 bp, Homo sapiens
ccaggagcctcatccagcctcag

SEQ ID NO: 6893208 - DNA, 17 bp, Homo sapiens
caacttctacttctgcc

SEQ ID NO: 6893209 - DNA, 12 bp, Homo sapiens
gcagggctcagc

SEQ ID NO: 6893210 - DNA, 14 bp, Homo sapiens
ctaattgctgttga

SEQ ID NO: 6893211 - DNA, 22 bp, Homo sapiens
gaggtgcttctagttctgccag

SEQ ID NO: 6893212 - DNA, 22 bp, Homo sapiens
agcacaggttagggtgtgtgcc

SEQ ID NO: 6893213 - DNA, 13 bp, Homo sapiens
ccatttgctcctt

SEQ ID NO: 6893214 - DNA, 23 bp, Homo sapiens
agacggccggccggacctctgag

SEQ ID NO: 6893215 - DNA, 23 bp, Homo sapiens
tcctccccaccagagctgcctcc

SEQ ID NO: 6893216 - DNA, 23 bp, Homo sapiens
ggagcctgtgcgtcccagctgaa

SEQ ID NO: 6893217 - DNA, 17 bp, Homo sapiens
agctgcccctccctgcc

SEQ ID NO: 6893218 - DNA, 21 bp, Homo sapiens
tcctagcttatctccctgctt

SEQ ID NO: 6893219 - DNA, 15 bp, Homo sapiens
cacactactacctct

SEQ ID NO: 6893220 - DNA, 21 bp, Homo sapiens
cccatcactgctgtccctcct

SEQ ID NO: 6893221 - DNA, 23 bp, Homo sapiens
aagaggaggacccctgccttcct

SEQ ID NO: 6893222 - DNA, 20 bp, Homo sapiens
gagggctgaggagcagccag

SEQ ID NO: 6893223 - DNA, 17 bp, Homo sapiens
gcaccctgcgcctccag

SEQ ID NO: 6893224 - DNA, 16 bp, Homo sapiens
ttcccaggtgctacac

SEQ ID NO: 6893225 - DNA, 17 bp, Homo sapiens
cttctctattcctgacc

SEQ ID NO: 6893226 - DNA, 20 bp, Homo sapiens
ctccagtcttccacctggaa

SEQ ID NO: 6893227 - DNA, 12 bp, Homo sapiens
tcattctgccaa

SEQ ID NO: 6893228 - DNA, 17 bp, Homo sapiens
acaattcaagctgagaa

SEQ ID NO: 6893229 - DNA, 16 bp, Homo sapiens
cctggcacaggactga

SEQ ID NO: 6893230 - DNA, 16 bp, Homo sapiens
agggctggactgaggc

SEQ ID NO: 6893231 - DNA, 18 bp, Homo sapiens
ctccatggccctgtccca

SEQ ID NO: 6893232 - DNA, 22 bp, Homo sapiens
tcactgcattcattctgagccc

SEQ ID NO: 6893233 - DNA, 16 bp, Homo sapiens
ccaagtctgtacctca

SEQ ID NO: 6893234 - DNA, 14 bp, Homo sapiens
ctctgccgctgcca

SEQ ID NO: 6893235 - DNA, 13 bp, Homo sapiens
agtgctcagctgt

SEQ ID NO: 6893236 - DNA, 21 bp, Homo sapiens
gcctcctctctccctgcctca

SEQ ID NO: 6893237 - DNA, 13 bp, Homo sapiens
acgggaggggagg

SEQ ID NO: 6893238 - DNA, 21 bp, Homo sapiens
tcctgggcccaggcagcacct

SEQ ID NO: 6893239 - DNA, 15 bp, Homo sapiens
ttccacttgtttgca

SEQ ID NO: 6893240 - DNA, 20 bp, Homo sapiens
gacataaagcctctgactca

SEQ ID NO: 6893241 - DNA, 15 bp, Homo sapiens
gcaatagagactgta

SEQ ID NO: 6893242 - DNA, 13 bp, Homo sapiens
catcttctttctt

SEQ ID NO: 6893243 - DNA, 20 bp, Homo sapiens
aggacacctgtggtatcttt

SEQ ID NO: 6893244 - DNA, 17 bp, Homo sapiens
cctatcacctcccctcc

SEQ ID NO: 6893245 - DNA, 22 bp, Homo sapiens
tgcagtccagaataagtgctgt

SEQ ID NO: 6893246 - DNA, 16 bp, Homo sapiens
ccagcagttctctgcc

SEQ ID NO: 6893247 - DNA, 13 bp, Homo sapiens
attctctgtctca

SEQ ID NO: 6893248 - DNA, 12 bp, Homo sapiens
ctcaggcctcca

SEQ ID NO: 6893249 - DNA, 17 bp, Homo sapiens
ctgctccagcctctgcc

SEQ ID NO: 6893250 - DNA, 14 bp, Homo sapiens
ccatcttccagcca

SEQ ID NO: 6893251 - DNA, 13 bp, Homo sapiens
ccttgctctacct

SEQ ID NO: 6893252 - DNA, 14 bp, Homo sapiens
catcgggtgccaaa

SEQ ID NO: 6893253 - DNA, 13 bp, Homo sapiens
gaccagctcagga

SEQ ID NO: 6893254 - DNA, 20 bp, Homo sapiens
acctgtggggatttctccca

SEQ ID NO: 6893255 - DNA, 22 bp, Homo sapiens
gccaagtcacaggttggccaga

SEQ ID NO: 6893256 - DNA, 20 bp, Homo sapiens
ccctaccacctccccagcct

SEQ ID NO: 6893257 - DNA, 15 bp, Homo sapiens
tgaatctctgcctct

SEQ ID NO: 6893258 - DNA, 19 bp, Homo sapiens
tttcatgtaaactgtgcac

SEQ ID NO: 6893259 - DNA, 22 bp, Homo sapiens
aatgtctatgttttctactcca

SEQ ID NO: 6893260 - DNA, 19 bp, Homo sapiens
gaacctagtactctctgct

SEQ ID NO: 6893261 - DNA, 23 bp, Homo sapiens
caggtctcctgggcatctggccc

SEQ ID NO: 6893262 - DNA, 16 bp, Homo sapiens
cctgccgcccccgcct

SEQ ID NO: 6893263 - DNA, 22 bp, Homo sapiens
attctttcaatccacagtattg

SEQ ID NO: 6893264 - DNA, 17 bp, Homo sapiens
tccccaggcccagccct

SEQ ID NO: 6893265 - DNA, 20 bp, Homo sapiens
ccaaaacttagacccatgct

SEQ ID NO: 6893266 - DNA, 22 bp, Homo sapiens
aatattatactaagaaaagata

SEQ ID NO: 6893267 - DNA, 17 bp, Homo sapiens
tgataatatattgtgtt

SEQ ID NO: 6893268 - DNA, 21 bp, Homo sapiens
atcttggcttaatttaatgta

SEQ ID NO: 6893269 - DNA, 18 bp, Homo sapiens
ccagaggttatctgcctg

SEQ ID NO: 6893270 - DNA, 22 bp, Homo sapiens
ttcctctgcagctgacctctgt

SEQ ID NO: 6893271 - DNA, 19 bp, Homo sapiens
cagcctgggctcctctgca

SEQ ID NO: 6893272 - DNA, 17 bp, Homo sapiens
cacggcttcactgacca

SEQ ID NO: 6893273 - DNA, 15 bp, Homo sapiens
cagttttcccacttt

SEQ ID NO: 6893274 - DNA, 17 bp, Homo sapiens
aggaaagtgttattttt

SEQ ID NO: 6893275 - DNA, 14 bp, Homo sapiens
gaaatgaaagggaa

SEQ ID NO: 6893276 - DNA, 20 bp, Homo sapiens
gtcagcagcctccctgaaga

SEQ ID NO: 6893277 - DNA, 18 bp, Homo sapiens
cacaccactgccctgcct

SEQ ID NO: 6893278 - DNA, 13 bp, Homo sapiens
caagtatgcctta

SEQ ID NO: 6893279 - DNA, 14 bp, Homo sapiens
cagagggtggagat

SEQ ID NO: 6893280 - DNA, 17 bp, Homo sapiens
gaaagcatttgaatgca

SEQ ID NO: 6893281 - DNA, 14 bp, Homo sapiens
agccttcctctgca

SEQ ID NO: 6893282 - DNA, 22 bp, Homo sapiens
gctactggacttgaatggttaa

SEQ ID NO: 6893283 - DNA, 15 bp, Homo sapiens
cacttcggataattt

SEQ ID NO: 6893284 - DNA, 16 bp, Homo sapiens
tgcactttccctagaa

SEQ ID NO: 6893285 - DNA, 13 bp, Homo sapiens
cagattctgcctc

SEQ ID NO: 6893286 - DNA, 20 bp, Homo sapiens
ctagctcaccaggcctggcc

SEQ ID NO: 6893287 - DNA, 15 bp, Homo sapiens
ctcttccccctctcc

SEQ ID NO: 6893288 - DNA, 21 bp, Homo sapiens
catattataaataaatgccaa

SEQ ID NO: 6893289 - DNA, 16 bp, Homo sapiens
caatgttggcctgtca

SEQ ID NO: 6893290 - DNA, 20 bp, Homo sapiens
agatttatctgcaaggattt

SEQ ID NO: 6893291 - DNA, 14 bp, Homo sapiens
catagttactgtgt

SEQ ID NO: 6893292 - DNA, 23 bp, Homo sapiens
cagtgttacaatcagtgtgaatg

SEQ ID NO: 6893293 - DNA, 21 bp, Homo sapiens
aggtgaccccatctctgctgc

SEQ ID NO: 6893294 - DNA, 15 bp, Homo sapiens
cttattgctgccaaa

SEQ ID NO: 6893295 - DNA, 18 bp, Homo sapiens
caattcatggttcaagta

SEQ ID NO: 6893296 - DNA, 14 bp, Homo sapiens
aaagacctacctcc

SEQ ID NO: 6893297 - DNA, 20 bp, Homo sapiens
tactttgtcctaagagattt

SEQ ID NO: 6893298 - DNA, 12 bp, Homo sapiens
cacttggcagcc

SEQ ID NO: 6893299 - DNA, 19 bp, Homo sapiens
taattgtgaccaatacatt

SEQ ID NO: 6893300 - DNA, 12 bp, Homo sapiens
tggttcctctgc

SEQ ID NO: 6893301 - DNA, 21 bp, Homo sapiens
cagggcaaatgacatgcactg

SEQ ID NO: 6893302 - DNA, 16 bp, Homo sapiens
ttgtccttagcctgga

SEQ ID NO: 6893303 - DNA, 16 bp, Homo sapiens
ccctgggcctgctgct

SEQ ID NO: 6893304 - DNA, 13 bp, Homo sapiens
aacgatatatgta

SEQ ID NO: 6893305 - DNA, 14 bp, Homo sapiens
atgcgagactctga

SEQ ID NO: 6893306 - DNA, 19 bp, Homo sapiens
ccgtcctcacccctgtcct

SEQ ID NO: 6893307 - DNA, 16 bp, Homo sapiens
gtgttctttcctgccc

SEQ ID NO: 6893308 - DNA, 16 bp, Homo sapiens
agagttggctcaggca

SEQ ID NO: 6893309 - DNA, 20 bp, Homo sapiens
gaacctattttcatttgtac

SEQ ID NO: 6893310 - DNA, 19 bp, Homo sapiens
ctttttctggactctggac

SEQ ID NO: 6893311 - DNA, 14 bp, Homo sapiens
gtctgaattattct

SEQ ID NO: 6893312 - DNA, 19 bp, Homo sapiens
tgctcttatccccagctgt

SEQ ID NO: 6893313 - DNA, 22 bp, Homo sapiens
caaagaggctgcccctctcacc

SEQ ID NO: 6893314 - DNA, 21 bp, Homo sapiens
cctagagagaataaattggat

SEQ ID NO: 6893315 - DNA, 18 bp, Homo sapiens
ctgggccctgcctgcagc

SEQ ID NO: 6893316 - DNA, 18 bp, Homo sapiens
ttgggggggaccctgcct

SEQ ID NO: 6893317 - DNA, 15 bp, Homo sapiens
tctgcttcagcctcc

SEQ ID NO: 6893318 - DNA, 13 bp, Homo sapiens
ctcagcttgtgcc

SEQ ID NO: 6893319 - DNA, 15 bp, Homo sapiens
ctagtcaagctcctc

SEQ ID NO: 6893320 - DNA, 15 bp, Homo sapiens
ctgaggctctttctg

SEQ ID NO: 6893321 - DNA, 17 bp, Homo sapiens
ctggaaccagagccaca

SEQ ID NO: 6893322 - DNA, 15 bp, Homo sapiens
gtaaattattcagtt

SEQ ID NO: 6893323 - DNA, 18 bp, Homo sapiens
tagccagatttgtctttt

SEQ ID NO: 6893324 - DNA, 14 bp, Homo sapiens
ttccttcactgccc

SEQ ID NO: 6893325 - DNA, 18 bp, Homo sapiens
cacgcctatgccctgccc

SEQ ID NO: 6893326 - DNA, 20 bp, Homo sapiens
tgtactcagggcattctgtt

SEQ ID NO: 6893327 - DNA, 12 bp, Homo sapiens
acttcctgctgc

SEQ ID NO: 6893328 - DNA, 18 bp, Homo sapiens
cctccagtaccttctgcc

SEQ ID NO: 6893329 - DNA, 13 bp, Homo sapiens
atacatgctgcta

SEQ ID NO: 6893330 - DNA, 20 bp, Homo sapiens
ccggtggcctattccaggaa

SEQ ID NO: 6893331 - DNA, 17 bp, Homo sapiens
ctcccccggctgggcct

SEQ ID NO: 6893332 - DNA, 22 bp, Homo sapiens
gtgagcgagtggatgctgtgct

SEQ ID NO: 6893333 - DNA, 18 bp, Homo sapiens
gactaccgcaggcccgga

SEQ ID NO: 6893334 - DNA, 23 bp, Homo sapiens
tgggaggcaagaggggtggagac

SEQ ID NO: 6893335 - DNA, 16 bp, Homo sapiens
acccacctccacccag

SEQ ID NO: 6893336 - DNA, 13 bp, Homo sapiens
ttctgtctctgcc

SEQ ID NO: 6893337 - DNA, 21 bp, Homo sapiens
gccatgggtgcagaccctgaa

SEQ ID NO: 6893338 - DNA, 20 bp, Homo sapiens
cctggatgtcccctgtccca

SEQ ID NO: 6893339 - DNA, 15 bp, Homo sapiens
tacttttgttgtatg

SEQ ID NO: 6893340 - DNA, 18 bp, Homo sapiens
tagtctggaactgctgct

SEQ ID NO: 6893341 - DNA, 18 bp, Homo sapiens
cttttcttctattgcctc

SEQ ID NO: 6893342 - DNA, 19 bp, Homo sapiens
ccctctcccaccctcttcc

SEQ ID NO: 6893343 - DNA, 21 bp, Homo sapiens
ctccatgactgtgtgttgtga

SEQ ID NO: 6893344 - DNA, 22 bp, Homo sapiens
atgtcctccagaagcctctggc

SEQ ID NO: 6893345 - DNA, 13 bp, Homo sapiens
gcagaataaagca

SEQ ID NO: 6893346 - DNA, 22 bp, Homo sapiens
ctctctcacctgctcccagtcc

SEQ ID NO: 6893347 - DNA, 20 bp, Homo sapiens
attttcctaaggccactgtt

SEQ ID NO: 6893348 - DNA, 17 bp, Homo sapiens
gcgtcactccagtgctc

SEQ ID NO: 6893349 - DNA, 17 bp, Homo sapiens
agaatgatcatctgtaa

SEQ ID NO: 6893350 - DNA, 19 bp, Homo sapiens
tgccatgcctgctccctgt

SEQ ID NO: 6893351 - DNA, 19 bp, Homo sapiens
cctttcttttgaaatgcca

SEQ ID NO: 6893352 - DNA, 12 bp, Homo sapiens
ttcactccctct

SEQ ID NO: 6893353 - DNA, 20 bp, Homo sapiens
gtcttcaaccctgccctgca

SEQ ID NO: 6893354 - DNA, 23 bp, Homo sapiens
tttcaattgtttatatggataat

SEQ ID NO: 6893355 - DNA, 19 bp, Homo sapiens
ctgctgggtggcccatccc

SEQ ID NO: 6893356 - DNA, 20 bp, Homo sapiens
catgcagtttgaaattctga

SEQ ID NO: 6893357 - DNA, 15 bp, Homo sapiens
ctcctgagtagctga

SEQ ID NO: 6893358 - DNA, 18 bp, Homo sapiens
atcatccattctctctgc

SEQ ID NO: 6893359 - DNA, 15 bp, Homo sapiens
gctctggagcagcca

SEQ ID NO: 6893360 - DNA, 21 bp, Homo sapiens
catcttccctgcccctgtgcc

SEQ ID NO: 6893361 - DNA, 18 bp, Homo sapiens
tcttctgtaatatttaca

SEQ ID NO: 6893362 - DNA, 17 bp, Homo sapiens
acatcttgtgcatgcaa

SEQ ID NO: 6893363 - DNA, 18 bp, Homo sapiens
cacagagtcgatgctcaa

SEQ ID NO: 6893364 - DNA, 17 bp, Homo sapiens
tgtagataaataatgta

SEQ ID NO: 6893365 - DNA, 22 bp, Homo sapiens
aaccaagggccctcactcagga

SEQ ID NO: 6893366 - DNA, 17 bp, Homo sapiens
aaggagaaaaaaaacct

SEQ ID NO: 6893367 - DNA, 18 bp, Homo sapiens
tttaaaaatcttaatgta

SEQ ID NO: 6893368 - DNA, 21 bp, Homo sapiens
catcccgggttcaagagattc

SEQ ID NO: 6893369 - DNA, 22 bp, Homo sapiens
catgatgccctcccctcagcgc

SEQ ID NO: 6893370 - DNA, 15 bp, Homo sapiens
ctggacctatgtcct

SEQ ID NO: 6893371 - DNA, 21 bp, Homo sapiens
gaagagaaaggactcagtgtg

SEQ ID NO: 6893372 - DNA, 18 bp, Homo sapiens
ctctctgtcttctctcca

SEQ ID NO: 6893373 - DNA, 13 bp, Homo sapiens
cttgccactgcca

SEQ ID NO: 6893374 - DNA, 17 bp, Homo sapiens
tcgcgccagcgacctct

SEQ ID NO: 6893375 - DNA, 19 bp, Homo sapiens
cacactcagatcctcctca

SEQ ID NO: 6893376 - DNA, 18 bp, Homo sapiens
agagaggaggcctggacc

SEQ ID NO: 6893377 - DNA, 16 bp, Homo sapiens
cttttgtaattgtgta

SEQ ID NO: 6893378 - DNA, 18 bp, Homo sapiens
cccaggtggcctgcgtct

SEQ ID NO: 6893379 - DNA, 22 bp, Homo sapiens
catctagccagcccctcttccc

SEQ ID NO: 6893380 - DNA, 19 bp, Homo sapiens
cccttcccttccactgcct

SEQ ID NO: 6893381 - DNA, 19 bp, Homo sapiens
agatagaatttggcccaga

SEQ ID NO: 6893382 - DNA, 23 bp, Homo sapiens
cctcttagaagaatattgtattg

SEQ ID NO: 6893383 - DNA, 18 bp, Homo sapiens
cctgctcacctgtgtgcc

SEQ ID NO: 6893384 - DNA, 14 bp, Homo sapiens
cccttgttgcactg

SEQ ID NO: 6893385 - DNA, 14 bp, Homo sapiens
gtaatgcattgcct

SEQ ID NO: 6893386 - DNA, 20 bp, Homo sapiens
ccatctctcccacttcctcc

SEQ ID NO: 6893387 - DNA, 21 bp, Homo sapiens
aaacattcatgtaactctcca

SEQ ID NO: 6893388 - DNA, 23 bp, Homo sapiens
ggaaatataccttaacaggctga

SEQ ID NO: 6893389 - DNA, 21 bp, Homo sapiens
gaggcctcttggacctctgct

SEQ ID NO: 6893390 - DNA, 21 bp, Homo sapiens
cagatgaggaaacaggcctca

SEQ ID NO: 6893391 - DNA, 16 bp, Homo sapiens
tcatccctccctgcct

SEQ ID NO: 6893392 - DNA, 23 bp, Homo sapiens
ctcctggcctcagactgcaccca

SEQ ID NO: 6893393 - DNA, 16 bp, Homo sapiens
ctggggtaggctgctc

SEQ ID NO: 6893394 - DNA, 19 bp, Homo sapiens
tccagctgggctctgcaat

SEQ ID NO: 6893395 - DNA, 22 bp, Homo sapiens
acttgcttagtatggttctcag

SEQ ID NO: 6893396 - DNA, 22 bp, Homo sapiens
gcaaagggcctgcccagacaag

SEQ ID NO: 6893397 - DNA, 19 bp, Homo sapiens
tgtacgtactgcatttgcc

SEQ ID NO: 6893398 - DNA, 14 bp, Homo sapiens
aaataacaatgtta

SEQ ID NO: 6893399 - DNA, 14 bp, Homo sapiens
tggtttctgtgtgt

SEQ ID NO: 6893400 - DNA, 14 bp, Homo sapiens
agcgctcctctgcc

SEQ ID NO: 6893401 - DNA, 15 bp, Homo sapiens
attcagacaacatta

SEQ ID NO: 6893402 - DNA, 18 bp, Homo sapiens
ctctcctgggcccctccc

SEQ ID NO: 6893403 - DNA, 14 bp, Homo sapiens
ctcttgacagtctg

SEQ ID NO: 6893404 - DNA, 14 bp, Homo sapiens
gcttggcctgctgt

SEQ ID NO: 6893405 - DNA, 19 bp, Homo sapiens
accctctgctatgtctgtg

SEQ ID NO: 6893406 - DNA, 19 bp, Homo sapiens
caccccggctccccctgcc

SEQ ID NO: 6893407 - DNA, 23 bp, Homo sapiens
agttagtctactcttaagccatc

SEQ ID NO: 6893408 - DNA, 15 bp, Homo sapiens
cctccagcctcggcc

SEQ ID NO: 6893409 - DNA, 15 bp, Homo sapiens
ctagccttgcttgtt

SEQ ID NO: 6893410 - DNA, 23 bp, Homo sapiens
tacccgggaagggggctgggaca

SEQ ID NO: 6893411 - DNA, 14 bp, Homo sapiens
cacccactccttta

SEQ ID NO: 6893412 - DNA, 22 bp, Homo sapiens
ccctgctcccacgcctgcttct

SEQ ID NO: 6893413 - DNA, 21 bp, Homo sapiens
aggattctgctggcctctgcg

SEQ ID NO: 6893414 - DNA, 12 bp, Homo sapiens
gccagagccaaa

SEQ ID NO: 6893415 - DNA, 21 bp, Homo sapiens
tttttacagcattgtctttgc

SEQ ID NO: 6893416 - DNA, 20 bp, Homo sapiens
aaagtgttttgtaccagtga

SEQ ID NO: 6893417 - DNA, 13 bp, Homo sapiens
cagttgctggtaa

SEQ ID NO: 6893418 - DNA, 23 bp, Homo sapiens
tcaagggcagagaactgtctttc

SEQ ID NO: 6893419 - DNA, 16 bp, Homo sapiens
gccaccgcagctgctg

SEQ ID NO: 6893420 - DNA, 19 bp, Homo sapiens
gggatgctagccccagaga

SEQ ID NO: 6893421 - DNA, 13 bp, Homo sapiens
cctccctcttccc

SEQ ID NO: 6893422 - DNA, 22 bp, Homo sapiens
cacagtgactgggccctgtcca

SEQ ID NO: 6893423 - DNA, 12 bp, Homo sapiens
aatttatttcca

SEQ ID NO: 6893424 - DNA, 18 bp, Homo sapiens
aaagccaaccttcaaaga

SEQ ID NO: 6893425 - DNA, 22 bp, Homo sapiens
ccttcctcccacctccccctcc

SEQ ID NO: 6893426 - DNA, 17 bp, Homo sapiens
aaggtttattgttaata

SEQ ID NO: 6893427 - DNA, 15 bp, Homo sapiens
cacacggccctgccc

SEQ ID NO: 6893428 - DNA, 20 bp, Homo sapiens
cagtattgagacactgtcaa

SEQ ID NO: 6893429 - DNA, 13 bp, Homo sapiens
atatgcatgccag

SEQ ID NO: 6893430 - DNA, 14 bp, Homo sapiens
gatttgatctttgt

SEQ ID NO: 6893431 - DNA, 13 bp, Homo sapiens
ccctcctccctca

SEQ ID NO: 6893432 - DNA, 23 bp, Homo sapiens
cacctacccatacaccccctctt

SEQ ID NO: 6893433 - DNA, 22 bp, Homo sapiens
cagggccctggggtctctgagc

SEQ ID NO: 6893434 - DNA, 17 bp, Homo sapiens
gcctccagaagctgctc

SEQ ID NO: 6893435 - DNA, 14 bp, Homo sapiens
agacagctgtttga

SEQ ID NO: 6893436 - DNA, 21 bp, Homo sapiens
agtcgtgacctgctaggccag

SEQ ID NO: 6893437 - DNA, 17 bp, Homo sapiens
ctgcccgccctccctcc

SEQ ID NO: 6893438 - DNA, 16 bp, Homo sapiens
cacttgtcctcttgcc

SEQ ID NO: 6893439 - DNA, 21 bp, Homo sapiens
tgaacaacccaatctggctgg

SEQ ID NO: 6893440 - DNA, 16 bp, Homo sapiens
ctcaggggcctggagg

SEQ ID NO: 6893441 - DNA, 20 bp, Homo sapiens
acagcctgtcttcagatcct

SEQ ID NO: 6893442 - DNA, 13 bp, Homo sapiens
ctggctgccctgg

SEQ ID NO: 6893443 - DNA, 18 bp, Homo sapiens
gaaagagtagtgcattta

SEQ ID NO: 6893444 - DNA, 12 bp, Homo sapiens
attctgccaaag

SEQ ID NO: 6893445 - DNA, 17 bp, Homo sapiens
acttcagactctctcct

SEQ ID NO: 6893446 - DNA, 17 bp, Homo sapiens
atccaccttcctgccca

SEQ ID NO: 6893447 - DNA, 18 bp, Homo sapiens
tacctcaccctgctacac

SEQ ID NO: 6893448 - DNA, 15 bp, Homo sapiens
aatttccaaactgtt

SEQ ID NO: 6893449 - DNA, 15 bp, Homo sapiens
cctttcctcctctga

SEQ ID NO: 6893450 - DNA, 23 bp, Homo sapiens
cacctccttggcaccggcctcta

SEQ ID NO: 6893451 - DNA, 16 bp, Homo sapiens
ctgtctagcacttcct

SEQ ID NO: 6893452 - DNA, 14 bp, Homo sapiens
cttttatgctcacc

SEQ ID NO: 6893453 - DNA, 19 bp, Homo sapiens
acctcagttggcctctgcc

SEQ ID NO: 6893454 - DNA, 15 bp, Homo sapiens
aacctccatcctgcc

SEQ ID NO: 6893455 - DNA, 19 bp, Homo sapiens
tgcaacatttctgtatact

SEQ ID NO: 6893456 - DNA, 23 bp, Homo sapiens
agcccttccatgtcgcctctgca

SEQ ID NO: 6893457 - DNA, 21 bp, Homo sapiens
cttgctggctacgcctcttct

SEQ ID NO: 6893458 - DNA, 22 bp, Homo sapiens
atgctccctcagcctcagagga

SEQ ID NO: 6893459 - DNA, 19 bp, Homo sapiens
tggctcagacccctcagcc

SEQ ID NO: 6893460 - DNA, 16 bp, Homo sapiens
tacattcaaattcttt

SEQ ID NO: 6893461 - DNA, 19 bp, Homo sapiens
catgccttaaacctacctc

SEQ ID NO: 6893462 - DNA, 17 bp, Homo sapiens
ccctggtgtccctgcct

SEQ ID NO: 6893463 - DNA, 21 bp, Homo sapiens
tacatttgatgcatgtctttt

SEQ ID NO: 6893464 - DNA, 14 bp, Homo sapiens
taaacttgcaatga

SEQ ID NO: 6893465 - DNA, 14 bp, Homo sapiens
caagtgcctagact

SEQ ID NO: 6893466 - DNA, 19 bp, Homo sapiens
gatgtggccaggggtgctc

SEQ ID NO: 6893467 - DNA, 14 bp, Homo sapiens
gctaactgggttaa

SEQ ID NO: 6893468 - DNA, 14 bp, Homo sapiens
cattttgaaaatat

SEQ ID NO: 6893469 - DNA, 23 bp, Homo sapiens
aacatagtcctgttactatggta

SEQ ID NO: 6893470 - DNA, 22 bp, Homo sapiens
cccttggcgggcagcccagcct

SEQ ID NO: 6893471 - DNA, 18 bp, Homo sapiens
aaattacaagtattcagt

SEQ ID NO: 6893472 - DNA, 18 bp, Homo sapiens
cttcctcctcctttgcct

SEQ ID NO: 6893473 - DNA, 16 bp, Homo sapiens
cagtagcatctcagtg

SEQ ID NO: 6893474 - DNA, 22 bp, Homo sapiens
agggacccttgcctgcctccta

SEQ ID NO: 6893475 - DNA, 12 bp, Homo sapiens
aacttcagtgca

SEQ ID NO: 6893476 - DNA, 19 bp, Homo sapiens
ttcccagtgagcctctgcg

SEQ ID NO: 6893477 - DNA, 13 bp, Homo sapiens
acataaagactgt

SEQ ID NO: 6893478 - DNA, 22 bp, Homo sapiens
cttaagataatatttaaaatag

SEQ ID NO: 6893479 - DNA, 17 bp, Homo sapiens
ctgtctaacctgtgacc

SEQ ID NO: 6893480 - DNA, 17 bp, Homo sapiens
ccttccatatccctgcc

SEQ ID NO: 6893481 - DNA, 16 bp, Homo sapiens
cttagggccctggagg

SEQ ID NO: 6893482 - DNA, 23 bp, Homo sapiens
agccgtggcttcccgctcagccc

SEQ ID NO: 6893483 - DNA, 20 bp, Homo sapiens
cccttggagctgccgtgcct

SEQ ID NO: 6893484 - DNA, 19 bp, Homo sapiens
tggcctggcatctgtgtgt

SEQ ID NO: 6893485 - DNA, 15 bp, Homo sapiens
actgtcctttctcca

SEQ ID NO: 6893486 - DNA, 18 bp, Homo sapiens
ttgtgtactttcttccct

SEQ ID NO: 6893487 - DNA, 23 bp, Homo sapiens
tcaacctaccaccccttcctgtc

SEQ ID NO: 6893488 - DNA, 13 bp, Homo sapiens
cctggactttcct

SEQ ID NO: 6893489 - DNA, 14 bp, Homo sapiens
ccagttctgctcct

SEQ ID NO: 6893490 - DNA, 17 bp, Homo sapiens
cttaggcctctctgcct

SEQ ID NO: 6893491 - DNA, 14 bp, Homo sapiens
gcattactcttgta

SEQ ID NO: 6893492 - DNA, 14 bp, Homo sapiens
taatcttaatgtat

SEQ ID NO: 6893493 - DNA, 14 bp, Homo sapiens
aaattttgtaagaa

SEQ ID NO: 6893494 - DNA, 13 bp, Homo sapiens
ggggtgctgtggt

SEQ ID NO: 6893495 - DNA, 17 bp, Homo sapiens
taattttgatatacatt

SEQ ID NO: 6893496 - DNA, 14 bp, Homo sapiens
cacagccctgtcag

SEQ ID NO: 6893497 - DNA, 16 bp, Homo sapiens
tgtgcttttaaatgca

SEQ ID NO: 6893498 - DNA, 16 bp, Homo sapiens
ctcaaatggggccaga

SEQ ID NO: 6893499 - DNA, 14 bp, Homo sapiens
ctaaactgtttctt

SEQ ID NO: 6893500 - DNA, 19 bp, Homo sapiens
cagtgctgtccatgcttct

SEQ ID NO: 6893501 - DNA, 18 bp, Homo sapiens
ttcatggaatggacatcc

SEQ ID NO: 6893502 - DNA, 12 bp, Homo sapiens
cctaagcatcta

SEQ ID NO: 6893503 - DNA, 18 bp, Homo sapiens
tggcagtcctggaagcca

SEQ ID NO: 6893504 - DNA, 18 bp, Homo sapiens
cagctgtgagccatgcct

SEQ ID NO: 6893505 - DNA, 15 bp, Homo sapiens
caggtggggcagctt

SEQ ID NO: 6893506 - DNA, 12 bp, Homo sapiens
cccagccaccac

SEQ ID NO: 6893507 - DNA, 22 bp, Homo sapiens
agaggtgtacactaacatttcc

SEQ ID NO: 6893508 - DNA, 16 bp, Homo sapiens
catatgctgtacatga

SEQ ID NO: 6893509 - DNA, 16 bp, Homo sapiens
cccagaaaaaaggact

SEQ ID NO: 6893510 - DNA, 16 bp, Homo sapiens
cccaggcccctgccac

SEQ ID NO: 6893511 - DNA, 21 bp, Homo sapiens
tcacagtcctggactcctgcc

SEQ ID NO: 6893512 - DNA, 19 bp, Homo sapiens
tatagattagaattctgta

SEQ ID NO: 6893513 - DNA, 13 bp, Homo sapiens
acagtttgctgta

SEQ ID NO: 6893514 - DNA, 16 bp, Homo sapiens
ttctagagcactgcca

SEQ ID NO: 6893515 - DNA, 18 bp, Homo sapiens
cagacaaagccctgtcct

SEQ ID NO: 6893516 - DNA, 15 bp, Homo sapiens
ttgtaagtatgtgaa

SEQ ID NO: 6893517 - DNA, 22 bp, Homo sapiens
cctacagttggaaatccatcca

SEQ ID NO: 6893518 - DNA, 17 bp, Homo sapiens
tgctgccaaccatacct

SEQ ID NO: 6893519 - DNA, 16 bp, Homo sapiens
acttgctccctctcca

SEQ ID NO: 6893520 - DNA, 13 bp, Homo sapiens
ccctccccctacc

SEQ ID NO: 6893521 - DNA, 18 bp, Homo sapiens
ataaactgagcctgttca

SEQ ID NO: 6893522 - DNA, 22 bp, Homo sapiens
ttaactattgcatttatatgta

SEQ ID NO: 6893523 - DNA, 14 bp, Homo sapiens
agtgctctgcctct

SEQ ID NO: 6893524 - DNA, 12 bp, Homo sapiens
actcctcctgcc

SEQ ID NO: 6893525 - DNA, 12 bp, Homo sapiens
atttctggtcaa

SEQ ID NO: 6893526 - DNA, 17 bp, Homo sapiens
ctggagatcctcctgca

SEQ ID NO: 6893527 - DNA, 17 bp, Homo sapiens
caatccaaatgcattca

SEQ ID NO: 6893528 - DNA, 13 bp, Homo sapiens
ttaatctactgta

SEQ ID NO: 6893529 - DNA, 16 bp, Homo sapiens
cgattctcctgcctca

SEQ ID NO: 6893530 - DNA, 20 bp, Homo sapiens
atgtatgtggatacagtcat

SEQ ID NO: 6893531 - DNA, 23 bp, Homo sapiens
atgttgtgttggtatttactgca

SEQ ID NO: 6893532 - DNA, 23 bp, Homo sapiens
ccgtcctggaggttccccagccc

SEQ ID NO: 6893533 - DNA, 21 bp, Homo sapiens
cagttcagaaatttggcattg

SEQ ID NO: 6893534 - DNA, 14 bp, Homo sapiens
ccgctgcccagccc

SEQ ID NO: 6893535 - DNA, 19 bp, Homo sapiens
cggaggggatccagccact

SEQ ID NO: 6893536 - DNA, 16 bp, Homo sapiens
cttggtgactgtccca

SEQ ID NO: 6893537 - DNA, 18 bp, Homo sapiens
cagcctggcctcctgcct

SEQ ID NO: 6893538 - DNA, 20 bp, Homo sapiens
aatgtttataactctaggga

SEQ ID NO: 6893539 - DNA, 21 bp, Homo sapiens
ctccatgcttagtcactgcct

SEQ ID NO: 6893540 - DNA, 20 bp, Homo sapiens
ataatgttattattactcta

SEQ ID NO: 6893541 - DNA, 21 bp, Homo sapiens
agggtatgtcacaaagagctg

SEQ ID NO: 6893542 - DNA, 23 bp, Homo sapiens
tgacccggcccccgccctctgcc

SEQ ID NO: 6893543 - DNA, 23 bp, Homo sapiens
tgcagctgggcttggcctggaga

SEQ ID NO: 6893544 - DNA, 14 bp, Homo sapiens
aacttcatctgcca

SEQ ID NO: 6893545 - DNA, 13 bp, Homo sapiens
ctcctcactgcca

SEQ ID NO: 6893546 - DNA, 19 bp, Homo sapiens
catgagttgtcagctttga

SEQ ID NO: 6893547 - DNA, 19 bp, Homo sapiens
cagaaatgtggatgctctt

SEQ ID NO: 6893548 - DNA, 16 bp, Homo sapiens
ctggagccagggcaga

SEQ ID NO: 6893549 - DNA, 14 bp, Homo sapiens
tccctttccctacc

SEQ ID NO: 6893550 - DNA, 13 bp, Homo sapiens
tcctctcttggca

SEQ ID NO: 6893551 - DNA, 21 bp, Homo sapiens
cattgtcttgttatgtacaaa

SEQ ID NO: 6893552 - DNA, 18 bp, Homo sapiens
tcggacagcccatctgcc

SEQ ID NO: 6893553 - DNA, 13 bp, Homo sapiens
cattgctacctca

SEQ ID NO: 6893554 - DNA, 15 bp, Homo sapiens
atcaaaactttcttt

SEQ ID NO: 6893555 - DNA, 22 bp, Homo sapiens
tagctttattatggcttgtgaa

SEQ ID NO: 6893556 - DNA, 14 bp, Homo sapiens
cacgtcccgctgcc

SEQ ID NO: 6893557 - DNA, 21 bp, Homo sapiens
ctttcgacttgcatttttgca

SEQ ID NO: 6893558 - DNA, 19 bp, Homo sapiens
taattgtgtttacatttta

SEQ ID NO: 6893559 - DNA, 16 bp, Homo sapiens
ctaagtgggacattag

SEQ ID NO: 6893560 - DNA, 19 bp, Homo sapiens
aaaatttgagactatttaa

SEQ ID NO: 6893561 - DNA, 19 bp, Homo sapiens
gccagggctgggtcacagg

SEQ ID NO: 6893562 - DNA, 14 bp, Homo sapiens
ccatgactgctcag

SEQ ID NO: 6893563 - DNA, 22 bp, Homo sapiens
ccctcttcggtgttcttcttct

SEQ ID NO: 6893564 - DNA, 19 bp, Homo sapiens
ctgtggaaggcctccctct

SEQ ID NO: 6893565 - DNA, 21 bp, Homo sapiens
agggaggcggggaggaggaac

SEQ ID NO: 6893566 - DNA, 18 bp, Homo sapiens
ctacataattaaatttta

SEQ ID NO: 6893567 - DNA, 18 bp, Homo sapiens
aggaaggagctgcctgga

SEQ ID NO: 6893568 - DNA, 14 bp, Homo sapiens
cctgagcactgcca

SEQ ID NO: 6893569 - DNA, 22 bp, Homo sapiens
cctttcctacatgccccctccc

SEQ ID NO: 6893570 - DNA, 17 bp, Homo sapiens
atcctgcaccctctgct

SEQ ID NO: 6893571 - DNA, 23 bp, Homo sapiens
ctccaggtcggagtgcctggagt

SEQ ID NO: 6893572 - DNA, 18 bp, Homo sapiens
ccctctcttaccccgtcc

SEQ ID NO: 6893573 - DNA, 23 bp, Homo sapiens
aatggcaacaaacacattgtgaa

SEQ ID NO: 6893574 - DNA, 12 bp, Homo sapiens
tcctgtttgtat

SEQ ID NO: 6893575 - DNA, 17 bp, Homo sapiens
ccaatttttctgcactg

SEQ ID NO: 6893576 - DNA, 20 bp, Homo sapiens
caaccaggaggggtctgcct

SEQ ID NO: 6893577 - DNA, 22 bp, Homo sapiens
aggcctacatgctttgtgaaca

SEQ ID NO: 6893578 - DNA, 19 bp, Homo sapiens
cagggctgcaaaactggaa

SEQ ID NO: 6893579 - DNA, 21 bp, Homo sapiens
ctcagtgaagttgctgcttct

SEQ ID NO: 6893580 - DNA, 13 bp, Homo sapiens
ccaccctcctgcg

SEQ ID NO: 6893581 - DNA, 20 bp, Homo sapiens
gccctttagggctgttgcta

SEQ ID NO: 6893582 - DNA, 22 bp, Homo sapiens
acagtctacattgagcatttga

SEQ ID NO: 6893583 - DNA, 19 bp, Homo sapiens
tcttcccttctcccttgcc

SEQ ID NO: 6893584 - DNA, 20 bp, Homo sapiens
ctactggcagctcctctcct

SEQ ID NO: 6893585 - DNA, 17 bp, Homo sapiens
ttcccgatggtctctct

SEQ ID NO: 6893586 - DNA, 15 bp, Homo sapiens
cttgttgcactgccc

SEQ ID NO: 6893587 - DNA, 13 bp, Homo sapiens
ctccagggccagg

SEQ ID NO: 6893588 - DNA, 19 bp, Homo sapiens
accccttgttgcactgccc

SEQ ID NO: 6893589 - DNA, 14 bp, Homo sapiens
cctcctcagctccc

SEQ ID NO: 6893590 - DNA, 13 bp, Homo sapiens
ctcctcactgccc

SEQ ID NO: 6893591 - DNA, 19 bp, Homo sapiens
tgtgcaagtgtctgtgtgc

SEQ ID NO: 6893592 - DNA, 13 bp, Homo sapiens
cctcctcccatcc

SEQ ID NO: 6893593 - DNA, 14 bp, Homo sapiens
ttccgacttgtccc

SEQ ID NO: 6893594 - DNA, 18 bp, Homo sapiens
caaaagaatgagtgcctt

SEQ ID NO: 6893595 - DNA, 10 bp, Homo sapiens
catgcactgt

SEQ ID NO: 6893596 - DNA, 22 bp, Homo sapiens
aacggcatgtgaattctgtgaa

SEQ ID NO: 6893597 - DNA, 19 bp, Homo sapiens
tgtatttaggccatttgtt

SEQ ID NO: 6893598 - DNA, 20 bp, Homo sapiens
cttctgggtggctcctgcca

SEQ ID NO: 6893599 - DNA, 19 bp, Homo sapiens
ctgtccccagccctgtcct

SEQ ID NO: 6893600 - DNA, 15 bp, Homo sapiens
ctttgcaggttgctt

SEQ ID NO: 6893601 - DNA, 15 bp, Homo sapiens
atttctctgtgaatc

SEQ ID NO: 6893602 - DNA, 19 bp, Homo sapiens
gtatgctgatcatcgccag

SEQ ID NO: 6893603 - DNA, 21 bp, Homo sapiens
aaaatccactttatcttgaat

SEQ ID NO: 6893604 - DNA, 15 bp, Homo sapiens
cggctcctcctcacc

SEQ ID NO: 6893605 - DNA, 20 bp, Homo sapiens
actttcacgtggcctccgca

SEQ ID NO: 6893606 - DNA, 15 bp, Homo sapiens
gagaagctactttgt

SEQ ID NO: 6893607 - DNA, 13 bp, Homo sapiens
tcctctgctgcat

SEQ ID NO: 6893608 - DNA, 14 bp, Homo sapiens
aggtgcactccaga

SEQ ID NO: 6893609 - DNA, 18 bp, Homo sapiens
cactgtccttccctgcca

SEQ ID NO: 6893610 - DNA, 20 bp, Homo sapiens
cttccagatttgagctgcct

SEQ ID NO: 6893611 - DNA, 15 bp, Homo sapiens
aatactacctctgaa

SEQ ID NO: 6893612 - DNA, 14 bp, Homo sapiens
agacagaacttgaa

SEQ ID NO: 6893613 - DNA, 18 bp, Homo sapiens
ctcttagtcctccctgct

SEQ ID NO: 6893614 - DNA, 14 bp, Homo sapiens
cctcgccctctcct

SEQ ID NO: 6893615 - DNA, 16 bp, Homo sapiens
ctttaccttcatttca

SEQ ID NO: 6893616 - DNA, 20 bp, Homo sapiens
cacccacccccaggcctcct

SEQ ID NO: 6893617 - DNA, 14 bp, Homo sapiens
agccttcagctcca

SEQ ID NO: 6893618 - DNA, 15 bp, Homo sapiens
cccttcctcctgcct

SEQ ID NO: 6893619 - DNA, 14 bp, Homo sapiens
attccttggcagcc

SEQ ID NO: 6893620 - DNA, 21 bp, Homo sapiens
acaatttcatttccagcattt

SEQ ID NO: 6893621 - DNA, 15 bp, Homo sapiens
tttggtttacattta

SEQ ID NO: 6893622 - DNA, 21 bp, Homo sapiens
agaagggttagacaagcctgg

SEQ ID NO: 6893623 - DNA, 22 bp, Homo sapiens
atacatcttcattaatactgtg

SEQ ID NO: 6893624 - DNA, 15 bp, Homo sapiens
acctctcccagccct

SEQ ID NO: 6893625 - DNA, 16 bp, Homo sapiens
atcattgtaaacatta

SEQ ID NO: 6893626 - DNA, 13 bp, Homo sapiens
cattcctgtgccc

SEQ ID NO: 6893627 - DNA, 12 bp, Homo sapiens
aaagccacatct

SEQ ID NO: 6893628 - DNA, 14 bp, Homo sapiens
cacccacctcggcc

SEQ ID NO: 6893629 - DNA, 23 bp, Homo sapiens
gagggcactcagaagttgtgcta

SEQ ID NO: 6893630 - DNA, 21 bp, Homo sapiens
cctctactaatttcctgctga

SEQ ID NO: 6893631 - DNA, 20 bp, Homo sapiens
ccgatgctgaggccacccac

SEQ ID NO: 6893632 - DNA, 20 bp, Homo sapiens
caaacctcacactactgtat

SEQ ID NO: 6893633 - DNA, 16 bp, Homo sapiens
accgcttccggctcct

SEQ ID NO: 6893634 - DNA, 23 bp, Homo sapiens
aggccttggtggagcagccagag

SEQ ID NO: 6893635 - DNA, 14 bp, Homo sapiens
cattctaatgcata

SEQ ID NO: 6893636 - DNA, 22 bp, Homo sapiens
ccatggagtggcagcccagcca

SEQ ID NO: 6893637 - DNA, 19 bp, Homo sapiens
tcagcaaaaagactggatt

SEQ ID NO: 6893638 - DNA, 21 bp, Homo sapiens
agccgggggaggggccctcag

SEQ ID NO: 6893639 - DNA, 11 bp, Homo sapiens
accgcattcca

SEQ ID NO: 6893640 - DNA, 18 bp, Homo sapiens
agtacctactgtgtgcca

SEQ ID NO: 6893641 - DNA, 18 bp, Homo sapiens
ctcagcagttcacttcct

SEQ ID NO: 6893642 - DNA, 17 bp, Homo sapiens
ccctctcctccccttcc

SEQ ID NO: 6893643 - DNA, 15 bp, Homo sapiens
agcagtccctgctta

SEQ ID NO: 6893644 - DNA, 12 bp, Homo sapiens
ctatacattcct

SEQ ID NO: 6893645 - DNA, 15 bp, Homo sapiens
cagcccctcctccct

SEQ ID NO: 6893646 - DNA, 19 bp, Homo sapiens
ctatgggggcactgaggac

SEQ ID NO: 6893647 - DNA, 14 bp, Homo sapiens
ccatgtgctgggaa

SEQ ID NO: 6893648 - DNA, 18 bp, Homo sapiens
caaagcacttaagtgtta

SEQ ID NO: 6893649 - DNA, 11 bp, Homo sapiens
tgttggctgcg

SEQ ID NO: 6893650 - DNA, 15 bp, Homo sapiens
tatatttatactcta

SEQ ID NO: 6893651 - DNA, 16 bp, Homo sapiens
aaataatactaattta

SEQ ID NO: 6893652 - DNA, 15 bp, Homo sapiens
taatatggatctgta

SEQ ID NO: 6893653 - DNA, 17 bp, Homo sapiens
gagttccattcttggca

SEQ ID NO: 6893654 - DNA, 14 bp, Homo sapiens
ccctcagcctgcct

SEQ ID NO: 6893655 - DNA, 18 bp, Homo sapiens
tgaataccacttacctca

SEQ ID NO: 6893656 - DNA, 23 bp, Homo sapiens
actggctgggagtccttacctcg

SEQ ID NO: 6893657 - DNA, 22 bp, Homo sapiens
tcatggctgttatctgtcttta

SEQ ID NO: 6893658 - DNA, 15 bp, Homo sapiens
cctgacccccttcct

SEQ ID NO: 6893659 - DNA, 21 bp, Homo sapiens
cgccaaagtgcagcccttcct

SEQ ID NO: 6893660 - DNA, 16 bp, Homo sapiens
ctccaaacaattctga

SEQ ID NO: 6893661 - DNA, 15 bp, Homo sapiens
cctgcgtcccagcct

SEQ ID NO: 6893662 - DNA, 17 bp, Homo sapiens
agacaaaagtctgtctt

SEQ ID NO: 6893663 - DNA, 21 bp, Homo sapiens
cccagactgtctccacggcct

SEQ ID NO: 6893664 - DNA, 12 bp, Homo sapiens
ctaagaaaatag

SEQ ID NO: 6893665 - DNA, 16 bp, Homo sapiens
tcctcatcctccctga

SEQ ID NO: 6893666 - DNA, 18 bp, Homo sapiens
tccctgggaactcatcct

SEQ ID NO: 6893667 - DNA, 14 bp, Homo sapiens
tgtccaactggccc

SEQ ID NO: 6893668 - DNA, 12 bp, Homo sapiens
cttgtcaggacc

SEQ ID NO: 6893669 - DNA, 15 bp, Homo sapiens
caaccagcacatcca

SEQ ID NO: 6893670 - DNA, 20 bp, Homo sapiens
caataaaggcagctgcctct

SEQ ID NO: 6893671 - DNA, 14 bp, Homo sapiens
cagcgcacagctgc

SEQ ID NO: 6893672 - DNA, 17 bp, Homo sapiens
gaaactgagtctgtgga

SEQ ID NO: 6893673 - DNA, 20 bp, Homo sapiens
ctctaacaccacactgacca

SEQ ID NO: 6893674 - DNA, 13 bp, Homo sapiens
ggtgggaggggaa

SEQ ID NO: 6893675 - DNA, 22 bp, Homo sapiens
catgtattagccagtcattgta

SEQ ID NO: 6893676 - DNA, 17 bp, Homo sapiens
ggcttcagtggcagctg

SEQ ID NO: 6893677 - DNA, 15 bp, Homo sapiens
ctcagaggagtctgg

SEQ ID NO: 6893678 - DNA, 23 bp, Homo sapiens
caagtgggctggtattctctcta

SEQ ID NO: 6893679 - DNA, 21 bp, Homo sapiens
agactcttcccctccctccca

SEQ ID NO: 6893680 - DNA, 19 bp, Homo sapiens
tccagcccctcctccctca

SEQ ID NO: 6893681 - DNA, 21 bp, Homo sapiens
tctcctggcctggccatctcc

SEQ ID NO: 6893682 - DNA, 15 bp, Homo sapiens
aacctcctctgtgaa

SEQ ID NO: 6893683 - DNA, 13 bp, Homo sapiens
ctttcatctctct

SEQ ID NO: 6893684 - DNA, 23 bp, Homo sapiens
tttgcacctgtccccaccctcca

SEQ ID NO: 6893685 - DNA, 13 bp, Homo sapiens
tgattatttgcat

SEQ ID NO: 6893686 - DNA, 17 bp, Homo sapiens
aatggccagtgctgctt

SEQ ID NO: 6893687 - DNA, 20 bp, Homo sapiens
aggcactgttcaatactgta

SEQ ID NO: 6893688 - DNA, 21 bp, Homo sapiens
ggcccccaacccctcctccct

SEQ ID NO: 6893689 - DNA, 18 bp, Homo sapiens
tctcagatccttgtttca

SEQ ID NO: 6893690 - DNA, 15 bp, Homo sapiens
cacaggatcagtctg

SEQ ID NO: 6893691 - DNA, 17 bp, Homo sapiens
ccatcccctccctgcct

SEQ ID NO: 6893692 - DNA, 14 bp, Homo sapiens
attaacctctgcac

SEQ ID NO: 6893693 - DNA, 19 bp, Homo sapiens
tgaataaagaatacttgaa

SEQ ID NO: 6893694 - DNA, 17 bp, Homo sapiens
cacagtaaaaacttgta

SEQ ID NO: 6893695 - DNA, 14 bp, Homo sapiens
gcctcccaggccac

SEQ ID NO: 6893696 - DNA, 14 bp, Homo sapiens
acgtgcactgacag

SEQ ID NO: 6893697 - DNA, 20 bp, Homo sapiens
ccggctgctcctccagccct

SEQ ID NO: 6893698 - DNA, 20 bp, Homo sapiens
acataactcacacccctgcc

SEQ ID NO: 6893699 - DNA, 18 bp, Homo sapiens
gcctcatgctgacttgca

SEQ ID NO: 6893700 - DNA, 21 bp, Homo sapiens
ccagggcaggctaccccttca

SEQ ID NO: 6893701 - DNA, 15 bp, Homo sapiens
tcatgatgcagtctc

SEQ ID NO: 6893702 - DNA, 14 bp, Homo sapiens
ctctctctccctcc

SEQ ID NO: 6893703 - DNA, 16 bp, Homo sapiens
ccactgatgctgttct

SEQ ID NO: 6893704 - DNA, 14 bp, Homo sapiens
agtcccactgcacc

SEQ ID NO: 6893705 - DNA, 12 bp, Homo sapiens
gtttttgccaaa

SEQ ID NO: 6893706 - DNA, 14 bp, Homo sapiens
caggaagctgtgag

SEQ ID NO: 6893707 - DNA, 17 bp, Homo sapiens
ctagtttatgctaccta

SEQ ID NO: 6893708 - DNA, 14 bp, Homo sapiens
caggggcaggcgca

SEQ ID NO: 6893709 - DNA, 17 bp, Homo sapiens
atacaatttacttttaa

SEQ ID NO: 6893710 - DNA, 15 bp, Homo sapiens
cgggcagtctgctct

SEQ ID NO: 6893711 - DNA, 13 bp, Homo sapiens
ctgtcccttgcct

SEQ ID NO: 6893712 - DNA, 17 bp, Homo sapiens
ctttgttgttctgcctg

SEQ ID NO: 6893713 - DNA, 14 bp, Homo sapiens
tgtgcatctggcct

SEQ ID NO: 6893714 - DNA, 17 bp, Homo sapiens
actttatttaatttcat

SEQ ID NO: 6893715 - DNA, 17 bp, Homo sapiens
acctgcacacccctgca

SEQ ID NO: 6893716 - DNA, 12 bp, Homo sapiens
atgtgttccaaa

SEQ ID NO: 6893717 - DNA, 15 bp, Homo sapiens
attaattcaatgaaa

SEQ ID NO: 6893718 - DNA, 12 bp, Homo sapiens
ctttccctgccc

SEQ ID NO: 6893719 - DNA, 21 bp, Homo sapiens
agttcatacctaagtactgta

SEQ ID NO: 6893720 - DNA, 15 bp, Homo sapiens
tcagggacctgctgc

SEQ ID NO: 6893721 - DNA, 15 bp, Homo sapiens
tatcagatacatcac

SEQ ID NO: 6893722 - DNA, 17 bp, Homo sapiens
ttccatttttcctctgt

SEQ ID NO: 6893723 - DNA, 17 bp, Homo sapiens
ctcctgggatctgctcg

SEQ ID NO: 6893724 - DNA, 14 bp, Homo sapiens
ccttcctcctctcc

SEQ ID NO: 6893725 - DNA, 21 bp, Homo sapiens
atgcctctggaggcctctggc

SEQ ID NO: 6893726 - DNA, 18 bp, Homo sapiens
caagtggagcctgacagc

SEQ ID NO: 6893727 - DNA, 15 bp, Homo sapiens
cttcccctccctccc

SEQ ID NO: 6893728 - DNA, 13 bp, Homo sapiens
aataaaatattca

SEQ ID NO: 6893729 - DNA, 18 bp, Homo sapiens
aggcctgacacaggccag

SEQ ID NO: 6893730 - DNA, 14 bp, Homo sapiens
ctcaggctgtccca

SEQ ID NO: 6893731 - DNA, 18 bp, Homo sapiens
caaattatttgtgtaata

SEQ ID NO: 6893732 - DNA, 19 bp, Homo sapiens
tggtgtcagcccctcttcc

SEQ ID NO: 6893733 - DNA, 22 bp, Homo sapiens
aatattgacttctcttgaatta

SEQ ID NO: 6893734 - DNA, 19 bp, Homo sapiens
tctccacccccagctgctt

SEQ ID NO: 6893735 - DNA, 22 bp, Homo sapiens
ccttttctagcccgaatacaaa

SEQ ID NO: 6893736 - DNA, 16 bp, Homo sapiens
caactttactgtccta

SEQ ID NO: 6893737 - DNA, 21 bp, Homo sapiens
tatgcttttataggcctgtgt

SEQ ID NO: 6893738 - DNA, 13 bp, Homo sapiens
cagtccccagccc

SEQ ID NO: 6893739 - DNA, 18 bp, Homo sapiens
ttaaccttccaagactga

SEQ ID NO: 6893740 - DNA, 15 bp, Homo sapiens
attgtttcatatctg

SEQ ID NO: 6893741 - DNA, 19 bp, Homo sapiens
ggctaacatttaggagaag

SEQ ID NO: 6893742 - DNA, 15 bp, Homo sapiens
ccagcatcccagcct

SEQ ID NO: 6893743 - DNA, 14 bp, Homo sapiens
tttcttcctctgca

SEQ ID NO: 6893744 - DNA, 17 bp, Homo sapiens
agcccttgcacaggcca

SEQ ID NO: 6893745 - DNA, 20 bp, Homo sapiens
ttcctgagcagtccctgctt

SEQ ID NO: 6893746 - DNA, 15 bp, Homo sapiens
agctatacctgtgcc

SEQ ID NO: 6893747 - DNA, 17 bp, Homo sapiens
tcaatgcccctgaattt

SEQ ID NO: 6893748 - DNA, 12 bp, Homo sapiens
gtgtccctgtgg

SEQ ID NO: 6893749 - DNA, 14 bp, Homo sapiens
ttcccctccctggg

SEQ ID NO: 6893750 - DNA, 20 bp, Homo sapiens
tcacctatttaatgttttta

SEQ ID NO: 6893751 - DNA, 14 bp, Homo sapiens
ccacatctgtttca

SEQ ID NO: 6893752 - DNA, 14 bp, Homo sapiens
ctgtgctgccctgc

SEQ ID NO: 6893753 - DNA, 22 bp, Homo sapiens
catatcctggtgccccccaccc

SEQ ID NO: 6893754 - DNA, 21 bp, Homo sapiens
aaccgtccccggcccctgccc

SEQ ID NO: 6893755 - DNA, 14 bp, Homo sapiens
ctccagtcctgcca

SEQ ID NO: 6893756 - DNA, 16 bp, Homo sapiens
cccttccgtccatccc

SEQ ID NO: 6893757 - DNA, 16 bp, Homo sapiens
tgaactcaatgcatga

SEQ ID NO: 6893758 - DNA, 21 bp, Homo sapiens
tgtaaactataaactactgta

SEQ ID NO: 6893759 - DNA, 19 bp, Homo sapiens
cattgaggataaattgcca

SEQ ID NO: 6893760 - DNA, 22 bp, Homo sapiens
tcctgggcccctccctacctca

SEQ ID NO: 6893761 - DNA, 13 bp, Homo sapiens
tgtaccatctgtc

SEQ ID NO: 6893762 - DNA, 18 bp, Homo sapiens
cacccctctgcccctgca

SEQ ID NO: 6893763 - DNA, 18 bp, Homo sapiens
cctgctggggccgccacg

SEQ ID NO: 6893764 - DNA, 21 bp, Homo sapiens
tgcccacttctgtgtagacat

SEQ ID NO: 6893765 - DNA, 13 bp, Homo sapiens
tgtacattatgtt

SEQ ID NO: 6893766 - DNA, 11 bp, Homo sapiens
ggcctgctgct

SEQ ID NO: 6893767 - DNA, 16 bp, Homo sapiens
tgccagacattgctct

SEQ ID NO: 6893768 - DNA, 17 bp, Homo sapiens
gaggaactgtccagaga

SEQ ID NO: 6893769 - DNA, 18 bp, Homo sapiens
gattgttttatcatgaca

SEQ ID NO: 6893770 - DNA, 14 bp, Homo sapiens
cagacctcatgccc

SEQ ID NO: 6893771 - DNA, 12 bp, Homo sapiens
tagataaactca

SEQ ID NO: 6893772 - DNA, 18 bp, Homo sapiens
cctggcctggccctgccc

SEQ ID NO: 6893773 - DNA, 13 bp, Homo sapiens
caaatctgtgtat

SEQ ID NO: 6893774 - DNA, 21 bp, Homo sapiens
ccagctccttggctgcagcca

SEQ ID NO: 6893775 - DNA, 18 bp, Homo sapiens
gcctggtgcgctgtgctc

SEQ ID NO: 6893776 - DNA, 12 bp, Homo sapiens
agctttctgtgc

SEQ ID NO: 6893777 - DNA, 19 bp, Homo sapiens
caaggcctctctctgcctg

SEQ ID NO: 6893778 - DNA, 23 bp, Homo sapiens
agggcaccccttgtttctgttgt

SEQ ID NO: 6893779 - DNA, 17 bp, Homo sapiens
agttactcagccctggg

SEQ ID NO: 6893780 - DNA, 15 bp, Homo sapiens
acttcatcttctcag

SEQ ID NO: 6893781 - DNA, 15 bp, Homo sapiens
attctagtgctgctg

SEQ ID NO: 6893782 - DNA, 18 bp, Homo sapiens
tagaacaggacctctgct

SEQ ID NO: 6893783 - DNA, 16 bp, Homo sapiens
acattgctgtatttta

SEQ ID NO: 6893784 - DNA, 14 bp, Homo sapiens
ctttattgcactag

SEQ ID NO: 6893785 - DNA, 16 bp, Homo sapiens
ccctgccaccgtcaca

SEQ ID NO: 6893786 - DNA, 19 bp, Homo sapiens
agatgctagagcctctgcc

SEQ ID NO: 6893787 - DNA, 20 bp, Homo sapiens
catggagactcctgccctgt

SEQ ID NO: 6893788 - DNA, 23 bp, Homo sapiens
gaagttccacttaacacatgaat

SEQ ID NO: 6893789 - DNA, 20 bp, Homo sapiens
cacattaacccccaaattca

SEQ ID NO: 6893790 - DNA, 16 bp, Homo sapiens
cagtgctgccatgcca

SEQ ID NO: 6893791 - DNA, 18 bp, Homo sapiens
ttctctccagcccctgga

SEQ ID NO: 6893792 - DNA, 24 bp, Homo sapiens
ctcagttcgaccaaactcagttca

SEQ ID NO: 6893793 - DNA, 19 bp, Homo sapiens
cacccggtgacctctagcc

SEQ ID NO: 6893794 - DNA, 15 bp, Homo sapiens
aatttatgcatttca

SEQ ID NO: 6893795 - DNA, 19 bp, Homo sapiens
tgtgtggatgctgagctgt

SEQ ID NO: 6893796 - DNA, 17 bp, Homo sapiens
acattttcttgaatttt

SEQ ID NO: 6893797 - DNA, 20 bp, Homo sapiens
cagcagacagagccaggaga

SEQ ID NO: 6893798 - DNA, 13 bp, Homo sapiens
aatggtctcagtg

SEQ ID NO: 6893799 - DNA, 20 bp, Homo sapiens
gatgttacaagtttgctaaa

SEQ ID NO: 6893800 - DNA, 16 bp, Homo sapiens
cttatactgtacaata

SEQ ID NO: 6893801 - DNA, 17 bp, Homo sapiens
agcttctgccccctgca

SEQ ID NO: 6893802 - DNA, 19 bp, Homo sapiens
ctgtgtatgagtgtgaatg

SEQ ID NO: 6893803 - DNA, 18 bp, Homo sapiens
tctgcgtccaccaggcct

SEQ ID NO: 6893804 - DNA, 14 bp, Homo sapiens
agatacctgtgagg

SEQ ID NO: 6893805 - DNA, 12 bp, Homo sapiens
agacctacctcc

SEQ ID NO: 6893806 - DNA, 17 bp, Homo sapiens
cagtcgccctctgtgcc

SEQ ID NO: 6893807 - DNA, 22 bp, Homo sapiens
cccacagcacagctccctgcca

SEQ ID NO: 6893808 - DNA, 16 bp, Homo sapiens
gcttcactcctgctgt

SEQ ID NO: 6893809 - DNA, 16 bp, Homo sapiens
ggctccctcctctggc

SEQ ID NO: 6893810 - DNA, 22 bp, Homo sapiens
caccacactccccgcctgtcct

SEQ ID NO: 6893811 - DNA, 22 bp, Homo sapiens
ataaatggtctcagtatctgta

SEQ ID NO: 6893812 - DNA, 17 bp, Homo sapiens
agtcctggtccctctga

SEQ ID NO: 6893813 - DNA, 15 bp, Homo sapiens
tccaattagtttcct

SEQ ID NO: 6893814 - DNA, 16 bp, Homo sapiens
atcatgagcctgctgg

SEQ ID NO: 6893815 - DNA, 15 bp, Homo sapiens
cctctgtctcatcct

SEQ ID NO: 6893816 - DNA, 22 bp, Homo sapiens
tctatacaaatataaatcttaa

SEQ ID NO: 6893817 - DNA, 17 bp, Homo sapiens
gcctcggctcctgctgc

SEQ ID NO: 6893818 - DNA, 14 bp, Homo sapiens
caatcttgttactg

SEQ ID NO: 6893819 - DNA, 23 bp, Homo sapiens
agcagcagcacttagacctgcca

SEQ ID NO: 6893820 - DNA, 22 bp, Homo sapiens
cagtatacaagataagcttcca

SEQ ID NO: 6893821 - DNA, 19 bp, Homo sapiens
actccagggtcccctgcca

SEQ ID NO: 6893822 - DNA, 17 bp, Homo sapiens
ggtgcacttttctgtgt

SEQ ID NO: 6893823 - DNA, 15 bp, Homo sapiens
ccttcaaggcctccc

SEQ ID NO: 6893824 - DNA, 14 bp, Homo sapiens
ctccactcactcca

SEQ ID NO: 6893825 - DNA, 21 bp, Homo sapiens
tcacatttttgtaatgctgta

SEQ ID NO: 6893826 - DNA, 16 bp, Homo sapiens
ctcgcgattcaggacg

SEQ ID NO: 6893827 - DNA, 14 bp, Homo sapiens
tgcacccctcccat

SEQ ID NO: 6893828 - DNA, 18 bp, Homo sapiens
gccctctcactccagcca

SEQ ID NO: 6893829 - DNA, 20 bp, Homo sapiens
agtagcactgactatttgac

SEQ ID NO: 6893830 - DNA, 13 bp, Homo sapiens
tcatgcctgctga

SEQ ID NO: 6893831 - DNA, 13 bp, Homo sapiens
ccaggctgtgcta

SEQ ID NO: 6893832 - DNA, 21 bp, Homo sapiens
cctgctgcaccaacccagccg

SEQ ID NO: 6893833 - DNA, 23 bp, Homo sapiens
cactgccccaccagccacctctt

SEQ ID NO: 6893834 - DNA, 14 bp, Homo sapiens
caccaactctctct

SEQ ID NO: 6893835 - DNA, 20 bp, Homo sapiens
catttatttattcatgtgta

SEQ ID NO: 6893836 - DNA, 16 bp, Homo sapiens
cgatgtcactcagccc

SEQ ID NO: 6893837 - DNA, 19 bp, Homo sapiens
cccagatgttttacgtctg

SEQ ID NO: 6893838 - DNA, 16 bp, Homo sapiens
ctattgcttgggtctc

SEQ ID NO: 6893839 - DNA, 23 bp, Homo sapiens
acctgaaagcctgtctctttcca

SEQ ID NO: 6893840 - DNA, 22 bp, Homo sapiens
ccagttaacgtattagttgcca

SEQ ID NO: 6893841 - DNA, 20 bp, Homo sapiens
ctgtgtgttcttttgataca

SEQ ID NO: 6893842 - DNA, 13 bp, Homo sapiens
actcacctctgcc

SEQ ID NO: 6893843 - DNA, 14 bp, Homo sapiens
ccattccacatccc

SEQ ID NO: 6893844 - DNA, 16 bp, Homo sapiens
cattttatactgtaca

SEQ ID NO: 6893845 - DNA, 18 bp, Homo sapiens
acccaccgggccactcct

SEQ ID NO: 6893846 - DNA, 15 bp, Homo sapiens
atatttagaaaattt

SEQ ID NO: 6893847 - DNA, 18 bp, Homo sapiens
cccactccagccctgtcc

SEQ ID NO: 6893848 - DNA, 19 bp, Homo sapiens
cctttattcacccctgccc

SEQ ID NO: 6893849 - DNA, 18 bp, Homo sapiens
caagtccttacctcttcc

SEQ ID NO: 6893850 - DNA, 23 bp, Homo sapiens
cacctctgccccttgggcctccc

SEQ ID NO: 6893851 - DNA, 24 bp, Homo sapiens
agccagcagggcgggccaggagaa

SEQ ID NO: 6893852 - DNA, 12 bp, Homo sapiens
atgaacattcca

SEQ ID NO: 6893853 - DNA, 20 bp, Homo sapiens
cccaggtcccccgactgcct

SEQ ID NO: 6893854 - DNA, 13 bp, Homo sapiens
agccccctctgcc

SEQ ID NO: 6893855 - DNA, 15 bp, Homo sapiens
cttggactcctccca

SEQ ID NO: 6893856 - DNA, 12 bp, Homo sapiens
atatttactgtt

SEQ ID NO: 6893857 - DNA, 21 bp, Homo sapiens
ctgggacccctcccaacctca

SEQ ID NO: 6893858 - DNA, 21 bp, Homo sapiens
atgaaagacctgaataccact

SEQ ID NO: 6893859 - DNA, 18 bp, Homo sapiens
tgactgggccctgcctct

SEQ ID NO: 6893860 - DNA, 18 bp, Homo sapiens
ctctaccttcctgtccct

SEQ ID NO: 6893861 - DNA, 15 bp, Homo sapiens
tgtccctcctcttcc

SEQ ID NO: 6893862 - DNA, 22 bp, Homo sapiens
aataacctgcacaggcttgctg

SEQ ID NO: 6893863 - DNA, 14 bp, Homo sapiens
gctccccctctgct

SEQ ID NO: 6893864 - DNA, 17 bp, Homo sapiens
gcctgcccagcctcgca

SEQ ID NO: 6893865 - DNA, 19 bp, Homo sapiens
ccctgtccccctcccctcc

SEQ ID NO: 6893866 - DNA, 15 bp, Homo sapiens
agactcacctctgcc

SEQ ID NO: 6893867 - DNA, 22 bp, Homo sapiens
cccaggcctgtccaccctgcca

SEQ ID NO: 6893868 - DNA, 13 bp, Homo sapiens
cacctctccctca

SEQ ID NO: 6893869 - DNA, 13 bp, Homo sapiens
atacaatttgcac

SEQ ID NO: 6893870 - DNA, 15 bp, Homo sapiens
ctgcctgcactccct

SEQ ID NO: 6893871 - DNA, 22 bp, Homo sapiens
cccagaggccaggaatctgcca

SEQ ID NO: 6893872 - DNA, 13 bp, Homo sapiens
actgacccagagg

SEQ ID NO: 6893873 - DNA, 21 bp, Homo sapiens
gcccacaggaagctcagcctt

SEQ ID NO: 6893874 - DNA, 19 bp, Homo sapiens
tttcgtgtggatcttgcca

SEQ ID NO: 6893875 - DNA, 14 bp, Homo sapiens
gccttggccttgca

SEQ ID NO: 6893876 - DNA, 17 bp, Homo sapiens
cacagtaaagagtacac

SEQ ID NO: 6893877 - DNA, 23 bp, Homo sapiens
agggtggccccctgtgccagctc

SEQ ID NO: 6893878 - DNA, 19 bp, Homo sapiens
tgtaggaaatctgaagcct

SEQ ID NO: 6893879 - DNA, 16 bp, Homo sapiens
cttcctttctcctgcc

SEQ ID NO: 6893880 - DNA, 17 bp, Homo sapiens
catcactgccttggccc

SEQ ID NO: 6893881 - DNA, 23 bp, Homo sapiens
taatatttcagtggaatagatgt

SEQ ID NO: 6893882 - DNA, 15 bp, Homo sapiens
ccctgctccctgcct

SEQ ID NO: 6893883 - DNA, 21 bp, Homo sapiens
ccaactctaacaggcactttg

SEQ ID NO: 6893884 - DNA, 15 bp, Homo sapiens
ctcttagtcctccct

SEQ ID NO: 6893885 - DNA, 17 bp, Homo sapiens
tgccaggttgcagctgc

SEQ ID NO: 6893886 - DNA, 18 bp, Homo sapiens
aaccctgcttctgctgcc

SEQ ID NO: 6893887 - DNA, 16 bp, Homo sapiens
catccccctccttgcc

SEQ ID NO: 6893888 - DNA, 17 bp, Homo sapiens
cacaataaaacaatctc

SEQ ID NO: 6893889 - DNA, 14 bp, Homo sapiens
cccttcccctccct

SEQ ID NO: 6893890 - DNA, 14 bp, Homo sapiens
cagagcctccctca

SEQ ID NO: 6893891 - DNA, 15 bp, Homo sapiens
cacctgccaccgcca

SEQ ID NO: 6893892 - DNA, 18 bp, Homo sapiens
ccttccaggggtgggaca

SEQ ID NO: 6893893 - DNA, 14 bp, Homo sapiens
cttccacctcagcc

SEQ ID NO: 6893894 - DNA, 22 bp, Homo sapiens
cagcttgggtcaggttcttgcc

SEQ ID NO: 6893895 - DNA, 17 bp, Homo sapiens
agcagccagccctgcct

SEQ ID NO: 6893896 - DNA, 23 bp, Homo sapiens
ggctcccaggggctccctccgcc

SEQ ID NO: 6893897 - DNA, 23 bp, Homo sapiens
gtgaccccttttcagcttctgct

SEQ ID NO: 6893898 - DNA, 14 bp, Homo sapiens
tgaattattttgtt

SEQ ID NO: 6893899 - DNA, 19 bp, Homo sapiens
acataaacaacgcattgcc

SEQ ID NO: 6893900 - DNA, 16 bp, Homo sapiens
cctgtacccagctcct

SEQ ID NO: 6893901 - DNA, 16 bp, Homo sapiens
gttcctgaagctgctg

SEQ ID NO: 6893902 - DNA, 18 bp, Homo sapiens
cctcttttgttgtttctt

SEQ ID NO: 6893903 - DNA, 17 bp, Homo sapiens
cacctgtcttctctccc

SEQ ID NO: 6893904 - DNA, 20 bp, Homo sapiens
agcctcctgagtagctggga

SEQ ID NO: 6893905 - DNA, 15 bp, Homo sapiens
tttaagttgtttgca

SEQ ID NO: 6893906 - DNA, 13 bp, Homo sapiens
agactatgtgtca

SEQ ID NO: 6893907 - DNA, 11 bp, Homo sapiens
acctttgtcac

SEQ ID NO: 6893908 - DNA, 14 bp, Homo sapiens
tgtcacttactgtt

SEQ ID NO: 6893909 - DNA, 15 bp, Homo sapiens
cttgggccactgccc

SEQ ID NO: 6893910 - DNA, 18 bp, Homo sapiens
aggatacagctcttctca

SEQ ID NO: 6893911 - DNA, 14 bp, Homo sapiens
tgatgtgatttatg

SEQ ID NO: 6893912 - DNA, 13 bp, Homo sapiens
caaattgctgctt

SEQ ID NO: 6893913 - DNA, 14 bp, Homo sapiens
ttttctcctccgcc

SEQ ID NO: 6893914 - DNA, 15 bp, Homo sapiens
acttgctccctctcc

SEQ ID NO: 6893915 - DNA, 21 bp, Homo sapiens
aacatctgaaaagaaatgcta

SEQ ID NO: 6893916 - DNA, 19 bp, Homo sapiens
tccaggtccgtagctcccc

SEQ ID NO: 6893917 - DNA, 15 bp, Homo sapiens
ctgagctgagccagg

SEQ ID NO: 6893918 - DNA, 19 bp, Homo sapiens
ctccagcagtgctgggccc

SEQ ID NO: 6893919 - DNA, 22 bp, Homo sapiens
aactatggtaaataactgtgac

SEQ ID NO: 6893920 - DNA, 23 bp, Homo sapiens
cacaaccgtccccggcccctgcc

SEQ ID NO: 6893921 - DNA, 22 bp, Homo sapiens
acacctaagggacatgttttga

SEQ ID NO: 6893922 - DNA, 13 bp, Homo sapiens
ccatctctctccc

SEQ ID NO: 6893923 - DNA, 18 bp, Homo sapiens
ccaagcacagcagcctgg

SEQ ID NO: 6893924 - DNA, 14 bp, Homo sapiens
gtgataaatttgat

SEQ ID NO: 6893925 - DNA, 22 bp, Homo sapiens
cacttgagaaccagtctcctca

SEQ ID NO: 6893926 - DNA, 13 bp, Homo sapiens
cagagctgtgcca

SEQ ID NO: 6893927 - DNA, 14 bp, Homo sapiens
aggtttagagatta

SEQ ID NO: 6893928 - DNA, 17 bp, Homo sapiens
cagtaaagaggcttcca

SEQ ID NO: 6893929 - DNA, 19 bp, Homo sapiens
cctgggcatttggtgagag

SEQ ID NO: 6893930 - DNA, 14 bp, Homo sapiens
cccgatgctgcttt

SEQ ID NO: 6893931 - DNA, 12 bp, Homo sapiens
aagctggtgcta

SEQ ID NO: 6893932 - DNA, 18 bp, Homo sapiens
ggattttcccctgaagac

SEQ ID NO: 6893933 - DNA, 21 bp, Homo sapiens
catctgcaccccttctctcct

SEQ ID NO: 6893934 - DNA, 16 bp, Homo sapiens
gagggagaaaggagaa

SEQ ID NO: 6893935 - DNA, 17 bp, Homo sapiens
cacgcaccactgcttcc

SEQ ID NO: 6893936 - DNA, 21 bp, Homo sapiens
aacaacccacaccgtcttcct

SEQ ID NO: 6893937 - DNA, 14 bp, Homo sapiens
ggactgcctctgcc

SEQ ID NO: 6893938 - DNA, 20 bp, Homo sapiens
tgactcctgaaacctcttcc

SEQ ID NO: 6893939 - DNA, 19 bp, Homo sapiens
ctagcccaccctgctgcct

SEQ ID NO: 6893940 - DNA, 15 bp, Homo sapiens
aggttcaaagatatt

SEQ ID NO: 6893941 - DNA, 14 bp, Homo sapiens
tactacaatatgta

SEQ ID NO: 6893942 - DNA, 19 bp, Homo sapiens
caatgccacatacttgcag

SEQ ID NO: 6893943 - DNA, 20 bp, Homo sapiens
agaaatgtataaactttaga

SEQ ID NO: 6893944 - DNA, 22 bp, Homo sapiens
ctgtggcagaccgggggccaga

SEQ ID NO: 6893945 - DNA, 18 bp, Homo sapiens
ctctccctacctccctcc

SEQ ID NO: 6893946 - DNA, 18 bp, Homo sapiens
tcagtgatcttcactgta

SEQ ID NO: 6893947 - DNA, 22 bp, Homo sapiens
tgcgtcctcctcacctcatgcc

SEQ ID NO: 6893948 - DNA, 14 bp, Homo sapiens
cctcagctgcttct

SEQ ID NO: 6893949 - DNA, 14 bp, Homo sapiens
cccggggccttcct

SEQ ID NO: 6893950 - DNA, 15 bp, Homo sapiens
attatcaatatctaa

SEQ ID NO: 6893951 - DNA, 23 bp, Homo sapiens
cttcaaccccctcgcctcctact

SEQ ID NO: 6893952 - DNA, 13 bp, Homo sapiens
tcaatttgctgaa

SEQ ID NO: 6893953 - DNA, 18 bp, Homo sapiens
tgtataaagattgtactt

SEQ ID NO: 6893954 - DNA, 15 bp, Homo sapiens
aatccttgagaatct

SEQ ID NO: 6893955 - DNA, 20 bp, Homo sapiens
cttaaacaacacctcctcct

SEQ ID NO: 6893956 - DNA, 13 bp, Homo sapiens
cctcagcctctca

SEQ ID NO: 6893957 - DNA, 12 bp, Homo sapiens
ggccctgctgcc

SEQ ID NO: 6893958 - DNA, 17 bp, Homo sapiens
agcggctgaacaggccg

SEQ ID NO: 6893959 - DNA, 13 bp, Homo sapiens
ttctcctgcctca

SEQ ID NO: 6893960 - DNA, 21 bp, Homo sapiens
cctgtgtcccatgacccaccc

SEQ ID NO: 6893961 - DNA, 12 bp, Homo sapiens
aaactactgtaa

SEQ ID NO: 6893962 - DNA, 21 bp, Homo sapiens
tgctggccatgaatctctgcc

SEQ ID NO: 6893963 - DNA, 22 bp, Homo sapiens
gtaccaagccaccgcagctgct

SEQ ID NO: 6893964 - DNA, 12 bp, Homo sapiens
tctacactgcct

SEQ ID NO: 6893965 - DNA, 15 bp, Homo sapiens
cacatgtcttgtaca

SEQ ID NO: 6893966 - DNA, 22 bp, Homo sapiens
gcccccagtgggaccacatgcc

SEQ ID NO: 6893967 - DNA, 23 bp, Homo sapiens
tagggggccttgcggaagccata

SEQ ID NO: 6893968 - DNA, 23 bp, Homo sapiens
caggaagacttccagctttctct

SEQ ID NO: 6893969 - DNA, 22 bp, Homo sapiens
cctcttatctcatcctttcctc

SEQ ID NO: 6893970 - DNA, 17 bp, Homo sapiens
cactattgtgaatattt

SEQ ID NO: 6893971 - DNA, 20 bp, Homo sapiens
aggtctccttactctgagcc

SEQ ID NO: 6893972 - DNA, 18 bp, Homo sapiens
tcagagactggcagccag

SEQ ID NO: 6893973 - DNA, 20 bp, Homo sapiens
cccagccccatccctgtcct

SEQ ID NO: 6893974 - DNA, 19 bp, Homo sapiens
agacatctcaaatacagta

SEQ ID NO: 6893975 - DNA, 18 bp, Homo sapiens
ccaaaaccgccagctctg

SEQ ID NO: 6893976 - DNA, 18 bp, Homo sapiens
ccctgccacctcctgcct

SEQ ID NO: 6893977 - DNA, 18 bp, Homo sapiens
caaacatggagaaatcta

SEQ ID NO: 6893978 - DNA, 20 bp, Homo sapiens
atccctggctgacctgctgt

SEQ ID NO: 6893979 - DNA, 22 bp, Homo sapiens
agggcatgcacgggcatgcaca

SEQ ID NO: 6893980 - DNA, 22 bp, Homo sapiens
ttacatgaggactctattcttt

SEQ ID NO: 6893981 - DNA, 17 bp, Homo sapiens
tcccagtctcatctcct

SEQ ID NO: 6893982 - DNA, 11 bp, Homo sapiens
tcgtctgtgaa

SEQ ID NO: 6893983 - DNA, 12 bp, Homo sapiens
catgttacttga

SEQ ID NO: 6893984 - DNA, 14 bp, Homo sapiens
caagtccccagccc

SEQ ID NO: 6893985 - DNA, 21 bp, Homo sapiens
caccgagtgatttccatctct

SEQ ID NO: 6893986 - DNA, 13 bp, Homo sapiens
caagttcagggaa

SEQ ID NO: 6893987 - DNA, 13 bp, Homo sapiens
cttttatgtttga

SEQ ID NO: 6893988 - DNA, 12 bp, Homo sapiens
tgacttactgta

SEQ ID NO: 6893989 - DNA, 20 bp, Homo sapiens
ctgctgaagctgcctgcttt

SEQ ID NO: 6893990 - DNA, 21 bp, Homo sapiens
atgtgtcccagtgaacagttt

SEQ ID NO: 6893991 - DNA, 14 bp, Homo sapiens
ccacaccccagccc

SEQ ID NO: 6893992 - DNA, 18 bp, Homo sapiens
cagctgcctggccatgct

SEQ ID NO: 6893993 - DNA, 16 bp, Homo sapiens
tgtacataactcctgt

SEQ ID NO: 6893994 - DNA, 22 bp, Homo sapiens
cactgagtgcctactctttgcc

SEQ ID NO: 6893995 - DNA, 20 bp, Homo sapiens
attaattgttttgcactttt

SEQ ID NO: 6893996 - DNA, 23 bp, Homo sapiens
cgcaaacgtgaaattctattgaa

SEQ ID NO: 6893997 - DNA, 20 bp, Homo sapiens
tcctgaaccagtcctgctgc

SEQ ID NO: 6893998 - DNA, 18 bp, Homo sapiens
actatttcaataagtgtt

SEQ ID NO: 6893999 - DNA, 19 bp, Homo sapiens
gagctttgtcacttgccac

SEQ ID NO: 6894000 - DNA, 22 bp, Homo sapiens
ggcttactacatgtgggagctt

SEQ ID NO: 6894001 - DNA, 19 bp, Homo sapiens
gtacttttctggttccaaa

SEQ ID NO: 6894002 - DNA, 16 bp, Homo sapiens
ccctgtctctgcatct

SEQ ID NO: 6894003 - DNA, 17 bp, Homo sapiens
acttccctcatctctcc

SEQ ID NO: 6894004 - DNA, 16 bp, Homo sapiens
gccacttgacattcct

SEQ ID NO: 6894005 - DNA, 16 bp, Homo sapiens
actatgatgggcttct

SEQ ID NO: 6894006 - DNA, 18 bp, Homo sapiens
tccattaaacttctactg

SEQ ID NO: 6894007 - DNA, 15 bp, Homo sapiens
cccccacccctggct

SEQ ID NO: 6894008 - DNA, 19 bp, Homo sapiens
cactgaagagctcttggcc

SEQ ID NO: 6894009 - DNA, 24 bp, Homo sapiens
caagcttctgagacgtcatgagga

SEQ ID NO: 6894010 - DNA, 18 bp, Homo sapiens
tcctcaaggggccatcct

SEQ ID NO: 6894011 - DNA, 20 bp, Homo sapiens
gatgtccagaagaatattca

SEQ ID NO: 6894012 - DNA, 16 bp, Homo sapiens
gcccccgccctctgcc

SEQ ID NO: 6894013 - DNA, 16 bp, Homo sapiens
ctaggaaccctggagg

SEQ ID NO: 6894014 - DNA, 22 bp, Homo sapiens
ctctagagcagactacagctgg

SEQ ID NO: 6894015 - DNA, 17 bp, Homo sapiens
ctctacctctctttctc

SEQ ID NO: 6894016 - DNA, 13 bp, Homo sapiens
ctactcagaagcc

SEQ ID NO: 6894017 - DNA, 17 bp, Homo sapiens
cacaatctacactgcct

SEQ ID NO: 6894018 - DNA, 23 bp, Homo sapiens
ttcctgtgcccatcatctctgcc

SEQ ID NO: 6894019 - DNA, 16 bp, Homo sapiens
cctttcccaccctcct

SEQ ID NO: 6894020 - DNA, 20 bp, Homo sapiens
tccagcctctgccgctgcca

SEQ ID NO: 6894021 - DNA, 16 bp, Homo sapiens
atattgtacaaatgta

SEQ ID NO: 6894022 - DNA, 19 bp, Homo sapiens
cctagtcccttcccctccc

SEQ ID NO: 6894023 - DNA, 19 bp, Homo sapiens
gccctcatggcccctctga

SEQ ID NO: 6894024 - DNA, 21 bp, Homo sapiens
taacaacatgtttccagcatt

SEQ ID NO: 6894025 - DNA, 22 bp, Homo sapiens
tccagggaaacagcctctctct

SEQ ID NO: 6894026 - DNA, 17 bp, Homo sapiens
tccacttggtctgtgag

SEQ ID NO: 6894027 - DNA, 17 bp, Homo sapiens
acctgtatttttgttag

SEQ ID NO: 6894028 - DNA, 20 bp, Homo sapiens
cacagaaagggcagcttcag

SEQ ID NO: 6894029 - DNA, 16 bp, Homo sapiens
tcaccaaggcagtgca

SEQ ID NO: 6894030 - DNA, 20 bp, Homo sapiens
cacctggatggatctgctcc

SEQ ID NO: 6894031 - DNA, 12 bp, Homo sapiens
cattctgccaaa

SEQ ID NO: 6894032 - DNA, 16 bp, Homo sapiens
cccatcctccccttcc

SEQ ID NO: 6894033 - DNA, 23 bp, Homo sapiens
tgccttcctaagcctgtggctgt

SEQ ID NO: 6894034 - DNA, 21 bp, Homo sapiens
cttcctgacccggattggccc

SEQ ID NO: 6894035 - DNA, 15 bp, Homo sapiens
caagggattctggga

SEQ ID NO: 6894036 - DNA, 13 bp, Homo sapiens
cacaggcctgtgt

SEQ ID NO: 6894037 - DNA, 15 bp, Homo sapiens
caataactactgtgt

SEQ ID NO: 6894038 - DNA, 18 bp, Homo sapiens
agcccagaaaacctccag

SEQ ID NO: 6894039 - DNA, 15 bp, Homo sapiens
agcgcccccactcct

SEQ ID NO: 6894040 - DNA, 14 bp, Homo sapiens
cacctcggcctccc

SEQ ID NO: 6894041 - DNA, 23 bp, Homo sapiens
acctccccttttctatgttgcta

SEQ ID NO: 6894042 - DNA, 16 bp, Homo sapiens
ataaacgatatatgta

SEQ ID NO: 6894043 - DNA, 17 bp, Homo sapiens
cctccctgacgtctgcc

SEQ ID NO: 6894044 - DNA, 20 bp, Homo sapiens
agaaagtggcagagccagga

SEQ ID NO: 6894045 - DNA, 18 bp, Homo sapiens
agtcatctgtaagagctt

SEQ ID NO: 6894046 - DNA, 19 bp, Homo sapiens
gaaaattatattctgttta

SEQ ID NO: 6894047 - DNA, 13 bp, Homo sapiens
cagaaaatatact

SEQ ID NO: 6894048 - DNA, 16 bp, Homo sapiens
cacttctgtatgcatc

SEQ ID NO: 6894049 - DNA, 13 bp, Homo sapiens
cctctcactgtct

SEQ ID NO: 6894050 - DNA, 19 bp, Homo sapiens
ttgacaattcctagataaa

SEQ ID NO: 6894051 - DNA, 17 bp, Homo sapiens
gagtctttggttctaag

SEQ ID NO: 6894052 - DNA, 17 bp, Homo sapiens
cactgtggaactgccac

SEQ ID NO: 6894053 - DNA, 23 bp, Homo sapiens
gttctgtttcctgtgtctccaag

SEQ ID NO: 6894054 - DNA, 16 bp, Homo sapiens
cttacagcctctgact

SEQ ID NO: 6894055 - DNA, 17 bp, Homo sapiens
ggtggaggcgagccaga

SEQ ID NO: 6894056 - DNA, 14 bp, Homo sapiens
agcaatacaacttt

SEQ ID NO: 6894057 - DNA, 17 bp, Homo sapiens
catctccctgcctggcc

SEQ ID NO: 6894058 - DNA, 14 bp, Homo sapiens
ttgtgattctgcct

SEQ ID NO: 6894059 - DNA, 13 bp, Homo sapiens
gaaatcactgtga

SEQ ID NO: 6894060 - DNA, 23 bp, Homo sapiens
ctgcttgtaggtatgtctgtgcc

SEQ ID NO: 6894061 - DNA, 23 bp, Homo sapiens
ttgtacatttatttattactgtc

SEQ ID NO: 6894062 - DNA, 13 bp, Homo sapiens
cagcaaatgcaaa

SEQ ID NO: 6894063 - DNA, 22 bp, Homo sapiens
ctggctatttaaaaagctcttt

SEQ ID NO: 6894064 - DNA, 18 bp, Homo sapiens
cttgagttcaccatctct

SEQ ID NO: 6894065 - DNA, 21 bp, Homo sapiens
tcaccttcgtttactatgcct

SEQ ID NO: 6894066 - DNA, 14 bp, Homo sapiens
tcattgctgtctgc

SEQ ID NO: 6894067 - DNA, 17 bp, Homo sapiens
cgtttgaccaatttgca

SEQ ID NO: 6894068 - DNA, 20 bp, Homo sapiens
caaatcaccacaaactgtaa

SEQ ID NO: 6894069 - DNA, 15 bp, Homo sapiens
ctggaccccctgccc

SEQ ID NO: 6894070 - DNA, 22 bp, Homo sapiens
ccctgcgccctccctccctcca

SEQ ID NO: 6894071 - DNA, 19 bp, Homo sapiens
atcttcaggtgaacactta

SEQ ID NO: 6894072 - DNA, 20 bp, Homo sapiens
agtgtcaaggggccctagga

SEQ ID NO: 6894073 - DNA, 18 bp, Homo sapiens
gccacttgcactgtgctt

SEQ ID NO: 6894074 - DNA, 14 bp, Homo sapiens
ctctggccctgcct

SEQ ID NO: 6894075 - DNA, 17 bp, Homo sapiens
aggaggggtctgcctcc

SEQ ID NO: 6894076 - DNA, 22 bp, Homo sapiens
ccagctccacacattccagcca

SEQ ID NO: 6894077 - DNA, 21 bp, Homo sapiens
cagcatctactactctgtctt

SEQ ID NO: 6894078 - DNA, 21 bp, Homo sapiens
acctaattcgatgaaggctgc

SEQ ID NO: 6894079 - DNA, 20 bp, Homo sapiens
cagttcccggagcacagccc

SEQ ID NO: 6894080 - DNA, 12 bp, Homo sapiens
cctggtggagaa

SEQ ID NO: 6894081 - DNA, 14 bp, Homo sapiens
aactatgacagata

SEQ ID NO: 6894082 - DNA, 18 bp, Homo sapiens
aatgtactacatttgcat

SEQ ID NO: 6894083 - DNA, 21 bp, Homo sapiens
tggttcccagggtggcgtcca

SEQ ID NO: 6894084 - DNA, 19 bp, Homo sapiens
tgggagagtacctgtgtgt

SEQ ID NO: 6894085 - DNA, 21 bp, Homo sapiens
actctggccttggttcctcca

SEQ ID NO: 6894086 - DNA, 15 bp, Homo sapiens
aagttgaaaagccaa

SEQ ID NO: 6894087 - DNA, 14 bp, Homo sapiens
cccccgccctgccc

SEQ ID NO: 6894088 - DNA, 17 bp, Homo sapiens
agatcaagcctgcctca

SEQ ID NO: 6894089 - DNA, 24 bp, Homo sapiens
cccaccacgatgtggccctggcct

SEQ ID NO: 6894090 - DNA, 21 bp, Homo sapiens
gatagccctgtcctggtggta

SEQ ID NO: 6894091 - DNA, 17 bp, Homo sapiens
ctgttggctctctgacg

SEQ ID NO: 6894092 - DNA, 13 bp, Homo sapiens
ggaaagtattttt

SEQ ID NO: 6894093 - DNA, 23 bp, Homo sapiens
tttagctgtgaatggctgtgccc

SEQ ID NO: 6894094 - DNA, 11 bp, Homo sapiens
ccaccctgccc

SEQ ID NO: 6894095 - DNA, 13 bp, Homo sapiens
ccaggcccagcca

SEQ ID NO: 6894096 - DNA, 17 bp, Homo sapiens
ctctgacatcccttcct

SEQ ID NO: 6894097 - DNA, 14 bp, Homo sapiens
ctgtcatctgtgca

SEQ ID NO: 6894098 - DNA, 20 bp, Homo sapiens
cccatcagtgtacccccgcc

SEQ ID NO: 6894099 - DNA, 19 bp, Homo sapiens
cagttggacagtaagattt

SEQ ID NO: 6894100 - DNA, 17 bp, Homo sapiens
caggccaacagtagcca

SEQ ID NO: 6894101 - DNA, 17 bp, Homo sapiens
caaattctttattcttc

SEQ ID NO: 6894102 - DNA, 18 bp, Homo sapiens
cttgttctgtcccttcca

SEQ ID NO: 6894103 - DNA, 14 bp, Homo sapiens
tcaaattctgtctg

SEQ ID NO: 6894104 - DNA, 16 bp, Homo sapiens
ccatcctccagcttct

SEQ ID NO: 6894105 - DNA, 17 bp, Homo sapiens
catatgatgtacatgta

SEQ ID NO: 6894106 - DNA, 16 bp, Homo sapiens
aagtagatgcatttgg

SEQ ID NO: 6894107 - DNA, 14 bp, Homo sapiens
tctataattttaca

SEQ ID NO: 6894108 - DNA, 23 bp, Homo sapiens
tgctagatgagaattcagctgcc

SEQ ID NO: 6894109 - DNA, 20 bp, Homo sapiens
tgggccatgggtcctcggcc

SEQ ID NO: 6894110 - DNA, 16 bp, Homo sapiens
ctaaattcatgctgct

SEQ ID NO: 6894111 - DNA, 17 bp, Homo sapiens
ggtggcccagagccata

SEQ ID NO: 6894112 - DNA, 17 bp, Homo sapiens
aaccttctggcctccca

SEQ ID NO: 6894113 - DNA, 22 bp, Homo sapiens
aatgcaattcaatgcaatgaaa

SEQ ID NO: 6894114 - DNA, 16 bp, Homo sapiens
cactctgtttgctcac

SEQ ID NO: 6894115 - DNA, 18 bp, Homo sapiens
attttataaatgatatca

SEQ ID NO: 6894116 - DNA, 14 bp, Homo sapiens
cctcccctgggact

SEQ ID NO: 6894117 - DNA, 13 bp, Homo sapiens
gcagctgaagcct

SEQ ID NO: 6894118 - DNA, 12 bp, Homo sapiens
catcacttgatg

SEQ ID NO: 6894119 - DNA, 18 bp, Homo sapiens
gtgttcacaaactgtgaa

SEQ ID NO: 6894120 - DNA, 15 bp, Homo sapiens
gtctcagcctcctca

SEQ ID NO: 6894121 - DNA, 17 bp, Homo sapiens
cacaccctgcccctgca

SEQ ID NO: 6894122 - DNA, 15 bp, Homo sapiens
acatggtgtctccca

SEQ ID NO: 6894123 - DNA, 16 bp, Homo sapiens
cacaagcctgagaact

SEQ ID NO: 6894124 - DNA, 16 bp, Homo sapiens
ctccagagtctgagcc

SEQ ID NO: 6894125 - DNA, 23 bp, Homo sapiens
cctgttcacgtgttttccatccc

SEQ ID NO: 6894126 - DNA, 23 bp, Homo sapiens
aatcagtagaaagctaaagtgat

SEQ ID NO: 6894127 - DNA, 21 bp, Homo sapiens
catcagagtgtatttttgtaa

SEQ ID NO: 6894128 - DNA, 19 bp, Homo sapiens
ctccagtgccgctcctgct

SEQ ID NO: 6894129 - DNA, 19 bp, Homo sapiens
cttctattaaggacattta

SEQ ID NO: 6894130 - DNA, 19 bp, Homo sapiens
ttttaaagcaatcttggca

SEQ ID NO: 6894131 - DNA, 13 bp, Homo sapiens
gcagccaggccac

SEQ ID NO: 6894132 - DNA, 20 bp, Homo sapiens
ctttccatgggcccgctgcc

SEQ ID NO: 6894133 - DNA, 14 bp, Homo sapiens
gtcatgctgcctta

SEQ ID NO: 6894134 - DNA, 85 bp, Homo sapiens
atgagataagggatctgcccctagaagctgtctggctgctttttggtagagcaggcatgctgcattgaggggctctcttcctcat

SEQ ID NO: 6894135 - DNA, 83 bp, Homo sapiens
gataaatttctgggcacagaattgctgggataaaatatatgcatgtttttaagcctttggtaattctgtgtagaggttgtatc

SEQ ID NO: 6894136 - DNA, 86 bp, Homo sapiens
ggtgttgctggtttggggcaggaagtagcagtctgagcacatttcttgtacacctgctgtttgcctggctctgcgccaggggctcc

SEQ ID NO: 6894137 - DNA, 96 bp, Homo sapiens
tgtgagagtggctgaggttatgctggttgtatagtttgggattaggtttcttcagaatcctctaggttgttataactgttctctccactctgcaca

SEQ ID NO: 6894138 - DNA, 127 bp, Homo sapiens
caaatgaaatgatgtgtaggcatagtattaggtattacagtaatctggacatgatttaaagaactggatacaggaggttgtttgcaggttatatgcaaatactatgctaatttatatcattgacttg

SEQ ID NO: 6894139 - DNA, 109 bp, Homo sapiens
ctctgcaagtaggagaaaagaggtaggaggtaggtattgtgtgagaactgggtgtctctattttcaatccagtatttcctctgaaacccctctgcttcttacttcagag

SEQ ID NO: 6894140 - DNA, 63 bp, Homo sapiens
ttatctgaaatgtttgggtccagaagtcttgtgaattttggatttttgaatatttgcacataa

SEQ ID NO: 6894141 - DNA, 70 bp, Homo sapiens
gtccaggatcacgaggttgcagcactggatcaggagactgtgggaggctgagtagctttgtgctctgggc

SEQ ID NO: 6894142 - DNA, 79 bp, Homo sapiens
aggccctcacagtctattgtgagtagctgacagtagcatgagcactataagtactaaagcacagatgctgtgagagcct

SEQ ID NO: 6894143 - DNA, 82 bp, Homo sapiens
gcggttagctgagagctcacttgaggatgtgggctgggaaccttatttcttctccagtgagctacttggacttcctcacggc

SEQ ID NO: 6894144 - DNA, 68 bp, Homo sapiens
ataggacttggtgactctcaatgctcaagaaagtcattttctaattgcatcattgtcacagtcactat

SEQ ID NO: 6894145 - DNA, 79 bp, Homo sapiens
agcccagcatctaaactgtgataccgttgatacatggcacttccatggtattagaggcaacacatttggaaagcaagct

SEQ ID NO: 6894146 - DNA, 104 bp, Homo sapiens
gtctttgcctcatggagctaacattctaagaggagaaacatgcagtaaacaagtaaagaaatgtatgctctattcagggagtagtttgtgctatgaggaaaagc

SEQ ID NO: 6894147 - DNA, 65 bp, Homo sapiens
catcttggagatgttgatgtgtggtgtccaaaactgatgctccaaacagcaattctttaaagatg

SEQ ID NO: 6894148 - DNA, 100 bp, Homo sapiens
tggaagttgatgtacatatgctgtgttaattctatcttgactatcatttcctgaacagcatgattaagttaagcagcagattatggtctacattaatcca

SEQ ID NO: 6894149 - DNA, 93 bp, Homo sapiens
atcttttggtgagccggttcctctggactgggaacttcccacacgcttctcagaattttccccttcctaggtgggacaggatgaccagaaggt

SEQ ID NO: 6894150 - DNA, 86 bp, Homo sapiens
tgtatgtatatgtctatttgtgtgtgcatgtgtgtgtgggtttgagtttgtgtgtgcatgtgagcacaagtttgcatgtgtgtgca

SEQ ID NO: 6894151 - DNA, 87 bp, Homo sapiens
gctcagagtccttttgttttgagatgaggtctcacttattttgcccagtccagtctcaaagtcccagatgcaaggaattgtttgtgc

SEQ ID NO: 6894152 - DNA, 63 bp, Homo sapiens
tccctcgtggagcttgtattcagttgtcaatttccccttactagatgcaagctccatgaggga

SEQ ID NO: 6894153 - DNA, 75 bp, Homo sapiens
cttctgagaaatctttgagtgtaaggaatgtggggcgttttatagccacactaaataccttagagttcggagaag

SEQ ID NO: 6894154 - DNA, 82 bp, Homo sapiens
tcaaatctcacttgaatttcatcccttccattggtaacatgttagaaaataatttgatggaaaatttcatggtgagattgga

SEQ ID NO: 6894155 - DNA, 130 bp, Homo sapiens
atctatgtttaactttttcaggaatcatcaaagtgtttttcacagtggctgtgccatttgacattcccaccatcagtgtacaagggtatggtagcttatttttatgacttacgtaggtatcagacaggat

SEQ ID NO: 6894156 - DNA, 109 bp, Homo sapiens
atgaataaagcaagcataccattaagtggaattaaatcagacttgttttcagttaaaatagcgggatttctgggtaattccatattggaaactagctggtttctttcat

SEQ ID NO: 6894157 - DNA, 81 bp, Homo sapiens
cctgcggcctcacttcttccctgaagacctcatgtgacaggagtactgccctataccaggagggaaggaatgtcactcagg

SEQ ID NO: 6894158 - DNA, 109 bp, Homo sapiens
caccactcacatggaacttactttctagtggaattctggtatgttttaatggaagataaggttgtatctgaattactattggtaaaggtgagcaaaatttagagtgatg

SEQ ID NO: 6894159 - DNA, 73 bp, Homo sapiens
gacttttttctctccttaccctgagaggcataccaaaatagttacctctcagggtgaggaaagaatttaagtc

SEQ ID NO: 6894160 - DNA, 92 bp, Homo sapiens
atggatgctttatatttctttttctttcataattttactgattagaacctccagtataatgctgaatagaagtggcaagagtaggcattcat

SEQ ID NO: 6894161 - DNA, 93 bp, Homo sapiens
taggagacgacagttccatgtgtgttactgcccttgaataccttccagtggaacaaaatgtggaggtggaaggcagtgatattgttgatcctg

SEQ ID NO: 6894162 - DNA, 88 bp, Homo sapiens
ttaggcattttcagtgttgttgttgttgttgttttttaatgtatcattttagcaattgatagcaacaagctacattccagatgtctag

SEQ ID NO: 6894163 - DNA, 96 bp, Homo sapiens
ctgtgcttttaatttatgcatttttcctcctaatgcatgtagataatatataccaaattcatagacttaggaatgaagaagtatgatataacacag

SEQ ID NO: 6894164 - DNA, 124 bp, Homo sapiens
gccactcctctaatcaaggccttctagcaggttctgtactgggatcaacagtgtcccccaaaattcatgtcttcccagaacctcagagtgtgacctttggaaatggggctgttgcagatgtggt

SEQ ID NO: 6894165 - DNA, 61 bp, Homo sapiens
aggctagacagctttcccatgtgctcaagcgattactcaggtacttaagactctttagcct

SEQ ID NO: 6894166 - DNA, 106 bp, Homo sapiens
aaagtgtgatgatatgttggatctgttggtttggtacctagattaataatctttgttgaagtgctagcgtgctagacaaccacagaaaacaatattcattcatttt

SEQ ID NO: 6894167 - DNA, 104 bp, Homo sapiens
ttagaatatcttccatctcatgtcaaatgaatgctgaacgggggttttgattatttttagttaatcgaacctgaatacagtaattttgatgagttgtattctag

SEQ ID NO: 6894168 - DNA, 68 bp, Homo sapiens
cccctcagactggggctccctgagtaagggctgtgtctcccctcagtctgagccctatctaggagggg

SEQ ID NO: 6894169 - DNA, 63 bp, Homo sapiens
attctagaattaggctacatggactggactaccagctatatgacattggccaagttctgtaat

SEQ ID NO: 6894170 - DNA, 79 bp, Homo sapiens
gggcctatgccctccctcctgctctctgtgccagctagtttgtggcaggcagaggggtgtgtggaaagtgcatgggcct

SEQ ID NO: 6894171 - DNA, 91 bp, Homo sapiens
tggagagctgttagttgggcagggctgaagcgtaggtggcgaggaacaggaggctcctactgcagatggccttgttcttcggatcctccca

SEQ ID NO: 6894172 - DNA, 67 bp, Homo sapiens
gcagcatctgaggggttgtgagaaatgtaggatttaaaggtcctacacctgaccctacagaaactgc

SEQ ID NO: 6894173 - DNA, 76 bp, Homo sapiens
gatatgtgctcacagtatgaggactagaacaagaaggcagtgtagtttggttcagtctcagctggaaacatgtgtc

SEQ ID NO: 6894174 - DNA, 78 bp, Homo sapiens
gcttctcctaattgtaagctccttgagggaggcaatgggtttaaccactgctgaatacccagtgtgcatgggagatgc

SEQ ID NO: 6894175 - DNA, 94 bp, Homo sapiens
tgcatatgtatatgcatatgtacttgcatatgtatttgcatatgtacttgcatatgtatatgcatatgtacttgcatatgtatatgcatatgta

SEQ ID NO: 6894176 - DNA, 74 bp, Homo sapiens
tggctagatggcagaaagctggagctgacttgtagtgattgtctatctctaagcctcagtttttccatctgtta

SEQ ID NO: 6894177 - DNA, 113 bp, Homo sapiens
aggatttgttggtgaatggaatgtaaagcgtgtgataaaggatagttacagcattgtcttatagcaattttatcatccagcttgttattttatccatctcaccagcccagcct

SEQ ID NO: 6894178 - DNA, 76 bp, Homo sapiens
gaggacatgagatttgggagtggccaggattggaatgatatggtttggctctgtgtctccacccaaatcttacctt

SEQ ID NO: 6894179 - DNA, 61 bp, Homo sapiens
agcatgacagcactgctgctgttaatcttgattacctggctgaggtagtgtttgtcaagtt

SEQ ID NO: 6894180 - DNA, 124 bp, Homo sapiens
gaatgacatggtttggctctgtgtctccacccaattctcatctcaaattgtagtccccacatgttgagggagaaatgtgatatgaggtgattggatcatggaggcagttttccccatgttgttc

SEQ ID NO: 6894181 - DNA, 130 bp, Homo sapiens
agccatgtctaagtcagagtctcctaaaaagcctgaacagctgcagaagcttttcatcacatggttgatctttgaaataactgatgagggtttctacagccattttgagcagtgagaactcttatggact

SEQ ID NO: 6894182 - DNA, 60 bp, Homo sapiens
tagagcattagaaattagtgtacagatttaaatattggtgcatgtaaattctgggctcta

SEQ ID NO: 6894183 - DNA, 65 bp, Homo sapiens
tatgacaccattttggtcagtgatggactgcatatatgacagtggtcattattaaaattgttata

SEQ ID NO: 6894184 - DNA, 75 bp, Homo sapiens
aaagatacagatatagagatttatagatgtgagtgggattactgaatcatatggtaattctatgtctaaattttt

SEQ ID NO: 6894185 - DNA, 95 bp, Homo sapiens
ggtatcacttggagaatccacttccaggacagcctcactcacacagctggaagtcagtgtggttgctggcttggacctcagttctccatttggcc

SEQ ID NO: 6894186 - DNA, 89 bp, Homo sapiens
tctctaacaaggtgcagagcttagctgattggtgaacagtgattggtttccgctttgttcacagtggctaagttctgcacctgaagaga

SEQ ID NO: 6894187 - DNA, 80 bp, Homo sapiens
gtcacttcaatctgcaagcaatccaggaaggctacctgaaggaggcagcacttggtccaagcttgaaagattgagtagac

SEQ ID NO: 6894188 - DNA, 102 bp, Homo sapiens
cttcgaactcctcagatccagcaattcacatgtacctaaaaaagcaagaacagtcttcgtcctgggatcacagtggcagggatttggggagaaaaattgagg

SEQ ID NO: 6894189 - DNA, 106 bp, Homo sapiens
cccagcttgccctggcggccccagcagcccttgtagtgaccgtggcgtgtgcatggacggcatgagtggcagtgggcagtgtctgtgccgttcaggttttgctggg

SEQ ID NO: 6894190 - DNA, 128 bp, Homo sapiens
gtgtatatgtagcatgttttctttatccatttgtttactgatggacactgggttgcttccaagccttggctattgtgaatagtgctgtagtaaacatgggaatgaagatatctctttgatatattcat

SEQ ID NO: 6894191 - DNA, 82 bp, Homo sapiens
gttgagggccatttaggcagattccatattttggctattgtgaatagtgctgattaacatgaatgtgtagatgtccttcaat

SEQ ID NO: 6894192 - DNA, 64 bp, Homo sapiens
ggatgcatggggtattgaggtaatcctattttgttaaatctgatcacttcaaatacctcattcc

SEQ ID NO: 6894193 - DNA, 60 bp, Homo sapiens
tctgctgtgagggagagggcgaaaatgaaatgattattgcaagcctaggctctcacaaga

SEQ ID NO: 6894194 - DNA, 129 bp, Homo sapiens
caagagggtggctggtgggagggggtgtgcctgtgacagcgacctgggcagggcatccctctcatgcctggaagaactgtccggtcaatgtcgcaggcccagcacaccttcccaacgagctgaaagctg

SEQ ID NO: 6894195 - DNA, 88 bp, Homo sapiens
agtccagtgcccagccagctcttattttctctcctaaatctgcagtggcagattgagctggggatgagtgaggcttgtggtctggatt

SEQ ID NO: 6894196 - DNA, 58 bp, Homo sapiens
tcagactggggctccctgaggatggggctgtgccttccctcagaccagagctccctga

SEQ ID NO: 6894197 - DNA, 102 bp, Homo sapiens
gtaaataaaaaataaaacccattctcactctaacccatgctgtatctgatttttttcctgaggtaggcttgagatgggagggttgttattttttgtaaatgc

SEQ ID NO: 6894198 - DNA, 65 bp, Homo sapiens
taggcaacatgtcgaatactgtctttatttaaaaaaaattaattgggcgtggtggcatgtgcctg

SEQ ID NO: 6894199 - DNA, 91 bp, Homo sapiens
tcactaaagacatggtgtaggtgaacatgagattggataccataaatctgtactggcttccatctgtacgaccacatggtgtctgcagtgg

SEQ ID NO: 6894200 - DNA, 78 bp, Homo sapiens
ctcccgccccacccttctttccacgcccctccggagctcccggggaggaagctggaacacgggattggggttcgggag

SEQ ID NO: 6894201 - DNA, 105 bp, Homo sapiens
gtgggaatcaaggctaaatgatcagtgtatgtgtgttcaatggcagaaaaattattgaatagagtaacgtggacaaagaatactccttttgccttgaaaacctat

SEQ ID NO: 6894202 - DNA, 60 bp, Homo sapiens
tagtgaaggtcatgatgcaaaagcaatgctaggcttttgcaatagtcctggcctgtacta

SEQ ID NO: 6894203 - DNA, 61 bp, Homo sapiens
agcaggcacagaggaatggtgaggaaccttgaagctctcataacagtctccagtgcccgct

SEQ ID NO: 6894204 - DNA, 75 bp, Homo sapiens
gctcttacatttgaggtagtttgttgtacagtaatacataactaatgcagaaattaatacctagaagtagggtgc

SEQ ID NO: 6894205 - DNA, 76 bp, Homo sapiens
cttgattcctgtctggggccagtgctgggtgggcccagctccccacttacccacagggcacagacaggaagcaaag

SEQ ID NO: 6894206 - DNA, 73 bp, Homo sapiens
ctataggaggcaagtactgtttttatctccattttagagataaactgaggcagtattttagtgacttaggtag

SEQ ID NO: 6894207 - DNA, 57 bp, Homo sapiens
tagacatggttgtacgttatctcactacatctcggtacatgtctacagccatgtctg

SEQ ID NO: 6894208 - DNA, 68 bp, Homo sapiens
ctgtcacatccattttgcaagtatttcagactaacgtttaaagtaaactgggaagggaagtaggccag

SEQ ID NO: 6894209 - DNA, 83 bp, Homo sapiens
catatattagcgcttactgagttgccaaataaatgaatccataggagtctattaagttggcaacttagtaagcactttatgtg

SEQ ID NO: 6894210 - DNA, 64 bp, Homo sapiens
gccaccacacccggctaattttgttattttttatagagacagggttttgtcgtgttgtgcaggc

SEQ ID NO: 6894211 - DNA, 107 bp, Homo sapiens
aagaaataaatacaaaagataaacacagcaatactggctgtcaaagatggaaaataaccatttagacaatctaatattgttttgttttggtttggtttttacttttt

SEQ ID NO: 6894212 - DNA, 70 bp, Homo sapiens
gggtggtggggaaccccaccatatttggatcaaactgacactcacatatgctgggatttccgaactacct

SEQ ID NO: 6894213 - DNA, 96 bp, Homo sapiens
ggtgactataagtgagaacatagagtaactagtctgtttagcaagaaggtactatactgacatggtttggctctgtgtctccacccaaatctcatc

SEQ ID NO: 6894214 - DNA, 55 bp, Homo sapiens
cccggaggcagatgttgcagtgagcagagattgcaccactgcacttcagcctggg

SEQ ID NO: 6894215 - DNA, 60 bp, Homo sapiens
gccagtgcatctgtaagtggctttgctgccaagcagaattgagctgagcatgccactggc

SEQ ID NO: 6894216 - DNA, 55 bp, Homo sapiens
gcagttttacctgagctgctggagaatccccagcaaagactctgccaaaaactgc

SEQ ID NO: 6894217 - DNA, 67 bp, Homo sapiens
aaatgggtgcttagacactttgcatttaatgtaattattgatatgtttggatttaggtttaccattt

SEQ ID NO: 6894218 - DNA, 83 bp, Homo sapiens
tgtccctgagagttgaacacattggggaaaaattgggcacagcccattacttttacaaactccagtgagtgagcctcaatgca

SEQ ID NO: 6894219 - DNA, 130 bp, Homo sapiens
gtagtgtctggaacagtctgatttgtctccatatctgcattgtcccagaagtgactttggcactaaaaagttgatcattaattactgtttgggccaggtgtggtggctcatgcctgtaatcctggcactt

SEQ ID NO: 6894220 - DNA, 124 bp, Homo sapiens
tgggctggacttttagcctctattctgctgaccagccccagcactgcaaacatcttttaaactctctttggaaacaaggggaggcagatgggagctggaagttgcaggacaagaatccagccca

SEQ ID NO: 6894221 - DNA, 86 bp, Homo sapiens
gcaaaaaatgcaatgtctaatttgagcacctttggtatttttgatgaataccgaaggtgttcaaattaggcactgcaattttatgc

SEQ ID NO: 6894222 - DNA, 82 bp, Homo sapiens
agatctgaagtgattagaaccacttgatagaatctacgactggaactactaccaagtcgttctaattagaagactcagatct

SEQ ID NO: 6894223 - DNA, 63 bp, Homo sapiens
gttctggagctcagacatctgaaatgggttatcaaggctcatttcttgtggagacttcaggac

SEQ ID NO: 6894224 - DNA, 105 bp, Homo sapiens
acaagtaagaatcatagggatgacgtttgttatatttcctttcatcatgcctgagagcatagtgggaggaagtggtgatatttttatcctctgggttgttgatgt

SEQ ID NO: 6894225 - DNA, 73 bp, Homo sapiens
ggtctgctagtgtttgctggaggtccactccagaccctgtttgcctgggtatcaccagcggaagctgcagacc

SEQ ID NO: 6894226 - DNA, 70 bp, Homo sapiens
aatgacctcattcactccaaacccacgggtactttctgctccacctcttggcagtgtgtgagctgttatt

SEQ ID NO: 6894227 - DNA, 106 bp, Homo sapiens
ttacacatgctcagattcctgtgtagttatagtgcaatcatgtgacctattttctatgaatcatatgtatccacatgagaccaggatttcttcaagggcagtgtga

SEQ ID NO: 6894228 - DNA, 103 bp, Homo sapiens
caaaattttgaccctgttttgactgtgcccgatgacaaaattcacaggtgtgaaattttccacttgtggaattatgttggcattcaaaaaactggggattttg

SEQ ID NO: 6894229 - DNA, 129 bp, Homo sapiens
tttggctttcaaatataagatggacatgagattttgtgggggtggtgagcaggggtgggatgatatgttttggctctgtgtctccacccaaatcacatcttgaattgtaatccccaagtgttgagggaa

SEQ ID NO: 6894230 - DNA, 83 bp, Homo sapiens
gtgacagagacagattgaagcttaaattagctcatcataggctatgattttatctaactttaggcttacttgtaccatgtcat

SEQ ID NO: 6894231 - DNA, 119 bp, Homo sapiens
tacaatagagtctttctttcaaagagctcacagtccactggaaaatcaggaaagtatgttggtgactccagtacaatgtgataaggtctgtggaatggcacatagaaagctttgtagta

SEQ ID NO: 6894232 - DNA, 123 bp, Homo sapiens
ttggctacacattggaatcatttgaggtaggttgaaagatagattctgatttaattgtctaggatgcatcctgagcatcaggatttttttaaatctttccgtatgaagcttacaaatagtcag

SEQ ID NO: 6894233 - DNA, 70 bp, Homo sapiens
gactggacaacagagcaagactccatctcaaaaaaaaggtctttataggaagtctgtgatgttgtttttc

SEQ ID NO: 6894234 - DNA, 114 bp, Homo sapiens
aagggggagaggacttagaatgttaagaatatgtatatatacacacatatatatataataagaatatatgtatgtgtatgtatgtgtatttttgagacagggcttctctctgtt

SEQ ID NO: 6894235 - DNA, 93 bp, Homo sapiens
gctcagtggttaagttctgtccacaccccctccttgcagtctccattcaagctattctgagacggcagggctgttgaccaaggaccacaaagc

SEQ ID NO: 6894236 - DNA, 83 bp, Homo sapiens
cagtacactcatccataaagtaggaaacactacaccctccagtgctgttagtagtgctttctactttatgggtgactgcactg

SEQ ID NO: 6894237 - DNA, 80 bp, Homo sapiens
tcttttacacagcctgtaatgatgacttcagctgtggtttctgaagttaactcattgatgattacagtgtttggggagga

SEQ ID NO: 6894238 - DNA, 60 bp, Homo sapiens
gagactgtaagctccttgaggacaggaaccataggtttgtctaccgtagagcacattctc

SEQ ID NO: 6894239 - DNA, 65 bp, Homo sapiens
ggtctgtgcctccctggaacaaagctgagaaggaaggagctttgtcccagagggagggataggct

SEQ ID NO: 6894240 - DNA, 130 bp, Homo sapiens
ttataaatcactcttgcaggtatttggagaatggacgaatgaggcaaaaatagagacaagaaagcaaatttcattactgcatctctccaggtgaaacttgcagggcaaatggagaaaaatgaatttgtaa

SEQ ID NO: 6894241 - DNA, 70 bp, Homo sapiens
tctgagcaccctttgcacatcagtcgtttcttgtctatcacttgcagtggtgtgctggagcttgcttaga

SEQ ID NO: 6894242 - DNA, 78 bp, Homo sapiens
ttgtcctgcactgaatagtagactgtacacagagcctgcacatagtaggaaaacagtaaatacttgttgagaggacaa

SEQ ID NO: 6894243 - DNA, 130 bp, Homo sapiens
ttcctgcctgtgtcacaggggttgtaaaagccagtacaattttacaaaggacgaattcccccaaggaagatcttgcctgagtaaaattgttcaatattttggctgttattactgctctgacatccaggaa

SEQ ID NO: 6894244 - DNA, 68 bp, Homo sapiens
ggatgaggtagtgtttagtccagtcctatattccaacaactggaaaaatctgtagtcactacctatcc

SEQ ID NO: 6894245 - DNA, 63 bp, Homo sapiens
cagagcagatggagctggaagaggggaagacaggcaacagactctgccagtattatctgtctg

SEQ ID NO: 6894246 - DNA, 55 bp, Homo sapiens
tggaggcctggattattttgagggctatagccttgagaactgtgagtaggcccca

SEQ ID NO: 6894247 - DNA, 95 bp, Homo sapiens
gtacaaaacacatttataggtatattcactgaatgaaaactggtttctttgccactcctcagtgagcatacagtatagaatgtgtattaatgtgc

SEQ ID NO: 6894248 - DNA, 93 bp, Homo sapiens
ctgccatccctgctggtggaaggggtccgggctctccacggcgggacaatgtctcccacaagccttggtcctcattcaggacagggaaggcag

SEQ ID NO: 6894249 - DNA, 80 bp, Homo sapiens
cctgatttaattctgaagtgctaatcctgtgcttgtggagacatgggctgaggtagtagggcactgaagctggaattggg

SEQ ID NO: 6894250 - DNA, 69 bp, Homo sapiens
ggctggacaagcttggtcttccgccatgctgctcacacagaagcaggctcacgccaggcagtgccagtt

SEQ ID NO: 6894251 - DNA, 72 bp, Homo sapiens
agattgagaaatcggatggttgccgtgtctgtgtggaaagaagtagacatgggagacttttcattttgttct

SEQ ID NO: 6894252 - DNA, 87 bp, Homo sapiens
gtctgtactattttccacagtggctgtagttctgtaaataattaatgaatgagtccttccccagccccttggagactggctgctgac

SEQ ID NO: 6894253 - DNA, 57 bp, Homo sapiens
gtcatgcactacataacgatgttttggtcaatgaccgaccgcgtgtagtgtcgtggc

SEQ ID NO: 6894254 - DNA, 97 bp, Homo sapiens
gggtagatactttcactaactgggtagtagcatttccatgccttacagagaagtcctctgaggtagtaaaggtgttagttaatgaaattattccccc

SEQ ID NO: 6894255 - DNA, 96 bp, Homo sapiens
tggtgccatgattttctgcctgcaaaggctactgtcattctattggctatagccaagaatgtggcatagcttactgcaaatagcaaaactgggcca

SEQ ID NO: 6894256 - DNA, 62 bp, Homo sapiens
ttttcctattgggtatttattgagcacaatttttatttggtgaaaatgatccaatagggaaa

SEQ ID NO: 6894257 - DNA, 67 bp, Homo sapiens
gtaaaggcttttagtgatggtaatggccaggcttcatagcattagccatcacttgcaaaaccttgac

SEQ ID NO: 6894258 - DNA, 79 bp, Homo sapiens
cagctcagctcctggcagtgtcttatcaggagtgcagaagctccagaaagaaatcagtgtccttaggggagcaggtttg

SEQ ID NO: 6894259 - DNA, 56 bp, Homo sapiens
ttcacagtactgtgtgacttgagcagctctggaagctaggaaacacatactgtgag

SEQ ID NO: 6894260 - DNA, 112 bp, Homo sapiens
gagtgtggtggcatgtgtctgtggtgccagctactctgtaggctgaagtgggaggatcacatgagcctggcaggtagaggctgccatgaattgtgattgtgccactgcactc

SEQ ID NO: 6894261 - DNA, 109 bp, Homo sapiens
gccaatcttccttattagactggaagctccttgaggccaggggtcatgcccagaatgatacttggtacagagtgggcactcagtaattgctgaatgagtgatacatggc

SEQ ID NO: 6894262 - DNA, 85 bp, Homo sapiens
tgtcctttagttgcatgccagacttggctgtagccagtcgatactggttttaaatcatagattaagtctgcattcccaagggata

SEQ ID NO: 6894263 - DNA, 64 bp, Homo sapiens
gacttatttgcccatgtttagcagatttttacctgagaacaacctctgggccacttgataggtt

SEQ ID NO: 6894264 - DNA, 80 bp, Homo sapiens
ggcccctctgcgtgttcacagcggaccttgatttaatgtctatacaattaaggcacgcggtgaatgccaagagaggcgcc

SEQ ID NO: 6894265 - DNA, 69 bp, Homo sapiens
taaagtatactgaaggtatccagggaacttcactccaaaatatggctccctggtataataggtattttg

SEQ ID NO: 6894266 - DNA, 72 bp, Homo sapiens
agattgagaaatcggatggttgccgtgtctgtgtagaaagaggtagacatgggagacttttcattttgttct

SEQ ID NO: 6894267 - DNA, 81 bp, Homo sapiens
ctccctaccccactgcctctgtctatcctccccagcaaggatctgcagagaagaggacagttctaacaaaggggaagtgag

SEQ ID NO: 6894268 - DNA, 95 bp, Homo sapiens
ggaatctcactctgtcgcccagctggagtgctggagtgcagtggtgcgatctcagctcactgcaacctctgcctcctgggcacaagtgagtctcc

SEQ ID NO: 6894269 - DNA, 59 bp, Homo sapiens
agactgtgactagacctatatctttttgaggtctacaaataagatgtaagtcaaggtct

SEQ ID NO: 6894270 - DNA, 81 bp, Homo sapiens
cttacctacctacttatctatctgtttttatgtctatctgtcatgcttagcatagtaactggcagattgtaggcagttagg

SEQ ID NO: 6894271 - DNA, 75 bp, Homo sapiens
ggcccctgagtgaggtgaagagtggagctcaggacctttggtcctgagttagtgagttcactaacaagtggagcc

SEQ ID NO: 6894272 - DNA, 78 bp, Homo sapiens
cagactggaaaatctctgcaggcaaatgtgatgtcactgaggaaatcacacacttacccgtagagattctacagtctg

SEQ ID NO: 6894273 - DNA, 99 bp, Homo sapiens
ggctgagaatgtcccttcttcttctgatcaggagtcagagctaaggcacatgtcacagcagctctctcccaagaggcaggggagctggaagggtaagcc

SEQ ID NO: 6894274 - DNA, 106 bp, Homo sapiens
acagcagttcttggtgatgttaatagcacaattgtgaagaccaacataagagctagagttgatttcacagtactgtgactattgacagggacagtgatgatgatgt

SEQ ID NO: 6894275 - DNA, 61 bp, Homo sapiens
atttacatagcagcatagtcacaggctgtcctgtggaagacagtgactggttgtgttagat

SEQ ID NO: 6894276 - DNA, 107 bp, Homo sapiens
tgtgaaatattctcaatctgacttataggctttgtgaagttaaactctttttaaaggtttggcgttaacagggttaaaaggttacagtggatcctggatattaaata

SEQ ID NO: 6894277 - DNA, 72 bp, Homo sapiens
cccttaaacatgcagcactattttatgttttgcatttttaattttgggcatagaatttcatgtatgttgggg

SEQ ID NO: 6894278 - DNA, 130 bp, Homo sapiens
gttgtttcaaatgctgttcttttaggtagaactctatgaaattgctgtgttcattggtcaaaaatggccaaataccagtcatttcatatggttcaacctactatctatgaggactattgcaataaacagc

SEQ ID NO: 6894279 - DNA, 74 bp, Homo sapiens
tttgtaatgcatctgttgaggtctgacaaagccagaaaaaaactgtgttgtctacttcaatttgtatatgtgaa

SEQ ID NO: 6894280 - DNA, 74 bp, Homo sapiens
cagagcatttattggtacaaggctgctttattcagatggaaagactgagttagaggctgtattagtttgttctg

SEQ ID NO: 6894281 - DNA, 129 bp, Homo sapiens
tgtaaaacttcaaagatgaatgtcatttttaaatgtgagaaaaagaggggtaaatgatggctggtttaaacatacgttaaacagcttctctttgtcttagagggacagtgcgggcctgggaagtgagca

SEQ ID NO: 6894282 - DNA, 79 bp, Homo sapiens
ccagccctggtccatcagtgcagactgtaagttggaatgtcataatcatgtaacacaactgcttgaggtccagagtggg

SEQ ID NO: 6894283 - DNA, 62 bp, Homo sapiens
tacacaaatgcaccccagaagctgcagtgacaaatggccttctgggaagatgtcatgctgta

SEQ ID NO: 6894284 - DNA, 81 bp, Homo sapiens
cggtgcagtacgcagtctatcaacagcaataagtgtggatgagaaaacttgtgtggagagaagaggcagtgtgctgtgttg

SEQ ID NO: 6894285 - DNA, 119 bp, Homo sapiens
tctcttcacgtttttagccatgcagcatttacaactcgtatggtagcaaaatcaactcaaattgaggtttgggtttataatttactacttgtgataactgaatggttcacaaacagaga

SEQ ID NO: 6894286 - DNA, 55 bp, Homo sapiens
gttcatccccgcgtctcaagtccccagcacagggcttggcacagggaagatgcac

SEQ ID NO: 6894287 - DNA, 107 bp, Homo sapiens
tagagcaatgattatggaagtttcataaatgcatataaatgttgctgtcataagaccatgaaagactattgtttgtgtcaatgacttctgcaacagaattttctctg

SEQ ID NO: 6894288 - DNA, 84 bp, Homo sapiens
taattgcatattgcttttatttctatggactaatgttttaatcagtcttattatagtagaacaagggagcagagatgccgatta

SEQ ID NO: 6894289 - DNA, 79 bp, Homo sapiens
gaagttattcagtggtttgagaacttagaattggaaaatctctcctttttatttccctcaggacccaacttgtaacttc

SEQ ID NO: 6894290 - DNA, 86 bp, Homo sapiens
ttggcacagagcagtgttgagtgtctgtttgcaggttttcgccctgttattcaacagatatttattgagcacctactctgtggcag

SEQ ID NO: 6894291 - DNA, 74 bp, Homo sapiens
cagctggtactgaagtgaaggcaatcttttagaggactgtgacctgtgaaatctggcttaacttcaactagctg

SEQ ID NO: 6894292 - DNA, 100 bp, Homo sapiens
ggcagttctcgggagtgcttctgcgtgtgtgatatgcctctgcacacatgtcttgtgcatgtgggagtgtcacatgctgcacgaggctcacctgtctgcc

SEQ ID NO: 6894293 - DNA, 79 bp, Homo sapiens
gcaggcagggtgtccccatctgcccaagtctgtctgagtcctggggttttatgggcttcagaggggaggtagtgcctgc

SEQ ID NO: 6894294 - DNA, 86 bp, Homo sapiens
agactatacattgaggatatgctaaagaatatcaggtaactgtctaaaaagatatatatgcaattttttagtgcaatgagtattct

SEQ ID NO: 6894295 - DNA, 89 bp, Homo sapiens
gtggtggtgattccttgatgctttcatttttgaagattttgaaatattagctagaatcattcaacgagtatttactgagtctctactat

SEQ ID NO: 6894296 - DNA, 99 bp, Homo sapiens
gcctgggtgaatttgatcctaaacttgcactgacctcaaaacagtcagaaactcagccgctttttgtctgtgtcagtgccagttcattcattcactggc

SEQ ID NO: 6894297 - DNA, 70 bp, Homo sapiens
gttcagtagaggtgactatgtcaattgtttaaaaggtaggtagatacatgtgttggctcagatgctgaac

SEQ ID NO: 6894298 - DNA, 77 bp, Homo sapiens
ttgcccatattttgttcttatgtaggtggtaaatttatacttaccattgcatggtaataaaatgtgacatgtggcaa

SEQ ID NO: 6894299 - DNA, 85 bp, Homo sapiens
tgaactcctctccttaaaaatctatgttgaactgatgcactgtatcttgtttctgcaactagttttaagctccttgaggtattta

SEQ ID NO: 6894300 - DNA, 61 bp, Homo sapiens
atcaccatggatggagactgatatgggtatgttttacctgtgattcaaataccatggtgat

SEQ ID NO: 6894301 - DNA, 114 bp, Homo sapiens
tcaatgcacacaggacttggtgacctataatccttgacagagggcagatgtgatgtaatatccatattcactttgtctttttcctcaaggatattaccaaatcattgtgtatga

SEQ ID NO: 6894302 - DNA, 94 bp, Homo sapiens
gtctggtgaggattcattgctagagaggtagtgtgatcctttggaggtattgaatcactctggctttttatacagtttgagttcttgcatagat

SEQ ID NO: 6894303 - DNA, 75 bp, Homo sapiens
attattgtgatacagtatggaaaatgtatagttccttagagaataattgcattttgtgctgcttatggctatggt

SEQ ID NO: 6894304 - DNA, 60 bp, Homo sapiens
actcttcatcctcctagagagcatggcacctctgtcagcaccatgggtagtgatgtgggt

SEQ ID NO: 6894305 - DNA, 66 bp, Homo sapiens
gggaggaagcacaagtgcagtgggctttctagagttgtacacatgcccacttgaagcattcttccc

SEQ ID NO: 6894306 - DNA, 82 bp, Homo sapiens
cctcccaaagtgctgagatgacaggtgtgagccactacactgggtcccattttcatgtcattccatttcagattcaaggagg

SEQ ID NO: 6894307 - DNA, 73 bp, Homo sapiens
ggattttgataagtgctttggaagaaacgttcttcggaacattcattcattcaacaaatatttattgagctcc

SEQ ID NO: 6894308 - DNA, 87 bp, Homo sapiens
gaaaatattcatccatcattagtggcattttcctaaaattgaagcttggattccaatttgtttgatgatggaaagggtgaatttttc

SEQ ID NO: 6894309 - DNA, 70 bp, Homo sapiens
tatcatatgctttcattcatatgtgagagctgaaaaagttgatctcatgaagatagagagtacagtgata

SEQ ID NO: 6894310 - DNA, 69 bp, Homo sapiens
actgccagactgtcttccaaagtggctgtaccattttgcagtactgagaggtgacagcgtgctggcagt

SEQ ID NO: 6894311 - DNA, 103 bp, Homo sapiens
ggccagagggcagtatcgctttgtgtactgtagcaagctaaatatttctagaatgagaaaccatagctttgaactacagcacatgcagatctgagttctagct

SEQ ID NO: 6894312 - DNA, 102 bp, Homo sapiens
caagcacacatatttcttgaaggatttgtatataatatacatggttgtcatgaaggttaataattgaaatgtttgtatataaggtccttattatggtgcttg

SEQ ID NO: 6894313 - DNA, 99 bp, Homo sapiens
tcaaactaaacaaagataatttcctgaggtagtgattgtagaagtgacaaattatctcaccacccaagcactggtctcaagattgtcttttggggatga

SEQ ID NO: 6894314 - DNA, 124 bp, Homo sapiens
tgtagtggttgatttgccagtgtagtagctggtttactggtgtggtggttggtttaccaatattgtggttggtttaccgatgtagtacttggtttagcagtatagtggctggtttactggtata

SEQ ID NO: 6894315 - DNA, 124 bp, Homo sapiens
cagtagtcattcaggagcaggttgtttggtttctatgtagttgtgcggttttgagtgagtttcttaattctgagctctaacttgattgcactgtggtctaagagactgtttgttatgatttctg

SEQ ID NO: 6894316 - DNA, 130 bp, Homo sapiens
ggagagcactgagtctcccttcagactggggctccctgaggacagggctgtatcccttagattggagctccctgaggatggggctgtgtcccttagactgggcctccctgaggacgagtctgtgtctccc

SEQ ID NO: 6894317 - DNA, 73 bp, Homo sapiens
gatatgagatttgggagggaacaggggtggaatgatatgatttggctctgtgtctccactcaaatctcatatt

SEQ ID NO: 6894318 - DNA, 112 bp, Homo sapiens
ttagttcactgctccttccccagtgtcaagcttagccaggtgctcattaaagaattacaaaatgagcaaatggttacttgactcgtgaggtaggataagacaatgagactga

SEQ ID NO: 6894319 - DNA, 92 bp, Homo sapiens
tgttggatattcatgttttagaaagacaatgggaagtgctgatttttgtttctttttccagaatcttctctatgcagcagaaactccaaaca

SEQ ID NO: 6894320 - DNA, 98 bp, Homo sapiens
ttcagctttgtagcttcatatttatattttataattcagcagaaaatgacttgatttgctatcttggaatgtgtaatactgaaggtaaaatttctgaa

SEQ ID NO: 6894321 - DNA, 78 bp, Homo sapiens
caaagacctgagtcagaagcctgtctgacttgtttggggaataacaaggaggccagtgcagctggaacagagtaaatg

SEQ ID NO: 6894322 - DNA, 97 bp, Homo sapiens
tttgttccttctaaggattccagtgagggagttgggtgtataggaaggaaatcttattgtccaagtttccctttgaaacctcttagaatggaataaa

SEQ ID NO: 6894323 - DNA, 108 bp, Homo sapiens
gagacggaggtggaagcagtgattcttgtctgagggctcacggctgtctctggaaataagacccgagcagctgagcttttccgtggatcacgtctcccccttcctctc

SEQ ID NO: 6894324 - DNA, 84 bp, Homo sapiens
cttttctcatgaggtagggagtttgttgttgttttgataaatacttagatgaacatattcaggcactttacccagtgggagggg

SEQ ID NO: 6894325 - DNA, 84 bp, Homo sapiens
gaaggtttataaagatgctatagtgaaggagtctctggggacacaaatcgagtggctgttttattgtgatttttacagatgttt

SEQ ID NO: 6894326 - DNA, 71 bp, Homo sapiens
tggctgtagggaggaagggttggaaaaaagagaagatgttttctatcttggacctttacctaaaataggca

SEQ ID NO: 6894327 - DNA, 82 bp, Homo sapiens
tgaactacggcaaggcccaggaatcctctgagattgtacatccactttcccatggagagattccagggctttgattctctca

SEQ ID NO: 6894328 - DNA, 65 bp, Homo sapiens
tggcagttgagttactgggtgaaaagtttaatgtgcatcggattttttaaaaagtagcattgcca

SEQ ID NO: 6894329 - DNA, 82 bp, Homo sapiens
acagggaacacagcaggcccatactggaaggtgctggggaggcccgggacccctgtatagtatggcaggctggtgtaactgt

SEQ ID NO: 6894330 - DNA, 103 bp, Homo sapiens
gaagtcaagattctggcactagcatcaaggaataaaaagaggcatgaagcttcagcttctttctgtttctctgaagacacctaatgtcttgattctgctcttc

SEQ ID NO: 6894331 - DNA, 90 bp, Homo sapiens
gtataaatttgaccctgtcatcatgatgctatctggttattttgcacactaggtgatgcaggttctttgtagtgtcattggtctttatac

SEQ ID NO: 6894332 - DNA, 67 bp, Homo sapiens
cagccttcagtctggttcttgaccccgatagggcatgcccacagggtgtcatcagcttgaagacctg

SEQ ID NO: 6894333 - DNA, 77 bp, Homo sapiens
tgctgctctctctggtttgcattctagtactgtcccactgaccaggctgctgcaggcacagatgctgagcatgtgca

SEQ ID NO: 6894334 - DNA, 103 bp, Homo sapiens
gatggtgagtgaggataggaacttggcctggtttggctcacctctcagattcattggaagaggcaagttcattagcacagtttcagtccaccattacagcatt

SEQ ID NO: 6894335 - DNA, 79 bp, Homo sapiens
tgccagactccgttgttcttaacccccagtgcagatagccaatgtgtgtacctggcctgagcacagcggctgcttggca

SEQ ID NO: 6894336 - DNA, 82 bp, Homo sapiens
ggcttgagtgtgtttgtgagcacaggcacacacgtgtgcatgtgcacatgtgcgtgtctgtgtatgcaggccgtattaggcc

SEQ ID NO: 6894337 - DNA, 84 bp, Homo sapiens
gacatctagatcagtgcagtagaactttagttaattccagttataaaatagctattaattagggttttcattggcttaaatgtt

SEQ ID NO: 6894338 - DNA, 95 bp, Homo sapiens
ccagttcctgcaggccaccgcccaggaagaagggatctttggtgagtcccaaccagtcagcccaggctcctgcaggcagtggtgtttgctggtgg

SEQ ID NO: 6894339 - DNA, 61 bp, Homo sapiens
gctggtcagatgctgcctaagccgagtgaacattcagggcatggctgcacttggcactggc

SEQ ID NO: 6894340 - DNA, 83 bp, Homo sapiens
gtgcgtgaggaagactgcatggcatagtgattaagaaccagggtacggctgggtgtggtcactcatgcctgtaatctcagcac

SEQ ID NO: 6894341 - DNA, 94 bp, Homo sapiens
cggcctcacgtgctgctgccgtcagataatggtggggctgaaacatcaagatggcttccctcatgtgtctggtaggagcttagtggtggggctg

SEQ ID NO: 6894342 - DNA, 74 bp, Homo sapiens
ctacttcatcagtgcatggacagatttagagaggtgtggtaacctctcaggctgcacagcagggttagaggtgg

SEQ ID NO: 6894343 - DNA, 78 bp, Homo sapiens
tttaaaggagtgaggtttaggcatgcagaggcagggaacttttagcacctgcacagtttgatttcttgctccttcaaa

SEQ ID NO: 6894344 - DNA, 87 bp, Homo sapiens
ggcagtaggcagctgcaaacatccgactgaaagcccatctgtggcttcacagcttccagtcgaggatgtttacagtcgctcactgtc

SEQ ID NO: 6894345 - DNA, 68 bp, Homo sapiens
tgagcagtaggtctgaatagtgggcttaaaatattcagtaacccttgctataaacagatgtgctgtca

SEQ ID NO: 6894346 - DNA, 127 bp, Homo sapiens
gggagacagagtggtcagtgcagtcttccaggggtaggggtagtaggtttccaggggtattgtcattaaggggaatctttggatgccactgctctttataggcagatgctggcttctgctgttacct

SEQ ID NO: 6894347 - DNA, 60 bp, Homo sapiens
gggcacatgcctttgctattgtgaatagtgctgcagtgatcaatacaggtgcatgtgtct

SEQ ID NO: 6894348 - DNA, 130 bp, Homo sapiens
tatcttgtctagcccactgccactggactgtgtgtaaggaggatatgttgtccagcccaccaccactggactgcatgtaaggcaatatgttgtccggcccactgtcactggactgtgtgtaaggcagata

SEQ ID NO: 6894349 - DNA, 66 bp, Homo sapiens
ttctcacattcacagaatggcaagttatggtctaactgtgctttgcctggtgtgaaatagtgggaa

SEQ ID NO: 6894350 - DNA, 93 bp, Homo sapiens
gtggcatgaatggcccccagattcctggcctgatctctggatgggcgaagaagaggggaggcagaggagctggaaacatggggcagggtccac

SEQ ID NO: 6894351 - DNA, 72 bp, Homo sapiens
agattgagaaatcggatggttgccatgtctgtgtagaaagaggtagacatgggagacttttcattttgttct

SEQ ID NO: 6894352 - DNA, 77 bp, Homo sapiens
ggtaggaaagaaatgagtagtgatattcaaaatcttgtaaaatttcagaagcatatcacttattcattttacttacc

SEQ ID NO: 6894353 - DNA, 77 bp, Homo sapiens
gtttcattgactttgttttggtaatcctctgggagtgaaggagggtttagaagtaaaggcatgcaggtgaatgtagc

SEQ ID NO: 6894354 - DNA, 102 bp, Homo sapiens
gggctgtggagaacctcccgtgccgtctcacaggtgcacgtggctgtgggccgctccaaggtcaggctctatgtggactgccggaaggtggctgagcggccc

SEQ ID NO: 6894355 - DNA, 91 bp, Homo sapiens
gttatatctggcctgtctagctttcccaatgttctctgattactatttctgagaacattgggaaagctatggtagctttaaggtaggtaac

SEQ ID NO: 6894356 - DNA, 72 bp, Homo sapiens
gtttttgaggcaggagttaatgtgctcagcatgaagagctgggtctgcacagaaaactgctgcttcttgagc

SEQ ID NO: 6894357 - DNA, 122 bp, Homo sapiens
aggtggctgtcttcaaggaactcacagtctgttgggtgtttcagtcatgtgaacaaataaattgtaatacaagacactacatgtaaaagacccatgggatttcaaagagagacaatctacct

SEQ ID NO: 6894358 - DNA, 70 bp, Homo sapiens
gtggattagttttctttagccaaatgaaaaggaaataaagttcatagttcagcaaaagagaatggtccat

SEQ ID NO: 6894359 - DNA, 104 bp, Homo sapiens
ctggttttgaaatgttaggacatgagatttggaggggccaggggtgaaatgatatgatttggctgtgtccccacccaaatctcaatttgaattgtagctaccag

SEQ ID NO: 6894360 - DNA, 70 bp, Homo sapiens
gtgaggaggagaggcctgtgggtttgtctctgaccttctatcagttgagctcacagtctgttttccttgc

SEQ ID NO: 6894361 - DNA, 86 bp, Homo sapiens
tttaattgttattgtttatgatgatgatgttttaattgttgatgtaacaccctgagcatcttcgtgaaagcttcataataattaaa

SEQ ID NO: 6894362 - DNA, 82 bp, Homo sapiens
ccaggccctgtgagactgcaagggtacaatgatgagcaagttacagagcctgctttcaggagctcacagtctttgggtctgg

SEQ ID NO: 6894363 - DNA, 82 bp, Homo sapiens
caccacaagccctccatgcatagagcagaacttggcacagattctcagaggctgctgtgtgcatgccatgggtttgaccgtg

SEQ ID NO: 6894364 - DNA, 70 bp, Homo sapiens
tttaatcagtttttcaaaacaaaccctgttagaattgaatagcgtggcaaattttggcaagctgaataga

SEQ ID NO: 6894365 - DNA, 109 bp, Homo sapiens
atgatcgccattctaactggtgtgagacggtatctcattgtggttttgatttgcatttctctgatggccagtgatgatgagcattgtttcatgtgttttttggctgcat

SEQ ID NO: 6894366 - DNA, 77 bp, Homo sapiens
accccctaaagctgaaacagtgcttcactcagccaacgttaagggcttgatgcattctggttccagtctggggaggt

SEQ ID NO: 6894367 - DNA, 55 bp, Homo sapiens
gcagagatgtgggagatgcttctgcaggaagcacactggtatctcctcactctgc

SEQ ID NO: 6894368 - DNA, 63 bp, Homo sapiens
tctgggggcttagcttaagggaagggagagcactctgcttattcacattaataagtcttcaga

SEQ ID NO: 6894369 - DNA, 57 bp, Homo sapiens
gttcactggctgcagcaaatggaccactctgttgtaaagtgctgatggtgagggagc

SEQ ID NO: 6894370 - DNA, 79 bp, Homo sapiens
cctgccctccaggagctcacaatctagtgggaaagtcagaaaggtaactcaatagactgtgagctccttgagggcaagg

SEQ ID NO: 6894371 - DNA, 93 bp, Homo sapiens
gtaacaaaccacctccaaatttagtggcttaaaataatataaacattcattaagtttatgattgtgaaggctggtagtttgggctggggttac

SEQ ID NO: 6894372 - DNA, 130 bp, Homo sapiens
tcctgtcagatcagcagaggtattagatttgcataggagcatgaacgctattgtgaactgtgcatgcgagggatgtaggttgtgtgctccttatgagaacctaagaattaccctgatgatctgaagtgga

SEQ ID NO: 6894373 - DNA, 78 bp, Homo sapiens
cctggggtgggaccaacaggcagttcccataatattctttaaggcacccgtgagctgccagctggcccggcttccagg

SEQ ID NO: 6894374 - DNA, 74 bp, Homo sapiens
gcctatggaatgtcaagaagcagtaagggtgtaatgttagcaccttaataagcaatttatgagcatttcaatgc

SEQ ID NO: 6894375 - DNA, 88 bp, Homo sapiens
ccattattcattcattgtttattgaaagtttcaggcaccgtactgggcaccagaagaataaagatgacaatgacatggacagtgatgg

SEQ ID NO: 6894376 - DNA, 72 bp, Homo sapiens
cccagtgacgaaattccacttacatatgcaactgaaaaaaaggtgaaagttgaggtaggaatttgtattggg

SEQ ID NO: 6894377 - DNA, 108 bp, Homo sapiens
agcacttttggcatttctattaaagacacaggctgtctggaacagatgactttaccataaatacttgtctctgagccgtatggcttggctagtggcttggcaagtgct

SEQ ID NO: 6894378 - DNA, 62 bp, Homo sapiens
gagaatgcaagaaatgtgaagctacaatatattgtaaaaaatttcgctttttttgtattgtt

SEQ ID NO: 6894379 - DNA, 68 bp, Homo sapiens
ctcctctggctgtgttcagcatcaacggcctcatgatcaaacagctgcagtacacggcctatggggag

SEQ ID NO: 6894380 - DNA, 102 bp, Homo sapiens
gtggtctagtttatatatttgaggcatgtattaatattatattcacattcatatttatgtgcgaatgtttatatgtatttatatgtctgtatcttaggttgc

SEQ ID NO: 6894381 - DNA, 84 bp, Homo sapiens
caggcacagcagacacaggcacgctgttgtgctagcaaatcgtttgcagaagggtgatgtgcctgagcttgtcctctgctcctg

SEQ ID NO: 6894382 - DNA, 95 bp, Homo sapiens
ggtcagcccttgtacctccctgccttccctgttggtctgtgattgggacctctgcctgctcccagacagaaggctccttgaggtagcagctggtc

SEQ ID NO: 6894383 - DNA, 91 bp, Homo sapiens
atgtgaggacatgagatttgggagggtccaggggcgaaatgatatggtttggctctgtgtcttcacccaaatctcatcttgcagctcacat

SEQ ID NO: 6894384 - DNA, 130 bp, Homo sapiens
gtgtgtgtgtgtgcgtgcacaagtgtgcttgcaggtgtatgtgtgtgcacatacaagtgtgcatgcaggtgtgtatgtgcacatacaagtgtgcttgcaggtgtgtgtgtgtgcacgcgtgcacactcac

SEQ ID NO: 6894385 - DNA, 79 bp, Homo sapiens
cggtgagtgggccagtgggaactgggtctccggaccaagaagccgtgagcctgccctgttcacagtggataactttctg

SEQ ID NO: 6894386 - DNA, 103 bp, Homo sapiens
tgccgccctccttgatgtgggccaccagctggtacttctgcacgtgcttgtctgtcttgcagtgcagctggaagttggccttgagctgggtgttgtagcggca

SEQ ID NO: 6894387 - DNA, 108 bp, Homo sapiens
tacagtaacatgttgtacaagcttatagcctgggagcattaggctatgccatatagcctaggtgcacagtaggctatacaatctaggcttgtgtaagtatactctgtg

SEQ ID NO: 6894388 - DNA, 57 bp, Homo sapiens
tctgaaatgcttgggaccagaagtcttttagactttggtttttttgtgtgttttgga

SEQ ID NO: 6894389 - DNA, 60 bp, Homo sapiens
tgagaaaccttcggtcctaagccagggcatcagctgactggttgcacagagggtgtttca

SEQ ID NO: 6894390 - DNA, 58 bp, Homo sapiens
aggcagtctgattcaagagcccatgtttcctgaaagaggaattttgggtggaaagtct

SEQ ID NO: 6894391 - DNA, 115 bp, Homo sapiens
tcaggttgtcatgagtcacaaaaataaatgtagtgatgctcttaaagggtttagcaccaagctgggcccaaggaagcattctgtgtgtctattgaccaacttttacctatcctga

SEQ ID NO: 6894392 - DNA, 101 bp, Homo sapiens
ccaggctgcaccgcaggtaggtgagcagtgggtgagcaaagcttcatctgtatttacagccagctgcttcccatagctcgcattacctgggaccagcctgg

SEQ ID NO: 6894393 - DNA, 107 bp, Homo sapiens
ccgggatgactgtcaggatggcagcttgttctaaggaagcatttgtatcttcagacgcaaatttccccagaacgcccctggctggtttcaactgtcagtcactccgg

SEQ ID NO: 6894394 - DNA, 113 bp, Homo sapiens
cccaggggcacatggcatggagagtaaatggcagaatcagaatgtggacacaaatttgtttgggtctgaatcctgtgttcttttcattatatcgagtgtctggcctccttggg

SEQ ID NO: 6894395 - DNA, 81 bp, Homo sapiens
aggggagggaggagatgaggtgaggttgaggaaagaatacttcagtgtgtgcttaatctgcctcctcctgcaccctgccct

SEQ ID NO: 6894396 - DNA, 68 bp, Homo sapiens
ctgtgtctttagaggcaccaggggctcatgattctaggagagtaatggtgcttctgtgagataaacag

SEQ ID NO: 6894397 - DNA, 77 bp, Homo sapiens
cctctccacatcacagtggctgtttatttaataattcatcattctttcagttaacacagcacctgtgatgtgccagg

SEQ ID NO: 6894398 - DNA, 79 bp, Homo sapiens
ggtaagtgtacagtaccctgatgaactaaagccaaaagttagggctgatttcgggcttcatcacggtgaacacctcacc

SEQ ID NO: 6894399 - DNA, 107 bp, Homo sapiens
ggctggttgggaagaagtttctggaagctcttcatagctcacttattagtagggagtgtgactggttgggaagaggcttccggaagctcttgggatcccaaagagct

SEQ ID NO: 6894400 - DNA, 60 bp, Homo sapiens
gagaagcagaaggaagcagggcctttcccacttggcccttcttttaatagccagtttctt

SEQ ID NO: 6894401 - DNA, 100 bp, Homo sapiens
cccttggccttcatgtgagcaatgttatcaggttgatcccaaaacaatggaatgcctaccatagggatcccatggtagattgcctcatagatgccattgg

SEQ ID NO: 6894402 - DNA, 81 bp, Homo sapiens
ggatatattacacagtggttaagtctgggcatttagtgtaacctaatagtgtacattttaccattaagtaatttctcatcc

SEQ ID NO: 6894403 - DNA, 84 bp, Homo sapiens
aacaaattaaagaacactgtgaggtaatgacctaagacgatattcgtctgtcttttccatgccttttatgattctctgaatgtt

SEQ ID NO: 6894404 - DNA, 79 bp, Homo sapiens
tggcaactatagcttggctactgctgatgtttattcaaggcccaaggggtctttattcagcaggtggtgagttctgcca

SEQ ID NO: 6894405 - DNA, 106 bp, Homo sapiens
cttttctatttttgttgttgttgttgttgttgttgttcttcactgcttttgtagcaggacaagcctcagacaaaactcctcagacaccgagttaaagaaggaaggg

SEQ ID NO: 6894406 - DNA, 99 bp, Homo sapiens
tctttgcaggtggaaggtggacatttgtccaggattgcgggctgaggaccctggaggagcctccccgaagtcctcactctccaccttcccacccaggga

SEQ ID NO: 6894407 - DNA, 99 bp, Homo sapiens
gtgtctcaatagccaagacatttagaaaagctgggtatccacatgcacaaagtgcatttgtctgcatttgggagccagtaaaatgtggaatgggatcac

SEQ ID NO: 6894408 - DNA, 84 bp, Homo sapiens
cacgaagtgagcttttctaaggctagaagctgccacctgtcaaagtggtttaattcaggattttggcagaagcacattattgtg

SEQ ID NO: 6894409 - DNA, 60 bp, Homo sapiens
gtcccagcaagataagaccatgtccagaaggaccagtggcagtaaagctggaaaagtgac

SEQ ID NO: 6894410 - DNA, 120 bp, Homo sapiens
ctggtaaaatgacatcattcagaaagaatcaatcaggagacagcaggcacacaaggatagaagttctcactttgggccgctgttttcaggcttttcagtttgaaggtgaggttttgccag

SEQ ID NO: 6894411 - DNA, 130 bp, Homo sapiens
ctcaggcagaaccaagcttgggcccctagtgtagaagggctgtcttctgggtgccaggtgcagcaatcactctaggtgtctgctgctaagcccagaactcgcctttccagtgactaagcttctgcttgag

SEQ ID NO: 6894412 - DNA, 130 bp, Homo sapiens
cccatcttggagggctgtgctatagaataagtgaggaagtggttgtatggtttccatcatatattagctgcttgatggacactggataaccctgttggctctctatactgtcccaggtacaagaatatag

SEQ ID NO: 6894413 - DNA, 63 bp, Homo sapiens
gttttcaaggtagaagcagcttatactccaggcccctggcattagacagagctccttgagggc

SEQ ID NO: 6894414 - DNA, 129 bp, Homo sapiens
atgttcagaaaaatggtcaggtcctcagggaatagttaaaactgtgcaggactagactacttaggtttatatccctgcctcagtgcttgacagctctgggaccttgggcacctcagttttctcatctat

SEQ ID NO: 6894415 - DNA, 88 bp, Homo sapiens
gccaagaataggaaaaccaaagtgtgaattatgaagtagtctgtatgtatatggctttttattcatcttacagattggtcctgttggc

SEQ ID NO: 6894416 - DNA, 122 bp, Homo sapiens
aaatgttcaaatgttcgttttatgagttagtcactttgtacatcttcttagctggtgagattcgactgtttcattgcagctcgtgtcatggtttgtttcatggtcatagagcattaacattt

SEQ ID NO: 6894417 - DNA, 84 bp, Homo sapiens
tgttttctctgaaaccctctgttctttaacgctgaagtcctggatgcctgctaggagcagctcgagaaggaagcagggacagca

SEQ ID NO: 6894418 - DNA, 129 bp, Homo sapiens
taccaggaaccctacctccccacctctgacccagctctccagtgcccaggagaattccctgctttgtaaaatgaattctcctggacactggagatctgggtcagagctggagagatagggttcctggca

SEQ ID NO: 6894419 - DNA, 118 bp, Homo sapiens
ggggtacatgtgcaggtttcttacattggcaaattgtgtatcactgggatgtggtgtacaaatgatcccgcccaggtagtgagcatagtaccaggtagtaaattgtacgtttcacccc

SEQ ID NO: 6894420 - DNA, 85 bp, Homo sapiens
ccttcgtgtggagatgtttctgcattgccttaaatacagcctatgtctgcttttgagaattaatagcaggaaaaattgtcgaagg

SEQ ID NO: 6894421 - DNA, 72 bp, Homo sapiens
agattgagaaatcggatggttgccgtgtctgtgtagaaagtagtagacatgggagacttttcattttgttct

SEQ ID NO: 6894422 - DNA, 60 bp, Homo sapiens
gggggccaaggagcagcttctgggcagtgtgctggctccagatgaatgcacttgttcccc

SEQ ID NO: 6894423 - DNA, 80 bp, Homo sapiens
gtgcagccatttgaaaagcagttcagcattatcttctttggatacctgttgacacaatgcttctcatccaaggcctgcac

SEQ ID NO: 6894424 - DNA, 88 bp, Homo sapiens
tgtgagaaggatgagatttgggaggggccaggggcagaatgatatggtctggctctgtgtccccacccaagtctcattttgaattgta

SEQ ID NO: 6894425 - DNA, 62 bp, Homo sapiens
cagcagactgtggcttcttggagggcaggaactgattgcctttttccttggccaaagtgctg

SEQ ID NO: 6894426 - DNA, 56 bp, Homo sapiens
gggaatgaagtctagcaagcattgaatttttaagtttgcttttctgattttttccc

SEQ ID NO: 6894427 - DNA, 84 bp, Homo sapiens
ctggatttcggacccacagaatctttttagataatatatatttatgtgtcaagttgttaagttctggggtaattcgttatgcag

SEQ ID NO: 6894428 - DNA, 74 bp, Homo sapiens
atgctgccaagtcatcgtctgttttcttcaagaaaatgtggagaataggatacatgtttggtaaatgatggcat

SEQ ID NO: 6894429 - DNA, 64 bp, Homo sapiens
tctaatccactgtcaactttgaataacaccaaaaaattcacagtaagtaggatagttgattaga

SEQ ID NO: 6894430 - DNA, 72 bp, Homo sapiens
tataagcacatccttgactgatgcaggaatctagcttactccttttcctaatgtcaggcgatgctgctcata

SEQ ID NO: 6894431 - DNA, 73 bp, Homo sapiens
ctgaggtaggagggtgatcagcatggttcaatcagcgtcctagatccagctctcaccaatccttttcattcag

SEQ ID NO: 6894432 - DNA, 60 bp, Homo sapiens
ggcagggctgtaaaggcacttagagatgtttttggttggaagtgccttgctggctgtgcc

SEQ ID NO: 6894433 - DNA, 75 bp, Homo sapiens
ctctgccatctaaaactactatcaaacctaccttttgtctccagtggtgggtcctgaggggagctgaaggtagag

SEQ ID NO: 6894434 - DNA, 88 bp, Homo sapiens
tcatctctagtttctcatcagctgttgagtttgggggaaagtatttccctggagctgtaacagctctccatgtggggaaagggagtgg

SEQ ID NO: 6894435 - DNA, 80 bp, Homo sapiens
ggaaggtagatatggttcagttcctcgtgtttttttcatgtagacagaaacagagaaatattggctatatgatctcaacc

SEQ ID NO: 6894436 - DNA, 76 bp, Homo sapiens
ggattgaggtattttggaatgtcaaaagtctgctattccataaatgtagcattaatattctagaatatttctctcc

SEQ ID NO: 6894437 - DNA, 124 bp, Homo sapiens
tccaacactgaaagattacaatttgacatgagatttgggtggggacacagatagtaactgatatggtctggctctgtgtccccacccaaacctcatctggaattgtaatccccacatgttagga

SEQ ID NO: 6894438 - DNA, 120 bp, Homo sapiens
caggtcttacccagtcaggaggaatgagataagggatctgcccctagaagctgtctggctgctttttggtagagcaggcatgctgcattgaggggctctcttcctcatctggactacctg

SEQ ID NO: 6894439 - DNA, 74 bp, Homo sapiens
ggcccagcagatggagggccaggaggaggaagagtctgcagcatttgttctcctggctcccaccctgccaggtc

SEQ ID NO: 6894440 - DNA, 62 bp, Homo sapiens
gcctcttgtatgtgtgcagtgcttttgccttcaggcaacagaatagttgatgtacagtaggc

SEQ ID NO: 6894441 - DNA, 129 bp, Homo sapiens
ttaagtcaaggagaaaagtcagaggaaaatgggcaggtaatagtggatgaggagaacatctaaatcagtggggttcttaacattgtctgcacatcatctgtgacatttttaaaaccactagtgactcga

SEQ ID NO: 6894442 - DNA, 87 bp, Homo sapiens
gacaggaatgtggcatgtgtggttacaggttctgattgaagaaagttcccagttcagcactgccaaccgaacatttaaaattctgtc

SEQ ID NO: 6894443 - DNA, 80 bp, Homo sapiens
gggactagagaccaatgtttataggattaaaaatattaattactaaaataattcagctgaacaactgtgtttctattcct

SEQ ID NO: 6894444 - DNA, 74 bp, Homo sapiens
ctgccttcacagtgctcacagttcagtgaagaaaatgacaaaacaaggaattaagatgaagctgtgatgggcag

SEQ ID NO: 6894445 - DNA, 105 bp, Homo sapiens
tgagattttgagaaactgaggttctaagtggttcctttaaatagatcacactacttgaaatgtttgaagaccactgagttactgaaattttcttccaagttctca

SEQ ID NO: 6894446 - DNA, 79 bp, Homo sapiens
ttcctttctcatctgtatggcttttctttcctagtgttattgcactggctaagaccgccactacaatattgagttggag

SEQ ID NO: 6894447 - DNA, 121 bp, Homo sapiens
catcagaatcacgtggaagtcttgttaaaacacagattgcttgatccatgcccaaggtttctgattcagtaggtctggaatggggcttggatttttagcaaatttccaggtgatgctgatg

SEQ ID NO: 6894448 - DNA, 80 bp, Homo sapiens
tcaagaggtgtctgctttttccccttctggcgagctctataaatcagcaattcagtgaagtggaaaagcatagcctctga

SEQ ID NO: 6894449 - DNA, 93 bp, Homo sapiens
ggtccctgccctctagaagctcacagtctagttgtgttcatgtgcaagtcatttacccccagctagattgtaagctccttgagggcagttacc

SEQ ID NO: 6894450 - DNA, 125 bp, Homo sapiens
ttattcatatagttgtactctgaccattcagactagtgtatagagatggaatggagatgcttttaatgttcttattcatatagttgtactctgaccattcagactagtgtatagagatggaatgg

SEQ ID NO: 6894451 - DNA, 72 bp, Homo sapiens
tagcaatgacacagacatgcagtgtcatctacacctctctatctctgattcttgtgtggtctggtcttgcta

SEQ ID NO: 6894452 - DNA, 78 bp, Homo sapiens
tgcctgccctcagggagctcacagtccagtagaaagttctctgaggatgggatgggctctctggtactgggtggtgca

SEQ ID NO: 6894453 - DNA, 58 bp, Homo sapiens
atataggctaacaactattgaggattggggctttttttagtcctctgttggtttatgt

SEQ ID NO: 6894454 - DNA, 115 bp, Homo sapiens
cagattatttcttcttgctcattaacatccttttctttctgactggataactccttttaccaattcttgtaggacaggtctggtgttgatgaattcctcaggttttgtttgtctg

SEQ ID NO: 6894455 - DNA, 118 bp, Homo sapiens
agaagctgagagaaggaaactggggttaatgttatgcaatgccttgagtgctgtgatggagagcctgccgtggaagcacttgggttttgttgttgttgttgggtttctttctgtttct

SEQ ID NO: 6894456 - DNA, 88 bp, Homo sapiens
ggagcccaggttgtttgtgcagaggagtgcctgcaggcctgtgccaggccaccctcagccccacccctggcatccatccctgagctcc

SEQ ID NO: 6894457 - DNA, 105 bp, Homo sapiens
ggatgcggaaaaataggaatgcttttacactgttggtgggaatgtaagttaattcaactattatggaagacagtgtggttggtggttcctcaaggatttacaacc

SEQ ID NO: 6894458 - DNA, 98 bp, Homo sapiens
agcagccagcatggctaggataaaagcagacagaggaacacggaaggactggactggctaagtccttcagcctttatctttctcccatgctgcctgct

SEQ ID NO: 6894459 - DNA, 67 bp, Homo sapiens
gtcactgtcagtgccttgatacttgcattgatttcttttcttaaaggtgcactgtggtggcagtggc

SEQ ID NO: 6894460 - DNA, 70 bp, Homo sapiens
gtttcctgggctttgtttctctcctacctcagctgggtcctgagtgagttgcaaagtgttactagaaagc

SEQ ID NO: 6894461 - DNA, 130 bp, Homo sapiens
ttttgtccctctatagtccaagtaatttctctcatttgtttagcagcttttgatgtatcaaagaaaacttgcatcagatggatttaaacaggcagagaataatttaagactattgtaataggggacagag

SEQ ID NO: 6894462 - DNA, 80 bp, Homo sapiens
gtttgagagatcagttggacatgattagcagggagagcatttgtgtttttatgagagttatgccgagataggtaacagat

SEQ ID NO: 6894463 - DNA, 81 bp, Homo sapiens
actgtttttgttggatgtatgcttttatgacaatttccacataaacttccagttacaggtattttattgagcagagacagt

SEQ ID NO: 6894464 - DNA, 110 bp, Homo sapiens
ttcttttcccttaaatgttctctgtctttaattttactatgactggggaccttccagggccagacattgtgtaagatgctgggatagatgacttagatgtggtcaaagaa

SEQ ID NO: 6894465 - DNA, 130 bp, Homo sapiens
gtaagagaaagcatttccttcctccttcataaaactttgcctggctgtgcagcgtgtggcttgccctgtgatttctgagcacacttgcatttcaggcacttgtgttctggattctagtctttgatctccc

SEQ ID NO: 6894466 - DNA, 89 bp, Homo sapiens
cctgaatgccatggattgaggtctcccaggaaacagactctgtatagagatgtgaatgcaggagatttatcaggacatgctgtctcagg

SEQ ID NO: 6894467 - DNA, 65 bp, Homo sapiens
acaccagctgcagatcatgtttacagctcagctgaaacaaaacatcagatctgcctgctgcctgt

SEQ ID NO: 6894468 - DNA, 72 bp, Homo sapiens
ctgggctcagtgtctcactcctgtaatcccagcaccttgagaggccgaggtgggaggattactgaagcccag

SEQ ID NO: 6894469 - DNA, 69 bp, Homo sapiens
gaattctgagaggacaagacaaggaccagagaaagcgctatggaacttcttttcttttcttctcttttc

SEQ ID NO: 6894470 - DNA, 95 bp, Homo sapiens
gtgagtcagagtctacagctgaacagtgtctcaggtggtgatgggcacagtacagcttgagaaacactgtgctgtgcagatggtccctgacttac

SEQ ID NO: 6894471 - DNA, 86 bp, Homo sapiens
gcaagagctattcacattctcaggcctggtctcatacagagtcacctacaatgtgtgactattaggtcttgtggaattcttctggc

SEQ ID NO: 6894472 - DNA, 72 bp, Homo sapiens
gaagggcaacaactggacatagctggcaactagtcctaatggccattgcagctgtgtttcaaatgaattttc

SEQ ID NO: 6894473 - DNA, 111 bp, Homo sapiens
tgagtagctgggtctataggtgcttgccatcatgcgtggctaattttttaatctttttgtagagttaggtcttgctgtgttgcccaagctggcctcaaactcctagcttca

SEQ ID NO: 6894474 - DNA, 77 bp, Homo sapiens
tcccagggttctcccgacccatgtgccagggtgtgaagacacagcactgcccttcagggttgagaggccaccaggga

SEQ ID NO: 6894475 - DNA, 82 bp, Homo sapiens
caagaaccgtgtacctactctttaaacaaataggtttaatactgtttaaaaatataaagggtactgtatagatgtgttcttg

SEQ ID NO: 6894476 - DNA, 112 bp, Homo sapiens
tggtaaatgacagtacctcttcttcattcagcaaggcatgtgcaggaggcgatgtctgagcagtgctccaagccccatagctaaagtggatgaggagaggttcaatttgcca

SEQ ID NO: 6894477 - DNA, 86 bp, Homo sapiens
agtgtgtcttcttggccttcctatggaatgtaatcatgtggtggttttccaaccttatgtgatatattcattccaggatgcccact

SEQ ID NO: 6894478 - DNA, 77 bp, Homo sapiens
gaggggtcctgggcagtccagctggaaacggacttcacagcacagtctgggttctagaacgagcccgaggagccctt

SEQ ID NO: 6894479 - DNA, 76 bp, Homo sapiens
gactagatggagaggaaagtgcagttttgggaaatgaaaacagaattttaagtgctggttttcttctcttttggtt

SEQ ID NO: 6894480 - DNA, 108 bp, Homo sapiens
caggtgccttctccgtgtcctcctgcacagagatgcagactggctcaggcatggcctgcccccaggagctcactgtctaatgggaagagacatgcatgaaagcagctg

SEQ ID NO: 6894481 - DNA, 117 bp, Homo sapiens
ggagggttgagcttccatgtgaccagccaggcctcaggagcagggacctgctggaccccagcctgccactggcccggggatcctggcagtgggaagctggaagtccattcagactcc

SEQ ID NO: 6894482 - DNA, 98 bp, Homo sapiens
cttggggacgtcagcacactcacctgtggagagccagccagaagacaggcagtggcacaagttttctgaggtagagattgtgactgtaggtgaccaag

SEQ ID NO: 6894483 - DNA, 79 bp, Homo sapiens
gcatagatctggcttcattcagcatgacagttctaaagaacgtcatctttgcgtgttgtggctgagtagtgtcagaagc

SEQ ID NO: 6894484 - DNA, 76 bp, Homo sapiens
agtgcatgatttttaagcatttgcactctttacaaattgtttgttggaagtgcttcaagggttatttgttagcact

SEQ ID NO: 6894485 - DNA, 102 bp, Homo sapiens
gaaagggtgtaacaagtaatccatgggagcagcaggtatctttaagggggtccaaaagctgcttgagatccactgcctgttgtcatatcacgtccacccttc

SEQ ID NO: 6894486 - DNA, 128 bp, Homo sapiens
gatggaagtggctctcaatgggacggggagctggaaaggggatggaatgggaagataatcttccttctccgaacatccccagctgaactcctctccaaccgtagtctccaatgtctagccgcctcttc

SEQ ID NO: 6894487 - DNA, 96 bp, Homo sapiens
ggacactcagaattccctttggcagccttctcctcttccctgtttgtgatgtttcaggaactgagagtgcagggaatgctgtcagatgagtggtcc

SEQ ID NO: 6894488 - DNA, 104 bp, Homo sapiens
gtggctctcggtggaaggggagctggaaaggggatcgagtgggaagaaggtgatctttccctgaagcccagcctgtctccagccaggctcccctctgaagccgc

SEQ ID NO: 6894489 - DNA, 72 bp, Homo sapiens
tatgtctacatgtgtacagtacatgtgtagtgatgtgtgtatgtctacatgtgtacagtacatgtgtgcatg

SEQ ID NO: 6894490 - DNA, 74 bp, Homo sapiens
gcgggcgcctgtagtcccagctactcgggaggctcaggcaggagaatggcgtgaagctggaaggcggagcttgc

SEQ ID NO: 6894491 - DNA, 84 bp, Homo sapiens
ttctaaagctccttccactaaaaagttgacatttttatgtgaaaatatatcaaaattcgaacgtcttgtggattcaggctagaa

SEQ ID NO: 6894492 - DNA, 60 bp, Homo sapiens
cccttttgttctttccgaactgcagccagcgatggctgcagttcacaggagcaagcaggg

SEQ ID NO: 6894493 - DNA, 84 bp, Homo sapiens
gcttttcccatattggcactgcacatgattgctcagagcggagagacacaagcaaaaatgtgctagtgccaaaatcggccaagc

SEQ ID NO: 6894494 - DNA, 130 bp, Homo sapiens
ttccagctagaattgagaaaacatctgagtcaatgtcataaagtaggcaagcattccatttaatagtttgtaatatgttggctatggtttgctttgtttttgctttgctttgattttgtttttgttggaa

SEQ ID NO: 6894495 - DNA, 101 bp, Homo sapiens
gtaaatagacacaaatcttttcagtgggtttatttcatgtggttttgcctattcattcaattagcatttaatagctcatcaagaagatctgtgttatttac

SEQ ID NO: 6894496 - DNA, 129 bp, Homo sapiens
tacttcttcctttagagtcaggtgttgtgtgtctctttttcctgccttattgtactggagaggataccagtgcaatattcaaagtggagaggagttttttcaataaacaaacaaatattaaagtagata

SEQ ID NO: 6894497 - DNA, 125 bp, Homo sapiens
cagagctctggcagtgtcctactggttggtggttgggtttctttgccctgccatgctttaaggtaagtgttggcagtgccaggaaaggatcctaactctgacttcttcgaacctgtcaggtcctg

SEQ ID NO: 6894498 - DNA, 62 bp, Homo sapiens
aacctgacctggaaatacaagaagtatgtcattgacatatctttatgatattcaagcaggtt

SEQ ID NO: 6894499 - DNA, 75 bp, Homo sapiens
ggcagaggaagctggaagtgggagatgtagcaactgaaagacacgctgccttcccccacactcagcagccctgcc

SEQ ID NO: 6894500 - DNA, 79 bp, Homo sapiens
aaggcagaatgtccttccacctgttttatgctgtaagacaaacttccaagtgcgaggcagtgtggagggctgttgcctt

SEQ ID NO: 6894501 - DNA, 79 bp, Homo sapiens
gcccctaaggatcttgtgcatttgttcattggcttctgttttcctctctgcccaactagactgcaggctccttgagggc

SEQ ID NO: 6894502 - DNA, 93 bp, Homo sapiens
tagagaagaggacatagatctagactttaaaaaactgaacaagaaatatttggaaggatttttaagccaagaggttgtaactgtcccttccta

SEQ ID NO: 6894503 - DNA, 76 bp, Homo sapiens
gctgggtcaaccacagtatgtcagctccacttctggccataaggattggtccagggggtagatatgtgatccaagc

SEQ ID NO: 6894504 - DNA, 95 bp, Homo sapiens
cttaataatacagtaccttagtcgagctctctactccctcacaagaaggactccaaatggagggttcctgagctaggtgtgcagatatgagtaag

SEQ ID NO: 6894505 - DNA, 129 bp, Homo sapiens
tggaggatggtagctctcttctcacaactccactaggcagtgccccagtagggactcggtgtggcagctccaacccatttcccttccgcattgccctagcagaagctccttgagggtcccactcctgca

SEQ ID NO: 6894506 - DNA, 76 bp, Homo sapiens
agggacatgagatttgggaggggccaggggcagaatgatatagtttggctctgtgtctccacccaaatctcacctt

SEQ ID NO: 6894507 - DNA, 77 bp, Homo sapiens
tcttctggctcctggctccactgccctggctctgtgctctgtgctggccgtggtagccggagggaggacccaggaga

SEQ ID NO: 6894508 - DNA, 60 bp, Homo sapiens
cccaagcaaaccaatacacagctgtttctagttaggcagatgtttggcattgcttcaggg

SEQ ID NO: 6894509 - DNA, 57 bp, Homo sapiens
ttacgacctttgtcatgcttgggatttgtggaaatttcacagtggtaagggttgtga

SEQ ID NO: 6894510 - DNA, 80 bp, Homo sapiens
gagggctccctagccatttggaactgtgagtcaattaaatctattttctttgtaaactatacagtctccaggcagtcctt

SEQ ID NO: 6894511 - DNA, 58 bp, Homo sapiens
gggcagcctgtgccttcttattccagggacctggggcacagagttggcagagctgctc

SEQ ID NO: 6894512 - DNA, 80 bp, Homo sapiens
aggtgattagatcatgagagcaggctccccccttgctgttctcgtgatggtgagtgagttctcatgaaatctagttgttt

SEQ ID NO: 6894513 - DNA, 85 bp, Homo sapiens
gttctcccatgaactgtcttgctgtagtttaatgcaccgaggtgcctgtaacatccagcaacatagtcagcatcagtggggggac

SEQ ID NO: 6894514 - DNA, 64 bp, Homo sapiens
aggattgctgtggctttatagtacagtttgaagtcaagtactgtgatagctgaagttttgttct

SEQ ID NO: 6894515 - DNA, 59 bp, Homo sapiens
tgaggcagcaattgtattgtatgaccagaatcaaggtcatacaaaacgattgtgtttca

SEQ ID NO: 6894516 - DNA, 72 bp, Homo sapiens
agattgagaaatcgaatggttgccgtgtctgtgtagaaagaagtagacatgggagacttttcattttgttct

SEQ ID NO: 6894517 - DNA, 58 bp, Homo sapiens
ttagagcaaggatggcagcagaggttataacagatatgctgagactcctgtgctttaa

SEQ ID NO: 6894518 - DNA, 95 bp, Homo sapiens
ccgggctcaatcaattcttccacctcagcctccagagtagcttgcatagtcccagatacttgggaggctgaggtaggaggattgattgagccagg

SEQ ID NO: 6894519 - DNA, 130 bp, Homo sapiens
ctccttggttaaattcagtgagtaatttctgactgtattcactgccgggggatatatttctttagagttaaatatcactggctgtgcattttgatatgagaaatgcgggctgcaatttataaccgacaag

SEQ ID NO: 6894520 - DNA, 86 bp, Homo sapiens
ctaagactcttgactatagaccattttacaatagtgtgggatgtcttaaccatacaaattgtaaaaggttttcagaatttctttag

SEQ ID NO: 6894521 - DNA, 128 bp, Homo sapiens
gcatgtccatacagtataggtatgtcgagaaatgaagtattatatttttgtgagttgcaattcttttattcacatttttgtgtactttggttgtcttttcttgtgttttcctagtaccaatgttatgc

SEQ ID NO: 6894522 - DNA, 118 bp, Homo sapiens
cctggtctgagggctcttgaggctgaggaggttaacatctgcatccacccactcaacatttctgctggagtgtctgtgtctggggtgcagcctcctggctaagagaccctggctcagg

SEQ ID NO: 6894523 - DNA, 90 bp, Homo sapiens
cccagtcaggctgccattcagggcgtgctggtcaagatgcctccattatatgaataagttaggcctgaagtagcaggctgatggtttggg

SEQ ID NO: 6894524 - DNA, 72 bp, Homo sapiens
accacaggagagaagggggaagctggcaagtagacctgcagaggctcttcccatcgtctccttcaccttggt

SEQ ID NO: 6894525 - DNA, 130 bp, Homo sapiens
agaaaatgaaattttcctggtaaagatggaggaaaaagaaatgctggcttgttgagaaaatgaagcttccaagagtagcaaattcttttatctccttgttcatgcttttcctttgttcagtaaaatattt

SEQ ID NO: 6894526 - DNA, 78 bp, Homo sapiens
gtggcaatatggctaggttactaaactgccttatacagaacctaatgcaattagtacttctgaccatagactttccac

SEQ ID NO: 6894527 - DNA, 118 bp, Homo sapiens
ctgtgaggaataaagatatgttgtttaaggcaccacgtctaaggtaattttttgtatcagcctaagatattactcaacatgggcaggagtaacatattctctggcttttcctcatcag

SEQ ID NO: 6894528 - DNA, 71 bp, Homo sapiens
ggagtggcagggtcttgctgtgttgcccagggtgggcttgaattcctgggctcaagtgatcctcccacttt

SEQ ID NO: 6894529 - DNA, 70 bp, Homo sapiens
taagctttcagcagcagcctcctgtgctacagctcacacagtcaggctgtggcaggcagctggaagcttg

SEQ ID NO: 6894530 - DNA, 62 bp, Homo sapiens
aggcagaggtagctggaaccaggaacaaaggactgagtctggggttgggttaactactgctt

SEQ ID NO: 6894531 - DNA, 116 bp, Homo sapiens
gatgggagtggctctcagtggaaggggagctggaaaggggatggtatgggaagaaggggatcttttcctgaagcccagctgtctccagccaggctcctctccaaagtcatgccatc

SEQ ID NO: 6894532 - DNA, 114 bp, Homo sapiens
gtaagttaaatggaatgagatcttcttcagtgcacctgatgtcttgggaagggtgagttgaggcgtggtggatgtgaaacatgatctcattataaatgttcccatttgttttat

SEQ ID NO: 6894533 - DNA, 65 bp, Homo sapiens
ctttagtaaagttcaacagccagaaatattagccatttggcctggctaaagttggataattagag

SEQ ID NO: 6894534 - DNA, 96 bp, Homo sapiens
agtctttgcagtctgggcttgtttgtacctgtttttcttcagaaggccttccaagaatttaaaggagcgaataagtctcctaagatggcagttatt

SEQ ID NO: 6894535 - DNA, 62 bp, Homo sapiens
atcacttacactggttctgcatctttgatcaaaccctgaatgatacagaattatgtagtgat

SEQ ID NO: 6894536 - DNA, 56 bp, Homo sapiens
agctctagggggcgccgttcatattgtagtttatgtaaacatcaccccctggagtt

SEQ ID NO: 6894537 - DNA, 111 bp, Homo sapiens
gccacaaaagctagtttttcagctgttgagatggtttcagagtggtcctgcttatttaaaataaactgtgacctctcaatcagtgccagtggatgaactgtttgttgttgc

SEQ ID NO: 6894538 - DNA, 74 bp, Homo sapiens
tgaggtagttctaatattaaagacatatatgtggatatgcattcagattaaattaaatgttcagaactgctaca

SEQ ID NO: 6894539 - DNA, 80 bp, Homo sapiens
gacagtgctttgtagtttcattgtgtaaggctttcacttctttggttaaattcatacaataaactcataggtattttgtt

SEQ ID NO: 6894540 - DNA, 72 bp, Homo sapiens
agattgagaaatcggatggttgccatgtctgtgtagaaagaagtagacatgggagacttttcattttgttct

SEQ ID NO: 6894541 - DNA, 81 bp, Homo sapiens
gcattgtttattgtttgcagcagactgagttacgtggctataataccactagagaagctgttgtagcttgttagaccatgt

SEQ ID NO: 6894542 - DNA, 56 bp, Homo sapiens
cagcagcagtggctgcagaacagcagatattggtgtactgcaaatgctgctgcctg

SEQ ID NO: 6894543 - DNA, 83 bp, Homo sapiens
cactcactcacttgcagtgcagctggaatatcttgggcattaatctgagagaatgctgcattgaaatgcaaaaatgatgcttg

SEQ ID NO: 6894544 - DNA, 76 bp, Homo sapiens
aaatcattatgaactaaagtgtttgtatgcagataagcttatctgtacattcatggtttagttgatttcttgattt

SEQ ID NO: 6894545 - DNA, 124 bp, Homo sapiens
ggtgtcccagcatccagcccgggggtttcatctcctgagccctgtcatgaatgtgctgctgcctttcagtagactctcttgctagagtgaagggtcttgaggctcctgaaggaaaggggacacc

SEQ ID NO: 6894546 - DNA, 128 bp, Homo sapiens
cagtctaagaaagcaaattcatttggagtaagaatgggcagttcaatgtcctcacaaactgtctttatgtttaattgtattgctaattttaatgtttatttttaaatgaattagtttttttaagattg

SEQ ID NO: 6894547 - DNA, 69 bp, Homo sapiens
ggtatacttactagcatattatatagctctaagagtgtagagttatatgatgtgctagtgaagtgtatt

SEQ ID NO: 6894548 - DNA, 104 bp, Homo sapiens
gtggtggcatatgcctgtaatctcagctactcagaaggctgaggcacgagaatcgcttgagcttgagaggtagaggttgcagtgagctgagattgtgccactac

SEQ ID NO: 6894549 - DNA, 129 bp, Homo sapiens
gataatatttatattctattttgtaaatctacgtctgttatattttgtgctatttgttgattgtaaaagctgaacaataatgatacagtgtaaatagatatgtagtttttacagtagaggcaagtcttc

SEQ ID NO: 6894550 - DNA, 110 bp, Homo sapiens
gaattttccagatgtttaagttctgcttcccttttgattaaaaatttactctttaaattctctcttcttgtattttactatcaagagaagcgaagccacatcttccattc

SEQ ID NO: 6894551 - DNA, 93 bp, Homo sapiens
gtgagaatctatcctaaatatctgaagaattctcaacatagtaatgatgctctgtatatagtgtagagaaatcttggaacgggtagaactcac

SEQ ID NO: 6894552 - DNA, 63 bp, Homo sapiens
agtaggttctcaaataattgctggattaattattaaataacaagtatttattgagcatctact

SEQ ID NO: 6894553 - DNA, 78 bp, Homo sapiens
gtccctgaaccactagtgatgagaagatgaggggaggctgactcctcaggcttgtacttagtgagaaattcagaggac

SEQ ID NO: 6894554 - DNA, 123 bp, Homo sapiens
gtctcctcagtaaggcatggctttgattgacagaagactactgtgcgtatatgagttctattgagagctttagcccgttggcagtagttgtcagaatgtcattcacatgcagacaggagagac

SEQ ID NO: 6894555 - DNA, 98 bp, Homo sapiens
gcacgattagcatttgaggtgaagttctgttatacactcaggctgtggctctctgaaagtcagtgcatcacagaactttgtctcgaaagctttctagc

SEQ ID NO: 6894556 - DNA, 64 bp, Homo sapiens
aatggcatgttaaagtagtattaaaaggctgacttaccattagcatgctatttaatgtgtcatt

SEQ ID NO: 6894557 - DNA, 72 bp, Homo sapiens
ctcaggcaaatcattagcctcatgtacctcagttttctcacctgcgtcacaggcttgtgaacattgcatgag

SEQ ID NO: 6894558 - DNA, 130 bp, Homo sapiens
gaacctcagtgccatgtgagaaggggcagggcctccaggactcccccaggtggcagaggctctctgacctgcccttccagcctgcccttgccacccttctctttgaactgagtatgtaatcttcctcttc

SEQ ID NO: 6894559 - DNA, 75 bp, Homo sapiens
tttgattgtgaaggatggtgtcaagtctgcaaagaaaaatgtttctaaatcagtaaggcatattctcacattaaa

SEQ ID NO: 6894560 - DNA, 64 bp, Homo sapiens
gggatggggagctggaaaggggaaggaataggaagataatcttcccctggagtttgactattcc

SEQ ID NO: 6894561 - DNA, 56 bp, Homo sapiens
tggcctggatctgcagagcagggcttcagaggaggcagtggagctggaataggcca

SEQ ID NO: 6894562 - DNA, 81 bp, Homo sapiens
gtcacactaaagcagcacagtaatattggtgtttaatatatatttcactacgccaatatttacgtgctgctagagtggaac

SEQ ID NO: 6894563 - DNA, 78 bp, Homo sapiens
acattacacaacatttttcatctgggtgtttctctctgctcagtacctgggagttactcagaaggaattgtgttttgt

SEQ ID NO: 6894564 - DNA, 130 bp, Homo sapiens
aatctccatacttgaactttttctgttattaaatcttgctgtacctctacaaggtaaatatgacctttctaggtgagcaggatttcatggtgtaatagttttgtgcttctgactagtgtaggtgaccatt

SEQ ID NO: 6894565 - DNA, 107 bp, Homo sapiens
ctatcattaatttggtaatgccctcaaacaagttcccattccaacagttcctacttggatgctttggcaacggagaacttactctttcatatatcatataatgatgg

SEQ ID NO: 6894566 - DNA, 82 bp, Homo sapiens
ctttagaagatgagtaggtagcattagtaatcttatagcagtttgcaaagattaagatagaattaatgttgaatttctaaag

SEQ ID NO: 6894567 - DNA, 87 bp, Homo sapiens
gagggagagggaaagattaagggaattcctggaggcataattctgtcttcctccggaagacctcagtctttttctcttaagtacctc

SEQ ID NO: 6894568 - DNA, 75 bp, Homo sapiens
aggtatttatagcagcacaaatggactatgacagaaattgatactgagaatgggatgttgctataactaatacct

SEQ ID NO: 6894569 - DNA, 110 bp, Homo sapiens
ttgagactgcaacacctatgtcagtatttacctagtgtagaacagataatttacaacttttgtgaaatctcctaccattacgtgtgtaaactacagtggtaatgtctcaa

SEQ ID NO: 6894570 - DNA, 68 bp, Homo sapiens
gggcaggtggggctactgagctggaactgggtttgtctgctccagagaatcatagactccatcaaccc

SEQ ID NO: 6894571 - DNA, 117 bp, Homo sapiens
aaggtaagattggtcccctcctatgtgccagataatgggctggatgtacatttagtctcctaaatgtgacgatgtacatccagcccattatctggcacataggaggggaccaacctt

SEQ ID NO: 6894572 - DNA, 67 bp, Homo sapiens
tacatcacaggcattttgagtgtccaccttgaccttttttcaggggcaactcaaatgctgtgctgta

SEQ ID NO: 6894573 - DNA, 83 bp, Homo sapiens
gtgtgcatcgtggtcaaatgctcagactcctgtggtggctgctcatgcaccacggatgtttgagcatgtgctacggtgtctac

SEQ ID NO: 6894574 - DNA, 64 bp, Homo sapiens
cctactccaaaatactcacactggactgaatgaagtctacagtgtcaatgtgtcttgagagagg

SEQ ID NO: 6894575 - DNA, 67 bp, Homo sapiens
ccttcaatcataagtataactggtacaggttaagcatgccttacctgaaatgcttaggaccagaagg

SEQ ID NO: 6894576 - DNA, 127 bp, Homo sapiens
tggtatgttgttaacagtcaggtagtggttaagttctgtgccgtgatctgcatcaaccctaacctcaagtagcgagaacggcaatgaaaataatgtatttccttctacagtacttaattgtgtgcca

SEQ ID NO: 6894577 - DNA, 129 bp, Homo sapiens
cccccagccgattgcggtcaggagcactttatcttacagactgaatgttggttttaggatgagagggcttatcagaagctcggaatgtttatgtgtgtggagaagtttatggcagggttggaaggaggg

SEQ ID NO: 6894578 - DNA, 68 bp, Homo sapiens
cgcccgggcagccccgcactggagctggaacgagtcctggcagccggctccgcgggagctcccgggcg

SEQ ID NO: 6894579 - DNA, 84 bp, Homo sapiens
tgaggacccctgcactagagaagggcacagtctcataaagcagatcctgagactaaagactcattctgctgctgggtcactgca

SEQ ID NO: 6894580 - DNA, 94 bp, Homo sapiens
gtaatcctagcactttgagaggctgaggctggtggatcatttgagcccaggaggtcaagaccagcctggcaacatgtcgaagtgctgtctttac

SEQ ID NO: 6894581 - DNA, 72 bp, Homo sapiens
agattgagaaatcggatggttgccgtgtctgtgtggaaagtagtagacatgggagacttttcattttgttct

SEQ ID NO: 6894582 - DNA, 95 bp, Homo sapiens
tcctgaccctgaggcagtgtgagataataaatgtttgctattttaagctatgagataataaatgtttgctattttaaagctcctaatttgtggga

SEQ ID NO: 6894583 - DNA, 60 bp, Homo sapiens
gagatttggggggaggtaggggcagaatatggtttggctctgcgtcttcacccaaatctc

SEQ ID NO: 6894584 - DNA, 76 bp, Homo sapiens
ttgagacctctgccagactgtgagctccttgagggcagaatccttggcctttgcatccacagcacagagatttcaa

SEQ ID NO: 6894585 - DNA, 73 bp, Homo sapiens
tctagacgactggactaaggagtgatttatgggccttacattatgattatctctcaaagaccaaaagtgtaga

SEQ ID NO: 6894586 - DNA, 78 bp, Homo sapiens
gccagaagttgtaggtttgcatatttactccactacttcctggtgaggtggcatgagtaaactgtttagtttctaggc

SEQ ID NO: 6894587 - DNA, 58 bp, Homo sapiens
agcaagactgtgaatagtttgcatttacaattcctgtgtacacaacctacagtctgct

SEQ ID NO: 6894588 - DNA, 64 bp, Homo sapiens
tctgccatgtaacatcactaccatgtggttgctcagcctattttgaattacatggtgtgacaga

SEQ ID NO: 6894589 - DNA, 76 bp, Homo sapiens
ttaagagaagcacagtgaagcataaggagattgactttgaaatcggacagtcttgcattcacagtctggctcttga

SEQ ID NO: 6894590 - DNA, 84 bp, Homo sapiens
ggagctcctctctgagctgggctctcttgagggctaagggagccagttctctcggccctagagcccagaatggaaaagagcttc

SEQ ID NO: 6894591 - DNA, 66 bp, Homo sapiens
gctctcccttcctgagaccctcacagtgatgctcactgtctgtgaagtcataggaggggaccccgc

SEQ ID NO: 6894592 - DNA, 89 bp, Homo sapiens
gccagcccactgtcctgcatgggctcagaggagctggaacggtgtcagctggtgccagctccctgggggcagggcaggccgggccaggc

SEQ ID NO: 6894593 - DNA, 112 bp, Homo sapiens
caaattgtcaagaaggagaggacaactaaactggcaacagaacttggataccacctgttactcactgctatagtttggatgtttgtccctgtaaacctcaagttgatatttg

SEQ ID NO: 6894594 - DNA, 111 bp, Homo sapiens
gtcctgggatggatgaattcacagtggctgacaggctggccgttctacagctgcaaatgtcactgtgagctagatctgatcagctgagactttgctgtgaccgggtaggat

SEQ ID NO: 6894595 - DNA, 103 bp, Homo sapiens
ggccccctcctccttcccttgcttccactttcagttgggtagatctttctgtgatcttagaaaacacgtgtttagctgatggacagtaggaagagtgtgggcc

SEQ ID NO: 6894596 - DNA, 130 bp, Homo sapiens
tttgatatcagctggcagcagtggtagagtggaagaaagcatttgtgaatttgggagtaagaaaacttgtcttctgacaaccgttattcataattgaatttctatcttgcattgtggccatttgtgagaa

SEQ ID NO: 6894597 - DNA, 84 bp, Homo sapiens
gactttacatggaactgaaatctgaatttagagatggttcacatcgtttccactctgaaacactttttagtaaagattgaagtc

SEQ ID NO: 6894598 - DNA, 89 bp, Homo sapiens
acttttaaaccacccaggcatgctgtaggcattcagtaaataaattattttcccagtttttgaagattcagtagcctggaattagaagt

SEQ ID NO: 6894599 - DNA, 92 bp, Homo sapiens
gtgaggtagggaaggctggtattatgatccatggtttatagattagggaattaaatctcagatatgaattagctttcccaaaatatcctcac

SEQ ID NO: 6894600 - DNA, 97 bp, Homo sapiens
acagtactgtgttaactgaaccaagtacagatgggaatagagtggatctttcatttgcatggttctgagcatggttcaaatatgcacaagtttctgt

SEQ ID NO: 6894601 - DNA, 129 bp, Homo sapiens
ccggtgagggccaaggggagctggaagggtctctcttgttagcccaggaagcccagggaccagtgggtccccccgaaagcccctgtgcttgcagcagtgtccaccccagtgtctaacagtcctcccggg

SEQ ID NO: 6894602 - DNA, 121 bp, Homo sapiens
acttcagcttcctctggccccggtcttcacagctgctggctgtggctgcaaggttaagatgacgttagctttctaaggctagagagactgtgcctaggacgcgccatgggaatgtaatggt

SEQ ID NO: 6894603 - DNA, 55 bp, Homo sapiens
cgctgagaggtgacagcgtgctggccctcctcacagccctcgctcgctctcggcg

SEQ ID NO: 6894604 - DNA, 111 bp, Homo sapiens
agtacttcttggctcagtactccttggcacagtactccttggctcagtactccttggcacagtactccttggtgcagtactgtttggcacagtactttttggctcagtact

SEQ ID NO: 6894605 - DNA, 76 bp, Homo sapiens
gtaatactttaagactgtctgggacaagatgagatggtggttattgctgttgtataatagttttgaggtttgatac

SEQ ID NO: 6894606 - DNA, 81 bp, Homo sapiens
atactatcaatatgacagcactgttgaaggtggccttgaccacctggctgaggtagtgcttgtcatgtttttctatggtat

SEQ ID NO: 6894607 - DNA, 68 bp, Homo sapiens
gaaacttcaaaagtttcagcatttgaaaattattattttgtcagtgcacagagatttttgtttgtttt

SEQ ID NO: 6894608 - DNA, 74 bp, Homo sapiens
ggctgtaacacacagaaggaagccccacttaatcaaaagtaactgggccaactcctcctgcccaaccccatgcc

SEQ ID NO: 6894609 - DNA, 101 bp, Homo sapiens
ctaaaccagtgcagatttgctggcccactgagcctcccagatgagaacctgcatttcaacaaggtcctcagtgcagcaaagtttgagatatactgggctag

SEQ ID NO: 6894610 - DNA, 86 bp, Homo sapiens
caaaccatgtgaggtatacgttggttcagtctggaaaggtgagcctgcctctctggaccaaaccagtgtatacctcacatgtattg

SEQ ID NO: 6894611 - DNA, 69 bp, Homo sapiens
ttggccagtggactaagttctgacatgttgcatgacaccttcccagaacttggtttcaaacacggttga

SEQ ID NO: 6894612 - DNA, 92 bp, Homo sapiens
tggccttcatgtgagcaatgttatcaggttgatcccaaaacaatggaatgcccaccatagggatcccatgatagattgcctcatagatgcca

SEQ ID NO: 6894613 - DNA, 113 bp, Homo sapiens
attgagttaagaaggccaggactttaaatcctcctccccaggatgatcagtccattggatgcgagttatccctggaaggaggcatgactttggctgaagaagttttcctcagt

SEQ ID NO: 6894614 - DNA, 104 bp, Homo sapiens
tacacatacacactgtgataatgaagcatatcagggattatatccttcaaaatgtgtaggatctctagttttatggatgcatcatattccaaggtgtatatgta

SEQ ID NO: 6894615 - DNA, 86 bp, Homo sapiens
agttgaaaggccagactttggccaaatccccaaagaccaagagtcagcctttcttcctgggtttctggcagagatctggagcaact

SEQ ID NO: 6894616 - DNA, 55 bp, Homo sapiens
agttttgaagtcaggaagtgtgaggcttccagctttgttcttctttcttaagact

SEQ ID NO: 6894617 - DNA, 66 bp, Homo sapiens
gctgagcgccagtggcagctggaacaggcatcccaagggggttggcagcagcaatcactggtgagc

SEQ ID NO: 6894618 - DNA, 66 bp, Homo sapiens
acatgacatatgattctgaagacaaaggttaaggataacatgtgtttagttatcatatttcattgt

SEQ ID NO: 6894619 - DNA, 79 bp, Homo sapiens
tgcctaatgcctctcctgctgggagccctttttagaatttaagtcttaaaggatggaagcccagaaggaagcagaagca

SEQ ID NO: 6894620 - DNA, 86 bp, Homo sapiens
tgtccttcagcatttagagcacagtttcagggtgtagtagtgcattcctgcttttctgagatcactgcgcactatagagcaggata

SEQ ID NO: 6894621 - DNA, 109 bp, Homo sapiens
catatgtgaaaatttggatagccagactgcttttaggactttatatactaagtaataagagagaagcctgaaagcgtaggttggaaactagagagtttgtattcatgtg

SEQ ID NO: 6894622 - DNA, 60 bp, Homo sapiens
ccagggaatagtaacttttgttacttacatactatgtataaaacagaaagcactacctgg

SEQ ID NO: 6894623 - DNA, 83 bp, Homo sapiens
gggatggtgacagtagtgttagaactgattctttccattgagtcatagaagaactccgttaaaatctactgtcctgcctaccc

SEQ ID NO: 6894624 - DNA, 68 bp, Homo sapiens
ttgggggtaacaggtggtagtttgtgctcaaattctagctgtagcatctactagttgtatggcctgaa

SEQ ID NO: 6894625 - DNA, 84 bp, Homo sapiens
aataattatgttttgggaagtgcttccattgtctactgctgtgtgacaaactccaggacttagtgacctaaaacaacagttatt

SEQ ID NO: 6894626 - DNA, 74 bp, Homo sapiens
cttgctgttcagttcagaggagtaattcacctgtctgattgtgctttctcctgagctatagaattgtcagcaag

SEQ ID NO: 6894627 - DNA, 60 bp, Homo sapiens
gatccctcatggcttggtcctatctttgaggcagtgaatgagttcacatgaggtctggtc

SEQ ID NO: 6894628 - DNA, 71 bp, Homo sapiens
ctaatacagtctctgataactgtcagttctaggtatctagagatgatgaaaagagagacttaggtatctag

SEQ ID NO: 6894629 - DNA, 72 bp, Homo sapiens
ggcagaaagatggaatgtaaagggtatgggatttggatacagacagacctggatttgcgttttaactcttcc

SEQ ID NO: 6894630 - DNA, 77 bp, Homo sapiens
gagcaattcaattcacctagtagaacccagcagctcccagcctgtgtggggattatgaggtagaagttgggctgctt

SEQ ID NO: 6894631 - DNA, 78 bp, Homo sapiens
gtgtctgtcagttcacagtggcttaggctatggttgttagtgaaagttgtggtgaggctttgctggagatgaggacac

SEQ ID NO: 6894632 - DNA, 92 bp, Homo sapiens
tctctctctctctctctcttttctgaacagaaagtctggttaccctgaggtagctgtttagaaagacagcgtggagggaacagacagagaga

SEQ ID NO: 6894633 - DNA, 111 bp, Homo sapiens
ttatgaataatatcacagggtgtacatcacctatgacattaaaaataacacccccctaggatattatgaataatatcatggagtgtacacaccctgtgtcattaggagtaa

SEQ ID NO: 6894634 - DNA, 76 bp, Homo sapiens
tagtcattcaggtgtaggttgttcagtttccatgtagttctgtggttttgagtgagtgtcttactcctgagttcta

SEQ ID NO: 6894635 - DNA, 74 bp, Homo sapiens
gatttctttgggtagggagctggaatcctaaaggcatgccagactttccagaacactctcttaccctagatatc

SEQ ID NO: 6894636 - DNA, 59 bp, Homo sapiens
tccagttcacaggttatgcagtacacagtggcacttgctgaggtagccagtgagatgga

SEQ ID NO: 6894637 - DNA, 62 bp, Homo sapiens
tattgtcatgtctgtaaatacaccatcgaaccataaaaattggcactacagacaagacaatg

SEQ ID NO: 6894638 - DNA, 113 bp, Homo sapiens
cctgagctatgaactgcagcctagaggcactgtggcatcttacagcttggggtcaggttttggctgcactgggggatccaatttgctcttgggttaccaggaaagtactcagg

SEQ ID NO: 6894639 - DNA, 79 bp, Homo sapiens
agaatctattgaacactcacaatcttgccttataaacagattgtaaacatgctgaggctggagatgatcatgtgattct

SEQ ID NO: 6894640 - DNA, 84 bp, Homo sapiens
ttggtttccttgactctgtttggtaaaggctgtcctaattgtatgcaagagatggcagacacaggcaggcagaggagagatcga

SEQ ID NO: 6894641 - DNA, 129 bp, Homo sapiens
attggaatcattggagagctgtaaaatactgatgcctgggcctcccacccctgagaaatcctgatttatctggtcaggtgcggggcccaggcaccggcatttctccaaagctcccctggtgattctaat

SEQ ID NO: 6894642 - DNA, 55 bp, Homo sapiens
gcttccccgtgggctgtggctcatttacagtcctgtaaacagccccatggagagc

SEQ ID NO: 6894643 - DNA, 72 bp, Homo sapiens
gtccactgaggctttctaaggaataacttgagactcctctttctggggtctagacttggaggtcttgaggac

SEQ ID NO: 6894644 - DNA, 87 bp, Homo sapiens
tctatgagtatgtgtaattttgtgcattagagaattttctatttgtctgccaatgggctcttttgccaagatgtaggcaggcataga

SEQ ID NO: 6894645 - DNA, 129 bp, Homo sapiens
ataaacagaaaagtcaaacatcaggtgaagtaggagagttcgtggcatgagggaagtttgtggcgtattttgtatacttcctaccactatttttctgtcttttcaaatttgttgaacttcattgatagt

SEQ ID NO: 6894646 - DNA, 75 bp, Homo sapiens
tgttagattggtgcaaatgtaattgccattgaaagtaatggcaaaaactgcaattacatttgcactaacctaata

SEQ ID NO: 6894647 - DNA, 71 bp, Homo sapiens
ggggctgagagctggaatctgagggatggggatgtcttgggatccagcctctgattccattctaggcaccc

SEQ ID NO: 6894648 - DNA, 124 bp, Homo sapiens
ccaagtttttgtcttcttcttgtcttgaactctttaactgaaatacaggcatagacaatccgtgtccgccctttaaagatgcctgttatctgcagaccttcagggcagagaagctggaagttgg

SEQ ID NO: 6894649 - DNA, 97 bp, Homo sapiens
tgggaactggagtaaaggtcacttgtgctatgctttagcaactgccaccactctctttgcaaaagcgtagcacaagtgacctttaccgtagttccca

SEQ ID NO: 6894650 - DNA, 67 bp, Homo sapiens
tggcagtggctttgctggtggagaagagggcctttctctccgctcattccagaaaggccactcaccg

SEQ ID NO: 6894651 - DNA, 85 bp, Homo sapiens
tgaaggtggaagggtggttctgctgtgttctcttccttggaatttctgggaaaaccacgagcgggactagaacccaaaatcttca

SEQ ID NO: 6894652 - DNA, 88 bp, Homo sapiens
gttcgggcccatctcccctccctggaccagtgctgcagagggctgcatcctgtccatctggctcctgggaggggtggaaccactgaac

SEQ ID NO: 6894653 - DNA, 69 bp, Homo sapiens
ggatacataaagtagcagagcatgactccatgtgggttggttccactttgtgttttggcttttgtattc

SEQ ID NO: 6894654 - DNA, 91 bp, Homo sapiens
acttagtgaacttagtgcacttagtgctctaagtttaccaagtttaccatttattgtacttagtgtacttagtgctctaagtttaccaagt

SEQ ID NO: 6894655 - DNA, 112 bp, Homo sapiens
gaggattaatttttactttttctttgagatctattgtacagtgtggtgaatatagtaaataacagtgtattgtacatttcaaagtagctgagagtaaattttgaatattctc

SEQ ID NO: 6894656 - DNA, 98 bp, Homo sapiens
caggaaaagaaaaatcagtttcaaggacagctgccaagacagagcaggtagaatcttgatgttttttgttgttgttattggtggtttttttgtttttg

SEQ ID NO: 6894657 - DNA, 85 bp, Homo sapiens
tgttgtgactgactgaggcagggagagtggatatgtagtcaatattttctctttcctttccttttacttccaaagtcttcacaca

SEQ ID NO: 6894658 - DNA, 62 bp, Homo sapiens
gtggctgtggtggcacagcgggctgggggaagcccctctggcactgccggccccgcagctgc

SEQ ID NO: 6894659 - DNA, 82 bp, Homo sapiens
catgtctaacaggtctaaatccctccatctcagagagggttgccctgtggaatgcattagggactttagcttgattcacatg

SEQ ID NO: 6894660 - DNA, 113 bp, Homo sapiens
agacctgggcaagtcatttagcctcttggtaactgtttcctgagctgtaaaatgaggatgccatgccgcaaggttgttgtatgacttaaatgaggaagtaattgtaaaggtct

SEQ ID NO: 6894661 - DNA, 82 bp, Homo sapiens
gtgacacgctgcagaggagctggaaggctggacagcctcggggaggctcagctaattccagggctacaccttggggtgttat

SEQ ID NO: 6894662 - DNA, 67 bp, Homo sapiens
ggcagtgttaagaaatattatttttgtcatgttctaatgcagtagataggcacttttatgcactgcc

SEQ ID NO: 6894663 - DNA, 83 bp, Homo sapiens
tggtaaccatcaaaagtaacagcatctccactggaaattggtacacagtccacatggagttgctgttacacttgataacacca

SEQ ID NO: 6894664 - DNA, 93 bp, Homo sapiens
ttgagagctagaaggaagcatttctagaaggagagaaacaaggtgtaggttgaccaaacatttgcctgggtgtgttatcttccttgttctcaa

SEQ ID NO: 6894665 - DNA, 120 bp, Homo sapiens
ctcagtgccctgtttcagccctttgcgaaccattgttacctgtcttgcctctctaactggtccattgaggacaggaataatgtcttttgctaatggcagtcagagacaggcagatctggg

SEQ ID NO: 6894666 - DNA, 92 bp, Homo sapiens
acatagaaatagaaaattaatgcaaggtggattttagaaaatactgaatatcaagtgtgaaattgtatttggcattgaatttatgtatatgt

SEQ ID NO: 6894667 - DNA, 61 bp, Homo sapiens
tacaggtctgctgattcatggttcaaacatcaccaaaccacctgtggatcagattcttgta

SEQ ID NO: 6894668 - DNA, 65 bp, Homo sapiens
gttcttcagcccatatcttccagtggccccactgcccttcccactggcctgcctgggctgagagc

SEQ ID NO: 6894669 - DNA, 112 bp, Homo sapiens
ctgcctctttgtcaggaaggtcttcaggcttttcctgcctcctactaccctcacatattgtagtgccaataaaggtcagggaaactaccttgggccctgttgcagaaggcag

SEQ ID NO: 6894670 - DNA, 91 bp, Homo sapiens
ttgccctgttagagtgtaagctccttgagggtgggattgtgccacattcaccttttcccacctatactaagcactacttgttacactgcag

SEQ ID NO: 6894671 - DNA, 78 bp, Homo sapiens
agggtctacaggctggggaccctgcgggctggatgaggaccccctcactggtctttggcttctcaggctggggaccct

SEQ ID NO: 6894672 - DNA, 55 bp, Homo sapiens
ctggccaggcttcatcctggaaccatctttgtggctgggagctggaactgggcag

SEQ ID NO: 6894673 - DNA, 64 bp, Homo sapiens
catcagaatctgagtctctgccctaaaattgctcagtctcgtgggagagatagcatattctgtg

SEQ ID NO: 6894674 - DNA, 85 bp, Homo sapiens
ttcctcctctcagtagcatcaccattcaagtggctgttacactttttattctccacctgcttttggtgattttactgaaggtgaa

SEQ ID NO: 6894675 - DNA, 63 bp, Homo sapiens
tgaccttttcatagctggatattttatttgatgttggaatgtaatcagaatatgaaaatgtca

SEQ ID NO: 6894676 - DNA, 94 bp, Homo sapiens
ccctgggccaggctgtttctgtctgtgtggacacggctgccctgcacttggttggcctccaagacagacgaaaagctagcaagcagcctcaggg

SEQ ID NO: 6894677 - DNA, 128 bp, Homo sapiens
ctttcatcttcttaaaggctcttctctgaacttcctctgtaggactgggggtggaggtagctgagaaccatcacctttgagtcatcaggctgtagatctagacatgtaggcccaggaagagtagaaag

SEQ ID NO: 6894678 - DNA, 92 bp, Homo sapiens
gtcagctgtgcaattactttgttttggcaggacactttggagtcaagaaaacattggctggagttcaaggccaagattttggatcagctgcc

SEQ ID NO: 6894679 - DNA, 74 bp, Homo sapiens
cctgggccatcagatttggccctgtcctgcagggtttcgctcattctgtggaagctgccagtctgaagcctggg

SEQ ID NO: 6894680 - DNA, 113 bp, Homo sapiens
gtgaattcaaagctgcagactcctgggaggaaattctgctgtttgcttatgcccaaggtgccatttcagagcaaaagtgtagctttctttccatccatcagtgaacttttcac

SEQ ID NO: 6894681 - DNA, 73 bp, Homo sapiens
caggtattcaatgggcatttgttgaaccaactaatgagaaagtatttattcaacaagtatttattgagcactg

SEQ ID NO: 6894682 - DNA, 81 bp, Homo sapiens
tggatacatgagatggttgaccagagagcacacgctttatttgtgccgtttgtgacctggtccactaaccctcagtatcta

SEQ ID NO: 6894683 - DNA, 71 bp, Homo sapiens
gacctgatggacttactgcagtggcaggaacttatctttataagcttcatgtttccagtaaaatttaggtc

SEQ ID NO: 6894684 - DNA, 59 bp, Homo sapiens
tgtgtctactgatctgattcagacaaagcctggatgtctattagaaaagattagataca

SEQ ID NO: 6894685 - DNA, 97 bp, Homo sapiens
ttcttggttgctcccaaaagaaacatattgtgatcctcttcattttctgatcttgattcagtgtgttactttctcctatggagcgttgtttcaagag

SEQ ID NO: 6894686 - DNA, 63 bp, Homo sapiens
gtcctctgagacatcaggttgagcagtattgtggctgtcatcatgaaccttgtcatcagggac

SEQ ID NO: 6894687 - DNA, 103 bp, Homo sapiens
cctcttgccatgttgtcatggaggcctcccctaaatgtgtatgccacaaaagaagcagtgtcagcagcaagggggaggatcccagagaaaatagaagaagggg

SEQ ID NO: 6894688 - DNA, 101 bp, Homo sapiens
tactgaaacaattcaacaggcaatggatgccctgaatttgatagaaactcatgaaaggcaaactcagagtcaactgttgcctgttaattctccaaacagta

SEQ ID NO: 6894689 - DNA, 130 bp, Homo sapiens
ctgtgcagggcgcctgggcgagggcaggggccacacccgctgtccctgctgagctcggtcctgagttagaaccgtcaggctctcagcaggcacggacaggctgcatgtcctcggaggcatggccctgcgg

SEQ ID NO: 6894690 - DNA, 82 bp, Homo sapiens
agctgagaaaatttcaggaagtgtcagggtcaaggggtccttgggagggacttcacctttaccttcacctttctactcagct

SEQ ID NO: 6894691 - DNA, 87 bp, Homo sapiens
ccagactggggctccttgagggcaggggccaagctcccatccaaggggaggcaagaacctgccactcgggcagggcttcagaactgg

SEQ ID NO: 6894692 - DNA, 64 bp, Homo sapiens
caactctgcctatagaagctgttcccagagaaaatctgggactgcagtgaaggcacatgggttg

SEQ ID NO: 6894693 - DNA, 130 bp, Homo sapiens
atatgccatagcttcatatgccattagtaaatagcttcgtatgccatacagtctctgttgaaattactcagatatgtcattgtagcatgaagacagctatagacgatgtatagagaatgagcatggttgt

SEQ ID NO: 6894694 - DNA, 93 bp, Homo sapiens
gtaagggaaggaaggtggacgggaggattgtgagggttataagggttgtaataatcgctaattcacaattcaaactgttcagaactcctttac

SEQ ID NO: 6894695 - DNA, 130 bp, Homo sapiens
ctgagatcttactaccagccccttaaagtcattctgactctgttttagggatttgtcctgggcccctggttgataaagtccctgagactctggagtgtaatcagacttgattttttccccatcctctcag

SEQ ID NO: 6894696 - DNA, 84 bp, Homo sapiens
aactggtcggtgatttaggtagtttcctgttgttgggatccacctttctctcgacagcacgacactgccttcattacttcagtt

SEQ ID NO: 6894697 - DNA, 77 bp, Homo sapiens
ttctcttccctctcatctgctggattgaatgttgatgtgatggagtcttggatccagaggtgaagatgggaggagag

SEQ ID NO: 6894698 - DNA, 94 bp, Homo sapiens
tcacatgcacatacttcctgtgtgggcatggagaccacacgcccatgtgcccgtgactccatgtgcatacctgtgagtgagtatgtgcttgcga

SEQ ID NO: 6894699 - DNA, 92 bp, Homo sapiens
actttccaggtgtcacacagtgagtggcataatcagagtacaatttgagtcatgcccatacatcacattgccagtgattacccaaggaaagt

SEQ ID NO: 6894700 - DNA, 96 bp, Homo sapiens
ggtacatttctttgtgtgtatgcagtctttttcttctagctaatttctgtctggtggagaagaaacatttgtatgtcagtagtggagtcatgtgcc

SEQ ID NO: 6894701 - DNA, 80 bp, Homo sapiens
tttgtcaacaaaggcccacagctgtgagggtcacttgtagaaaacaatggagatttgagaacagttgagggctagacaga

SEQ ID NO: 6894702 - DNA, 97 bp, Homo sapiens
aaacccagagttttcaattcagtagctctggaataggaactgataattagcgtttgtaacaaagtttctaggtgctgctgatcaagatgatgtattt

SEQ ID NO: 6894703 - DNA, 65 bp, Homo sapiens
atgaaatgctgtagagactgtatttgacacacaaagtctgaaatatttactctttggctcttcat

SEQ ID NO: 6894704 - DNA, 72 bp, Homo sapiens
agctattttcaggactctcagaggctgaactctgcacaaaaggggtagcagcacagaaagcctggagatact

SEQ ID NO: 6894705 - DNA, 65 bp, Homo sapiens
cgtggcagtagagctggaacttgaatctggaattatctggctagtgatctagctcttcttccatg

SEQ ID NO: 6894706 - DNA, 61 bp, Homo sapiens
tgaggtaggtgtcgagagaggttgggtctgccaggttcaaattttcttggcacttaaatta

SEQ ID NO: 6894707 - DNA, 86 bp, Homo sapiens
cgtgtcttcctcatgagacttagagctccttgagggtggggaaaatatctgatctatttctctaatgtctaatatgaggcagaccg

SEQ ID NO: 6894708 - DNA, 72 bp, Homo sapiens
accctctgtatttaaaaatgagtcttctgtgatttaatcttatagggaagactagtgttttaagttacgggt

SEQ ID NO: 6894709 - DNA, 105 bp, Homo sapiens
gggaaatttgcaaaggtgtaaggaaattgagtccgctcaggccaggcataggcctgtgtgaggcttgggcatggctcctgtcttactcccttgctaatgctgccc

SEQ ID NO: 6894710 - DNA, 71 bp, Homo sapiens
tcccacacagccaggcccagcacgcagggagaggcgccctccctggaccagctctccttgtctgtgtggga

SEQ ID NO: 6894711 - DNA, 100 bp, Homo sapiens
taccctggcattatgtagcagggagcactaatctcattttcagttgagaaaactggagctgaaatgggtgcacttccttacctgcctaagctattaggta

SEQ ID NO: 6894712 - DNA, 98 bp, Homo sapiens
tgcaaagcaccctcagagatgctggtcaacaacattgactggatttaagagaatctagtcaatgttttgttgactagattttggcgagactgccagca

SEQ ID NO: 6894713 - DNA, 130 bp, Homo sapiens
actgaataatttcatacttaagtgttgggttaagtcactatgtaatatctatacagtcaaatcaataattggaatgtatagatgttatgtaatgacttaacccaacacttaaataatgaaatatttctgt

SEQ ID NO: 6894714 - DNA, 129 bp, Homo sapiens
ccgttaattatatcacagttaattgttggaatgtatgggaggcagcagggcacctaattttgttttgttttgttttaagacagggtcttgctctgttgcccaggctagagtacagtggtgtgatcatgg

SEQ ID NO: 6894715 - DNA, 77 bp, Homo sapiens
tctgcaggtctgctggagtgtgctagaggtctactccagaccctgtttgcctgggtatcaccagcagaagctgcaga

SEQ ID NO: 6894716 - DNA, 83 bp, Homo sapiens
ccatgagttaattgctcgagaaataacctccagatttaataaaagaaaagaggaggttcttcatgagctagttaaaatcatgg

SEQ ID NO: 6894717 - DNA, 87 bp, Homo sapiens
cagagagaagagtttgcggggactcagcctttgtcagccccagctgacagtgaggctggcaaggctggtatttgaaatattcctctg

SEQ ID NO: 6894718 - DNA, 86 bp, Homo sapiens
gcaggaggctgtggccaggtccctgggggcagtgtcctgggggcagcgaccacttcccaagggactcaggaggctcagactcctgc

SEQ ID NO: 6894719 - DNA, 130 bp, Homo sapiens
aagacacagaaagaaccctgcccttcagaagctaatagtgggacgtttcttgttactgtgactctaagaagggttatagcaccatttaaacatctctggcttccaagaggcttctaataaacagtgttat

SEQ ID NO: 6894720 - DNA, 115 bp, Homo sapiens
gctataaaactaaaaatatagaacttgaaaaaatggaagacatactgttttcttagatgagaaagaaacacaaaccagtattccaagttgtcagttcttattaatcgatggtggc

SEQ ID NO: 6894721 - DNA, 62 bp, Homo sapiens
tgttcagttgaccgtggctctggggtattggttggaaccagaggagctgtgttagctggtcg

SEQ ID NO: 6894722 - DNA, 74 bp, Homo sapiens
tctactaggtatatcttatatgtgcaggtactaatgacaacacagggcccaacacatagtaggcatttggtgga

SEQ ID NO: 6894723 - DNA, 128 bp, Homo sapiens
tcttttagcactgttaaggtttattattaacgctgcacttattaaggagacagttggtccataaatatttcaccttactaagctgtgtacaagtcgttggttttaaactcagatagggtttaacaaga

SEQ ID NO: 6894724 - DNA, 77 bp, Homo sapiens
ggaatgagtgggatttcaggtgtcaaggataggctgaggaaggaattccacatccttttatgatacccactcaatct

SEQ ID NO: 6894725 - DNA, 101 bp, Homo sapiens
cttcacagggacttctcacctcactgtctatagcaggctggagcacggatgtatgcatgcccctgctatagaggcatggatgtagcagtgaccccctgagg

SEQ ID NO: 6894726 - DNA, 62 bp, Homo sapiens
aatcatagcttccattgactgagctttcccgtgtcttggtcacagtgcctgaagctctgatt

SEQ ID NO: 6894727 - DNA, 93 bp, Homo sapiens
ggcttctggggtaatggcatcatctatggatcaagcttagatttacctgacagctgaattccagggataggatggagttgcttcactgaagct

SEQ ID NO: 6894728 - DNA, 90 bp, Homo sapiens
gctatctaaatatcacctggaattgttacaccatgcagtgaatgtttaagaaatgagagtggacgattttggttgatggttttagttagc

SEQ ID NO: 6894729 - DNA, 76 bp, Homo sapiens
gcaactgcaggtggatggcactttaatccttaggagtggatgataccaaggaaggggaaagtgtacctggagctgc

SEQ ID NO: 6894730 - DNA, 59 bp, Homo sapiens
agccactcattcattcgttcaacagtgtttattgagcagctgagctggaatgagaggct

SEQ ID NO: 6894731 - DNA, 87 bp, Homo sapiens
gctgaggaagaattgagtgggaagatactgagaggtgacagcgtgctggcaaccctcgctcactctcagtgcctcctcggcctcagc

SEQ ID NO: 6894732 - DNA, 102 bp, Homo sapiens
ccactggttttcaatttactttcagtacacttcagtatttgtggaggtcctaatctctttcgagtggaaatgtaattatagtgtagtagaaggcaatagtgg

SEQ ID NO: 6894733 - DNA, 71 bp, Homo sapiens
gcattcccacggatgctgtagctggcactgcactgggtcatacctgaagccagcacagtactgggtcttgc

SEQ ID NO: 6894734 - DNA, 89 bp, Homo sapiens
tttcctttattcattcatttgcctacacagtttttgattggctgcactgcactaggcactgctgtaggcagtgaggagatggcaggaga

SEQ ID NO: 6894735 - DNA, 97 bp, Homo sapiens
tgttattttttctatctctgaatgattaaatgtgatttcatttatgtagcaatactatgattgtggctgcattagatcacgctgatagaaagataca

SEQ ID NO: 6894736 - DNA, 71 bp, Homo sapiens
acaaattaatgacttgtccttaaaatatcaattttgtgattcatgttttggcaggtggttagatgttttgt

SEQ ID NO: 6894737 - DNA, 90 bp, Homo sapiens
cctacactgagagctcttcagggttatccacataggagtaaattcaagaattcctggctgagtgccttgggctggagacatcagtgtagg

SEQ ID NO: 6894738 - DNA, 79 bp, Homo sapiens
ggaaggggagctggaaagggtatggtacgggaaggtgatctttccctgaagcctggccctctacagctggactcctttc

SEQ ID NO: 6894739 - DNA, 56 bp, Homo sapiens
cagcctactgtgcctaccgaggctccacgtgggtctcagcaggcaccagaaggctg

SEQ ID NO: 6894740 - DNA, 76 bp, Homo sapiens
gaactagcactctttctggcagcctggagaagtgggtggtacctaccccaatggcattgtcagaataagtgacttc

SEQ ID NO: 6894741 - DNA, 66 bp, Homo sapiens
tgatgtagatgacagactcgcttcaagttaggactaacactgtggtgttctttgtcctctaaagca

SEQ ID NO: 6894742 - DNA, 71 bp, Homo sapiens
gcttttcagactgcccatgtttgccatttgctgtttgactggtaaattgtttggcaagtctgtgcctctgc

SEQ ID NO: 6894743 - DNA, 95 bp, Homo sapiens
gccttctgcaagttctcctgaccttcactggcactgggtgagattagagggagcagaaccttgattacaatgttccagaggcagagataggaggc

SEQ ID NO: 6894744 - DNA, 65 bp, Homo sapiens
cctggggagccctacgcctctcagaaagctgtaacaagcaggagggttttgtagagtcccatagg

SEQ ID NO: 6894745 - DNA, 90 bp, Homo sapiens
gaaattttatttttagatatactgcacgatatggtgaatgtacttaacaacagtgtattgtacatttccaaattgctgagagtaaatttc

SEQ ID NO: 6894746 - DNA, 66 bp, Homo sapiens
ccggcaagagaggaagtgagagggtgttgggaggtgccaggttctttcacaacctgctttagtggg

SEQ ID NO: 6894747 - DNA, 71 bp, Homo sapiens
ttgagttgacatcttggttgcaattagttacaaaagtggttccaatattatttcaacaggtgtcaacttgg

SEQ ID NO: 6894748 - DNA, 84 bp, Homo sapiens
ggaatccccgagatgcacctgctcagactcctgtctcatctcaggtgcagagatgatccgggggtgggcagtgttctcggctcc

SEQ ID NO: 6894749 - DNA, 91 bp, Homo sapiens
gcacttccactgcgagacagacgtgagtggacagagctgcccgttctcacagtgcaggtctgtctccagcacacacaaagtggaggattgc

SEQ ID NO: 6894750 - DNA, 95 bp, Homo sapiens
tgaataatccacagtcattcatcttttttatagttagtttgctcagggtcctgaaggacattatcagaaacgtgagacatttggaacagtattca

SEQ ID NO: 6894751 - DNA, 62 bp, Homo sapiens
actccattcctgtaggtgaccactgctggcttctgggaaagagtggagctggaaagtggggt

SEQ ID NO: 6894752 - DNA, 101 bp, Homo sapiens
aggtcatagagctggaaattggcagagctgggactggaagccaggccaggcacctggctcctgagtttcagctctaagcctaggccatcctacgctgacct

SEQ ID NO: 6894753 - DNA, 76 bp, Homo sapiens
gagttaattaatcaaagacatggggaagctgaggtgtctatccttcattcctgccagtcattggttgagggcactc

SEQ ID NO: 6894754 - DNA, 66 bp, Homo sapiens
gtggcgtttattcccttagtatgtaggtgacccagggtggctttgctttggcaagggagaagtcac

SEQ ID NO: 6894755 - DNA, 66 bp, Homo sapiens
tatttgcttagcattgtatttccagcatttagacaatgctggaatgtattaagtattgagtaaatg

SEQ ID NO: 6894756 - DNA, 66 bp, Homo sapiens
atgagatttaggaggggccagggaagaatgatatggtctggctccgtgtccgctcccaaatctcat

SEQ ID NO: 6894757 - DNA, 124 bp, Homo sapiens
gttatatttaaaataatctctagtgcttttctaatcaagttgagagtctttttgcaattttataaaagtgatttggcaatttgacaaagtaggtcatcaaagctctgtttccaaaatatgtagc

SEQ ID NO: 6894758 - DNA, 86 bp, Homo sapiens
agagcatggctttctccttgctgtctttttcccttcctaacatcactataatgtctgtgaggtgagcaggcatgcagaagccctct

SEQ ID NO: 6894759 - DNA, 60 bp, Homo sapiens
tgacttgatttaatcttcttgatgttcatgtttggacagtaagagaagatgtagatgtca

SEQ ID NO: 6894760 - DNA, 65 bp, Homo sapiens
ggatgaggcaggaagttatataatgctaattgaagaattctgcattataagttcctttttggtcc

SEQ ID NO: 6894761 - DNA, 91 bp, Homo sapiens
aagatgaggtatgaggttctatgatcatgatggaactttgaataacatttttgtgacagtcgtgattatacctatcttaaccaatagtctt

SEQ ID NO: 6894762 - DNA, 56 bp, Homo sapiens
agatattcctcagaccctcattgtgagtgcttgctgagtgtctgtggtgaatgtct

SEQ ID NO: 6894763 - DNA, 76 bp, Homo sapiens
tagaagattctaaagtggagagtagaagacgtgaaagtaagacggatgttctctacatttttgctttagagctcta

SEQ ID NO: 6894764 - DNA, 76 bp, Homo sapiens
acctgccctcatggcacttagtgtctcaaaagtaattttgccaattacatttgggatgagtgtcatgaggaagggt

SEQ ID NO: 6894765 - DNA, 64 bp, Homo sapiens
tttctgcaagatgttgtcatatgctcagacattttacttgacatatgacttatccttgaagaaa

SEQ ID NO: 6894766 - DNA, 66 bp, Homo sapiens
ctttgcattgtttcaaaagtgaattactgcagtggttcagcagaatacgttgagaaaaatgcaaag

SEQ ID NO: 6894767 - DNA, 60 bp, Homo sapiens
gttatataacaaatacctagtggagccagcctccaattctaggcaatttgttgtcatagc

SEQ ID NO: 6894768 - DNA, 74 bp, Homo sapiens
tgtgaaaagtagctcaagttgtttcactcattattttaatcagtgaaagtgcttagagtgtggtatttctcata

SEQ ID NO: 6894769 - DNA, 78 bp, Homo sapiens
gggaacacaggcagtgtgtagctggaagagaagcgagaagcgtactttgcaggtggaacacatgtgacttagtgacct

SEQ ID NO: 6894770 - DNA, 130 bp, Homo sapiens
cctgtcagatcagctgtggtattagattctcatgggagctcaaacccagtggtgaaccatgcatgcaagagacatgggttgtgtgctcctcatgagactctactaactaatgcctgatgatctgaagtgg

SEQ ID NO: 6894771 - DNA, 84 bp, Homo sapiens
tcagagtggggccctgcaggccaggcaagggcttcaaagtttgtgctgagagagcccaggagcaggggcagggttttgtgctgg

SEQ ID NO: 6894772 - DNA, 86 bp, Homo sapiens
tcacgtgctctgctccacctggtcagagacccttgacctttagaagactggacctgagggcgtggctggtggacctgagggcgtgg

SEQ ID NO: 6894773 - DNA, 76 bp, Homo sapiens
gggaggggatagggccagactgagggtccctgagcttgtgcatggtcaggaacttactcggtttggatttcctgcc

SEQ ID NO: 6894774 - DNA, 84 bp, Homo sapiens
tttaggcaaatttcagatgtgctggactttacccccacagcatagacactgtgtaaaaagtaccaggcactggagtatcttgag

SEQ ID NO: 6894775 - DNA, 64 bp, Homo sapiens
ccaagtgcatgcacacccagctgggtcatgacagcacccaggctctgggtgtgacagcacctgg

SEQ ID NO: 6894776 - DNA, 100 bp, Homo sapiens
ttagactgtgagctccttgagggactttgtcataatcactgttacatcccagtgcctcacactatgcctggcccttaagaagtgctcaataaatgtctga

SEQ ID NO: 6894777 - DNA, 81 bp, Homo sapiens
ggtcatgagggagcagtgcaggcgtgaagctgaaaccccccatttctagtctttgttctgctgctagctcactctgtgacc

SEQ ID NO: 6894778 - DNA, 73 bp, Homo sapiens
atttaaccagtacttattgagcacctactaagtgccaggcactgtttttggtgctggtgatgtatgagtgaat

SEQ ID NO: 6894779 - DNA, 85 bp, Homo sapiens
cttgttgtgcagtggcatttgagagcgcatgcttaagttgtcaaatgcagatatttaatgcaattttctcagtccattcaacaag

SEQ ID NO: 6894780 - DNA, 86 bp, Homo sapiens
aacctgctacattgaggtagtagatttttgtccattgatactttatctttgtagcctaacatctgccttcttaatgtgatcaagtt

SEQ ID NO: 6894781 - DNA, 103 bp, Homo sapiens
gtatctctgccacccacggagttctaatgactttaaaatatgctagtaatgaggaaagacatatgggatattatgtagagctgaggtaggtggtaagagatac

SEQ ID NO: 6894782 - DNA, 67 bp, Homo sapiens
gataatgaatgcacattagtaagtgcatcttaatacaggacgtttatgtatttatgcattcattatt

SEQ ID NO: 6894783 - DNA, 129 bp, Homo sapiens
ggtgagcatagttagtaacagtgtattgtacatttcaaaattgctaagagagcaaatttcaaatgttctcaccacaaaaaatagtaagtttttgaagtgataactatattaacttgatttaagttttcc

SEQ ID NO: 6894784 - DNA, 74 bp, Homo sapiens
ccgtctggaggctgggtcgggtgctgtccaggccttcctgtgacgtgtctcctggcaccacgtgccaccagagg

SEQ ID NO: 6894785 - DNA, 85 bp, Homo sapiens
ggactctgactcagccaaggcccagcccctcttagcttcctcatctgctaaaaggaagagctggaccagaggactggtttggtcc

SEQ ID NO: 6894786 - DNA, 76 bp, Homo sapiens
gctgggtccagtggttcttaacagttcaacagttctgtagcgcaattgtgaaatgtttaggaccactagacccggc

SEQ ID NO: 6894787 - DNA, 85 bp, Homo sapiens
agtgttttctccagtacagctgcagcagcctgttcaaccgtgtgacattcagcaggcggtagctgccacttccccgaaggctgct

SEQ ID NO: 6894788 - DNA, 98 bp, Homo sapiens
ggagcacagccagctttattggcctagatatgattagatgcttcctttaccccttctggaggtgttagtggttctgagccttggaagttctgttctcc

SEQ ID NO: 6894789 - DNA, 64 bp, Homo sapiens
gcattaatactggagcgttacagtaacaataagagctaacttttactgagacctcacagtgtgc

SEQ ID NO: 6894790 - DNA, 58 bp, Homo sapiens
tagcataccttgataagtgaacaatcatgccttgatatcaagtatccaggtagtgcta

SEQ ID NO: 6894791 - DNA, 69 bp, Homo sapiens
aaagttctaccaagtttagagtcatgtagggacagtttcctaagtgcatgattgaacttggcaaatttt

SEQ ID NO: 6894792 - DNA, 72 bp, Homo sapiens
agattgagaaatcggatggttgccgtgtctgtgtagaaagaagtagacatgggagacttttcattttgttct

SEQ ID NO: 6894793 - DNA, 88 bp, Homo sapiens
aaatgcctgtcagtgtgtacactttccaagaaacacaccaggatgtaccaggatagtgatgtcacacccttgatagaagctagcattt

SEQ ID NO: 6894794 - DNA, 94 bp, Homo sapiens
cctgttgaatgaaaacacaggttcattctgtgaggtgaatccaaacatcacaaagcattttcacagatagcttgtttctagtttttattgcagg

SEQ ID NO: 6894795 - DNA, 77 bp, Homo sapiens
ggagcttacgattcagaggggctaagtacttgctctgaaacacatggcagtaagtggtgatccctggattggcatcc

SEQ ID NO: 6894796 - DNA, 100 bp, Homo sapiens
aacaatagaaattactgtatttgataagtgaagtttattttagggagtatcatttttttaagaaggtgtaatttatatacagtaaaatttatcctttgtt

SEQ ID NO: 6894797 - DNA, 62 bp, Homo sapiens
ggaagctcagctgtgtgggctcatcatggaaatggtggaagctgtggcataactgagagttt

SEQ ID NO: 6894798 - DNA, 63 bp, Homo sapiens
gccccaatcatctcttcaaggtgccatctctcaacacggttgcattgagagttgcattggggt

SEQ ID NO: 6894799 - DNA, 105 bp, Homo sapiens
tccaatatcatactttatgggcaagaagctggaagcattccccttgaaaaccagcacaagacaaggacgccctctctcagcactcctattcaacacagtattgga

SEQ ID NO: 6894800 - DNA, 85 bp, Homo sapiens
tccccatctcaaagacatctggtagctgaggctggttgacccatccaatcagtgatctttcagttggtaggttttttggtgggga

SEQ ID NO: 6894801 - DNA, 67 bp, Homo sapiens
cacatatcacacataactaagctgcacataactcaatgttgtcactaggtagtgtgtcagatctgtg

SEQ ID NO: 6894802 - DNA, 106 bp, Homo sapiens
tgaactaggccagtcttctcattgcctgagttgttaacacagatgacaggcattcacggatgtaatgctaattgttttaatgaggtaggagtgggaaagtagttca

SEQ ID NO: 6894803 - DNA, 81 bp, Homo sapiens
ctatttacatagtattcacattgttttaggtattataaataacctaatgatgatttaaaatatatgggaggatgtggatag

SEQ ID NO: 6894804 - DNA, 118 bp, Homo sapiens
ctgactaccccttctctgaaatgcttgggaccagaagtgttttggattttggaatatttgcattatattccaaaacccaaaatgctccaatgagcatttcctttgagtgtcacgtcag

SEQ ID NO: 6894805 - DNA, 130 bp, Homo sapiens
caaaaaggctgaccttcccttgactgagagagaactcagcttacctgttttcatgctggaacatcattattttctttggacttcagctgaaacactggatctttctgggtctggaatgtatcagcctttg

SEQ ID NO: 6894806 - DNA, 81 bp, Homo sapiens
gaagctcagtcaagtgttgtaactaggttatgagtaaaccgtactaaggaatcctaaaacagctgtgatgaaatgagcttt

SEQ ID NO: 6894807 - DNA, 122 bp, Homo sapiens
gaggttcagtgacttgcccaaggtcatagagctggaaattggcagagctgggactggaagccaggccaggcacctggctcctgagtttcagctctaagcctaggccatcctacgctgacctc

SEQ ID NO: 6894808 - DNA, 56 bp, Homo sapiens
gagctttccacagaggctgaacatggcttcagaagccacagcctctgggaaaactc

SEQ ID NO: 6894809 - DNA, 118 bp, Homo sapiens
tgtggagtatgtaaagaaggtaggtggtgacagagctgaaaggcagtgggtagtgtgaagttgcatccctcaccaagttgctttttgcttctcttatcaggctttctcatacttctca

SEQ ID NO: 6894810 - DNA, 104 bp, Homo sapiens
cagctgctggatctaagttcttatagctccatcagagtcagagctctttctgtttccagtagaaagggacttatcctctgaatataagatagatcatttagctg

SEQ ID NO: 6894811 - DNA, 69 bp, Homo sapiens
ggctggggaagctgatgacgctcccctggcagccctggggcggcggctccaccagcttcttcaccagct

SEQ ID NO: 6894812 - DNA, 58 bp, Homo sapiens
tcaggctagactttggcgaagcacagcaccctggggctgagcctgaaggttagcttga

SEQ ID NO: 6894813 - DNA, 87 bp, Homo sapiens
tgatatgagtgatttgttggctaatataaccagaagttccagaggatgaatggattatatttggctcagtttagcagctcagtatta

SEQ ID NO: 6894814 - DNA, 59 bp, Homo sapiens
gcaagacattgtattgtgttcctaagcttaacgcatagcagcaagaatgggatgtgtgt

SEQ ID NO: 6894815 - DNA, 69 bp, Homo sapiens
tttgacttggactggtactacaccatcagctcttttggttttctagcttgccagttgaagatcttcaga

SEQ ID NO: 6894816 - DNA, 84 bp, Homo sapiens
tacataacaagaatgccagtggttggccctgcaggcttggtgtcatggcccccaaggtaccactggagactctggttctttgtg

SEQ ID NO: 6894817 - DNA, 128 bp, Homo sapiens
tgacagatggaattcagaatatagataggaatgaagacattgagatccagaagtatgttgaaacctgatatggtttggctctgtgtctccactcaaatatcatcttgaattgcaattcccatgtgtca

SEQ ID NO: 6894818 - DNA, 68 bp, Homo sapiens
tgtcctacggagtttcatgtgaacatacatagtatacacattactgcacttgagaaagctgagggata

SEQ ID NO: 6894819 - DNA, 87 bp, Homo sapiens
ggatgtcttttgttttcttttcttgcctgattgctctggctaggacttccagtgcaatgttaaataggaaaggagaaagtgggcacc

SEQ ID NO: 6894820 - DNA, 79 bp, Homo sapiens
ggttgggacagaccatgtagcaccttccacttaattcctattacttatttggaggtagcagcacatggtggttttattc

SEQ ID NO: 6894821 - DNA, 78 bp, Homo sapiens
gggagttctttatagcagtgtggaaagggactaatatagaaaattggtactaagtggggcattgttataaagacaccc

SEQ ID NO: 6894822 - DNA, 56 bp, Homo sapiens
ggtagactgagctccttgaggacagagattgactgtttttaaaatatcagtattcc

SEQ ID NO: 6894823 - DNA, 84 bp, Homo sapiens
tctgataagatcttatcccatcctacttgaaaggtgatgcacaatttacttgtgaggtaggtggtgaaaaatgactctatcaga

SEQ ID NO: 6894824 - DNA, 56 bp, Homo sapiens
tttcacagtgagctatgtcttgtgtttataaaagcaagggtggtgatattgtggaa

SEQ ID NO: 6894825 - DNA, 130 bp, Homo sapiens
gtgaagcagggattattcacttagttttcataatgcacaggcccctgtgaaccagagattattcatttagttttcatagtgcacaggtgcctgtgaaccagggattattcacttagttttcataatgcac

SEQ ID NO: 6894826 - DNA, 130 bp, Homo sapiens
gggaaggcataattgtgttttgaaatgtgagaaacaggagatttgggagggaccaggggtagaatgatatagtctggctctgtgtcctcacccaaatctcatcttgaattgtaatacaaattataatccc

SEQ ID NO: 6894827 - DNA, 98 bp, Homo sapiens
taaaccttcttttattggtcttttcccctttgtttatgtgagattacatcatctaatctgaggtaggaagagctgccatctgaagaactgcaggtttg

SEQ ID NO: 6894828 - DNA, 83 bp, Homo sapiens
ttctctggccatagctggctagaatagggatagaccttgacctaagtcaagcctatcaaattctgcctcctatgagtttagaa

SEQ ID NO: 6894829 - DNA, 127 bp, Homo sapiens
gctttccaaggaggcagttttcaggcctgaaggaggtccctgtggcaatcagcactcctctttcctgggatgtgcagtgtgaccagggctgcctcttactccctctggcatatccttctgggaaagc

SEQ ID NO: 6894830 - DNA, 119 bp, Homo sapiens
agtgtggcaccagtgaccagagcgggagattgggggggtgtcccctatggcccaggcacaggcctgttaagggggtcatctctcttgcccgctgccacaagcactgttgtaaacacact

SEQ ID NO: 6894831 - DNA, 107 bp, Homo sapiens
ggcctaggcagctgtgtgtgtgcacgtgtgtcgtggaggcctacgcagctgtgtgtgtgtgttgtggaggcctaggttgatgtgtgtgcacgtgtgttgtagaggcc

SEQ ID NO: 6894832 - DNA, 61 bp, Homo sapiens
ggctgaaggcagtgagtttgtgtttcctttggaatgagcacatgttctactggcttctgcc

SEQ ID NO: 6894833 - DNA, 69 bp, Homo sapiens
gtgcagaggtcacaaaagtgaacacttttttacctctccttcctgtgcccactgttaagacttttgcat

SEQ ID NO: 6894834 - DNA, 93 bp, Homo sapiens
accatttgacatcatggatatgttaatttgcttatctgtagtaattatttcactatgtatacgtatattgaaatatcatgagccagccatggt

SEQ ID NO: 6894835 - DNA, 63 bp, Homo sapiens
ttattcctttttctgtctgattggattagccaggacttccagtacaatgttgaaaaggagtga

SEQ ID NO: 6894836 - DNA, 83 bp, Homo sapiens
agaaaagagagacctggagccagaagagccagttcaagttccaccttggccactacttacttggcttcattcccttgttttct

SEQ ID NO: 6894837 - DNA, 60 bp, Homo sapiens
aggagctgatagtctatggagaatgagagtaaacaccttccaaaggctgtgattagtcct

SEQ ID NO: 6894838 - DNA, 92 bp, Homo sapiens
gctttcagctgggggcatagatgcaggcaaagtggcaactcacaaaatattctttgccaaagccagatctgtgcctcactctggctgtaggt

SEQ ID NO: 6894839 - DNA, 90 bp, Homo sapiens
gatcagagtgcctccttggaaatctctgggtaaagttctctcattgttagatgaggaaactgaggcccagagaagttaaggggtctgatc

SEQ ID NO: 6894840 - DNA, 92 bp, Homo sapiens
gctggcaggcaggagagtttccggctgaggacaaggaacccgttgaggcagacagcagggctctgtgcagcaggagaccggcttgtttgtgc

SEQ ID NO: 6894841 - DNA, 120 bp, Homo sapiens
gtcgaaagtgaatgtcttcaggaacggggtgagacatgttaggggtgctgctttcctaaacaacacggtagcaccacttcatgctttcagttatgtgcatactgaactttcattaaaaac

SEQ ID NO: 6894842 - DNA, 84 bp, Homo sapiens
agatatgggcctagaggtcgatatctgggcctggagtggagatatgggccaggagtggagatatgggcctagaggtcgatatct

SEQ ID NO: 6894843 - DNA, 57 bp, Homo sapiens
tagtgctctccaaatggctctatgtaccccaattgttcaagagtccaggagagtctg

SEQ ID NO: 6894844 - DNA, 88 bp, Homo sapiens
agtcatgagagtcaaataagaagatgcatgtgaagtacttagcacagggcctaaagactttatatgcatcacattggctgttattatt

SEQ ID NO: 6894845 - DNA, 79 bp, Homo sapiens
ggccctcgtgcctcacctgctgcccctgccccagcgtggggatgcatcccaggacacagacagaggctccatgaggacc

SEQ ID NO: 6894846 - DNA, 62 bp, Homo sapiens
gtggagagaaaaaagacagttcttcggtgtcataaagacattctatctttttgctctgccat

SEQ ID NO: 6894847 - DNA, 63 bp, Homo sapiens
ttggaggcctgggtgtgttgagccagttcactccagcgtgggcagcagacactccagccccag

SEQ ID NO: 6894848 - DNA, 63 bp, Homo sapiens
gagaggcagggagtagctgaattctggtgttcaggtttttaagttctgcctccccagtctctc

SEQ ID NO: 6894849 - DNA, 80 bp, Homo sapiens
ataggggagaaaaaggcaagattaggaccagaagaataatgactttttgtaaagaattcataaacctttttttctactat

SEQ ID NO: 6894850 - DNA, 80 bp, Homo sapiens
tctattgagattctccaaatgcacttctaattcatggaattagttagaggtggacagggagaatgtgatattctcataga

SEQ ID NO: 6894851 - DNA, 75 bp, Homo sapiens
agaaaggttttggtttttaagagatgagcccattttattttaactgtgcaatattataaaggccaatgtcttttt

SEQ ID NO: 6894852 - DNA, 118 bp, Homo sapiens
ggtgagcccatggccttctgctgccaccacattcagggacacatgagccgagtcctgtacagttcatgcctagtgctgagttgaggtgagtcagtttctgatgcagttgggctccacc

SEQ ID NO: 6894853 - DNA, 60 bp, Homo sapiens
ctcagactggggctccctgaggaaaaggctgtgtctcccctcagactggggccccctgag

SEQ ID NO: 6894854 - DNA, 68 bp, Homo sapiens
ctctgtttgtccaaaggccttttgagatggctggtgaaccactcttaagcaagctgttggcaataggg

SEQ ID NO: 6894855 - DNA, 66 bp, Homo sapiens
tgagacagtaattgtatagtttctaggtgttccccatctcaagattttgtatgttaccttgcctca

SEQ ID NO: 6894856 - DNA, 70 bp, Homo sapiens
tgaacaggtatttattgaacatccactaggcatcaggttgtgtggttgtgtattagatgctgggaattca

SEQ ID NO: 6894857 - DNA, 90 bp, Homo sapiens
ctgcccttgtgctgctcacatgtgtgttagcacatgtaacagacatatacatgaataaggcatgatgtgcagtggcaaatgagggggtag

SEQ ID NO: 6894858 - DNA, 68 bp, Homo sapiens
aggcacaggggtcagcaacctgcttgaggaggcagtctgtcccttagcagagctcgctcactgtgctt

SEQ ID NO: 6894859 - DNA, 90 bp, Homo sapiens
gctgaatgatgttttatgtcccttttgtgttgtcattgttctaactttagtgagaccatttgacatacagtggatggctgcatccagagc

SEQ ID NO: 6894860 - DNA, 92 bp, Homo sapiens
gggaggacacagtagaaacaggcaggcagatgcaggtgtagtgaacacttattggatactgtgtgctgagtgttgtctgaggtgctcttttc

SEQ ID NO: 6894861 - DNA, 130 bp, Homo sapiens
gtctcccaacttgagctgtatgaaggctcttggtctccctgggagttggtggagggtggaggcagcctgggcttccctgtacactaacttgagaccagtgcaataaaagtacacaccttaaaaaaaagac

SEQ ID NO: 6894862 - DNA, 82 bp, Homo sapiens
agagcagaatgtcatttcaaaaaccacatctaatattcttctgtggatgtacagttactttgaaaattgatatttctgcttt

SEQ ID NO: 6894863 - DNA, 106 bp, Homo sapiens
catcttttggctcttgtgcatcttcttttaatgaggcatctcatacggtggatcaaatgtagttcattgtcatgtttcattgcctgaagtttgtggtctggggatg

SEQ ID NO: 6894864 - DNA, 64 bp, Homo sapiens
tttgaattgtctgtgggttgcaaggctgccaattttcagaagtttgcaccatgataaattcaga

SEQ ID NO: 6894865 - DNA, 59 bp, Homo sapiens
gtgtttatcacgtttcatttgtgtgttatactatatagaacacagaaatgtgtggccac

SEQ ID NO: 6894866 - DNA, 103 bp, Homo sapiens
ggagtggggtaggtagtggcaggtcacgagcctagaggagatggtttggggccatttggggctttggtcttctagctgtgagccaacaggacccacaccctcc

SEQ ID NO: 6894867 - DNA, 97 bp, Homo sapiens
cacaggtggccattggtaaataatttctactgcagcagttaatggaaatgcagttttcattacagtaaggaaattgaaatctcagctggcctctgtg

SEQ ID NO: 6894868 - DNA, 63 bp, Homo sapiens
acttttagcctatagtttctgctaagacatttattgttgtaggtctgttatgggctgaactgt

SEQ ID NO: 6894869 - DNA, 74 bp, Homo sapiens
tgaacatacttgggctttatacttagggactttgattcagtaggtccaggatgaagcccagtgattttgtttca

SEQ ID NO: 6894870 - DNA, 58 bp, Homo sapiens
tacagcttagattccccagagccaaatccaggcctgacaagaggcagaatcagctgtg

SEQ ID NO: 6894871 - DNA, 130 bp, Homo sapiens
tttcatactgtttaagttctgtttcatggtttgttttctttcagcatacactatcatgtctggcttatgacagagttctgctttccaataaaatcaccaatagctatgtgtggttcttgagcacttgaaa

SEQ ID NO: 6894872 - DNA, 130 bp, Homo sapiens
cacagataaagcctaagtgcaattagagtttgagaattaccgtgtcaagtttctgaactagtaagtatcagaatttaaaatgtgtagattctctaagacagtaattccacttctaggaatctgtcttttg

SEQ ID NO: 6894873 - DNA, 123 bp, Homo sapiens
ggcatctattgtttcctgagtttttaatggtcatcattctaactggcatgaaatggcatctcattgtggtattgatttgcatttcgaccagtgatgatgagcttttttttcatgtttattgcc

SEQ ID NO: 6894874 - DNA, 85 bp, Homo sapiens
taccttctgtctagatgttagatcattttgaactaatttggaaatcttcatgcttaatttagaagtgattcatctacagatcgtg

SEQ ID NO: 6894875 - DNA, 124 bp, Homo sapiens
ttaatatcgttaacatgttcagactacctgtgatggttaatactgagtgtcaaattgattggatttaaggatgcaaagtattaatccttggtatgtctgtgagggtgttgccaaaggagattaa

SEQ ID NO: 6894876 - DNA, 129 bp, Homo sapiens
cccggataccagttcaccatttgtcccttcattctgcccaaaaaactgatggcttcctctgaatctgtcagtaaggcaagtgattatctaggaattgacagaagtgattatctaggaatggagtctggg

SEQ ID NO: 6894877 - DNA, 56 bp, Homo sapiens
ctgttcagtccactaagacccttgttagaggaggcggggggtctggaccagaacag

SEQ ID NO: 6894878 - DNA, 65 bp, Homo sapiens
aatgtatggaggaggctctctcagagactgaactctaggtctttgcgtcaccttcctcccccatt

SEQ ID NO: 6894879 - DNA, 119 bp, Homo sapiens
gcactatgagagaccctgaggcagagtattcacttaaaccatgcccaaattctggaccaacagaaactgaggtaataagtgtttgtttttcaaagtcttgggttattaattcattgtgc

SEQ ID NO: 6894880 - DNA, 130 bp, Homo sapiens
aaagataactgtgtttaacattttgcggaactgttttccatagcagctgcatcattttacagtcccaccagtgatgcacaatggttccagttgctatacagcctcaccaacacatgttatagatttcttt

SEQ ID NO: 6894881 - DNA, 104 bp, Homo sapiens
ctgaggacggggctgcggctgccctcagactggggctccctgaggacaggactgtgtctccctcagactggagctccctgaggacagggctgtgtctccctcag

SEQ ID NO: 6894882 - DNA, 79 bp, Homo sapiens
aggcacagatttggggaaagcaatgaatcatctgactacgacttctaattggatttggagtgttattccgtttgtgcct

SEQ ID NO: 6894883 - DNA, 22 bp, Homo sapiens
atgcttcatgatttggccatgt

SEQ ID NO: 6894884 - DNA, 22 bp, Homo sapiens
ggaagaagcagggcatttgaat

SEQ ID NO: 6894885 - DNA, 22 bp, Homo sapiens
taacacattagttctcctagat

SEQ ID NO: 6894886 - DNA, 17 bp, Homo sapiens
ctattactcccaagtaa

SEQ ID NO: 6894887 - DNA, 22 bp, Homo sapiens
gccttctgattgctggactgac

SEQ ID NO: 6894888 - DNA, 22 bp, Homo sapiens
ctttctcttcactgtcatgatc

SEQ ID NO: 6894889 - DNA, 22 bp, Homo sapiens
ccgaggagcttttccaaggtgt

SEQ ID NO: 6894890 - DNA, 19 bp, Homo sapiens
gcatcagagcagaaggggt

SEQ ID NO: 6894891 - DNA, 22 bp, Homo sapiens
agtgtattgctttcatcatttt

SEQ ID NO: 6894892 - DNA, 22 bp, Homo sapiens
atggccagcaagttcagaattt

SEQ ID NO: 6894893 - DNA, 22 bp, Homo sapiens
aggcattttaagatgctctgca

SEQ ID NO: 6894894 - DNA, 22 bp, Homo sapiens
gttccaggcagtggcaacagct

SEQ ID NO: 6894895 - DNA, 22 bp, Homo sapiens
tggaggtggagttggaaactga

SEQ ID NO: 6894896 - DNA, 21 bp, Homo sapiens
agcctggcccagggggaggct

SEQ ID NO: 6894897 - DNA, 22 bp, Homo sapiens
tagaaaccctgccttagtagct

SEQ ID NO: 6894898 - DNA, 22 bp, Homo sapiens
atcacagcacacctgacatgta

SEQ ID NO: 6894899 - DNA, 22 bp, Homo sapiens
cctcttgactctaaatcccgcg

SEQ ID NO: 6894900 - DNA, 22 bp, Homo sapiens
tgcaggtggattcaatgtggga

SEQ ID NO: 6894901 - DNA, 22 bp, Homo sapiens
taatggaggtggcaaaaggtct

SEQ ID NO: 6894902 - DNA, 22 bp, Homo sapiens
aaccttttgcaagtgccttgac

SEQ ID NO: 6894903 - DNA, 20 bp, Homo sapiens
caaatgaagctgttggcctc

SEQ ID NO: 6894904 - DNA, 22 bp, Homo sapiens
agtgtttaaactgaagtgatga

SEQ ID NO: 6894905 - DNA, 22 bp, Homo sapiens
ctggaagtataggggagatgat

SEQ ID NO: 6894906 - DNA, 22 bp, Homo sapiens
aggcagtggagaaggtttgtga

SEQ ID NO: 6894907 - DNA, 22 bp, Homo sapiens
tggcacccagtggagctgtgct

SEQ ID NO: 6894908 - DNA, 22 bp, Homo sapiens
tagaagttaaaggaatacagaa

SEQ ID NO: 6894909 - DNA, 22 bp, Homo sapiens
cctcattctttcctgggcccct

SEQ ID NO: 6894910 - DNA, 22 bp, Homo sapiens
caggcagagttagtgatttagg

SEQ ID NO: 6894911 - DNA, 22 bp, Homo sapiens
tgctgctttgatgtgtaaatca

SEQ ID NO: 6894912 - DNA, 22 bp, Homo sapiens
caccttccatctccttggctag

SEQ ID NO: 6894913 - DNA, 22 bp, Homo sapiens
ttagtgcagctgagccccatgg

SEQ ID NO: 6894914 - DNA, 22 bp, Homo sapiens
actgctcaaggatctggtaggg

SEQ ID NO: 6894915 - DNA, 18 bp, Homo sapiens
agaagcacaagatgtctt

SEQ ID NO: 6894916 - DNA, 22 bp, Homo sapiens
agcaatttctcgcaccagacgc

SEQ ID NO: 6894917 - DNA, 18 bp, Homo sapiens
aggtggcctgggagcttt

SEQ ID NO: 6894918 - DNA, 22 bp, Homo sapiens
aggccctgttatgagccactgt

SEQ ID NO: 6894919 - DNA, 22 bp, Homo sapiens
tataagtggagattagggaaca

SEQ ID NO: 6894920 - DNA, 22 bp, Homo sapiens
taccacctcaacctcatctgac

SEQ ID NO: 6894921 - DNA, 22 bp, Homo sapiens
tgcagtgtgaggtccacatctg

SEQ ID NO: 6894922 - DNA, 22 bp, Homo sapiens
aacaattgacacttcattgtga

SEQ ID NO: 6894923 - DNA, 22 bp, Homo sapiens
tttatatatggctggtctggat

SEQ ID NO: 6894924 - DNA, 22 bp, Homo sapiens
gttacagtcaggagatattttg

SEQ ID NO: 6894925 - DNA, 23 bp, Homo sapiens
tgtcgcttctcaggactataggc

SEQ ID NO: 6894926 - DNA, 22 bp, Homo sapiens
tacaggtctaactaaatgaatt

SEQ ID NO: 6894927 - DNA, 23 bp, Homo sapiens
ctgtcctgtagttcacgttggcc

SEQ ID NO: 6894928 - DNA, 22 bp, Homo sapiens
caggatatatctctagtgttgg

SEQ ID NO: 6894929 - DNA, 22 bp, Homo sapiens
cactcctgttccactaaatgag

SEQ ID NO: 6894930 - DNA, 22 bp, Homo sapiens
tccaaggggaaaggcgccggcg

SEQ ID NO: 6894931 - DNA, 22 bp, Homo sapiens
ttaaagcatgctgcttttccat

SEQ ID NO: 6894932 - DNA, 22 bp, Homo sapiens
atgagtgtacgtgaaagtagat

SEQ ID NO: 6894933 - DNA, 22 bp, Homo sapiens
tctgtgcagttcttgtcttgac

SEQ ID NO: 6894934 - DNA, 22 bp, Homo sapiens
tcagaggtaaaaactcactgta

SEQ ID NO: 6894935 - DNA, 22 bp, Homo sapiens
cctgtacacggtctatgcctcc

SEQ ID NO: 6894936 - DNA, 22 bp, Homo sapiens
ctgggcatatacgtgcaagtca

SEQ ID NO: 6894937 - DNA, 22 bp, Homo sapiens
gagagtccaggtctgggtcctt

SEQ ID NO: 6894938 - DNA, 22 bp, Homo sapiens
tgtttactcctgatatattttt

SEQ ID NO: 6894939 - DNA, 22 bp, Homo sapiens
cccacatttttgagtcttcatc

SEQ ID NO: 6894940 - DNA, 22 bp, Homo sapiens
cactttgtgtgggatcaggggt

SEQ ID NO: 6894941 - DNA, 22 bp, Homo sapiens
gtttcatataccaagcacttga

SEQ ID NO: 6894942 - DNA, 22 bp, Homo sapiens
ttagtgtctggctatatttaaa

SEQ ID NO: 6894943 - DNA, 22 bp, Homo sapiens
tgccctggctctccactagttt

SEQ ID NO: 6894944 - DNA, 22 bp, Homo sapiens
gatctctgtggactcttagcac

SEQ ID NO: 6894945 - DNA, 22 bp, Homo sapiens
ctagagaaacagtgctctgaac

SEQ ID NO: 6894946 - DNA, 22 bp, Homo sapiens
ggcagcttcggacggcttataa

SEQ ID NO: 6894947 - DNA, 22 bp, Homo sapiens
ttagtgtgttaatgagtatatc

SEQ ID NO: 6894948 - DNA, 22 bp, Homo sapiens
tagaatccagattctatgctaa

SEQ ID NO: 6894949 - DNA, 22 bp, Homo sapiens
aacttctggatgtttcaaatgt

SEQ ID NO: 6894950 - DNA, 22 bp, Homo sapiens
cagacacttattgagcaagtac

SEQ ID NO: 6894951 - DNA, 22 bp, Homo sapiens
tcagggttgtgaaggaaagggg

SEQ ID NO: 6894952 - DNA, 22 bp, Homo sapiens
ggagcactataatagagatttt

SEQ ID NO: 6894953 - DNA, 22 bp, Homo sapiens
agtaaacatagaatgttcttcc

SEQ ID NO: 6894954 - DNA, 22 bp, Homo sapiens
gccactgtactccagcctgcga

SEQ ID NO: 6894955 - DNA, 22 bp, Homo sapiens
actgtaacctcaaactcctggg

SEQ ID NO: 6894956 - DNA, 22 bp, Homo sapiens
ttcttgttttgcccaagttgta

SEQ ID NO: 6894957 - DNA, 22 bp, Homo sapiens
gcagtaaaggtgacaatatagg

SEQ ID NO: 6894958 - DNA, 22 bp, Homo sapiens
acaatagaaataattaagcaca

SEQ ID NO: 6894959 - DNA, 22 bp, Homo sapiens
taggtggttataaattcaaggc

SEQ ID NO: 6894960 - DNA, 22 bp, Homo sapiens
accttgatggggctgttggagt

SEQ ID NO: 6894961 - DNA, 22 bp, Homo sapiens
gttttagtgtaacggagtgtga

SEQ ID NO: 6894962 - DNA, 22 bp, Homo sapiens
tctgccatgcacccggacagct

SEQ ID NO: 6894963 - DNA, 22 bp, Homo sapiens
gaatcacggtattctgcacggg

SEQ ID NO: 6894964 - DNA, 22 bp, Homo sapiens
acagggctggggcacttggctg

SEQ ID NO: 6894965 - DNA, 22 bp, Homo sapiens
gtctggagcctgggtccctgct

SEQ ID NO: 6894966 - DNA, 22 bp, Homo sapiens
gatggctggctatatcagggga

SEQ ID NO: 6894967 - DNA, 22 bp, Homo sapiens
ttttggtaaataatcaactttg

SEQ ID NO: 6894968 - DNA, 22 bp, Homo sapiens
agtgctttgaatgttctgggca

SEQ ID NO: 6894969 - DNA, 22 bp, Homo sapiens
actcagaggaccaaaaggaaag

SEQ ID NO: 6894970 - DNA, 22 bp, Homo sapiens
gcctggagaattaaaaggaagg

SEQ ID NO: 6894971 - DNA, 22 bp, Homo sapiens
ccagggtagctgagctaagcct

SEQ ID NO: 6894972 - DNA, 22 bp, Homo sapiens
gacttctcggcaccctttggca

SEQ ID NO: 6894973 - DNA, 22 bp, Homo sapiens
agaacagcaacatcagacaaag

SEQ ID NO: 6894974 - DNA, 22 bp, Homo sapiens
ttccttggtgtaactgctccta

SEQ ID NO: 6894975 - DNA, 22 bp, Homo sapiens
tccctgagactctggagtgtaa

SEQ ID NO: 6894976 - DNA, 22 bp, Homo sapiens
acgctaggcatgagaaaggtct

SEQ ID NO: 6894977 - DNA, 22 bp, Homo sapiens
tcattgagctgtatggacacaa

SEQ ID NO: 6894978 - DNA, 22 bp, Homo sapiens
attctaatgccctggccccagc

SEQ ID NO: 6894979 - DNA, 22 bp, Homo sapiens
gcttgggcttaactgtaggttc

SEQ ID NO: 6894980 - DNA, 22 bp, Homo sapiens
aaagtggttcttacatccgtgg

SEQ ID NO: 6894981 - DNA, 22 bp, Homo sapiens
tccttcagttcaattagtccgt

SEQ ID NO: 6894982 - DNA, 22 bp, Homo sapiens
gcacagccctgagcgcatgtct

SEQ ID NO: 6894983 - DNA, 22 bp, Homo sapiens
gtacctatgatctgcaggtagt

SEQ ID NO: 6894984 - DNA, 22 bp, Homo sapiens
aagcagggtgtcttgacccatg

SEQ ID NO: 6894985 - DNA, 23 bp, Homo sapiens
cagggtgaccaatgtggccatca

SEQ ID NO: 6894986 - DNA, 22 bp, Homo sapiens
tttattcactcattcagccagt

SEQ ID NO: 6894987 - DNA, 22 bp, Homo sapiens
tgccaggctcagcccctatctt

SEQ ID NO: 6894988 - DNA, 22 bp, Homo sapiens
tgaggcagggagtttaattgtc

SEQ ID NO: 6894989 - DNA, 22 bp, Homo sapiens
ctcacagttttttcctgttaat

SEQ ID NO: 6894990 - DNA, 22 bp, Homo sapiens
aagaaactcactttgggaggca

SEQ ID NO: 6894991 - DNA, 22 bp, Homo sapiens
tatctattatgttctatgtgtc

SEQ ID NO: 6894992 - DNA, 22 bp, Homo sapiens
gatctcaaagcagtgtgggttg

SEQ ID NO: 6894993 - DNA, 22 bp, Homo sapiens
ccaaggttagaaaaggtacttt

SEQ ID NO: 6894994 - DNA, 18 bp, Homo sapiens
tcttccaacactgacacc

SEQ ID NO: 6894995 - DNA, 22 bp, Homo sapiens
aaggaagcagcaatgcatgatt

SEQ ID NO: 6894996 - DNA, 22 bp, Homo sapiens
aaggctgaccagtttacacttt

SEQ ID NO: 6894997 - DNA, 23 bp, Homo sapiens
actttatcctatatctttgttct

SEQ ID NO: 6894998 - DNA, 22 bp, Homo sapiens
ggtcatctgtatgtcctcagct

SEQ ID NO: 6894999 - DNA, 22 bp, Homo sapiens
tagctgttaagttgtttggaaa

SEQ ID NO: 6895000 - DNA, 22 bp, Homo sapiens
ggaaggggagctggaaagggta

SEQ ID NO: 6895001 - DNA, 22 bp, Homo sapiens
tcagggcacattctgcagtggc

SEQ ID NO: 6895002 - DNA, 22 bp, Homo sapiens
tgctttatggagcccatctcat

SEQ ID NO: 6895003 - DNA, 22 bp, Homo sapiens
catcagctgagggtgagcagaa

SEQ ID NO: 6895004 - DNA, 22 bp, Homo sapiens
atagggcctaaaaagtattgct

SEQ ID NO: 6895005 - DNA, 22 bp, Homo sapiens
gatgcacgttgctgagtttctg

SEQ ID NO: 6895006 - DNA, 22 bp, Homo sapiens
agagcactgcgccggctcggaa

SEQ ID NO: 6895007 - DNA, 22 bp, Homo sapiens
tcccagggcttttctcatgctt

SEQ ID NO: 6895008 - DNA, 22 bp, Homo sapiens
ctgtgagtccctggggaggtta

SEQ ID NO: 6895009 - DNA, 22 bp, Homo sapiens
gagctgtctctttgggcctttt

SEQ ID NO: 6895010 - DNA, 22 bp, Homo sapiens
tatttgtctggtctaaggaggg

SEQ ID NO: 6895011 - DNA, 22 bp, Homo sapiens
cctgggctgggcgtctcatggg

SEQ ID NO: 6895012 - DNA, 22 bp, Homo sapiens
gtggccaacctggccctgaact

SEQ ID NO: 6895013 - DNA, 22 bp, Homo sapiens
ctggccctgtaggatgtgagtt

SEQ ID NO: 6895014 - DNA, 22 bp, Homo sapiens
gtgtgccaccactgacaggatt

SEQ ID NO: 6895015 - DNA, 22 bp, Homo sapiens
gctgcagccttcttgccattaa

SEQ ID NO: 6895016 - DNA, 21 bp, Homo sapiens
atgttcactgggtcaattaga

SEQ ID NO: 6895017 - DNA, 22 bp, Homo sapiens
aaggcattacctaagtttggga

SEQ ID NO: 6895018 - DNA, 22 bp, Homo sapiens
catgtaaatccttctttaggcc

SEQ ID NO: 6895019 - DNA, 22 bp, Homo sapiens
gtgcatcaatttcccatgtgtc

SEQ ID NO: 6895020 - DNA, 22 bp, Homo sapiens
gaggcaccagccccgctagcct

SEQ ID NO: 6895021 - DNA, 22 bp, Homo sapiens
gtgtccagttttttctctgctg

SEQ ID NO: 6895022 - DNA, 22 bp, Homo sapiens
ggggtcacactgtggtgactgg

SEQ ID NO: 6895023 - DNA, 22 bp, Homo sapiens
cagttaaacagattgagtgtta

SEQ ID NO: 6895024 - DNA, 22 bp, Homo sapiens
taagcagtttttcttgtattaa

SEQ ID NO: 6895025 - DNA, 22 bp, Homo sapiens
gcacatttgagacatccaggca

SEQ ID NO: 6895026 - DNA, 22 bp, Homo sapiens
cagaagatgcagtgtctgagaa

SEQ ID NO: 6895027 - DNA, 22 bp, Homo sapiens
aacactgaagtagtgaatactg

SEQ ID NO: 6895028 - DNA, 22 bp, Homo sapiens
ttaaagcaacctcagccctctt

SEQ ID NO: 6895029 - DNA, 22 bp, Homo sapiens
gtgtgcacagtatactagggtt

SEQ ID NO: 6895030 - DNA, 22 bp, Homo sapiens
aatacatgttttctactattct

SEQ ID NO: 6895031 - DNA, 22 bp, Homo sapiens
tgctgcctttactgggatttaa

SEQ ID NO: 6895032 - DNA, 23 bp, Homo sapiens
gtattgctgctggacatgtaatt

SEQ ID NO: 6895033 - DNA, 22 bp, Homo sapiens
ccattaaagcaccactgtaata

SEQ ID NO: 6895034 - DNA, 22 bp, Homo sapiens
cacctgggtcattgctggtgtt

SEQ ID NO: 6895035 - DNA, 22 bp, Homo sapiens
tgtctgcccattcatgggcaca

SEQ ID NO: 6895036 - DNA, 22 bp, Homo sapiens
gcccatttttagtagatttagt

SEQ ID NO: 6895037 - DNA, 23 bp, Homo sapiens
ccctgcagtcagggtgagatggt

SEQ ID NO: 6895038 - DNA, 20 bp, Homo sapiens
tgcctttcctgtttcatctt

SEQ ID NO: 6895039 - DNA, 22 bp, Homo sapiens
cctttacacgtaaggctgttga

SEQ ID NO: 6895040 - DNA, 22 bp, Homo sapiens
catgtcttatttatgcttctta

SEQ ID NO: 6895041 - DNA, 22 bp, Homo sapiens
acatgcataagcctagccatca

SEQ ID NO: 6895042 - DNA, 22 bp, Homo sapiens
tagaaacaagggagaggattct

SEQ ID NO: 6895043 - DNA, 22 bp, Homo sapiens
tcagggattgcaaaattcatcc

SEQ ID NO: 6895044 - DNA, 22 bp, Homo sapiens
ttcattgtgattcttggctagc

SEQ ID NO: 6895045 - DNA, 18 bp, Homo sapiens
agcatgagtcaggggtgc

SEQ ID NO: 6895046 - DNA, 22 bp, Homo sapiens
ttaattaattagttaagcatgt

SEQ ID NO: 6895047 - DNA, 22 bp, Homo sapiens
gacatttcaatctcattatggg

SEQ ID NO: 6895048 - DNA, 22 bp, Homo sapiens
tactttggatccttacaatagc

SEQ ID NO: 6895049 - DNA, 22 bp, Homo sapiens
gtccctgggatgcccttctggg

SEQ ID NO: 6895050 - DNA, 22 bp, Homo sapiens
tgacaccttgctaaatggcacc

SEQ ID NO: 6895051 - DNA, 22 bp, Homo sapiens
tggcagcttgaatgcagtcttt

SEQ ID NO: 6895052 - DNA, 22 bp, Homo sapiens
ccttagcatggctgtgctgtgt

SEQ ID NO: 6895053 - DNA, 22 bp, Homo sapiens
attcaacgggtagaagggtctt

SEQ ID NO: 6895054 - DNA, 22 bp, Homo sapiens
cctgtttgttacctcgtttgag

SEQ ID NO: 6895055 - DNA, 22 bp, Homo sapiens
gatgtggggttgagggaccagc

SEQ ID NO: 6895056 - DNA, 22 bp, Homo sapiens
tcctgagatgtggagctccatg

SEQ ID NO: 6895057 - DNA, 22 bp, Homo sapiens
attctagcagatattggaaatt

SEQ ID NO: 6895058 - DNA, 22 bp, Homo sapiens
tcaggctggtggtcagatggct

SEQ ID NO: 6895059 - DNA, 22 bp, Homo sapiens
aacatgaaaactacctgtgatt

SEQ ID NO: 6895060 - DNA, 22 bp, Homo sapiens
atgtaaggttcagagtatgtga

SEQ ID NO: 6895061 - DNA, 22 bp, Homo sapiens
ggagatattgcctgatgaagaa

SEQ ID NO: 6895062 - DNA, 22 bp, Homo sapiens
caggcagcatcagtctgctgta

SEQ ID NO: 6895063 - DNA, 20 bp, Homo sapiens
gatgagacccatgcatgaga

SEQ ID NO: 6895064 - DNA, 22 bp, Homo sapiens
aggccctgctttccagagctca

SEQ ID NO: 6895065 - DNA, 22 bp, Homo sapiens
ctcagggacgttagaggacagg

SEQ ID NO: 6895066 - DNA, 22 bp, Homo sapiens
ttggcattgaagtttcattggt

SEQ ID NO: 6895067 - DNA, 22 bp, Homo sapiens
agaggcacagaggcagtcccct

SEQ ID NO: 6895068 - DNA, 18 bp, Homo sapiens
tggtttgtcatgagaatt

SEQ ID NO: 6895069 - DNA, 21 bp, Homo sapiens
tgtgacctccctctatctttc

SEQ ID NO: 6895070 - DNA, 22 bp, Homo sapiens
tggtcagagcccctttcataga

SEQ ID NO: 6895071 - DNA, 22 bp, Homo sapiens
tatataatttgtaaaagcacct

SEQ ID NO: 6895072 - DNA, 21 bp, Homo sapiens
ggcaattaggcttctgagtat

SEQ ID NO: 6895073 - DNA, 23 bp, Homo sapiens
agccagggcactggtggagattg

SEQ ID NO: 6895074 - DNA, 22 bp, Homo sapiens
gaagacatttgtaacacttgca

SEQ ID NO: 6895075 - DNA, 22 bp, Homo sapiens
tctgggaaacactgcatcccca

SEQ ID NO: 6895076 - DNA, 22 bp, Homo sapiens
tatctgtctttatcaggattta

SEQ ID NO: 6895077 - DNA, 22 bp, Homo sapiens
aaactgtaatgcaggatcaaga

SEQ ID NO: 6895078 - DNA, 22 bp, Homo sapiens
aggctgtgatgagcctcatgga

SEQ ID NO: 6895079 - DNA, 22 bp, Homo sapiens
tatgatgggaggaatggaattt

SEQ ID NO: 6895080 - DNA, 22 bp, Homo sapiens
atagagtgatgtaaggtatgtg

SEQ ID NO: 6895081 - DNA, 22 bp, Homo sapiens
tgaggagaaatgctcagagcca

SEQ ID NO: 6895082 - DNA, 23 bp, Homo sapiens
gagtgttcatagcaggctcttgc

SEQ ID NO: 6895083 - DNA, 22 bp, Homo sapiens
ctccagtcttctcatgtatccc

SEQ ID NO: 6895084 - DNA, 22 bp, Homo sapiens
attctcaaagccagagtcaacg

SEQ ID NO: 6895085 - DNA, 22 bp, Homo sapiens
aacttaagaggttaagggcttg

SEQ ID NO: 6895086 - DNA, 22 bp, Homo sapiens
ttccttggagcgctaaagctct

SEQ ID NO: 6895087 - DNA, 22 bp, Homo sapiens
tgccatagcaatggtaagctga

SEQ ID NO: 6895088 - DNA, 21 bp, Homo sapiens
tggctaaaccctagtaaatta

SEQ ID NO: 6895089 - DNA, 22 bp, Homo sapiens
cttcctttccccaatcatatcg

SEQ ID NO: 6895090 - DNA, 22 bp, Homo sapiens
agagctgtgtcctgtgcactag

SEQ ID NO: 6895091 - DNA, 22 bp, Homo sapiens
actgccattttgaataattact

SEQ ID NO: 6895092 - DNA, 22 bp, Homo sapiens
tgctgcattcaggagcacagtt

SEQ ID NO: 6895093 - DNA, 23 bp, Homo sapiens
tgaagcccagtgattttgtttca

SEQ ID NO: 6895094 - DNA, 18 bp, Homo sapiens
agagggaatcagttggat

SEQ ID NO: 6895095 - DNA, 22 bp, Homo sapiens
gctgggcttctcaatgctgcct

SEQ ID NO: 6895096 - DNA, 22 bp, Homo sapiens
gctggcacacagtacacgcctt

SEQ ID NO: 6895097 - DNA, 22 bp, Homo sapiens
aagccgggcctgagaaatgaca

SEQ ID NO: 6895098 - DNA, 22 bp, Homo sapiens
cttcttgctgggggcctcagtg

SEQ ID NO: 6895099 - DNA, 22 bp, Homo sapiens
gcctctccgagccactgcctct

SEQ ID NO: 6895100 - DNA, 22 bp, Homo sapiens
ctggctctgagtggtatcttga

SEQ ID NO: 6895101 - DNA, 22 bp, Homo sapiens
ggaccagtttcaaactgtacca

SEQ ID NO: 6895102 - DNA, 22 bp, Homo sapiens
aaacttagttaagcatattatt

SEQ ID NO: 6895103 - DNA, 22 bp, Homo sapiens
gcctgagcagctatacacacag

SEQ ID NO: 6895104 - DNA, 22 bp, Homo sapiens
acaatgcaattgtaaggtgtgt

SEQ ID NO: 6895105 - DNA, 22 bp, Homo sapiens
aaagatctgtgttaactcaagg

SEQ ID NO: 6895106 - DNA, 22 bp, Homo sapiens
gtacttctggccaggctggcca

SEQ ID NO: 6895107 - DNA, 22 bp, Homo sapiens
ctcagtgaattggaggatggcc

SEQ ID NO: 6895108 - DNA, 20 bp, Homo sapiens
ctttagaagaacccaagcat

SEQ ID NO: 6895109 - DNA, 22 bp, Homo sapiens
ggaaagagggacccagcttggt

SEQ ID NO: 6895110 - DNA, 22 bp, Homo sapiens
ctttctaattctcccatagtct

SEQ ID NO: 6895111 - DNA, 22 bp, Homo sapiens
ttagcagctaaactgacagacc

SEQ ID NO: 6895112 - DNA, 22 bp, Homo sapiens
gaaatcttttaaccattcattt

SEQ ID NO: 6895113 - DNA, 18 bp, Homo sapiens
actcacagcagaagaagg

SEQ ID NO: 6895114 - DNA, 22 bp, Homo sapiens
agcagcagtgacagccgaaagc

SEQ ID NO: 6895115 - DNA, 22 bp, Homo sapiens
aggtggcagagctggcccagcg

SEQ ID NO: 6895116 - DNA, 22 bp, Homo sapiens
tcgaagtacccagggctctccc

SEQ ID NO: 6895117 - DNA, 22 bp, Homo sapiens
ttctggcttatgagctataatg

SEQ ID NO: 6895118 - DNA, 22 bp, Homo sapiens
ttattcaggaggtgctcgaagg

SEQ ID NO: 6895119 - DNA, 22 bp, Homo sapiens
ctagttttaagctccttgaggt

SEQ ID NO: 6895120 - DNA, 22 bp, Homo sapiens
tagaaacatcagctaaccaaaa

SEQ ID NO: 6895121 - DNA, 22 bp, Homo sapiens
gtcagctgcagtgggcacagcc

SEQ ID NO: 6895122 - DNA, 22 bp, Homo sapiens
gacatgtaaatggcaattatgg

SEQ ID NO: 6895123 - DNA, 19 bp, Homo sapiens
gatcatttttgcactgctt

SEQ ID NO: 6895124 - DNA, 19 bp, Homo sapiens
tttcccagcccttgctgtg

SEQ ID NO: 6895125 - DNA, 22 bp, Homo sapiens
tgggcccgcgcaaaggactcca

SEQ ID NO: 6895126 - DNA, 22 bp, Homo sapiens
tgtgagtgaatgggtctgaagt

SEQ ID NO: 6895127 - DNA, 21 bp, Homo sapiens
accaaaacctatactttctgt

SEQ ID NO: 6895128 - DNA, 22 bp, Homo sapiens
ccatctgtctcctgatctagct

SEQ ID NO: 6895129 - DNA, 22 bp, Homo sapiens
tttcactgttaggagtatgcta

SEQ ID NO: 6895130 - DNA, 22 bp, Homo sapiens
aatggttttgtctcatcaatgt

SEQ ID NO: 6895131 - DNA, 20 bp, Homo sapiens
tccctggggccctacttcct

SEQ ID NO: 6895132 - DNA, 22 bp, Homo sapiens
tgatttactcccacttagagcc

SEQ ID NO: 6895133 - DNA, 19 bp, Homo sapiens
ccagggctttaagttgagg

SEQ ID NO: 6895134 - DNA, 22 bp, Homo sapiens
tgcctgtgacccaaggatgcga

SEQ ID NO: 6895135 - DNA, 20 bp, Homo sapiens
aggtgtccacgtggcagggt

SEQ ID NO: 6895136 - DNA, 22 bp, Homo sapiens
ctgagcatttgcctttttaaca

SEQ ID NO: 6895137 - DNA, 22 bp, Homo sapiens
tccaactttctcctccggcttg

SEQ ID NO: 6895138 - DNA, 22 bp, Homo sapiens
atctttgtcactctactgtcta

SEQ ID NO: 6895139 - DNA, 22 bp, Homo sapiens
cattctgagatatgggctgaag

SEQ ID NO: 6895140 - DNA, 22 bp, Homo sapiens
agggctgggctgcttgttgtca

SEQ ID NO: 6895141 - DNA, 19 bp, Homo sapiens
tatgtgtgcatttgtgcat

SEQ ID NO: 6895142 - DNA, 22 bp, Homo sapiens
caagggaaggctaagggcaaca

SEQ ID NO: 6895143 - DNA, 22 bp, Homo sapiens
ccacattcagtccaggcttgga

SEQ ID NO: 6895144 - DNA, 22 bp, Homo sapiens
acaatatcagctcaagccctgt

SEQ ID NO: 6895145 - DNA, 22 bp, Homo sapiens
tagaatagtggctggcatattt

SEQ ID NO: 6895146 - DNA, 19 bp, Homo sapiens
cacctacttttggatttgc

SEQ ID NO: 6895147 - DNA, 22 bp, Homo sapiens
gtaggtcaatatttctgtctta

SEQ ID NO: 6895148 - DNA, 22 bp, Homo sapiens
tggtggagtttctctttcaaac

SEQ ID NO: 6895149 - DNA, 22 bp, Homo sapiens
cttaggaaagttttctgctgca

SEQ ID NO: 6895150 - DNA, 22 bp, Homo sapiens
gacttcaaagcgtgataaagat

SEQ ID NO: 6895151 - DNA, 22 bp, Homo sapiens
aggaaataagggcacttcagat

SEQ ID NO: 6895152 - DNA, 22 bp, Homo sapiens
tgtgcatggcatcattgcagcc

SEQ ID NO: 6895153 - DNA, 22 bp, Homo sapiens
actgttatgttattacccatgt

SEQ ID NO: 6895154 - DNA, 17 bp, Homo sapiens
ttgctactacgccaagt

SEQ ID NO: 6895155 - DNA, 22 bp, Homo sapiens
gctctaggagaggggcagtcca

SEQ ID NO: 6895156 - DNA, 22 bp, Homo sapiens
cctgtgcattgaccacactctc

SEQ ID NO: 6895157 - DNA, 22 bp, Homo sapiens
tcataacaacctggaaggccag

SEQ ID NO: 6895158 - DNA, 22 bp, Homo sapiens
catgcacaacatactcaagagg

SEQ ID NO: 6895159 - DNA, 22 bp, Homo sapiens
gggagccagagtcacctagaga

SEQ ID NO: 6895160 - DNA, 22 bp, Homo sapiens
ggagttggaggctccagggaac

SEQ ID NO: 6895161 - DNA, 21 bp, Homo sapiens
tatctgctttttaaggctcac

SEQ ID NO: 6895162 - DNA, 22 bp, Homo sapiens
tccctgaaacataatagatgcc

SEQ ID NO: 6895163 - DNA, 22 bp, Homo sapiens
tggtgaggaagacctgctcctg

SEQ ID NO: 6895164 - DNA, 22 bp, Homo sapiens
caggtgtcagcagcactgtact

SEQ ID NO: 6895165 - DNA, 22 bp, Homo sapiens
aaaatagataatgccagggtca

SEQ ID NO: 6895166 - DNA, 22 bp, Homo sapiens
ggctctgcttctcacctgttcc

SEQ ID NO: 6895167 - DNA, 22 bp, Homo sapiens
tctcaggagtagtgggatccat

SEQ ID NO: 6895168 - DNA, 22 bp, Homo sapiens
agaatttcaaaaggaagccagc

SEQ ID NO: 6895169 - DNA, 22 bp, Homo sapiens
agtaaatggcccagggttatca

SEQ ID NO: 6895170 - DNA, 22 bp, Homo sapiens
gcttggctttgtcttgttcact

SEQ ID NO: 6895171 - DNA, 22 bp, Homo sapiens
tcctcagggcggcctccgtctt

SEQ ID NO: 6895172 - DNA, 22 bp, Homo sapiens
gctggcagcattagaccctggg

SEQ ID NO: 6895173 - DNA, 22 bp, Homo sapiens
ctatggcttaagattgacatga

SEQ ID NO: 6895174 - DNA, 17 bp, Homo sapiens
tcagcaaagacaaagga

SEQ ID NO: 6895175 - DNA, 22 bp, Homo sapiens
cgggccctttaaggatgtgtcg

SEQ ID NO: 6895176 - DNA, 19 bp, Homo sapiens
tgattcatctaactgcctc

SEQ ID NO: 6895177 - DNA, 22 bp, Homo sapiens
tcaggaggtgtaacgaatacag

SEQ ID NO: 6895178 - DNA, 22 bp, Homo sapiens
cccggccccgtggcaggtaacg

SEQ ID NO: 6895179 - DNA, 22 bp, Homo sapiens
ttagcttaattaaataatcagt

SEQ ID NO: 6895180 - DNA, 17 bp, Homo sapiens
gtgcagggatgaaggat

SEQ ID NO: 6895181 - DNA, 22 bp, Homo sapiens
aggctgtctgaccccagagccc

SEQ ID NO: 6895182 - DNA, 22 bp, Homo sapiens
taggagctgagacatctttaaa

SEQ ID NO: 6895183 - DNA, 22 bp, Homo sapiens
tctacagacagagcaggtggga

SEQ ID NO: 6895184 - DNA, 22 bp, Homo sapiens
cacaccagcatggtctcagtgt

SEQ ID NO: 6895185 - DNA, 22 bp, Homo sapiens
cctcagagactgcatcttccct

SEQ ID NO: 6895186 - DNA, 22 bp, Homo sapiens
cacaggccagtaagactgtgtt

SEQ ID NO: 6895187 - DNA, 22 bp, Homo sapiens
tggcccagatctctgaccttga

SEQ ID NO: 6895188 - DNA, 22 bp, Homo sapiens
ccagatttgtaggggctcttac

SEQ ID NO: 6895189 - DNA, 22 bp, Homo sapiens
agagacaaacactgcaacttct

SEQ ID NO: 6895190 - DNA, 22 bp, Homo sapiens
cagtttttagattagttggtgg

SEQ ID NO: 6895191 - DNA, 22 bp, Homo sapiens
aaacaaatagtgcatgggaatt

SEQ ID NO: 6895192 - DNA, 21 bp, Homo sapiens
ttggaagataatgcttatgat

SEQ ID NO: 6895193 - DNA, 21 bp, Homo sapiens
ctgaattatgtgcttaccttt

SEQ ID NO: 6895194 - DNA, 22 bp, Homo sapiens
aaacatagataatagatagatg

SEQ ID NO: 6895195 - DNA, 22 bp, Homo sapiens
aaagaatgcagtgccttccagc

SEQ ID NO: 6895196 - DNA, 22 bp, Homo sapiens
tctcacagcctctggaggtagt

SEQ ID NO: 6895197 - DNA, 22 bp, Homo sapiens
atggccagcttataggggctca

SEQ ID NO: 6895198 - DNA, 17 bp, Homo sapiens
agctgaccagatggact

SEQ ID NO: 6895199 - DNA, 22 bp, Homo sapiens
gccagtaagtggtagagactta

SEQ ID NO: 6895200 - DNA, 22 bp, Homo sapiens
tagcagaggctactgctccttg

SEQ ID NO: 6895201 - DNA, 22 bp, Homo sapiens
tgtgactgtggacttttgtggg

SEQ ID NO: 6895202 - DNA, 22 bp, Homo sapiens
cttcactgatgggacagctcaa

SEQ ID NO: 6895203 - DNA, 22 bp, Homo sapiens
attttagctgtccagtggattg

SEQ ID NO: 6895204 - DNA, 22 bp, Homo sapiens
tgacaggaaacatgcagtgatt

SEQ ID NO: 6895205 - DNA, 23 bp, Homo sapiens
gttgcctttgcatcttcatccat

SEQ ID NO: 6895206 - DNA, 22 bp, Homo sapiens
aaagatatgtctccaaagagat

SEQ ID NO: 6895207 - DNA, 17 bp, Homo sapiens
aggaaagtctgctgtcc

SEQ ID NO: 6895208 - DNA, 16 bp, Homo sapiens
accattctagccacat

SEQ ID NO: 6895209 - DNA, 22 bp, Homo sapiens
tgggctgagtggcagccagagt

SEQ ID NO: 6895210 - DNA, 20 bp, Homo sapiens
ctgtttattagaagtggatt

SEQ ID NO: 6895211 - DNA, 22 bp, Homo sapiens
tgctgggctggggcctcagacc

SEQ ID NO: 6895212 - DNA, 17 bp, Homo sapiens
gggcttgctgagtgtgt

SEQ ID NO: 6895213 - DNA, 22 bp, Homo sapiens
tactgaggccatgagtctcata

SEQ ID NO: 6895214 - DNA, 22 bp, Homo sapiens
cacagcaagagctaaatgacca

SEQ ID NO: 6895215 - DNA, 22 bp, Homo sapiens
tcccagagacatcatttctccg

SEQ ID NO: 6895216 - DNA, 22 bp, Homo sapiens
ttagacagtaaggcttcagttg

SEQ ID NO: 6895217 - DNA, 22 bp, Homo sapiens
agggcagcttccatagtctggc

SEQ ID NO: 6895218 - DNA, 22 bp, Homo sapiens
aggcaggctggtctgaagagtg

SEQ ID NO: 6895219 - DNA, 22 bp, Homo sapiens
ggtgtgggagagattctttcct

SEQ ID NO: 6895220 - DNA, 22 bp, Homo sapiens
tgctttacaagcctgcttcctc

SEQ ID NO: 6895221 - DNA, 22 bp, Homo sapiens
gtgacagccttcagtgtctctg

SEQ ID NO: 6895222 - DNA, 22 bp, Homo sapiens
aatggagtggttcttgccctct

SEQ ID NO: 6895223 - DNA, 22 bp, Homo sapiens
agaggaagctgagatgcctctt

SEQ ID NO: 6895224 - DNA, 22 bp, Homo sapiens
caactgtgaattttatgatacc

SEQ ID NO: 6895225 - DNA, 22 bp, Homo sapiens
tctctgtaaggaagaattagat

SEQ ID NO: 6895226 - DNA, 22 bp, Homo sapiens
aaagtgcacctgcttcttcttg

SEQ ID NO: 6895227 - DNA, 22 bp, Homo sapiens
tttgacattgccaatttgctca

SEQ ID NO: 6895228 - DNA, 22 bp, Homo sapiens
cagtagatttggtaaactagga

SEQ ID NO: 6895229 - DNA, 22 bp, Homo sapiens
gaagggctgcaggtctgggccc

SEQ ID NO: 6895230 - DNA, 22 bp, Homo sapiens
gatttagagaatgttttgtaag

SEQ ID NO: 6895231 - DNA, 22 bp, Homo sapiens
gcaaggctgacctctctagact

SEQ ID NO: 6895232 - DNA, 22 bp, Homo sapiens
tagagcttggggatttagtagt

SEQ ID NO: 6895233 - DNA, 22 bp, Homo sapiens
tagactagaggatcagcaaggg

SEQ ID NO: 6895234 - DNA, 22 bp, Homo sapiens
aagccagtgggcatagcagttg

SEQ ID NO: 6895235 - DNA, 22 bp, Homo sapiens
ggctgccctcgtctactgccca

SEQ ID NO: 6895236 - DNA, 22 bp, Homo sapiens
actggcactatgttggagaaat

SEQ ID NO: 6895237 - DNA, 22 bp, Homo sapiens
atgaggtcattcttggattaca

SEQ ID NO: 6895238 - DNA, 22 bp, Homo sapiens
acttcagtgtggtataaaacgt

SEQ ID NO: 6895239 - DNA, 22 bp, Homo sapiens
acctccccattaggtcacccac

SEQ ID NO: 6895240 - DNA, 22 bp, Homo sapiens
aaggccttaaagctctctccag

SEQ ID NO: 6895241 - DNA, 22 bp, Homo sapiens
ctgtggaaataaacaatgctaa

SEQ ID NO: 6895242 - DNA, 22 bp, Homo sapiens
tagccagggagacactgtggag

SEQ ID NO: 6895243 - DNA, 20 bp, Homo sapiens
tgacacttgatattgtcagt

SEQ ID NO: 6895244 - DNA, 22 bp, Homo sapiens
taatactgtatactgcaaattt

SEQ ID NO: 6895245 - DNA, 22 bp, Homo sapiens
gctctgtggtggggcagagttt

SEQ ID NO: 6895246 - DNA, 22 bp, Homo sapiens
gggctctggtacttcctggctc

SEQ ID NO: 6895247 - DNA, 22 bp, Homo sapiens
atggtttagttagggcttttca

SEQ ID NO: 6895248 - DNA, 21 bp, Homo sapiens
tactgagacctcacagtgtgc

SEQ ID NO: 6895249 - DNA, 22 bp, Homo sapiens
gctctgccaacagtttgggcaa

SEQ ID NO: 6895250 - DNA, 18 bp, Homo sapiens
tggcttcctgcgggctgc

SEQ ID NO: 6895251 - DNA, 22 bp, Homo sapiens
acttatagccagaattaattat

SEQ ID NO: 6895252 - DNA, 22 bp, Homo sapiens
cagaccctcttctattggtggg

SEQ ID NO: 6895253 - DNA, 22 bp, Homo sapiens
cctaacatatgtaaaggtcttt

SEQ ID NO: 6895254 - DNA, 22 bp, Homo sapiens
ccccactttgagtagcacttga

SEQ ID NO: 6895255 - DNA, 19 bp, Homo sapiens
ttcattctttctacttacc

SEQ ID NO: 6895256 - DNA, 22 bp, Homo sapiens
gtgctctatagagatctaatcg

SEQ ID NO: 6895257 - DNA, 22 bp, Homo sapiens
ccattgattaccagcagcagtt

SEQ ID NO: 6895258 - DNA, 22 bp, Homo sapiens
ctgttaaagtgatcctttgtta

SEQ ID NO: 6895259 - DNA, 22 bp, Homo sapiens
gtattgggtgagggcaaagggt

SEQ ID NO: 6895260 - DNA, 22 bp, Homo sapiens
taactagaagaatgcaccaaga

SEQ ID NO: 6895261 - DNA, 22 bp, Homo sapiens
cctgcaccttcaagaaaataat

SEQ ID NO: 6895262 - DNA, 22 bp, Homo sapiens
ctcttagttttttcctcatgaa

SEQ ID NO: 6895263 - DNA, 22 bp, Homo sapiens
attcacagggggagaagggtat

SEQ ID NO: 6895264 - DNA, 22 bp, Homo sapiens
atatacaggtggtatgtgtaaa

SEQ ID NO: 6895265 - DNA, 22 bp, Homo sapiens
ccctaaggacacctgctgtcca

SEQ ID NO: 6895266 - DNA, 21 bp, Homo sapiens
tctgtgctgccgtcaacatcc

SEQ ID NO: 6895267 - DNA, 22 bp, Homo sapiens
gaggcctgaggctgcctggagc

SEQ ID NO: 6895268 - DNA, 22 bp, Homo sapiens
ggtctggagtagatgagtcatg

SEQ ID NO: 6895269 - DNA, 22 bp, Homo sapiens
agcaccatcagatgcaatatct

SEQ ID NO: 6895270 - DNA, 22 bp, Homo sapiens
ccctttaagtcctggaacaaag

SEQ ID NO: 6895271 - DNA, 22 bp, Homo sapiens
aggggaagagccctttacatgg

SEQ ID NO: 6895272 - DNA, 21 bp, Homo sapiens
agattgtatggaggtgagagg

SEQ ID NO: 6895273 - DNA, 22 bp, Homo sapiens
aggggagactggaatctaacat

SEQ ID NO: 6895274 - DNA, 22 bp, Homo sapiens
tagaaggcggactctccctctg

SEQ ID NO: 6895275 - DNA, 22 bp, Homo sapiens
agaacagcagcacgtcaagctg

SEQ ID NO: 6895276 - DNA, 22 bp, Homo sapiens
agagcaggcataaagctttgaa

SEQ ID NO: 6895277 - DNA, 22 bp, Homo sapiens
cctgatcaaagaggtcagcatt

SEQ ID NO: 6895278 - DNA, 22 bp, Homo sapiens
ttccagagtattggtagctata

SEQ ID NO: 6895279 - DNA, 22 bp, Homo sapiens
tttctcccccatgataatttct

SEQ ID NO: 6895280 - DNA, 22 bp, Homo sapiens
tagggtcctcatctgtaaatga

SEQ ID NO: 6895281 - DNA, 22 bp, Homo sapiens
cttcatgctgagaagctgaatg

SEQ ID NO: 6895282 - DNA, 17 bp, Homo sapiens
tttgatagaatcagagt

SEQ ID NO: 6895283 - DNA, 22 bp, Homo sapiens
cttctcggccgtgtggatgcgc

SEQ ID NO: 6895284 - DNA, 22 bp, Homo sapiens
tttgaaagcctggcttttctct

SEQ ID NO: 6895285 - DNA, 22 bp, Homo sapiens
tgtattagatctgagaacttct

SEQ ID NO: 6895286 - DNA, 22 bp, Homo sapiens
tgaggcaaagttcaagctgaaa

SEQ ID NO: 6895287 - DNA, 22 bp, Homo sapiens
tatgctttgatttcctcagctg

SEQ ID NO: 6895288 - DNA, 22 bp, Homo sapiens
agagcagcctgtgatgatgcac

SEQ ID NO: 6895289 - DNA, 22 bp, Homo sapiens
agactttaatgtgcaaatgaaa

SEQ ID NO: 6895290 - DNA, 17 bp, Homo sapiens
gtgagctgagtcaggac

SEQ ID NO: 6895291 - DNA, 22 bp, Homo sapiens
aatatatgactccactgcatga

SEQ ID NO: 6895292 - DNA, 22 bp, Homo sapiens
ccggtgttcaaagtctggtatg

SEQ ID NO: 6895293 - DNA, 22 bp, Homo sapiens
tgcaggtctccattggcagact

SEQ ID NO: 6895294 - DNA, 22 bp, Homo sapiens
cacatttcattggcttacgtaa

SEQ ID NO: 6895295 - DNA, 22 bp, Homo sapiens
tgcttcattaaaacaatatttt

SEQ ID NO: 6895296 - DNA, 22 bp, Homo sapiens
tcaaaccaccttgttactgggg

SEQ ID NO: 6895297 - DNA, 22 bp, Homo sapiens
tttctgaaatctcttttgagga

SEQ ID NO: 6895298 - DNA, 22 bp, Homo sapiens
aggctcagtcccggcccgcgcc

SEQ ID NO: 6895299 - DNA, 22 bp, Homo sapiens
tctgagcagggcagtgtccatg

SEQ ID NO: 6895300 - DNA, 22 bp, Homo sapiens
gaggcagtgtttactgccctgt

SEQ ID NO: 6895301 - DNA, 22 bp, Homo sapiens
gggcaatggatgtgatgactcc

SEQ ID NO: 6895302 - DNA, 22 bp, Homo sapiens
tttatgtcccttcaaatgttta

SEQ ID NO: 6895303 - DNA, 22 bp, Homo sapiens
atcctttagtcctacaactcga

SEQ ID NO: 6895304 - DNA, 22 bp, Homo sapiens
tgataacttgtaaattagattc

SEQ ID NO: 6895305 - DNA, 21 bp, Homo sapiens
aagcaggaacttcaaagggac

SEQ ID NO: 6895306 - DNA, 22 bp, Homo sapiens
tcatgtttttgccatatgactc

SEQ ID NO: 6895307 - DNA, 22 bp, Homo sapiens
ttccagttaaggaagctattct

SEQ ID NO: 6895308 - DNA, 22 bp, Homo sapiens
tgtgcatcaagagaaaacagtg

SEQ ID NO: 6895309 - DNA, 22 bp, Homo sapiens
tcagaggctacagtctgggagt

SEQ ID NO: 6895310 - DNA, 22 bp, Homo sapiens
gctgttcctgcttagaggtcgg

SEQ ID NO: 6895311 - DNA, 22 bp, Homo sapiens
attgtaattttagagaaagtgg

SEQ ID NO: 6895312 - DNA, 22 bp, Homo sapiens
tcttacaagaaataagccaatg

SEQ ID NO: 6895313 - DNA, 22 bp, Homo sapiens
atgctctctgtcctgctcagag

SEQ ID NO: 6895314 - DNA, 22 bp, Homo sapiens
aggcttcatgtgtcctgggtga

SEQ ID NO: 6895315 - DNA, 22 bp, Homo sapiens
tggagtacaaggctttagtggt

SEQ ID NO: 6895316 - DNA, 21 bp, Homo sapiens
tctgatggtagatgagatgtg

SEQ ID NO: 6895317 - DNA, 19 bp, Homo sapiens
tgccaaatccatgcccagg

SEQ ID NO: 6895318 - DNA, 22 bp, Homo sapiens
tgtcccagacataagtggacat

SEQ ID NO: 6895319 - DNA, 22 bp, Homo sapiens
tcccagaaccctgccaggtcct

SEQ ID NO: 6895320 - DNA, 20 bp, Homo sapiens
tactgaggttaggggatgga

SEQ ID NO: 6895321 - DNA, 22 bp, Homo sapiens
agtgaaatgattctgagcaaga

SEQ ID NO: 6895322 - DNA, 22 bp, Homo sapiens
tcctcttctaagctcattcagg

SEQ ID NO: 6895323 - DNA, 22 bp, Homo sapiens
tgccagagaggagaaagcattt

SEQ ID NO: 6895324 - DNA, 22 bp, Homo sapiens
tatatgcttgggaaatggtaga

SEQ ID NO: 6895325 - DNA, 22 bp, Homo sapiens
atattgatcttggaactgattt

SEQ ID NO: 6895326 - DNA, 22 bp, Homo sapiens
tagcatctgtactgacataatc

SEQ ID NO: 6895327 - DNA, 22 bp, Homo sapiens
gtgcttttccttatttggtgct

SEQ ID NO: 6895328 - DNA, 22 bp, Homo sapiens
gcatccttttttcctgccctgc

SEQ ID NO: 6895329 - DNA, 22 bp, Homo sapiens
tgagacttcctgatgaggcccg

SEQ ID NO: 6895330 - DNA, 21 bp, Homo sapiens
gctgtctcctccttgcaccag

SEQ ID NO: 6895331 - DNA, 19 bp, Homo sapiens
tggaaagtaaccccagagt

SEQ ID NO: 6895332 - DNA, 22 bp, Homo sapiens
gtgaggtgggctggccagagac

SEQ ID NO: 6895333 - DNA, 22 bp, Homo sapiens
caggccctgcacagtggtcctg

SEQ ID NO: 6895334 - DNA, 22 bp, Homo sapiens
tcctccaggataaaatgtgttg

SEQ ID NO: 6895335 - DNA, 22 bp, Homo sapiens
tcagccctgggcttcctcatgg

SEQ ID NO: 6895336 - DNA, 20 bp, Homo sapiens
gctgtgcctccagctggtgg

SEQ ID NO: 6895337 - DNA, 22 bp, Homo sapiens
tctggccccatacagagggtct

SEQ ID NO: 6895338 - DNA, 22 bp, Homo sapiens
gtgttgactcttggacttcaag

SEQ ID NO: 6895339 - DNA, 22 bp, Homo sapiens
cagtatgactacaaacagcttt

SEQ ID NO: 6895340 - DNA, 22 bp, Homo sapiens
tgtcttggttcttctgaaacac

SEQ ID NO: 6895341 - DNA, 22 bp, Homo sapiens
tttcttccccactgcaggctct

SEQ ID NO: 6895342 - DNA, 22 bp, Homo sapiens
atgaactgcagtataaacttgg

SEQ ID NO: 6895343 - DNA, 22 bp, Homo sapiens
gttattgagacatagagttatg

SEQ ID NO: 6895344 - DNA, 22 bp, Homo sapiens
tggtgctgtggaggggcagaag

SEQ ID NO: 6895345 - DNA, 22 bp, Homo sapiens
tacattccttcgtttagagatt

SEQ ID NO: 6895346 - DNA, 22 bp, Homo sapiens
aagccaatggattggttgcttt

SEQ ID NO: 6895347 - DNA, 22 bp, Homo sapiens
ccactgacacagacaaggcctg

SEQ ID NO: 6895348 - DNA, 22 bp, Homo sapiens
tggtggttatgcgctttgtggg

SEQ ID NO: 6895349 - DNA, 22 bp, Homo sapiens
acttgttagatataaagtttgt

SEQ ID NO: 6895350 - DNA, 22 bp, Homo sapiens
aagccctccgtacgtgctagct

SEQ ID NO: 6895351 - DNA, 22 bp, Homo sapiens
acggagtatttacaagaggaaa

SEQ ID NO: 6895352 - DNA, 22 bp, Homo sapiens
cacccaggctggaatgcagtgg

SEQ ID NO: 6895353 - DNA, 22 bp, Homo sapiens
cacccaggctggagtgcagtga

SEQ ID NO: 6895354 - DNA, 22 bp, Homo sapiens
atttgcatgacctttgcaagtg

SEQ ID NO: 6895355 - DNA, 22 bp, Homo sapiens
accaggctggagtgcagtggcg

SEQ ID NO: 6895356 - DNA, 22 bp, Homo sapiens
ttcagataagtcaagttagtat

SEQ ID NO: 6895357 - DNA, 22 bp, Homo sapiens
ccttctctactcctgatgcatg

SEQ ID NO: 6895358 - DNA, 22 bp, Homo sapiens
caccagctctccaccaggtttc

SEQ ID NO: 6895359 - DNA, 22 bp, Homo sapiens
tctgccctggggtcagcctcca

SEQ ID NO: 6895360 - DNA, 22 bp, Homo sapiens
tcacattgttcttagtttacct

SEQ ID NO: 6895361 - DNA, 22 bp, Homo sapiens
acagggctcgtcgggccctcgg

SEQ ID NO: 6895362 - DNA, 22 bp, Homo sapiens
ccaattttattcttctgcaagt

SEQ ID NO: 6895363 - DNA, 22 bp, Homo sapiens
ctactgtctcatcagtgttatt

SEQ ID NO: 6895364 - DNA, 22 bp, Homo sapiens
cagggctgtaaattagtgctga

SEQ ID NO: 6895365 - DNA, 22 bp, Homo sapiens
gcactttgcccctcctttggca

SEQ ID NO: 6895366 - DNA, 22 bp, Homo sapiens
tgcattaagcacacttttgaat

SEQ ID NO: 6895367 - DNA, 22 bp, Homo sapiens
tccaaagaagtcacaaacgaag

SEQ ID NO: 6895368 - DNA, 22 bp, Homo sapiens
ctatgacacaggccattatata

SEQ ID NO: 6895369 - DNA, 22 bp, Homo sapiens
gccctcagcaggaaagatcaac

SEQ ID NO: 6895370 - DNA, 22 bp, Homo sapiens
gtctcccaacccctgtgcccag

SEQ ID NO: 6895371 - DNA, 22 bp, Homo sapiens
tgctcagaaagccaccagagcg

SEQ ID NO: 6895372 - DNA, 22 bp, Homo sapiens
catggcaatttcataaacaggt

SEQ ID NO: 6895373 - DNA, 22 bp, Homo sapiens
agcagtgttttgattctgggag

SEQ ID NO: 6895374 - DNA, 20 bp, Homo sapiens
gggtgtgtgcagggcctggt

SEQ ID NO: 6895375 - DNA, 22 bp, Homo sapiens
tttgttacaaagaaagaagagc

SEQ ID NO: 6895376 - DNA, 22 bp, Homo sapiens
tttcaagtagagggatcgctag

SEQ ID NO: 6895377 - DNA, 22 bp, Homo sapiens
agggaagaatcactgggatgtt

SEQ ID NO: 6895378 - DNA, 22 bp, Homo sapiens
gttattgtgtttgttcagggca

SEQ ID NO: 6895379 - DNA, 22 bp, Homo sapiens
ctaattgtttgtgttgtcacct

SEQ ID NO: 6895380 - DNA, 22 bp, Homo sapiens
atgatggaggtgtcctggattt

SEQ ID NO: 6895381 - DNA, 22 bp, Homo sapiens
gtgggcagttggtgattctcgt

SEQ ID NO: 6895382 - DNA, 22 bp, Homo sapiens
tgttttaagctctagaagggga

SEQ ID NO: 6895383 - DNA, 22 bp, Homo sapiens
aagttaagtagtactctcttca

SEQ ID NO: 6895384 - DNA, 22 bp, Homo sapiens
ggccactccgctgctactggaa

SEQ ID NO: 6895385 - DNA, 22 bp, Homo sapiens
tccatgacagcgtgagagtttg

SEQ ID NO: 6895386 - DNA, 22 bp, Homo sapiens
tatattatcataaaaccattca

SEQ ID NO: 6895387 - DNA, 22 bp, Homo sapiens
tgaaagcactcacttctgctct

SEQ ID NO: 6895388 - DNA, 22 bp, Homo sapiens
tttctctgctgtgttggcagct

SEQ ID NO: 6895389 - DNA, 22 bp, Homo sapiens
aattatttaactcctttggaga

SEQ ID NO: 6895390 - DNA, 22 bp, Homo sapiens
ggtgagggtaaactaaaacatc

SEQ ID NO: 6895391 - DNA, 22 bp, Homo sapiens
ctcagcattcaatgtccagtcc

SEQ ID NO: 6895392 - DNA, 22 bp, Homo sapiens
aaacttcagactccccacttct

SEQ ID NO: 6895393 - DNA, 22 bp, Homo sapiens
agttcaaaaaggtaaagtttat

SEQ ID NO: 6895394 - DNA, 16 bp, Homo sapiens
tgacccttgaccagcc

SEQ ID NO: 6895395 - DNA, 22 bp, Homo sapiens
aaggccagagtactagaggctg

SEQ ID NO: 6895396 - DNA, 22 bp, Homo sapiens
ctgtgctggtccagggagctgg

SEQ ID NO: 6895397 - DNA, 22 bp, Homo sapiens
attctaaagcttgtggagctta

SEQ ID NO: 6895398 - DNA, 22 bp, Homo sapiens
aaggatgcagggacccaaggct

SEQ ID NO: 6895399 - DNA, 22 bp, Homo sapiens
tccagtggtggtttgaagggca

SEQ ID NO: 6895400 - DNA, 22 bp, Homo sapiens
tttgaaagaaaccagtgagtga

SEQ ID NO: 6895401 - DNA, 22 bp, Homo sapiens
tttctggaaccacaaaagtatg

SEQ ID NO: 6895402 - DNA, 22 bp, Homo sapiens
gcagtgtccagggtggtctgca

SEQ ID NO: 6895403 - DNA, 22 bp, Homo sapiens
attgagcagcttctctgccatc

SEQ ID NO: 6895404 - DNA, 20 bp, Homo sapiens
aagtttaggggaaagtgaca

SEQ ID NO: 6895405 - DNA, 22 bp, Homo sapiens
aagcacactcagatattgactc

SEQ ID NO: 6895406 - DNA, 22 bp, Homo sapiens
ttggccaaggaagtagcaacgg

SEQ ID NO: 6895407 - DNA, 22 bp, Homo sapiens
gaggaggtggaattccaggaat

SEQ ID NO: 6895408 - DNA, 22 bp, Homo sapiens
tctcagcagggccatcctgagc

SEQ ID NO: 6895409 - DNA, 22 bp, Homo sapiens
agggaggtaggagcttctagct

SEQ ID NO: 6895410 - DNA, 22 bp, Homo sapiens
atgacagctaaggaatgtgtag

SEQ ID NO: 6895411 - DNA, 22 bp, Homo sapiens
agtgatgtcacaaactatggtg

SEQ ID NO: 6895412 - DNA, 22 bp, Homo sapiens
agcatggcactcaaggctcctg

SEQ ID NO: 6895413 - DNA, 22 bp, Homo sapiens
ttgggtagcagcagggctcgat

SEQ ID NO: 6895414 - DNA, 22 bp, Homo sapiens
tagctttaataagctgctgaat

SEQ ID NO: 6895415 - DNA, 22 bp, Homo sapiens
agtaactctcctttgacatatt

SEQ ID NO: 6895416 - DNA, 22 bp, Homo sapiens
tcacagcctggacagttgcctg

SEQ ID NO: 6895417 - DNA, 23 bp, Homo sapiens
catcattgttatgggtgctacta

SEQ ID NO: 6895418 - DNA, 22 bp, Homo sapiens
tttacagtgagagcttagtgag

SEQ ID NO: 6895419 - DNA, 22 bp, Homo sapiens
gatagagtgttgcctctcaatt

SEQ ID NO: 6895420 - DNA, 22 bp, Homo sapiens
gttcctttgtttagcagagaca

SEQ ID NO: 6895421 - DNA, 22 bp, Homo sapiens
agtgagcatccagagaggtggg

SEQ ID NO: 6895422 - DNA, 22 bp, Homo sapiens
ttcttgaatcactttagagata

SEQ ID NO: 6895423 - DNA, 22 bp, Homo sapiens
aaagcagctttcggccctcggg

SEQ ID NO: 6895424 - DNA, 22 bp, Homo sapiens
tcaggcagctccaggaatggta

SEQ ID NO: 6895425 - DNA, 22 bp, Homo sapiens
gctgtgatgtggagggtgctga

SEQ ID NO: 6895426 - DNA, 22 bp, Homo sapiens
gggcactgggtcttctccacgc

SEQ ID NO: 6895427 - DNA, 22 bp, Homo sapiens
gcacttgggcagagacgcacag

SEQ ID NO: 6895428 - DNA, 22 bp, Homo sapiens
gggagctgaaggagccggcggg

SEQ ID NO: 6895429 - DNA, 22 bp, Homo sapiens
tcatgcaaaagacttgaacttt

SEQ ID NO: 6895430 - DNA, 22 bp, Homo sapiens
tggggtccagtgccaccccaag

SEQ ID NO: 6895431 - DNA, 22 bp, Homo sapiens
tctgtcgtagttaggcaacaac

SEQ ID NO: 6895432 - DNA, 22 bp, Homo sapiens
caaacattccgcttctcccagg

SEQ ID NO: 6895433 - DNA, 22 bp, Homo sapiens
tttccacatcaccatgaggtga

SEQ ID NO: 6895434 - DNA, 22 bp, Homo sapiens
ctccctgagtttgtggctaagt

SEQ ID NO: 6895435 - DNA, 22 bp, Homo sapiens
ggttcagggctaccagtgggtg

SEQ ID NO: 6895436 - DNA, 22 bp, Homo sapiens
aagcagagttagcttgtcacct

SEQ ID NO: 6895437 - DNA, 22 bp, Homo sapiens
ggccctgaagtgattgtgagtt

SEQ ID NO: 6895438 - DNA, 22 bp, Homo sapiens
acctctgaaacttaatctattg

SEQ ID NO: 6895439 - DNA, 22 bp, Homo sapiens
ggacaccggtcctattggatga

SEQ ID NO: 6895440 - DNA, 22 bp, Homo sapiens
tggcttgggagattctcgaact

SEQ ID NO: 6895441 - DNA, 22 bp, Homo sapiens
tggcactgcctggcagggcccc

SEQ ID NO: 6895442 - DNA, 22 bp, Homo sapiens
tcacttgacctcttgaactcct

SEQ ID NO: 6895443 - DNA, 22 bp, Homo sapiens
ttctggttacattgttacagct

SEQ ID NO: 6895444 - DNA, 22 bp, Homo sapiens
ctctttgcctaactgttttcaa

SEQ ID NO: 6895445 - DNA, 22 bp, Homo sapiens
ttgatcaggttgctgtggtgta

SEQ ID NO: 6895446 - DNA, 22 bp, Homo sapiens
ggtctctgtttggggctggcaa

SEQ ID NO: 6895447 - DNA, 22 bp, Homo sapiens
tgctccagggcctccagtgggg

SEQ ID NO: 6895448 - DNA, 22 bp, Homo sapiens
ttcagacacagcgctgggaaat

SEQ ID NO: 6895449 - DNA, 22 bp, Homo sapiens
tgccctggttctgtgggtgagc

SEQ ID NO: 6895450 - DNA, 22 bp, Homo sapiens
aagccttgcagcattaggctct

SEQ ID NO: 6895451 - DNA, 22 bp, Homo sapiens
tcaaggccacagtgagcagagt

SEQ ID NO: 6895452 - DNA, 22 bp, Homo sapiens
ggcttatattgctctattcaca

SEQ ID NO: 6895453 - DNA, 22 bp, Homo sapiens
caggtcagagtccccctgtcct

SEQ ID NO: 6895454 - DNA, 22 bp, Homo sapiens
agaatcctgatgaaaaggagag

SEQ ID NO: 6895455 - DNA, 23 bp, Homo sapiens
agttggcatattcaagcacagtc

SEQ ID NO: 6895456 - DNA, 22 bp, Homo sapiens
tttttgctccacaactttgaag

SEQ ID NO: 6895457 - DNA, 22 bp, Homo sapiens
agtatggggctgtgtgtgcaca

SEQ ID NO: 6895458 - DNA, 22 bp, Homo sapiens
caataaggatttgtggaccaca

SEQ ID NO: 6895459 - DNA, 22 bp, Homo sapiens
agatttgtcttggtctcatctg

SEQ ID NO: 6895460 - DNA, 22 bp, Homo sapiens
acttaaaaacagatccagcagg

SEQ ID NO: 6895461 - DNA, 22 bp, Homo sapiens
ggtggcatggcaaagaaatagc

SEQ ID NO: 6895462 - DNA, 17 bp, Homo sapiens
ctgaggattatggttgt

SEQ ID NO: 6895463 - DNA, 22 bp, Homo sapiens
ccccagcagactcagggcaggt

SEQ ID NO: 6895464 - DNA, 22 bp, Homo sapiens
ttgtgtaaatgtctgtctttct

SEQ ID NO: 6895465 - DNA, 22 bp, Homo sapiens
tttctcctccagagagacacag

SEQ ID NO: 6895466 - DNA, 22 bp, Homo sapiens
aggaggccttggggcttagagc

SEQ ID NO: 6895467 - DNA, 22 bp, Homo sapiens
gttcagcacaggtgctcagaca

SEQ ID NO: 6895468 - DNA, 22 bp, Homo sapiens
gagaggtggaggttgcagtgag

SEQ ID NO: 6895469 - DNA, 22 bp, Homo sapiens
agatgctgcagcctggactgga

SEQ ID NO: 6895470 - DNA, 22 bp, Homo sapiens
ataaaatcagagttggattgga

SEQ ID NO: 6895471 - DNA, 23 bp, Homo sapiens
atgcaagagtttctcaaactgga

SEQ ID NO: 6895472 - DNA, 22 bp, Homo sapiens
ctgcacagccctcaagagcctg

SEQ ID NO: 6895473 - DNA, 23 bp, Homo sapiens
ttttagtgactcctttatctgcc

SEQ ID NO: 6895474 - DNA, 22 bp, Homo sapiens
aaagtacagggttgtggggtga

SEQ ID NO: 6895475 - DNA, 22 bp, Homo sapiens
tccaatcaattgttctacctga

SEQ ID NO: 6895476 - DNA, 22 bp, Homo sapiens
tagtacagtactgggctctagt

SEQ ID NO: 6895477 - DNA, 22 bp, Homo sapiens
ctgaagcttgataaactataaa

SEQ ID NO: 6895478 - DNA, 22 bp, Homo sapiens
ttgcaccaaatgagttaaaatt

SEQ ID NO: 6895479 - DNA, 22 bp, Homo sapiens
tgcagccatctttcttggagga

SEQ ID NO: 6895480 - DNA, 20 bp, Homo sapiens
ctgagaactatgactgtctt

SEQ ID NO: 6895481 - DNA, 22 bp, Homo sapiens
atctgtggaaaggtaaccagta

SEQ ID NO: 6895482 - DNA, 22 bp, Homo sapiens
tgtcacagtctcgtgagcatct

SEQ ID NO: 6895483 - DNA, 22 bp, Homo sapiens
tttctaaggccagagactgctg

SEQ ID NO: 6895484 - DNA, 22 bp, Homo sapiens
gtctagggctcctcagtgacaa

SEQ ID NO: 6895485 - DNA, 20 bp, Homo sapiens
tgtccaggggatcgttggcc

SEQ ID NO: 6895486 - DNA, 22 bp, Homo sapiens
ggttctaggtctggggataatg

SEQ ID NO: 6895487 - DNA, 22 bp, Homo sapiens
cttactgcagcagcccatggac

SEQ ID NO: 6895488 - DNA, 22 bp, Homo sapiens
aatgtgtagtcattgatcaaga

SEQ ID NO: 6895489 - DNA, 22 bp, Homo sapiens
tctgaaagggctaaataatttg

SEQ ID NO: 6895490 - DNA, 22 bp, Homo sapiens
tattacaatttacattgcactt

SEQ ID NO: 6895491 - DNA, 22 bp, Homo sapiens
gaggcccagagaggttgcatga

SEQ ID NO: 6895492 - DNA, 22 bp, Homo sapiens
gtgacagagattaatagcttgg

SEQ ID NO: 6895493 - DNA, 22 bp, Homo sapiens
aaggacaagtagtatttgcatc

SEQ ID NO: 6895494 - DNA, 16 bp, Homo sapiens
aggccaaaaaggggca

SEQ ID NO: 6895495 - DNA, 22 bp, Homo sapiens
ctggtttaaaattactggttaa

SEQ ID NO: 6895496 - DNA, 22 bp, Homo sapiens
gttcttccctttggggattgtg

SEQ ID NO: 6895497 - DNA, 18 bp, Homo sapiens
tgtcactctggagcccag

SEQ ID NO: 6895498 - DNA, 17 bp, Homo sapiens
tctcaggggctagccct

SEQ ID NO: 6895499 - DNA, 22 bp, Homo sapiens
tgggcttctggagtggggcaga

SEQ ID NO: 6895500 - DNA, 22 bp, Homo sapiens
ttggcacagccacttctgctgc

SEQ ID NO: 6895501 - DNA, 22 bp, Homo sapiens
agggcccaccttggtgctgagg

SEQ ID NO: 6895502 - DNA, 22 bp, Homo sapiens
catgcactctttgagaaggatg

SEQ ID NO: 6895503 - DNA, 22 bp, Homo sapiens
acaagtctcaacagcagccagc

SEQ ID NO: 6895504 - DNA, 22 bp, Homo sapiens
gtgacagggggcttggtttcta

SEQ ID NO: 6895505 - DNA, 22 bp, Homo sapiens
aaagttctttctcttatttggt

SEQ ID NO: 6895506 - DNA, 22 bp, Homo sapiens
agcatagtatgataagtgacaa

SEQ ID NO: 6895507 - DNA, 22 bp, Homo sapiens
ctcattagacaggtatacttta

SEQ ID NO: 6895508 - DNA, 21 bp, Homo sapiens
tcagtcctgttagcctttggg

SEQ ID NO: 6895509 - DNA, 21 bp, Homo sapiens
aaagaatcatgggtaatttca

SEQ ID NO: 6895510 - DNA, 17 bp, Homo sapiens
ttaaaggatgctctctc

SEQ ID NO: 6895511 - DNA, 22 bp, Homo sapiens
ggtgcatggaaagagtaagtaa

SEQ ID NO: 6895512 - DNA, 22 bp, Homo sapiens
catgcagatttgctgagataat

SEQ ID NO: 6895513 - DNA, 22 bp, Homo sapiens
acactataagacagatacagca

SEQ ID NO: 6895514 - DNA, 21 bp, Homo sapiens
tctataactatagtgacagat

SEQ ID NO: 6895515 - DNA, 22 bp, Homo sapiens
atggtcttagggtaggcagctg

SEQ ID NO: 6895516 - DNA, 22 bp, Homo sapiens
tcaatatagcagtgtacttgag

SEQ ID NO: 6895517 - DNA, 22 bp, Homo sapiens
ctaaacaatgaacaaagcactg

SEQ ID NO: 6895518 - DNA, 22 bp, Homo sapiens
agtgcattcagtattcataggc

SEQ ID NO: 6895519 - DNA, 22 bp, Homo sapiens
aagaagttaaataaatggacca

SEQ ID NO: 6895520 - DNA, 22 bp, Homo sapiens
cagtcatccaggaaatgtatcc

SEQ ID NO: 6895521 - DNA, 22 bp, Homo sapiens
caggtgctcccagagaagtgct

SEQ ID NO: 6895522 - DNA, 22 bp, Homo sapiens
atggctccagctggtagagatt

SEQ ID NO: 6895523 - DNA, 22 bp, Homo sapiens
tgctttaaagtatttctcgcaa

SEQ ID NO: 6895524 - DNA, 19 bp, Homo sapiens
tcacttgaagttcagaaat

SEQ ID NO: 6895525 - DNA, 22 bp, Homo sapiens
gcagagcaccaaagtgaaagat

SEQ ID NO: 6895526 - DNA, 22 bp, Homo sapiens
gtgctcattttgtaatgtaact

SEQ ID NO: 6895527 - DNA, 22 bp, Homo sapiens
cccctcattacaggcggggagc

SEQ ID NO: 6895528 - DNA, 22 bp, Homo sapiens
ggttttgcaaatgagctaatga

SEQ ID NO: 6895529 - DNA, 22 bp, Homo sapiens
aatgaccagcgcctgcagaggg

SEQ ID NO: 6895530 - DNA, 22 bp, Homo sapiens
ctgaagaggactgggttggagg

SEQ ID NO: 6895531 - DNA, 22 bp, Homo sapiens
tgtgaggaacccggaatgtggg

SEQ ID NO: 6895532 - DNA, 22 bp, Homo sapiens
tgtgccaagatcaaacttttct

SEQ ID NO: 6895533 - DNA, 22 bp, Homo sapiens
tagtttaggtggggtagacaga

SEQ ID NO: 6895534 - DNA, 22 bp, Homo sapiens
gatccttacagttagacgttgg

SEQ ID NO: 6895535 - DNA, 22 bp, Homo sapiens
tacatgtggagataactgaagc

SEQ ID NO: 6895536 - DNA, 23 bp, Homo sapiens
cttctggctctatatcagaattc

SEQ ID NO: 6895537 - DNA, 22 bp, Homo sapiens
aggaggaaggcttcattaggtt

SEQ ID NO: 6895538 - DNA, 22 bp, Homo sapiens
agagggatggccccgtaactca

SEQ ID NO: 6895539 - DNA, 22 bp, Homo sapiens
tcctgagcacctatgccatggc

SEQ ID NO: 6895540 - DNA, 22 bp, Homo sapiens
ggagtgcagtggcgtgatctca

SEQ ID NO: 6895541 - DNA, 18 bp, Homo sapiens
cggcagagtgcttctagc

SEQ ID NO: 6895542 - DNA, 22 bp, Homo sapiens
gcagcatattgtactggcctgc

SEQ ID NO: 6895543 - DNA, 22 bp, Homo sapiens
ggatctgagagcaagcaggacc

SEQ ID NO: 6895544 - DNA, 22 bp, Homo sapiens
aggcaccaggttgtggtttgtc

SEQ ID NO: 6895545 - DNA, 18 bp, Homo sapiens
gcatttggtgagtttggc

SEQ ID NO: 6895546 - DNA, 22 bp, Homo sapiens
ctggccaggaggtaaccagatg

SEQ ID NO: 6895547 - DNA, 19 bp, Homo sapiens
gccctcctcactgagctct

SEQ ID NO: 6895548 - DNA, 22 bp, Homo sapiens
tgtatttttagacctttagacc

SEQ ID NO: 6895549 - DNA, 19 bp, Homo sapiens
agcagtggagccatgcctg

SEQ ID NO: 6895550 - DNA, 22 bp, Homo sapiens
aaggcagtggttgggtggagga

SEQ ID NO: 6895551 - DNA, 22 bp, Homo sapiens
ctggtccagtggatgctgaggg

SEQ ID NO: 6895552 - DNA, 22 bp, Homo sapiens
ttctgctatacttatgaataca

SEQ ID NO: 6895553 - DNA, 22 bp, Homo sapiens
gtccacaaaattactatcttac

SEQ ID NO: 6895554 - DNA, 22 bp, Homo sapiens
ctcctcctcaaattagcttttg

SEQ ID NO: 6895555 - DNA, 22 bp, Homo sapiens
tttgcacttaacttatttgaaa

SEQ ID NO: 6895556 - DNA, 22 bp, Homo sapiens
gtgtcactggaatactgtctgt

SEQ ID NO: 6895557 - DNA, 22 bp, Homo sapiens
agcttctctctttgcactcaca

SEQ ID NO: 6895558 - DNA, 22 bp, Homo sapiens
gccatcacatccaggctacctc

SEQ ID NO: 6895559 - DNA, 22 bp, Homo sapiens
tgcaaataggggacaactcttt

SEQ ID NO: 6895560 - DNA, 22 bp, Homo sapiens
gggagagatgctgattgccaat

SEQ ID NO: 6895561 - DNA, 22 bp, Homo sapiens
aagttcaagagtgacatattag

SEQ ID NO: 6895562 - DNA, 18 bp, Homo sapiens
tcagcctgttgtctgcct

SEQ ID NO: 6895563 - DNA, 22 bp, Homo sapiens
cgggcaccaccctggtgtgtcc

SEQ ID NO: 6895564 - DNA, 22 bp, Homo sapiens
gttggttagatttcctcacttt

SEQ ID NO: 6895565 - DNA, 20 bp, Homo sapiens
tgttgattggtgtcatctca

SEQ ID NO: 6895566 - DNA, 22 bp, Homo sapiens
gctctctggctagtccatcggg

SEQ ID NO: 6895567 - DNA, 22 bp, Homo sapiens
aggtgtggctggggcagaggcc

SEQ ID NO: 6895568 - DNA, 23 bp, Homo sapiens
cctgggtttcagagctgcttttc

SEQ ID NO: 6895569 - DNA, 22 bp, Homo sapiens
tcacccagatagtgagcatagt

SEQ ID NO: 6895570 - DNA, 22 bp, Homo sapiens
aggagctgctttggtgcggttt

SEQ ID NO: 6895571 - DNA, 20 bp, Homo sapiens
gttcccaggaattgaagacc

SEQ ID NO: 6895572 - DNA, 20 bp, Homo sapiens
tgggactgacccatctgagc

SEQ ID NO: 6895573 - DNA, 22 bp, Homo sapiens
tgcaaacatcaatggcctgagc

SEQ ID NO: 6895574 - DNA, 22 bp, Homo sapiens
tttatctgttcctcttggaggc

SEQ ID NO: 6895575 - DNA, 22 bp, Homo sapiens
tagcagtgtctaggtaggccat

SEQ ID NO: 6895576 - DNA, 22 bp, Homo sapiens
cagaccctgggccacagaggag

SEQ ID NO: 6895577 - DNA, 22 bp, Homo sapiens
aagctgaggatacatgaagcct

SEQ ID NO: 6895578 - DNA, 22 bp, Homo sapiens
aatatttatatttctcttccct

SEQ ID NO: 6895579 - DNA, 22 bp, Homo sapiens
agcgttattcttagcctggaga

SEQ ID NO: 6895580 - DNA, 22 bp, Homo sapiens
gcttagtgtaggacctggaata

SEQ ID NO: 6895581 - DNA, 22 bp, Homo sapiens
tccttgaatcctagcatcctat

SEQ ID NO: 6895582 - DNA, 22 bp, Homo sapiens
ctgttgctgggaacgcatgtca

SEQ ID NO: 6895583 - DNA, 21 bp, Homo sapiens
cctttgagtgtgtttgaagta

SEQ ID NO: 6895584 - DNA, 22 bp, Homo sapiens
gccggccagcaagcttcaggtg

SEQ ID NO: 6895585 - DNA, 22 bp, Homo sapiens
tattgaaattcttcatgtcctc

SEQ ID NO: 6895586 - DNA, 22 bp, Homo sapiens
ctgaaggagcatagtcagtttt

SEQ ID NO: 6895587 - DNA, 22 bp, Homo sapiens
cagttaccagatcgcaggaggt

SEQ ID NO: 6895588 - DNA, 22 bp, Homo sapiens
ttattcaggtcatggactgtca

SEQ ID NO: 6895589 - DNA, 22 bp, Homo sapiens
gaaaagttcatcatatattcag

SEQ ID NO: 6895590 - DNA, 22 bp, Homo sapiens
gctgtgtatcagatgccacggg

SEQ ID NO: 6895591 - DNA, 22 bp, Homo sapiens
tatgcagggtgggttctctgag

SEQ ID NO: 6895592 - DNA, 22 bp, Homo sapiens
tttatccagcagctattcaaaa

SEQ ID NO: 6895593 - DNA, 21 bp, Homo sapiens
tacattgactacaaataaagc

SEQ ID NO: 6895594 - DNA, 22 bp, Homo sapiens
tcaaggcacttcatgtctcagt

SEQ ID NO: 6895595 - DNA, 22 bp, Homo sapiens
aaacagcaattacttttgcacc

SEQ ID NO: 6895596 - DNA, 22 bp, Homo sapiens
ttccttccatagcaaaacatgc

SEQ ID NO: 6895597 - DNA, 22 bp, Homo sapiens
aagctgaggcccatggcaaggt

SEQ ID NO: 6895598 - DNA, 22 bp, Homo sapiens
ctgctttaagtattcaacaaag

SEQ ID NO: 6895599 - DNA, 22 bp, Homo sapiens
atattagcagtgatcaaaatgg

SEQ ID NO: 6895600 - DNA, 22 bp, Homo sapiens
aattacagtcggagcagcactg

SEQ ID NO: 6895601 - DNA, 22 bp, Homo sapiens
ttgtgcttgccctggaggtgcg

SEQ ID NO: 6895602 - DNA, 22 bp, Homo sapiens
ttacaggggtgtggaggcaatc

SEQ ID NO: 6895603 - DNA, 22 bp, Homo sapiens
ttgtatgctgtaggcatgcatt

SEQ ID NO: 6895604 - DNA, 22 bp, Homo sapiens
ctgaatgcttgcctttggctaa

SEQ ID NO: 6895605 - DNA, 22 bp, Homo sapiens
tttgctttgactgtcagcaagt

SEQ ID NO: 6895606 - DNA, 22 bp, Homo sapiens
ctcctttgatcccaaatgaccc

SEQ ID NO: 6895607 - DNA, 21 bp, Homo sapiens
tcagctttgcaactgcacatc

SEQ ID NO: 6895608 - DNA, 22 bp, Homo sapiens
tatgtcactcggctcggcccac

SEQ ID NO: 6895609 - DNA, 22 bp, Homo sapiens
aggggagccgaggggcatctgt

SEQ ID NO: 6895610 - DNA, 22 bp, Homo sapiens
catctgccactctctcccacca

SEQ ID NO: 6895611 - DNA, 22 bp, Homo sapiens
tatgcagtgtatgcactgagat

SEQ ID NO: 6895612 - DNA, 16 bp, Homo sapiens
gttgactctttctctt

SEQ ID NO: 6895613 - DNA, 22 bp, Homo sapiens
taacagagtgaaaatcagcaca

SEQ ID NO: 6895614 - DNA, 22 bp, Homo sapiens
taaggccagcatgaatgcagca

SEQ ID NO: 6895615 - DNA, 22 bp, Homo sapiens
aggacctgaaattcttgctttt

SEQ ID NO: 6895616 - DNA, 20 bp, Homo sapiens
aggctgccaggtctcacatc

SEQ ID NO: 6895617 - DNA, 22 bp, Homo sapiens
ggggaggcaagatgaagtgagg

SEQ ID NO: 6895618 - DNA, 22 bp, Homo sapiens
atccatttctatcttgctgagg

SEQ ID NO: 6895619 - DNA, 23 bp, Homo sapiens
gccaggctccggtctgtggccac

SEQ ID NO: 6895620 - DNA, 22 bp, Homo sapiens
agttgtcacttcaagcaagtgt

SEQ ID NO: 6895621 - DNA, 22 bp, Homo sapiens
gagctggccgcagagagggcag

SEQ ID NO: 6895622 - DNA, 22 bp, Homo sapiens
aggaggctgtggagcactccat

SEQ ID NO: 6895623 - DNA, 22 bp, Homo sapiens
gtcacacttctttctgtgtctc

SEQ ID NO: 6895624 - DNA, 23 bp, Homo sapiens
agaattgtaaatagaatatacct

SEQ ID NO: 6895625 - DNA, 22 bp, Homo sapiens
gactctttccctgtgacagagt

SEQ ID NO: 6895626 - DNA, 22 bp, Homo sapiens
acgatgtggcctgaatcaggca

SEQ ID NO: 6895627 - DNA, 22 bp, Homo sapiens
ggactgggtaggagcccagggc

SEQ ID NO: 6895628 - DNA, 22 bp, Homo sapiens
tacactggccaaatgcctttgg

SEQ ID NO: 6895629 - DNA, 22 bp, Homo sapiens
aatgatccttgttgtttaacca

SEQ ID NO: 6895630 - DNA, 22 bp, Homo sapiens
aagtttgcgtgtcctatttgat

SEQ ID NO: 6895631 - DNA, 22 bp, Homo sapiens
ccttagcagggagtctgtccag

SEQ ID NO: 6895632 - DNA, 22 bp, Homo sapiens
cttagctgcgggccctcctcgc

SEQ ID NO: 6895633 - DNA, 22 bp, Homo sapiens
aggacttgtttaaagtttgtgc

SEQ ID NO: 6895634 - DNA, 23 bp, Homo sapiens
aaatgtcttctagctcttgagaa

SEQ ID NO: 6895635 - DNA, 23 bp, Homo sapiens
gcagttagtccactttgcagaga

SEQ ID NO: 6895636 - DNA, 22 bp, Homo sapiens
gacagcaacctcatgagaaact

SEQ ID NO: 6895637 - DNA, 22 bp, Homo sapiens
agctcctatgagaaatatctgt

SEQ ID NO: 6895638 - DNA, 17 bp, Homo sapiens
gccaggaggtttgagct

SEQ ID NO: 6895639 - DNA, 22 bp, Homo sapiens
ttgctaaatgtgttatatctgt

SEQ ID NO: 6895640 - DNA, 22 bp, Homo sapiens
aggcttcttgataaaatgcaga

SEQ ID NO: 6895641 - DNA, 22 bp, Homo sapiens
gtctgaatacgtacttgtgaag

SEQ ID NO: 6895642 - DNA, 22 bp, Homo sapiens
caggggagtgagtccctctctg

SEQ ID NO: 6895643 - DNA, 22 bp, Homo sapiens
acagagtctcagggatgaaagc

SEQ ID NO: 6895644 - DNA, 22 bp, Homo sapiens
tgcccacaggaagacaccagcg

SEQ ID NO: 6895645 - DNA, 22 bp, Homo sapiens
catgtgtccacccttgaacaca

SEQ ID NO: 6895646 - DNA, 21 bp, Homo sapiens
tatgcagtttacttaggtatt

SEQ ID NO: 6895647 - DNA, 22 bp, Homo sapiens
tgccatcctgtgtcatgctcat

SEQ ID NO: 6895648 - DNA, 22 bp, Homo sapiens
tcagctggtgccactcagtcaa

SEQ ID NO: 6895649 - DNA, 22 bp, Homo sapiens
taacatcaaactgcattttcta

SEQ ID NO: 6895650 - DNA, 20 bp, Homo sapiens
aggtataagaaatgtgattt

SEQ ID NO: 6895651 - DNA, 22 bp, Homo sapiens
tttggagttgttatggttatat

SEQ ID NO: 6895652 - DNA, 22 bp, Homo sapiens
ttggagagatttaggtctcagt

SEQ ID NO: 6895653 - DNA, 22 bp, Homo sapiens
tagcacatacataatagataga

SEQ ID NO: 6895654 - DNA, 22 bp, Homo sapiens
tcactctgtggcccaggcagtg

SEQ ID NO: 6895655 - DNA, 22 bp, Homo sapiens
gtgtaaacaacagtggtttgaa

SEQ ID NO: 6895656 - DNA, 19 bp, Homo sapiens
ctgtgggcggaggaggggc

SEQ ID NO: 6895657 - DNA, 22 bp, Homo sapiens
cagcttctgctcatggaggggt

SEQ ID NO: 6895658 - DNA, 22 bp, Homo sapiens
ggggactctgcttctgggatca

SEQ ID NO: 6895659 - DNA, 22 bp, Homo sapiens
tcacagcaaaagtgtgcagagc

SEQ ID NO: 6895660 - DNA, 22 bp, Homo sapiens
ccaggagcctgggccaggctgg

SEQ ID NO: 6895661 - DNA, 19 bp, Homo sapiens
taaggcagcagtgacaggc

SEQ ID NO: 6895662 - DNA, 22 bp, Homo sapiens
tagcagagaggtttcagctaat

SEQ ID NO: 6895663 - DNA, 22 bp, Homo sapiens
gaatgagggagatgttggtgca

SEQ ID NO: 6895664 - DNA, 22 bp, Homo sapiens
tgcattcctttagcagatttga

SEQ ID NO: 6895665 - DNA, 22 bp, Homo sapiens
ctgcagaaatatggatgtgata

SEQ ID NO: 6895666 - DNA, 22 bp, Homo sapiens
gagctgtttttccaaactattg

SEQ ID NO: 6895667 - DNA, 22 bp, Homo sapiens
ggcctggagaaggcccagggag

SEQ ID NO: 6895668 - DNA, 22 bp, Homo sapiens
taattacaaagcaagcacaggg

SEQ ID NO: 6895669 - DNA, 22 bp, Homo sapiens
aagagttttctataatcttggc

SEQ ID NO: 6895670 - DNA, 22 bp, Homo sapiens
atagaaacagaggtcaggcatt

SEQ ID NO: 6895671 - DNA, 22 bp, Homo sapiens
ctgtgcaaaggccttatgtttt

SEQ ID NO: 6895672 - DNA, 20 bp, Homo sapiens
gccctctgcctccctcagcg

SEQ ID NO: 6895673 - DNA, 22 bp, Homo sapiens
taaggcataaggccagaggcta

SEQ ID NO: 6895674 - DNA, 22 bp, Homo sapiens
tttctggcagcgggacaggggt

SEQ ID NO: 6895675 - DNA, 22 bp, Homo sapiens
ttcctgttagccattattagct

SEQ ID NO: 6895676 - DNA, 22 bp, Homo sapiens
agggatgctgtgatacatcctt

SEQ ID NO: 6895677 - DNA, 22 bp, Homo sapiens
ctctgtcctggtttatactggc

SEQ ID NO: 6895678 - DNA, 22 bp, Homo sapiens
gcagacatcacctcagtgctat

SEQ ID NO: 6895679 - DNA, 22 bp, Homo sapiens
tcacagttttagaaaatagata

SEQ ID NO: 6895680 - DNA, 17 bp, Homo sapiens
gggctgacagtggcctc

SEQ ID NO: 6895681 - DNA, 22 bp, Homo sapiens
caccatttagtagcaagagctc

SEQ ID NO: 6895682 - DNA, 22 bp, Homo sapiens
aaagttaggtgtggatttctca

SEQ ID NO: 6895683 - DNA, 22 bp, Homo sapiens
ttctgagcacgttcatttaaat

SEQ ID NO: 6895684 - DNA, 17 bp, Homo sapiens
ttcaatgattaatgcat

SEQ ID NO: 6895685 - DNA, 22 bp, Homo sapiens
tcctggcaaagcaagttatgaa

SEQ ID NO: 6895686 - DNA, 22 bp, Homo sapiens
aagattcccagagaagttccac

SEQ ID NO: 6895687 - DNA, 22 bp, Homo sapiens
gaggccagcccctcttgaaggc

SEQ ID NO: 6895688 - DNA, 22 bp, Homo sapiens
aggatatccctacacatcactg

SEQ ID NO: 6895689 - DNA, 22 bp, Homo sapiens
gatcttctttctctgtagaggt

SEQ ID NO: 6895690 - DNA, 22 bp, Homo sapiens
tcacccatgtgtctcccttata

SEQ ID NO: 6895691 - DNA, 22 bp, Homo sapiens
tttcacagaactcactaaggag

SEQ ID NO: 6895692 - DNA, 22 bp, Homo sapiens
cttgtcacagcacctcagtctc

SEQ ID NO: 6895693 - DNA, 22 bp, Homo sapiens
gctctggtggtgatcagacgct

SEQ ID NO: 6895694 - DNA, 22 bp, Homo sapiens
ttgtatcagtgcctataaaatg

SEQ ID NO: 6895695 - DNA, 22 bp, Homo sapiens
gaggagctgatatttataatga

SEQ ID NO: 6895696 - DNA, 22 bp, Homo sapiens
tatgctgaatttggtttgctat

SEQ ID NO: 6895697 - DNA, 22 bp, Homo sapiens
tactgaggtactttacttataa

SEQ ID NO: 6895698 - DNA, 23 bp, Homo sapiens
tcctggtgacatgcctgagcatc

SEQ ID NO: 6895699 - DNA, 22 bp, Homo sapiens
tctgtagtaggttgtagttctt

SEQ ID NO: 6895700 - DNA, 22 bp, Homo sapiens
ttggctgctgggaactcaaaca

SEQ ID NO: 6895701 - DNA, 22 bp, Homo sapiens
ttcagttccttatcatagggtt

SEQ ID NO: 6895702 - DNA, 22 bp, Homo sapiens
ggtgtcagtgctgcggacgtca

SEQ ID NO: 6895703 - DNA, 21 bp, Homo sapiens
actcatttgtctgcatctaat

SEQ ID NO: 6895704 - DNA, 22 bp, Homo sapiens
gacagcaggatgtgaggggatg

SEQ ID NO: 6895705 - DNA, 22 bp, Homo sapiens
atgcatgtattatctagatgag

SEQ ID NO: 6895706 - DNA, 22 bp, Homo sapiens
taggctgagcttgtagatcgta

SEQ ID NO: 6895707 - DNA, 20 bp, Homo sapiens
atcagaggatagggaagtgg

SEQ ID NO: 6895708 - DNA, 22 bp, Homo sapiens
gcccttggcctctttggcccgg

SEQ ID NO: 6895709 - DNA, 22 bp, Homo sapiens
agaagaaatgaggccgttctgc

SEQ ID NO: 6895710 - DNA, 22 bp, Homo sapiens
gagaagcaatttccaactgtgc

SEQ ID NO: 6895711 - DNA, 22 bp, Homo sapiens
cgctgtgcctggcacccagtgt

SEQ ID NO: 6895712 - DNA, 22 bp, Homo sapiens
ggcttcaccaggtgcatgcatg

SEQ ID NO: 6895713 - DNA, 22 bp, Homo sapiens
cagcaacatatatgaaactgtg

SEQ ID NO: 6895714 - DNA, 21 bp, Homo sapiens
tctatctctagtccgctgcac

SEQ ID NO: 6895715 - DNA, 22 bp, Homo sapiens
attctctctagaagctgagatg

SEQ ID NO: 6895716 - DNA, 20 bp, Homo sapiens
aggcatgtcccagtttctcc

SEQ ID NO: 6895717 - DNA, 22 bp, Homo sapiens
acagtctacttgagcttgtata

SEQ ID NO: 6895718 - DNA, 22 bp, Homo sapiens
atatggaatggtaatctacaat

SEQ ID NO: 6895719 - DNA, 22 bp, Homo sapiens
ctaggccttcataggcatggaa

SEQ ID NO: 6895720 - DNA, 22 bp, Homo sapiens
tctttgtaagacatgtaagtcc

SEQ ID NO: 6895721 - DNA, 22 bp, Homo sapiens
ccgctcctgaagagcctccccg

SEQ ID NO: 6895722 - DNA, 22 bp, Homo sapiens
tacaatacttaacctattttgc

SEQ ID NO: 6895723 - DNA, 22 bp, Homo sapiens
aagttggtaggagacagaaggt

SEQ ID NO: 6895724 - DNA, 22 bp, Homo sapiens
tcttaattctgtgtcttcacta

SEQ ID NO: 6895725 - DNA, 22 bp, Homo sapiens
gcagagctgagcggctgcccgg

SEQ ID NO: 6895726 - DNA, 22 bp, Homo sapiens
gctccagggagtacatttatca

SEQ ID NO: 6895727 - DNA, 22 bp, Homo sapiens
gacctttcaaatgtttacatga

SEQ ID NO: 6895728 - DNA, 23 bp, Homo sapiens
tggcaaggaatgggatggagact

SEQ ID NO: 6895729 - DNA, 22 bp, Homo sapiens
aagaaggcttcagagcccagga

SEQ ID NO: 6895730 - DNA, 22 bp, Homo sapiens
ctgaggtacctggagcaggtcc

SEQ ID NO: 6895731 - DNA, 22 bp, Homo sapiens
ctgagggtgctattcttgcctt

SEQ ID NO: 6895732 - DNA, 22 bp, Homo sapiens
tcagaaaagagaaaatcttata

SEQ ID NO: 6895733 - DNA, 22 bp, Homo sapiens
gcaccgagaaggaagcatgcct

SEQ ID NO: 6895734 - DNA, 22 bp, Homo sapiens
ctatggctgtgttcatgctaca

SEQ ID NO: 6895735 - DNA, 22 bp, Homo sapiens
cctttggggctttactgtggaa

SEQ ID NO: 6895736 - DNA, 22 bp, Homo sapiens
caggtgttaatcacttttaagc

SEQ ID NO: 6895737 - DNA, 22 bp, Homo sapiens
gcagaggccatcaactttgcca

SEQ ID NO: 6895738 - DNA, 20 bp, Homo sapiens
agatacagtttaattactct

SEQ ID NO: 6895739 - DNA, 22 bp, Homo sapiens
tttgtgtaccttgtacatttgt

SEQ ID NO: 6895740 - DNA, 22 bp, Homo sapiens
tgccatattattgagcatatta

SEQ ID NO: 6895741 - DNA, 22 bp, Homo sapiens
tctgatctgtgccttaggcctg

SEQ ID NO: 6895742 - DNA, 22 bp, Homo sapiens
ggtcattgttcttttctgtgat

SEQ ID NO: 6895743 - DNA, 22 bp, Homo sapiens
ctacaccggagcctggaaggta

SEQ ID NO: 6895744 - DNA, 22 bp, Homo sapiens
gagcttaatagtcatgctttct

SEQ ID NO: 6895745 - DNA, 22 bp, Homo sapiens
gagggagtgctttctgatagtt

SEQ ID NO: 6895746 - DNA, 22 bp, Homo sapiens
ggtggggattcctgatcactgt

SEQ ID NO: 6895747 - DNA, 22 bp, Homo sapiens
gaaacgttggcataagtttatg

SEQ ID NO: 6895748 - DNA, 22 bp, Homo sapiens
aggagggagcactatatgggga

SEQ ID NO: 6895749 - DNA, 20 bp, Homo sapiens
gagatgcaagtgtatctgac

SEQ ID NO: 6895750 - DNA, 22 bp, Homo sapiens
ggtctggaccatggacgccggg

SEQ ID NO: 6895751 - DNA, 22 bp, Homo sapiens
aggcagcattcaggggtgatga

SEQ ID NO: 6895752 - DNA, 22 bp, Homo sapiens
tcacagactcaagggcatagga

SEQ ID NO: 6895753 - DNA, 16 bp, Homo sapiens
gatgagtcttagtggt

SEQ ID NO: 6895754 - DNA, 22 bp, Homo sapiens
aacaggagagtaaatatatgat

SEQ ID NO: 6895755 - DNA, 22 bp, Homo sapiens
tgttttgtctaatagggcaggt

SEQ ID NO: 6895756 - DNA, 22 bp, Homo sapiens
ctttcaggttctataggaagcc

SEQ ID NO: 6895757 - DNA, 22 bp, Homo sapiens
agagggcccatgttgggctgct

SEQ ID NO: 6895758 - DNA, 23 bp, Homo sapiens
ttgcagggatggagttcaaaatg

SEQ ID NO: 6895759 - DNA, 22 bp, Homo sapiens
caggtgacatcaacaggaccac

SEQ ID NO: 6895760 - DNA, 22 bp, Homo sapiens
gatggcttcacttacatggctg

SEQ ID NO: 6895761 - DNA, 22 bp, Homo sapiens
cagctgagtggaccctagaggc

SEQ ID NO: 6895762 - DNA, 22 bp, Homo sapiens
tcataaattagctgtctttgaa

SEQ ID NO: 6895763 - DNA, 22 bp, Homo sapiens
gagctttggggaagaatacaga

SEQ ID NO: 6895764 - DNA, 22 bp, Homo sapiens
actgattacacgagttctgact

SEQ ID NO: 6895765 - DNA, 22 bp, Homo sapiens
tactagaatgccactgttagtg

SEQ ID NO: 6895766 - DNA, 22 bp, Homo sapiens
ttgtatgtttctgtgcacatga

SEQ ID NO: 6895767 - DNA, 20 bp, Homo sapiens
tgtgtgcacacatgacattc

SEQ ID NO: 6895768 - DNA, 22 bp, Homo sapiens
tgttcattttgaagtacttcaa

SEQ ID NO: 6895769 - DNA, 22 bp, Homo sapiens
ctgtgtgcaggtgctgggtacc

SEQ ID NO: 6895770 - DNA, 22 bp, Homo sapiens
catgacacccaggcatagcacc

SEQ ID NO: 6895771 - DNA, 22 bp, Homo sapiens
ccaggtgtagcactgctcacag

SEQ ID NO: 6895772 - DNA, 21 bp, Homo sapiens
cccaggctgaattaaaaatat

SEQ ID NO: 6895773 - DNA, 17 bp, Homo sapiens
ccagatgtgtaggtcgt

SEQ ID NO: 6895774 - DNA, 22 bp, Homo sapiens
agacattttaacatctgggttt

SEQ ID NO: 6895775 - DNA, 22 bp, Homo sapiens
tccttcttccctggtttgcatc

SEQ ID NO: 6895776 - DNA, 22 bp, Homo sapiens
tctgcccaggaggtcccatggg

SEQ ID NO: 6895777 - DNA, 22 bp, Homo sapiens
tggcagctagatagtgtgttta

SEQ ID NO: 6895778 - DNA, 22 bp, Homo sapiens
tcagcaggctgtcagcaggggc

SEQ ID NO: 6895779 - DNA, 22 bp, Homo sapiens
actacaaaagcactgggtatta

SEQ ID NO: 6895780 - DNA, 22 bp, Homo sapiens
acatgcatacaagcacatgtag

SEQ ID NO: 6895781 - DNA, 22 bp, Homo sapiens
gctggcctcatcactgacttct

SEQ ID NO: 6895782 - DNA, 22 bp, Homo sapiens
cctgtgggaaaggtctgctctc

SEQ ID NO: 6895783 - DNA, 22 bp, Homo sapiens
agggcagcctctcagcctaggt

SEQ ID NO: 6895784 - DNA, 22 bp, Homo sapiens
ctattttaagaggccattaggt

SEQ ID NO: 6895785 - DNA, 22 bp, Homo sapiens
ttggctgctaatggctgacagc

SEQ ID NO: 6895786 - DNA, 22 bp, Homo sapiens
cagcaggatttgaaaggaagag

SEQ ID NO: 6895787 - DNA, 22 bp, Homo sapiens
gagctggtgtgtgcccgagcac

SEQ ID NO: 6895788 - DNA, 22 bp, Homo sapiens
tttacagaagagaaggatgctt

SEQ ID NO: 6895789 - DNA, 22 bp, Homo sapiens
gtctggtacacaaaaggtacaa

SEQ ID NO: 6895790 - DNA, 22 bp, Homo sapiens
agtccctttagtctggagagct

SEQ ID NO: 6895791 - DNA, 22 bp, Homo sapiens
acatgctagactttctttatga

SEQ ID NO: 6895792 - DNA, 22 bp, Homo sapiens
gctcacagtctggcatagtctc

SEQ ID NO: 6895793 - DNA, 22 bp, Homo sapiens
gctctggagagccataggccct

SEQ ID NO: 6895794 - DNA, 22 bp, Homo sapiens
attatgcccagagatgagtgct

SEQ ID NO: 6895795 - DNA, 22 bp, Homo sapiens
aatgcaccaagcctgctggggt

SEQ ID NO: 6895796 - DNA, 22 bp, Homo sapiens
gggctttaacacccagtcaggg

SEQ ID NO: 6895797 - DNA, 22 bp, Homo sapiens
agggcagaaaccaccttgatgg

SEQ ID NO: 6895798 - DNA, 22 bp, Homo sapiens
tgtgtacacagatagtaatggc

SEQ ID NO: 6895799 - DNA, 22 bp, Homo sapiens
gtgactcttaaagcaaatcttg

SEQ ID NO: 6895800 - DNA, 22 bp, Homo sapiens
cagcttgggggcgctggcctca

SEQ ID NO: 6895801 - DNA, 22 bp, Homo sapiens
tggtacaaagcctctttgcctc

SEQ ID NO: 6895802 - DNA, 22 bp, Homo sapiens
ttctggctccgcggggcggccc

SEQ ID NO: 6895803 - DNA, 22 bp, Homo sapiens
tcaggacagggatcacatcatc

SEQ ID NO: 6895804 - DNA, 22 bp, Homo sapiens
atagtgggaattacgatatact

SEQ ID NO: 6895805 - DNA, 22 bp, Homo sapiens
ggctgtgaagtagcaggggcag

SEQ ID NO: 6895806 - DNA, 22 bp, Homo sapiens
gtttgtgtcaatgacttctgca

SEQ ID NO: 6895807 - DNA, 22 bp, Homo sapiens
agggaagaggaccagagtctct

SEQ ID NO: 6895808 - DNA, 22 bp, Homo sapiens
gagctggcctcaggcacaggag

SEQ ID NO: 6895809 - DNA, 22 bp, Homo sapiens
ttcacaccaagcttcccaaaga

SEQ ID NO: 6895810 - DNA, 22 bp, Homo sapiens
tttattaatgtagcatccatgg

SEQ ID NO: 6895811 - DNA, 22 bp, Homo sapiens
tttcagaatagcaaagcaagct

SEQ ID NO: 6895812 - DNA, 22 bp, Homo sapiens
gaagattagaccatttccagct

SEQ ID NO: 6895813 - DNA, 17 bp, Homo sapiens
tctgcagggggccgtgt

SEQ ID NO: 6895814 - DNA, 22 bp, Homo sapiens
gagagctccttcaggaagcttc

SEQ ID NO: 6895815 - DNA, 22 bp, Homo sapiens
tggctctgctgaacctagtgca

SEQ ID NO: 6895816 - DNA, 22 bp, Homo sapiens
aaacattcactctcaattttag

SEQ ID NO: 6895817 - DNA, 22 bp, Homo sapiens
agtggtcttcaattccctttgt

SEQ ID NO: 6895818 - DNA, 22 bp, Homo sapiens
agttattcatttattctgtaca

SEQ ID NO: 6895819 - DNA, 22 bp, Homo sapiens
tggagctggttctggggaagct

SEQ ID NO: 6895820 - DNA, 22 bp, Homo sapiens
taggcaagtagaaaagtttgaa

SEQ ID NO: 6895821 - DNA, 22 bp, Homo sapiens
tctgtggctttcttatgttgta

SEQ ID NO: 6895822 - DNA, 22 bp, Homo sapiens
ggtggcatacaacatagaggct

SEQ ID NO: 6895823 - DNA, 21 bp, Homo sapiens
ggctgggtcatgcagctggcc

SEQ ID NO: 6895824 - DNA, 22 bp, Homo sapiens
cctggcttttgttcccggcgtc

SEQ ID NO: 6895825 - DNA, 19 bp, Homo sapiens
ggacaccctatcaatacct

SEQ ID NO: 6895826 - DNA, 22 bp, Homo sapiens
gacattgaacaagtttcctgac

SEQ ID NO: 6895827 - DNA, 22 bp, Homo sapiens
aagtttagtggtggtgttccat

SEQ ID NO: 6895828 - DNA, 22 bp, Homo sapiens
cctttgagcctgggcgcggacc

SEQ ID NO: 6895829 - DNA, 22 bp, Homo sapiens
cctgggagaactgctgggttgg

SEQ ID NO: 6895830 - DNA, 22 bp, Homo sapiens
tagtagcaacaagaaacaaata

SEQ ID NO: 6895831 - DNA, 22 bp, Homo sapiens
tagaaccagtccacagaatttg

SEQ ID NO: 6895832 - DNA, 22 bp, Homo sapiens
gagccaagattgtgtccctgca

SEQ ID NO: 6895833 - DNA, 22 bp, Homo sapiens
tctggggatggtctactttctg

SEQ ID NO: 6895834 - DNA, 22 bp, Homo sapiens
gatgaggctcatgcaccctgcg

SEQ ID NO: 6895835 - DNA, 22 bp, Homo sapiens
tcctgccagctggggctgcttc

SEQ ID NO: 6895836 - DNA, 22 bp, Homo sapiens
agcagcatggagaaaccgttca

SEQ ID NO: 6895837 - DNA, 22 bp, Homo sapiens
tccttcctgcaggccaagtcct

SEQ ID NO: 6895838 - DNA, 22 bp, Homo sapiens
caacattttcatggccagggag

SEQ ID NO: 6895839 - DNA, 22 bp, Homo sapiens
agaatctgctttttaacaagat

SEQ ID NO: 6895840 - DNA, 22 bp, Homo sapiens
tgcagcaagtaaccatcttcct

SEQ ID NO: 6895841 - DNA, 22 bp, Homo sapiens
aagtgctgtacagtgtgtaaat

SEQ ID NO: 6895842 - DNA, 22 bp, Homo sapiens
gctccggcttggtgtgcagggt

SEQ ID NO: 6895843 - DNA, 22 bp, Homo sapiens
gctctgtgaagggtgttgctca

SEQ ID NO: 6895844 - DNA, 17 bp, Homo sapiens
ggctttagggacaccac

SEQ ID NO: 6895845 - DNA, 22 bp, Homo sapiens
tgggagctcctggagggcagga

SEQ ID NO: 6895846 - DNA, 22 bp, Homo sapiens
tctgaattctgacaatttgaat

SEQ ID NO: 6895847 - DNA, 22 bp, Homo sapiens
ggattcagcgaggcagcctgga

SEQ ID NO: 6895848 - DNA, 22 bp, Homo sapiens
accctctgcatcagcttcttta

SEQ ID NO: 6895849 - DNA, 22 bp, Homo sapiens
ctttgtgcttgacccatgggtc

SEQ ID NO: 6895850 - DNA, 22 bp, Homo sapiens
aggaatgttaagaaggtctacc

SEQ ID NO: 6895851 - DNA, 22 bp, Homo sapiens
ggaggggtggtcacctggcagg

SEQ ID NO: 6895852 - DNA, 22 bp, Homo sapiens
gaaacattcagtcaacagtgtt

SEQ ID NO: 6895853 - DNA, 22 bp, Homo sapiens
tatttccaaaagcctattatga

SEQ ID NO: 6895854 - DNA, 22 bp, Homo sapiens
actacactccaattttctaggt

SEQ ID NO: 6895855 - DNA, 22 bp, Homo sapiens
tcatgctttggttgctgtcctt

SEQ ID NO: 6895856 - DNA, 22 bp, Homo sapiens
tcttattttttaatgacagaga

SEQ ID NO: 6895857 - DNA, 22 bp, Homo sapiens
tacagtaccagaaatgctaaga

SEQ ID NO: 6895858 - DNA, 22 bp, Homo sapiens
cttggcattgtgttgatagaag

SEQ ID NO: 6895859 - DNA, 22 bp, Homo sapiens
tgtggacattttttgtcagtag

SEQ ID NO: 6895860 - DNA, 22 bp, Homo sapiens
tcctctgggcctatttgttcac

SEQ ID NO: 6895861 - DNA, 22 bp, Homo sapiens
tccgtgcccctggcactaggtc

SEQ ID NO: 6895862 - DNA, 22 bp, Homo sapiens
aggttacagtcatctcagaatc

SEQ ID NO: 6895863 - DNA, 21 bp, Homo sapiens
actcccatcataactggtggg

SEQ ID NO: 6895864 - DNA, 19 bp, Homo sapiens
tggcttcttcggtgttccc

SEQ ID NO: 6895865 - DNA, 22 bp, Homo sapiens
atttggaaatgtaagaatgcaa

SEQ ID NO: 6895866 - DNA, 22 bp, Homo sapiens
actgatgaaaggtaagactcca

SEQ ID NO: 6895867 - DNA, 22 bp, Homo sapiens
gcaggcttcaagcacagctttt

SEQ ID NO: 6895868 - DNA, 22 bp, Homo sapiens
gagctcagaggcgtctttgtcc

SEQ ID NO: 6895869 - DNA, 20 bp, Homo sapiens
cttagcaccagcaggacagg

SEQ ID NO: 6895870 - DNA, 22 bp, Homo sapiens
atttgttcatgggttgttatgc

SEQ ID NO: 6895871 - DNA, 22 bp, Homo sapiens
cctgggctttgctggcaaggcc

SEQ ID NO: 6895872 - DNA, 22 bp, Homo sapiens
ttcagaaatgtcagccatcaga

SEQ ID NO: 6895873 - DNA, 22 bp, Homo sapiens
attgctgactcaataattgaag

SEQ ID NO: 6895874 - DNA, 20 bp, Homo sapiens
tcagggcatgggacagcccc

SEQ ID NO: 6895875 - DNA, 22 bp, Homo sapiens
cagaggtctgatgcgtccctgc

SEQ ID NO: 6895876 - DNA, 22 bp, Homo sapiens
tgcgcatgcgtggctctccggc

SEQ ID NO: 6895877 - DNA, 22 bp, Homo sapiens
tggccatgggatagtgcagggg

SEQ ID NO: 6895878 - DNA, 22 bp, Homo sapiens
gaggctgcattcttcccactgc

SEQ ID NO: 6895879 - DNA, 22 bp, Homo sapiens
catcagttcatgtctagctgct

SEQ ID NO: 6895880 - DNA, 22 bp, Homo sapiens
cagtggcacatggaccttgtca

SEQ ID NO: 6895881 - DNA, 22 bp, Homo sapiens
tggtaatttacgcatttctgta

SEQ ID NO: 6895882 - DNA, 22 bp, Homo sapiens
agtgacccctgtctcctcgctg

SEQ ID NO: 6895883 - DNA, 19 bp, Homo sapiens
agggctaggcacatagggc

SEQ ID NO: 6895884 - DNA, 22 bp, Homo sapiens
tcctgctgggcctgctttagga

SEQ ID NO: 6895885 - DNA, 18 bp, Homo sapiens
agcaaagcaagagatcac

SEQ ID NO: 6895886 - DNA, 22 bp, Homo sapiens
aagttaaggcacatgctttgga

SEQ ID NO: 6895887 - DNA, 22 bp, Homo sapiens
gacagctgtacactcctggtta

SEQ ID NO: 6895888 - DNA, 22 bp, Homo sapiens
atggcagggcacagctctagtt

SEQ ID NO: 6895889 - DNA, 22 bp, Homo sapiens
caggatctgccaatattcaacc

SEQ ID NO: 6895890 - DNA, 22 bp, Homo sapiens
gctaaggaggaatagtgaggca

SEQ ID NO: 6895891 - DNA, 22 bp, Homo sapiens
ttggaactcgtgttacttgtat

SEQ ID NO: 6895892 - DNA, 22 bp, Homo sapiens
gtggctttcatttcaggatgtg

SEQ ID NO: 6895893 - DNA, 23 bp, Homo sapiens
tttcatgttggcatgactgactt

SEQ ID NO: 6895894 - DNA, 22 bp, Homo sapiens
cagatagaatgcaagacctctc

SEQ ID NO: 6895895 - DNA, 22 bp, Homo sapiens
tacatacacaaatgctgaatgg

SEQ ID NO: 6895896 - DNA, 22 bp, Homo sapiens
tctctgtagacctgaccagcac

SEQ ID NO: 6895897 - DNA, 22 bp, Homo sapiens
aaggcatgctgagtcctaaaag

SEQ ID NO: 6895898 - DNA, 22 bp, Homo sapiens
tttgcaatttgtgctgcaaatg

SEQ ID NO: 6895899 - DNA, 22 bp, Homo sapiens
attggccatttgcatgtattat

SEQ ID NO: 6895900 - DNA, 22 bp, Homo sapiens
agagcatcctggttttatgaag

SEQ ID NO: 6895901 - DNA, 22 bp, Homo sapiens
ttggcaacacatggaaaaattt

SEQ ID NO: 6895902 - DNA, 22 bp, Homo sapiens
agctgctgtgtgctcaggcagg

SEQ ID NO: 6895903 - DNA, 22 bp, Homo sapiens
atgaagcaggcacagcttcagg

SEQ ID NO: 6895904 - DNA, 23 bp, Homo sapiens
gccaggcacatggtggacacgca

SEQ ID NO: 6895905 - DNA, 22 bp, Homo sapiens
agggagctcagttggaagcggt

SEQ ID NO: 6895906 - DNA, 22 bp, Homo sapiens
ttctctcttccagttcccactt

SEQ ID NO: 6895907 - DNA, 22 bp, Homo sapiens
acagtaaatcaacagaatatct

SEQ ID NO: 6895908 - DNA, 22 bp, Homo sapiens
caggagacaatggctgtggggc

SEQ ID NO: 6895909 - DNA, 22 bp, Homo sapiens
gaaaaggctgcccacttattga

SEQ ID NO: 6895910 - DNA, 20 bp, Homo sapiens
tcctaagaggatggccacgt

SEQ ID NO: 6895911 - DNA, 22 bp, Homo sapiens
cagacctgggtccctggcctgt

SEQ ID NO: 6895912 - DNA, 22 bp, Homo sapiens
ggcaccaggctgggcataggcc

SEQ ID NO: 6895913 - DNA, 22 bp, Homo sapiens
atgggtggaggagaaaggcatc

SEQ ID NO: 6895914 - DNA, 22 bp, Homo sapiens
tttcccagcctcagctcagcag

SEQ ID NO: 6895915 - DNA, 22 bp, Homo sapiens
gaccctcaaacaattacactgc

SEQ ID NO: 6895916 - DNA, 22 bp, Homo sapiens
ggagtcagcctgtcagagtgta

SEQ ID NO: 6895917 - DNA, 22 bp, Homo sapiens
gctgcacttgagcctgggagaa

SEQ ID NO: 6895918 - DNA, 20 bp, Homo sapiens
gtttgaaatgattggttggt

SEQ ID NO: 6895919 - DNA, 22 bp, Homo sapiens
tatttctttcaggtatgtgttg

SEQ ID NO: 6895920 - DNA, 22 bp, Homo sapiens
ccttaggggtgacagaaatacc

SEQ ID NO: 6895921 - DNA, 17 bp, Homo sapiens
acagtgtctatgaaatg

SEQ ID NO: 6895922 - DNA, 20 bp, Homo sapiens
tgaaaaggtcaggagacatg

SEQ ID NO: 6895923 - DNA, 22 bp, Homo sapiens
aattgaacttgatctttagcta

SEQ ID NO: 6895924 - DNA, 22 bp, Homo sapiens
tcctccagaccacttctgtgcg

SEQ ID NO: 6895925 - DNA, 22 bp, Homo sapiens
ttaaagcacctccttggatgtg

SEQ ID NO: 6895926 - DNA, 22 bp, Homo sapiens
acagagctgggatctgaaccca

SEQ ID NO: 6895927 - DNA, 21 bp, Homo sapiens
cccagggaagccgcagtcacc

SEQ ID NO: 6895928 - DNA, 22 bp, Homo sapiens
ccatcactcatctagatattta

SEQ ID NO: 6895929 - DNA, 22 bp, Homo sapiens
gatttattggtctttcattggt

SEQ ID NO: 6895930 - DNA, 22 bp, Homo sapiens
gtccttcaaggtccttggtgtg

SEQ ID NO: 6895931 - DNA, 22 bp, Homo sapiens
aggcttctaaatcacaaggaaa

SEQ ID NO: 6895932 - DNA, 22 bp, Homo sapiens
attctgcttttgctgacctacc

SEQ ID NO: 6895933 - DNA, 22 bp, Homo sapiens
ctgtgagggccagagtcagggc

SEQ ID NO: 6895934 - DNA, 22 bp, Homo sapiens
ttcccgtctttgctatgcctgc

SEQ ID NO: 6895935 - DNA, 22 bp, Homo sapiens
cactatatctgttcttgtttat

SEQ ID NO: 6895936 - DNA, 22 bp, Homo sapiens
aatgcctaagtaattattttga

SEQ ID NO: 6895937 - DNA, 22 bp, Homo sapiens
gtgcatgaagactcagaaagtc

SEQ ID NO: 6895938 - DNA, 22 bp, Homo sapiens
aatgcttcctcctcacctcagg

SEQ ID NO: 6895939 - DNA, 20 bp, Homo sapiens
agtgtctggtgcagggcctc

SEQ ID NO: 6895940 - DNA, 22 bp, Homo sapiens
tctggcccatgatcctgctaac

SEQ ID NO: 6895941 - DNA, 21 bp, Homo sapiens
ccaggctgggagggcagttcc

SEQ ID NO: 6895942 - DNA, 22 bp, Homo sapiens
attaagtatgcaatggtgcagt

SEQ ID NO: 6895943 - DNA, 22 bp, Homo sapiens
gtgctccaacattagtgtgctt

SEQ ID NO: 6895944 - DNA, 20 bp, Homo sapiens
ttgcacagagaaggaggcag

SEQ ID NO: 6895945 - DNA, 22 bp, Homo sapiens
tggtgggacatctgaggagagg

SEQ ID NO: 6895946 - DNA, 22 bp, Homo sapiens
ttctcatacaggatctcttatt

SEQ ID NO: 6895947 - DNA, 22 bp, Homo sapiens
agtcaaataagagagagatgtt

SEQ ID NO: 6895948 - DNA, 20 bp, Homo sapiens
ctctccttgccgacttggca

SEQ ID NO: 6895949 - DNA, 22 bp, Homo sapiens
ctggctcccgttgtccttgaag

SEQ ID NO: 6895950 - DNA, 22 bp, Homo sapiens
tccccaggtcctgtcggctcct

SEQ ID NO: 6895951 - DNA, 22 bp, Homo sapiens
gtctcagattcagacatctaca

SEQ ID NO: 6895952 - DNA, 22 bp, Homo sapiens
tttgaaaatttaagtgctacac

SEQ ID NO: 6895953 - DNA, 22 bp, Homo sapiens
gtacaggttggctctatcgctg

SEQ ID NO: 6895954 - DNA, 22 bp, Homo sapiens
atataaagaagtggaaaatgag

SEQ ID NO: 6895955 - DNA, 22 bp, Homo sapiens
aaactgcaatgacaggtaggag

SEQ ID NO: 6895956 - DNA, 22 bp, Homo sapiens
agccctgacctgtcctgttctg

SEQ ID NO: 6895957 - DNA, 22 bp, Homo sapiens
cagcagaaatggattttgagat

SEQ ID NO: 6895958 - DNA, 22 bp, Homo sapiens
tggcagggtacaccttaacacc

SEQ ID NO: 6895959 - DNA, 19 bp, Homo sapiens
tctgagggtccagatgcat

SEQ ID NO: 6895960 - DNA, 22 bp, Homo sapiens
tacatgtggtagggagggcagt

SEQ ID NO: 6895961 - DNA, 22 bp, Homo sapiens
cactgcagcctctgcctctcag

SEQ ID NO: 6895962 - DNA, 22 bp, Homo sapiens
agctcctgctctttgtccctaa

SEQ ID NO: 6895963 - DNA, 22 bp, Homo sapiens
tgaatagttctactacttgaca

SEQ ID NO: 6895964 - DNA, 22 bp, Homo sapiens
ctttcactcgagctcctgcagc

SEQ ID NO: 6895965 - DNA, 22 bp, Homo sapiens
taatgctgagtgatgttgaaag

SEQ ID NO: 6895966 - DNA, 22 bp, Homo sapiens
gatgagtcactgcaggtgctgg

SEQ ID NO: 6895967 - DNA, 22 bp, Homo sapiens
tgagtgtccttaaggttgttct

SEQ ID NO: 6895968 - DNA, 22 bp, Homo sapiens
ccttcagtcccatgtttctctt

SEQ ID NO: 6895969 - DNA, 22 bp, Homo sapiens
actttgccacattctttaggcc

SEQ ID NO: 6895970 - DNA, 22 bp, Homo sapiens
gcgacagtgcggccaccttcat

SEQ ID NO: 6895971 - DNA, 22 bp, Homo sapiens
taagaatcgatgtttatttaga

SEQ ID NO: 6895972 - DNA, 22 bp, Homo sapiens
aaggaggaataaagaggtggtg

SEQ ID NO: 6895973 - DNA, 22 bp, Homo sapiens
taggtgtgattcgaagagcaaa

SEQ ID NO: 6895974 - DNA, 22 bp, Homo sapiens
aactatgataccaatccagctt

SEQ ID NO: 6895975 - DNA, 22 bp, Homo sapiens
cagtcaccaccaggtggcagta

SEQ ID NO: 6895976 - DNA, 22 bp, Homo sapiens
gagtgtctgtgacagctcatga

SEQ ID NO: 6895977 - DNA, 22 bp, Homo sapiens
agcagatatgatacttaattta

SEQ ID NO: 6895978 - DNA, 22 bp, Homo sapiens
tcctgtgatggcttgcgatgtg

SEQ ID NO: 6895979 - DNA, 22 bp, Homo sapiens
atgtctgtacgagttacaatgg

SEQ ID NO: 6895980 - DNA, 22 bp, Homo sapiens
ttgccaggggacatctggagcc

SEQ ID NO: 6895981 - DNA, 22 bp, Homo sapiens
taattgcagggagcctgggggc

SEQ ID NO: 6895982 - DNA, 22 bp, Homo sapiens
attgtgaatagtgctgcaataa

SEQ ID NO: 6895983 - DNA, 22 bp, Homo sapiens
gttgaatatcccgtatcttaaa

SEQ ID NO: 6895984 - DNA, 22 bp, Homo sapiens
actagggattacactgtattca

SEQ ID NO: 6895985 - DNA, 22 bp, Homo sapiens
gggtaattggggccttgcagtg

SEQ ID NO: 6895986 - DNA, 22 bp, Homo sapiens
ttgagctctgatgcttttcaga

SEQ ID NO: 6895987 - DNA, 22 bp, Homo sapiens
ttttagaagttcacttgggttt

SEQ ID NO: 6895988 - DNA, 19 bp, Homo sapiens
acagcagggatttttggag

SEQ ID NO: 6895989 - DNA, 22 bp, Homo sapiens
ctctgaggttcctttgccctcg

SEQ ID NO: 6895990 - DNA, 22 bp, Homo sapiens
taagaatcagtagatatagatt

SEQ ID NO: 6895991 - DNA, 22 bp, Homo sapiens
cctggtggagaggggcggagcg

SEQ ID NO: 6895992 - DNA, 22 bp, Homo sapiens
tagtgcatacctaacatttttg

SEQ ID NO: 6895993 - DNA, 22 bp, Homo sapiens
aatatctcaccatgacaaagca

SEQ ID NO: 6895994 - DNA, 22 bp, Homo sapiens
gcagccaccctcaaggctgaat

SEQ ID NO: 6895995 - DNA, 22 bp, Homo sapiens
cagcagtccctgcagtggggaa

SEQ ID NO: 6895996 - DNA, 22 bp, Homo sapiens
ccagccagctgcccttggggcc

SEQ ID NO: 6895997 - DNA, 22 bp, Homo sapiens
tgtggactctggagtcagacag

SEQ ID NO: 6895998 - DNA, 22 bp, Homo sapiens
actgagcaatgcagtgggagcg

SEQ ID NO: 6895999 - DNA, 22 bp, Homo sapiens
cttccagggtccaggaagagcc

SEQ ID NO: 6896000 - DNA, 22 bp, Homo sapiens
tgccctgccaagactcagtggt

SEQ ID NO: 6896001 - DNA, 22 bp, Homo sapiens
caggcccaggggtctggcccac

SEQ ID NO: 6896002 - DNA, 22 bp, Homo sapiens
ggaggaggcggcagaagttcct

SEQ ID NO: 6896003 - DNA, 22 bp, Homo sapiens
gaggtgtcatcaggcagctctg

SEQ ID NO: 6896004 - DNA, 22 bp, Homo sapiens
tcagtgtttcagtttggaaatg

SEQ ID NO: 6896005 - DNA, 22 bp, Homo sapiens
aagttcctcttctctgcaggga

SEQ ID NO: 6896006 - DNA, 22 bp, Homo sapiens
ctaggcccatgaggtttgctgg

SEQ ID NO: 6896007 - DNA, 22 bp, Homo sapiens
attggcaggaaccgaggagggg

SEQ ID NO: 6896008 - DNA, 22 bp, Homo sapiens
ttatttatggccctcacctgat

SEQ ID NO: 6896009 - DNA, 22 bp, Homo sapiens
ctagtgctctaggggctgaagg

SEQ ID NO: 6896010 - DNA, 21 bp, Homo sapiens
tggcactgcttagcaggttcc

SEQ ID NO: 6896011 - DNA, 22 bp, Homo sapiens
cacagcagacagggaggcggct

SEQ ID NO: 6896012 - DNA, 22 bp, Homo sapiens
tggggagagaccggaatgtttc

SEQ ID NO: 6896013 - DNA, 22 bp, Homo sapiens
tcactgaatgcagatacgtgac

SEQ ID NO: 6896014 - DNA, 22 bp, Homo sapiens
tcagaacattacattttgagct

SEQ ID NO: 6896015 - DNA, 22 bp, Homo sapiens
gtgagccaataccatgctgttc

SEQ ID NO: 6896016 - DNA, 18 bp, Homo sapiens
taggctgggggctgtagt

SEQ ID NO: 6896017 - DNA, 22 bp, Homo sapiens
atatggctgtgtttatagccat

SEQ ID NO: 6896018 - DNA, 22 bp, Homo sapiens
cagtgggacatgggcactgggc

SEQ ID NO: 6896019 - DNA, 22 bp, Homo sapiens
ttttggctctgcaggtttgcac

SEQ ID NO: 6896020 - DNA, 22 bp, Homo sapiens
ctgcctgtggtctgtgatctaa

SEQ ID NO: 6896021 - DNA, 23 bp, Homo sapiens
tggagatgccccactccctgtct

SEQ ID NO: 6896022 - DNA, 22 bp, Homo sapiens
aaactgctttccacagtggcta

SEQ ID NO: 6896023 - DNA, 22 bp, Homo sapiens
tctctgtattcttcgtaatgcc

SEQ ID NO: 6896024 - DNA, 22 bp, Homo sapiens
tccagaaactgctgagataaga

SEQ ID NO: 6896025 - DNA, 22 bp, Homo sapiens
gtgtagcatatagcaagagcat

SEQ ID NO: 6896026 - DNA, 22 bp, Homo sapiens
caggtcctgcagggagagtaaa

SEQ ID NO: 6896027 - DNA, 22 bp, Homo sapiens
atgagctcatccgagtcacact

SEQ ID NO: 6896028 - DNA, 22 bp, Homo sapiens
tcttttagagcatttctgattc

SEQ ID NO: 6896029 - DNA, 22 bp, Homo sapiens
tgcctggagtccccaagtccat

SEQ ID NO: 6896030 - DNA, 21 bp, Homo sapiens
tattaatttttcttcccacta

SEQ ID NO: 6896031 - DNA, 22 bp, Homo sapiens
tatgtctggcatgttgtaatta

SEQ ID NO: 6896032 - DNA, 19 bp, Homo sapiens
tcccgcccactgagcgtgc

SEQ ID NO: 6896033 - DNA, 22 bp, Homo sapiens
cacatgcagttttccagcagtc

SEQ ID NO: 6896034 - DNA, 21 bp, Homo sapiens
ttctgggttgttaatctgaac

SEQ ID NO: 6896035 - DNA, 22 bp, Homo sapiens
ccatgccctaaaggactggcag

SEQ ID NO: 6896036 - DNA, 20 bp, Homo sapiens
ttttatgtcaccttcctgtc

SEQ ID NO: 6896037 - DNA, 22 bp, Homo sapiens
ttctcctcactgcagcctttca

SEQ ID NO: 6896038 - DNA, 23 bp, Homo sapiens
tgcaggtagggcccagcagtctt

SEQ ID NO: 6896039 - DNA, 22 bp, Homo sapiens
tggtggcaattcaaagacagca

SEQ ID NO: 6896040 - DNA, 22 bp, Homo sapiens
tgtcaatgggaatttgttttag

SEQ ID NO: 6896041 - DNA, 22 bp, Homo sapiens
cactgcactccagcctgggtca

SEQ ID NO: 6896042 - DNA, 23 bp, Homo sapiens
tttaatgaccaatagaaggaaca

SEQ ID NO: 6896043 - DNA, 22 bp, Homo sapiens
accaatgtgatgatattaggag

SEQ ID NO: 6896044 - DNA, 22 bp, Homo sapiens
ttcaacatttttgagtttaggt

SEQ ID NO: 6896045 - DNA, 22 bp, Homo sapiens
agaaagttagcagactcttggc

SEQ ID NO: 6896046 - DNA, 22 bp, Homo sapiens
caacagaaggtgtactactgaa

SEQ ID NO: 6896047 - DNA, 22 bp, Homo sapiens
ccatgtgtaaattagataactc

SEQ ID NO: 6896048 - DNA, 22 bp, Homo sapiens
gtggctgctcgggctccggccc

SEQ ID NO: 6896049 - DNA, 22 bp, Homo sapiens
actggctgaggaagttgccact

SEQ ID NO: 6896050 - DNA, 23 bp, Homo sapiens
ccataatcagggttgtggggtcc

SEQ ID NO: 6896051 - DNA, 22 bp, Homo sapiens
ttctccagttatattatgttaa

SEQ ID NO: 6896052 - DNA, 22 bp, Homo sapiens
gtcaggggccatgggccaagga

SEQ ID NO: 6896053 - DNA, 22 bp, Homo sapiens
gtaacaaacggttccaagatgc

SEQ ID NO: 6896054 - DNA, 22 bp, Homo sapiens
atgctccaccttttgcaggaac

SEQ ID NO: 6896055 - DNA, 22 bp, Homo sapiens
gtcctctgcttcatgccctgat

SEQ ID NO: 6896056 - DNA, 22 bp, Homo sapiens
gtggcagtctttggcaatgaca

SEQ ID NO: 6896057 - DNA, 22 bp, Homo sapiens
tttcacacaacgtgaatatact

SEQ ID NO: 6896058 - DNA, 22 bp, Homo sapiens
acaggatttcaccatgttggcc

SEQ ID NO: 6896059 - DNA, 22 bp, Homo sapiens
attctgggtctgggtgtgatca

SEQ ID NO: 6896060 - DNA, 22 bp, Homo sapiens
tcagtcttccctccagtgcaac

SEQ ID NO: 6896061 - DNA, 22 bp, Homo sapiens
gactgcctcagtttccctgcag

SEQ ID NO: 6896062 - DNA, 22 bp, Homo sapiens
atagtcactctgttaggtgttt

SEQ ID NO: 6896063 - DNA, 22 bp, Homo sapiens
gtattcacctaaatgtagtttg

SEQ ID NO: 6896064 - DNA, 23 bp, Homo sapiens
cctggggagctgtatccagagtg

SEQ ID NO: 6896065 - DNA, 22 bp, Homo sapiens
aggatcagggtggtggaagtca

SEQ ID NO: 6896066 - DNA, 22 bp, Homo sapiens
gttggtgagtttctgatcacaa

SEQ ID NO: 6896067 - DNA, 22 bp, Homo sapiens
cacatttaaaaaatccacgatc

SEQ ID NO: 6896068 - DNA, 22 bp, Homo sapiens
cttgcctgctggagcagggctc

SEQ ID NO: 6896069 - DNA, 22 bp, Homo sapiens
cgggggcgtctggtgagaccat

SEQ ID NO: 6896070 - DNA, 21 bp, Homo sapiens
ccagtgctacagctgcctgac

SEQ ID NO: 6896071 - DNA, 22 bp, Homo sapiens
tggaactaaggtagaaactatt

SEQ ID NO: 6896072 - DNA, 22 bp, Homo sapiens
gctccaggagctcacagctcgc

SEQ ID NO: 6896073 - DNA, 22 bp, Homo sapiens
atccatgttcataagaattgta

SEQ ID NO: 6896074 - DNA, 22 bp, Homo sapiens
agaggagcctcagtttgcagcc

SEQ ID NO: 6896075 - DNA, 22 bp, Homo sapiens
catccactagaatgacagagtt

SEQ ID NO: 6896076 - DNA, 22 bp, Homo sapiens
ttttcatttttgtagatgcaag

SEQ ID NO: 6896077 - DNA, 22 bp, Homo sapiens
ctaggaagctgtgcggaccctg

SEQ ID NO: 6896078 - DNA, 20 bp, Homo sapiens
tctggggatgaggtctagga

SEQ ID NO: 6896079 - DNA, 22 bp, Homo sapiens
agcagtttctcttgtatcttca

SEQ ID NO: 6896080 - DNA, 22 bp, Homo sapiens
cacaggaggcaatggtaagatt

SEQ ID NO: 6896081 - DNA, 22 bp, Homo sapiens
cagctaagttccaggggctttc

SEQ ID NO: 6896082 - DNA, 18 bp, Homo sapiens
tccagagctggtgcttct

SEQ ID NO: 6896083 - DNA, 22 bp, Homo sapiens
taaggtttaacgccctgtctcg

SEQ ID NO: 6896084 - DNA, 22 bp, Homo sapiens
aggagccctccgttgcttcatc

SEQ ID NO: 6896085 - DNA, 22 bp, Homo sapiens
tggattgcagcagctcctgtgg

SEQ ID NO: 6896086 - DNA, 22 bp, Homo sapiens
cagtctttgttcccattactga

SEQ ID NO: 6896087 - DNA, 22 bp, Homo sapiens
actgtgcatgaaccgaaacaaa

SEQ ID NO: 6896088 - DNA, 22 bp, Homo sapiens
tcctccaaggcagggggagaga

SEQ ID NO: 6896089 - DNA, 22 bp, Homo sapiens
catcagcttttctatgtggtga

SEQ ID NO: 6896090 - DNA, 22 bp, Homo sapiens
gctctgctcttgacttaccagg

SEQ ID NO: 6896091 - DNA, 22 bp, Homo sapiens
gctgctttataatctcggcaga

SEQ ID NO: 6896092 - DNA, 19 bp, Homo sapiens
cattaggattagagacaag

SEQ ID NO: 6896093 - DNA, 22 bp, Homo sapiens
gccatggacttctgcggacaca

SEQ ID NO: 6896094 - DNA, 22 bp, Homo sapiens
cctctgcgtctctccacactga

SEQ ID NO: 6896095 - DNA, 22 bp, Homo sapiens
tcaaggcatacatttagaagag

SEQ ID NO: 6896096 - DNA, 23 bp, Homo sapiens
tctaatacatgaaacctagatgt

SEQ ID NO: 6896097 - DNA, 22 bp, Homo sapiens
caagggccatctgagggcactg

SEQ ID NO: 6896098 - DNA, 22 bp, Homo sapiens
accctggtgttgccccgctttt

SEQ ID NO: 6896099 - DNA, 22 bp, Homo sapiens
ggctctgcatgtgagtgggtgg

SEQ ID NO: 6896100 - DNA, 22 bp, Homo sapiens
tgtttacacaatagtctctctc

SEQ ID NO: 6896101 - DNA, 22 bp, Homo sapiens
acatactatgaatacatgtgtc

SEQ ID NO: 6896102 - DNA, 22 bp, Homo sapiens
tctgggataagaccacagattt

SEQ ID NO: 6896103 - DNA, 17 bp, Homo sapiens
tgcttcatcccgatcct

SEQ ID NO: 6896104 - DNA, 22 bp, Homo sapiens
taagagctccaatatttgtggc

SEQ ID NO: 6896105 - DNA, 22 bp, Homo sapiens
tctgcactgggagcatgtctgg

SEQ ID NO: 6896106 - DNA, 22 bp, Homo sapiens
aagcacattttccagcagctct

SEQ ID NO: 6896107 - DNA, 22 bp, Homo sapiens
gttcacatgctctcatgctttt

SEQ ID NO: 6896108 - DNA, 22 bp, Homo sapiens
acaggtgttttggaggatgatt

SEQ ID NO: 6896109 - DNA, 22 bp, Homo sapiens
gagtgggtccacagaggtgaca

SEQ ID NO: 6896110 - DNA, 22 bp, Homo sapiens
ccaccaggctctgtccgagcgg

SEQ ID NO: 6896111 - DNA, 22 bp, Homo sapiens
ggcctgctgcagtgtgacagtt

SEQ ID NO: 6896112 - DNA, 22 bp, Homo sapiens
agcatgtggctcatccctttat

SEQ ID NO: 6896113 - DNA, 22 bp, Homo sapiens
ctgtcaggttggtctcagagct

SEQ ID NO: 6896114 - DNA, 22 bp, Homo sapiens
atggatattggccaaactcatt

SEQ ID NO: 6896115 - DNA, 22 bp, Homo sapiens
gacagacagagaatgggcttga

SEQ ID NO: 6896116 - DNA, 22 bp, Homo sapiens
atgggcagagtggggacaggaa

SEQ ID NO: 6896117 - DNA, 22 bp, Homo sapiens
ttcgatgtattttttcacagga

SEQ ID NO: 6896118 - DNA, 22 bp, Homo sapiens
ctgctgtggatgcaggacctca

SEQ ID NO: 6896119 - DNA, 20 bp, Homo sapiens
caggccttcaggatggctgg

SEQ ID NO: 6896120 - DNA, 19 bp, Homo sapiens
tagtacaaaagcagccata

SEQ ID NO: 6896121 - DNA, 20 bp, Homo sapiens
accagagacctgaatcagtt

SEQ ID NO: 6896122 - DNA, 22 bp, Homo sapiens
tggaacaagggcgtggcggtcg

SEQ ID NO: 6896123 - DNA, 22 bp, Homo sapiens
cactggttttaatttccatttc

SEQ ID NO: 6896124 - DNA, 22 bp, Homo sapiens
ccttgtcttgcacagatgcagc

SEQ ID NO: 6896125 - DNA, 22 bp, Homo sapiens
aatagtcctctccttggaattt

SEQ ID NO: 6896126 - DNA, 22 bp, Homo sapiens
catctgtgtatctgtgcttaga

SEQ ID NO: 6896127 - DNA, 22 bp, Homo sapiens
ggtcagtgctgccagagtgacc

SEQ ID NO: 6896128 - DNA, 22 bp, Homo sapiens
ctgagtttccagataagacctt

SEQ ID NO: 6896129 - DNA, 22 bp, Homo sapiens
aaacagcaatggagaagccagg

SEQ ID NO: 6896130 - DNA, 22 bp, Homo sapiens
ttaatgttttaagttatagaga

SEQ ID NO: 6896131 - DNA, 22 bp, Homo sapiens
gagcagcagattgtctccatgg

SEQ ID NO: 6896132 - DNA, 22 bp, Homo sapiens
gttcccattggggatcttgggc

SEQ ID NO: 6896133 - DNA, 22 bp, Homo sapiens
tgttttggaggtcctcactaga

SEQ ID NO: 6896134 - DNA, 22 bp, Homo sapiens
ttttcattgtaaatcaggaaac

SEQ ID NO: 6896135 - DNA, 22 bp, Homo sapiens
agcagagaccatatagcccaga

SEQ ID NO: 6896136 - DNA, 20 bp, Homo sapiens
ggcttaaggaattcttttct

SEQ ID NO: 6896137 - DNA, 22 bp, Homo sapiens
cagcatggggatcactgtaggc

SEQ ID NO: 6896138 - DNA, 22 bp, Homo sapiens
ctctttctcattgtcagcagaa

SEQ ID NO: 6896139 - DNA, 22 bp, Homo sapiens
catgtcttggcttaggcacaga

SEQ ID NO: 6896140 - DNA, 22 bp, Homo sapiens
cacagggaggcagccatgctcc

SEQ ID NO: 6896141 - DNA, 22 bp, Homo sapiens
gtactgtccagtgtcgctcctc

SEQ ID NO: 6896142 - DNA, 23 bp, Homo sapiens
tccatactctaaacatgttattt

SEQ ID NO: 6896143 - DNA, 22 bp, Homo sapiens
ccagaggtgctctttggaagtg

SEQ ID NO: 6896144 - DNA, 23 bp, Homo sapiens
tggtttatgatatgtatgggaat

SEQ ID NO: 6896145 - DNA, 21 bp, Homo sapiens
agcagagccaccattacctgc

SEQ ID NO: 6896146 - DNA, 22 bp, Homo sapiens
cttcagtttatcccatcatcca

SEQ ID NO: 6896147 - DNA, 22 bp, Homo sapiens
aatgtctttaaagtgcaataga

SEQ ID NO: 6896148 - DNA, 22 bp, Homo sapiens
tttgtcatatcacacaattttg

SEQ ID NO: 6896149 - DNA, 22 bp, Homo sapiens
tgtacaaagagtatagctttga

SEQ ID NO: 6896150 - DNA, 22 bp, Homo sapiens
tatttgttgcgggaattgctat

SEQ ID NO: 6896151 - DNA, 21 bp, Homo sapiens
tggctctgctcagagcagtcc

SEQ ID NO: 6896152 - DNA, 16 bp, Homo sapiens
ccacagggcaaggggc

SEQ ID NO: 6896153 - DNA, 22 bp, Homo sapiens
gcacaggcatcaggctttttct

SEQ ID NO: 6896154 - DNA, 22 bp, Homo sapiens
aagtttgtggtcatttattata

SEQ ID NO: 6896155 - DNA, 22 bp, Homo sapiens
gtgcttatccccattctggagg

SEQ ID NO: 6896156 - DNA, 22 bp, Homo sapiens
ttcggtctggctgttatacgct

SEQ ID NO: 6896157 - DNA, 22 bp, Homo sapiens
caccaggcacatagtaggcact

SEQ ID NO: 6896158 - DNA, 22 bp, Homo sapiens
aatagattcatggttaagagca

SEQ ID NO: 6896159 - DNA, 22 bp, Homo sapiens
tttcatgttggggagttgagtg

SEQ ID NO: 6896160 - DNA, 22 bp, Homo sapiens
ttcctaactggcctttatggat

SEQ ID NO: 6896161 - DNA, 20 bp, Homo sapiens
atcacctgtaggttctttgt

SEQ ID NO: 6896162 - DNA, 22 bp, Homo sapiens
tctttgatacagatgtaagctg

SEQ ID NO: 6896163 - DNA, 22 bp, Homo sapiens
ttccttcttccagaggctgccc

SEQ ID NO: 6896164 - DNA, 22 bp, Homo sapiens
aagtctcttcctctgccaaaga

SEQ ID NO: 6896165 - DNA, 22 bp, Homo sapiens
cagctttgcaggctggtcagtg

SEQ ID NO: 6896166 - DNA, 22 bp, Homo sapiens
gaggggccggcatgtgcctctc

SEQ ID NO: 6896167 - DNA, 22 bp, Homo sapiens
tgctgagtgggattcctgtgct

SEQ ID NO: 6896168 - DNA, 22 bp, Homo sapiens
aaaagtcagtctctcctagctc

SEQ ID NO: 6896169 - DNA, 22 bp, Homo sapiens
tattagtctgtaaattgatgct

SEQ ID NO: 6896170 - DNA, 18 bp, Homo sapiens
caattcaagagcctacag

SEQ ID NO: 6896171 - DNA, 22 bp, Homo sapiens
cataaagtaaagatgtcttcca

SEQ ID NO: 6896172 - DNA, 19 bp, Homo sapiens
tttggcaggagataggatg

SEQ ID NO: 6896173 - DNA, 22 bp, Homo sapiens
ccggtcttcaaatggctgcttc

SEQ ID NO: 6896174 - DNA, 22 bp, Homo sapiens
atgacacaattttagagctgaa

SEQ ID NO: 6896175 - DNA, 22 bp, Homo sapiens
atgaatgcatacatttgtcaag

SEQ ID NO: 6896176 - DNA, 21 bp, Homo sapiens
tccaggccatggtggggaggc

SEQ ID NO: 6896177 - DNA, 22 bp, Homo sapiens
gtcctctgcccaggtcaaggtt

SEQ ID NO: 6896178 - DNA, 22 bp, Homo sapiens
ccggctactcgggaggctgacg

SEQ ID NO: 6896179 - DNA, 22 bp, Homo sapiens
gctgaccattaggaggacgata

SEQ ID NO: 6896180 - DNA, 22 bp, Homo sapiens
tgagcacttttcaaagagagct

SEQ ID NO: 6896181 - DNA, 22 bp, Homo sapiens
cagcccagagccagttcccgct

SEQ ID NO: 6896182 - DNA, 22 bp, Homo sapiens
gaagcgtctaggtagaaattta

SEQ ID NO: 6896183 - DNA, 22 bp, Homo sapiens
tcagaacatcccagatagtaga

SEQ ID NO: 6896184 - DNA, 22 bp, Homo sapiens
agtctggctttttgatgagctt

SEQ ID NO: 6896185 - DNA, 22 bp, Homo sapiens
gatccaaattattttttagagg

SEQ ID NO: 6896186 - DNA, 22 bp, Homo sapiens
atggatttgcttatacacatgt

SEQ ID NO: 6896187 - DNA, 22 bp, Homo sapiens
tgtccaccggtcctgtgatggg

SEQ ID NO: 6896188 - DNA, 22 bp, Homo sapiens
cattcagtggagtattattcag

SEQ ID NO: 6896189 - DNA, 22 bp, Homo sapiens
aattatgtggaagaggattaaa

SEQ ID NO: 6896190 - DNA, 20 bp, Homo sapiens
atcctcaccctcagtcctag

SEQ ID NO: 6896191 - DNA, 22 bp, Homo sapiens
gaaggcactgaactccttctgg

SEQ ID NO: 6896192 - DNA, 22 bp, Homo sapiens
ggtggcataagaacactaaaga

SEQ ID NO: 6896193 - DNA, 22 bp, Homo sapiens
attctttcatataaaggctcag

SEQ ID NO: 6896194 - DNA, 22 bp, Homo sapiens
gcacagctggggtatgatgcca

SEQ ID NO: 6896195 - DNA, 22 bp, Homo sapiens
gagggcagtgaattttgaagct

SEQ ID NO: 6896196 - DNA, 22 bp, Homo sapiens
cctctcttggatgtggatgggt

SEQ ID NO: 6896197 - DNA, 22 bp, Homo sapiens
cagagagcatgggaggcccgag

SEQ ID NO: 6896198 - DNA, 22 bp, Homo sapiens
ctagggctcgcaagggctggag

SEQ ID NO: 6896199 - DNA, 22 bp, Homo sapiens
tggctttacttaaactgaatca

SEQ ID NO: 6896200 - DNA, 22 bp, Homo sapiens
agggccagccccaccctctctg

SEQ ID NO: 6896201 - DNA, 22 bp, Homo sapiens
cattggaatgcatttgaagaga

SEQ ID NO: 6896202 - DNA, 22 bp, Homo sapiens
agcccaggctggagtgcagtgg

SEQ ID NO: 6896203 - DNA, 22 bp, Homo sapiens
gactattttataaactagtgaa

SEQ ID NO: 6896204 - DNA, 22 bp, Homo sapiens
ctgtgcagcttggcttcaggcc

SEQ ID NO: 6896205 - DNA, 22 bp, Homo sapiens
cacagaattaagggagaaatat

SEQ ID NO: 6896206 - DNA, 22 bp, Homo sapiens
gctgtacaaattccacaagaga

SEQ ID NO: 6896207 - DNA, 22 bp, Homo sapiens
tagctgttttgccataagcgct

SEQ ID NO: 6896208 - DNA, 22 bp, Homo sapiens
ttcaagttctgtggagagctgt

SEQ ID NO: 6896209 - DNA, 22 bp, Homo sapiens
ggaagagattctttacattcat

SEQ ID NO: 6896210 - DNA, 22 bp, Homo sapiens
gaaggcttatgtgtgactttcg

SEQ ID NO: 6896211 - DNA, 22 bp, Homo sapiens
gaagcagacttttgcttatttg

SEQ ID NO: 6896212 - DNA, 22 bp, Homo sapiens
ggtttattaatgtgaactgtat

SEQ ID NO: 6896213 - DNA, 22 bp, Homo sapiens
ttggagatatcacaccttcaca

SEQ ID NO: 6896214 - DNA, 17 bp, Homo sapiens
gctctgcctctcccacc

SEQ ID NO: 6896215 - DNA, 22 bp, Homo sapiens
gaggctgaatggccagaagcca

SEQ ID NO: 6896216 - DNA, 22 bp, Homo sapiens
cacctgcccagcacctgggatc

SEQ ID NO: 6896217 - DNA, 22 bp, Homo sapiens
tgccaaattttctcagagatgc

SEQ ID NO: 6896218 - DNA, 22 bp, Homo sapiens
aggacagtggcaaggcaggaca

SEQ ID NO: 6896219 - DNA, 22 bp, Homo sapiens
catgtggtctgcccggggatgt

SEQ ID NO: 6896220 - DNA, 22 bp, Homo sapiens
tttcacaaactcagggtgtgtg

SEQ ID NO: 6896221 - DNA, 22 bp, Homo sapiens
aaggtgtctctctgcttcttgg

SEQ ID NO: 6896222 - DNA, 22 bp, Homo sapiens
atagccacagttatattgagac

SEQ ID NO: 6896223 - DNA, 22 bp, Homo sapiens
tgaaatgagatagataatcagg

SEQ ID NO: 6896224 - DNA, 18 bp, Homo sapiens
tctctttcctcagtggag

SEQ ID NO: 6896225 - DNA, 22 bp, Homo sapiens
aagaggcatctcagcttcctct

SEQ ID NO: 6896226 - DNA, 21 bp, Homo sapiens
gatctttactttcctacttac

SEQ ID NO: 6896227 - DNA, 22 bp, Homo sapiens
tgtctgaaagaggacgagctgg

SEQ ID NO: 6896228 - DNA, 22 bp, Homo sapiens
tttcgagggccttaagtattcc

SEQ ID NO: 6896229 - DNA, 22 bp, Homo sapiens
gggtctggagggcagcccttct

SEQ ID NO: 6896230 - DNA, 22 bp, Homo sapiens
cctgtctggtgagggggttgca

SEQ ID NO: 6896231 - DNA, 22 bp, Homo sapiens
gagtaattctggtaaatcattg

SEQ ID NO: 6896232 - DNA, 22 bp, Homo sapiens
gcctggagtggtcctgctgccc

SEQ ID NO: 6896233 - DNA, 22 bp, Homo sapiens
aagcagccactggccagttata

SEQ ID NO: 6896234 - DNA, 22 bp, Homo sapiens
tatagcagtataacatgtttac

SEQ ID NO: 6896235 - DNA, 22 bp, Homo sapiens
ctaacctgttgaaggaattgct

SEQ ID NO: 6896236 - DNA, 22 bp, Homo sapiens
atttcagattcagaaatgtagg

SEQ ID NO: 6896237 - DNA, 22 bp, Homo sapiens
gaaatcatgagatctcttggac

SEQ ID NO: 6896238 - DNA, 22 bp, Homo sapiens
aagctgccctcattcccagtgc

SEQ ID NO: 6896239 - DNA, 22 bp, Homo sapiens
gatacagtgtgttaacgagaaa

SEQ ID NO: 6896240 - DNA, 22 bp, Homo sapiens
atctggggtgaataggttatgt

SEQ ID NO: 6896241 - DNA, 22 bp, Homo sapiens
aagacctaaaattccctcagat

SEQ ID NO: 6896242 - DNA, 17 bp, Homo sapiens
atttagcaagtagacag

SEQ ID NO: 6896243 - DNA, 22 bp, Homo sapiens
tcacccagcgggcgcacactcg

SEQ ID NO: 6896244 - DNA, 22 bp, Homo sapiens
gaggttcacttcctgaaatagc

SEQ ID NO: 6896245 - DNA, 22 bp, Homo sapiens
ttgggttttgatacatgtctaa

SEQ ID NO: 6896246 - DNA, 22 bp, Homo sapiens
aggaagctagagccaccggact

SEQ ID NO: 6896247 - DNA, 22 bp, Homo sapiens
agagtggcctcagagaaataca

SEQ ID NO: 6896248 - DNA, 22 bp, Homo sapiens
cctggggctccagagcagcgga

SEQ ID NO: 6896249 - DNA, 22 bp, Homo sapiens
gggaggaaatgtgcagcgaatt

SEQ ID NO: 6896250 - DNA, 22 bp, Homo sapiens
gaatgtcttctgttcccagctg

SEQ ID NO: 6896251 - DNA, 22 bp, Homo sapiens
ctcctctttagccccagctgga

SEQ ID NO: 6896252 - DNA, 22 bp, Homo sapiens
ccttttatactcagtgatatca

SEQ ID NO: 6896253 - DNA, 17 bp, Homo sapiens
tgcattgttggaaattt

SEQ ID NO: 6896254 - DNA, 22 bp, Homo sapiens
agttcacagggaaggttattgt

SEQ ID NO: 6896255 - DNA, 22 bp, Homo sapiens
agatatcttacactttgaagtt

SEQ ID NO: 6896256 - DNA, 22 bp, Homo sapiens
atgcaacagggttgggaggcgg

SEQ ID NO: 6896257 - DNA, 22 bp, Homo sapiens
ttttctgtgtgtccctcgacag

SEQ ID NO: 6896258 - DNA, 22 bp, Homo sapiens
agttgttctaaagagattttaa

SEQ ID NO: 6896259 - DNA, 22 bp, Homo sapiens
ctgccctggggggcctccttgc

SEQ ID NO: 6896260 - DNA, 17 bp, Homo sapiens
ttctgctgtcgtcctct

SEQ ID NO: 6896261 - DNA, 22 bp, Homo sapiens
tgcctgtgggtgccaccaccct

SEQ ID NO: 6896262 - DNA, 22 bp, Homo sapiens
ggccctgtccccttcagttttg

SEQ ID NO: 6896263 - DNA, 22 bp, Homo sapiens
taatacagggcactttgagtga

SEQ ID NO: 6896264 - DNA, 22 bp, Homo sapiens
atgcactgtaggtgccatctgc

SEQ ID NO: 6896265 - DNA, 22 bp, Homo sapiens
cttgtgaaatgccagataatct

SEQ ID NO: 6896266 - DNA, 20 bp, Homo sapiens
gggctcttaggtagcagggg

SEQ ID NO: 6896267 - DNA, 22 bp, Homo sapiens
ccagggctcgggtgcttagtca

SEQ ID NO: 6896268 - DNA, 20 bp, Homo sapiens
acagtgttaggtttttcctt

SEQ ID NO: 6896269 - DNA, 22 bp, Homo sapiens
ggtgtccacattccctggcagg

SEQ ID NO: 6896270 - DNA, 22 bp, Homo sapiens
ctccttctcctcgggaggccag

SEQ ID NO: 6896271 - DNA, 22 bp, Homo sapiens
tctgccaacccgtattggtgcc

SEQ ID NO: 6896272 - DNA, 22 bp, Homo sapiens
tgcgcgctggcgtcacttagca

SEQ ID NO: 6896273 - DNA, 22 bp, Homo sapiens
cagttttctatggtagaagcat

SEQ ID NO: 6896274 - DNA, 22 bp, Homo sapiens
acagctgctctacaggttattt

SEQ ID NO: 6896275 - DNA, 22 bp, Homo sapiens
gaacaatagtggtaacaaagcc

SEQ ID NO: 6896276 - DNA, 22 bp, Homo sapiens
gcaaaaagtagtgctggttagg

SEQ ID NO: 6896277 - DNA, 22 bp, Homo sapiens
ctgctttaaaactgatacatga

SEQ ID NO: 6896278 - DNA, 22 bp, Homo sapiens
tttcagactgcccatgtttgcc

SEQ ID NO: 6896279 - DNA, 22 bp, Homo sapiens
actgatgtgacagctgagcaga

SEQ ID NO: 6896280 - DNA, 18 bp, Homo sapiens
tgtcagtaaagtgacaga

SEQ ID NO: 6896281 - DNA, 22 bp, Homo sapiens
ctattgcatttgcatcttcatc

SEQ ID NO: 6896282 - DNA, 22 bp, Homo sapiens
tcacatgtcacaaaacactgcc

SEQ ID NO: 6896283 - DNA, 18 bp, Homo sapiens
tgctgtgcacagccctat

SEQ ID NO: 6896284 - DNA, 22 bp, Homo sapiens
cgtaggtggctcagcacctggg

SEQ ID NO: 6896285 - DNA, 22 bp, Homo sapiens
ccaaggatgaggctcaaggagg

SEQ ID NO: 6896286 - DNA, 21 bp, Homo sapiens
ctctggtttgcattggattat

SEQ ID NO: 6896287 - DNA, 22 bp, Homo sapiens
tctgaaatgttctcttgttttg

SEQ ID NO: 6896288 - DNA, 22 bp, Homo sapiens
gctgataaattacccagcatct

SEQ ID NO: 6896289 - DNA, 22 bp, Homo sapiens
aggcagttggtcattgctcttt

SEQ ID NO: 6896290 - DNA, 21 bp, Homo sapiens
ctggccgacccctctgtgctc

SEQ ID NO: 6896291 - DNA, 22 bp, Homo sapiens
ccaccagagcttcgtggcttaa

SEQ ID NO: 6896292 - DNA, 22 bp, Homo sapiens
agcaggtgatgtgagtctggaa

SEQ ID NO: 6896293 - DNA, 22 bp, Homo sapiens
tcacaggctaaatttatgcagg

SEQ ID NO: 6896294 - DNA, 19 bp, Homo sapiens
gtttttagtttctgaactg

SEQ ID NO: 6896295 - DNA, 22 bp, Homo sapiens
agtggggtccatcccttccctc

SEQ ID NO: 6896296 - DNA, 22 bp, Homo sapiens
atttcatgaaacattccccttg

SEQ ID NO: 6896297 - DNA, 21 bp, Homo sapiens
attttctctggatgatggtca

SEQ ID NO: 6896298 - DNA, 22 bp, Homo sapiens
gtagaacactggggctctgttg

SEQ ID NO: 6896299 - DNA, 22 bp, Homo sapiens
ctcactcagtttttagttcatc

SEQ ID NO: 6896300 - DNA, 22 bp, Homo sapiens
acacatgtaaaacacttagcaa

SEQ ID NO: 6896301 - DNA, 21 bp, Homo sapiens
tctaagccttgcagatgggtt

SEQ ID NO: 6896302 - DNA, 22 bp, Homo sapiens
actggtgttgatttggaagggg

SEQ ID NO: 6896303 - DNA, 22 bp, Homo sapiens
ggcttgaagggaggaaagcagg

SEQ ID NO: 6896304 - DNA, 22 bp, Homo sapiens
agtttaagctggttataggcaa

SEQ ID NO: 6896305 - DNA, 22 bp, Homo sapiens
tatatgcaattttttagtgcaa

SEQ ID NO: 6896306 - DNA, 22 bp, Homo sapiens
atgtaaagtataaagtaagggg

SEQ ID NO: 6896307 - DNA, 22 bp, Homo sapiens
gacctcatgatccacctgcctt

SEQ ID NO: 6896308 - DNA, 22 bp, Homo sapiens
agtgtcacagacccaatcagga

SEQ ID NO: 6896309 - DNA, 22 bp, Homo sapiens
aacaggcttccaggagggacga

SEQ ID NO: 6896310 - DNA, 22 bp, Homo sapiens
tctctgtgagccaggtcctagt

SEQ ID NO: 6896311 - DNA, 22 bp, Homo sapiens
gggaaagagtgcttgtccagag

SEQ ID NO: 6896312 - DNA, 22 bp, Homo sapiens
tctgcaagctaaggaagcatct

SEQ ID NO: 6896313 - DNA, 22 bp, Homo sapiens
cagtgagataccacagagcaaa

SEQ ID NO: 6896314 - DNA, 22 bp, Homo sapiens
acagtgccctatgaacagctct

SEQ ID NO: 6896315 - DNA, 20 bp, Homo sapiens
aaagtgcacagatacagctc

SEQ ID NO: 6896316 - DNA, 22 bp, Homo sapiens
tccctgttttatatcctaacaa

SEQ ID NO: 6896317 - DNA, 23 bp, Homo sapiens
tgcctattcagcagagtgatagc

SEQ ID NO: 6896318 - DNA, 22 bp, Homo sapiens
gtctggaagggagtgcattttc

SEQ ID NO: 6896319 - DNA, 22 bp, Homo sapiens
cttctgtagccagtaacatata

SEQ ID NO: 6896320 - DNA, 22 bp, Homo sapiens
ctctgagtttcatttccctcct

SEQ ID NO: 6896321 - DNA, 22 bp, Homo sapiens
agtgggcttactgagggagtgt

SEQ ID NO: 6896322 - DNA, 22 bp, Homo sapiens
gctggctgaatcttctgcaata

SEQ ID NO: 6896323 - DNA, 22 bp, Homo sapiens
aagtgtttccattgtgcaggct

SEQ ID NO: 6896324 - DNA, 22 bp, Homo sapiens
atgtgagctccggcaggtggaa

SEQ ID NO: 6896325 - DNA, 23 bp, Homo sapiens
acaggctcttaatcagtgctcct

SEQ ID NO: 6896326 - DNA, 22 bp, Homo sapiens
tactatttggaattttaaattg

SEQ ID NO: 6896327 - DNA, 22 bp, Homo sapiens
gttcatttttactttgatctac

SEQ ID NO: 6896328 - DNA, 22 bp, Homo sapiens
tctgtgtgtgcctgttaatatt

SEQ ID NO: 6896329 - DNA, 22 bp, Homo sapiens
tttaccagaattgccaccagaa

SEQ ID NO: 6896330 - DNA, 22 bp, Homo sapiens
cctgtggaatagaatcttccct

SEQ ID NO: 6896331 - DNA, 17 bp, Homo sapiens
acagaggcaggagtgga

SEQ ID NO: 6896332 - DNA, 22 bp, Homo sapiens
tggccagtggggttgagcagga

SEQ ID NO: 6896333 - DNA, 22 bp, Homo sapiens
atgtagatgcaatggatgtcct

SEQ ID NO: 6896334 - DNA, 22 bp, Homo sapiens
aacagtctgggagttccttata

SEQ ID NO: 6896335 - DNA, 22 bp, Homo sapiens
ttagcaagataacagtaatttt

SEQ ID NO: 6896336 - DNA, 22 bp, Homo sapiens
gttcaagggctgtgtatgtggt

SEQ ID NO: 6896337 - DNA, 22 bp, Homo sapiens
tggatgtgagaaggatcaggct

SEQ ID NO: 6896338 - DNA, 22 bp, Homo sapiens
agcctggctgtaacctcatggt

SEQ ID NO: 6896339 - DNA, 22 bp, Homo sapiens
gaaggctccttgagggaaggac

SEQ ID NO: 6896340 - DNA, 22 bp, Homo sapiens
ggattgtgataattgttgcaaa

SEQ ID NO: 6896341 - DNA, 22 bp, Homo sapiens
gcaatactaagtgacttttggg

SEQ ID NO: 6896342 - DNA, 22 bp, Homo sapiens
ggccccagctgtggtgaataga

SEQ ID NO: 6896343 - DNA, 22 bp, Homo sapiens
cagggtcaggaggatctggctt

SEQ ID NO: 6896344 - DNA, 22 bp, Homo sapiens
agctgatgtgacaaaacatagg

SEQ ID NO: 6896345 - DNA, 22 bp, Homo sapiens
tacagatattgtacagttatag

SEQ ID NO: 6896346 - DNA, 22 bp, Homo sapiens
gctgcagccaaattcattgtca

SEQ ID NO: 6896347 - DNA, 22 bp, Homo sapiens
tccaggagggttttctgccttc

SEQ ID NO: 6896348 - DNA, 22 bp, Homo sapiens
gcagtgagttatgatcatgcca

SEQ ID NO: 6896349 - DNA, 22 bp, Homo sapiens
tctgcacctctgaaattggtca

SEQ ID NO: 6896350 - DNA, 22 bp, Homo sapiens
gataggattattcccatttcca

SEQ ID NO: 6896351 - DNA, 21 bp, Homo sapiens
gagcatggcttacatcagcag

SEQ ID NO: 6896352 - DNA, 18 bp, Homo sapiens
gagagctgctacctagct

SEQ ID NO: 6896353 - DNA, 22 bp, Homo sapiens
gcagcaggatggccaattgcca

SEQ ID NO: 6896354 - DNA, 22 bp, Homo sapiens
tcagagtgtgacttggtcatga

SEQ ID NO: 6896355 - DNA, 22 bp, Homo sapiens
atctggtatttcctttgatagc

SEQ ID NO: 6896356 - DNA, 20 bp, Homo sapiens
agaaatattgagttcagagg

SEQ ID NO: 6896357 - DNA, 22 bp, Homo sapiens
aaaggcatgggtgcctgcatgt

SEQ ID NO: 6896358 - DNA, 22 bp, Homo sapiens
gctgaattttgttctagggttt

SEQ ID NO: 6896359 - DNA, 23 bp, Homo sapiens
aatgatgtcagaagatgaagtct

SEQ ID NO: 6896360 - DNA, 22 bp, Homo sapiens
gggctggaggagatccagaggc

SEQ ID NO: 6896361 - DNA, 22 bp, Homo sapiens
cagtaattccaagtgcttatac

SEQ ID NO: 6896362 - DNA, 22 bp, Homo sapiens
acctgtgtttctgtagtggtca

SEQ ID NO: 6896363 - DNA, 22 bp, Homo sapiens
gacagcagcataatacatgaac

SEQ ID NO: 6896364 - DNA, 22 bp, Homo sapiens
aagacattactggaatctgact

SEQ ID NO: 6896365 - DNA, 22 bp, Homo sapiens
ctctaacactgtaatgctttct

SEQ ID NO: 6896366 - DNA, 22 bp, Homo sapiens
ttggtgttgaacaaaactaaat

SEQ ID NO: 6896367 - DNA, 22 bp, Homo sapiens
gtatagttccaagcatattttg

SEQ ID NO: 6896368 - DNA, 22 bp, Homo sapiens
cttttacactcatctgggaggg

SEQ ID NO: 6896369 - DNA, 22 bp, Homo sapiens
catgaagccctcatcagtctga

SEQ ID NO: 6896370 - DNA, 22 bp, Homo sapiens
cagtgcaggaagtgagatgcct

SEQ ID NO: 6896371 - DNA, 18 bp, Homo sapiens
tggctgcttccaggtaca

SEQ ID NO: 6896372 - DNA, 23 bp, Homo sapiens
tggaagtggcagggagacaaagc

SEQ ID NO: 6896373 - DNA, 22 bp, Homo sapiens
gagctggtgatcagctggagga

SEQ ID NO: 6896374 - DNA, 22 bp, Homo sapiens
gccaggctgctggctgctgtcc

SEQ ID NO: 6896375 - DNA, 22 bp, Homo sapiens
tatagcaaaatggtggatatca

SEQ ID NO: 6896376 - DNA, 22 bp, Homo sapiens
cagcttctttgggattctttat

SEQ ID NO: 6896377 - DNA, 22 bp, Homo sapiens
tcagcagtcaaagagaatctct

SEQ ID NO: 6896378 - DNA, 22 bp, Homo sapiens
tccaatatttctcacatatgga

SEQ ID NO: 6896379 - DNA, 18 bp, Homo sapiens
taccaaattctggatgtc

SEQ ID NO: 6896380 - DNA, 22 bp, Homo sapiens
gcaatgtctgtgctaaaaactg

SEQ ID NO: 6896381 - DNA, 19 bp, Homo sapiens
aggattccagaacagtgtt

SEQ ID NO: 6896382 - DNA, 21 bp, Homo sapiens
ctgggctcatggtgttacaga

SEQ ID NO: 6896383 - DNA, 22 bp, Homo sapiens
tgacaaaggcaggccagaagag

SEQ ID NO: 6896384 - DNA, 22 bp, Homo sapiens
agccattgagttttatgtgcta

SEQ ID NO: 6896385 - DNA, 22 bp, Homo sapiens
tgtcatctgcgggtggcactgc

SEQ ID NO: 6896386 - DNA, 22 bp, Homo sapiens
gctgtgcagagcacagggtccc

SEQ ID NO: 6896387 - DNA, 20 bp, Homo sapiens
agctggcccccggtggcctg

SEQ ID NO: 6896388 - DNA, 22 bp, Homo sapiens
aaagcagggtccaaggagatgt

SEQ ID NO: 6896389 - DNA, 22 bp, Homo sapiens
gacctcaggtttgtaatggaca

SEQ ID NO: 6896390 - DNA, 22 bp, Homo sapiens
ttattccatagaagtcaaggaa

SEQ ID NO: 6896391 - DNA, 22 bp, Homo sapiens
gctgccccgagccatccttcag

SEQ ID NO: 6896392 - DNA, 22 bp, Homo sapiens
ttcacagtaagtaggatagttg

SEQ ID NO: 6896393 - DNA, 20 bp, Homo sapiens
tgcagcttcacctgtgtcat

SEQ ID NO: 6896394 - DNA, 17 bp, Homo sapiens
cccagagatgctgcctt

SEQ ID NO: 6896395 - DNA, 22 bp, Homo sapiens
tagtgttccagaagcaaacaag

SEQ ID NO: 6896396 - DNA, 22 bp, Homo sapiens
aggtagctggtgctgggctcct

SEQ ID NO: 6896397 - DNA, 22 bp, Homo sapiens
ttattgggtcccaacaagttgc

SEQ ID NO: 6896398 - DNA, 22 bp, Homo sapiens
gtaaaactgcagaacttggagg

SEQ ID NO: 6896399 - DNA, 22 bp, Homo sapiens
gccagggaacccaagggcctca

SEQ ID NO: 6896400 - DNA, 22 bp, Homo sapiens
tcaggtggctggttgctggcta

SEQ ID NO: 6896401 - DNA, 22 bp, Homo sapiens
tgtcatatgttgatgaaagaga

SEQ ID NO: 6896402 - DNA, 22 bp, Homo sapiens
ttgttttattctgcaatttccc

SEQ ID NO: 6896403 - DNA, 22 bp, Homo sapiens
tacaatcaggataataatagtg

SEQ ID NO: 6896404 - DNA, 18 bp, Homo sapiens
tggcttctgaacaactgc

SEQ ID NO: 6896405 - DNA, 22 bp, Homo sapiens
gtagaaatgtaaccaggagata

SEQ ID NO: 6896406 - DNA, 22 bp, Homo sapiens
tgccatttgttactatcaggac

SEQ ID NO: 6896407 - DNA, 22 bp, Homo sapiens
gttcctgaaagatgagtaatta

SEQ ID NO: 6896408 - DNA, 21 bp, Homo sapiens
agcagacagatgcacgcacac

SEQ ID NO: 6896409 - DNA, 22 bp, Homo sapiens
tttctgcaacgagtctttgact

SEQ ID NO: 6896410 - DNA, 22 bp, Homo sapiens
ttccagtgaaacatgaggtgtg

SEQ ID NO: 6896411 - DNA, 22 bp, Homo sapiens
tagtgttaattcagtttataat

SEQ ID NO: 6896412 - DNA, 22 bp, Homo sapiens
ctgttatgcatggtcattgcct

SEQ ID NO: 6896413 - DNA, 22 bp, Homo sapiens
gtgagttattatttatgtaaac

SEQ ID NO: 6896414 - DNA, 22 bp, Homo sapiens
acttgccataaatgaaaatact

SEQ ID NO: 6896415 - DNA, 22 bp, Homo sapiens
tttgatagttagggggacaagc

SEQ ID NO: 6896416 - DNA, 22 bp, Homo sapiens
gagcagctgagctggaatgaga

SEQ ID NO: 6896417 - DNA, 22 bp, Homo sapiens
tcagtgcacaatgacggtggct

SEQ ID NO: 6896418 - DNA, 22 bp, Homo sapiens
ctagataacttattttcaagga

SEQ ID NO: 6896419 - DNA, 22 bp, Homo sapiens
taagttgtattcccttgctttt

SEQ ID NO: 6896420 - DNA, 22 bp, Homo sapiens
aatgcattttattatatgtgac

SEQ ID NO: 6896421 - DNA, 22 bp, Homo sapiens
aagctagataacttttatattt

SEQ ID NO: 6896422 - DNA, 22 bp, Homo sapiens
ctattctgtgtatttactggct

SEQ ID NO: 6896423 - DNA, 22 bp, Homo sapiens
ctacagtactggatgctcagcc

SEQ ID NO: 6896424 - DNA, 22 bp, Homo sapiens
ctgtgcttgtgttcattgttaa

SEQ ID NO: 6896425 - DNA, 22 bp, Homo sapiens
catggcattgcataacggggct

SEQ ID NO: 6896426 - DNA, 22 bp, Homo sapiens
ctccgcttgtgtatacctccaa

SEQ ID NO: 6896427 - DNA, 22 bp, Homo sapiens
tttcaagagaaaactaacctat

SEQ ID NO: 6896428 - DNA, 22 bp, Homo sapiens
gcttggaagtaggattgggaga

SEQ ID NO: 6896429 - DNA, 22 bp, Homo sapiens
tctgtatctaattttacagtag

SEQ ID NO: 6896430 - DNA, 21 bp, Homo sapiens
tttgtttgtatcagaatggcc

SEQ ID NO: 6896431 - DNA, 22 bp, Homo sapiens
ttgtttatcgcttgctcacata

SEQ ID NO: 6896432 - DNA, 22 bp, Homo sapiens
acatgtatgtgtgcaaacacat

SEQ ID NO: 6896433 - DNA, 22 bp, Homo sapiens
agagctttttgacatctctcta

SEQ ID NO: 6896434 - DNA, 22 bp, Homo sapiens
caagagtttaaatcaatggcca

SEQ ID NO: 6896435 - DNA, 22 bp, Homo sapiens
gcaacacaatatcccagtacat

SEQ ID NO: 6896436 - DNA, 22 bp, Homo sapiens
tttgataattaaaaattgtagt

SEQ ID NO: 6896437 - DNA, 22 bp, Homo sapiens
tccagtccttgcctctgtcagg

SEQ ID NO: 6896438 - DNA, 22 bp, Homo sapiens
aaatagcaatgtgaaaagagga

SEQ ID NO: 6896439 - DNA, 22 bp, Homo sapiens
agaaggctgagactgggatgaa

SEQ ID NO: 6896440 - DNA, 22 bp, Homo sapiens
gctctccaaaccctgtggcttt

SEQ ID NO: 6896441 - DNA, 22 bp, Homo sapiens
tgtcctgcccaaggtcacatac

SEQ ID NO: 6896442 - DNA, 22 bp, Homo sapiens
aggagggtacaatgggtggaaa

SEQ ID NO: 6896443 - DNA, 22 bp, Homo sapiens
gtttggatgtgtagtgagggga

SEQ ID NO: 6896444 - DNA, 22 bp, Homo sapiens
ttccaacaatgtgttattgttc

SEQ ID NO: 6896445 - DNA, 22 bp, Homo sapiens
caatgaacacagcaatttcata

SEQ ID NO: 6896446 - DNA, 22 bp, Homo sapiens
ggcatgctctttatattgcaat

SEQ ID NO: 6896447 - DNA, 22 bp, Homo sapiens
actgcttcactgcgtcttatct

SEQ ID NO: 6896448 - DNA, 22 bp, Homo sapiens
tgtctgagtgatccagtttctc

SEQ ID NO: 6896449 - DNA, 22 bp, Homo sapiens
ggtctggaacccctcaagtgac

SEQ ID NO: 6896450 - DNA, 22 bp, Homo sapiens
atggacagtgtgaagcagatag

SEQ ID NO: 6896451 - DNA, 22 bp, Homo sapiens
ggtgcatggtggaggtgaccct

SEQ ID NO: 6896452 - DNA, 22 bp, Homo sapiens
ctgtctgctcataatggagggc

SEQ ID NO: 6896453 - DNA, 23 bp, Homo sapiens
ttgtgggcagattccatggggag

SEQ ID NO: 6896454 - DNA, 22 bp, Homo sapiens
actttgctgcaggtttaaagag

SEQ ID NO: 6896455 - DNA, 22 bp, Homo sapiens
tggcttcctgcatggatcctct

SEQ ID NO: 6896456 - DNA, 22 bp, Homo sapiens
gctgctgcgcttgtctactgtt

SEQ ID NO: 6896457 - DNA, 23 bp, Homo sapiens
tgcatcaataaagccagggtttg

SEQ ID NO: 6896458 - DNA, 22 bp, Homo sapiens
gtatagaaggatctggtgaatt

SEQ ID NO: 6896459 - DNA, 20 bp, Homo sapiens
tcccccactgtttctgctac

SEQ ID NO: 6896460 - DNA, 22 bp, Homo sapiens
tcacagtgaggcagttcttgta

SEQ ID NO: 6896461 - DNA, 22 bp, Homo sapiens
gaatgctctttggtcctagact

SEQ ID NO: 6896462 - DNA, 22 bp, Homo sapiens
gttattggcagcatttcagagt

SEQ ID NO: 6896463 - DNA, 22 bp, Homo sapiens
accatttactcccattggaagt

SEQ ID NO: 6896464 - DNA, 23 bp, Homo sapiens
tggcctctccccacctggcagaa

SEQ ID NO: 6896465 - DNA, 22 bp, Homo sapiens
tgtgtccacgcactggcatgat

SEQ ID NO: 6896466 - DNA, 22 bp, Homo sapiens
cagcatggggcttggagtcagc

SEQ ID NO: 6896467 - DNA, 22 bp, Homo sapiens
ctggggagaagcgactcggctg

SEQ ID NO: 6896468 - DNA, 22 bp, Homo sapiens
ttttagacttgtatgtaaagcc

SEQ ID NO: 6896469 - DNA, 23 bp, Homo sapiens
tccttcagagcctccctccaagc

SEQ ID NO: 6896470 - DNA, 22 bp, Homo sapiens
tggaatcaagaactttggttat

SEQ ID NO: 6896471 - DNA, 22 bp, Homo sapiens
atctctgggctttgagtttgtt

SEQ ID NO: 6896472 - DNA, 22 bp, Homo sapiens
ggagaggcgatgagtcacagcc

SEQ ID NO: 6896473 - DNA, 22 bp, Homo sapiens
gagatgctttgtgtatagacaa

SEQ ID NO: 6896474 - DNA, 22 bp, Homo sapiens
gagcagatgtgtgccaggatgc

SEQ ID NO: 6896475 - DNA, 22 bp, Homo sapiens
gcctcaagacatttttaattgc

SEQ ID NO: 6896476 - DNA, 22 bp, Homo sapiens
tagtcagggatgcaattatgtg

SEQ ID NO: 6896477 - DNA, 22 bp, Homo sapiens
tggcagctttttgtttcaggct

SEQ ID NO: 6896478 - DNA, 22 bp, Homo sapiens
ttgtatacattatcctgtttca

SEQ ID NO: 6896479 - DNA, 22 bp, Homo sapiens
atcttcaaggaaaaaatacagt

SEQ ID NO: 6896480 - DNA, 22 bp, Homo sapiens
ttgtgcagagaaatctttcttg

SEQ ID NO: 6896481 - DNA, 22 bp, Homo sapiens
caaacatttgacttctctcagg

SEQ ID NO: 6896482 - DNA, 22 bp, Homo sapiens
cttccataatcttgtttattta

SEQ ID NO: 6896483 - DNA, 22 bp, Homo sapiens
aaacttgaaaggtactgttggt

SEQ ID NO: 6896484 - DNA, 22 bp, Homo sapiens
cactgactccaaaaataaagaa

SEQ ID NO: 6896485 - DNA, 22 bp, Homo sapiens
tttccttccaggttcctaaggc

SEQ ID NO: 6896486 - DNA, 22 bp, Homo sapiens
gaagttatttgctatctactga

SEQ ID NO: 6896487 - DNA, 20 bp, Homo sapiens
ctgaaccaaggctttctcag

SEQ ID NO: 6896488 - DNA, 22 bp, Homo sapiens
tctaatctacaaaaggaaattc

SEQ ID NO: 6896489 - DNA, 22 bp, Homo sapiens
agaaccttggtgagtctaacct

SEQ ID NO: 6896490 - DNA, 22 bp, Homo sapiens
agcctggatcctaggctcagct

SEQ ID NO: 6896491 - DNA, 22 bp, Homo sapiens
taggaagggctcagggctcggt

SEQ ID NO: 6896492 - DNA, 22 bp, Homo sapiens
gctgtgtaggatcctgttgtat

SEQ ID NO: 6896493 - DNA, 22 bp, Homo sapiens
aacttcacctttttgccacact

SEQ ID NO: 6896494 - DNA, 23 bp, Homo sapiens
tgcatatcagaaatttcatatgg

SEQ ID NO: 6896495 - DNA, 22 bp, Homo sapiens
tgtcactgttacatgaactctt

SEQ ID NO: 6896496 - DNA, 22 bp, Homo sapiens
acattcaacatggctggtctag

SEQ ID NO: 6896497 - DNA, 22 bp, Homo sapiens
acacagctcagtgcctccaaga

SEQ ID NO: 6896498 - DNA, 22 bp, Homo sapiens
aactttctagagatgagttcgg

SEQ ID NO: 6896499 - DNA, 22 bp, Homo sapiens
taggagagctgaactattgtct

SEQ ID NO: 6896500 - DNA, 22 bp, Homo sapiens
ggagccttactagaatgtgagc

SEQ ID NO: 6896501 - DNA, 22 bp, Homo sapiens
tagaattcaagattcaacaggc

SEQ ID NO: 6896502 - DNA, 17 bp, Homo sapiens
tagaatatggtgggctg

SEQ ID NO: 6896503 - DNA, 22 bp, Homo sapiens
gctgtggcaatgtttataatta

SEQ ID NO: 6896504 - DNA, 22 bp, Homo sapiens
acaggaatttcctaatattcga

SEQ ID NO: 6896505 - DNA, 22 bp, Homo sapiens
accacagctttgcaccaggtgt

SEQ ID NO: 6896506 - DNA, 22 bp, Homo sapiens
ttcccagacctgtaggatcaga

SEQ ID NO: 6896507 - DNA, 22 bp, Homo sapiens
gtgcaaaagtaatggcagtttt

SEQ ID NO: 6896508 - DNA, 22 bp, Homo sapiens
aggcaaggaagaattctcccct

SEQ ID NO: 6896509 - DNA, 22 bp, Homo sapiens
tatctagatagtttagccatct

SEQ ID NO: 6896510 - DNA, 22 bp, Homo sapiens
ctaaaggctaggtctgaactca

SEQ ID NO: 6896511 - DNA, 22 bp, Homo sapiens
tgtggcctccccacttctgggg

SEQ ID NO: 6896512 - DNA, 22 bp, Homo sapiens
ggtcaggatccaagtctgtgct

SEQ ID NO: 6896513 - DNA, 22 bp, Homo sapiens
tagtctctgtggtcctgaggaa

SEQ ID NO: 6896514 - DNA, 22 bp, Homo sapiens
tgcccttataaaggaggcctga

SEQ ID NO: 6896515 - DNA, 22 bp, Homo sapiens
tgactctgaattgggaaatggg

SEQ ID NO: 6896516 - DNA, 22 bp, Homo sapiens
gcagaggtgctcagtggcagaa

SEQ ID NO: 6896517 - DNA, 23 bp, Homo sapiens
tttagcttataaatgcttttgaa

SEQ ID NO: 6896518 - DNA, 22 bp, Homo sapiens
taaagccctctgatcacactgg

SEQ ID NO: 6896519 - DNA, 22 bp, Homo sapiens
atcctgggaagtggcctcctcc

SEQ ID NO: 6896520 - DNA, 22 bp, Homo sapiens
taatacagtttccaagccagct

SEQ ID NO: 6896521 - DNA, 22 bp, Homo sapiens
ttattatggcagttttctaggt

SEQ ID NO: 6896522 - DNA, 22 bp, Homo sapiens
aatcaagagcggcgacagcctt

SEQ ID NO: 6896523 - DNA, 22 bp, Homo sapiens
tatttctgtaactcagggtctg

SEQ ID NO: 6896524 - DNA, 22 bp, Homo sapiens
actctgtgggtgagcctggaca

SEQ ID NO: 6896525 - DNA, 22 bp, Homo sapiens
tcttagaatgtcaactgatgtt

SEQ ID NO: 6896526 - DNA, 22 bp, Homo sapiens
ctgcagcagtgtgtctcatttt

SEQ ID NO: 6896527 - DNA, 22 bp, Homo sapiens
tggcaggtccactcacagatct

SEQ ID NO: 6896528 - DNA, 22 bp, Homo sapiens
aggttccaagaaatcatcagtg

SEQ ID NO: 6896529 - DNA, 22 bp, Homo sapiens
agcacagagaagatttcaatta

SEQ ID NO: 6896530 - DNA, 22 bp, Homo sapiens
gcagaatgtttccaaggtttgt

SEQ ID NO: 6896531 - DNA, 22 bp, Homo sapiens
tgaccagtgagcacagcatggt

SEQ ID NO: 6896532 - DNA, 22 bp, Homo sapiens
atgcttgggactccctgtagca

SEQ ID NO: 6896533 - DNA, 22 bp, Homo sapiens
cagctggccccacagtagaggc

SEQ ID NO: 6896534 - DNA, 22 bp, Homo sapiens
tagtagaatccaaaccaacagt

SEQ ID NO: 6896535 - DNA, 22 bp, Homo sapiens
agaaaataatttcttggctggt

SEQ ID NO: 6896536 - DNA, 22 bp, Homo sapiens
atgaatctgttttttgtcaata

SEQ ID NO: 6896537 - DNA, 22 bp, Homo sapiens
atgtaaccaccacacaaagcaa

SEQ ID NO: 6896538 - DNA, 22 bp, Homo sapiens
ggctggaatagagactgactgg

SEQ ID NO: 6896539 - DNA, 22 bp, Homo sapiens
agttccaccatttaggatctgt

SEQ ID NO: 6896540 - DNA, 22 bp, Homo sapiens
gcatttgttccgctttgtcatc

SEQ ID NO: 6896541 - DNA, 23 bp, Homo sapiens
ctgtacacaaactgcctgcctgt

SEQ ID NO: 6896542 - DNA, 22 bp, Homo sapiens
atgtgctttaaagaagccagct

SEQ ID NO: 6896543 - DNA, 22 bp, Homo sapiens
ctttggaacacatgggcatggt

SEQ ID NO: 6896544 - DNA, 22 bp, Homo sapiens
tatggaacgctagaggaagaaa

SEQ ID NO: 6896545 - DNA, 22 bp, Homo sapiens
gggcagagagctggaactcctt

SEQ ID NO: 6896546 - DNA, 22 bp, Homo sapiens
tggaggaagtggacagttgtgt

SEQ ID NO: 6896547 - DNA, 22 bp, Homo sapiens
taggttcactgtcttgaggagc

SEQ ID NO: 6896548 - DNA, 19 bp, Homo sapiens
tgaataacaataatggcta

SEQ ID NO: 6896549 - DNA, 19 bp, Homo sapiens
cctcagagctagtgaacat

SEQ ID NO: 6896550 - DNA, 22 bp, Homo sapiens
atttcatactaaggctcaaaaa

SEQ ID NO: 6896551 - DNA, 22 bp, Homo sapiens
agcatctggtgagggcctagtt

SEQ ID NO: 6896552 - DNA, 22 bp, Homo sapiens
ttcagcctgttcatgctgttgc

SEQ ID NO: 6896553 - DNA, 22 bp, Homo sapiens
agttaggagtataggaatgcct

SEQ ID NO: 6896554 - DNA, 22 bp, Homo sapiens
atcaaagtatctcaatatggta

SEQ ID NO: 6896555 - DNA, 22 bp, Homo sapiens
gcttgtttctatttatcaagta

SEQ ID NO: 6896556 - DNA, 22 bp, Homo sapiens
tgtcccatggataccaggctat

SEQ ID NO: 6896557 - DNA, 22 bp, Homo sapiens
ctggaggacccctgcctggaag

SEQ ID NO: 6896558 - DNA, 22 bp, Homo sapiens
ttgatgtctaagtcattggcct

SEQ ID NO: 6896559 - DNA, 22 bp, Homo sapiens
cgggctgctctggaccgacagc

SEQ ID NO: 6896560 - DNA, 22 bp, Homo sapiens
gctgcagagtgatgaagtgggg

SEQ ID NO: 6896561 - DNA, 20 bp, Homo sapiens
ctgtccatatttgaaaatgc

SEQ ID NO: 6896562 - DNA, 21 bp, Homo sapiens
tgggcctcaagtgggtggcag

SEQ ID NO: 6896563 - DNA, 22 bp, Homo sapiens
ttgaatgcgttgtgtggcccgt

SEQ ID NO: 6896564 - DNA, 23 bp, Homo sapiens
actgagccagggcctgggtcagc

SEQ ID NO: 6896565 - DNA, 22 bp, Homo sapiens
aggagagaatgttccaggcttg

SEQ ID NO: 6896566 - DNA, 22 bp, Homo sapiens
tttatctttggatcttcagaaa

SEQ ID NO: 6896567 - DNA, 22 bp, Homo sapiens
gactgtgggaagactgtaggtt

SEQ ID NO: 6896568 - DNA, 22 bp, Homo sapiens
tacaatgtacttccttgcacag

SEQ ID NO: 6896569 - DNA, 22 bp, Homo sapiens
acaccagggatatgaggaagga

SEQ ID NO: 6896570 - DNA, 19 bp, Homo sapiens
ggctggagaaaggaatcag

SEQ ID NO: 6896571 - DNA, 22 bp, Homo sapiens
aggagaaggaggcccctcacac

SEQ ID NO: 6896572 - DNA, 22 bp, Homo sapiens
gaagaggcaattgaataagcta

SEQ ID NO: 6896573 - DNA, 22 bp, Homo sapiens
gatgaaatttgaaaatagtgtt

SEQ ID NO: 6896574 - DNA, 18 bp, Homo sapiens
catagcacttcagcacat

SEQ ID NO: 6896575 - DNA, 22 bp, Homo sapiens
attatttgacttgagaacaggt

SEQ ID NO: 6896576 - DNA, 22 bp, Homo sapiens
agaggggaaggatgtgatgtga

SEQ ID NO: 6896577 - DNA, 22 bp, Homo sapiens
tacagcccaagaagtttatacg

SEQ ID NO: 6896578 - DNA, 22 bp, Homo sapiens
tgtatgaaggtttacctgctgt

SEQ ID NO: 6896579 - DNA, 19 bp, Homo sapiens
tttttacaagtaggtgtga

SEQ ID NO: 6896580 - DNA, 22 bp, Homo sapiens
acttcctagtgagatgaacccg

SEQ ID NO: 6896581 - DNA, 22 bp, Homo sapiens
tgccttttgttagggctgccag

SEQ ID NO: 6896582 - DNA, 22 bp, Homo sapiens
tggatgtttgaagttgcatgtg

SEQ ID NO: 6896583 - DNA, 22 bp, Homo sapiens
aaaggtatgatactgtgacatg

SEQ ID NO: 6896584 - DNA, 22 bp, Homo sapiens
cggtcctgtacttgatgagata

SEQ ID NO: 6896585 - DNA, 22 bp, Homo sapiens
ttctagaagtgtctatgtctgt

SEQ ID NO: 6896586 - DNA, 22 bp, Homo sapiens
tcagagtccatggtacttaatt

SEQ ID NO: 6896587 - DNA, 22 bp, Homo sapiens
aagcccggttgggaacgtggtg

SEQ ID NO: 6896588 - DNA, 23 bp, Homo sapiens
agggccaggtgcggaaacagctc

SEQ ID NO: 6896589 - DNA, 19 bp, Homo sapiens
aatgcctcaaattgggaga

SEQ ID NO: 6896590 - DNA, 22 bp, Homo sapiens
agcaccaggtcgctggcacgct

SEQ ID NO: 6896591 - DNA, 22 bp, Homo sapiens
tgtgaggacctcagcagagtct

SEQ ID NO: 6896592 - DNA, 22 bp, Homo sapiens
ccctaagaatctcccttgtagc

SEQ ID NO: 6896593 - DNA, 22 bp, Homo sapiens
ggcctgtggtttctagtaggtt

SEQ ID NO: 6896594 - DNA, 22 bp, Homo sapiens
ggcatttatttgtctcattctt

SEQ ID NO: 6896595 - DNA, 22 bp, Homo sapiens
gagggctctactcaccaccctg

SEQ ID NO: 6896596 - DNA, 22 bp, Homo sapiens
aaagcagtcactccagtgtgat

SEQ ID NO: 6896597 - DNA, 22 bp, Homo sapiens
tttctctctgactgggagctga

SEQ ID NO: 6896598 - DNA, 22 bp, Homo sapiens
atcctgtgaggataagcccttg

SEQ ID NO: 6896599 - DNA, 22 bp, Homo sapiens
ggactttaaaaagatgaccttt

SEQ ID NO: 6896600 - DNA, 22 bp, Homo sapiens
gttttcttcctgcaattggcat

SEQ ID NO: 6896601 - DNA, 22 bp, Homo sapiens
tgcaagacgtgaaattgagaca

SEQ ID NO: 6896602 - DNA, 22 bp, Homo sapiens
taggtcatcagattgacaaggg

SEQ ID NO: 6896603 - DNA, 22 bp, Homo sapiens
tcactgtatttggaagggatgg

SEQ ID NO: 6896604 - DNA, 22 bp, Homo sapiens
ggcattctaggccaaaatcagg

SEQ ID NO: 6896605 - DNA, 22 bp, Homo sapiens
tatttggaaaagggaagggaca

SEQ ID NO: 6896606 - DNA, 22 bp, Homo sapiens
taaaggtagcatgaaactgcaa

SEQ ID NO: 6896607 - DNA, 22 bp, Homo sapiens
tgattcgattcctttgtcttca

SEQ ID NO: 6896608 - DNA, 23 bp, Homo sapiens
ctcctggtgctgctatcaggggt

SEQ ID NO: 6896609 - DNA, 22 bp, Homo sapiens
cagcagctggttgaatccttct

SEQ ID NO: 6896610 - DNA, 23 bp, Homo sapiens
tggtccctcaaggaggccagggc

SEQ ID NO: 6896611 - DNA, 22 bp, Homo sapiens
agaacaggcagttggttggatt

SEQ ID NO: 6896612 - DNA, 22 bp, Homo sapiens
tgggctggctgaggcattcact

SEQ ID NO: 6896613 - DNA, 23 bp, Homo sapiens
tagtgtcaagagggagtgtaatt

SEQ ID NO: 6896614 - DNA, 22 bp, Homo sapiens
aaatgtatcctacttcctgagt

SEQ ID NO: 6896615 - DNA, 19 bp, Homo sapiens
ggccctgtaggatgtgagt

SEQ ID NO: 6896616 - DNA, 22 bp, Homo sapiens
gtttactggagaagatgacctg

SEQ ID NO: 6896617 - DNA, 19 bp, Homo sapiens
cacgagttctcttagcaaa

SEQ ID NO: 6896618 - DNA, 22 bp, Homo sapiens
tctccagaggtcccttgtctct

SEQ ID NO: 6896619 - DNA, 22 bp, Homo sapiens
aatgaacagatacacataggca

SEQ ID NO: 6896620 - DNA, 22 bp, Homo sapiens
gctcaggcctcggacacacaat

SEQ ID NO: 6896621 - DNA, 22 bp, Homo sapiens
cagctccctatggtgaggcgac

SEQ ID NO: 6896622 - DNA, 22 bp, Homo sapiens
tgagagcacagtgtggtctgga

SEQ ID NO: 6896623 - DNA, 22 bp, Homo sapiens
tacagataaaaatgctgttctt

SEQ ID NO: 6896624 - DNA, 22 bp, Homo sapiens
gtgatacaggtgttctggatat

SEQ ID NO: 6896625 - DNA, 22 bp, Homo sapiens
tgcaaagtcgcaaaattcttct

SEQ ID NO: 6896626 - DNA, 23 bp, Homo sapiens
tgtggaacgccataggagcacga

SEQ ID NO: 6896627 - DNA, 22 bp, Homo sapiens
ctgtcctccggccacctacagt

SEQ ID NO: 6896628 - DNA, 22 bp, Homo sapiens
gcagatgatgtagacagacagt

SEQ ID NO: 6896629 - DNA, 22 bp, Homo sapiens
tataacaggaagtattcaaaca

SEQ ID NO: 6896630 - DNA, 22 bp, Homo sapiens
atgctatgtaactggcagatag

SEQ ID NO: 6896631 - DNA, 22 bp, Homo sapiens
ccctcaggtgaaaggaaaaatt

SEQ ID NO: 6896632 - DNA, 22 bp, Homo sapiens
gcagctgtcgctaggagctgtg

SEQ ID NO: 6896633 - DNA, 22 bp, Homo sapiens
ttagattctgttgttgctagtg

SEQ ID NO: 6896634 - DNA, 22 bp, Homo sapiens
agccccccaagggccttctctt

SEQ ID NO: 6896635 - DNA, 22 bp, Homo sapiens
tgacaggcttgctaagacatag

SEQ ID NO: 6896636 - DNA, 22 bp, Homo sapiens
gactcgctcccttttgtcttat

SEQ ID NO: 6896637 - DNA, 22 bp, Homo sapiens
tcagtggagctaagcatgagat

SEQ ID NO: 6896638 - DNA, 22 bp, Homo sapiens
tatacctttaccttgaccaaat

SEQ ID NO: 6896639 - DNA, 22 bp, Homo sapiens
acaggctcgtgcgcgcacgtgt

SEQ ID NO: 6896640 - DNA, 18 bp, Homo sapiens
acagggatggggtaagtg

SEQ ID NO: 6896641 - DNA, 22 bp, Homo sapiens
tttactaccattctgatcagtg

SEQ ID NO: 6896642 - DNA, 22 bp, Homo sapiens
ttggtgagtgctatgtaccaca

SEQ ID NO: 6896643 - DNA, 22 bp, Homo sapiens
gaggttcagctgctgcctggta

SEQ ID NO: 6896644 - DNA, 22 bp, Homo sapiens
aatgataagacatgagtagagg

SEQ ID NO: 6896645 - DNA, 22 bp, Homo sapiens
aagggcaagatcctaagcatcc

SEQ ID NO: 6896646 - DNA, 22 bp, Homo sapiens
agtgtttgcatctcattgattt

SEQ ID NO: 6896647 - DNA, 22 bp, Homo sapiens
taactcaacttggagggttctt

SEQ ID NO: 6896648 - DNA, 22 bp, Homo sapiens
aagatgtgctatcaactggaga

SEQ ID NO: 6896649 - DNA, 22 bp, Homo sapiens
cagggaaagtcccaccccacac

SEQ ID NO: 6896650 - DNA, 22 bp, Homo sapiens
aacttgccaagagctttgctag

SEQ ID NO: 6896651 - DNA, 22 bp, Homo sapiens
gacaccagcaaggctgtgagga

SEQ ID NO: 6896652 - DNA, 22 bp, Homo sapiens
ccctcatgccagacagcatgca

SEQ ID NO: 6896653 - DNA, 22 bp, Homo sapiens
tactgttttttagactcatggt

SEQ ID NO: 6896654 - DNA, 22 bp, Homo sapiens
ctgccaggtaaactgcaggaat

SEQ ID NO: 6896655 - DNA, 22 bp, Homo sapiens
tgggtaggggacgtggaagaaa

SEQ ID NO: 6896656 - DNA, 22 bp, Homo sapiens
actacatttgcagagaagcaat

SEQ ID NO: 6896657 - DNA, 22 bp, Homo sapiens
tgttcctgtttctgcgtagttt

SEQ ID NO: 6896658 - DNA, 22 bp, Homo sapiens
acatttgaaataaactcaagtg

SEQ ID NO: 6896659 - DNA, 22 bp, Homo sapiens
cagatcagtgtggcattagcag

SEQ ID NO: 6896660 - DNA, 22 bp, Homo sapiens
gtttcctggaaactgctccact

SEQ ID NO: 6896661 - DNA, 22 bp, Homo sapiens
ctccagggagctgcgggagcca

SEQ ID NO: 6896662 - DNA, 22 bp, Homo sapiens
ttctagaatgttttgaaaggga

SEQ ID NO: 6896663 - DNA, 22 bp, Homo sapiens
ttgctgagctttggcaaggaag

SEQ ID NO: 6896664 - DNA, 22 bp, Homo sapiens
attttagtacctcaagtatcca

SEQ ID NO: 6896665 - DNA, 22 bp, Homo sapiens
gcagccctagcgacaaattgat

SEQ ID NO: 6896666 - DNA, 19 bp, Homo sapiens
gactaaataataatagcag

SEQ ID NO: 6896667 - DNA, 22 bp, Homo sapiens
ctggtcagggtagtgttgcaga

SEQ ID NO: 6896668 - DNA, 22 bp, Homo sapiens
aagggtttgtctccctcaaggc

SEQ ID NO: 6896669 - DNA, 22 bp, Homo sapiens
ggtgcctttggcccctggctag

SEQ ID NO: 6896670 - DNA, 22 bp, Homo sapiens
tggctaagaattggcagctgct

SEQ ID NO: 6896671 - DNA, 22 bp, Homo sapiens
gctgtacatcacaatttgctgt

SEQ ID NO: 6896672 - DNA, 22 bp, Homo sapiens
cagaaataaagtggacagagta

SEQ ID NO: 6896673 - DNA, 22 bp, Homo sapiens
caggaaacattcccataacaca

SEQ ID NO: 6896674 - DNA, 22 bp, Homo sapiens
tatgtgcaggggcaggagctca

SEQ ID NO: 6896675 - DNA, 22 bp, Homo sapiens
gctgctggggccttccctcggg

SEQ ID NO: 6896676 - DNA, 22 bp, Homo sapiens
ggctccagatgtcccctggcaa

SEQ ID NO: 6896677 - DNA, 22 bp, Homo sapiens
agatgccttgtaaaataggaca

SEQ ID NO: 6896678 - DNA, 22 bp, Homo sapiens
gaggcctggagccgcctaggcg

SEQ ID NO: 6896679 - DNA, 22 bp, Homo sapiens
gtcctggtcctgcctccccatg

SEQ ID NO: 6896680 - DNA, 22 bp, Homo sapiens
actctgtatccctctcaaattg

SEQ ID NO: 6896681 - DNA, 22 bp, Homo sapiens
aagcaagagttggagtgatgtt

SEQ ID NO: 6896682 - DNA, 22 bp, Homo sapiens
caggcaccccaggtgagcactg

SEQ ID NO: 6896683 - DNA, 22 bp, Homo sapiens
tgctctggaaataaatgattta

SEQ ID NO: 6896684 - DNA, 22 bp, Homo sapiens
ttgggaaacagtatagctaaca

SEQ ID NO: 6896685 - DNA, 22 bp, Homo sapiens
ggacatcttccagctgcttgcc

SEQ ID NO: 6896686 - DNA, 23 bp, Homo sapiens
ggctggtgcccttggccagtcgg

SEQ ID NO: 6896687 - DNA, 22 bp, Homo sapiens
ctgtctgttcagattcattact

SEQ ID NO: 6896688 - DNA, 18 bp, Homo sapiens
caagtatagaattaggtt

SEQ ID NO: 6896689 - DNA, 22 bp, Homo sapiens
acagcttttgaaaaattactgg

SEQ ID NO: 6896690 - DNA, 22 bp, Homo sapiens
aagtctgggcctccttcccaga

SEQ ID NO: 6896691 - DNA, 22 bp, Homo sapiens
agtggctgaagcatcaaaggca

SEQ ID NO: 6896692 - DNA, 22 bp, Homo sapiens
ggcaggctcagcagccaaggag

SEQ ID NO: 6896693 - DNA, 22 bp, Homo sapiens
ctccagattcctgctggcagaa

SEQ ID NO: 6896694 - DNA, 18 bp, Homo sapiens
gcgctggctgtcctgtcc

SEQ ID NO: 6896695 - DNA, 22 bp, Homo sapiens
acaggggaatttactgtcatta

SEQ ID NO: 6896696 - DNA, 22 bp, Homo sapiens
tccattttagagatgaagaaac

SEQ ID NO: 6896697 - DNA, 22 bp, Homo sapiens
tgacacaattgagtggtactat

SEQ ID NO: 6896698 - DNA, 22 bp, Homo sapiens
aggttagataagaaggttgtgg

SEQ ID NO: 6896699 - DNA, 22 bp, Homo sapiens
taggagggccctgaaaatggca

SEQ ID NO: 6896700 - DNA, 22 bp, Homo sapiens
aggcagcaaatgtctggaacag

SEQ ID NO: 6896701 - DNA, 22 bp, Homo sapiens
tgcagtcctaaatatatagctg

SEQ ID NO: 6896702 - DNA, 22 bp, Homo sapiens
tggtggggattccctccctggc

SEQ ID NO: 6896703 - DNA, 22 bp, Homo sapiens
tagaggcataagagggaagcag

SEQ ID NO: 6896704 - DNA, 22 bp, Homo sapiens
taaagtcagagatccttggctt

SEQ ID NO: 6896705 - DNA, 18 bp, Homo sapiens
ctctgaaagacacaccag

SEQ ID NO: 6896706 - DNA, 22 bp, Homo sapiens
ataagttggtggtctttaatta

SEQ ID NO: 6896707 - DNA, 22 bp, Homo sapiens
gcctcaggtaaaacttgagttt

SEQ ID NO: 6896708 - DNA, 20 bp, Homo sapiens
cttagaagggacatcctggg

SEQ ID NO: 6896709 - DNA, 23 bp, Homo sapiens
tttcaaggtgtctgtaccactga

SEQ ID NO: 6896710 - DNA, 22 bp, Homo sapiens
ggccttaggctcaacaggcaga

SEQ ID NO: 6896711 - DNA, 22 bp, Homo sapiens
agccaaaacatgtgagttttga

SEQ ID NO: 6896712 - DNA, 22 bp, Homo sapiens
atgttacacataggcataaatg

SEQ ID NO: 6896713 - DNA, 22 bp, Homo sapiens
gaaggcaggtttttcaaaactg

SEQ ID NO: 6896714 - DNA, 22 bp, Homo sapiens
atgtagaaattaggatgatagt

SEQ ID NO: 6896715 - DNA, 22 bp, Homo sapiens
tagtgtctgttgcttttgttca

SEQ ID NO: 6896716 - DNA, 22 bp, Homo sapiens
agcccagcttccttctgtctct

SEQ ID NO: 6896717 - DNA, 22 bp, Homo sapiens
gtctgccctgagctcccagtgc

SEQ ID NO: 6896718 - DNA, 20 bp, Homo sapiens
gtgtctggagtactagagag

SEQ ID NO: 6896719 - DNA, 22 bp, Homo sapiens
gcagggcttgcagcagctagac

SEQ ID NO: 6896720 - DNA, 22 bp, Homo sapiens
aacatcttgtccttagattaaa

SEQ ID NO: 6896721 - DNA, 22 bp, Homo sapiens
tttgaacaggagtatctatagt

SEQ ID NO: 6896722 - DNA, 21 bp, Homo sapiens
ggtcccattgtgaggcttgaa

SEQ ID NO: 6896723 - DNA, 22 bp, Homo sapiens
cttttctgagagggccaagatt

SEQ ID NO: 6896724 - DNA, 22 bp, Homo sapiens
tctgccacatgagggcacagca

SEQ ID NO: 6896725 - DNA, 22 bp, Homo sapiens
ctgagatattaagctctggctt

SEQ ID NO: 6896726 - DNA, 22 bp, Homo sapiens
tgaggcccaccttggccccggc

SEQ ID NO: 6896727 - DNA, 22 bp, Homo sapiens
ttctttctcactctttaggaag

SEQ ID NO: 6896728 - DNA, 22 bp, Homo sapiens
ggtggcatttaaattaattaag

SEQ ID NO: 6896729 - DNA, 22 bp, Homo sapiens
cagtggaatacgagcagatgtc

SEQ ID NO: 6896730 - DNA, 22 bp, Homo sapiens
atgcacagtacaaactggaaac

SEQ ID NO: 6896731 - DNA, 19 bp, Homo sapiens
gagacatgtagatagaaga

SEQ ID NO: 6896732 - DNA, 16 bp, Homo sapiens
gagggcagaggcggaa

SEQ ID NO: 6896733 - DNA, 22 bp, Homo sapiens
gcactggtatcacctgagagct

SEQ ID NO: 6896734 - DNA, 22 bp, Homo sapiens
ttaagcatttagttgtattgcc

SEQ ID NO: 6896735 - DNA, 22 bp, Homo sapiens
tctttgatcagcctttcactga

SEQ ID NO: 6896736 - DNA, 22 bp, Homo sapiens
ttctgtcccactggtctgtttg

SEQ ID NO: 6896737 - DNA, 20 bp, Homo sapiens
gcactggtctggatctcctg

SEQ ID NO: 6896738 - DNA, 22 bp, Homo sapiens
ccctgacagatggcaggggagc

SEQ ID NO: 6896739 - DNA, 22 bp, Homo sapiens
tggcagagccttgccaaactcc

SEQ ID NO: 6896740 - DNA, 22 bp, Homo sapiens
ttttgcctagggttgacccgtt

SEQ ID NO: 6896741 - DNA, 22 bp, Homo sapiens
gagagaaaaatgagcttcattg

SEQ ID NO: 6896742 - DNA, 22 bp, Homo sapiens
ttgctaaatccctataatattc

SEQ ID NO: 6896743 - DNA, 22 bp, Homo sapiens
gcagagaacccagcagattggc

SEQ ID NO: 6896744 - DNA, 22 bp, Homo sapiens
cttattctactccacaagctct

SEQ ID NO: 6896745 - DNA, 22 bp, Homo sapiens
cagctgagaaatggggaaaggg

SEQ ID NO: 6896746 - DNA, 22 bp, Homo sapiens
catagtgactcatgcctataat

SEQ ID NO: 6896747 - DNA, 21 bp, Homo sapiens
ctgtgcttcttcctaagccag

SEQ ID NO: 6896748 - DNA, 22 bp, Homo sapiens
catgtcactttaacaaattagt

SEQ ID NO: 6896749 - DNA, 22 bp, Homo sapiens
gactagggaatcattcttggat

SEQ ID NO: 6896750 - DNA, 22 bp, Homo sapiens
ttgagtcagtaattccatttct

SEQ ID NO: 6896751 - DNA, 22 bp, Homo sapiens
gtgtgagtgaaagtagtttgat

SEQ ID NO: 6896752 - DNA, 22 bp, Homo sapiens
ttctgatgatggcggctggagc

SEQ ID NO: 6896753 - DNA, 22 bp, Homo sapiens
tcttttagaaaagttgaatgta

SEQ ID NO: 6896754 - DNA, 18 bp, Homo sapiens
tggctcctgcctcctgca

SEQ ID NO: 6896755 - DNA, 22 bp, Homo sapiens
tgtatttcgctaggtactccct

SEQ ID NO: 6896756 - DNA, 22 bp, Homo sapiens
agctgtaagctttgggcaagtc

SEQ ID NO: 6896757 - DNA, 22 bp, Homo sapiens
tctatttgctggttgcttctgt

SEQ ID NO: 6896758 - DNA, 22 bp, Homo sapiens
gcagtggtccttacttcccagc

SEQ ID NO: 6896759 - DNA, 22 bp, Homo sapiens
gcataaatgttctttcagattt

SEQ ID NO: 6896760 - DNA, 22 bp, Homo sapiens
gagagctgtgttcattctacca

SEQ ID NO: 6896761 - DNA, 22 bp, Homo sapiens
tggaaacagatcataactaagc

SEQ ID NO: 6896762 - DNA, 22 bp, Homo sapiens
tatattgactttaaagaagcaa

SEQ ID NO: 6896763 - DNA, 22 bp, Homo sapiens
agcaagcagtgaagttgaatgt

SEQ ID NO: 6896764 - DNA, 22 bp, Homo sapiens
tgattctgcttatgggtggatt

SEQ ID NO: 6896765 - DNA, 17 bp, Homo sapiens
cttggcacctctgccat

SEQ ID NO: 6896766 - DNA, 22 bp, Homo sapiens
aattcatgagtagaatctatat

SEQ ID NO: 6896767 - DNA, 22 bp, Homo sapiens
caaagcagcctgcagtgtggac

SEQ ID NO: 6896768 - DNA, 19 bp, Homo sapiens
tgggatgatgcagaaggta

SEQ ID NO: 6896769 - DNA, 22 bp, Homo sapiens
tctaggcattgttattacaact

SEQ ID NO: 6896770 - DNA, 22 bp, Homo sapiens
cctactcactcttttcatgctt

SEQ ID NO: 6896771 - DNA, 22 bp, Homo sapiens
gagtctcctactggctgtcctt

SEQ ID NO: 6896772 - DNA, 22 bp, Homo sapiens
tggatccagctgctcctatgag

SEQ ID NO: 6896773 - DNA, 19 bp, Homo sapiens
catgtgcacatgtgaatgc

SEQ ID NO: 6896774 - DNA, 22 bp, Homo sapiens
ggaggcgatcctgggaaacacc

SEQ ID NO: 6896775 - DNA, 22 bp, Homo sapiens
cccaccacgtgctttgctggag

SEQ ID NO: 6896776 - DNA, 22 bp, Homo sapiens
ctaatgtggactctatcaaagt

SEQ ID NO: 6896777 - DNA, 18 bp, Homo sapiens
cgccctgctataaatgac

SEQ ID NO: 6896778 - DNA, 22 bp, Homo sapiens
ctttgacatccttgttcctcag

SEQ ID NO: 6896779 - DNA, 22 bp, Homo sapiens
gccacagcctctgggaaaactc

SEQ ID NO: 6896780 - DNA, 22 bp, Homo sapiens
aggatgagccgcgcaagctgac

SEQ ID NO: 6896781 - DNA, 22 bp, Homo sapiens
aaaaggaggcaaacagcctaga

SEQ ID NO: 6896782 - DNA, 22 bp, Homo sapiens
agggcgaggagacggaggcaca

SEQ ID NO: 6896783 - DNA, 22 bp, Homo sapiens
ccagcgactgtgacctcagcta

SEQ ID NO: 6896784 - DNA, 22 bp, Homo sapiens
ctgggctccctcatgtgtctgc

SEQ ID NO: 6896785 - DNA, 22 bp, Homo sapiens
tgtgttattgccactgaagacc

SEQ ID NO: 6896786 - DNA, 22 bp, Homo sapiens
aagttcaagtctcctgagtata

SEQ ID NO: 6896787 - DNA, 22 bp, Homo sapiens
gagtaggttgtcagactccaaa

SEQ ID NO: 6896788 - DNA, 22 bp, Homo sapiens
ctggagtacaggaatcttccca

SEQ ID NO: 6896789 - DNA, 22 bp, Homo sapiens
aacagtttcctgactcctatga

SEQ ID NO: 6896790 - DNA, 23 bp, Homo sapiens
cctcccaggctgcgagtcccgag

SEQ ID NO: 6896791 - DNA, 22 bp, Homo sapiens
attgggctgatgttacacaggc

SEQ ID NO: 6896792 - DNA, 22 bp, Homo sapiens
atttgtctttgagtgccctgct

SEQ ID NO: 6896793 - DNA, 22 bp, Homo sapiens
cttgtagctgactatcttgttc

SEQ ID NO: 6896794 - DNA, 19 bp, Homo sapiens
tgcctgtcagtagatctca

SEQ ID NO: 6896795 - DNA, 22 bp, Homo sapiens
aatctgtttccatgttttattg

SEQ ID NO: 6896796 - DNA, 22 bp, Homo sapiens
aacaagtctttggttttggcta

SEQ ID NO: 6896797 - DNA, 20 bp, Homo sapiens
atacaatcatgaggaaaaag

SEQ ID NO: 6896798 - DNA, 22 bp, Homo sapiens
acaacagtagcctttacaaggc

SEQ ID NO: 6896799 - DNA, 22 bp, Homo sapiens
agctggaagatcctggttttgt

SEQ ID NO: 6896800 - DNA, 22 bp, Homo sapiens
aaagacattagcttagatgtca

SEQ ID NO: 6896801 - DNA, 22 bp, Homo sapiens
ttagcttgtgccatatgaaact

SEQ ID NO: 6896802 - DNA, 21 bp, Homo sapiens
cttttctagtcccagccccgc

SEQ ID NO: 6896803 - DNA, 22 bp, Homo sapiens
cctcggagcacgccggccgccc

SEQ ID NO: 6896804 - DNA, 22 bp, Homo sapiens
cagacctctttttagcactccc

SEQ ID NO: 6896805 - DNA, 22 bp, Homo sapiens
tgggtggagctccacaacctgt

SEQ ID NO: 6896806 - DNA, 22 bp, Homo sapiens
ttatctgaaaacctcaaaatat

SEQ ID NO: 6896807 - DNA, 22 bp, Homo sapiens
tttgtgtatgcttcacctagcc

SEQ ID NO: 6896808 - DNA, 21 bp, Homo sapiens
aggtcagcccagctctggaag

SEQ ID NO: 6896809 - DNA, 22 bp, Homo sapiens
ttctgctctgacttgcaaggaa

SEQ ID NO: 6896810 - DNA, 22 bp, Homo sapiens
cagtcctgagctcctgggctga

SEQ ID NO: 6896811 - DNA, 22 bp, Homo sapiens
ctggcccaggagagcaggcatt

SEQ ID NO: 6896812 - DNA, 21 bp, Homo sapiens
tctgagaacttctgctgcagc

SEQ ID NO: 6896813 - DNA, 22 bp, Homo sapiens
tgtcccctttctttccttcgta

SEQ ID NO: 6896814 - DNA, 22 bp, Homo sapiens
cttctggatttattcattcctt

SEQ ID NO: 6896815 - DNA, 22 bp, Homo sapiens
gcgcagctttgtaaagatctgg

SEQ ID NO: 6896816 - DNA, 22 bp, Homo sapiens
aagatgtaaaggcaatataaag

SEQ ID NO: 6896817 - DNA, 22 bp, Homo sapiens
gatgcagggcagctctgggaca

SEQ ID NO: 6896818 - DNA, 22 bp, Homo sapiens
ttacagtggcagagttgggtag

SEQ ID NO: 6896819 - DNA, 22 bp, Homo sapiens
cattgctgtgggcatttgctgc

SEQ ID NO: 6896820 - DNA, 22 bp, Homo sapiens
tctgcccattcttagagtctag

SEQ ID NO: 6896821 - DNA, 22 bp, Homo sapiens
gttgttttcacaaacccatgat

SEQ ID NO: 6896822 - DNA, 22 bp, Homo sapiens
agagttttatggctttaattct

SEQ ID NO: 6896823 - DNA, 22 bp, Homo sapiens
aaagcattattctgtggaaaaa

SEQ ID NO: 6896824 - DNA, 22 bp, Homo sapiens
ctggtctgaaaaggaggcatgc

SEQ ID NO: 6896825 - DNA, 22 bp, Homo sapiens
gtccagaattactactgtttga

SEQ ID NO: 6896826 - DNA, 19 bp, Homo sapiens
tgtcactgtcatggcccag

SEQ ID NO: 6896827 - DNA, 22 bp, Homo sapiens
agcaccttgatcttggacttcc

SEQ ID NO: 6896828 - DNA, 22 bp, Homo sapiens
gtctagaatatctagaaagatc

SEQ ID NO: 6896829 - DNA, 22 bp, Homo sapiens
gcaccttatttaaatgatgttt

SEQ ID NO: 6896830 - DNA, 22 bp, Homo sapiens
attagtagcacacagagatcag

SEQ ID NO: 6896831 - DNA, 22 bp, Homo sapiens
gagtacagctcttttgttttca

SEQ ID NO: 6896832 - DNA, 22 bp, Homo sapiens
gcctctgcggagctgtacatca

SEQ ID NO: 6896833 - DNA, 22 bp, Homo sapiens
tgagacaaggaaaggaagctga

SEQ ID NO: 6896834 - DNA, 15 bp, Homo sapiens
tggcagcttgttaag

SEQ ID NO: 6896835 - DNA, 22 bp, Homo sapiens
ctgtataagataccacactgaa

SEQ ID NO: 6896836 - DNA, 22 bp, Homo sapiens
cctcctggtaattagcgaaagg

SEQ ID NO: 6896837 - DNA, 22 bp, Homo sapiens
aattctgatgagtcagagaaag

SEQ ID NO: 6896838 - DNA, 22 bp, Homo sapiens
atgtttgtgtttcccattcagg

SEQ ID NO: 6896839 - DNA, 22 bp, Homo sapiens
tcaaaatcaaagatacttgaaa

SEQ ID NO: 6896840 - DNA, 19 bp, Homo sapiens
tagctgcctgttacctcca

SEQ ID NO: 6896841 - DNA, 22 bp, Homo sapiens
agagaggcattcggtgatccca

SEQ ID NO: 6896842 - DNA, 22 bp, Homo sapiens
aactagtcagtgattctcagaa

SEQ ID NO: 6896843 - DNA, 22 bp, Homo sapiens
atcaggaattaggtgagatgga

SEQ ID NO: 6896844 - DNA, 22 bp, Homo sapiens
cagagtgtttctttgggtgggt

SEQ ID NO: 6896845 - DNA, 22 bp, Homo sapiens
agcacagcagcgtctaaccgat

SEQ ID NO: 6896846 - DNA, 23 bp, Homo sapiens
tgatttccagtgagtcagtggga

SEQ ID NO: 6896847 - DNA, 22 bp, Homo sapiens
ttccaggagaggaaacctgatt

SEQ ID NO: 6896848 - DNA, 22 bp, Homo sapiens
tccagtttctctcaatcaatta

SEQ ID NO: 6896849 - DNA, 22 bp, Homo sapiens
gagctcagcccaaagagcagtg

SEQ ID NO: 6896850 - DNA, 22 bp, Homo sapiens
ctcccaagataaataaggcagt

SEQ ID NO: 6896851 - DNA, 22 bp, Homo sapiens
ccctccctctgctgggtgtaga

SEQ ID NO: 6896852 - DNA, 22 bp, Homo sapiens
cctcagcttgatttctgcagag

SEQ ID NO: 6896853 - DNA, 22 bp, Homo sapiens
ccatttcacccactgctttagg

SEQ ID NO: 6896854 - DNA, 22 bp, Homo sapiens
tgaggcagtgatgtttaagcac

SEQ ID NO: 6896855 - DNA, 22 bp, Homo sapiens
gggtgagggatgagccttcttc

SEQ ID NO: 6896856 - DNA, 22 bp, Homo sapiens
cagattccggtcatctctcctt

SEQ ID NO: 6896857 - DNA, 22 bp, Homo sapiens
tcaggccacggctcactgagac

SEQ ID NO: 6896858 - DNA, 22 bp, Homo sapiens
caagatactcagaaaggcattg

SEQ ID NO: 6896859 - DNA, 22 bp, Homo sapiens
aggcatctctctgcttctgagc

SEQ ID NO: 6896860 - DNA, 20 bp, Homo sapiens
ttacaaagaggcatcgcttt

SEQ ID NO: 6896861 - DNA, 22 bp, Homo sapiens
ccagcccatgcccttatagcat

SEQ ID NO: 6896862 - DNA, 22 bp, Homo sapiens
ctttatgtgtactttccatttt

SEQ ID NO: 6896863 - DNA, 22 bp, Homo sapiens
tccacccagcacactgtggtag

SEQ ID NO: 6896864 - DNA, 17 bp, Homo sapiens
caggaaaatatgagtga

SEQ ID NO: 6896865 - DNA, 22 bp, Homo sapiens
aaggccaggcagggagctgtga

SEQ ID NO: 6896866 - DNA, 22 bp, Homo sapiens
ttcagaccacaggggtactatt

SEQ ID NO: 6896867 - DNA, 22 bp, Homo sapiens
ttgtagcagttctggactgcga

SEQ ID NO: 6896868 - DNA, 22 bp, Homo sapiens
ttgggcacactttgctggggag

SEQ ID NO: 6896869 - DNA, 22 bp, Homo sapiens
tcagtttgctcataggtgaggg

SEQ ID NO: 6896870 - DNA, 22 bp, Homo sapiens
aatgttttctctgtgaacacat

SEQ ID NO: 6896871 - DNA, 22 bp, Homo sapiens
atagcacatcactccagtgagt

SEQ ID NO: 6896872 - DNA, 20 bp, Homo sapiens
ggcacttgatcccctggttc

SEQ ID NO: 6896873 - DNA, 22 bp, Homo sapiens
atgagcaggtttaagagaggcc

SEQ ID NO: 6896874 - DNA, 22 bp, Homo sapiens
catggattgaatataaattaga

SEQ ID NO: 6896875 - DNA, 22 bp, Homo sapiens
gcatctctacaacgaagacagt

SEQ ID NO: 6896876 - DNA, 22 bp, Homo sapiens
acatgctaggtacagatctaaa

SEQ ID NO: 6896877 - DNA, 22 bp, Homo sapiens
cacagcaaagacactctcaact

SEQ ID NO: 6896878 - DNA, 23 bp, Homo sapiens
tttgaagaagtgaatatcatata

SEQ ID NO: 6896879 - DNA, 22 bp, Homo sapiens
taaatgctatcgcataaaacct

SEQ ID NO: 6896880 - DNA, 22 bp, Homo sapiens
agacagcagcagaggggctccc

SEQ ID NO: 6896881 - DNA, 22 bp, Homo sapiens
tttgacaacacgttatttgcct

SEQ ID NO: 6896882 - DNA, 22 bp, Homo sapiens
gctttaatgcttcgtggggcca

SEQ ID NO: 6896883 - DNA, 22 bp, Homo sapiens
aagtttgtgaggttaatccctt

SEQ ID NO: 6896884 - DNA, 17 bp, Homo sapiens
agcaacctcctcttcct

SEQ ID NO: 6896885 - DNA, 22 bp, Homo sapiens
tgggagagtttgtttagagtga

SEQ ID NO: 6896886 - DNA, 22 bp, Homo sapiens
tgttctttgctgttgatgtaga

SEQ ID NO: 6896887 - DNA, 22 bp, Homo sapiens
tgaaaattgttgtacttgataa

SEQ ID NO: 6896888 - DNA, 22 bp, Homo sapiens
tctgggttgaattggataaaca

SEQ ID NO: 6896889 - DNA, 22 bp, Homo sapiens
caaatgtaataaggagtttccc

SEQ ID NO: 6896890 - DNA, 23 bp, Homo sapiens
tgtgacagtgacaatactgactt

SEQ ID NO: 6896891 - DNA, 22 bp, Homo sapiens
ttgcaaatcacaagagcagagc

SEQ ID NO: 6896892 - DNA, 22 bp, Homo sapiens
gatccagtggtttctccatgta

SEQ ID NO: 6896893 - DNA, 22 bp, Homo sapiens
tggctcatgcctgtaatcttag

SEQ ID NO: 6896894 - DNA, 22 bp, Homo sapiens
ggggctcaggggaagtgtccag

SEQ ID NO: 6896895 - DNA, 23 bp, Homo sapiens
aagttcttttagatgtcttcgtg

SEQ ID NO: 6896896 - DNA, 23 bp, Homo sapiens
cagtgtgacaaaacttattactt

SEQ ID NO: 6896897 - DNA, 22 bp, Homo sapiens
atttttctctcacacttaccag

SEQ ID NO: 6896898 - DNA, 22 bp, Homo sapiens
gtccatgattctgtgacaccct

SEQ ID NO: 6896899 - DNA, 22 bp, Homo sapiens
cagtgagtgtgggaagtctctg

SEQ ID NO: 6896900 - DNA, 22 bp, Homo sapiens
tttgggatgctagacacctcag

SEQ ID NO: 6896901 - DNA, 22 bp, Homo sapiens
atgtcagatattttttggttgc

SEQ ID NO: 6896902 - DNA, 18 bp, Homo sapiens
tctaggagagtacctacc

SEQ ID NO: 6896903 - DNA, 22 bp, Homo sapiens
taccacctccatcctcctttca

SEQ ID NO: 6896904 - DNA, 22 bp, Homo sapiens
gtgtatcaacatgttttttgtg

SEQ ID NO: 6896905 - DNA, 22 bp, Homo sapiens
gttggagtgcagcttgtgcgat

SEQ ID NO: 6896906 - DNA, 22 bp, Homo sapiens
tgcttctgtattgaaattgtta

SEQ ID NO: 6896907 - DNA, 22 bp, Homo sapiens
tctgcctggagagttcttctct

SEQ ID NO: 6896908 - DNA, 18 bp, Homo sapiens
agtcagttgatggggacc

SEQ ID NO: 6896909 - DNA, 22 bp, Homo sapiens
acagggaaggacatgacttggc

SEQ ID NO: 6896910 - DNA, 20 bp, Homo sapiens
cctcctggtcaggtgtgcag

SEQ ID NO: 6896911 - DNA, 22 bp, Homo sapiens
cggggcctcagtttccccacct

SEQ ID NO: 6896912 - DNA, 22 bp, Homo sapiens
agatggttatctaagtgaaaaa

SEQ ID NO: 6896913 - DNA, 22 bp, Homo sapiens
agtccctctgggagcaggactg

SEQ ID NO: 6896914 - DNA, 22 bp, Homo sapiens
ctggcatttttggaaagaagaa

SEQ ID NO: 6896915 - DNA, 22 bp, Homo sapiens
atgctatactcaaagaaattca

SEQ ID NO: 6896916 - DNA, 22 bp, Homo sapiens
ctggctttgcgtctttgccaca

SEQ ID NO: 6896917 - DNA, 22 bp, Homo sapiens
taactacatttcactgcaatta

SEQ ID NO: 6896918 - DNA, 22 bp, Homo sapiens
atgcaatagtaattctagtctg

SEQ ID NO: 6896919 - DNA, 22 bp, Homo sapiens
taaagagcttcctgcccgttct

SEQ ID NO: 6896920 - DNA, 22 bp, Homo sapiens
ctggcaagaaatatatatctta

SEQ ID NO: 6896921 - DNA, 22 bp, Homo sapiens
tagacacaggggaatgtgaggt

SEQ ID NO: 6896922 - DNA, 19 bp, Homo sapiens
gggtcccaaaagatgtgct

SEQ ID NO: 6896923 - DNA, 22 bp, Homo sapiens
ttacaatcatctaggataaaga

SEQ ID NO: 6896924 - DNA, 22 bp, Homo sapiens
gctaagaggctatatctttctc

SEQ ID NO: 6896925 - DNA, 22 bp, Homo sapiens
caaaggcatcggcaattaggga

SEQ ID NO: 6896926 - DNA, 22 bp, Homo sapiens
gtatgtctgagtaataatgtgt

SEQ ID NO: 6896927 - DNA, 22 bp, Homo sapiens
agaaccctatctttctgaggtt

SEQ ID NO: 6896928 - DNA, 17 bp, Homo sapiens
attcatgaacatgtcct

SEQ ID NO: 6896929 - DNA, 22 bp, Homo sapiens
cagatgaagtattacagacatt

SEQ ID NO: 6896930 - DNA, 22 bp, Homo sapiens
agcggcgccggagggaggtgcg

SEQ ID NO: 6896931 - DNA, 22 bp, Homo sapiens
tagtggaactgtgtcatacaaa

SEQ ID NO: 6896932 - DNA, 20 bp, Homo sapiens
tctacatctacctgacggct

SEQ ID NO: 6896933 - DNA, 22 bp, Homo sapiens
ttacacttgggtgtggatttta

SEQ ID NO: 6896934 - DNA, 22 bp, Homo sapiens
aacagctgtctgcctatctctg

SEQ ID NO: 6896935 - DNA, 20 bp, Homo sapiens
tgacaaagtcccttcttttc

SEQ ID NO: 6896936 - DNA, 22 bp, Homo sapiens
tctgttcatacagagtatagta

SEQ ID NO: 6896937 - DNA, 20 bp, Homo sapiens
cctcaaataagtgccagcat

SEQ ID NO: 6896938 - DNA, 22 bp, Homo sapiens
agtggcaggtgtttcgtggtgc

SEQ ID NO: 6896939 - DNA, 22 bp, Homo sapiens
ttgagacactttgggcatcact

SEQ ID NO: 6896940 - DNA, 22 bp, Homo sapiens
cttgcggagaactgtgccctta

SEQ ID NO: 6896941 - DNA, 22 bp, Homo sapiens
actctaccatgccactccatag

SEQ ID NO: 6896942 - DNA, 22 bp, Homo sapiens
tgtctatgcaatggaaggactg

SEQ ID NO: 6896943 - DNA, 22 bp, Homo sapiens
aatgtcaaaatggaatgagact

SEQ ID NO: 6896944 - DNA, 22 bp, Homo sapiens
aatcatgaaatatcagttcttt

SEQ ID NO: 6896945 - DNA, 22 bp, Homo sapiens
tatcccatgcctcattaaagtt

SEQ ID NO: 6896946 - DNA, 22 bp, Homo sapiens
gggtgcagctttgaaagcatgt

SEQ ID NO: 6896947 - DNA, 22 bp, Homo sapiens
ggtgcaaaagtaatcacagttt

SEQ ID NO: 6896948 - DNA, 22 bp, Homo sapiens
aagacattgctgcttttaattg

SEQ ID NO: 6896949 - DNA, 22 bp, Homo sapiens
aatgatatgcaaattatcatca

SEQ ID NO: 6896950 - DNA, 22 bp, Homo sapiens
tactctaaaaagaagcagatct

SEQ ID NO: 6896951 - DNA, 22 bp, Homo sapiens
aaagtcatctaggagcagattt

SEQ ID NO: 6896952 - DNA, 22 bp, Homo sapiens
ggaacctgtacgttgtccttga

SEQ ID NO: 6896953 - DNA, 22 bp, Homo sapiens
gaggagaggccatcgttgttat

SEQ ID NO: 6896954 - DNA, 22 bp, Homo sapiens
gcctgtccttgtgaggtcccag

SEQ ID NO: 6896955 - DNA, 21 bp, Homo sapiens
tagcaattatagatgtctaaa

SEQ ID NO: 6896956 - DNA, 22 bp, Homo sapiens
tttgggctcactatgctgaaga

SEQ ID NO: 6896957 - DNA, 22 bp, Homo sapiens
cctgggtgaaatctctcctgca

SEQ ID NO: 6896958 - DNA, 22 bp, Homo sapiens
aagcatgtgctggggctttttg

SEQ ID NO: 6896959 - DNA, 22 bp, Homo sapiens
gacatgtcggatagaatgagtt

SEQ ID NO: 6896960 - DNA, 22 bp, Homo sapiens
tggatgctgagaacactgcctg

SEQ ID NO: 6896961 - DNA, 20 bp, Homo sapiens
attagagctacatggctaca

SEQ ID NO: 6896962 - DNA, 22 bp, Homo sapiens
tctgctgtcccgagggccactt

SEQ ID NO: 6896963 - DNA, 22 bp, Homo sapiens
tgtcatgggtctaaacattgat

SEQ ID NO: 6896964 - DNA, 22 bp, Homo sapiens
tctgataacaaccatgtctggc

SEQ ID NO: 6896965 - DNA, 22 bp, Homo sapiens
attggctcctagtcagctgagc

SEQ ID NO: 6896966 - DNA, 22 bp, Homo sapiens
agagtataattagtgtcttcta

SEQ ID NO: 6896967 - DNA, 22 bp, Homo sapiens
agagaaaactcattgaggtgtc

SEQ ID NO: 6896968 - DNA, 22 bp, Homo sapiens
gtggccaggcgtccgcgcggct

SEQ ID NO: 6896969 - DNA, 17 bp, Homo sapiens
agctgcctctcccacca

SEQ ID NO: 6896970 - DNA, 22 bp, Homo sapiens
aacctggaggctgtgtagtctt

SEQ ID NO: 6896971 - DNA, 22 bp, Homo sapiens
cttgtcactctggctccagagc

SEQ ID NO: 6896972 - DNA, 22 bp, Homo sapiens
tctcatgctgtagtgcactaac

SEQ ID NO: 6896973 - DNA, 22 bp, Homo sapiens
tagcaaagcccttcaggccctg

SEQ ID NO: 6896974 - DNA, 17 bp, Homo sapiens
ataagacagaagacaat

SEQ ID NO: 6896975 - DNA, 22 bp, Homo sapiens
ctcggaatggaacaacagcggt

SEQ ID NO: 6896976 - DNA, 22 bp, Homo sapiens
gcacagttctctcagtctccag

SEQ ID NO: 6896977 - DNA, 22 bp, Homo sapiens
aagcatgcaatctgtgataagg

SEQ ID NO: 6896978 - DNA, 21 bp, Homo sapiens
gctctgtgttacaagttgggg

SEQ ID NO: 6896979 - DNA, 22 bp, Homo sapiens
ctctgggaggtgttactatctg

SEQ ID NO: 6896980 - DNA, 16 bp, Homo sapiens
gctgctgcttcctgct

SEQ ID NO: 6896981 - DNA, 22 bp, Homo sapiens
ggcagcatatattcagtgggca

SEQ ID NO: 6896982 - DNA, 22 bp, Homo sapiens
cactgagccaggagcaatatca

SEQ ID NO: 6896983 - DNA, 22 bp, Homo sapiens
ctgggtagctgctgctccttca

SEQ ID NO: 6896984 - DNA, 22 bp, Homo sapiens
aaagccagaattcgtccagcct

SEQ ID NO: 6896985 - DNA, 22 bp, Homo sapiens
ccttggcttgtgggctgcagcc

SEQ ID NO: 6896986 - DNA, 22 bp, Homo sapiens
aggcgaagggaccagacggtag

SEQ ID NO: 6896987 - DNA, 22 bp, Homo sapiens
acagggcagaaatgttgcatct

SEQ ID NO: 6896988 - DNA, 20 bp, Homo sapiens
ggcttctttacatctgtgtt

SEQ ID NO: 6896989 - DNA, 22 bp, Homo sapiens
ccagttcaccagtggcagaagt

SEQ ID NO: 6896990 - DNA, 17 bp, Homo sapiens
ggtacctacttctaacc

SEQ ID NO: 6896991 - DNA, 22 bp, Homo sapiens
tttacaaggcagttattttcct

SEQ ID NO: 6896992 - DNA, 23 bp, Homo sapiens
tattagcaattcccacagagcag

SEQ ID NO: 6896993 - DNA, 17 bp, Homo sapiens
gcgtggagttggtgcgc

SEQ ID NO: 6896994 - DNA, 22 bp, Homo sapiens
tctgttcatagtagtgtatatg

SEQ ID NO: 6896995 - DNA, 22 bp, Homo sapiens
tttacaagtcagggactgttct

SEQ ID NO: 6896996 - DNA, 22 bp, Homo sapiens
attcatgaccccatggttgatt

SEQ ID NO: 6896997 - DNA, 22 bp, Homo sapiens
aggtttatctcatagaaagaat

SEQ ID NO: 6896998 - DNA, 22 bp, Homo sapiens
tctgctgtattaggttgaactg

SEQ ID NO: 6896999 - DNA, 22 bp, Homo sapiens
ctgaatcatggtcattagttta

SEQ ID NO: 6897000 - DNA, 22 bp, Homo sapiens
ttggctgacaaatggaatctct

SEQ ID NO: 6897001 - DNA, 22 bp, Homo sapiens
ataaggtataaggcctattttt

SEQ ID NO: 6897002 - DNA, 22 bp, Homo sapiens
ttgaaagaagaagctgcgatgt

SEQ ID NO: 6897003 - DNA, 22 bp, Homo sapiens
tttctggaaactgtaaagagga

SEQ ID NO: 6897004 - DNA, 22 bp, Homo sapiens
gccagaggggctcgaaggcgcg

SEQ ID NO: 6897005 - DNA, 22 bp, Homo sapiens
attgcactccagccctgctgac

SEQ ID NO: 6897006 - DNA, 17 bp, Homo sapiens
accattctttttactgc

SEQ ID NO: 6897007 - DNA, 22 bp, Homo sapiens
actgccttagaacaaagcagga

SEQ ID NO: 6897008 - DNA, 22 bp, Homo sapiens
gaccagatgcaacaacttatcc

SEQ ID NO: 6897009 - DNA, 22 bp, Homo sapiens
gacacagagggcaccagatatg

SEQ ID NO: 6897010 - DNA, 22 bp, Homo sapiens
tatggcttcttttgcaactact

SEQ ID NO: 6897011 - DNA, 22 bp, Homo sapiens
caagaaggctatatgggccagg

SEQ ID NO: 6897012 - DNA, 22 bp, Homo sapiens
tccagcagactcatcagcaagg

SEQ ID NO: 6897013 - DNA, 22 bp, Homo sapiens
actgcaggagacacagctgctg

SEQ ID NO: 6897014 - DNA, 22 bp, Homo sapiens
tgatagaaaggaaattaattgg

SEQ ID NO: 6897015 - DNA, 17 bp, Homo sapiens
tcgttttctgaacaaag

SEQ ID NO: 6897016 - DNA, 22 bp, Homo sapiens
gttgacagagcgcctttgaatt

SEQ ID NO: 6897017 - DNA, 22 bp, Homo sapiens
cactgcactccagcctcggtga

SEQ ID NO: 6897018 - DNA, 22 bp, Homo sapiens
cagtgtctgcctttctgtttgg

SEQ ID NO: 6897019 - DNA, 22 bp, Homo sapiens
ttctctgaaggccatgctcact

SEQ ID NO: 6897020 - DNA, 22 bp, Homo sapiens
gagatgctttctgcccttggta

SEQ ID NO: 6897021 - DNA, 22 bp, Homo sapiens
tcaaaaggacagaagacctaaa

SEQ ID NO: 6897022 - DNA, 22 bp, Homo sapiens
gaatacaaataataccaaggtg

SEQ ID NO: 6897023 - DNA, 22 bp, Homo sapiens
atctgtggatatgcacagagca

SEQ ID NO: 6897024 - DNA, 22 bp, Homo sapiens
ttctgcaccgttacagcaagag

SEQ ID NO: 6897025 - DNA, 22 bp, Homo sapiens
atattcacagtaagtgtagcag

SEQ ID NO: 6897026 - DNA, 22 bp, Homo sapiens
attgacacaatgggatgtaagg

SEQ ID NO: 6897027 - DNA, 22 bp, Homo sapiens
cattttgtagcaatgactgttg

SEQ ID NO: 6897028 - DNA, 22 bp, Homo sapiens
aatctcttgggaggaatgaatt

SEQ ID NO: 6897029 - DNA, 22 bp, Homo sapiens
tccaccagcagcctgtcagcct

SEQ ID NO: 6897030 - DNA, 22 bp, Homo sapiens
ctatggcatttattttgtcaat

SEQ ID NO: 6897031 - DNA, 22 bp, Homo sapiens
gggctagcctcttccctgctcc

SEQ ID NO: 6897032 - DNA, 22 bp, Homo sapiens
agatgtggatgagtcgccgacc

SEQ ID NO: 6897033 - DNA, 22 bp, Homo sapiens
aaggtacctaacatttgagtgt

SEQ ID NO: 6897034 - DNA, 22 bp, Homo sapiens
gaatgtttcatgtgtatgttag

SEQ ID NO: 6897035 - DNA, 22 bp, Homo sapiens
agtatacatatattagccttcg

SEQ ID NO: 6897036 - DNA, 17 bp, Homo sapiens
gatgttgaatctcttta

SEQ ID NO: 6897037 - DNA, 22 bp, Homo sapiens
taactgcagaggaaatgcatct

SEQ ID NO: 6897038 - DNA, 20 bp, Homo sapiens
agctctcagcatgctgcctg

SEQ ID NO: 6897039 - DNA, 22 bp, Homo sapiens
gaggtggtggtggaggcatagc

SEQ ID NO: 6897040 - DNA, 19 bp, Homo sapiens
gtgaggagtgtttacagaa

SEQ ID NO: 6897041 - DNA, 22 bp, Homo sapiens
tgccctcagcagcagctcctgc

SEQ ID NO: 6897042 - DNA, 18 bp, Homo sapiens
ttagatactagtgtgcta

SEQ ID NO: 6897043 - DNA, 22 bp, Homo sapiens
atgaacaagtatttgcatgagc

SEQ ID NO: 6897044 - DNA, 22 bp, Homo sapiens
agctctcttgtgttctgtatgg

SEQ ID NO: 6897045 - DNA, 22 bp, Homo sapiens
ttgcttgaacccaggaagtgga

SEQ ID NO: 6897046 - DNA, 22 bp, Homo sapiens
tcagcttatatttttagtgtaa

SEQ ID NO: 6897047 - DNA, 22 bp, Homo sapiens
tgctggggatccgtaccaaccc

SEQ ID NO: 6897048 - DNA, 22 bp, Homo sapiens
tatcccaggaggccacctgtca

SEQ ID NO: 6897049 - DNA, 22 bp, Homo sapiens
ccagggtggggtccaggaacca

SEQ ID NO: 6897050 - DNA, 22 bp, Homo sapiens
tcaggtgtttctggagaagtaa

SEQ ID NO: 6897051 - DNA, 22 bp, Homo sapiens
cagccctggcccaggtgcctta

SEQ ID NO: 6897052 - DNA, 22 bp, Homo sapiens
tgaaccaggcacatttcctaca

SEQ ID NO: 6897053 - DNA, 22 bp, Homo sapiens
gctagagaccagaggccttgaa

SEQ ID NO: 6897054 - DNA, 22 bp, Homo sapiens
tgcagctggaacttagaggaga

SEQ ID NO: 6897055 - DNA, 22 bp, Homo sapiens
atttagcagtcctcctcacaat

SEQ ID NO: 6897056 - DNA, 22 bp, Homo sapiens
ttacaaagcgttgagacaagta

SEQ ID NO: 6897057 - DNA, 22 bp, Homo sapiens
ctgtgcccacctggctctgagg

SEQ ID NO: 6897058 - DNA, 22 bp, Homo sapiens
atatgtctctgtacaacagtct

SEQ ID NO: 6897059 - DNA, 22 bp, Homo sapiens
acttaagatagagcaagtctga

SEQ ID NO: 6897060 - DNA, 22 bp, Homo sapiens
gcagtgttctaaattgggtgtg

SEQ ID NO: 6897061 - DNA, 22 bp, Homo sapiens
catgtcttatgcggaactttca

SEQ ID NO: 6897062 - DNA, 21 bp, Homo sapiens
cctgtgtatatggcttgcatg

SEQ ID NO: 6897063 - DNA, 22 bp, Homo sapiens
tggccagctgtaggttgtgcag

SEQ ID NO: 6897064 - DNA, 22 bp, Homo sapiens
agctctgattagagacattctt

SEQ ID NO: 6897065 - DNA, 22 bp, Homo sapiens
ctcctgggctgggaactcagcc

SEQ ID NO: 6897066 - DNA, 22 bp, Homo sapiens
tccctggacagccttgcctggg

SEQ ID NO: 6897067 - DNA, 22 bp, Homo sapiens
atgtatgtatgctgtgcttgca

SEQ ID NO: 6897068 - DNA, 22 bp, Homo sapiens
atgttccttgctctcaggtaag

SEQ ID NO: 6897069 - DNA, 22 bp, Homo sapiens
ctctgttgagcatttttcccct

SEQ ID NO: 6897070 - DNA, 22 bp, Homo sapiens
ttgcaaagagataatcctaggc

SEQ ID NO: 6897071 - DNA, 22 bp, Homo sapiens
tttatgagcaccttggcccaga

SEQ ID NO: 6897072 - DNA, 22 bp, Homo sapiens
tccacagcacaaagccagtgtg

SEQ ID NO: 6897073 - DNA, 22 bp, Homo sapiens
gaattgatgcttatggtcaggg

SEQ ID NO: 6897074 - DNA, 22 bp, Homo sapiens
gactgtgccagtcagtgggcgg

SEQ ID NO: 6897075 - DNA, 22 bp, Homo sapiens
cacataagaaatgaatatgaga

SEQ ID NO: 6897076 - DNA, 22 bp, Homo sapiens
aggagctgttttgttcagcaaa

SEQ ID NO: 6897077 - DNA, 22 bp, Homo sapiens
cagttcctcaaaggttaaatgt

SEQ ID NO: 6897078 - DNA, 22 bp, Homo sapiens
agtcattacggactagtactac

SEQ ID NO: 6897079 - DNA, 22 bp, Homo sapiens
actgcctgtagctcttcatctc

SEQ ID NO: 6897080 - DNA, 22 bp, Homo sapiens
gggctcatggacagctctccag

SEQ ID NO: 6897081 - DNA, 22 bp, Homo sapiens
attgtacactagtggcagcagt

SEQ ID NO: 6897082 - DNA, 22 bp, Homo sapiens
ttctgttacttgcaaccacagg

SEQ ID NO: 6897083 - DNA, 22 bp, Homo sapiens
tctttgcattcctgtgtgcttt

SEQ ID NO: 6897084 - DNA, 22 bp, Homo sapiens
atggtcaaggagaaacctggga

SEQ ID NO: 6897085 - DNA, 23 bp, Homo sapiens
tagacctctgctctaaccattag

SEQ ID NO: 6897086 - DNA, 22 bp, Homo sapiens
ttcaagatgccagggacgcggc

SEQ ID NO: 6897087 - DNA, 22 bp, Homo sapiens
tctccagggaggtagcccagtg

SEQ ID NO: 6897088 - DNA, 22 bp, Homo sapiens
tacccagcttcaagtcaggact

SEQ ID NO: 6897089 - DNA, 22 bp, Homo sapiens
tgtgcagtggcctcggcacgca

SEQ ID NO: 6897090 - DNA, 22 bp, Homo sapiens
tttgatgaacctatataatttg

SEQ ID NO: 6897091 - DNA, 22 bp, Homo sapiens
gagggggctctgccaacctgtc

SEQ ID NO: 6897092 - DNA, 22 bp, Homo sapiens
aatgtcttcttcagctgaataa

SEQ ID NO: 6897093 - DNA, 22 bp, Homo sapiens
atttccagtatgcaaatgcctc

SEQ ID NO: 6897094 - DNA, 22 bp, Homo sapiens
atgcatgttaagctcttaaaat

SEQ ID NO: 6897095 - DNA, 22 bp, Homo sapiens
tcaacaataggatatagcaggt

SEQ ID NO: 6897096 - DNA, 22 bp, Homo sapiens
agagtttacagaaataagctgt

SEQ ID NO: 6897097 - DNA, 22 bp, Homo sapiens
aactacattttacagaagatga

SEQ ID NO: 6897098 - DNA, 22 bp, Homo sapiens
tctggagtttgagcacttcaat

SEQ ID NO: 6897099 - DNA, 22 bp, Homo sapiens
aaagtgattatgctgtcaaaga

SEQ ID NO: 6897100 - DNA, 22 bp, Homo sapiens
aggccctggctgggtttcttta

SEQ ID NO: 6897101 - DNA, 22 bp, Homo sapiens
acaatactcatgctctttttct

SEQ ID NO: 6897102 - DNA, 22 bp, Homo sapiens
tgtgctgcctctcacagaatta

SEQ ID NO: 6897103 - DNA, 22 bp, Homo sapiens
cctgcgcgtctgggtctgtctc

SEQ ID NO: 6897104 - DNA, 23 bp, Homo sapiens
tcccaatagcactgtcatgtttc

SEQ ID NO: 6897105 - DNA, 19 bp, Homo sapiens
aggaaactgtcttttccag

SEQ ID NO: 6897106 - DNA, 22 bp, Homo sapiens
ggcagagcttgcagtgagccga

SEQ ID NO: 6897107 - DNA, 22 bp, Homo sapiens
ctttctgaaagacattttaact

SEQ ID NO: 6897108 - DNA, 22 bp, Homo sapiens
agttggttggacccaagtaagg

SEQ ID NO: 6897109 - DNA, 22 bp, Homo sapiens
atctagattaggtataagagct

SEQ ID NO: 6897110 - DNA, 23 bp, Homo sapiens
aggagttgcatgatttttagagc

SEQ ID NO: 6897111 - DNA, 22 bp, Homo sapiens
gcctcctgcccagatgagtgat

SEQ ID NO: 6897112 - DNA, 22 bp, Homo sapiens
tattgcatctcttcatatctgt

SEQ ID NO: 6897113 - DNA, 22 bp, Homo sapiens
tcccctctggaggctgcagggg

SEQ ID NO: 6897114 - DNA, 22 bp, Homo sapiens
ggacaggagtgaggcgggttcc

SEQ ID NO: 6897115 - DNA, 22 bp, Homo sapiens
tttcagactcatctcaagcttt

SEQ ID NO: 6897116 - DNA, 22 bp, Homo sapiens
gccaccaggttctgggttaagc

SEQ ID NO: 6897117 - DNA, 22 bp, Homo sapiens
ggccaggagcaagccaggctct

SEQ ID NO: 6897118 - DNA, 22 bp, Homo sapiens
agggaaaggtagtgaggtcaca

SEQ ID NO: 6897119 - DNA, 22 bp, Homo sapiens
gcattgtttcagtccactgtag

SEQ ID NO: 6897120 - DNA, 22 bp, Homo sapiens
agtggcagaagccaagtctgca

SEQ ID NO: 6897121 - DNA, 22 bp, Homo sapiens
gtcttgcagctcgctttgacta

SEQ ID NO: 6897122 - DNA, 22 bp, Homo sapiens
gcttcctaaatgcacagggcag

SEQ ID NO: 6897123 - DNA, 22 bp, Homo sapiens
tggcagcatgttatgtaaggaa

SEQ ID NO: 6897124 - DNA, 22 bp, Homo sapiens
ttgcacagtttgaagatgactc

SEQ ID NO: 6897125 - DNA, 22 bp, Homo sapiens
ctgaacaggctctgatggattc

SEQ ID NO: 6897126 - DNA, 22 bp, Homo sapiens
taggtacttttcaagtaataat

SEQ ID NO: 6897127 - DNA, 22 bp, Homo sapiens
tgtctgctgatgtcacatagcc

SEQ ID NO: 6897128 - DNA, 22 bp, Homo sapiens
ttattccattcagttcaacaag

SEQ ID NO: 6897129 - DNA, 22 bp, Homo sapiens
ccttttctgaaccacttaaata

SEQ ID NO: 6897130 - DNA, 22 bp, Homo sapiens
tgagtttaattggagcctgaat

SEQ ID NO: 6897131 - DNA, 22 bp, Homo sapiens
cagggcctcctaaggcatctaa

SEQ ID NO: 6897132 - DNA, 22 bp, Homo sapiens
tggtctgatattttttcttacc

SEQ ID NO: 6897133 - DNA, 22 bp, Homo sapiens
gctgagctgggacagtcctggg

SEQ ID NO: 6897134 - DNA, 22 bp, Homo sapiens
gccaatgacagtctcagttctg

SEQ ID NO: 6897135 - DNA, 22 bp, Homo sapiens
aggagattggctgaaaaatatt

SEQ ID NO: 6897136 - DNA, 22 bp, Homo sapiens
tggagccaaggccagttctcag

SEQ ID NO: 6897137 - DNA, 22 bp, Homo sapiens
tctcacagctctgctgcatgct

SEQ ID NO: 6897138 - DNA, 22 bp, Homo sapiens
ttccaataaaatgttatttgca

SEQ ID NO: 6897139 - DNA, 22 bp, Homo sapiens
agaaagtgcttccctttggact

SEQ ID NO: 6897140 - DNA, 22 bp, Homo sapiens
tagaaacaatgacatgcttgta

SEQ ID NO: 6897141 - DNA, 22 bp, Homo sapiens
cagttgatttttatggtgtgaa

SEQ ID NO: 6897142 - DNA, 22 bp, Homo sapiens
tcaggactagacatgaggaagg

SEQ ID NO: 6897143 - DNA, 22 bp, Homo sapiens
tgcagcttaaatcagggtttct

SEQ ID NO: 6897144 - DNA, 22 bp, Homo sapiens
gagtcccatgatgatagccaca

SEQ ID NO: 6897145 - DNA, 22 bp, Homo sapiens
ctgcatctgcataatcaacttc

SEQ ID NO: 6897146 - DNA, 22 bp, Homo sapiens
tcatgacactgggacaggagag

SEQ ID NO: 6897147 - DNA, 22 bp, Homo sapiens
ggcagaggtgaagttcacaagg

SEQ ID NO: 6897148 - DNA, 22 bp, Homo sapiens
aaggcttttgacggttgcctct

SEQ ID NO: 6897149 - DNA, 22 bp, Homo sapiens
gagttaagggaaagttgtggta

SEQ ID NO: 6897150 - DNA, 22 bp, Homo sapiens
cactctgagcccaagcaggctg

SEQ ID NO: 6897151 - DNA, 21 bp, Homo sapiens
atggctcaggccatcaatgga

SEQ ID NO: 6897152 - DNA, 22 bp, Homo sapiens
ttactttggcaaactcctgccc

SEQ ID NO: 6897153 - DNA, 22 bp, Homo sapiens
ggaagacatctgcttgcaccag

SEQ ID NO: 6897154 - DNA, 22 bp, Homo sapiens
agatttgataaaagtagcagtt

SEQ ID NO: 6897155 - DNA, 22 bp, Homo sapiens
gtctccacagcccagctgccac

SEQ ID NO: 6897156 - DNA, 22 bp, Homo sapiens
tcctgggcgagtggtggtacac

SEQ ID NO: 6897157 - DNA, 22 bp, Homo sapiens
tctgtttagatgctttatctgt

SEQ ID NO: 6897158 - DNA, 22 bp, Homo sapiens
ctgtgggagggtgagagaacca

SEQ ID NO: 6897159 - DNA, 22 bp, Homo sapiens
tttatttataagccacttgctg

SEQ ID NO: 6897160 - DNA, 22 bp, Homo sapiens
ttgaactttgaaccattcctat

SEQ ID NO: 6897161 - DNA, 22 bp, Homo sapiens
aaagtgcagaactgttctcact

SEQ ID NO: 6897162 - DNA, 20 bp, Homo sapiens
accttcaggaacttatcagc

SEQ ID NO: 6897163 - DNA, 22 bp, Homo sapiens
atacaagtgatataattgtttc

SEQ ID NO: 6897164 - DNA, 17 bp, Homo sapiens
tgcagcaaatgggggac

SEQ ID NO: 6897165 - DNA, 22 bp, Homo sapiens
tgcgccatgtgctctcggccct

SEQ ID NO: 6897166 - DNA, 22 bp, Homo sapiens
tcacacatctcaggtgtttaat

SEQ ID NO: 6897167 - DNA, 22 bp, Homo sapiens
gggttaaaacaggaagatcagc

SEQ ID NO: 6897168 - DNA, 22 bp, Homo sapiens
gagcacttaatcctgttattca

SEQ ID NO: 6897169 - DNA, 22 bp, Homo sapiens
atatatacaactagattaaaag

SEQ ID NO: 6897170 - DNA, 22 bp, Homo sapiens
aaggcgctgggctaaggcacca

SEQ ID NO: 6897171 - DNA, 22 bp, Homo sapiens
tggagctgaggggaatgctgag

SEQ ID NO: 6897172 - DNA, 22 bp, Homo sapiens
agctgccccatgagaggcaggt

SEQ ID NO: 6897173 - DNA, 22 bp, Homo sapiens
tccagtgatctagggagctgga

SEQ ID NO: 6897174 - DNA, 22 bp, Homo sapiens
aagctgattctaaaatttatta

SEQ ID NO: 6897175 - DNA, 22 bp, Homo sapiens
tgacagcccacctcacaggatt

SEQ ID NO: 6897176 - DNA, 22 bp, Homo sapiens
aaagcagcagaatctctcaggg

SEQ ID NO: 6897177 - DNA, 22 bp, Homo sapiens
agcagtgttctaatctggctag

SEQ ID NO: 6897178 - DNA, 22 bp, Homo sapiens
tctggggatgaggacctagatg

SEQ ID NO: 6897179 - DNA, 22 bp, Homo sapiens
aaaggcacaaattcagcatttt

SEQ ID NO: 6897180 - DNA, 21 bp, Homo sapiens
aaatctgttcctggctccaaa

SEQ ID NO: 6897181 - DNA, 20 bp, Homo sapiens
aatcaggcaaccaaatgtgg

SEQ ID NO: 6897182 - DNA, 22 bp, Homo sapiens
aagtgtgttgactgaattgggg

SEQ ID NO: 6897183 - DNA, 22 bp, Homo sapiens
tgtatatgtgtattttatgaca

SEQ ID NO: 6897184 - DNA, 22 bp, Homo sapiens
taatgttgctgtagaaagtcaa

SEQ ID NO: 6897185 - DNA, 22 bp, Homo sapiens
ctgggctcagcaggccaaggcc

SEQ ID NO: 6897186 - DNA, 22 bp, Homo sapiens
tggtccattatcccgctttcca

SEQ ID NO: 6897187 - DNA, 22 bp, Homo sapiens
gagagccctcactccttccctg

SEQ ID NO: 6897188 - DNA, 22 bp, Homo sapiens
aggctagggtaacagatgtggc

SEQ ID NO: 6897189 - DNA, 22 bp, Homo sapiens
catgctgtgctattcgtgctgt

SEQ ID NO: 6897190 - DNA, 22 bp, Homo sapiens
tcaggagcctgaaagaggtcta

SEQ ID NO: 6897191 - DNA, 22 bp, Homo sapiens
tcacaacgcctctgcaaatcct

SEQ ID NO: 6897192 - DNA, 22 bp, Homo sapiens
gctgggatggagactgcagtga

SEQ ID NO: 6897193 - DNA, 22 bp, Homo sapiens
ttaagaagtgattttcctcatt

SEQ ID NO: 6897194 - DNA, 22 bp, Homo sapiens
tcagtgtgttattctactttca

SEQ ID NO: 6897195 - DNA, 20 bp, Homo sapiens
gctgccagtgcctgatgctt

SEQ ID NO: 6897196 - DNA, 22 bp, Homo sapiens
aacctgcagtttttattctgag

SEQ ID NO: 6897197 - DNA, 22 bp, Homo sapiens
acagcagatctggctacaggtt

SEQ ID NO: 6897198 - DNA, 22 bp, Homo sapiens
catctgtaaggaagaggatcaa

SEQ ID NO: 6897199 - DNA, 22 bp, Homo sapiens
caaggcattgtgtaagcacttg

SEQ ID NO: 6897200 - DNA, 22 bp, Homo sapiens
ttttctatctcctagaactgcc

SEQ ID NO: 6897201 - DNA, 20 bp, Homo sapiens
gtttatacagaagaccccaa

SEQ ID NO: 6897202 - DNA, 22 bp, Homo sapiens
ctgttatttgagagtgttgaat

SEQ ID NO: 6897203 - DNA, 22 bp, Homo sapiens
tgtggtctcgttatgttgccca

SEQ ID NO: 6897204 - DNA, 22 bp, Homo sapiens
gtcctgggcccaggggctgcct

SEQ ID NO: 6897205 - DNA, 19 bp, Homo sapiens
tggcatgtttggctaagga

SEQ ID NO: 6897206 - DNA, 22 bp, Homo sapiens
cacatttgggacaggagataaa

SEQ ID NO: 6897207 - DNA, 22 bp, Homo sapiens
atgaggtggtcttcagtaggtc

SEQ ID NO: 6897208 - DNA, 14 bp, Homo sapiens
gcaggcagatcatt

SEQ ID NO: 6897209 - DNA, 21 bp, Homo sapiens
gtgcatcagatcagtggagtc

SEQ ID NO: 6897210 - DNA, 22 bp, Homo sapiens
acaaatgtgattgtttctgaaa

SEQ ID NO: 6897211 - DNA, 22 bp, Homo sapiens
tgtttccctggaagaggagaga

SEQ ID NO: 6897212 - DNA, 22 bp, Homo sapiens
ttcactgaattaatttccttct

SEQ ID NO: 6897213 - DNA, 21 bp, Homo sapiens
atgtgaaatatcatcagagca

SEQ ID NO: 6897214 - DNA, 22 bp, Homo sapiens
cagaattcgaatgagcagaatc

SEQ ID NO: 6897215 - DNA, 19 bp, Homo sapiens
agccagcaggcctctgagc

SEQ ID NO: 6897216 - DNA, 22 bp, Homo sapiens
tagatgtgttgcctggagttgt

SEQ ID NO: 6897217 - DNA, 22 bp, Homo sapiens
atgggtaagggtgtttggttag

SEQ ID NO: 6897218 - DNA, 22 bp, Homo sapiens
gggagctctccctgaggcctgg

SEQ ID NO: 6897219 - DNA, 22 bp, Homo sapiens
caggaaaggtgtgtcatgatgg

SEQ ID NO: 6897220 - DNA, 19 bp, Homo sapiens
ttgctgaaggaagcctctg

SEQ ID NO: 6897221 - DNA, 20 bp, Homo sapiens
gtggcctgtcctgttgtggg

SEQ ID NO: 6897222 - DNA, 22 bp, Homo sapiens
cagggttgggctccaaggatgg

SEQ ID NO: 6897223 - DNA, 22 bp, Homo sapiens
tgctcacttatccagttccact

SEQ ID NO: 6897224 - DNA, 22 bp, Homo sapiens
tcctgtttccaatttgttgggt

SEQ ID NO: 6897225 - DNA, 22 bp, Homo sapiens
ccaagcaggatattctgtgtca

SEQ ID NO: 6897226 - DNA, 22 bp, Homo sapiens
cctcccatggagctctgtccat

SEQ ID NO: 6897227 - DNA, 22 bp, Homo sapiens
tcaggctggagtgcagtggcgc

SEQ ID NO: 6897228 - DNA, 22 bp, Homo sapiens
atttctcactgagcagataaaa

SEQ ID NO: 6897229 - DNA, 22 bp, Homo sapiens
actccacaccacgggggccgcc

SEQ ID NO: 6897230 - DNA, 22 bp, Homo sapiens
atacttgaggttgtataaatat

SEQ ID NO: 6897231 - DNA, 22 bp, Homo sapiens
gttattggaaagcctggagggc

SEQ ID NO: 6897232 - DNA, 22 bp, Homo sapiens
caccgtggaggagctggagggc

SEQ ID NO: 6897233 - DNA, 22 bp, Homo sapiens
tgtgcagttttaagtggtctaa

SEQ ID NO: 6897234 - DNA, 22 bp, Homo sapiens
agggcgtggtggtgctggagca

SEQ ID NO: 6897235 - DNA, 22 bp, Homo sapiens
aacttggtaccaccttctgaag

SEQ ID NO: 6897236 - DNA, 23 bp, Homo sapiens
tacttaggaatggggacggcaag

SEQ ID NO: 6897237 - DNA, 23 bp, Homo sapiens
aggcaagggtgtaaaggaaatga

SEQ ID NO: 6897238 - DNA, 22 bp, Homo sapiens
ggtgccacataaatggagagag

SEQ ID NO: 6897239 - DNA, 22 bp, Homo sapiens
agacaattaaaaaattatgctt

SEQ ID NO: 6897240 - DNA, 22 bp, Homo sapiens
ttgctcttgaaaattgatgctg

SEQ ID NO: 6897241 - DNA, 22 bp, Homo sapiens
gcatgactggttttcttacaaa

SEQ ID NO: 6897242 - DNA, 18 bp, Homo sapiens
gagaagtgcatacattat

SEQ ID NO: 6897243 - DNA, 22 bp, Homo sapiens
agttgaatgttacagttctaaa

SEQ ID NO: 6897244 - DNA, 22 bp, Homo sapiens
tgaaaggttatttaggtctgct

SEQ ID NO: 6897245 - DNA, 22 bp, Homo sapiens
acattacctggcatttgatctt

SEQ ID NO: 6897246 - DNA, 22 bp, Homo sapiens
atctggctgagcgaggcccaca

SEQ ID NO: 6897247 - DNA, 22 bp, Homo sapiens
ttctctgagatagactaagtgg

SEQ ID NO: 6897248 - DNA, 22 bp, Homo sapiens
ccctgagaacaacttaggggtc

SEQ ID NO: 6897249 - DNA, 22 bp, Homo sapiens
ctgctggtgggaatttacaaga

SEQ ID NO: 6897250 - DNA, 22 bp, Homo sapiens
gatactttctcatttacccaag

SEQ ID NO: 6897251 - DNA, 22 bp, Homo sapiens
cggaagcgttctcagcaggggc

SEQ ID NO: 6897252 - DNA, 22 bp, Homo sapiens
tatatgcaatgaggtgggagta

SEQ ID NO: 6897253 - DNA, 22 bp, Homo sapiens
catgcttaattggagcattcat

SEQ ID NO: 6897254 - DNA, 22 bp, Homo sapiens
ctttggaataatcaagctctga

SEQ ID NO: 6897255 - DNA, 22 bp, Homo sapiens
tctccaggtgctaagtgtgcct

SEQ ID NO: 6897256 - DNA, 19 bp, Homo sapiens
acacagggatcagagggtt

SEQ ID NO: 6897257 - DNA, 22 bp, Homo sapiens
gttagacatgcagaatctcagg

SEQ ID NO: 6897258 - DNA, 22 bp, Homo sapiens
cctgataatgtaattgttaaat

SEQ ID NO: 6897259 - DNA, 23 bp, Homo sapiens
ggcctgtgttttgtctgaagtac

SEQ ID NO: 6897260 - DNA, 22 bp, Homo sapiens
gtggccagagtgtcattttatt

SEQ ID NO: 6897261 - DNA, 22 bp, Homo sapiens
acactttatctcatctcagaca

SEQ ID NO: 6897262 - DNA, 22 bp, Homo sapiens
gaaggcttggttttttcaacac

SEQ ID NO: 6897263 - DNA, 23 bp, Homo sapiens
acagaaatcatttgtaaggtacc

SEQ ID NO: 6897264 - DNA, 22 bp, Homo sapiens
cttaatttaaaatagttcaggc

SEQ ID NO: 6897265 - DNA, 22 bp, Homo sapiens
tggcctgccccgagatcctggc

SEQ ID NO: 6897266 - DNA, 22 bp, Homo sapiens
gtcccagttcctcctgtcagca

SEQ ID NO: 6897267 - DNA, 22 bp, Homo sapiens
agaggccccaggtgagcatgcc

SEQ ID NO: 6897268 - DNA, 22 bp, Homo sapiens
gagctctgtacacagagggtgt

SEQ ID NO: 6897269 - DNA, 22 bp, Homo sapiens
gggtcaggctagcccagacttc

SEQ ID NO: 6897270 - DNA, 22 bp, Homo sapiens
atagccactctaattctcttgt

SEQ ID NO: 6897271 - DNA, 22 bp, Homo sapiens
tgggtagggacttagctggctg

SEQ ID NO: 6897272 - DNA, 22 bp, Homo sapiens
aggctccgtccagtctcaggcc

SEQ ID NO: 6897273 - DNA, 22 bp, Homo sapiens
agatttactgagaactgattac

SEQ ID NO: 6897274 - DNA, 22 bp, Homo sapiens
tctgatgttgtgacatcacttc

SEQ ID NO: 6897275 - DNA, 22 bp, Homo sapiens
tattggaccacagactttaagg

SEQ ID NO: 6897276 - DNA, 22 bp, Homo sapiens
ggatagccgggtgttgtgggct

SEQ ID NO: 6897277 - DNA, 22 bp, Homo sapiens
cctttgtatttacctagtctca

SEQ ID NO: 6897278 - DNA, 22 bp, Homo sapiens
aagagctggctcttgcagcagc

SEQ ID NO: 6897279 - DNA, 22 bp, Homo sapiens
ggctctgcagtgacttgagggg

SEQ ID NO: 6897280 - DNA, 22 bp, Homo sapiens
tgcttaggatgctagcaggcat

SEQ ID NO: 6897281 - DNA, 22 bp, Homo sapiens
aaacttctggctacaagcaata

SEQ ID NO: 6897282 - DNA, 22 bp, Homo sapiens
cctgagctctgcactttttaga

SEQ ID NO: 6897283 - DNA, 22 bp, Homo sapiens
tggcagccacatctcgtggatt

SEQ ID NO: 6897284 - DNA, 22 bp, Homo sapiens
tccaggaggggtaggcagtatg

SEQ ID NO: 6897285 - DNA, 22 bp, Homo sapiens
tttcacagcgtctttctcttgc

SEQ ID NO: 6897286 - DNA, 22 bp, Homo sapiens
agagatacttttctttggatgc

SEQ ID NO: 6897287 - DNA, 22 bp, Homo sapiens
cagctgtgagagtgcattgaag

SEQ ID NO: 6897288 - DNA, 22 bp, Homo sapiens
agtgttaatatctggccctagg

SEQ ID NO: 6897289 - DNA, 22 bp, Homo sapiens
gtggcaggatcacggctcactg

SEQ ID NO: 6897290 - DNA, 22 bp, Homo sapiens
ttatcctgcatcctggaactca

SEQ ID NO: 6897291 - DNA, 22 bp, Homo sapiens
gaacattgctttatttcttcta

SEQ ID NO: 6897292 - DNA, 20 bp, Homo sapiens
gccgactgccttgtgagcct

SEQ ID NO: 6897293 - DNA, 20 bp, Homo sapiens
ggagctggcatccagcctct

SEQ ID NO: 6897294 - DNA, 22 bp, Homo sapiens
gctgtgtcctcacacagccttt

SEQ ID NO: 6897295 - DNA, 22 bp, Homo sapiens
aatactgcccccactctgccca

SEQ ID NO: 6897296 - DNA, 22 bp, Homo sapiens
acctttccaagtatcaggtggt

SEQ ID NO: 6897297 - DNA, 22 bp, Homo sapiens
tcgcttgcttcggtgaccctgg

SEQ ID NO: 6897298 - DNA, 22 bp, Homo sapiens
ttccatgcaagaagtatggctc

SEQ ID NO: 6897299 - DNA, 22 bp, Homo sapiens
aatgtgacatatctggcttagg

SEQ ID NO: 6897300 - DNA, 22 bp, Homo sapiens
gcccccttgacctaatcacctt

SEQ ID NO: 6897301 - DNA, 22 bp, Homo sapiens
ccaaggactggacacacaggtt

SEQ ID NO: 6897302 - DNA, 21 bp, Homo sapiens
tcatgggcaggtcacttcttt

SEQ ID NO: 6897303 - DNA, 20 bp, Homo sapiens
atgttcttcatttaatgttc

SEQ ID NO: 6897304 - DNA, 22 bp, Homo sapiens
ccctctgctgcctggctgggtc

SEQ ID NO: 6897305 - DNA, 22 bp, Homo sapiens
atttgctgccagtgtacactta

SEQ ID NO: 6897306 - DNA, 22 bp, Homo sapiens
gctccagtgaccatcgttttag

SEQ ID NO: 6897307 - DNA, 22 bp, Homo sapiens
gtcctgagagaggctccttgcc

SEQ ID NO: 6897308 - DNA, 22 bp, Homo sapiens
aggccctgttgtagcattttgg

SEQ ID NO: 6897309 - DNA, 22 bp, Homo sapiens
agatctttagtgaagctaaatc

SEQ ID NO: 6897310 - DNA, 22 bp, Homo sapiens
tggcagctctgttcaacatgag

SEQ ID NO: 6897311 - DNA, 23 bp, Homo sapiens
aagttctgattgtttttccatag

SEQ ID NO: 6897312 - DNA, 22 bp, Homo sapiens
aactgtttatgtaagtatgcag

SEQ ID NO: 6897313 - DNA, 16 bp, Homo sapiens
gtcacactggctgctt

SEQ ID NO: 6897314 - DNA, 19 bp, Homo sapiens
accctctgccacaagcctc

SEQ ID NO: 6897315 - DNA, 22 bp, Homo sapiens
gccttattacctgcactttgaa

SEQ ID NO: 6897316 - DNA, 22 bp, Homo sapiens
tgcagggctacaggactacaac

SEQ ID NO: 6897317 - DNA, 22 bp, Homo sapiens
agaggccctctctgctcagtct

SEQ ID NO: 6897318 - DNA, 22 bp, Homo sapiens
tttgtggcaggagcggagaccg

SEQ ID NO: 6897319 - DNA, 22 bp, Homo sapiens
cccaggtaaggatgctcctcat

SEQ ID NO: 6897320 - DNA, 22 bp, Homo sapiens
tctcccggctaagagcttcccg

SEQ ID NO: 6897321 - DNA, 22 bp, Homo sapiens
caatgatatctaggaatgggac

SEQ ID NO: 6897322 - DNA, 23 bp, Homo sapiens
aagtcagagccaagtcaatgaga

SEQ ID NO: 6897323 - DNA, 19 bp, Homo sapiens
tacaagcttttttggcagg

SEQ ID NO: 6897324 - DNA, 22 bp, Homo sapiens
gtcccacaggaactcggtggag

SEQ ID NO: 6897325 - DNA, 22 bp, Homo sapiens
tggcagctacagacagaggtga

SEQ ID NO: 6897326 - DNA, 22 bp, Homo sapiens
aagaactgtttacaattttcac

SEQ ID NO: 6897327 - DNA, 22 bp, Homo sapiens
ttcagcagagaaattacataat

SEQ ID NO: 6897328 - DNA, 22 bp, Homo sapiens
aacactgtgaggtaatgaccta

SEQ ID NO: 6897329 - DNA, 22 bp, Homo sapiens
cagtggaggccttgggaccttt

SEQ ID NO: 6897330 - DNA, 22 bp, Homo sapiens
tgatgagtttactcttttctaa

SEQ ID NO: 6897331 - DNA, 22 bp, Homo sapiens
gaagaatattcttgatcttaga

SEQ ID NO: 6897332 - DNA, 22 bp, Homo sapiens
ggtctggattttatctactgta

SEQ ID NO: 6897333 - DNA, 22 bp, Homo sapiens
gctacaggagataaaggcctct

SEQ ID NO: 6897334 - DNA, 22 bp, Homo sapiens
ctctcctttcactaaatattct

SEQ ID NO: 6897335 - DNA, 22 bp, Homo sapiens
cagcatggcttgagtgtttcct

SEQ ID NO: 6897336 - DNA, 22 bp, Homo sapiens
gagatgcttgtctgtcttatca

SEQ ID NO: 6897337 - DNA, 22 bp, Homo sapiens
ctccctggcacagcgagaggtt

SEQ ID NO: 6897338 - DNA, 22 bp, Homo sapiens
agggaggtggttccccagtgga

SEQ ID NO: 6897339 - DNA, 22 bp, Homo sapiens
tcagaattgcagggagggcagg

SEQ ID NO: 6897340 - DNA, 22 bp, Homo sapiens
caggaggcagtgggtgttgtct

SEQ ID NO: 6897341 - DNA, 22 bp, Homo sapiens
taagatgggctaagtttgtcct

SEQ ID NO: 6897342 - DNA, 22 bp, Homo sapiens
gctccgtctttattttctctga

SEQ ID NO: 6897343 - DNA, 22 bp, Homo sapiens
gaaacttcttgtctcacagttc

SEQ ID NO: 6897344 - DNA, 17 bp, Homo sapiens
attctttgatgtctctg

SEQ ID NO: 6897345 - DNA, 22 bp, Homo sapiens
tatgctcctattggaatgatag

SEQ ID NO: 6897346 - DNA, 22 bp, Homo sapiens
cccaggggttctgagcagcagc

SEQ ID NO: 6897347 - DNA, 22 bp, Homo sapiens
ttgtccagagccaggctgtcgg

SEQ ID NO: 6897348 - DNA, 22 bp, Homo sapiens
cttcctctgtggccagagtgta

SEQ ID NO: 6897349 - DNA, 22 bp, Homo sapiens
gaagtttttgtagagacagggt

SEQ ID NO: 6897350 - DNA, 22 bp, Homo sapiens
tcaggaggtgtaggtcaagtga

SEQ ID NO: 6897351 - DNA, 22 bp, Homo sapiens
gggcatgagagggcagctggca

SEQ ID NO: 6897352 - DNA, 22 bp, Homo sapiens
acaaagtcctggtgtatggcca

SEQ ID NO: 6897353 - DNA, 22 bp, Homo sapiens
tactgcttgatctagcatggct

SEQ ID NO: 6897354 - DNA, 18 bp, Homo sapiens
gtggggtgttgtgaggat

SEQ ID NO: 6897355 - DNA, 22 bp, Homo sapiens
gaagtctgctgctcaggagttt

SEQ ID NO: 6897356 - DNA, 18 bp, Homo sapiens
gggccctggcgtccgccc

SEQ ID NO: 6897357 - DNA, 22 bp, Homo sapiens
agtctatgattggcagcttttc

SEQ ID NO: 6897358 - DNA, 22 bp, Homo sapiens
gtgtggccctgcgtcctgagtc

SEQ ID NO: 6897359 - DNA, 22 bp, Homo sapiens
gcagtgttacttggtttgcaga

SEQ ID NO: 6897360 - DNA, 22 bp, Homo sapiens
tgaacactgccatatttaagaa

SEQ ID NO: 6897361 - DNA, 22 bp, Homo sapiens
ttattgcagatggtgtgagaga

SEQ ID NO: 6897362 - DNA, 22 bp, Homo sapiens
agggtctgtttaccacctcttt

SEQ ID NO: 6897363 - DNA, 22 bp, Homo sapiens
atttatctctggaaactaagca

SEQ ID NO: 6897364 - DNA, 22 bp, Homo sapiens
tattcctgttccccatcaccac

SEQ ID NO: 6897365 - DNA, 22 bp, Homo sapiens
gaagaactaactgaccatgaat

SEQ ID NO: 6897366 - DNA, 20 bp, Homo sapiens
tcctggagtattccatgctt

SEQ ID NO: 6897367 - DNA, 22 bp, Homo sapiens
tttccagaaataccatttggtg

SEQ ID NO: 6897368 - DNA, 22 bp, Homo sapiens
tttgactgttttatgaggtggt

SEQ ID NO: 6897369 - DNA, 22 bp, Homo sapiens
atgtggctttcatgattaagca

SEQ ID NO: 6897370 - DNA, 21 bp, Homo sapiens
taccaagaagtttgggaaagc

SEQ ID NO: 6897371 - DNA, 18 bp, Homo sapiens
ttgcaaattcttccctgt

SEQ ID NO: 6897372 - DNA, 22 bp, Homo sapiens
actacagtccctcatatgttgg

SEQ ID NO: 6897373 - DNA, 22 bp, Homo sapiens
ttgctgggtcagaagccaggag

SEQ ID NO: 6897374 - DNA, 22 bp, Homo sapiens
tcacatgtgttttctcaccaac

SEQ ID NO: 6897375 - DNA, 22 bp, Homo sapiens
ccaagctgactgtgctgttgtg

SEQ ID NO: 6897376 - DNA, 18 bp, Homo sapiens
tctgcctgcagggcatct

SEQ ID NO: 6897377 - DNA, 22 bp, Homo sapiens
ggagaagttggacagtttggga

SEQ ID NO: 6897378 - DNA, 22 bp, Homo sapiens
cagctgtttgggcatggccaga

SEQ ID NO: 6897379 - DNA, 22 bp, Homo sapiens
tcagttgcctccatagtcatcc

SEQ ID NO: 6897380 - DNA, 22 bp, Homo sapiens
ggagctgagcagcgatggcgga

SEQ ID NO: 6897381 - DNA, 22 bp, Homo sapiens
gcccaggagttcaagtctagtg

SEQ ID NO: 6897382 - DNA, 22 bp, Homo sapiens
actgtgggcctttcctttgacc

SEQ ID NO: 6897383 - DNA, 22 bp, Homo sapiens
ctccagctttttcccagttggc

SEQ ID NO: 6897384 - DNA, 22 bp, Homo sapiens
tttaattgattcacagtctgta

SEQ ID NO: 6897385 - DNA, 22 bp, Homo sapiens
agagcacagtatctgcacatca

SEQ ID NO: 6897386 - DNA, 22 bp, Homo sapiens
actagcagtcagcggttggcaa

SEQ ID NO: 6897387 - DNA, 22 bp, Homo sapiens
catgtgaccgctgggtgagcga

SEQ ID NO: 6897388 - DNA, 20 bp, Homo sapiens
tactgaagaagctgcccaga

SEQ ID NO: 6897389 - DNA, 22 bp, Homo sapiens
caataactagtaattattccgg

SEQ ID NO: 6897390 - DNA, 22 bp, Homo sapiens
tagctgaagggcatttaataaa

SEQ ID NO: 6897391 - DNA, 22 bp, Homo sapiens
agtgattttaacttccagcaat

SEQ ID NO: 6897392 - DNA, 22 bp, Homo sapiens
ccagggagcccacaggacaatg

SEQ ID NO: 6897393 - DNA, 22 bp, Homo sapiens
tccagaaacttttccagtctca

SEQ ID NO: 6897394 - DNA, 22 bp, Homo sapiens
acagttctttgtttatagcttg

SEQ ID NO: 6897395 - DNA, 22 bp, Homo sapiens
tctctgtgtcttagtgaaggga

SEQ ID NO: 6897396 - DNA, 22 bp, Homo sapiens
gaaggctaaaggggcagaggtt

SEQ ID NO: 6897397 - DNA, 19 bp, Homo sapiens
agacttgtcaaattatagt

SEQ ID NO: 6897398 - DNA, 22 bp, Homo sapiens
cttcaagtccagctcatgctct

SEQ ID NO: 6897399 - DNA, 23 bp, Homo sapiens
agacactgtaaagaattgcagtt

SEQ ID NO: 6897400 - DNA, 22 bp, Homo sapiens
cttattttgctgatgacccagg

SEQ ID NO: 6897401 - DNA, 22 bp, Homo sapiens
gaagcacactgattttatttct

SEQ ID NO: 6897402 - DNA, 20 bp, Homo sapiens
gcttggaagccacctgtatt

SEQ ID NO: 6897403 - DNA, 22 bp, Homo sapiens
ccagagtctatgagtcctcatt

SEQ ID NO: 6897404 - DNA, 22 bp, Homo sapiens
tggcagttatattgccttaggg

SEQ ID NO: 6897405 - DNA, 20 bp, Homo sapiens
ttggttgagccagggcctgg

SEQ ID NO: 6897406 - DNA, 20 bp, Homo sapiens
agatggtgaaggccagggag

SEQ ID NO: 6897407 - DNA, 22 bp, Homo sapiens
tgacagaggagctggaatgatt

SEQ ID NO: 6897408 - DNA, 22 bp, Homo sapiens
aagcaccaccctcccaacctgt

SEQ ID NO: 6897409 - DNA, 22 bp, Homo sapiens
gtgctttctgctgcattcctct

SEQ ID NO: 6897410 - DNA, 22 bp, Homo sapiens
taagtgatttgtagtatactat

SEQ ID NO: 6897411 - DNA, 21 bp, Homo sapiens
gctgctgcccctagtgaggcc

SEQ ID NO: 6897412 - DNA, 22 bp, Homo sapiens
ctggagtttgcggggacagaga

SEQ ID NO: 6897413 - DNA, 22 bp, Homo sapiens
ttcatttgagtttatagttgct

SEQ ID NO: 6897414 - DNA, 22 bp, Homo sapiens
tactctgggtgatggttaaaag

SEQ ID NO: 6897415 - DNA, 20 bp, Homo sapiens
gcctccacactcacccctta

SEQ ID NO: 6897416 - DNA, 22 bp, Homo sapiens
atgcacatcttacagatgcaga

SEQ ID NO: 6897417 - DNA, 19 bp, Homo sapiens
cctctccgcccaccagccc

SEQ ID NO: 6897418 - DNA, 22 bp, Homo sapiens
gctgaaatgtttaatttgggag

SEQ ID NO: 6897419 - DNA, 22 bp, Homo sapiens
agatggtctggttatttttagt

SEQ ID NO: 6897420 - DNA, 22 bp, Homo sapiens
gaaattgtaaaggattgcgcca

SEQ ID NO: 6897421 - DNA, 22 bp, Homo sapiens
tctgcatttggatcttgagctg

SEQ ID NO: 6897422 - DNA, 22 bp, Homo sapiens
agccagagctgatgtcattctc

SEQ ID NO: 6897423 - DNA, 18 bp, Homo sapiens
ctttcagtaatttcagcc

SEQ ID NO: 6897424 - DNA, 22 bp, Homo sapiens
ttcttgggaatttttccaacac

SEQ ID NO: 6897425 - DNA, 22 bp, Homo sapiens
actagaaagaagttttttgaga

SEQ ID NO: 6897426 - DNA, 22 bp, Homo sapiens
tcaggggcttgaggtgcatgtc

SEQ ID NO: 6897427 - DNA, 22 bp, Homo sapiens
ttggaagacagccgtctttatt

SEQ ID NO: 6897428 - DNA, 22 bp, Homo sapiens
tgtaaagggtgttaaattactc

SEQ ID NO: 6897429 - DNA, 22 bp, Homo sapiens
ttgtgtcatgttccattgaaaa

SEQ ID NO: 6897430 - DNA, 18 bp, Homo sapiens
agtaaatgttaaatattg

SEQ ID NO: 6897431 - DNA, 22 bp, Homo sapiens
agctcacagaaatcctgcagga

SEQ ID NO: 6897432 - DNA, 22 bp, Homo sapiens
atagacaatcccccatcctacc

SEQ ID NO: 6897433 - DNA, 22 bp, Homo sapiens
ttcaatgaggatagaactggat

SEQ ID NO: 6897434 - DNA, 22 bp, Homo sapiens
gcccagagtttgaagatacagt

SEQ ID NO: 6897435 - DNA, 19 bp, Homo sapiens
ggaagagaggaaaggtgga

SEQ ID NO: 6897436 - DNA, 22 bp, Homo sapiens
ttggaaggagtctttggggatg

SEQ ID NO: 6897437 - DNA, 22 bp, Homo sapiens
cctttggtaattctgtgtagag

SEQ ID NO: 6897438 - DNA, 22 bp, Homo sapiens
cccagtgttacgtgacagcctg

SEQ ID NO: 6897439 - DNA, 22 bp, Homo sapiens
tagggcagccacccaggctgct

SEQ ID NO: 6897440 - DNA, 22 bp, Homo sapiens
ttatggtaggagctgtcagttt

SEQ ID NO: 6897441 - DNA, 22 bp, Homo sapiens
tcagcagtcctccaggatcaag

SEQ ID NO: 6897442 - DNA, 22 bp, Homo sapiens
atttactagggctgtttaagta

SEQ ID NO: 6897443 - DNA, 22 bp, Homo sapiens
agtccagaacttcagctagttt

SEQ ID NO: 6897444 - DNA, 22 bp, Homo sapiens
caatagatgtttttgcttacca

SEQ ID NO: 6897445 - DNA, 22 bp, Homo sapiens
cagtgagtccaagatggctgaa

SEQ ID NO: 6897446 - DNA, 22 bp, Homo sapiens
tgcagaatgtggacagtgggtt

SEQ ID NO: 6897447 - DNA, 22 bp, Homo sapiens
aaaactttcagggatacagaaa

SEQ ID NO: 6897448 - DNA, 22 bp, Homo sapiens
taccacagtctgccattagatg

SEQ ID NO: 6897449 - DNA, 22 bp, Homo sapiens
cttgcagtttaggtcctctgtg

SEQ ID NO: 6897450 - DNA, 22 bp, Homo sapiens
agtggctgtgaaatacatggga

SEQ ID NO: 6897451 - DNA, 20 bp, Homo sapiens
tcactagtaaccatctgctt

SEQ ID NO: 6897452 - DNA, 22 bp, Homo sapiens
gttgtcaggtaaaacagtatgg

SEQ ID NO: 6897453 - DNA, 22 bp, Homo sapiens
tgtcaactgcctctgaaggagt

SEQ ID NO: 6897454 - DNA, 22 bp, Homo sapiens
aatatcctttccagagtacagt

SEQ ID NO: 6897455 - DNA, 22 bp, Homo sapiens
taagaaacccaggaatttctta

SEQ ID NO: 6897456 - DNA, 22 bp, Homo sapiens
tttgcattttagatttaggcct

SEQ ID NO: 6897457 - DNA, 22 bp, Homo sapiens
aggccgtgtgagcatgtgtgag

SEQ ID NO: 6897458 - DNA, 22 bp, Homo sapiens
tctacagggtcagagtttcatg

SEQ ID NO: 6897459 - DNA, 22 bp, Homo sapiens
cagcatgcaggggcctgagcac

SEQ ID NO: 6897460 - DNA, 19 bp, Homo sapiens
ggagcctggcaggggcgtg

SEQ ID NO: 6897461 - DNA, 18 bp, Homo sapiens
taacatgttttcattaag

SEQ ID NO: 6897462 - DNA, 22 bp, Homo sapiens
ctgctcacgccaccgttcatca

SEQ ID NO: 6897463 - DNA, 22 bp, Homo sapiens
tcagtgcagggtgggagagaga

SEQ ID NO: 6897464 - DNA, 22 bp, Homo sapiens
cacgcatgtggatcagatgaag

SEQ ID NO: 6897465 - DNA, 22 bp, Homo sapiens
aaatagacaggcttaaatagga

SEQ ID NO: 6897466 - DNA, 22 bp, Homo sapiens
tacctggaaaagttatatgtgt

SEQ ID NO: 6897467 - DNA, 22 bp, Homo sapiens
ttcctggctgatctaccaaagt

SEQ ID NO: 6897468 - DNA, 22 bp, Homo sapiens
gcatggtggagtctgagcaggg

SEQ ID NO: 6897469 - DNA, 22 bp, Homo sapiens
atattagggtctctaaattcta

SEQ ID NO: 6897470 - DNA, 22 bp, Homo sapiens
cagtcctctggagtgagggtga

SEQ ID NO: 6897471 - DNA, 22 bp, Homo sapiens
tacctagaccagttacaatgca

SEQ ID NO: 6897472 - DNA, 22 bp, Homo sapiens
gtgtaagtatctttgtatcttt

SEQ ID NO: 6897473 - DNA, 22 bp, Homo sapiens
gtacggtgaatcagtggatgaa

SEQ ID NO: 6897474 - DNA, 22 bp, Homo sapiens
tagtcagcatgaaataagcagc

SEQ ID NO: 6897475 - DNA, 22 bp, Homo sapiens
aggcagtgtgtagctggaagag

SEQ ID NO: 6897476 - DNA, 21 bp, Homo sapiens
ttctctacctctagtgctgta

SEQ ID NO: 6897477 - DNA, 22 bp, Homo sapiens
aagctgcagaccccctgtctca

SEQ ID NO: 6897478 - DNA, 22 bp, Homo sapiens
ctcccctagcccgttgggaggt

SEQ ID NO: 6897479 - DNA, 22 bp, Homo sapiens
cacctgttcattacccatccca

SEQ ID NO: 6897480 - DNA, 23 bp, Homo sapiens
gcagacagagcagactaagacaa

SEQ ID NO: 6897481 - DNA, 22 bp, Homo sapiens
cactggatttccaggaatactc

SEQ ID NO: 6897482 - DNA, 22 bp, Homo sapiens
gcacccagggcaggaagtgagg

SEQ ID NO: 6897483 - DNA, 22 bp, Homo sapiens
agtctctgcatgcctgctgtgc

SEQ ID NO: 6897484 - DNA, 22 bp, Homo sapiens
attcgggagataaggcttctgc

SEQ ID NO: 6897485 - DNA, 20 bp, Homo sapiens
atttcagtgtttgcaatttc

SEQ ID NO: 6897486 - DNA, 22 bp, Homo sapiens
cttgctgattcatgtcttcctg

SEQ ID NO: 6897487 - DNA, 22 bp, Homo sapiens
ctgaataatgttctcttgtatg

SEQ ID NO: 6897488 - DNA, 22 bp, Homo sapiens
acacagatttcactggaataga

SEQ ID NO: 6897489 - DNA, 22 bp, Homo sapiens
agttctggcggctgtcggcact

SEQ ID NO: 6897490 - DNA, 22 bp, Homo sapiens
actttggaaattgtctataaga

SEQ ID NO: 6897491 - DNA, 22 bp, Homo sapiens
actgtgatgatgaagcatggtt

SEQ ID NO: 6897492 - DNA, 22 bp, Homo sapiens
ctttgtggctcctgcaggccat

SEQ ID NO: 6897493 - DNA, 18 bp, Homo sapiens
gcaacagtatcagcaggc

SEQ ID NO: 6897494 - DNA, 22 bp, Homo sapiens
ctgagagcatcgctggagatag

SEQ ID NO: 6897495 - DNA, 22 bp, Homo sapiens
ccgtgttcaccagatgcccctc

SEQ ID NO: 6897496 - DNA, 22 bp, Homo sapiens
aaggagtgctgaaaggaagcgg

SEQ ID NO: 6897497 - DNA, 22 bp, Homo sapiens
tcacttataaaatgcaagatct

SEQ ID NO: 6897498 - DNA, 22 bp, Homo sapiens
gtgcctggcatgcgccggtgct

SEQ ID NO: 6897499 - DNA, 22 bp, Homo sapiens
gctggagttagaactagcctgg

SEQ ID NO: 6897500 - DNA, 22 bp, Homo sapiens
aggcattcaacaaatgtttgtg

SEQ ID NO: 6897501 - DNA, 22 bp, Homo sapiens
acaattgagtttctgagggttt

SEQ ID NO: 6897502 - DNA, 22 bp, Homo sapiens
ggtccagggggtagatatgtga

SEQ ID NO: 6897503 - DNA, 22 bp, Homo sapiens
gcagtcatcacggcttttaggc

SEQ ID NO: 6897504 - DNA, 22 bp, Homo sapiens
caaatgttattcattcttgttt

SEQ ID NO: 6897505 - DNA, 22 bp, Homo sapiens
gaaggaggcgttagccctagga

SEQ ID NO: 6897506 - DNA, 22 bp, Homo sapiens
aaagtggtcaccttctcatttc

SEQ ID NO: 6897507 - DNA, 22 bp, Homo sapiens
tccagactgcttctaggatgag

SEQ ID NO: 6897508 - DNA, 22 bp, Homo sapiens
gctggagaacccaggaggaaga

SEQ ID NO: 6897509 - DNA, 22 bp, Homo sapiens
cacccaggctagagtgcagtgg

SEQ ID NO: 6897510 - DNA, 22 bp, Homo sapiens
ccactgaaaaatttgagatgga

SEQ ID NO: 6897511 - DNA, 22 bp, Homo sapiens
tatggcttctgggccaaattta

SEQ ID NO: 6897512 - DNA, 22 bp, Homo sapiens
gctgtagggctgagctggaccg

SEQ ID NO: 6897513 - DNA, 22 bp, Homo sapiens
atggccaccatctctaaaacac

SEQ ID NO: 6897514 - DNA, 22 bp, Homo sapiens
tgtttgtatggacctgttctat

SEQ ID NO: 6897515 - DNA, 22 bp, Homo sapiens
ccattcacttttgccctgtcct

SEQ ID NO: 6897516 - DNA, 22 bp, Homo sapiens
cagagtgaaataggggatcaag

SEQ ID NO: 6897517 - DNA, 22 bp, Homo sapiens
atgtcctgctgattcacattat

SEQ ID NO: 6897518 - DNA, 22 bp, Homo sapiens
ctgtaagggcctgactaccctg

SEQ ID NO: 6897519 - DNA, 22 bp, Homo sapiens
caatgcttttgttctttactca

SEQ ID NO: 6897520 - DNA, 22 bp, Homo sapiens
atgggagtgtggttagagacct

SEQ ID NO: 6897521 - DNA, 22 bp, Homo sapiens
cttccaaagcactttatggacc

SEQ ID NO: 6897522 - DNA, 22 bp, Homo sapiens
tcataaattgggttggctgggt

SEQ ID NO: 6897523 - DNA, 22 bp, Homo sapiens
ttcttcaaaacaacactggcct

SEQ ID NO: 6897524 - DNA, 22 bp, Homo sapiens
ctttggagttccctaatttccc

SEQ ID NO: 6897525 - DNA, 22 bp, Homo sapiens
ttctatcatacttgaatacatt

SEQ ID NO: 6897526 - DNA, 22 bp, Homo sapiens
atctgtccaccttcccatttac

SEQ ID NO: 6897527 - DNA, 23 bp, Homo sapiens
ccacatggcaagatgatgcattc

SEQ ID NO: 6897528 - DNA, 22 bp, Homo sapiens
ttcttcaggatacgtcatccag

SEQ ID NO: 6897529 - DNA, 22 bp, Homo sapiens
acagggtgactttgtgacagat

SEQ ID NO: 6897530 - DNA, 21 bp, Homo sapiens
ccctcaggaaacagaatgcac

SEQ ID NO: 6897531 - DNA, 22 bp, Homo sapiens
agcaggggtggaaggtagcttt

SEQ ID NO: 6897532 - DNA, 22 bp, Homo sapiens
tgcaggaaaaataaatagtgtt

SEQ ID NO: 6897533 - DNA, 22 bp, Homo sapiens
atgctgtgctggctaaccatgg

SEQ ID NO: 6897534 - DNA, 22 bp, Homo sapiens
cctgagagtggtgtacaggaga

SEQ ID NO: 6897535 - DNA, 22 bp, Homo sapiens
attggtgcatgtaggtgatgct

SEQ ID NO: 6897536 - DNA, 22 bp, Homo sapiens
tagttagcattcagggagctgg

SEQ ID NO: 6897537 - DNA, 20 bp, Homo sapiens
actctaactctttacaacag

SEQ ID NO: 6897538 - DNA, 22 bp, Homo sapiens
tttcaagtttagtgtgttcaaa

SEQ ID NO: 6897539 - DNA, 22 bp, Homo sapiens
tgggacaaggactagctccaat

SEQ ID NO: 6897540 - DNA, 22 bp, Homo sapiens
tctacttccgcaaaaggcacat

SEQ ID NO: 6897541 - DNA, 23 bp, Homo sapiens
agacagtggccgagaggtactag

SEQ ID NO: 6897542 - DNA, 22 bp, Homo sapiens
atgcacagaaaaattgcttact

SEQ ID NO: 6897543 - DNA, 22 bp, Homo sapiens
ggaagatttcccgtagctgtgc

SEQ ID NO: 6897544 - DNA, 22 bp, Homo sapiens
tgcagctcaagctggtgaggtg

SEQ ID NO: 6897545 - DNA, 22 bp, Homo sapiens
ggacgcagcgagggaagcagcc

SEQ ID NO: 6897546 - DNA, 22 bp, Homo sapiens
ctgtttcaaaactagtacaaca

SEQ ID NO: 6897547 - DNA, 22 bp, Homo sapiens
agtgacaaggcctgaagctcct

SEQ ID NO: 6897548 - DNA, 22 bp, Homo sapiens
atgcatgaaagaatccaagcct

SEQ ID NO: 6897549 - DNA, 22 bp, Homo sapiens
tgcataaatattgttgggagta

SEQ ID NO: 6897550 - DNA, 22 bp, Homo sapiens
atgagttaggggcctgagtgga

SEQ ID NO: 6897551 - DNA, 22 bp, Homo sapiens
gagagcctttgaagggaagtga

SEQ ID NO: 6897552 - DNA, 22 bp, Homo sapiens
actgggctcataatgtcataga

SEQ ID NO: 6897553 - DNA, 22 bp, Homo sapiens
accttgggcaacctgctcctgc

SEQ ID NO: 6897554 - DNA, 22 bp, Homo sapiens
gcatttaaatttgaacttcaga

SEQ ID NO: 6897555 - DNA, 22 bp, Homo sapiens
actgaaagtccagcatggtaca

SEQ ID NO: 6897556 - DNA, 22 bp, Homo sapiens
tcctggctgtcactcgggttga

SEQ ID NO: 6897557 - DNA, 22 bp, Homo sapiens
aaagaatgtctgaacagctggc

SEQ ID NO: 6897558 - DNA, 22 bp, Homo sapiens
tcagttgcatattttgtgttct

SEQ ID NO: 6897559 - DNA, 19 bp, Homo sapiens
cagctggaatcatctgagg

SEQ ID NO: 6897560 - DNA, 22 bp, Homo sapiens
atttattacctcggagtttctg

SEQ ID NO: 6897561 - DNA, 22 bp, Homo sapiens
ctgcttctgggatgatggagta

SEQ ID NO: 6897562 - DNA, 22 bp, Homo sapiens
aaggtattatttgcaatcattt

SEQ ID NO: 6897563 - DNA, 22 bp, Homo sapiens
tctcaggcatggtttgttcatc

SEQ ID NO: 6897564 - DNA, 22 bp, Homo sapiens
agagctctttgatttgcttctc

SEQ ID NO: 6897565 - DNA, 22 bp, Homo sapiens
gctgaaatgcagatccctcact

SEQ ID NO: 6897566 - DNA, 20 bp, Homo sapiens
tctgccttatgaccttcgcc

SEQ ID NO: 6897567 - DNA, 22 bp, Homo sapiens
ttccaaactgccaattcagaag

SEQ ID NO: 6897568 - DNA, 22 bp, Homo sapiens
cacattgtagagattagaaaga

SEQ ID NO: 6897569 - DNA, 23 bp, Homo sapiens
atggggctcaacacttagtagct

SEQ ID NO: 6897570 - DNA, 22 bp, Homo sapiens
agctggcttgcatgctaaggag

SEQ ID NO: 6897571 - DNA, 22 bp, Homo sapiens
agtctgaagtagtctttagtgt

SEQ ID NO: 6897572 - DNA, 20 bp, Homo sapiens
ttgtttctgctattttctaa

SEQ ID NO: 6897573 - DNA, 22 bp, Homo sapiens
atgtttccatcaaatttgatga

SEQ ID NO: 6897574 - DNA, 22 bp, Homo sapiens
gcacaggtaatccgaatcattc

SEQ ID NO: 6897575 - DNA, 22 bp, Homo sapiens
tttagcaaaggtgtcttgggca

SEQ ID NO: 6897576 - DNA, 22 bp, Homo sapiens
cctgccaggccagtgagcttcc

SEQ ID NO: 6897577 - DNA, 22 bp, Homo sapiens
ctgcctggggaatgtgaggatt

SEQ ID NO: 6897578 - DNA, 19 bp, Homo sapiens
gctttagtttactcatcta

SEQ ID NO: 6897579 - DNA, 22 bp, Homo sapiens
acattctatggttgatgagttg

SEQ ID NO: 6897580 - DNA, 21 bp, Homo sapiens
aggaggctgtctctttcagct

SEQ ID NO: 6897581 - DNA, 22 bp, Homo sapiens
ctgggaagaagggacaacagcg

SEQ ID NO: 6897582 - DNA, 22 bp, Homo sapiens
tgtctctggcccatgagcagag

SEQ ID NO: 6897583 - DNA, 22 bp, Homo sapiens
caaggccactgctcaggtttcc

SEQ ID NO: 6897584 - DNA, 22 bp, Homo sapiens
aacattgcaaataagcttgcag

SEQ ID NO: 6897585 - DNA, 22 bp, Homo sapiens
gtgcaaatgtaattgccattga

SEQ ID NO: 6897586 - DNA, 22 bp, Homo sapiens
gccctgtcggaactgcgacctc

SEQ ID NO: 6897587 - DNA, 22 bp, Homo sapiens
agcagcttctttcactcctgga

SEQ ID NO: 6897588 - DNA, 22 bp, Homo sapiens
gtgttgcttcatctttatggtg

SEQ ID NO: 6897589 - DNA, 21 bp, Homo sapiens
agagaattgccttagatgttc

SEQ ID NO: 6897590 - DNA, 22 bp, Homo sapiens
gctatttctttaaattgatctc

SEQ ID NO: 6897591 - DNA, 22 bp, Homo sapiens
tgaaaccccagattaccacaaa

SEQ ID NO: 6897592 - DNA, 22 bp, Homo sapiens
agcatgcttattttatctcatt

SEQ ID NO: 6897593 - DNA, 22 bp, Homo sapiens
ttacagaactgtcttgaaattt

SEQ ID NO: 6897594 - DNA, 22 bp, Homo sapiens
tttcctcacttcatgagagttt

SEQ ID NO: 6897595 - DNA, 22 bp, Homo sapiens
cggcagagcggcgagcccctcc

SEQ ID NO: 6897596 - DNA, 18 bp, Homo sapiens
tggacacatggcctgggt

SEQ ID NO: 6897597 - DNA, 22 bp, Homo sapiens
gtcctgatagcccaacactgcc

SEQ ID NO: 6897598 - DNA, 22 bp, Homo sapiens
ggccttccagggaagacagggc

SEQ ID NO: 6897599 - DNA, 22 bp, Homo sapiens
aaagtgacaaccatttattaag

SEQ ID NO: 6897600 - DNA, 22 bp, Homo sapiens
cagggctcgctcttgcccttcg

SEQ ID NO: 6897601 - DNA, 22 bp, Homo sapiens
caggtggcttctccctaggcca

SEQ ID NO: 6897602 - DNA, 22 bp, Homo sapiens
actgagagttgaaaagggagga

SEQ ID NO: 6897603 - DNA, 22 bp, Homo sapiens
tccaggtaggccaagacagcta

SEQ ID NO: 6897604 - DNA, 22 bp, Homo sapiens
tgcgtggcgcagcgtgtgggat

SEQ ID NO: 6897605 - DNA, 22 bp, Homo sapiens
ttcagagaagtgcacaaaatca

SEQ ID NO: 6897606 - DNA, 22 bp, Homo sapiens
acgatgctggattatctcaagg

SEQ ID NO: 6897607 - DNA, 22 bp, Homo sapiens
ctgtggctgcagccttggtcct

SEQ ID NO: 6897608 - DNA, 22 bp, Homo sapiens
agtggcaggaaagtggaagaga

SEQ ID NO: 6897609 - DNA, 22 bp, Homo sapiens
cttgggcacatccctggtattt

SEQ ID NO: 6897610 - DNA, 22 bp, Homo sapiens
gataaagcaaggatgactgaag

SEQ ID NO: 6897611 - DNA, 22 bp, Homo sapiens
ggagcaccccagatcagagaac

SEQ ID NO: 6897612 - DNA, 22 bp, Homo sapiens
tgctggtccatgaggccagatc

SEQ ID NO: 6897613 - DNA, 22 bp, Homo sapiens
taggaacctactgtggttttaa

SEQ ID NO: 6897614 - DNA, 22 bp, Homo sapiens
ccaggcactcagagactgggac

SEQ ID NO: 6897615 - DNA, 22 bp, Homo sapiens
ggcaggtgctgggagcatctca

SEQ ID NO: 6897616 - DNA, 22 bp, Homo sapiens
ccagggcaattatttggagggt

SEQ ID NO: 6897617 - DNA, 22 bp, Homo sapiens
cacccaggacaggccagatgtg

SEQ ID NO: 6897618 - DNA, 22 bp, Homo sapiens
tgatgacagcaaaaaatgctag

SEQ ID NO: 6897619 - DNA, 22 bp, Homo sapiens
taattcatgggcccagtgatat

SEQ ID NO: 6897620 - DNA, 22 bp, Homo sapiens
tgaaattattcttaccaaggtg

SEQ ID NO: 6897621 - DNA, 22 bp, Homo sapiens
tacttgccatcagagtttatta

SEQ ID NO: 6897622 - DNA, 22 bp, Homo sapiens
tttaggaatagctgacaatctt

SEQ ID NO: 6897623 - DNA, 22 bp, Homo sapiens
gactacaactcccagaagactt

SEQ ID NO: 6897624 - DNA, 22 bp, Homo sapiens
acagatgagaaggctgaccagt

SEQ ID NO: 6897625 - DNA, 22 bp, Homo sapiens
agaaagattttcaacaggaggt

SEQ ID NO: 6897626 - DNA, 22 bp, Homo sapiens
aagtttcatgacttggttatta

SEQ ID NO: 6897627 - DNA, 22 bp, Homo sapiens
cttcagtgttcccatctgtaaa

SEQ ID NO: 6897628 - DNA, 22 bp, Homo sapiens
atctgagaagattttggcataa

SEQ ID NO: 6897629 - DNA, 22 bp, Homo sapiens
tccaccagggtttcatctccct

SEQ ID NO: 6897630 - DNA, 22 bp, Homo sapiens
atactatattaccttctcaact

SEQ ID NO: 6897631 - DNA, 22 bp, Homo sapiens
tggaaaacaatgatttgggcaa

SEQ ID NO: 6897632 - DNA, 22 bp, Homo sapiens
attgtgattagagaatatagag

SEQ ID NO: 6897633 - DNA, 22 bp, Homo sapiens
gaatgattaactagttgataca

SEQ ID NO: 6897634 - DNA, 23 bp, Homo sapiens
tcagaggatcatcaaacgttttc

SEQ ID NO: 6897635 - DNA, 22 bp, Homo sapiens
taccaagaaaagggattaaatg

SEQ ID NO: 6897636 - DNA, 22 bp, Homo sapiens
gaagatttctttatgaaagatg

SEQ ID NO: 6897637 - DNA, 22 bp, Homo sapiens
tttattaattagtgacccaatg

SEQ ID NO: 6897638 - DNA, 22 bp, Homo sapiens
gagaggtcatctcccatcagca

SEQ ID NO: 6897639 - DNA, 22 bp, Homo sapiens
gtatttctggtaactgctgcta

SEQ ID NO: 6897640 - DNA, 22 bp, Homo sapiens
cacatgagtgtaggaagaggga

SEQ ID NO: 6897641 - DNA, 22 bp, Homo sapiens
gctctcagaagagccaggctac

SEQ ID NO: 6897642 - DNA, 22 bp, Homo sapiens
agcagaatggggctgggaatag

SEQ ID NO: 6897643 - DNA, 22 bp, Homo sapiens
tgggctgtggagcacctttgca

SEQ ID NO: 6897644 - DNA, 22 bp, Homo sapiens
tcagaagcaaacatcactctag

SEQ ID NO: 6897645 - DNA, 22 bp, Homo sapiens
agagagcatggcacagaggggt

SEQ ID NO: 6897646 - DNA, 22 bp, Homo sapiens
aggtataagaagattatttata

SEQ ID NO: 6897647 - DNA, 22 bp, Homo sapiens
gctcatattcaactatcttcac

SEQ ID NO: 6897648 - DNA, 22 bp, Homo sapiens
atttgcaagagtaagaatttct

SEQ ID NO: 6897649 - DNA, 22 bp, Homo sapiens
aactactaccagtagtagtagt

SEQ ID NO: 6897650 - DNA, 22 bp, Homo sapiens
tgggctgagagtaccttataaa

SEQ ID NO: 6897651 - DNA, 18 bp, Homo sapiens
gctgtgtgcacctgataa

SEQ ID NO: 6897652 - DNA, 22 bp, Homo sapiens
tatcaggagttgacagttgcta

SEQ ID NO: 6897653 - DNA, 20 bp, Homo sapiens
tggcttgtttctatgggcag

SEQ ID NO: 6897654 - DNA, 22 bp, Homo sapiens
acacatctatattgcatctgca

SEQ ID NO: 6897655 - DNA, 22 bp, Homo sapiens
cctcctggaggctctagggaaa

SEQ ID NO: 6897656 - DNA, 22 bp, Homo sapiens
ttacagagctcatttctaaggg

SEQ ID NO: 6897657 - DNA, 22 bp, Homo sapiens
acagtttacagggatttgagct

SEQ ID NO: 6897658 - DNA, 22 bp, Homo sapiens
tcaggctgaaggaggcctatct

SEQ ID NO: 6897659 - DNA, 22 bp, Homo sapiens
tagcatgggtcgcgtctctgga

SEQ ID NO: 6897660 - DNA, 22 bp, Homo sapiens
gctgctgtgccccatctgcaga

SEQ ID NO: 6897661 - DNA, 22 bp, Homo sapiens
tgcaccctctgctatgtgctcc

SEQ ID NO: 6897662 - DNA, 22 bp, Homo sapiens
acaggtgtacaatgcatgacag

SEQ ID NO: 6897663 - DNA, 22 bp, Homo sapiens
tttggcagctctacctttttat

SEQ ID NO: 6897664 - DNA, 22 bp, Homo sapiens
tagaaatggagaacagattaat

SEQ ID NO: 6897665 - DNA, 22 bp, Homo sapiens
ggtatacaagagcaatttaggg

SEQ ID NO: 6897666 - DNA, 22 bp, Homo sapiens
gggtctgagctgaggggaaatc

SEQ ID NO: 6897667 - DNA, 22 bp, Homo sapiens
caatagctcccctgaaggtgca

SEQ ID NO: 6897668 - DNA, 21 bp, Homo sapiens
tccaaatcccattctgtagtc

SEQ ID NO: 6897669 - DNA, 22 bp, Homo sapiens
ttgggacaaagactccttgaat

SEQ ID NO: 6897670 - DNA, 22 bp, Homo sapiens
gaaagttttcatatataccaaa

SEQ ID NO: 6897671 - DNA, 22 bp, Homo sapiens
ctaaacagtgcatatgggtgtt

SEQ ID NO: 6897672 - DNA, 20 bp, Homo sapiens
gaagtgtcttgtttctggat

SEQ ID NO: 6897673 - DNA, 22 bp, Homo sapiens
tcctcagagcatagcgctgtct

SEQ ID NO: 6897674 - DNA, 22 bp, Homo sapiens
acacattttcaacactgtcaag

SEQ ID NO: 6897675 - DNA, 22 bp, Homo sapiens
gttatgattgaaattccagttt

SEQ ID NO: 6897676 - DNA, 22 bp, Homo sapiens
tgggccagagagtaagaaaggt

SEQ ID NO: 6897677 - DNA, 18 bp, Homo sapiens
ttgcccctgggtgaggat

SEQ ID NO: 6897678 - DNA, 22 bp, Homo sapiens
ttatgctaacctcatcttctcc

SEQ ID NO: 6897679 - DNA, 22 bp, Homo sapiens
tctgagcagatgctcgctctcc

SEQ ID NO: 6897680 - DNA, 21 bp, Homo sapiens
atgtagcttacaagataaagg

SEQ ID NO: 6897681 - DNA, 22 bp, Homo sapiens
gcttcaaggccaagacacctta

SEQ ID NO: 6897682 - DNA, 22 bp, Homo sapiens
tttataacttagtttggttgaa

SEQ ID NO: 6897683 - DNA, 21 bp, Homo sapiens
tgggggtcttcacggtgttgt

SEQ ID NO: 6897684 - DNA, 18 bp, Homo sapiens
aggtgccctccttacact

SEQ ID NO: 6897685 - DNA, 22 bp, Homo sapiens
gctctgcccagtgccctgagac

SEQ ID NO: 6897686 - DNA, 22 bp, Homo sapiens
acatgtgtgacaacagaggtga

SEQ ID NO: 6897687 - DNA, 22 bp, Homo sapiens
tcagtaacttacttattcacct

SEQ ID NO: 6897688 - DNA, 22 bp, Homo sapiens
agttttcctggtcacagcttgg

SEQ ID NO: 6897689 - DNA, 22 bp, Homo sapiens
cttgtgtatatatagtaactta

SEQ ID NO: 6897690 - DNA, 22 bp, Homo sapiens
actttgggcacagtgaggccag

SEQ ID NO: 6897691 - DNA, 22 bp, Homo sapiens
attagcattgctactctcaaga

SEQ ID NO: 6897692 - DNA, 22 bp, Homo sapiens
ctgcacttgacatgctctcaga

SEQ ID NO: 6897693 - DNA, 17 bp, Homo sapiens
tgagaagtaggcatcat

SEQ ID NO: 6897694 - DNA, 22 bp, Homo sapiens
ggcacagatagatcaagtgtct

SEQ ID NO: 6897695 - DNA, 22 bp, Homo sapiens
aagccaatgctagcccacatgc

SEQ ID NO: 6897696 - DNA, 22 bp, Homo sapiens
tatgctagatggaaaaatattg

SEQ ID NO: 6897697 - DNA, 22 bp, Homo sapiens
catccatagattgagagatggt

SEQ ID NO: 6897698 - DNA, 22 bp, Homo sapiens
aagcatgggaggcctggaggag

SEQ ID NO: 6897699 - DNA, 22 bp, Homo sapiens
tttggtcatgtcgtcatttggg

SEQ ID NO: 6897700 - DNA, 22 bp, Homo sapiens
tctaatgatcaagtgatgacag

SEQ ID NO: 6897701 - DNA, 21 bp, Homo sapiens
tcaaatcctgctgttaccact

SEQ ID NO: 6897702 - DNA, 22 bp, Homo sapiens
cggtggtctcctgcgacatgaa

SEQ ID NO: 6897703 - DNA, 22 bp, Homo sapiens
aagttcctcaaataaaacatga

SEQ ID NO: 6897704 - DNA, 23 bp, Homo sapiens
ccatggagcatggctcactaggc

SEQ ID NO: 6897705 - DNA, 22 bp, Homo sapiens
atgaggcaaggatcaggtaagg

SEQ ID NO: 6897706 - DNA, 21 bp, Homo sapiens
gagccttccctctgccctttc

SEQ ID NO: 6897707 - DNA, 22 bp, Homo sapiens
cattacagtgtcagaggaactg

SEQ ID NO: 6897708 - DNA, 22 bp, Homo sapiens
tgtcatctgaatttctcatcac

SEQ ID NO: 6897709 - DNA, 22 bp, Homo sapiens
tcaggaaagtgttctcagagga

SEQ ID NO: 6897710 - DNA, 22 bp, Homo sapiens
ctgtggctaggattattcctga

SEQ ID NO: 6897711 - DNA, 22 bp, Homo sapiens
atgctatagaaatatttaaatt

SEQ ID NO: 6897712 - DNA, 22 bp, Homo sapiens
cggggctgacagcaggtgtgct

SEQ ID NO: 6897713 - DNA, 22 bp, Homo sapiens
ttcaactattatgaataaaatt

SEQ ID NO: 6897714 - DNA, 22 bp, Homo sapiens
aatagtgtatttttcaaaatta

SEQ ID NO: 6897715 - DNA, 22 bp, Homo sapiens
ggcacagggagaggcggatttt

SEQ ID NO: 6897716 - DNA, 22 bp, Homo sapiens
gtcacagcctcaatcccatctg

SEQ ID NO: 6897717 - DNA, 22 bp, Homo sapiens
tgaggctcacgaacagaagact

SEQ ID NO: 6897718 - DNA, 22 bp, Homo sapiens
agggggctcagcatggatggag

SEQ ID NO: 6897719 - DNA, 22 bp, Homo sapiens
ataggcatttggagtgttgtga

SEQ ID NO: 6897720 - DNA, 22 bp, Homo sapiens
tgaagctgtccttgataggggc

SEQ ID NO: 6897721 - DNA, 22 bp, Homo sapiens
atagcaatgatcaagacagaca

SEQ ID NO: 6897722 - DNA, 22 bp, Homo sapiens
tatctttgtatcaatctccatt

SEQ ID NO: 6897723 - DNA, 22 bp, Homo sapiens
cctttctgacagtgatgggggg

SEQ ID NO: 6897724 - DNA, 22 bp, Homo sapiens
agtggagtgagtggcagaagga

SEQ ID NO: 6897725 - DNA, 22 bp, Homo sapiens
ttttaatccatctggtaaacct

SEQ ID NO: 6897726 - DNA, 17 bp, Homo sapiens
tgttccatttgaccacc

SEQ ID NO: 6897727 - DNA, 22 bp, Homo sapiens
atggcagggcagcctctcagag

SEQ ID NO: 6897728 - DNA, 19 bp, Homo sapiens
acagggcagcaataggata

SEQ ID NO: 6897729 - DNA, 21 bp, Homo sapiens
gagtgggacatgggagtggtt

SEQ ID NO: 6897730 - DNA, 22 bp, Homo sapiens
gtcattgtgtggacatggagaa

SEQ ID NO: 6897731 - DNA, 22 bp, Homo sapiens
ttttggctacaaagagcctagt

SEQ ID NO: 6897732 - DNA, 22 bp, Homo sapiens
agacatttggaagatacacata

SEQ ID NO: 6897733 - DNA, 22 bp, Homo sapiens
gacacagaatgggtgctcagta

SEQ ID NO: 6897734 - DNA, 22 bp, Homo sapiens
acttagaacaggcagaattcca

SEQ ID NO: 6897735 - DNA, 22 bp, Homo sapiens
tgtcctggagtgcttgggggaa

SEQ ID NO: 6897736 - DNA, 22 bp, Homo sapiens
actctgtagatgtggaaatgcg

SEQ ID NO: 6897737 - DNA, 21 bp, Homo sapiens
aatatatgcaatgctttctgc

SEQ ID NO: 6897738 - DNA, 22 bp, Homo sapiens
tcaacagccagaaatattagcc

SEQ ID NO: 6897739 - DNA, 20 bp, Homo sapiens
tagtgccagtgtgcatgcta

SEQ ID NO: 6897740 - DNA, 22 bp, Homo sapiens
ttaacaaagctctgttcctttt

SEQ ID NO: 6897741 - DNA, 22 bp, Homo sapiens
aaatatactagatgatgaccca

SEQ ID NO: 6897742 - DNA, 23 bp, Homo sapiens
tctgtgccagtttccatgtctgt

SEQ ID NO: 6897743 - DNA, 22 bp, Homo sapiens
tcttcccactgcccatgggcag

SEQ ID NO: 6897744 - DNA, 22 bp, Homo sapiens
aaggcagtaggtgtttcaaact

SEQ ID NO: 6897745 - DNA, 22 bp, Homo sapiens
aggcatgactttggctgaagaa

SEQ ID NO: 6897746 - DNA, 19 bp, Homo sapiens
tatgtgcatgtgtgcatat

SEQ ID NO: 6897747 - DNA, 22 bp, Homo sapiens
agtgcagatttttagtcagctt

SEQ ID NO: 6897748 - DNA, 22 bp, Homo sapiens
atatgtgtgtatttcttactag

SEQ ID NO: 6897749 - DNA, 22 bp, Homo sapiens
tggcaccatgttggcaaatgtt

SEQ ID NO: 6897750 - DNA, 22 bp, Homo sapiens
aaattattcaaaaagctgtgtt

SEQ ID NO: 6897751 - DNA, 22 bp, Homo sapiens
aggcttaatgagttaaatcact

SEQ ID NO: 6897752 - DNA, 22 bp, Homo sapiens
ttattccattgtcttttgactt

SEQ ID NO: 6897753 - DNA, 22 bp, Homo sapiens
aaagtcacttccttctgtcagc

SEQ ID NO: 6897754 - DNA, 22 bp, Homo sapiens
gccccaagggagcccagcacac

SEQ ID NO: 6897755 - DNA, 22 bp, Homo sapiens
atgtgtccttgttcccattcca

SEQ ID NO: 6897756 - DNA, 18 bp, Homo sapiens
acattgatggctttaagc

SEQ ID NO: 6897757 - DNA, 22 bp, Homo sapiens
cctctctgtgtggcctctccat

SEQ ID NO: 6897758 - DNA, 22 bp, Homo sapiens
tggcaaaacccacaattatatc

SEQ ID NO: 6897759 - DNA, 22 bp, Homo sapiens
agtgcaatgaataacagccacc

SEQ ID NO: 6897760 - DNA, 22 bp, Homo sapiens
atgctaaagctttgctttcatt

SEQ ID NO: 6897761 - DNA, 23 bp, Homo sapiens
atgctctatttgggatatgacag

SEQ ID NO: 6897762 - DNA, 22 bp, Homo sapiens
gtagggcatgtaagtcaccata

SEQ ID NO: 6897763 - DNA, 22 bp, Homo sapiens
ttaagaagccacacacctcttt

SEQ ID NO: 6897764 - DNA, 22 bp, Homo sapiens
gctgtaggaagacagaatgcag

SEQ ID NO: 6897765 - DNA, 22 bp, Homo sapiens
gagcttccagagacatcagagt

SEQ ID NO: 6897766 - DNA, 22 bp, Homo sapiens
gcaaacattcaggagtacagga

SEQ ID NO: 6897767 - DNA, 22 bp, Homo sapiens
agtggcttggctgcactacagg

SEQ ID NO: 6897768 - DNA, 22 bp, Homo sapiens
gccaggcagcagcgaggatggt

SEQ ID NO: 6897769 - DNA, 22 bp, Homo sapiens
tcaaattgtcatcttgataatg

SEQ ID NO: 6897770 - DNA, 22 bp, Homo sapiens
ttcaagtcctttggaaggcctg

SEQ ID NO: 6897771 - DNA, 22 bp, Homo sapiens
ctggctccatcactgggtgatg

SEQ ID NO: 6897772 - DNA, 22 bp, Homo sapiens
gagggctctaccaagtaactct

SEQ ID NO: 6897773 - DNA, 22 bp, Homo sapiens
agagccacggcaggcctaggaa

SEQ ID NO: 6897774 - DNA, 22 bp, Homo sapiens
tgttcttatgatgaagcactga

SEQ ID NO: 6897775 - DNA, 22 bp, Homo sapiens
cctcttctgcttcaggagcact

SEQ ID NO: 6897776 - DNA, 22 bp, Homo sapiens
taatgacttgaaggacccatgg

SEQ ID NO: 6897777 - DNA, 22 bp, Homo sapiens
agccctcttcccagatgcctca

SEQ ID NO: 6897778 - DNA, 17 bp, Homo sapiens
gatttcctgaagttctt

SEQ ID NO: 6897779 - DNA, 22 bp, Homo sapiens
agctagccatgtggctcctgtg

SEQ ID NO: 6897780 - DNA, 22 bp, Homo sapiens
tcagttctttatttcacagtga

SEQ ID NO: 6897781 - DNA, 23 bp, Homo sapiens
tcagaattccagtttctttgaag

SEQ ID NO: 6897782 - DNA, 22 bp, Homo sapiens
gatcgattcagtgtgcctaccc

SEQ ID NO: 6897783 - DNA, 22 bp, Homo sapiens
agaaatctttcctgaagtgttt

SEQ ID NO: 6897784 - DNA, 22 bp, Homo sapiens
tctgaccctactcagcactttg

SEQ ID NO: 6897785 - DNA, 22 bp, Homo sapiens
aggatgagattccagggtcaat

SEQ ID NO: 6897786 - DNA, 22 bp, Homo sapiens
aggcagatggatgggcatttgt

SEQ ID NO: 6897787 - DNA, 19 bp, Homo sapiens
ttcttgaacatgtttctca

SEQ ID NO: 6897788 - DNA, 22 bp, Homo sapiens
ctgttccagatcaggacaccgt

SEQ ID NO: 6897789 - DNA, 22 bp, Homo sapiens
gctgctgtaatgtgttaagtca

SEQ ID NO: 6897790 - DNA, 22 bp, Homo sapiens
atccttgaatgactctgccctc

SEQ ID NO: 6897791 - DNA, 22 bp, Homo sapiens
gcctgctggctgtccattgcag

SEQ ID NO: 6897792 - DNA, 18 bp, Homo sapiens
atgatcttagcaaatatt

SEQ ID NO: 6897793 - DNA, 22 bp, Homo sapiens
cttcccttctgtgcagggcaga

SEQ ID NO: 6897794 - DNA, 22 bp, Homo sapiens
actgttcaagcaaatgacattg

SEQ ID NO: 6897795 - DNA, 22 bp, Homo sapiens
cctgccagaggcaaagttttag

SEQ ID NO: 6897796 - DNA, 22 bp, Homo sapiens
tctaatcctatggtggggaggg

SEQ ID NO: 6897797 - DNA, 22 bp, Homo sapiens
gagaggtcggggacactgcaaa

SEQ ID NO: 6897798 - DNA, 22 bp, Homo sapiens
tccagccatgactcggacagtg

SEQ ID NO: 6897799 - DNA, 22 bp, Homo sapiens
atatgaaagtaagcatgtgtgt

SEQ ID NO: 6897800 - DNA, 22 bp, Homo sapiens
agagatggccttaggtgggaat

SEQ ID NO: 6897801 - DNA, 22 bp, Homo sapiens
gctcaagaccagacaaagcctg

SEQ ID NO: 6897802 - DNA, 22 bp, Homo sapiens
caggtgggcttgggagaacact

SEQ ID NO: 6897803 - DNA, 22 bp, Homo sapiens
agaaagaggatgcagatctcat

SEQ ID NO: 6897804 - DNA, 21 bp, Homo sapiens
gagcttgcaagcattatggga

SEQ ID NO: 6897805 - DNA, 23 bp, Homo sapiens
agcccctcatatctgctttctct

SEQ ID NO: 6897806 - DNA, 22 bp, Homo sapiens
gaacatctgttaaataaaggta

SEQ ID NO: 6897807 - DNA, 22 bp, Homo sapiens
cctggatgatccatgtcatgga

SEQ ID NO: 6897808 - DNA, 22 bp, Homo sapiens
gaggctggagatattccaatct

SEQ ID NO: 6897809 - DNA, 22 bp, Homo sapiens
cactgtggcttaccaaagctaa

SEQ ID NO: 6897810 - DNA, 22 bp, Homo sapiens
atgggctgactaatggtaaact

SEQ ID NO: 6897811 - DNA, 23 bp, Homo sapiens
agcagcaggaggtattgataagg

SEQ ID NO: 6897812 - DNA, 16 bp, Homo sapiens
gtctggcctacctgcc

SEQ ID NO: 6897813 - DNA, 22 bp, Homo sapiens
actgcatttggtaaagtcaaga

SEQ ID NO: 6897814 - DNA, 22 bp, Homo sapiens
ttcaggcccagcacagcgcgtg

SEQ ID NO: 6897815 - DNA, 22 bp, Homo sapiens
ccaaagtgctgggattcaggca

SEQ ID NO: 6897816 - DNA, 22 bp, Homo sapiens
tggcagttttcaagagttctgt

SEQ ID NO: 6897817 - DNA, 22 bp, Homo sapiens
agcagtagtgatggcccctgag

SEQ ID NO: 6897818 - DNA, 22 bp, Homo sapiens
ctgcagggtgacgttgcccacc

SEQ ID NO: 6897819 - DNA, 22 bp, Homo sapiens
actagtattagactaaaagtca

SEQ ID NO: 6897820 - DNA, 22 bp, Homo sapiens
tgtgaggaacaggactagagca

SEQ ID NO: 6897821 - DNA, 22 bp, Homo sapiens
ttggaaggcagcatttgtccat

SEQ ID NO: 6897822 - DNA, 22 bp, Homo sapiens
tttaatattctgcattctcctt

SEQ ID NO: 6897823 - DNA, 22 bp, Homo sapiens
gatgggtactcgttggactgag

SEQ ID NO: 6897824 - DNA, 22 bp, Homo sapiens
tgctcagaacatgattcaggcg

SEQ ID NO: 6897825 - DNA, 22 bp, Homo sapiens
gcttttacaagagccagagagg

SEQ ID NO: 6897826 - DNA, 21 bp, Homo sapiens
aactgagaccagctaaagtgg

SEQ ID NO: 6897827 - DNA, 22 bp, Homo sapiens
tcagagatggagttagcagtga

SEQ ID NO: 6897828 - DNA, 22 bp, Homo sapiens
gtccaaaagagccagccgggcg

SEQ ID NO: 6897829 - DNA, 22 bp, Homo sapiens
gtctgcattgaccctactagtc

SEQ ID NO: 6897830 - DNA, 18 bp, Homo sapiens
gtgtgctcagagagtgag

SEQ ID NO: 6897831 - DNA, 22 bp, Homo sapiens
tgggagatattgctgtggctgt

SEQ ID NO: 6897832 - DNA, 22 bp, Homo sapiens
tggctctgcagcagtgtgcgtg

SEQ ID NO: 6897833 - DNA, 22 bp, Homo sapiens
cagggatgctgttaaacatcct

SEQ ID NO: 6897834 - DNA, 22 bp, Homo sapiens
tggaggtggtgcccagcaattt

SEQ ID NO: 6897835 - DNA, 22 bp, Homo sapiens
tgctaatgtcctgaccgttctg

SEQ ID NO: 6897836 - DNA, 19 bp, Homo sapiens
ctggcttcaagcagtcctc

SEQ ID NO: 6897837 - DNA, 22 bp, Homo sapiens
ataattaggtcttataacgtct

SEQ ID NO: 6897838 - DNA, 22 bp, Homo sapiens
atagaatacatttcatggagat

SEQ ID NO: 6897839 - DNA, 22 bp, Homo sapiens
ttacaaagtttaaggtggcact

SEQ ID NO: 6897840 - DNA, 21 bp, Homo sapiens
gcaagtactatcatcattatc

SEQ ID NO: 6897841 - DNA, 22 bp, Homo sapiens
aatggctgaatgagtgaactag

SEQ ID NO: 6897842 - DNA, 22 bp, Homo sapiens
tctgtgtctgttacttcactgc

SEQ ID NO: 6897843 - DNA, 22 bp, Homo sapiens
agttggagaagaggtcgggaat

SEQ ID NO: 6897844 - DNA, 22 bp, Homo sapiens
tgcaaactattggtagagatgg

SEQ ID NO: 6897845 - DNA, 22 bp, Homo sapiens
ccagggcatcacatccagtgtt

SEQ ID NO: 6897846 - DNA, 22 bp, Homo sapiens
caggcacctgtgtgtctcaggg

SEQ ID NO: 6897847 - DNA, 22 bp, Homo sapiens
cctgggaaggggaagagaattc

SEQ ID NO: 6897848 - DNA, 22 bp, Homo sapiens
gactttaaaatgctagaacagg

SEQ ID NO: 6897849 - DNA, 22 bp, Homo sapiens
tagctgtttcagtgcagcagaa

SEQ ID NO: 6897850 - DNA, 22 bp, Homo sapiens
ttgaatctataatttcagtatt

SEQ ID NO: 6897851 - DNA, 22 bp, Homo sapiens
gtggcagaactatgtgattgct

SEQ ID NO: 6897852 - DNA, 22 bp, Homo sapiens
gtaaaacaagctttatggttcc

SEQ ID NO: 6897853 - DNA, 22 bp, Homo sapiens
ggcagagctgcatgagcactca

SEQ ID NO: 6897854 - DNA, 22 bp, Homo sapiens
gtggagtgcaacggttggagtt

SEQ ID NO: 6897855 - DNA, 22 bp, Homo sapiens
cttcctaaaagcttcaagagaa

SEQ ID NO: 6897856 - DNA, 22 bp, Homo sapiens
ttgaggcaggtccgggtccttc

SEQ ID NO: 6897857 - DNA, 22 bp, Homo sapiens
tatgcacattctttgtgggagc

SEQ ID NO: 6897858 - DNA, 22 bp, Homo sapiens
tgatttacaattgtaaaagttt

SEQ ID NO: 6897859 - DNA, 18 bp, Homo sapiens
tacaggaaggggttctcg

SEQ ID NO: 6897860 - DNA, 22 bp, Homo sapiens
gctgattctgaggtgctttcct

SEQ ID NO: 6897861 - DNA, 22 bp, Homo sapiens
aagcacagggtgtctgcattca

SEQ ID NO: 6897862 - DNA, 22 bp, Homo sapiens
agagccctgacggggacagatg

SEQ ID NO: 6897863 - DNA, 22 bp, Homo sapiens
taagttcctggaaggcaaggat

SEQ ID NO: 6897864 - DNA, 22 bp, Homo sapiens
aacatggaggcagacagacgtg

SEQ ID NO: 6897865 - DNA, 21 bp, Homo sapiens
tctattcattacagttatttg

SEQ ID NO: 6897866 - DNA, 22 bp, Homo sapiens
agatattctagaacctagtaga

SEQ ID NO: 6897867 - DNA, 22 bp, Homo sapiens
atgtattttgccagactgtctc

SEQ ID NO: 6897868 - DNA, 22 bp, Homo sapiens
aaacagttttctcatttagtgt

SEQ ID NO: 6897869 - DNA, 22 bp, Homo sapiens
cgtgccactgcactccagtctg

SEQ ID NO: 6897870 - DNA, 22 bp, Homo sapiens
gctccaaagtacagtgacttac

SEQ ID NO: 6897871 - DNA, 20 bp, Homo sapiens
gtctgcagtaagagggaata

SEQ ID NO: 6897872 - DNA, 22 bp, Homo sapiens
aatctagagaactgtggggcag

SEQ ID NO: 6897873 - DNA, 22 bp, Homo sapiens
tcctctccatgtctcacgccac

SEQ ID NO: 6897874 - DNA, 22 bp, Homo sapiens
agcataaaggtcaacgttttag

SEQ ID NO: 6897875 - DNA, 22 bp, Homo sapiens
aagtcagataggtgagtccaaa

SEQ ID NO: 6897876 - DNA, 22 bp, Homo sapiens
gaagtacattctgatagggaag

SEQ ID NO: 6897877 - DNA, 21 bp, Homo sapiens
agcacagcatatccaatgtca

SEQ ID NO: 6897878 - DNA, 22 bp, Homo sapiens
tggagcccagacactggcattg

SEQ ID NO: 6897879 - DNA, 22 bp, Homo sapiens
ttcaagttcatgtgtagtcagt

SEQ ID NO: 6897880 - DNA, 22 bp, Homo sapiens
cccaagagcttctaggacgctg

SEQ ID NO: 6897881 - DNA, 22 bp, Homo sapiens
ctatggctctggttatggctgt

SEQ ID NO: 6897882 - DNA, 22 bp, Homo sapiens
catccattcagtgcaaatcaca

SEQ ID NO: 6897883 - DNA, 22 bp, Homo sapiens
gtcctgttggggtgttgcagtc

SEQ ID NO: 6897884 - DNA, 22 bp, Homo sapiens
tgtccctggagcttctgtcccc

SEQ ID NO: 6897885 - DNA, 22 bp, Homo sapiens
gaatgtgggctgtgaagaggag

SEQ ID NO: 6897886 - DNA, 22 bp, Homo sapiens
tctcctttctggagcctgctca

SEQ ID NO: 6897887 - DNA, 22 bp, Homo sapiens
cgtctgcctaaggactgccttc

SEQ ID NO: 6897888 - DNA, 22 bp, Homo sapiens
gacctcaggcttctgtaattaa

SEQ ID NO: 6897889 - DNA, 22 bp, Homo sapiens
caggaaacaaagccttgctcat

SEQ ID NO: 6897890 - DNA, 22 bp, Homo sapiens
aatagcacttcctgaacacatt

SEQ ID NO: 6897891 - DNA, 22 bp, Homo sapiens
tcagagttgagctgttttgtgg

SEQ ID NO: 6897892 - DNA, 22 bp, Homo sapiens
tctcctggccctgtcgccatct

SEQ ID NO: 6897893 - DNA, 22 bp, Homo sapiens
ttggattacatgaaatgcagaa

SEQ ID NO: 6897894 - DNA, 19 bp, Homo sapiens
tacaagtaggcgttttctc

SEQ ID NO: 6897895 - DNA, 22 bp, Homo sapiens
aataattatttgagagcagacc

SEQ ID NO: 6897896 - DNA, 22 bp, Homo sapiens
tagcaggaccctgagcatccca

SEQ ID NO: 6897897 - DNA, 22 bp, Homo sapiens
gctgagagtgggtgcagtgctt

SEQ ID NO: 6897898 - DNA, 22 bp, Homo sapiens
tattgcagaattcgctggaaca

SEQ ID NO: 6897899 - DNA, 22 bp, Homo sapiens
ttgcctgctacggtcttcactg

SEQ ID NO: 6897900 - DNA, 22 bp, Homo sapiens
aaatagagctgggttaaacttt

SEQ ID NO: 6897901 - DNA, 22 bp, Homo sapiens
ttaaaacgtaaatgtccccagc

SEQ ID NO: 6897902 - DNA, 22 bp, Homo sapiens
ggcagtgggaaataagtgagaa

SEQ ID NO: 6897903 - DNA, 22 bp, Homo sapiens
ataactgcctgatgactctcaa

SEQ ID NO: 6897904 - DNA, 22 bp, Homo sapiens
tttcccaatgagtccttgagca

SEQ ID NO: 6897905 - DNA, 22 bp, Homo sapiens
ggtccccgtggaggctggagcg

SEQ ID NO: 6897906 - DNA, 22 bp, Homo sapiens
tgtctagacaagaagtattgcc

SEQ ID NO: 6897907 - DNA, 22 bp, Homo sapiens
tggaatgtaaacctcaggtggg

SEQ ID NO: 6897908 - DNA, 22 bp, Homo sapiens
tggcagtaaagctggaaaagtg

SEQ ID NO: 6897909 - DNA, 22 bp, Homo sapiens
cagcccagtgcatttgtgtact

SEQ ID NO: 6897910 - DNA, 22 bp, Homo sapiens
acagtactaagtgctcacatga

SEQ ID NO: 6897911 - DNA, 22 bp, Homo sapiens
gaacattactgcttgggagagg

SEQ ID NO: 6897912 - DNA, 22 bp, Homo sapiens
tccacccagtgtttctacaggt

SEQ ID NO: 6897913 - DNA, 20 bp, Homo sapiens
tttcagtggtttgtgcctag

SEQ ID NO: 6897914 - DNA, 22 bp, Homo sapiens
gagctgaaggagaaagcagggg

SEQ ID NO: 6897915 - DNA, 22 bp, Homo sapiens
gaaacacatatgaacagttgat

SEQ ID NO: 6897916 - DNA, 23 bp, Homo sapiens
agcagcccaatggcaagctctgg

SEQ ID NO: 6897917 - DNA, 22 bp, Homo sapiens
gagcagcaggtggctgtgatgg

SEQ ID NO: 6897918 - DNA, 22 bp, Homo sapiens
ttctctgtgagggtgctggatt

SEQ ID NO: 6897919 - DNA, 21 bp, Homo sapiens
gaatctttgatttacatggga

SEQ ID NO: 6897920 - DNA, 22 bp, Homo sapiens
tcccaagagcaagaacttgctg

SEQ ID NO: 6897921 - DNA, 22 bp, Homo sapiens
aagtacatggaggatagctgct

SEQ ID NO: 6897922 - DNA, 23 bp, Homo sapiens
gcttctgccatttgctagctgtg

SEQ ID NO: 6897923 - DNA, 22 bp, Homo sapiens
agaaattcctaaggtacacaag

SEQ ID NO: 6897924 - DNA, 22 bp, Homo sapiens
tgtgttggaaatagggtctttg

SEQ ID NO: 6897925 - DNA, 20 bp, Homo sapiens
aacttgttctacctgtttca

SEQ ID NO: 6897926 - DNA, 22 bp, Homo sapiens
agatcttttggttattataaga

SEQ ID NO: 6897927 - DNA, 22 bp, Homo sapiens
ttgctttgccaccagaagtcta

SEQ ID NO: 6897928 - DNA, 22 bp, Homo sapiens
attgacattaactatattagcc

SEQ ID NO: 6897929 - DNA, 22 bp, Homo sapiens
actgtattggaaatatagcaaa

SEQ ID NO: 6897930 - DNA, 22 bp, Homo sapiens
aaacactgcgtggtggcaactc

SEQ ID NO: 6897931 - DNA, 22 bp, Homo sapiens
gaggtggcgcgccatccctgcc

SEQ ID NO: 6897932 - DNA, 22 bp, Homo sapiens
actgggctgttttttgagtgga

SEQ ID NO: 6897933 - DNA, 22 bp, Homo sapiens
actttgtttggctattagagtc

SEQ ID NO: 6897934 - DNA, 22 bp, Homo sapiens
ctggctctgtggcttccttcat

SEQ ID NO: 6897935 - DNA, 22 bp, Homo sapiens
aagtatcttggaaaactcttct

SEQ ID NO: 6897936 - DNA, 22 bp, Homo sapiens
gtctgcttttctgccctttcat

SEQ ID NO: 6897937 - DNA, 22 bp, Homo sapiens
ggcttttgctgtgttttccaga

SEQ ID NO: 6897938 - DNA, 23 bp, Homo sapiens
ggcctggcccagggccctgatga

SEQ ID NO: 6897939 - DNA, 22 bp, Homo sapiens
agtcctagccctggatccatca

SEQ ID NO: 6897940 - DNA, 22 bp, Homo sapiens
tagctttgttagaatgtcttca

SEQ ID NO: 6897941 - DNA, 22 bp, Homo sapiens
ggtgtgcttgggcttcgcaggg

SEQ ID NO: 6897942 - DNA, 22 bp, Homo sapiens
gggctgagggccaattcctact

SEQ ID NO: 6897943 - DNA, 22 bp, Homo sapiens
ttcctttccctcacagcctcgg

SEQ ID NO: 6897944 - DNA, 22 bp, Homo sapiens
tggatttaacagaataccaggt

SEQ ID NO: 6897945 - DNA, 22 bp, Homo sapiens
cccaggaggttgaggctgcagt

SEQ ID NO: 6897946 - DNA, 22 bp, Homo sapiens
ttcagggccctgagagggcagt

SEQ ID NO: 6897947 - DNA, 22 bp, Homo sapiens
ccctgcacactcgtgtcttgac

SEQ ID NO: 6897948 - DNA, 21 bp, Homo sapiens
tgagatgctagaaggcaggga

SEQ ID NO: 6897949 - DNA, 22 bp, Homo sapiens
gaatacaggcaggtggctgtgc

SEQ ID NO: 6897950 - DNA, 22 bp, Homo sapiens
tttgcatattaatatctgcgct

SEQ ID NO: 6897951 - DNA, 22 bp, Homo sapiens
gtcccgcattgggcattcctgg

SEQ ID NO: 6897952 - DNA, 22 bp, Homo sapiens
tgtgctggggtccagctgagcc

SEQ ID NO: 6897953 - DNA, 22 bp, Homo sapiens
acttgctcaatgcttgaagcca

SEQ ID NO: 6897954 - DNA, 22 bp, Homo sapiens
tgctttataaccatttctgtgg

SEQ ID NO: 6897955 - DNA, 22 bp, Homo sapiens
caagttacaaaagaaccacggt

SEQ ID NO: 6897956 - DNA, 22 bp, Homo sapiens
tcaacaattttgagatgagaca

SEQ ID NO: 6897957 - DNA, 22 bp, Homo sapiens
caataaggtgaggctcaaggga

SEQ ID NO: 6897958 - DNA, 22 bp, Homo sapiens
ccaggtgtgtctggccccgaag

SEQ ID NO: 6897959 - DNA, 22 bp, Homo sapiens
gggctagcagattctacctaat

SEQ ID NO: 6897960 - DNA, 22 bp, Homo sapiens
atgttacagcagcccgaatgga

SEQ ID NO: 6897961 - DNA, 22 bp, Homo sapiens
tgctgcctaacagaactctttc

SEQ ID NO: 6897962 - DNA, 22 bp, Homo sapiens
aacctcaaactcttgggcttaa

SEQ ID NO: 6897963 - DNA, 22 bp, Homo sapiens
gagtgcaagttcttccttcttc

SEQ ID NO: 6897964 - DNA, 22 bp, Homo sapiens
gctgagtacatatgatgcatca

SEQ ID NO: 6897965 - DNA, 20 bp, Homo sapiens
tacatattatatcagctgca

SEQ ID NO: 6897966 - DNA, 23 bp, Homo sapiens
aatgacagtgtgtgattgaagaa

SEQ ID NO: 6897967 - DNA, 22 bp, Homo sapiens
aaggggaagtagcaccagaggt

SEQ ID NO: 6897968 - DNA, 22 bp, Homo sapiens
tcagaaaggagttagaggtctc

SEQ ID NO: 6897969 - DNA, 22 bp, Homo sapiens
atgacaatggacatagttaaaa

SEQ ID NO: 6897970 - DNA, 22 bp, Homo sapiens
ttcaactttaggcaaagaaaac

SEQ ID NO: 6897971 - DNA, 22 bp, Homo sapiens
tccatactaacagcatttatca

SEQ ID NO: 6897972 - DNA, 23 bp, Homo sapiens
tcattgatcttgtcagagcattt

SEQ ID NO: 6897973 - DNA, 22 bp, Homo sapiens
aatgctgtgatttattaagtat

SEQ ID NO: 6897974 - DNA, 22 bp, Homo sapiens
ctgtggctccatagaagttgca

SEQ ID NO: 6897975 - DNA, 22 bp, Homo sapiens
ggtcccaggaatctgtgttcta

SEQ ID NO: 6897976 - DNA, 22 bp, Homo sapiens
agaagttaccacatacttctct

SEQ ID NO: 6897977 - DNA, 22 bp, Homo sapiens
actggagtagatctgactgagt

SEQ ID NO: 6897978 - DNA, 22 bp, Homo sapiens
tggggctgtgagactacaggat

SEQ ID NO: 6897979 - DNA, 22 bp, Homo sapiens
ggtcaggtaggaagttaactat

SEQ ID NO: 6897980 - DNA, 22 bp, Homo sapiens
aggttagtgctgaaatgacatg

SEQ ID NO: 6897981 - DNA, 22 bp, Homo sapiens
cacaccctcgtgctccctcccg

SEQ ID NO: 6897982 - DNA, 22 bp, Homo sapiens
ctggtagtgtctgccgaggtcc

SEQ ID NO: 6897983 - DNA, 22 bp, Homo sapiens
ggactggtggctccttgggcag

SEQ ID NO: 6897984 - DNA, 22 bp, Homo sapiens
gcacacgtagaagaacttgact

SEQ ID NO: 6897985 - DNA, 22 bp, Homo sapiens
ggtgtcagtgagagcacagtac

SEQ ID NO: 6897986 - DNA, 22 bp, Homo sapiens
atgcagctatttgagcatgtca

SEQ ID NO: 6897987 - DNA, 22 bp, Homo sapiens
aacccagggtgaggggagtcta

SEQ ID NO: 6897988 - DNA, 22 bp, Homo sapiens
gtaatacttgaagaattcagag

SEQ ID NO: 6897989 - DNA, 22 bp, Homo sapiens
agcatctagcaattgtcctctt

SEQ ID NO: 6897990 - DNA, 22 bp, Homo sapiens
cagtatgtgatgcaacggaata

SEQ ID NO: 6897991 - DNA, 22 bp, Homo sapiens
tcctggtcagctttgaggttgt

SEQ ID NO: 6897992 - DNA, 22 bp, Homo sapiens
cagactgagggcatcacatacg

SEQ ID NO: 6897993 - DNA, 22 bp, Homo sapiens
gagcaacagtggcagtggtggg

SEQ ID NO: 6897994 - DNA, 22 bp, Homo sapiens
gcctggcagtggggccctggga

SEQ ID NO: 6897995 - DNA, 22 bp, Homo sapiens
agtccttttgttttgagatgag

SEQ ID NO: 6897996 - DNA, 22 bp, Homo sapiens
tagaatactagtgaagtcatcg

SEQ ID NO: 6897997 - DNA, 22 bp, Homo sapiens
atagatatttgagttgtttcca

SEQ ID NO: 6897998 - DNA, 22 bp, Homo sapiens
acactacaacagcagaggtgag

SEQ ID NO: 6897999 - DNA, 22 bp, Homo sapiens
ggaagcttcatacctttattta

SEQ ID NO: 6898000 - DNA, 22 bp, Homo sapiens
gtgctgcagggcctcctgcacc

SEQ ID NO: 6898001 - DNA, 22 bp, Homo sapiens
tggctgagtgttccaaggagca

SEQ ID NO: 6898002 - DNA, 22 bp, Homo sapiens
cttgtctgataatggggccaac

SEQ ID NO: 6898003 - DNA, 22 bp, Homo sapiens
actgtcaatagtgctgagcttg

SEQ ID NO: 6898004 - DNA, 22 bp, Homo sapiens
gtcaaagaaacgcaccttacat

SEQ ID NO: 6898005 - DNA, 22 bp, Homo sapiens
agaggtctcagttatgtttaaa

SEQ ID NO: 6898006 - DNA, 22 bp, Homo sapiens
tctggcattttggctgggaaac

SEQ ID NO: 6898007 - DNA, 22 bp, Homo sapiens
agtcattaaatgctgtcatggc

SEQ ID NO: 6898008 - DNA, 22 bp, Homo sapiens
tagcctctggaatcctttctct

SEQ ID NO: 6898009 - DNA, 22 bp, Homo sapiens
aaacctaggtttcctcattcag

SEQ ID NO: 6898010 - DNA, 22 bp, Homo sapiens
aaatatgtgatcagtgaataaa

SEQ ID NO: 6898011 - DNA, 22 bp, Homo sapiens
tggcatgttgataatggagaag

SEQ ID NO: 6898012 - DNA, 19 bp, Homo sapiens
gggctggagggatagagcc

SEQ ID NO: 6898013 - DNA, 22 bp, Homo sapiens
actgtcactgacagaatcaaca

SEQ ID NO: 6898014 - DNA, 22 bp, Homo sapiens
tttcttcctatgtatcttgctg

SEQ ID NO: 6898015 - DNA, 22 bp, Homo sapiens
cacacaccaatcaaatgtcaga

SEQ ID NO: 6898016 - DNA, 22 bp, Homo sapiens
gaaatgttggacacttgaaatt

SEQ ID NO: 6898017 - DNA, 22 bp, Homo sapiens
ccatccagaccagtccatgggt

SEQ ID NO: 6898018 - DNA, 22 bp, Homo sapiens
tctgcctgttcccgattccatg

SEQ ID NO: 6898019 - DNA, 22 bp, Homo sapiens
gagagggcaaacttgtagctaa

SEQ ID NO: 6898020 - DNA, 17 bp, Homo sapiens
aaaattctgtaaagagg

SEQ ID NO: 6898021 - DNA, 22 bp, Homo sapiens
tcagcttcaaatttggtgaagt

SEQ ID NO: 6898022 - DNA, 22 bp, Homo sapiens
acactgttccacactaagaagg

SEQ ID NO: 6898023 - DNA, 22 bp, Homo sapiens
agcggaaggcctggctgatccg

SEQ ID NO: 6898024 - DNA, 22 bp, Homo sapiens
agttaaatgtcagtagcttaac

SEQ ID NO: 6898025 - DNA, 22 bp, Homo sapiens
agagaagagcaatgataaattt

SEQ ID NO: 6898026 - DNA, 21 bp, Homo sapiens
cgacagtgtatagattagagc

SEQ ID NO: 6898027 - DNA, 22 bp, Homo sapiens
gccctgtggccccagtgggctc

SEQ ID NO: 6898028 - DNA, 22 bp, Homo sapiens
tcaggaaatggacatctttgct

SEQ ID NO: 6898029 - DNA, 22 bp, Homo sapiens
atttcctggaatgactagtggg

SEQ ID NO: 6898030 - DNA, 22 bp, Homo sapiens
tcctggtgtttatgtcacatag

SEQ ID NO: 6898031 - DNA, 22 bp, Homo sapiens
ggcttaagtcctgaatttatgc

SEQ ID NO: 6898032 - DNA, 22 bp, Homo sapiens
tagggctgggtacactcttgcc

SEQ ID NO: 6898033 - DNA, 22 bp, Homo sapiens
caaagtaaactaccactgtttc

SEQ ID NO: 6898034 - DNA, 20 bp, Homo sapiens
ctgagccaactctcttcttg

SEQ ID NO: 6898035 - DNA, 22 bp, Homo sapiens
ctgcatatcaaattactcctgg

SEQ ID NO: 6898036 - DNA, 22 bp, Homo sapiens
ttcatattcaaatactctgctt

SEQ ID NO: 6898037 - DNA, 19 bp, Homo sapiens
gcttctgtttgggcttaga

SEQ ID NO: 6898038 - DNA, 22 bp, Homo sapiens
tgcagtctgtacattttaagaa

SEQ ID NO: 6898039 - DNA, 22 bp, Homo sapiens
gccctttcttcttctggactgg

SEQ ID NO: 6898040 - DNA, 22 bp, Homo sapiens
caggttcttgaagccttctggc

SEQ ID NO: 6898041 - DNA, 22 bp, Homo sapiens
caggaaacatatgtgcttgagg

SEQ ID NO: 6898042 - DNA, 22 bp, Homo sapiens
tcagttcaaacaggtgtctgga

SEQ ID NO: 6898043 - DNA, 22 bp, Homo sapiens
cagtgagggcccccttccaggt

SEQ ID NO: 6898044 - DNA, 22 bp, Homo sapiens
atgtgaaacgcaatgggatcat

SEQ ID NO: 6898045 - DNA, 20 bp, Homo sapiens
gaatggagcctagtgtgtgg

SEQ ID NO: 6898046 - DNA, 22 bp, Homo sapiens
agtgatttatgtatgtgcacgt

SEQ ID NO: 6898047 - DNA, 22 bp, Homo sapiens
tgtaccaaaaatgtgtcagact

SEQ ID NO: 6898048 - DNA, 22 bp, Homo sapiens
agcagatgtttcagagcaggct

SEQ ID NO: 6898049 - DNA, 22 bp, Homo sapiens
ttaaatgtgatttcatttatgt

SEQ ID NO: 6898050 - DNA, 22 bp, Homo sapiens
agtcacttcatggtttcttgga

SEQ ID NO: 6898051 - DNA, 22 bp, Homo sapiens
ggtgtcagatacataggaagta

SEQ ID NO: 6898052 - DNA, 22 bp, Homo sapiens
tctgtccatttacagatatgca

SEQ ID NO: 6898053 - DNA, 22 bp, Homo sapiens
taatgcctagattattctgttt

SEQ ID NO: 6898054 - DNA, 22 bp, Homo sapiens
cacagcagggatgaatggagtg

SEQ ID NO: 6898055 - DNA, 22 bp, Homo sapiens
acaggctgacttcctgccatgt

SEQ ID NO: 6898056 - DNA, 22 bp, Homo sapiens
ctgttcaatttgtttcagttat

SEQ ID NO: 6898057 - DNA, 22 bp, Homo sapiens
cctctgcagcagagagccagag

SEQ ID NO: 6898058 - DNA, 21 bp, Homo sapiens
tcacctggcttctgacctggc

SEQ ID NO: 6898059 - DNA, 22 bp, Homo sapiens
cagggacatttccaagagaatt

SEQ ID NO: 6898060 - DNA, 22 bp, Homo sapiens
aagagctcttcataaaggcata

SEQ ID NO: 6898061 - DNA, 22 bp, Homo sapiens
cttcttaatcataacggtatct

SEQ ID NO: 6898062 - DNA, 22 bp, Homo sapiens
gtgtctctaggacctggtacta

SEQ ID NO: 6898063 - DNA, 22 bp, Homo sapiens
tatgttcttagaagaggcagca

SEQ ID NO: 6898064 - DNA, 20 bp, Homo sapiens
catgccatgtctactgaggc

SEQ ID NO: 6898065 - DNA, 22 bp, Homo sapiens
tgttattatctgttaggtgttc

SEQ ID NO: 6898066 - DNA, 22 bp, Homo sapiens
caaggccaaggttttgtgaact

SEQ ID NO: 6898067 - DNA, 22 bp, Homo sapiens
aagtagttagtccgcctgctct

SEQ ID NO: 6898068 - DNA, 22 bp, Homo sapiens
ttttggcactgcgtctacatgg

SEQ ID NO: 6898069 - DNA, 22 bp, Homo sapiens
tttcacaaatgtctttaacttg

SEQ ID NO: 6898070 - DNA, 22 bp, Homo sapiens
ctgggtctggccacaggaagta

SEQ ID NO: 6898071 - DNA, 22 bp, Homo sapiens
tttctgccgttccctgctctgt

SEQ ID NO: 6898072 - DNA, 22 bp, Homo sapiens
gtcataaagacagaaacattcc

SEQ ID NO: 6898073 - DNA, 22 bp, Homo sapiens
tattctacagtgttagtgttag

SEQ ID NO: 6898074 - DNA, 23 bp, Homo sapiens
actgagggccacttccatcgtga

SEQ ID NO: 6898075 - DNA, 22 bp, Homo sapiens
aatccctactagagcataccgt

SEQ ID NO: 6898076 - DNA, 22 bp, Homo sapiens
ccaatagagtgctgtaagaatt

SEQ ID NO: 6898077 - DNA, 22 bp, Homo sapiens
tgtgagcactgtgatgctgttc

SEQ ID NO: 6898078 - DNA, 23 bp, Homo sapiens
accagtccattcccctcatgatt

SEQ ID NO: 6898079 - DNA, 22 bp, Homo sapiens
aataagatcttaaaggttatat

SEQ ID NO: 6898080 - DNA, 22 bp, Homo sapiens
tcagactgaaagatacacctct

SEQ ID NO: 6898081 - DNA, 22 bp, Homo sapiens
ttcttactacatttgcaggcta

SEQ ID NO: 6898082 - DNA, 20 bp, Homo sapiens
tccctaggcaggagggcact

SEQ ID NO: 6898083 - DNA, 20 bp, Homo sapiens
agttaggaatttaagtgtta

SEQ ID NO: 6898084 - DNA, 22 bp, Homo sapiens
gctacatagtaacccacaaatc

SEQ ID NO: 6898085 - DNA, 22 bp, Homo sapiens
gtccagcatttaggcttgctga

SEQ ID NO: 6898086 - DNA, 22 bp, Homo sapiens
cggcgttggagcgggctttggt

SEQ ID NO: 6898087 - DNA, 22 bp, Homo sapiens
ttcttcttcaagtgctgcattc

SEQ ID NO: 6898088 - DNA, 22 bp, Homo sapiens
cagcacatcttctgatcttttg

SEQ ID NO: 6898089 - DNA, 22 bp, Homo sapiens
aaacacttcttaggtcttaagt

SEQ ID NO: 6898090 - DNA, 20 bp, Homo sapiens
agatcttttctatagaagtg

SEQ ID NO: 6898091 - DNA, 22 bp, Homo sapiens
cagtttctgtggtctcttttca

SEQ ID NO: 6898092 - DNA, 22 bp, Homo sapiens
tctggaggcaactaacctagtt

SEQ ID NO: 6898093 - DNA, 20 bp, Homo sapiens
ctgttcctgtcccatgaagc

SEQ ID NO: 6898094 - DNA, 22 bp, Homo sapiens
ttcttggctgggctttgcttcc

SEQ ID NO: 6898095 - DNA, 22 bp, Homo sapiens
ggctgcacactgcaaactcaga

SEQ ID NO: 6898096 - DNA, 22 bp, Homo sapiens
tacacccaggtaccgtgatttc

SEQ ID NO: 6898097 - DNA, 21 bp, Homo sapiens
acaaattgtttatataggaag

SEQ ID NO: 6898098 - DNA, 22 bp, Homo sapiens
catgccaagcatgttcagaagt

SEQ ID NO: 6898099 - DNA, 17 bp, Homo sapiens
gagagtctaatgggaga

SEQ ID NO: 6898100 - DNA, 22 bp, Homo sapiens
gctctctttgtgccacttaagg

SEQ ID NO: 6898101 - DNA, 22 bp, Homo sapiens
tagaagtactccttagccttta

SEQ ID NO: 6898102 - DNA, 19 bp, Homo sapiens
gccaggaaagaatcaggcg

SEQ ID NO: 6898103 - DNA, 22 bp, Homo sapiens
aaactgctgggcatatatttct

SEQ ID NO: 6898104 - DNA, 22 bp, Homo sapiens
ggcctgtgctgtcagccctagt

SEQ ID NO: 6898105 - DNA, 22 bp, Homo sapiens
cctggggaagtcacttctcttt

SEQ ID NO: 6898106 - DNA, 22 bp, Homo sapiens
tgcacccatagcacacactcct

SEQ ID NO: 6898107 - DNA, 22 bp, Homo sapiens
gattagctctagatctgggcta

SEQ ID NO: 6898108 - DNA, 22 bp, Homo sapiens
ttccagaacttttgttaatttc

SEQ ID NO: 6898109 - DNA, 22 bp, Homo sapiens
ggctggctttctctccgcacct

SEQ ID NO: 6898110 - DNA, 22 bp, Homo sapiens
tctggggataagacccaggtat

SEQ ID NO: 6898111 - DNA, 22 bp, Homo sapiens
accttctggtctgcctgacagc

SEQ ID NO: 6898112 - DNA, 22 bp, Homo sapiens
catgatataaagtagtagataa

SEQ ID NO: 6898113 - DNA, 22 bp, Homo sapiens
cacaggagtgctgctattgttg

SEQ ID NO: 6898114 - DNA, 22 bp, Homo sapiens
ctgagctgtggccaccaattta

SEQ ID NO: 6898115 - DNA, 22 bp, Homo sapiens
gacagcagcatgtttacaggcc

SEQ ID NO: 6898116 - DNA, 22 bp, Homo sapiens
tggctgccctcatgggcctgat

SEQ ID NO: 6898117 - DNA, 22 bp, Homo sapiens
tgtccagtgatgccaagatgaa

SEQ ID NO: 6898118 - DNA, 22 bp, Homo sapiens
ggcacagcaagaagggaaatga

SEQ ID NO: 6898119 - DNA, 22 bp, Homo sapiens
ggtgggaggactgtttgaggca

SEQ ID NO: 6898120 - DNA, 22 bp, Homo sapiens
tctgcctgttcaagtcttctag

SEQ ID NO: 6898121 - DNA, 22 bp, Homo sapiens
tacacataggtctgaataaaaa

SEQ ID NO: 6898122 - DNA, 22 bp, Homo sapiens
ttgtttaaaagaaatcatagaa

SEQ ID NO: 6898123 - DNA, 22 bp, Homo sapiens
agtaacacttggaatgatagca

SEQ ID NO: 6898124 - DNA, 22 bp, Homo sapiens
acaggctttattattggttagt

SEQ ID NO: 6898125 - DNA, 22 bp, Homo sapiens
gatcccaggtgatcttatttgt

SEQ ID NO: 6898126 - DNA, 22 bp, Homo sapiens
tctgatattggggtcagagtag

SEQ ID NO: 6898127 - DNA, 20 bp, Homo sapiens
ggccttgcttctccggcttc

SEQ ID NO: 6898128 - DNA, 22 bp, Homo sapiens
tcacattttttactggacttaa

SEQ ID NO: 6898129 - DNA, 22 bp, Homo sapiens
ccaggaagggctctttaaagac

SEQ ID NO: 6898130 - DNA, 21 bp, Homo sapiens
acactgacaaccatccacgag

SEQ ID NO: 6898131 - DNA, 22 bp, Homo sapiens
ggagcacaccgggagcttgcct

SEQ ID NO: 6898132 - DNA, 22 bp, Homo sapiens
tattagcaacagagctcttgtt

SEQ ID NO: 6898133 - DNA, 22 bp, Homo sapiens
gacaggatgtattggcaagagg

SEQ ID NO: 6898134 - DNA, 22 bp, Homo sapiens
agtttacaacagtagctatgga

SEQ ID NO: 6898135 - DNA, 22 bp, Homo sapiens
gccgccctctgcaggggctgag

SEQ ID NO: 6898136 - DNA, 22 bp, Homo sapiens
ggcatcctgggactggcttctt

SEQ ID NO: 6898137 - DNA, 22 bp, Homo sapiens
ctagatttctagttcattatcc

SEQ ID NO: 6898138 - DNA, 22 bp, Homo sapiens
aggctctcagatcagccacatt

SEQ ID NO: 6898139 - DNA, 22 bp, Homo sapiens
gctgggctggaaggccaaggca

SEQ ID NO: 6898140 - DNA, 22 bp, Homo sapiens
ggtctctttgcttcagctacag

SEQ ID NO: 6898141 - DNA, 22 bp, Homo sapiens
ctcagatgtgttggatggaaaa

SEQ ID NO: 6898142 - DNA, 22 bp, Homo sapiens
cctgggttccagcaccctctag

SEQ ID NO: 6898143 - DNA, 22 bp, Homo sapiens
gaggcccagggtacaggccgct

SEQ ID NO: 6898144 - DNA, 22 bp, Homo sapiens
tcccagggcactcaccctccct

SEQ ID NO: 6898145 - DNA, 22 bp, Homo sapiens
aggctcagcccctgggaggaga

SEQ ID NO: 6898146 - DNA, 22 bp, Homo sapiens
ttggtaaatgttgattgtggct

SEQ ID NO: 6898147 - DNA, 22 bp, Homo sapiens
cttttcatgagtctgttatggg

SEQ ID NO: 6898148 - DNA, 22 bp, Homo sapiens
ttccctggggaaggtgaccttt

SEQ ID NO: 6898149 - DNA, 22 bp, Homo sapiens
actgcttctccaatgaattaga

SEQ ID NO: 6898150 - DNA, 22 bp, Homo sapiens
acatgcctccattgagctgtgg

SEQ ID NO: 6898151 - DNA, 18 bp, Homo sapiens
atttatgctaatgggata

SEQ ID NO: 6898152 - DNA, 22 bp, Homo sapiens
ggcatctggatctgcttctccc

SEQ ID NO: 6898153 - DNA, 22 bp, Homo sapiens
ctcctgagggatgcttaggctt

SEQ ID NO: 6898154 - DNA, 22 bp, Homo sapiens
tgcagcccaggcgtcaggtggt

SEQ ID NO: 6898155 - DNA, 23 bp, Homo sapiens
tctcttacctgagacatttccta

SEQ ID NO: 6898156 - DNA, 23 bp, Homo sapiens
agtgttaaatttcgcacctaaat

SEQ ID NO: 6898157 - DNA, 20 bp, Homo sapiens
taagaacaagactaggaagc

SEQ ID NO: 6898158 - DNA, 19 bp, Homo sapiens
tccttcagtcagatctggg

SEQ ID NO: 6898159 - DNA, 22 bp, Homo sapiens
ctcttttcaaacctgtttatgg

SEQ ID NO: 6898160 - DNA, 22 bp, Homo sapiens
caaaaccaagaacattcatttc

SEQ ID NO: 6898161 - DNA, 22 bp, Homo sapiens
gtctgagcaccctggcctgtca

SEQ ID NO: 6898162 - DNA, 23 bp, Homo sapiens
actgattaacatgtgtgatattc

SEQ ID NO: 6898163 - DNA, 21 bp, Homo sapiens
ctggagggtagagttgggctg

SEQ ID NO: 6898164 - DNA, 22 bp, Homo sapiens
tgttggcagttggaagggagtg

SEQ ID NO: 6898165 - DNA, 22 bp, Homo sapiens
tcagtgtcttgacctgggtgtg

SEQ ID NO: 6898166 - DNA, 22 bp, Homo sapiens
gcacagagcttgtttacatttg

SEQ ID NO: 6898167 - DNA, 22 bp, Homo sapiens
tcgatagaaaagagctgcaggg

SEQ ID NO: 6898168 - DNA, 22 bp, Homo sapiens
tcctctcagtgtggttgtggga

SEQ ID NO: 6898169 - DNA, 22 bp, Homo sapiens
gcatggcagaacacctcgcccg

SEQ ID NO: 6898170 - DNA, 22 bp, Homo sapiens
ttttatgtaatccttactgtcg

SEQ ID NO: 6898171 - DNA, 22 bp, Homo sapiens
taagttagcaaggccaaggtaa

SEQ ID NO: 6898172 - DNA, 22 bp, Homo sapiens
cacacagacagctctctgaaga

SEQ ID NO: 6898173 - DNA, 19 bp, Homo sapiens
caggtcttcttggaggact

SEQ ID NO: 6898174 - DNA, 22 bp, Homo sapiens
agtgacttctcctaatgtcata

SEQ ID NO: 6898175 - DNA, 19 bp, Homo sapiens
aactgtgtgtgatattgac

SEQ ID NO: 6898176 - DNA, 22 bp, Homo sapiens
tggcccgcagcacgcgcaccat

SEQ ID NO: 6898177 - DNA, 22 bp, Homo sapiens
attgttcagagtagggctctgt

SEQ ID NO: 6898178 - DNA, 22 bp, Homo sapiens
atgcagctgacattttcatgtt

SEQ ID NO: 6898179 - DNA, 22 bp, Homo sapiens
agggagacaaaagcagctgcca

SEQ ID NO: 6898180 - DNA, 22 bp, Homo sapiens
cagcacatggatggagttagga

SEQ ID NO: 6898181 - DNA, 22 bp, Homo sapiens
ttcctgatagaacactttccaa

SEQ ID NO: 6898182 - DNA, 22 bp, Homo sapiens
atttcagcagcccatgtttgga

SEQ ID NO: 6898183 - DNA, 22 bp, Homo sapiens
gaaggcggacgccagggggtcg

SEQ ID NO: 6898184 - DNA, 22 bp, Homo sapiens
acattgatactgagatacaaag

SEQ ID NO: 6898185 - DNA, 22 bp, Homo sapiens
cccccggttcctgtttgcagag

SEQ ID NO: 6898186 - DNA, 22 bp, Homo sapiens
gctgaggtgtcaccttgctggg

SEQ ID NO: 6898187 - DNA, 22 bp, Homo sapiens
ctggggtggtgcaggcctcatg

SEQ ID NO: 6898188 - DNA, 22 bp, Homo sapiens
attctcaagctggctgggagca

SEQ ID NO: 6898189 - DNA, 22 bp, Homo sapiens
gaatacatgaaccctcctgtgg

SEQ ID NO: 6898190 - DNA, 22 bp, Homo sapiens
taatgatgcagttactgtctca

SEQ ID NO: 6898191 - DNA, 22 bp, Homo sapiens
tacagtgcatagaggcatgata

SEQ ID NO: 6898192 - DNA, 22 bp, Homo sapiens
ggctccctagggagagtgggag

SEQ ID NO: 6898193 - DNA, 22 bp, Homo sapiens
cagtgggtgagaggaaaagctt

SEQ ID NO: 6898194 - DNA, 22 bp, Homo sapiens
ttagacatagaatattgtctag

SEQ ID NO: 6898195 - DNA, 22 bp, Homo sapiens
cacacatgtgagcagagaggcg

SEQ ID NO: 6898196 - DNA, 22 bp, Homo sapiens
agacttcaaagcctttgttcat

SEQ ID NO: 6898197 - DNA, 22 bp, Homo sapiens
atctaaaccctactttctttct

SEQ ID NO: 6898198 - DNA, 22 bp, Homo sapiens
attagtgcccaggctgcctctt

SEQ ID NO: 6898199 - DNA, 22 bp, Homo sapiens
ctgtcaacattggtgtctgtca

SEQ ID NO: 6898200 - DNA, 19 bp, Homo sapiens
tgaggcacagtggtgaaat

SEQ ID NO: 6898201 - DNA, 22 bp, Homo sapiens
aagtgccagtttctggcttcct

SEQ ID NO: 6898202 - DNA, 22 bp, Homo sapiens
ctctgtggtaaaatagcagtat

SEQ ID NO: 6898203 - DNA, 20 bp, Homo sapiens
aaggctatgctgtggtctgc

SEQ ID NO: 6898204 - DNA, 17 bp, Homo sapiens
ttgaccaaaatgcagcc

SEQ ID NO: 6898205 - DNA, 22 bp, Homo sapiens
cacacatgtctctccatgctct

SEQ ID NO: 6898206 - DNA, 22 bp, Homo sapiens
aaccatgctagcatcaaaatgt

SEQ ID NO: 6898207 - DNA, 22 bp, Homo sapiens
aaagttttagaactaggaagca

SEQ ID NO: 6898208 - DNA, 22 bp, Homo sapiens
aggcactgaaggaagcttgcgc

SEQ ID NO: 6898209 - DNA, 22 bp, Homo sapiens
ctagtttaaagcagctgaaagg

SEQ ID NO: 6898210 - DNA, 22 bp, Homo sapiens
ggtcctgctggctcagctgagc

SEQ ID NO: 6898211 - DNA, 22 bp, Homo sapiens
tgtgggaagatgttgcaggaga

SEQ ID NO: 6898212 - DNA, 20 bp, Homo sapiens
ccagtttctttcccagcctc

SEQ ID NO: 6898213 - DNA, 22 bp, Homo sapiens
ggcccagtgtgggtggatgttg

SEQ ID NO: 6898214 - DNA, 19 bp, Homo sapiens
gtcactaagttttgggggt

SEQ ID NO: 6898215 - DNA, 22 bp, Homo sapiens
ccacatacaaatggggtgctgt

SEQ ID NO: 6898216 - DNA, 22 bp, Homo sapiens
tgtaatgaaatggtacaactgt

SEQ ID NO: 6898217 - DNA, 22 bp, Homo sapiens
aaatgcacaaagattttgcact

SEQ ID NO: 6898218 - DNA, 22 bp, Homo sapiens
tgcacattagtgtttgagatgc

SEQ ID NO: 6898219 - DNA, 19 bp, Homo sapiens
cttctggatccgcagggcc

SEQ ID NO: 6898220 - DNA, 22 bp, Homo sapiens
agaatacatctagtgctgcatg

SEQ ID NO: 6898221 - DNA, 23 bp, Homo sapiens
tagagaaagccaccgagtctctc

SEQ ID NO: 6898222 - DNA, 22 bp, Homo sapiens
aggagccagggaagctgctttc

SEQ ID NO: 6898223 - DNA, 22 bp, Homo sapiens
tcatctcagagaggtatgttag

SEQ ID NO: 6898224 - DNA, 22 bp, Homo sapiens
ttctaccagctactcactgata

SEQ ID NO: 6898225 - DNA, 22 bp, Homo sapiens
tctccgggtggcggcgaaggga

SEQ ID NO: 6898226 - DNA, 22 bp, Homo sapiens
tgagctagggctggtgaggagc

SEQ ID NO: 6898227 - DNA, 22 bp, Homo sapiens
tgtcctcacaggaatgaacttt

SEQ ID NO: 6898228 - DNA, 22 bp, Homo sapiens
ggtgtcaggaaaatctcagtgt

SEQ ID NO: 6898229 - DNA, 19 bp, Homo sapiens
agccacagaacttgcagga

SEQ ID NO: 6898230 - DNA, 22 bp, Homo sapiens
caggcagcatttactctgatga

SEQ ID NO: 6898231 - DNA, 22 bp, Homo sapiens
ggctcctccaagcaactctcag

SEQ ID NO: 6898232 - DNA, 19 bp, Homo sapiens
tctaatatctacttccctg

SEQ ID NO: 6898233 - DNA, 22 bp, Homo sapiens
taaatttttgttaacagcctct

SEQ ID NO: 6898234 - DNA, 21 bp, Homo sapiens
ccaggctggccatggtattga

SEQ ID NO: 6898235 - DNA, 22 bp, Homo sapiens
tgatgcaatgtttacatcttga

SEQ ID NO: 6898236 - DNA, 22 bp, Homo sapiens
gcacagaaccctatctttcgga

SEQ ID NO: 6898237 - DNA, 22 bp, Homo sapiens
gacattctgtgactctgaacag

SEQ ID NO: 6898238 - DNA, 22 bp, Homo sapiens
aagattgccccatttacactgc

SEQ ID NO: 6898239 - DNA, 22 bp, Homo sapiens
tttagagcccatgtgagtgtga

SEQ ID NO: 6898240 - DNA, 22 bp, Homo sapiens
acatgcacacctatatacatgt

SEQ ID NO: 6898241 - DNA, 22 bp, Homo sapiens
cctgccagggccagaggccagc

SEQ ID NO: 6898242 - DNA, 22 bp, Homo sapiens
cagcccctccctcaggcaggtg

SEQ ID NO: 6898243 - DNA, 22 bp, Homo sapiens
tcaagaatagctgcaaacaggg

SEQ ID NO: 6898244 - DNA, 22 bp, Homo sapiens
tgagaatagaaagagctgtcat

SEQ ID NO: 6898245 - DNA, 22 bp, Homo sapiens
ttacagagataaactgtaagtg

SEQ ID NO: 6898246 - DNA, 22 bp, Homo sapiens
atcctttaagttaataaaattc

SEQ ID NO: 6898247 - DNA, 23 bp, Homo sapiens
aggaagctaagtgtggctgcgga

SEQ ID NO: 6898248 - DNA, 23 bp, Homo sapiens
cccagagcacagcctccagatgc

SEQ ID NO: 6898249 - DNA, 22 bp, Homo sapiens
cccaaacatccaggtgctggac

SEQ ID NO: 6898250 - DNA, 22 bp, Homo sapiens
atctctggcaatgcagcatcgt

SEQ ID NO: 6898251 - DNA, 22 bp, Homo sapiens
cttggcatgcagcaggcactca

SEQ ID NO: 6898252 - DNA, 22 bp, Homo sapiens
gccgtccccgaggccggaggga

SEQ ID NO: 6898253 - DNA, 22 bp, Homo sapiens
ttcagagtaggatactagctta

SEQ ID NO: 6898254 - DNA, 22 bp, Homo sapiens
tgattcaagctactgttactgg

SEQ ID NO: 6898255 - DNA, 22 bp, Homo sapiens
cacccaggcatgggttgagatg

SEQ ID NO: 6898256 - DNA, 22 bp, Homo sapiens
tggcagcaaaaccagaatcaga

SEQ ID NO: 6898257 - DNA, 22 bp, Homo sapiens
gcctcccttggtgtctcccggg

SEQ ID NO: 6898258 - DNA, 22 bp, Homo sapiens
ctgaaattctgcctctgcacaa

SEQ ID NO: 6898259 - DNA, 22 bp, Homo sapiens
cctcacagtttggctaactgtg

SEQ ID NO: 6898260 - DNA, 22 bp, Homo sapiens
atttgtcatgtatgtaaagttg

SEQ ID NO: 6898261 - DNA, 22 bp, Homo sapiens
gtgaacattgaggcagaaagga

SEQ ID NO: 6898262 - DNA, 22 bp, Homo sapiens
tttaaaaaactagtctgagtct

SEQ ID NO: 6898263 - DNA, 22 bp, Homo sapiens
ctgtgctgcagacgcagtagct

SEQ ID NO: 6898264 - DNA, 22 bp, Homo sapiens
agttctgcatgaaaaaggacta

SEQ ID NO: 6898265 - DNA, 21 bp, Homo sapiens
ttcaacagcataatgtaggaa

SEQ ID NO: 6898266 - DNA, 22 bp, Homo sapiens
ggaggaggtgggttaagttgta

SEQ ID NO: 6898267 - DNA, 23 bp, Homo sapiens
agcaatctgtgtttcagcaagcc

SEQ ID NO: 6898268 - DNA, 22 bp, Homo sapiens
ggccatttttgttcttatctct

SEQ ID NO: 6898269 - DNA, 22 bp, Homo sapiens
tcacagcagtaaagaaaacact

SEQ ID NO: 6898270 - DNA, 22 bp, Homo sapiens
aatttacaggtgcactcgccat

SEQ ID NO: 6898271 - DNA, 22 bp, Homo sapiens
atggcattatagcaatggtttg

SEQ ID NO: 6898272 - DNA, 22 bp, Homo sapiens
ccatttactagggagatctaga

SEQ ID NO: 6898273 - DNA, 22 bp, Homo sapiens
agtctgtctaatattattcagg

SEQ ID NO: 6898274 - DNA, 22 bp, Homo sapiens
ttgaagacacagacatatagag

SEQ ID NO: 6898275 - DNA, 22 bp, Homo sapiens
gtctaacaagcattaggaaccc

SEQ ID NO: 6898276 - DNA, 22 bp, Homo sapiens
agtattacatggccaatctcct

SEQ ID NO: 6898277 - DNA, 18 bp, Homo sapiens
ggagtctcaggagaggaa

SEQ ID NO: 6898278 - DNA, 22 bp, Homo sapiens
gattaagagaagtttcttatcg

SEQ ID NO: 6898279 - DNA, 22 bp, Homo sapiens
gcttccagtcctcagaggctgg

SEQ ID NO: 6898280 - DNA, 22 bp, Homo sapiens
ttctgcattcatttttcctaca

SEQ ID NO: 6898281 - DNA, 22 bp, Homo sapiens
gctgtggctccaatggtgagcc

SEQ ID NO: 6898282 - DNA, 22 bp, Homo sapiens
tggtcagatgctgagtggatct

SEQ ID NO: 6898283 - DNA, 22 bp, Homo sapiens
aagcttggaagtcttcctttca

SEQ ID NO: 6898284 - DNA, 22 bp, Homo sapiens
cagttaaagtgcttatcacaga

SEQ ID NO: 6898285 - DNA, 22 bp, Homo sapiens
gcaagatagagttgcaaatatt

SEQ ID NO: 6898286 - DNA, 23 bp, Homo sapiens
tccaaatacctgtcaccttgtct

SEQ ID NO: 6898287 - DNA, 22 bp, Homo sapiens
aggttaaataaagttggattat

SEQ ID NO: 6898288 - DNA, 22 bp, Homo sapiens
gaaggcatctatgtgacctgga

SEQ ID NO: 6898289 - DNA, 22 bp, Homo sapiens
ctgccagctctctggaggctct

SEQ ID NO: 6898290 - DNA, 22 bp, Homo sapiens
gcagttttagtggatctggggc

SEQ ID NO: 6898291 - DNA, 18 bp, Homo sapiens
aagatcacaaaatagctg

SEQ ID NO: 6898292 - DNA, 22 bp, Homo sapiens
attggcagtaagactctttctt

SEQ ID NO: 6898293 - DNA, 22 bp, Homo sapiens
catattgtgtgatgagtataat

SEQ ID NO: 6898294 - DNA, 22 bp, Homo sapiens
tctttgaagttcccctggaaga

SEQ ID NO: 6898295 - DNA, 22 bp, Homo sapiens
gaaagtattagcctagaagtca

SEQ ID NO: 6898296 - DNA, 22 bp, Homo sapiens
ggtttaattacctgcatctcaa

SEQ ID NO: 6898297 - DNA, 22 bp, Homo sapiens
aggcacaggcctcagcacccag

SEQ ID NO: 6898298 - DNA, 22 bp, Homo sapiens
ccactggcaaccccgcctcata

SEQ ID NO: 6898299 - DNA, 19 bp, Homo sapiens
gtttccttgggtgtaggga

SEQ ID NO: 6898300 - DNA, 22 bp, Homo sapiens
ttagaaagggtgtctgaatctg

SEQ ID NO: 6898301 - DNA, 22 bp, Homo sapiens
cactaattacaaagagatggga

SEQ ID NO: 6898302 - DNA, 22 bp, Homo sapiens
gggcccctgggaattctgtgat

SEQ ID NO: 6898303 - DNA, 22 bp, Homo sapiens
gtctttcttaattcaagtgctt

SEQ ID NO: 6898304 - DNA, 22 bp, Homo sapiens
tcaggtgggcagtgggttgagc

SEQ ID NO: 6898305 - DNA, 22 bp, Homo sapiens
ggcaggcagcctccatccacag

SEQ ID NO: 6898306 - DNA, 22 bp, Homo sapiens
gtgccctcctgaagccatcaca

SEQ ID NO: 6898307 - DNA, 22 bp, Homo sapiens
tttggcaccatttttattctct

SEQ ID NO: 6898308 - DNA, 22 bp, Homo sapiens
attccactccaataagtgtcaa

SEQ ID NO: 6898309 - DNA, 22 bp, Homo sapiens
cagaaacagagaaatattggct

SEQ ID NO: 6898310 - DNA, 20 bp, Homo sapiens
tctcagggtcttagatggaa

SEQ ID NO: 6898311 - DNA, 22 bp, Homo sapiens
gtgcaaaagtaaatgtggtttt

SEQ ID NO: 6898312 - DNA, 22 bp, Homo sapiens
cccttccttgtgactggtgggg

SEQ ID NO: 6898313 - DNA, 22 bp, Homo sapiens
tatggctttgaaagggcttttc

SEQ ID NO: 6898314 - DNA, 22 bp, Homo sapiens
aaaggcttgtccagtaagggga

SEQ ID NO: 6898315 - DNA, 22 bp, Homo sapiens
ttacaaggtaagttgttaagtc

SEQ ID NO: 6898316 - DNA, 22 bp, Homo sapiens
gcctgcctgctgtgtgcaagtt

SEQ ID NO: 6898317 - DNA, 22 bp, Homo sapiens
gacagcttcttgggccgggcct

SEQ ID NO: 6898318 - DNA, 22 bp, Homo sapiens
ttctaactggcttgacagtttc

SEQ ID NO: 6898319 - DNA, 22 bp, Homo sapiens
tcagaggcagctgatgttctgt

SEQ ID NO: 6898320 - DNA, 22 bp, Homo sapiens
ttacagaagtgaaggcctttaa

SEQ ID NO: 6898321 - DNA, 18 bp, Homo sapiens
gggcagatgtcccaagat

SEQ ID NO: 6898322 - DNA, 22 bp, Homo sapiens
atgtgtgctcttgagccttcac

SEQ ID NO: 6898323 - DNA, 22 bp, Homo sapiens
tcttcagagactctgagcccct

SEQ ID NO: 6898324 - DNA, 19 bp, Homo sapiens
ccttccccttcagcctctg

SEQ ID NO: 6898325 - DNA, 22 bp, Homo sapiens
aagtcttaggaaatagcaaaga

SEQ ID NO: 6898326 - DNA, 22 bp, Homo sapiens
tgtctatgtatacatgtgtata

SEQ ID NO: 6898327 - DNA, 22 bp, Homo sapiens
aggaagagtgttacctatgggt

SEQ ID NO: 6898328 - DNA, 22 bp, Homo sapiens
cacaggaagtggtcagtgccag

SEQ ID NO: 6898329 - DNA, 22 bp, Homo sapiens
atgcacatacatatgctctata

SEQ ID NO: 6898330 - DNA, 18 bp, Homo sapiens
gggaatcagaatctcatt

SEQ ID NO: 6898331 - DNA, 22 bp, Homo sapiens
ccactgcactccagccttggca

SEQ ID NO: 6898332 - DNA, 22 bp, Homo sapiens
gagcagtgatgggaggacgtca

SEQ ID NO: 6898333 - DNA, 22 bp, Homo sapiens
acatcttcactggtttctggaa

SEQ ID NO: 6898334 - DNA, 22 bp, Homo sapiens
gaagttagtacctggtatactt

SEQ ID NO: 6898335 - DNA, 22 bp, Homo sapiens
tgagaagcccacactctttcct

SEQ ID NO: 6898336 - DNA, 22 bp, Homo sapiens
tccacaggtcctctttgcaaag

SEQ ID NO: 6898337 - DNA, 22 bp, Homo sapiens
tatttggcaaagaattttctgg

SEQ ID NO: 6898338 - DNA, 22 bp, Homo sapiens
gccttggactaccactcccaca

SEQ ID NO: 6898339 - DNA, 22 bp, Homo sapiens
ttatttaggaggaaactgaggt

SEQ ID NO: 6898340 - DNA, 22 bp, Homo sapiens
aagctttgtccaaggccatgca

SEQ ID NO: 6898341 - DNA, 22 bp, Homo sapiens
ttgctattttgagagtcatagt

SEQ ID NO: 6898342 - DNA, 20 bp, Homo sapiens
aatgaggtcccactgaggag

SEQ ID NO: 6898343 - DNA, 22 bp, Homo sapiens
aaagtggtttcccagttcagta

SEQ ID NO: 6898344 - DNA, 22 bp, Homo sapiens
tccaggcctctagcccctatct

SEQ ID NO: 6898345 - DNA, 22 bp, Homo sapiens
agaccctttgaagaggataaag

SEQ ID NO: 6898346 - DNA, 22 bp, Homo sapiens
aactctggttcagtgatttcag

SEQ ID NO: 6898347 - DNA, 22 bp, Homo sapiens
cgtgagtgggtagcttattctt

SEQ ID NO: 6898348 - DNA, 19 bp, Homo sapiens
gtgctccagggcaaggagt

SEQ ID NO: 6898349 - DNA, 22 bp, Homo sapiens
ctggagcagcaggtggccaggg

SEQ ID NO: 6898350 - DNA, 17 bp, Homo sapiens
gactgaggtaaggtgag

SEQ ID NO: 6898351 - DNA, 22 bp, Homo sapiens
tgcagaacgggtcttctagcac

SEQ ID NO: 6898352 - DNA, 22 bp, Homo sapiens
agtctggggtctggtagaacga

SEQ ID NO: 6898353 - DNA, 22 bp, Homo sapiens
aacatgctgggtgtttttgatg

SEQ ID NO: 6898354 - DNA, 22 bp, Homo sapiens
ggtagatataaaaacaagacta

SEQ ID NO: 6898355 - DNA, 22 bp, Homo sapiens
accctactaaatgtggtatgtc

SEQ ID NO: 6898356 - DNA, 19 bp, Homo sapiens
cagagctgctggcctcgtc

SEQ ID NO: 6898357 - DNA, 22 bp, Homo sapiens
ttagatcaatactaaagaagtt

SEQ ID NO: 6898358 - DNA, 22 bp, Homo sapiens
gtcttcaattgcatttgatggg

SEQ ID NO: 6898359 - DNA, 22 bp, Homo sapiens
gaagtgtgaaggtgatgtggag

SEQ ID NO: 6898360 - DNA, 22 bp, Homo sapiens
tcccagtgagatgaaacaggta

SEQ ID NO: 6898361 - DNA, 22 bp, Homo sapiens
cttattagagttgtgttctgtt

SEQ ID NO: 6898362 - DNA, 22 bp, Homo sapiens
aggattcatggtgcagacaaag

SEQ ID NO: 6898363 - DNA, 22 bp, Homo sapiens
aggactgttttttcttctaggg

SEQ ID NO: 6898364 - DNA, 22 bp, Homo sapiens
tctgcaggatggatgctcagaa

SEQ ID NO: 6898365 - DNA, 22 bp, Homo sapiens
aaggcaatgaatactgtttttg

SEQ ID NO: 6898366 - DNA, 20 bp, Homo sapiens
acctgggattagatacccaa

SEQ ID NO: 6898367 - DNA, 21 bp, Homo sapiens
tctggggaagacatctaggat

SEQ ID NO: 6898368 - DNA, 22 bp, Homo sapiens
ctcatttacctttgcaatcaag

SEQ ID NO: 6898369 - DNA, 23 bp, Homo sapiens
tggccagggtactacacccaccc

SEQ ID NO: 6898370 - DNA, 22 bp, Homo sapiens
gcagaagcagcagatgggcgca

SEQ ID NO: 6898371 - DNA, 22 bp, Homo sapiens
acctgcaggcacaggtgtgcgc

SEQ ID NO: 6898372 - DNA, 22 bp, Homo sapiens
agctgctgtggccacatctggc

SEQ ID NO: 6898373 - DNA, 22 bp, Homo sapiens
agctggtggagcctttctgttt

SEQ ID NO: 6898374 - DNA, 22 bp, Homo sapiens
tcatgcatgttgtactggccca

SEQ ID NO: 6898375 - DNA, 22 bp, Homo sapiens
ctctcagtaaatttctgcccca

SEQ ID NO: 6898376 - DNA, 18 bp, Homo sapiens
cgctcaccaggtaagtct

SEQ ID NO: 6898377 - DNA, 22 bp, Homo sapiens
tgtgaactttggatggttctga

SEQ ID NO: 6898378 - DNA, 22 bp, Homo sapiens
aggaatgtgtgtccaccgggga

SEQ ID NO: 6898379 - DNA, 22 bp, Homo sapiens
atgtcacattggagctgctgga

SEQ ID NO: 6898380 - DNA, 22 bp, Homo sapiens
agtctttatacagaaatatatg

SEQ ID NO: 6898381 - DNA, 22 bp, Homo sapiens
aaataggggaccaggaaaggag

SEQ ID NO: 6898382 - DNA, 22 bp, Homo sapiens
tcagccaggcacaatggcagct

SEQ ID NO: 6898383 - DNA, 22 bp, Homo sapiens
ttccaagagctgctggggtaag

SEQ ID NO: 6898384 - DNA, 22 bp, Homo sapiens
agggctttgcaatgcacagtgg

SEQ ID NO: 6898385 - DNA, 22 bp, Homo sapiens
tgagaggcagaatggtgcctgc

SEQ ID NO: 6898386 - DNA, 22 bp, Homo sapiens
ttgaagcacaatgtcttttatc

SEQ ID NO: 6898387 - DNA, 22 bp, Homo sapiens
tggctgagaccatcagggtgta

SEQ ID NO: 6898388 - DNA, 22 bp, Homo sapiens
tgaacttgaattttggaaatac

SEQ ID NO: 6898389 - DNA, 22 bp, Homo sapiens
ttgtacaagttttgagcttaag

SEQ ID NO: 6898390 - DNA, 22 bp, Homo sapiens
ctgggcagtttattcagttctg

SEQ ID NO: 6898391 - DNA, 22 bp, Homo sapiens
acataaatagattattgggagg

SEQ ID NO: 6898392 - DNA, 22 bp, Homo sapiens
tagattcttctaggtctttagc

SEQ ID NO: 6898393 - DNA, 22 bp, Homo sapiens
gttgaaagatgtcttggttccc

SEQ ID NO: 6898394 - DNA, 22 bp, Homo sapiens
ctgtcacccacccagcctgtca

SEQ ID NO: 6898395 - DNA, 22 bp, Homo sapiens
tcctccctgtaccattcctctg

SEQ ID NO: 6898396 - DNA, 22 bp, Homo sapiens
acctgccagtgaatactatctt

SEQ ID NO: 6898397 - DNA, 22 bp, Homo sapiens
tgaggtgcagcaatcctcatgt

SEQ ID NO: 6898398 - DNA, 22 bp, Homo sapiens
ggttttcaaagaggcatttcat

SEQ ID NO: 6898399 - DNA, 22 bp, Homo sapiens
agaacctcacgagattccttca

SEQ ID NO: 6898400 - DNA, 22 bp, Homo sapiens
acttcagagaaagagggaattc

SEQ ID NO: 6898401 - DNA, 22 bp, Homo sapiens
gtccctagtggaaagacatgat

SEQ ID NO: 6898402 - DNA, 22 bp, Homo sapiens
tcctggcccactcctagcttct

SEQ ID NO: 6898403 - DNA, 22 bp, Homo sapiens
cctccaagtgagagatggtaca

SEQ ID NO: 6898404 - DNA, 22 bp, Homo sapiens
gaataattttgatcagaaggga

SEQ ID NO: 6898405 - DNA, 20 bp, Homo sapiens
tcagtgtggcggggacctca

SEQ ID NO: 6898406 - DNA, 22 bp, Homo sapiens
gtttcagaaatgttctcctgct

SEQ ID NO: 6898407 - DNA, 22 bp, Homo sapiens
ccctgggagaagttgagggctg

SEQ ID NO: 6898408 - DNA, 22 bp, Homo sapiens
tgtgtcaagtggaatttcaggg

SEQ ID NO: 6898409 - DNA, 22 bp, Homo sapiens
ttttggccacatccttttgagt

SEQ ID NO: 6898410 - DNA, 22 bp, Homo sapiens
cttaatgtggacctggtttcta

SEQ ID NO: 6898411 - DNA, 22 bp, Homo sapiens
acagttaattaacattaagggg

SEQ ID NO: 6898412 - DNA, 22 bp, Homo sapiens
tgtcccagttcccagggttgct

SEQ ID NO: 6898413 - DNA, 22 bp, Homo sapiens
aagctgcttggggctcctgcag

SEQ ID NO: 6898414 - DNA, 22 bp, Homo sapiens
aggtttgttttggaaagatcat

SEQ ID NO: 6898415 - DNA, 22 bp, Homo sapiens
gcccacagctcgttcctctcct

SEQ ID NO: 6898416 - DNA, 22 bp, Homo sapiens
aggctctagatcaaggtgggag

SEQ ID NO: 6898417 - DNA, 22 bp, Homo sapiens
agtcagtggctccgagcctggt

SEQ ID NO: 6898418 - DNA, 22 bp, Homo sapiens
ttggagccctgaggatctggat

SEQ ID NO: 6898419 - DNA, 22 bp, Homo sapiens
tgtaacaatttcttactattgt

SEQ ID NO: 6898420 - DNA, 22 bp, Homo sapiens
cagagtcatgggccgtcaggca

SEQ ID NO: 6898421 - DNA, 22 bp, Homo sapiens
ggctccaggagggccttggcca

SEQ ID NO: 6898422 - DNA, 22 bp, Homo sapiens
cagctgtgatatgcctgcctga

SEQ ID NO: 6898423 - DNA, 22 bp, Homo sapiens
gtatttgtagtagcatagaatt

SEQ ID NO: 6898424 - DNA, 22 bp, Homo sapiens
ttaaggttcagtgtggcaggac

SEQ ID NO: 6898425 - DNA, 22 bp, Homo sapiens
actgggaacctgtgctaggagg

SEQ ID NO: 6898426 - DNA, 22 bp, Homo sapiens
gcttggctggagaaagttacct

SEQ ID NO: 6898427 - DNA, 22 bp, Homo sapiens
gctgtggcctggcgcagagctg

SEQ ID NO: 6898428 - DNA, 22 bp, Homo sapiens
tgtcaggagcaatgataaattt

SEQ ID NO: 6898429 - DNA, 22 bp, Homo sapiens
tttaaagagaatgtgaaggagt

SEQ ID NO: 6898430 - DNA, 22 bp, Homo sapiens
tcccatttatctagatgtcaga

SEQ ID NO: 6898431 - DNA, 22 bp, Homo sapiens
tctctgaagctcaattgagata

SEQ ID NO: 6898432 - DNA, 22 bp, Homo sapiens
atttattattgtggttacttct

SEQ ID NO: 6898433 - DNA, 22 bp, Homo sapiens
tgatgacaaactttcctgatgc

SEQ ID NO: 6898434 - DNA, 22 bp, Homo sapiens
tgtcttaacataaaaggaaatc

SEQ ID NO: 6898435 - DNA, 22 bp, Homo sapiens
tgcaaggcttgcaatggtgatc

SEQ ID NO: 6898436 - DNA, 22 bp, Homo sapiens
aggctgaggctggcagctccag

SEQ ID NO: 6898437 - DNA, 22 bp, Homo sapiens
ttcagcagatccctaagtcctg

SEQ ID NO: 6898438 - DNA, 22 bp, Homo sapiens
acactgtgcagattccctgtga

SEQ ID NO: 6898439 - DNA, 20 bp, Homo sapiens
ctggcttcgggaactagttt

SEQ ID NO: 6898440 - DNA, 19 bp, Homo sapiens
cagtatcattgcacatagt

SEQ ID NO: 6898441 - DNA, 22 bp, Homo sapiens
aatggagattccaagttccttt

SEQ ID NO: 6898442 - DNA, 22 bp, Homo sapiens
caaaccttgtaaatgccaaact

SEQ ID NO: 6898443 - DNA, 22 bp, Homo sapiens
agatgaaaagataagcagcaat

SEQ ID NO: 6898444 - DNA, 19 bp, Homo sapiens
gcctggctgggatgagccc

SEQ ID NO: 6898445 - DNA, 22 bp, Homo sapiens
tccagagtacggaagagtcatc

SEQ ID NO: 6898446 - DNA, 22 bp, Homo sapiens
gaattttaataaaggtttatca

SEQ ID NO: 6898447 - DNA, 22 bp, Homo sapiens
ctcaggagagtcttatatctcc

SEQ ID NO: 6898448 - DNA, 22 bp, Homo sapiens
gctgaggaaggtttcttatcaa

SEQ ID NO: 6898449 - DNA, 22 bp, Homo sapiens
ttctgcagtgaatgactcaata

SEQ ID NO: 6898450 - DNA, 22 bp, Homo sapiens
aagggctccaagaggtagctgg

SEQ ID NO: 6898451 - DNA, 22 bp, Homo sapiens
agggcactctgcagggaccacc

SEQ ID NO: 6898452 - DNA, 22 bp, Homo sapiens
tatgtgtatacctatacatgtg

SEQ ID NO: 6898453 - DNA, 22 bp, Homo sapiens
ccccatggcaactgctgggggt

SEQ ID NO: 6898454 - DNA, 22 bp, Homo sapiens
atctccagtgaggcagattctg

SEQ ID NO: 6898455 - DNA, 22 bp, Homo sapiens
cctcttcacctcgggcacactg

SEQ ID NO: 6898456 - DNA, 18 bp, Homo sapiens
cacaggagccacactcac

SEQ ID NO: 6898457 - DNA, 22 bp, Homo sapiens
agctgccttttgagaaagctca

SEQ ID NO: 6898458 - DNA, 22 bp, Homo sapiens
acattacttaccttgggttcta

SEQ ID NO: 6898459 - DNA, 22 bp, Homo sapiens
cttctgctggcatactgcccca

SEQ ID NO: 6898460 - DNA, 22 bp, Homo sapiens
ttcctccacgtgacaggagcca

SEQ ID NO: 6898461 - DNA, 19 bp, Homo sapiens
cctttcagaacagaagcca

SEQ ID NO: 6898462 - DNA, 22 bp, Homo sapiens
tatgagtacaaggaaggatgga

SEQ ID NO: 6898463 - DNA, 22 bp, Homo sapiens
tgggaaggtacacgggaaagag

SEQ ID NO: 6898464 - DNA, 22 bp, Homo sapiens
gagcccagtaggcaaagctgca

SEQ ID NO: 6898465 - DNA, 22 bp, Homo sapiens
ctgggcttgcactgcagcgaga

SEQ ID NO: 6898466 - DNA, 22 bp, Homo sapiens
tggctggagggttagtgagata

SEQ ID NO: 6898467 - DNA, 22 bp, Homo sapiens
tggatgtagctcagtcgattct

SEQ ID NO: 6898468 - DNA, 22 bp, Homo sapiens
ttacagaagtattgagagatcc

SEQ ID NO: 6898469 - DNA, 22 bp, Homo sapiens
tgttttcagatgcagggacaca

SEQ ID NO: 6898470 - DNA, 22 bp, Homo sapiens
ttttaaaggctgtatgaccaag

SEQ ID NO: 6898471 - DNA, 21 bp, Homo sapiens
ttgggccttttctggtagctt

SEQ ID NO: 6898472 - DNA, 22 bp, Homo sapiens
ctgtatggggcacagggctggc

SEQ ID NO: 6898473 - DNA, 22 bp, Homo sapiens
ctctcagatggagtgtgaatgg

SEQ ID NO: 6898474 - DNA, 22 bp, Homo sapiens
ttctgaaaccactgaccaacta

SEQ ID NO: 6898475 - DNA, 22 bp, Homo sapiens
atcctgcagggggttttattca

SEQ ID NO: 6898476 - DNA, 22 bp, Homo sapiens
tgaaatcattggggttgaataa

SEQ ID NO: 6898477 - DNA, 22 bp, Homo sapiens
tgtaatgaaaaggaggaaatag

SEQ ID NO: 6898478 - DNA, 22 bp, Homo sapiens
gggtcttcgccgccgccataac

SEQ ID NO: 6898479 - DNA, 22 bp, Homo sapiens
caggttatcaaggtccctgtca

SEQ ID NO: 6898480 - DNA, 22 bp, Homo sapiens
cctgctgtcagcatcctcgcga

SEQ ID NO: 6898481 - DNA, 22 bp, Homo sapiens
ctgtgttcagtgctactgagtt

SEQ ID NO: 6898482 - DNA, 22 bp, Homo sapiens
tgttgtttctactaataggcca

SEQ ID NO: 6898483 - DNA, 21 bp, Homo sapiens
gagctgggcgaggctccgggg

SEQ ID NO: 6898484 - DNA, 22 bp, Homo sapiens
ggcctagggcttggtcatggca

SEQ ID NO: 6898485 - DNA, 22 bp, Homo sapiens
gcccagggtctacaaaaatatt

SEQ ID NO: 6898486 - DNA, 22 bp, Homo sapiens
gccattcaattctacaagtata

SEQ ID NO: 6898487 - DNA, 22 bp, Homo sapiens
tatgtctttgtccatgtgcagt

SEQ ID NO: 6898488 - DNA, 22 bp, Homo sapiens
atgctaaatggccagtaccaaa

SEQ ID NO: 6898489 - DNA, 22 bp, Homo sapiens
ttccaactctgaaatgtgaaat

SEQ ID NO: 6898490 - DNA, 22 bp, Homo sapiens
gtggcagtgccgtttggttcag

SEQ ID NO: 6898491 - DNA, 22 bp, Homo sapiens
tgaggatggtcccgaggacact

SEQ ID NO: 6898492 - DNA, 21 bp, Homo sapiens
tccaggctgatgatgtcaact

SEQ ID NO: 6898493 - DNA, 22 bp, Homo sapiens
caatacaattaccagttaatca

SEQ ID NO: 6898494 - DNA, 22 bp, Homo sapiens
taactgtagaacaaaatgggct

SEQ ID NO: 6898495 - DNA, 18 bp, Homo sapiens
tcctgcagcttctatgta

SEQ ID NO: 6898496 - DNA, 22 bp, Homo sapiens
cctgcagagtccctttgttcag

SEQ ID NO: 6898497 - DNA, 20 bp, Homo sapiens
atttgggacgattggccacc

SEQ ID NO: 6898498 - DNA, 22 bp, Homo sapiens
agagcctgtctgcctttctacc

SEQ ID NO: 6898499 - DNA, 19 bp, Homo sapiens
tgttgccaggtatcatgtt

SEQ ID NO: 6898500 - DNA, 22 bp, Homo sapiens
gacctctgaaggcagagcaggg

SEQ ID NO: 6898501 - DNA, 22 bp, Homo sapiens
tttgaatgttggattgacttag

SEQ ID NO: 6898502 - DNA, 22 bp, Homo sapiens
tcaaatacagaagatcctttcc

SEQ ID NO: 6898503 - DNA, 22 bp, Homo sapiens
aaaattgtcgaacagtagtaac

SEQ ID NO: 6898504 - DNA, 22 bp, Homo sapiens
ctcctccagcttccagtggctc

SEQ ID NO: 6898505 - DNA, 22 bp, Homo sapiens
tcctctgagctcaaaatccagc

SEQ ID NO: 6898506 - DNA, 22 bp, Homo sapiens
caatctataaatatcagtttcc

SEQ ID NO: 6898507 - DNA, 22 bp, Homo sapiens
cagcagctcccatccgctgagc

SEQ ID NO: 6898508 - DNA, 22 bp, Homo sapiens
ctgaggcctctttccttggctt

SEQ ID NO: 6898509 - DNA, 22 bp, Homo sapiens
ttagaaagaactttagatatca

SEQ ID NO: 6898510 - DNA, 22 bp, Homo sapiens
agacaggcagggcatggaaaaa

SEQ ID NO: 6898511 - DNA, 22 bp, Homo sapiens
caagcaatgccctggtatatta

SEQ ID NO: 6898512 - DNA, 22 bp, Homo sapiens
tctgaggtggggctggagcatt

SEQ ID NO: 6898513 - DNA, 22 bp, Homo sapiens
gcattttaataagattcatagg

SEQ ID NO: 6898514 - DNA, 22 bp, Homo sapiens
taaaatgtgtttctgtatggtt

SEQ ID NO: 6898515 - DNA, 18 bp, Homo sapiens
tttcattataaagcaggc

SEQ ID NO: 6898516 - DNA, 22 bp, Homo sapiens
gcccaggctagcgtagagtgca

SEQ ID NO: 6898517 - DNA, 22 bp, Homo sapiens
ctgctcctgtccagcagggcca

SEQ ID NO: 6898518 - DNA, 17 bp, Homo sapiens
atgcaggtgtgaggggc

SEQ ID NO: 6898519 - DNA, 22 bp, Homo sapiens
actgtcttgtgttaaagaacca

SEQ ID NO: 6898520 - DNA, 22 bp, Homo sapiens
tatcaaacttgttttttggtgt

SEQ ID NO: 6898521 - DNA, 21 bp, Homo sapiens
tatttagttttacaaatgtgg

SEQ ID NO: 6898522 - DNA, 22 bp, Homo sapiens
atgtatttgaaatttgagacat

SEQ ID NO: 6898523 - DNA, 22 bp, Homo sapiens
gctctggtgagtgtagttcagg

SEQ ID NO: 6898524 - DNA, 22 bp, Homo sapiens
tatgtttttaagagaatgcatt

SEQ ID NO: 6898525 - DNA, 22 bp, Homo sapiens
ctgattctccttgtctggtata

SEQ ID NO: 6898526 - DNA, 22 bp, Homo sapiens
tgtaaggcacttggtctaatac

SEQ ID NO: 6898527 - DNA, 23 bp, Homo sapiens
ggagagctcctcgtgactcactg

SEQ ID NO: 6898528 - DNA, 22 bp, Homo sapiens
tcagtgtttttaaagcaatata

SEQ ID NO: 6898529 - DNA, 22 bp, Homo sapiens
tcacattctagaatgttatcgt

SEQ ID NO: 6898530 - DNA, 22 bp, Homo sapiens
gcatgcatttgtacttgatttt

SEQ ID NO: 6898531 - DNA, 22 bp, Homo sapiens
ttacttaaaaattctaagcccc

SEQ ID NO: 6898532 - DNA, 22 bp, Homo sapiens
atgtctgtccaaccctgcaggg

SEQ ID NO: 6898533 - DNA, 18 bp, Homo sapiens
ccttcagctctgccagta

SEQ ID NO: 6898534 - DNA, 22 bp, Homo sapiens
ctgcgtgttcctgaagcgcgct

SEQ ID NO: 6898535 - DNA, 22 bp, Homo sapiens
ctggatccttctctgtgtattt

SEQ ID NO: 6898536 - DNA, 21 bp, Homo sapiens
atgaaggcagtgccaagggct

SEQ ID NO: 6898537 - DNA, 22 bp, Homo sapiens
tgaaacacaagcctggttagtg

SEQ ID NO: 6898538 - DNA, 18 bp, Homo sapiens
gttttccatttgttcctc

SEQ ID NO: 6898539 - DNA, 22 bp, Homo sapiens
ctgaaggattagagagcactta

SEQ ID NO: 6898540 - DNA, 22 bp, Homo sapiens
gctcacttaatttcatgctaca

SEQ ID NO: 6898541 - DNA, 17 bp, Homo sapiens
tcccaggaacagggaat

SEQ ID NO: 6898542 - DNA, 22 bp, Homo sapiens
tgcttaaaccctgatcatgtgt

SEQ ID NO: 6898543 - DNA, 22 bp, Homo sapiens
aggagtcagattgtttgaatgt

SEQ ID NO: 6898544 - DNA, 22 bp, Homo sapiens
agtaattctactaggaatttat

SEQ ID NO: 6898545 - DNA, 22 bp, Homo sapiens
ccagcttgttccttagactctg

SEQ ID NO: 6898546 - DNA, 22 bp, Homo sapiens
ctgctctgtatatgagcaggaa

SEQ ID NO: 6898547 - DNA, 22 bp, Homo sapiens
aggtagaagagcaaggaataac

SEQ ID NO: 6898548 - DNA, 22 bp, Homo sapiens
tgcctgccccacaaggggttgc

SEQ ID NO: 6898549 - DNA, 22 bp, Homo sapiens
gtctcctggaaatatgcccata

SEQ ID NO: 6898550 - DNA, 22 bp, Homo sapiens
taggcaggctgaatgtagattt

SEQ ID NO: 6898551 - DNA, 22 bp, Homo sapiens
tcctgtgccatctctagagact

SEQ ID NO: 6898552 - DNA, 22 bp, Homo sapiens
tggagttggccgcccggaccga

SEQ ID NO: 6898553 - DNA, 22 bp, Homo sapiens
aataattgtcaactatgctaca

SEQ ID NO: 6898554 - DNA, 22 bp, Homo sapiens
ttaaacagaggtagcagactgg

SEQ ID NO: 6898555 - DNA, 20 bp, Homo sapiens
tccctcagtttccagccctg

SEQ ID NO: 6898556 - DNA, 19 bp, Homo sapiens
gaatgggttctgtagggag

SEQ ID NO: 6898557 - DNA, 22 bp, Homo sapiens
gcaggctaactacaatcaaggg

SEQ ID NO: 6898558 - DNA, 22 bp, Homo sapiens
taaggtttgcttatcttcgcct

SEQ ID NO: 6898559 - DNA, 22 bp, Homo sapiens
tattatgagccaggtgctgtct

SEQ ID NO: 6898560 - DNA, 22 bp, Homo sapiens
agtaaacaatgtatgaggacag

SEQ ID NO: 6898561 - DNA, 18 bp, Homo sapiens
tatattctgtgccctggt

SEQ ID NO: 6898562 - DNA, 22 bp, Homo sapiens
gcactgcaggtgggtggagagg

SEQ ID NO: 6898563 - DNA, 22 bp, Homo sapiens
acaggcatccaggactaggcct

SEQ ID NO: 6898564 - DNA, 22 bp, Homo sapiens
ctggcaggctctctggtcggtt

SEQ ID NO: 6898565 - DNA, 22 bp, Homo sapiens
gagtgtacctattatattagtc

SEQ ID NO: 6898566 - DNA, 22 bp, Homo sapiens
tgctctagctcataggactcat

SEQ ID NO: 6898567 - DNA, 22 bp, Homo sapiens
tggcaatataatcatctgctct

SEQ ID NO: 6898568 - DNA, 22 bp, Homo sapiens
tctatcctgcttagaagtatgt

SEQ ID NO: 6898569 - DNA, 22 bp, Homo sapiens
tatgtaaaggattgagatgaat

SEQ ID NO: 6898570 - DNA, 22 bp, Homo sapiens
tggattagtttaacaatgtggc

SEQ ID NO: 6898571 - DNA, 22 bp, Homo sapiens
tggccctgtgtcctgctgccag

SEQ ID NO: 6898572 - DNA, 22 bp, Homo sapiens
cacagagctcaagtcttagaaa

SEQ ID NO: 6898573 - DNA, 22 bp, Homo sapiens
agaaagttgttttagccaaacc

SEQ ID NO: 6898574 - DNA, 19 bp, Homo sapiens
ggaactcacttagagaaac

SEQ ID NO: 6898575 - DNA, 22 bp, Homo sapiens
atggaggtgccaggtgtgaggg

SEQ ID NO: 6898576 - DNA, 22 bp, Homo sapiens
gtactttagagtaaaatagacc

SEQ ID NO: 6898577 - DNA, 22 bp, Homo sapiens
atagaccctggaaatggcagag

SEQ ID NO: 6898578 - DNA, 22 bp, Homo sapiens
ttcaccacagtctcatctacgc

SEQ ID NO: 6898579 - DNA, 22 bp, Homo sapiens
caggagaaacataattttctgg

SEQ ID NO: 6898580 - DNA, 22 bp, Homo sapiens
ttaaagctggcgttacagtttg

SEQ ID NO: 6898581 - DNA, 22 bp, Homo sapiens
ttggtttactctggggatatct

SEQ ID NO: 6898582 - DNA, 22 bp, Homo sapiens
caagtttaaggcactgataagt

SEQ ID NO: 6898583 - DNA, 22 bp, Homo sapiens
atgcattatcaattgatgtagg

SEQ ID NO: 6898584 - DNA, 22 bp, Homo sapiens
tgtggccaaaataaaatgaggt

SEQ ID NO: 6898585 - DNA, 22 bp, Homo sapiens
gcttgaggagacttttggggga

SEQ ID NO: 6898586 - DNA, 22 bp, Homo sapiens
ggcagtgactgttcagacgtcc

SEQ ID NO: 6898587 - DNA, 22 bp, Homo sapiens
aatgaacacagccctctacttt

SEQ ID NO: 6898588 - DNA, 22 bp, Homo sapiens
cccttgcatcccatgtgtggcc

SEQ ID NO: 6898589 - DNA, 22 bp, Homo sapiens
actgcagaggtggggtgcagag

SEQ ID NO: 6898590 - DNA, 22 bp, Homo sapiens
tagcaaccagaacagcactcta

SEQ ID NO: 6898591 - DNA, 22 bp, Homo sapiens
ctagtagacagaaatgtccagt

SEQ ID NO: 6898592 - DNA, 22 bp, Homo sapiens
agcgaaattatttcaggtttgg

SEQ ID NO: 6898593 - DNA, 22 bp, Homo sapiens
tcaagcagcagatcaagagcta

SEQ ID NO: 6898594 - DNA, 19 bp, Homo sapiens
agcttttactaacagcaga

SEQ ID NO: 6898595 - DNA, 22 bp, Homo sapiens
ttggacggtggaggcaacttgg

SEQ ID NO: 6898596 - DNA, 22 bp, Homo sapiens
aaaactgtatcttcttgggact

SEQ ID NO: 6898597 - DNA, 22 bp, Homo sapiens
aaggcaggatgcggacccatct

SEQ ID NO: 6898598 - DNA, 22 bp, Homo sapiens
aactggaatagcacaggaaaag

SEQ ID NO: 6898599 - DNA, 20 bp, Homo sapiens
aagtttggagtcaggagacc

SEQ ID NO: 6898600 - DNA, 22 bp, Homo sapiens
ggtgtctatgattcagtttatg

SEQ ID NO: 6898601 - DNA, 22 bp, Homo sapiens
tgcatttacctggaggtcattt

SEQ ID NO: 6898602 - DNA, 22 bp, Homo sapiens
gttaacttccccatgtctgcat

SEQ ID NO: 6898603 - DNA, 22 bp, Homo sapiens
tgctcagaattgcgctggtgga

SEQ ID NO: 6898604 - DNA, 22 bp, Homo sapiens
aggttgaagagactttaaatta

SEQ ID NO: 6898605 - DNA, 22 bp, Homo sapiens
tttatacctcattcttagcaaa

SEQ ID NO: 6898606 - DNA, 17 bp, Homo sapiens
cctgggaggagttatga

SEQ ID NO: 6898607 - DNA, 22 bp, Homo sapiens
caggaccaagcaaagtttcttt

SEQ ID NO: 6898608 - DNA, 23 bp, Homo sapiens
aggaactgcttcatttttgaaag

SEQ ID NO: 6898609 - DNA, 21 bp, Homo sapiens
agcaactctgactagatgagg

SEQ ID NO: 6898610 - DNA, 22 bp, Homo sapiens
acatagcacgtctcaatttgga

SEQ ID NO: 6898611 - DNA, 22 bp, Homo sapiens
aactgagggccctgctgaagca

SEQ ID NO: 6898612 - DNA, 22 bp, Homo sapiens
cttctaggcttgacatctccct

SEQ ID NO: 6898613 - DNA, 22 bp, Homo sapiens
cttacattgtctcttgctgagc

SEQ ID NO: 6898614 - DNA, 22 bp, Homo sapiens
tatggctgtattctatgttact

SEQ ID NO: 6898615 - DNA, 22 bp, Homo sapiens
tcagaacagcgagaatattcac

SEQ ID NO: 6898616 - DNA, 22 bp, Homo sapiens
gtgcctcccggggctcttcctt

SEQ ID NO: 6898617 - DNA, 17 bp, Homo sapiens
tcaggaggtgtttctag

SEQ ID NO: 6898618 - DNA, 22 bp, Homo sapiens
tcaggatggagtctatccagtg

SEQ ID NO: 6898619 - DNA, 22 bp, Homo sapiens
actgtcaagagattcaaattca

SEQ ID NO: 6898620 - DNA, 22 bp, Homo sapiens
tcccaagattattgagggaggg

SEQ ID NO: 6898621 - DNA, 22 bp, Homo sapiens
tatgttctgtctgtacagattt

SEQ ID NO: 6898622 - DNA, 22 bp, Homo sapiens
tgtggtctccccagtgccagct

SEQ ID NO: 6898623 - DNA, 22 bp, Homo sapiens
tgcctgactgctgccaccacta

SEQ ID NO: 6898624 - DNA, 22 bp, Homo sapiens
tcctgagataggagttgaaggc

SEQ ID NO: 6898625 - DNA, 22 bp, Homo sapiens
tagatgatggaaaaaagcaata

SEQ ID NO: 6898626 - DNA, 22 bp, Homo sapiens
ttacaagattaattattggagt

SEQ ID NO: 6898627 - DNA, 22 bp, Homo sapiens
aggtaaattcagcagtgacatt

SEQ ID NO: 6898628 - DNA, 22 bp, Homo sapiens
gcagagccctgggggtatggtg

SEQ ID NO: 6898629 - DNA, 22 bp, Homo sapiens
atgcccttcatttatcatgaaa

SEQ ID NO: 6898630 - DNA, 22 bp, Homo sapiens
cttctaggtcttgattgaatgt

SEQ ID NO: 6898631 - DNA, 22 bp, Homo sapiens
actgtattcctactagaatcta

SEQ ID NO: 6898632 - DNA, 22 bp, Homo sapiens
ctttcaaagaccttggcatggg

SEQ ID NO: 6898633 - DNA, 22 bp, Homo sapiens
tattcacattaataagtcttca

SEQ ID NO: 6898634 - DNA, 19 bp, Homo sapiens
ctgggaggtgttcagagaa

SEQ ID NO: 6898635 - DNA, 22 bp, Homo sapiens
cagcaaagcttgttccttcctg

SEQ ID NO: 6898636 - DNA, 22 bp, Homo sapiens
tagagtaacacaaacgaattgg

SEQ ID NO: 6898637 - DNA, 22 bp, Homo sapiens
tattccagatgaaatcattcag

SEQ ID NO: 6898638 - DNA, 22 bp, Homo sapiens
caacatatttttatgtaggtca

SEQ ID NO: 6898639 - DNA, 22 bp, Homo sapiens
cacttgggattaggggctaggt

SEQ ID NO: 6898640 - DNA, 18 bp, Homo sapiens
atcttgtttttggattaa

SEQ ID NO: 6898641 - DNA, 22 bp, Homo sapiens
ttctgtcaaactcacaggccga

SEQ ID NO: 6898642 - DNA, 16 bp, Homo sapiens
tccctgaggttttgga

SEQ ID NO: 6898643 - DNA, 22 bp, Homo sapiens
tcagggcaatgtccctcagaag

SEQ ID NO: 6898644 - DNA, 22 bp, Homo sapiens
catggccaggcacgcgcatagc

SEQ ID NO: 6898645 - DNA, 22 bp, Homo sapiens
tgagattccctgaatgatatat

SEQ ID NO: 6898646 - DNA, 22 bp, Homo sapiens
actgcactccagcccgggtgac

SEQ ID NO: 6898647 - DNA, 22 bp, Homo sapiens
atggagtggtacttacttggct

SEQ ID NO: 6898648 - DNA, 22 bp, Homo sapiens
cagggacagccttggggtggcg

SEQ ID NO: 6898649 - DNA, 21 bp, Homo sapiens
gggctcagtggaaaagagtgt

SEQ ID NO: 6898650 - DNA, 22 bp, Homo sapiens
ttaaactgggaaagtcttgggg

SEQ ID NO: 6898651 - DNA, 22 bp, Homo sapiens
gagccagacaggctagagcggg

SEQ ID NO: 6898652 - DNA, 22 bp, Homo sapiens
tttagaaggactacagtgtgat

SEQ ID NO: 6898653 - DNA, 22 bp, Homo sapiens
gcagggctgggacttactggta

SEQ ID NO: 6898654 - DNA, 22 bp, Homo sapiens
tgtttggttccagagggcctct

SEQ ID NO: 6898655 - DNA, 22 bp, Homo sapiens
ctggcagcccaacctagagtct

SEQ ID NO: 6898656 - DNA, 22 bp, Homo sapiens
tcacatgtcaaaaactacataa

SEQ ID NO: 6898657 - DNA, 22 bp, Homo sapiens
cccaggaagcggagattgcaga

SEQ ID NO: 6898658 - DNA, 22 bp, Homo sapiens
gctttatgcaaacctggtactt

SEQ ID NO: 6898659 - DNA, 22 bp, Homo sapiens
tgtgagtctaggtcagggtgtt

SEQ ID NO: 6898660 - DNA, 22 bp, Homo sapiens
agtttattgtatatggtagttt

SEQ ID NO: 6898661 - DNA, 22 bp, Homo sapiens
agtagcattctccctctacact

SEQ ID NO: 6898662 - DNA, 22 bp, Homo sapiens
tacataatgagctagttaagtt

SEQ ID NO: 6898663 - DNA, 22 bp, Homo sapiens
atccatcccatcttcaccaggg

SEQ ID NO: 6898664 - DNA, 22 bp, Homo sapiens
tatgtgttatttggtatacatt

SEQ ID NO: 6898665 - DNA, 22 bp, Homo sapiens
ccgggggcgggacgagcttgac

SEQ ID NO: 6898666 - DNA, 22 bp, Homo sapiens
ttgtacttccagacctagcagg

SEQ ID NO: 6898667 - DNA, 22 bp, Homo sapiens
acattctacagttaaccattag

SEQ ID NO: 6898668 - DNA, 17 bp, Homo sapiens
ggcttcagggagctggg

SEQ ID NO: 6898669 - DNA, 22 bp, Homo sapiens
agagttctgtctgccacacgaa

SEQ ID NO: 6898670 - DNA, 22 bp, Homo sapiens
cctccactctggcctctcaggt

SEQ ID NO: 6898671 - DNA, 22 bp, Homo sapiens
cagcatctctgggagaagcatc

SEQ ID NO: 6898672 - DNA, 22 bp, Homo sapiens
tccatgcagcagcctcccagcc

SEQ ID NO: 6898673 - DNA, 22 bp, Homo sapiens
tctgaggatctgaagggaacag

SEQ ID NO: 6898674 - DNA, 17 bp, Homo sapiens
tctgccagttttagaat

SEQ ID NO: 6898675 - DNA, 22 bp, Homo sapiens
ttgcatgaaggttcaggtgtat

SEQ ID NO: 6898676 - DNA, 20 bp, Homo sapiens
tcagagtcatcaaagatggt

SEQ ID NO: 6898677 - DNA, 22 bp, Homo sapiens
aatgcttccaaaataccaagcc

SEQ ID NO: 6898678 - DNA, 22 bp, Homo sapiens
ctggcctggggcctcagctgct

SEQ ID NO: 6898679 - DNA, 22 bp, Homo sapiens
ggctacactggctatgctggct

SEQ ID NO: 6898680 - DNA, 22 bp, Homo sapiens
agcaccctccaacttccctgta

SEQ ID NO: 6898681 - DNA, 22 bp, Homo sapiens
tttcaccacagaggcaagacaa

SEQ ID NO: 6898682 - DNA, 22 bp, Homo sapiens
tcctctccatattttctgattt

SEQ ID NO: 6898683 - DNA, 22 bp, Homo sapiens
agctcccagaaggccctgcgcc

SEQ ID NO: 6898684 - DNA, 22 bp, Homo sapiens
tatttcagcacatgggataggt

SEQ ID NO: 6898685 - DNA, 22 bp, Homo sapiens
agcaccttcacaggctctcagg

SEQ ID NO: 6898686 - DNA, 22 bp, Homo sapiens
tattggattgagacattttaga

SEQ ID NO: 6898687 - DNA, 18 bp, Homo sapiens
actgtctctgagagtggt

SEQ ID NO: 6898688 - DNA, 22 bp, Homo sapiens
gggagacagttcagatagtttc

SEQ ID NO: 6898689 - DNA, 22 bp, Homo sapiens
gatttcacccacttcccagtgt

SEQ ID NO: 6898690 - DNA, 22 bp, Homo sapiens
gggcagctgcagggatggtgac

SEQ ID NO: 6898691 - DNA, 22 bp, Homo sapiens
gagatgcaagcaagtctatttt

SEQ ID NO: 6898692 - DNA, 22 bp, Homo sapiens
caaatgttaaatgtgttaagac

SEQ ID NO: 6898693 - DNA, 22 bp, Homo sapiens
gccctgggcaaggttctggcca

SEQ ID NO: 6898694 - DNA, 22 bp, Homo sapiens
tcatatatcgaatgggcatcat

SEQ ID NO: 6898695 - DNA, 22 bp, Homo sapiens
gtctcttgtggatgttgggaag

SEQ ID NO: 6898696 - DNA, 22 bp, Homo sapiens
gggaagggagctgggtatttag

SEQ ID NO: 6898697 - DNA, 19 bp, Homo sapiens
ctgctgccggagactcgtc

SEQ ID NO: 6898698 - DNA, 22 bp, Homo sapiens
ggccagtgtgcaggtcagagat

SEQ ID NO: 6898699 - DNA, 22 bp, Homo sapiens
cagatgcatgagttcattagga

SEQ ID NO: 6898700 - DNA, 23 bp, Homo sapiens
taggaggagaccgcagtgttacc

SEQ ID NO: 6898701 - DNA, 22 bp, Homo sapiens
tattggaaggcattagtgaata

SEQ ID NO: 6898702 - DNA, 19 bp, Homo sapiens
ctgcatgtagagcatcgtt

SEQ ID NO: 6898703 - DNA, 22 bp, Homo sapiens
ttgacaggaaaaagtttaggat

SEQ ID NO: 6898704 - DNA, 20 bp, Homo sapiens
ttttctgtgccaagaaaact

SEQ ID NO: 6898705 - DNA, 22 bp, Homo sapiens
ttgttacgtgatgtgtcagggt

SEQ ID NO: 6898706 - DNA, 22 bp, Homo sapiens
tggctgcacttcaacacatcct

SEQ ID NO: 6898707 - DNA, 22 bp, Homo sapiens
tctggccaacaaaaactaagtc

SEQ ID NO: 6898708 - DNA, 22 bp, Homo sapiens
ctcaggccttgaagtcttttct

SEQ ID NO: 6898709 - DNA, 22 bp, Homo sapiens
aagaacatgctataattatctt

SEQ ID NO: 6898710 - DNA, 22 bp, Homo sapiens
agactattacctaaaagataca

SEQ ID NO: 6898711 - DNA, 22 bp, Homo sapiens
ctcttgtttcctttctgcagtc

SEQ ID NO: 6898712 - DNA, 22 bp, Homo sapiens
ctgaaggaagcaggtggcctgt

SEQ ID NO: 6898713 - DNA, 22 bp, Homo sapiens
tagtcaaacctcagaatacccc

SEQ ID NO: 6898714 - DNA, 22 bp, Homo sapiens
ccctttaattccaacacaggaa

SEQ ID NO: 6898715 - DNA, 22 bp, Homo sapiens
ccagggctgagactgtattggg

SEQ ID NO: 6898716 - DNA, 22 bp, Homo sapiens
aatttccaaatttctgtcacac

SEQ ID NO: 6898717 - DNA, 22 bp, Homo sapiens
tgcctccctctctgccactgga

SEQ ID NO: 6898718 - DNA, 22 bp, Homo sapiens
acagatggaatgtgttatggga

SEQ ID NO: 6898719 - DNA, 17 bp, Homo sapiens
gcaagggatgggagatt

SEQ ID NO: 6898720 - DNA, 22 bp, Homo sapiens
gcacctttggaatgaaaagttg

SEQ ID NO: 6898721 - DNA, 22 bp, Homo sapiens
ttcattcttatttgtgatctgg

SEQ ID NO: 6898722 - DNA, 22 bp, Homo sapiens
tgagcaatatgtgaattttctt

SEQ ID NO: 6898723 - DNA, 22 bp, Homo sapiens
aggtccagcctgccctctctcc

SEQ ID NO: 6898724 - DNA, 22 bp, Homo sapiens
agctgggatgataacctcagtc

SEQ ID NO: 6898725 - DNA, 22 bp, Homo sapiens
acctgccagaatgctagtcctg

SEQ ID NO: 6898726 - DNA, 22 bp, Homo sapiens
ttgatgtaaagtgattcatggg

SEQ ID NO: 6898727 - DNA, 22 bp, Homo sapiens
acagctgaaaccagggatctgg

SEQ ID NO: 6898728 - DNA, 22 bp, Homo sapiens
gacacagttacttattttgcct

SEQ ID NO: 6898729 - DNA, 22 bp, Homo sapiens
cttgaaaaatatgccttgcttc

SEQ ID NO: 6898730 - DNA, 22 bp, Homo sapiens
tgctttattcagtctctgccat

SEQ ID NO: 6898731 - DNA, 22 bp, Homo sapiens
cacctctcatttctacagattc

SEQ ID NO: 6898732 - DNA, 22 bp, Homo sapiens
taggtatacagagatttctggg

SEQ ID NO: 6898733 - DNA, 22 bp, Homo sapiens
tgagcagacttgatgaggcagc

SEQ ID NO: 6898734 - DNA, 22 bp, Homo sapiens
ggcttcttcctgtgaacatgtt

SEQ ID NO: 6898735 - DNA, 22 bp, Homo sapiens
ctggctccctggacatggggcc

SEQ ID NO: 6898736 - DNA, 22 bp, Homo sapiens
ttctagacttcaggcattctcc

SEQ ID NO: 6898737 - DNA, 22 bp, Homo sapiens
catttaatccatagaggaatgt

SEQ ID NO: 6898738 - DNA, 22 bp, Homo sapiens
gatctgaagagttattttctga

SEQ ID NO: 6898739 - DNA, 22 bp, Homo sapiens
ggttaggatcagatcctggagg

SEQ ID NO: 6898740 - DNA, 21 bp, Homo sapiens
ggacatgaggcaggagaggct

SEQ ID NO: 6898741 - DNA, 20 bp, Homo sapiens
tctctggccagaaacaacag

SEQ ID NO: 6898742 - DNA, 22 bp, Homo sapiens
aatctcacaagccggtatgggt

SEQ ID NO: 6898743 - DNA, 22 bp, Homo sapiens
gtttagaattctaactttaagg

SEQ ID NO: 6898744 - DNA, 22 bp, Homo sapiens
ttcaggtagacgcagcagaaca

SEQ ID NO: 6898745 - DNA, 22 bp, Homo sapiens
acgagaggtccttagaatctgt

SEQ ID NO: 6898746 - DNA, 22 bp, Homo sapiens
gagaggcttaagggctgtgaag

SEQ ID NO: 6898747 - DNA, 22 bp, Homo sapiens
ggagctggtcagccttgagcat

SEQ ID NO: 6898748 - DNA, 22 bp, Homo sapiens
tggggaggtaacaatttcaggc

SEQ ID NO: 6898749 - DNA, 22 bp, Homo sapiens
tctcatacatgtttgcagaaag

SEQ ID NO: 6898750 - DNA, 22 bp, Homo sapiens
attgggctttatgtaggggaag

SEQ ID NO: 6898751 - DNA, 22 bp, Homo sapiens
taaagtataagcattggagtat

SEQ ID NO: 6898752 - DNA, 22 bp, Homo sapiens
acatttcttccacatgctgctg

SEQ ID NO: 6898753 - DNA, 22 bp, Homo sapiens
ctgggcctggtagggcttgaaa

SEQ ID NO: 6898754 - DNA, 22 bp, Homo sapiens
actgattatgcgtactctctac

SEQ ID NO: 6898755 - DNA, 22 bp, Homo sapiens
atggcagcctgagcagaggaat

SEQ ID NO: 6898756 - DNA, 22 bp, Homo sapiens
atgcacagatcctggcacttag

SEQ ID NO: 6898757 - DNA, 17 bp, Homo sapiens
ttatcttgctgtttcta

SEQ ID NO: 6898758 - DNA, 22 bp, Homo sapiens
tttactacttgtgataactgaa

SEQ ID NO: 6898759 - DNA, 22 bp, Homo sapiens
tgccaagagatgactgaaatgg

SEQ ID NO: 6898760 - DNA, 22 bp, Homo sapiens
cctgcgtctggccttgctccaa

SEQ ID NO: 6898761 - DNA, 22 bp, Homo sapiens
ggcctcctgttggctagtgtga

SEQ ID NO: 6898762 - DNA, 22 bp, Homo sapiens
tcccacatgtgaatcctcaggt

SEQ ID NO: 6898763 - DNA, 19 bp, Homo sapiens
gcctcatttccacctcccc

SEQ ID NO: 6898764 - DNA, 22 bp, Homo sapiens
cattatggaagacagtgtggtg

SEQ ID NO: 6898765 - DNA, 22 bp, Homo sapiens
aaatcagttggaacacaagcag

SEQ ID NO: 6898766 - DNA, 22 bp, Homo sapiens
aatgtgtagggtgcctgttttt

SEQ ID NO: 6898767 - DNA, 22 bp, Homo sapiens
gtgccaccttcaaatcacattg

SEQ ID NO: 6898768 - DNA, 22 bp, Homo sapiens
ttctctgctctcacatacagaa

SEQ ID NO: 6898769 - DNA, 22 bp, Homo sapiens
ggtggctgtgagcattatgtga

SEQ ID NO: 6898770 - DNA, 22 bp, Homo sapiens
atggcttaagaatgcttttgtg

SEQ ID NO: 6898771 - DNA, 22 bp, Homo sapiens
tatatctaggaaccctgagatt

SEQ ID NO: 6898772 - DNA, 20 bp, Homo sapiens
acagagatcagctgatgggc

SEQ ID NO: 6898773 - DNA, 22 bp, Homo sapiens
tcctgcagttacatcccagcca

SEQ ID NO: 6898774 - DNA, 20 bp, Homo sapiens
tctgtgctcatcccacagta

SEQ ID NO: 6898775 - DNA, 22 bp, Homo sapiens
ttgctgatttatttttaacccg

SEQ ID NO: 6898776 - DNA, 22 bp, Homo sapiens
tggaaacaaagctggatgtagt

SEQ ID NO: 6898777 - DNA, 22 bp, Homo sapiens
caggaggaacaagaggttctgg

SEQ ID NO: 6898778 - DNA, 22 bp, Homo sapiens
agagtcccagggacactccaga

SEQ ID NO: 6898779 - DNA, 19 bp, Homo sapiens
agtttgcagaaggatatgg

SEQ ID NO: 6898780 - DNA, 21 bp, Homo sapiens
tatcagagacattgagaggca

SEQ ID NO: 6898781 - DNA, 22 bp, Homo sapiens
ctggtacaaaatgctgatatca

SEQ ID NO: 6898782 - DNA, 22 bp, Homo sapiens
cctctctccaattttcacctca

SEQ ID NO: 6898783 - DNA, 22 bp, Homo sapiens
tgtatgtattttgctaggctga

SEQ ID NO: 6898784 - DNA, 22 bp, Homo sapiens
aggagagctggtgtctggaatc

SEQ ID NO: 6898785 - DNA, 22 bp, Homo sapiens
ggtgagttctcagcttattgca

SEQ ID NO: 6898786 - DNA, 22 bp, Homo sapiens
attcagtcaaaccactggtcat

SEQ ID NO: 6898787 - DNA, 22 bp, Homo sapiens
tcatggcttcaaggaagcaggc

SEQ ID NO: 6898788 - DNA, 22 bp, Homo sapiens
caagttatttcattggaacaat

SEQ ID NO: 6898789 - DNA, 22 bp, Homo sapiens
agacactgatgttcagctcaat

SEQ ID NO: 6898790 - DNA, 22 bp, Homo sapiens
atatatggttaggaatctatga

SEQ ID NO: 6898791 - DNA, 22 bp, Homo sapiens
tttggcagagtaaggcctgctt

SEQ ID NO: 6898792 - DNA, 22 bp, Homo sapiens
tcttcggaacacaaagttttcc

SEQ ID NO: 6898793 - DNA, 22 bp, Homo sapiens
tgttatgaactgcctatggaga

SEQ ID NO: 6898794 - DNA, 22 bp, Homo sapiens
ccctgtggaggaggagagcagt

SEQ ID NO: 6898795 - DNA, 22 bp, Homo sapiens
cctgagtgaattccctcactgt

SEQ ID NO: 6898796 - DNA, 22 bp, Homo sapiens
acaggcactgtcaagtcatgaa

SEQ ID NO: 6898797 - DNA, 18 bp, Homo sapiens
cagaagcaggcagtgcag

SEQ ID NO: 6898798 - DNA, 20 bp, Homo sapiens
ttcttgatttgatcctggtt

SEQ ID NO: 6898799 - DNA, 22 bp, Homo sapiens
gtcacaggcagtaactaggacc

SEQ ID NO: 6898800 - DNA, 20 bp, Homo sapiens
agctgccttcattttctaga

SEQ ID NO: 6898801 - DNA, 22 bp, Homo sapiens
ctggctttggtcccctgtgcct

SEQ ID NO: 6898802 - DNA, 22 bp, Homo sapiens
taaaggcagttctgattaggtc

SEQ ID NO: 6898803 - DNA, 22 bp, Homo sapiens
tctgagagagggtcagatgcta

SEQ ID NO: 6898804 - DNA, 18 bp, Homo sapiens
ctccagagctgtgagaca

SEQ ID NO: 6898805 - DNA, 22 bp, Homo sapiens
cttcttccaagcttatgctcaa

SEQ ID NO: 6898806 - DNA, 22 bp, Homo sapiens
caaaggacccataattaaaacc

SEQ ID NO: 6898807 - DNA, 22 bp, Homo sapiens
gtgaaatctgaggcccatgatg

SEQ ID NO: 6898808 - DNA, 22 bp, Homo sapiens
agcatgcttttttaccttacat

SEQ ID NO: 6898809 - DNA, 22 bp, Homo sapiens
ttaacagaggacacatcaaact

SEQ ID NO: 6898810 - DNA, 22 bp, Homo sapiens
atgaacatcggaaatgagactg

SEQ ID NO: 6898811 - DNA, 22 bp, Homo sapiens
ttctttgggctcagagagggag

SEQ ID NO: 6898812 - DNA, 22 bp, Homo sapiens
ttcacagctaagagctaagtaa

SEQ ID NO: 6898813 - DNA, 22 bp, Homo sapiens
tccttatatctatagttttgca

SEQ ID NO: 6898814 - DNA, 22 bp, Homo sapiens
gccactgtagagtatggacaag

SEQ ID NO: 6898815 - DNA, 22 bp, Homo sapiens
taatatctacttcatagagttt

SEQ ID NO: 6898816 - DNA, 22 bp, Homo sapiens
tgtagtgtgacataggtgtcca

SEQ ID NO: 6898817 - DNA, 22 bp, Homo sapiens
atggaaatcgatgtctaagtta

SEQ ID NO: 6898818 - DNA, 22 bp, Homo sapiens
tggtcctgcccacgcccatctg

SEQ ID NO: 6898819 - DNA, 22 bp, Homo sapiens
ggtagaaggggaagaggtccat

SEQ ID NO: 6898820 - DNA, 22 bp, Homo sapiens
tgattaatatcaccaccattgg

SEQ ID NO: 6898821 - DNA, 18 bp, Homo sapiens
gaaagtgcggggcagggg

SEQ ID NO: 6898822 - DNA, 22 bp, Homo sapiens
gaattgggggttttgcaaggca

SEQ ID NO: 6898823 - DNA, 22 bp, Homo sapiens
gaagcccagggcgtggccgggc

SEQ ID NO: 6898824 - DNA, 22 bp, Homo sapiens
gactttcttgcagaaatattcc

SEQ ID NO: 6898825 - DNA, 18 bp, Homo sapiens
ggctgtggacaagattag

SEQ ID NO: 6898826 - DNA, 22 bp, Homo sapiens
ctaccctgtatttagagatgca

SEQ ID NO: 6898827 - DNA, 22 bp, Homo sapiens
agtgatcagtgagtgaagcagg

SEQ ID NO: 6898828 - DNA, 20 bp, Homo sapiens
caaaagcaatgaagttatga

SEQ ID NO: 6898829 - DNA, 18 bp, Homo sapiens
ttcaccagtgtgatgggt

SEQ ID NO: 6898830 - DNA, 22 bp, Homo sapiens
taaaagaagcttcaaggccggc

SEQ ID NO: 6898831 - DNA, 22 bp, Homo sapiens
ccaaaggccaagctcaggtaaa

SEQ ID NO: 6898832 - DNA, 22 bp, Homo sapiens
tcagtgggaggccattgaatgg

SEQ ID NO: 6898833 - DNA, 22 bp, Homo sapiens
aacccgggaggtggaggttatg

SEQ ID NO: 6898834 - DNA, 22 bp, Homo sapiens
gatgggtgggttctgtgagagg

SEQ ID NO: 6898835 - DNA, 22 bp, Homo sapiens
gatcaaggcagtagggccagct

SEQ ID NO: 6898836 - DNA, 22 bp, Homo sapiens
gctcccacaaccttcttgctcc

SEQ ID NO: 6898837 - DNA, 22 bp, Homo sapiens
acgttttcagtgactgtgcttc

SEQ ID NO: 6898838 - DNA, 22 bp, Homo sapiens
tgaagattgagaaattatccaa

SEQ ID NO: 6898839 - DNA, 22 bp, Homo sapiens
tggctatggtattgatgggttt

SEQ ID NO: 6898840 - DNA, 22 bp, Homo sapiens
catcattgaacacttcttcctg

SEQ ID NO: 6898841 - DNA, 22 bp, Homo sapiens
ccctgggagtccactgatgtca

SEQ ID NO: 6898842 - DNA, 22 bp, Homo sapiens
ccagggcaggggctggagttca

SEQ ID NO: 6898843 - DNA, 22 bp, Homo sapiens
atgtataatgctaattagctag

SEQ ID NO: 6898844 - DNA, 22 bp, Homo sapiens
tcagggactgcagagggaagct

SEQ ID NO: 6898845 - DNA, 22 bp, Homo sapiens
ttgcatactgacctctaagctt

SEQ ID NO: 6898846 - DNA, 22 bp, Homo sapiens
cctcctggaggctctaagggag

SEQ ID NO: 6898847 - DNA, 22 bp, Homo sapiens
cttcagatattaatatcaatta

SEQ ID NO: 6898848 - DNA, 22 bp, Homo sapiens
gtaagaaaaccttctttctaat

SEQ ID NO: 6898849 - DNA, 22 bp, Homo sapiens
gttaagaatcaagacttatctt

SEQ ID NO: 6898850 - DNA, 22 bp, Homo sapiens
gaaagcataactaatatttatt

SEQ ID NO: 6898851 - DNA, 22 bp, Homo sapiens
ccagggcctgagggcgacgccc

SEQ ID NO: 6898852 - DNA, 22 bp, Homo sapiens
aaatccaggagaatttccactt

SEQ ID NO: 6898853 - DNA, 22 bp, Homo sapiens
acagccagtgactgcagaccct

SEQ ID NO: 6898854 - DNA, 22 bp, Homo sapiens
cagtgagagagaacgcattcat

SEQ ID NO: 6898855 - DNA, 22 bp, Homo sapiens
attgtgctataagcgtggttct

SEQ ID NO: 6898856 - DNA, 22 bp, Homo sapiens
attcccacatgtcgtgggaggg

SEQ ID NO: 6898857 - DNA, 22 bp, Homo sapiens
gaatgcactcacccatcactca

SEQ ID NO: 6898858 - DNA, 22 bp, Homo sapiens
tggaatgtattaagtattgagt

SEQ ID NO: 6898859 - DNA, 22 bp, Homo sapiens
ttagctgagattaagtgaactt

SEQ ID NO: 6898860 - DNA, 22 bp, Homo sapiens
cagggggctcaaaggagagtgc

SEQ ID NO: 6898861 - DNA, 22 bp, Homo sapiens
tggagcctcctcacactgtggc

SEQ ID NO: 6898862 - DNA, 22 bp, Homo sapiens
aagttcttgataagtccactgt

SEQ ID NO: 6898863 - DNA, 22 bp, Homo sapiens
tttctcagttactagctgtggt

SEQ ID NO: 6898864 - DNA, 22 bp, Homo sapiens
ccacttcctgcaggtaaggagc

SEQ ID NO: 6898865 - DNA, 23 bp, Homo sapiens
ttccaaggggatgtctccaagtg

SEQ ID NO: 6898866 - DNA, 22 bp, Homo sapiens
atgaagcatctcacaatctagt

SEQ ID NO: 6898867 - DNA, 22 bp, Homo sapiens
tgtcatgtttcatgtttgtagg

SEQ ID NO: 6898868 - DNA, 22 bp, Homo sapiens
gaagactactgttgcactcata

SEQ ID NO: 6898869 - DNA, 22 bp, Homo sapiens
agcacctgtgccctgatggaga

SEQ ID NO: 6898870 - DNA, 22 bp, Homo sapiens
gtgaaggtgggagacaggtgag

SEQ ID NO: 6898871 - DNA, 22 bp, Homo sapiens
aagaactgtatcaagatgtagt

SEQ ID NO: 6898872 - DNA, 22 bp, Homo sapiens
tgagataataaatagctttctt

SEQ ID NO: 6898873 - DNA, 22 bp, Homo sapiens
aagcaacattctctgtggcatt

SEQ ID NO: 6898874 - DNA, 22 bp, Homo sapiens
tcctccacgatggcacacctgg

SEQ ID NO: 6898875 - DNA, 22 bp, Homo sapiens
gtttaggaaattgggtattaga

SEQ ID NO: 6898876 - DNA, 22 bp, Homo sapiens
tattttaaagtgaagggtcttg

SEQ ID NO: 6898877 - DNA, 22 bp, Homo sapiens
gagaatatattgaagtagttcc

SEQ ID NO: 6898878 - DNA, 22 bp, Homo sapiens
ggttttatcctacccacacagc

SEQ ID NO: 6898879 - DNA, 22 bp, Homo sapiens
cttggattcctcatatgcacag

SEQ ID NO: 6898880 - DNA, 22 bp, Homo sapiens
aaacttgagcagtcagatgaag

SEQ ID NO: 6898881 - DNA, 23 bp, Homo sapiens
acagggctagctgacagtggtat

SEQ ID NO: 6898882 - DNA, 22 bp, Homo sapiens
aggcaggctcaatgcccagtct

SEQ ID NO: 6898883 - DNA, 22 bp, Homo sapiens
ctctcagaagtagcacgtgggc

SEQ ID NO: 6898884 - DNA, 22 bp, Homo sapiens
atcagagccctgatgacagact

SEQ ID NO: 6898885 - DNA, 22 bp, Homo sapiens
cattgacgatcatgtactttta

SEQ ID NO: 6898886 - DNA, 23 bp, Homo sapiens
acagactgtattcaaagtaggac

SEQ ID NO: 6898887 - DNA, 22 bp, Homo sapiens
tgggaggagccctctgggaagg

SEQ ID NO: 6898888 - DNA, 22 bp, Homo sapiens
gactctggttgcgggttctgct

SEQ ID NO: 6898889 - DNA, 21 bp, Homo sapiens
tttagggaccaggtcataggc

SEQ ID NO: 6898890 - DNA, 22 bp, Homo sapiens
gcctggagttcagccaagtccc

SEQ ID NO: 6898891 - DNA, 22 bp, Homo sapiens
aactgcttgatgaagctcccac

SEQ ID NO: 6898892 - DNA, 16 bp, Homo sapiens
cctctgggcctgcaag

SEQ ID NO: 6898893 - DNA, 22 bp, Homo sapiens
acagccaggaggaactcagtga

SEQ ID NO: 6898894 - DNA, 22 bp, Homo sapiens
agctgataggtgtaggatacac

SEQ ID NO: 6898895 - DNA, 20 bp, Homo sapiens
cctttctggagtgctgttca

SEQ ID NO: 6898896 - DNA, 22 bp, Homo sapiens
ctgaggaagaggtaccatttgt

SEQ ID NO: 6898897 - DNA, 23 bp, Homo sapiens
gacaaagcacttgaaatgtgtac

SEQ ID NO: 6898898 - DNA, 15 bp, Homo sapiens
gggtatggatgtggt

SEQ ID NO: 6898899 - DNA, 22 bp, Homo sapiens
tctgagctcaagtgacagttag

SEQ ID NO: 6898900 - DNA, 22 bp, Homo sapiens
cctggattcaagtctttctttc

SEQ ID NO: 6898901 - DNA, 22 bp, Homo sapiens
tcacattgccgtctgtgcactt

SEQ ID NO: 6898902 - DNA, 22 bp, Homo sapiens
ggcagaatgaggcttaggaatg

SEQ ID NO: 6898903 - DNA, 22 bp, Homo sapiens
acataccatacatggtgagatg

SEQ ID NO: 6898904 - DNA, 18 bp, Homo sapiens
cagctgaggaccaaactg

SEQ ID NO: 6898905 - DNA, 22 bp, Homo sapiens
gaggtagcatgctggaagggac

SEQ ID NO: 6898906 - DNA, 22 bp, Homo sapiens
gctgtgaaagctgccacactgt

SEQ ID NO: 6898907 - DNA, 22 bp, Homo sapiens
agtaacagggtatttgtgtggg

SEQ ID NO: 6898908 - DNA, 19 bp, Homo sapiens
gctctgagaggggcatggg

SEQ ID NO: 6898909 - DNA, 22 bp, Homo sapiens
cagctttgtcatttgatttggg

SEQ ID NO: 6898910 - DNA, 22 bp, Homo sapiens
atgcgtgtttgtatacacacaa

SEQ ID NO: 6898911 - DNA, 22 bp, Homo sapiens
agaatgtgaagattttgaatta

SEQ ID NO: 6898912 - DNA, 22 bp, Homo sapiens
tccaggcattccagccattcca

SEQ ID NO: 6898913 - DNA, 22 bp, Homo sapiens
ctggctcacctccgctccagca

SEQ ID NO: 6898914 - DNA, 23 bp, Homo sapiens
ttcccacatcttccacagctatg

SEQ ID NO: 6898915 - DNA, 22 bp, Homo sapiens
cacagagacatgatgtcattgc

SEQ ID NO: 6898916 - DNA, 22 bp, Homo sapiens
gattgtcactccctatatggta

SEQ ID NO: 6898917 - DNA, 22 bp, Homo sapiens
cagtttctgggaggaaaggaag

SEQ ID NO: 6898918 - DNA, 22 bp, Homo sapiens
ccccagggaagctttgcttact

SEQ ID NO: 6898919 - DNA, 22 bp, Homo sapiens
tcaatctgttccattagaacat

SEQ ID NO: 6898920 - DNA, 22 bp, Homo sapiens
tcatgcaggtttccagccagat

SEQ ID NO: 6898921 - DNA, 22 bp, Homo sapiens
gagatggtagcctcagaagagt

SEQ ID NO: 6898922 - DNA, 22 bp, Homo sapiens
acactgtctcatatgaggggac

SEQ ID NO: 6898923 - DNA, 22 bp, Homo sapiens
tacagcagactgaaggttgtgt

SEQ ID NO: 6898924 - DNA, 22 bp, Homo sapiens
gatctgaatcaatagaataact

SEQ ID NO: 6898925 - DNA, 22 bp, Homo sapiens
aaaggcttaatgttgttgtaat

SEQ ID NO: 6898926 - DNA, 22 bp, Homo sapiens
catgaagctcttgcacctctag

SEQ ID NO: 6898927 - DNA, 22 bp, Homo sapiens
ttctcaggtagtgctgatgctg

SEQ ID NO: 6898928 - DNA, 22 bp, Homo sapiens
tgctgcacagcccacttccctg

SEQ ID NO: 6898929 - DNA, 22 bp, Homo sapiens
cctgacactgccgccaccccgc

SEQ ID NO: 6898930 - DNA, 22 bp, Homo sapiens
cagaggtctccatcaccctcct

SEQ ID NO: 6898931 - DNA, 22 bp, Homo sapiens
aagagaatgacaaggagaacct

SEQ ID NO: 6898932 - DNA, 22 bp, Homo sapiens
ctttctctggaggggagtggtt

SEQ ID NO: 6898933 - DNA, 22 bp, Homo sapiens
ttcagtctcctcattttacaaa

SEQ ID NO: 6898934 - DNA, 22 bp, Homo sapiens
agcagcaggattttcgttggga

SEQ ID NO: 6898935 - DNA, 22 bp, Homo sapiens
gtccttggcttcttgttgactg

SEQ ID NO: 6898936 - DNA, 22 bp, Homo sapiens
gggttcatcaaaggacagactc

SEQ ID NO: 6898937 - DNA, 18 bp, Homo sapiens
tcattagggattgcaaag

SEQ ID NO: 6898938 - DNA, 22 bp, Homo sapiens
tatcagatttagaggagtcata

SEQ ID NO: 6898939 - DNA, 22 bp, Homo sapiens
gagaaactgttggaattttaat

SEQ ID NO: 6898940 - DNA, 22 bp, Homo sapiens
ttatggctgggacaaaagcttc

SEQ ID NO: 6898941 - DNA, 22 bp, Homo sapiens
ggcaggagataaaatattagtt

SEQ ID NO: 6898942 - DNA, 22 bp, Homo sapiens
gtaggcactctgtaagcatttg

SEQ ID NO: 6898943 - DNA, 22 bp, Homo sapiens
catggaggaccctcagggagct

SEQ ID NO: 6898944 - DNA, 22 bp, Homo sapiens
gacatctgaatttagcagtttt

SEQ ID NO: 6898945 - DNA, 22 bp, Homo sapiens
gggcacttctaagcatggggct

SEQ ID NO: 6898946 - DNA, 22 bp, Homo sapiens
caggagagcccgggtccgggct

SEQ ID NO: 6898947 - DNA, 22 bp, Homo sapiens
gtctgccagcaccataaattag

SEQ ID NO: 6898948 - DNA, 22 bp, Homo sapiens
agagctctcttcataacggcct

SEQ ID NO: 6898949 - DNA, 22 bp, Homo sapiens
tgagaaattcgacatatattta

SEQ ID NO: 6898950 - DNA, 22 bp, Homo sapiens
gcacatgctcaatgtgtatgta

SEQ ID NO: 6898951 - DNA, 23 bp, Homo sapiens
tggaatgtctgattctgctctag

SEQ ID NO: 6898952 - DNA, 22 bp, Homo sapiens
tagtttcttgattagccacttt

SEQ ID NO: 6898953 - DNA, 22 bp, Homo sapiens
ggagctgggaattggatcatct

SEQ ID NO: 6898954 - DNA, 22 bp, Homo sapiens
tcttcctcatgaattctcgtat

SEQ ID NO: 6898955 - DNA, 19 bp, Homo sapiens
tacatgctcttggttcagg

SEQ ID NO: 6898956 - DNA, 22 bp, Homo sapiens
gacactgtcccacagaattcga

SEQ ID NO: 6898957 - DNA, 22 bp, Homo sapiens
atatgtcgctacatcattagat

SEQ ID NO: 6898958 - DNA, 22 bp, Homo sapiens
tctgtctgagtggtgttagagt

SEQ ID NO: 6898959 - DNA, 22 bp, Homo sapiens
tccaataacatctaaaaactta

SEQ ID NO: 6898960 - DNA, 22 bp, Homo sapiens
aaggaggaaaatattgttgctg

SEQ ID NO: 6898961 - DNA, 22 bp, Homo sapiens
cttcagtctagggtgcacttga

SEQ ID NO: 6898962 - DNA, 22 bp, Homo sapiens
tattggtatggtaagaattgaa

SEQ ID NO: 6898963 - DNA, 22 bp, Homo sapiens
tctgctgcagcaggattctctg

SEQ ID NO: 6898964 - DNA, 22 bp, Homo sapiens
aacagctaccttctcactgtgc

SEQ ID NO: 6898965 - DNA, 22 bp, Homo sapiens
tttgtggatggaaaatagcagg

SEQ ID NO: 6898966 - DNA, 15 bp, Homo sapiens
gagatgctctcaggg

SEQ ID NO: 6898967 - DNA, 22 bp, Homo sapiens
aaggcttggaccagctacagtg

SEQ ID NO: 6898968 - DNA, 22 bp, Homo sapiens
gtctgagaactactgaggataa

SEQ ID NO: 6898969 - DNA, 22 bp, Homo sapiens
gctccaggaagggaaatctcca

SEQ ID NO: 6898970 - DNA, 22 bp, Homo sapiens
aaggcttgatatttacagtctt

SEQ ID NO: 6898971 - DNA, 23 bp, Homo sapiens
agccctgctgagacccagctccc

SEQ ID NO: 6898972 - DNA, 22 bp, Homo sapiens
ggcaggcagtgtggtgtgaaac

SEQ ID NO: 6898973 - DNA, 22 bp, Homo sapiens
atggtgaagcttcatgggtgtt

SEQ ID NO: 6898974 - DNA, 22 bp, Homo sapiens
tggcctgtggcttaaggtctgt

SEQ ID NO: 6898975 - DNA, 22 bp, Homo sapiens
gtgtccttatgcataccagagt

SEQ ID NO: 6898976 - DNA, 22 bp, Homo sapiens
ttcagaaagtgaatcttgttat

SEQ ID NO: 6898977 - DNA, 22 bp, Homo sapiens
tcgtttgtctgtttaagcaggg

SEQ ID NO: 6898978 - DNA, 22 bp, Homo sapiens
tgcgcctggggccctggctgtc

SEQ ID NO: 6898979 - DNA, 22 bp, Homo sapiens
caggtgacttctgaggccttca

SEQ ID NO: 6898980 - DNA, 22 bp, Homo sapiens
cagtgtcaggatcagtatattt

SEQ ID NO: 6898981 - DNA, 22 bp, Homo sapiens
agacaatggagggaaatacttc

SEQ ID NO: 6898982 - DNA, 22 bp, Homo sapiens
agcaccctcccaccctctcaga

SEQ ID NO: 6898983 - DNA, 22 bp, Homo sapiens
aaaagagtcttaggcagtcata

SEQ ID NO: 6898984 - DNA, 22 bp, Homo sapiens
ggcagccttctctcataggtga

SEQ ID NO: 6898985 - DNA, 22 bp, Homo sapiens
gagaggaatatcattatattag

SEQ ID NO: 6898986 - DNA, 22 bp, Homo sapiens
tgtttaatttttcatgagccaa

SEQ ID NO: 6898987 - DNA, 20 bp, Homo sapiens
gagcttcaactcagcaaaca

SEQ ID NO: 6898988 - DNA, 22 bp, Homo sapiens
gagtgcagtatcttctgtgtcc

SEQ ID NO: 6898989 - DNA, 22 bp, Homo sapiens
ttctgggcttggctgtttccat

SEQ ID NO: 6898990 - DNA, 22 bp, Homo sapiens
tatcctaagatgagcatgtcat

SEQ ID NO: 6898991 - DNA, 22 bp, Homo sapiens
agggagccttcctggctgtggt

SEQ ID NO: 6898992 - DNA, 22 bp, Homo sapiens
agccatttcaacaaccggctgc

SEQ ID NO: 6898993 - DNA, 22 bp, Homo sapiens
actagtttattacagttccact

SEQ ID NO: 6898994 - DNA, 22 bp, Homo sapiens
actccctccaaatctgcacagt

SEQ ID NO: 6898995 - DNA, 22 bp, Homo sapiens
tggctcttaaggtccctgtgct

SEQ ID NO: 6898996 - DNA, 22 bp, Homo sapiens
tcctgcagagtcccactgattt

SEQ ID NO: 6898997 - DNA, 22 bp, Homo sapiens
tgtgtacaggacagaaaggagg

SEQ ID NO: 6898998 - DNA, 22 bp, Homo sapiens
acagacctatggcagctgccat

SEQ ID NO: 6898999 - DNA, 22 bp, Homo sapiens
gatggagtctgaagctgggaac

SEQ ID NO: 6899000 - DNA, 22 bp, Homo sapiens
aaagcatgctactttatatagg

SEQ ID NO: 6899001 - DNA, 22 bp, Homo sapiens
aggcccagctgggccaggaaca

SEQ ID NO: 6899002 - DNA, 22 bp, Homo sapiens
gaagttcaggtgggaattgagc

SEQ ID NO: 6899003 - DNA, 21 bp, Homo sapiens
tctgtcattctatttcatata

SEQ ID NO: 6899004 - DNA, 22 bp, Homo sapiens
cagtccttaaggaaacatttgt

SEQ ID NO: 6899005 - DNA, 22 bp, Homo sapiens
cagagggcactcggagtgacat

SEQ ID NO: 6899006 - DNA, 22 bp, Homo sapiens
tctagaatgacatgcaagagta

SEQ ID NO: 6899007 - DNA, 22 bp, Homo sapiens
gggagtgtgcagaagctggggg

SEQ ID NO: 6899008 - DNA, 20 bp, Homo sapiens
tctctaaagcacctggacta

SEQ ID NO: 6899009 - DNA, 21 bp, Homo sapiens
ttcctggcggcagaaacgtga

SEQ ID NO: 6899010 - DNA, 22 bp, Homo sapiens
aggagtgtggccagggctctgg

SEQ ID NO: 6899011 - DNA, 22 bp, Homo sapiens
tacattctgaaataaatggttt

SEQ ID NO: 6899012 - DNA, 22 bp, Homo sapiens
agccagggtaaggtacttagta

SEQ ID NO: 6899013 - DNA, 22 bp, Homo sapiens
aaactagaaatcagcaagatag

SEQ ID NO: 6899014 - DNA, 22 bp, Homo sapiens
catgttcacctgtggcactagt

SEQ ID NO: 6899015 - DNA, 22 bp, Homo sapiens
ccatgagcttcctatatagggt

SEQ ID NO: 6899016 - DNA, 22 bp, Homo sapiens
agcttcattccagccactgtga

SEQ ID NO: 6899017 - DNA, 22 bp, Homo sapiens
ctggctcttgcgactcagcttg

SEQ ID NO: 6899018 - DNA, 22 bp, Homo sapiens
gaggcagtccagtgggtaagaa

SEQ ID NO: 6899019 - DNA, 22 bp, Homo sapiens
tgattctcttagatgatgtgtt

SEQ ID NO: 6899020 - DNA, 22 bp, Homo sapiens
gagttcagtagttatagtctag

SEQ ID NO: 6899021 - DNA, 22 bp, Homo sapiens
aacaattagactgacggtatta

SEQ ID NO: 6899022 - DNA, 22 bp, Homo sapiens
ggcagcaactcattattcctgt

SEQ ID NO: 6899023 - DNA, 22 bp, Homo sapiens
tggggctaacgagagagcagag

SEQ ID NO: 6899024 - DNA, 22 bp, Homo sapiens
ttattgagtttacagctttaga

SEQ ID NO: 6899025 - DNA, 22 bp, Homo sapiens
gcccaggatggagaatagtggt

SEQ ID NO: 6899026 - DNA, 22 bp, Homo sapiens
gtaggtcttctgaaaaccaaaa

SEQ ID NO: 6899027 - DNA, 22 bp, Homo sapiens
tcatcatcattctcccccactt

SEQ ID NO: 6899028 - DNA, 22 bp, Homo sapiens
taatatctggcattcaaacatg

SEQ ID NO: 6899029 - DNA, 22 bp, Homo sapiens
ttcagcaaggcatgtgcaggag

SEQ ID NO: 6899030 - DNA, 22 bp, Homo sapiens
tttggcaagtgggaaattagta

SEQ ID NO: 6899031 - DNA, 22 bp, Homo sapiens
aatgtgctccaattgtctactt

SEQ ID NO: 6899032 - DNA, 22 bp, Homo sapiens
tttcaaagagaggcagaaggaa

SEQ ID NO: 6899033 - DNA, 22 bp, Homo sapiens
aggagccattgcaggatggcag

SEQ ID NO: 6899034 - DNA, 22 bp, Homo sapiens
aacttaatgatttcatgcatgt

SEQ ID NO: 6899035 - DNA, 22 bp, Homo sapiens
aggaggcagatgcttggctgta

SEQ ID NO: 6899036 - DNA, 22 bp, Homo sapiens
atctccagttagcagtactgat

SEQ ID NO: 6899037 - DNA, 22 bp, Homo sapiens
aggatgtgttcatagctgacgc

SEQ ID NO: 6899038 - DNA, 22 bp, Homo sapiens
gccagagtgccatcagtgccat

SEQ ID NO: 6899039 - DNA, 23 bp, Homo sapiens
ttccttaactgttaagattgtct

SEQ ID NO: 6899040 - DNA, 22 bp, Homo sapiens
caagtggggcagattctcttcc

SEQ ID NO: 6899041 - DNA, 22 bp, Homo sapiens
gccctgaggggtggtgtctgta

SEQ ID NO: 6899042 - DNA, 22 bp, Homo sapiens
ccagctctctgtcctccccaca

SEQ ID NO: 6899043 - DNA, 22 bp, Homo sapiens
cctgctggacctcaacacattt

SEQ ID NO: 6899044 - DNA, 22 bp, Homo sapiens
gcatttggtttggctcaggcca

SEQ ID NO: 6899045 - DNA, 22 bp, Homo sapiens
tacaatgagctgagccagaggc

SEQ ID NO: 6899046 - DNA, 22 bp, Homo sapiens
agtgtgtgtttgggcggtttat

SEQ ID NO: 6899047 - DNA, 22 bp, Homo sapiens
aacaggagaggggaatgtagag

SEQ ID NO: 6899048 - DNA, 22 bp, Homo sapiens
tgtgttttacaaattctcttaa

SEQ ID NO: 6899049 - DNA, 22 bp, Homo sapiens
atgagcagtttttaagtagcaa

SEQ ID NO: 6899050 - DNA, 22 bp, Homo sapiens
aggctcctgatcctggggtctg

SEQ ID NO: 6899051 - DNA, 22 bp, Homo sapiens
gaggtagcgagtggacagtgca

SEQ ID NO: 6899052 - DNA, 22 bp, Homo sapiens
attctcaaacaagtggtttgat

SEQ ID NO: 6899053 - DNA, 22 bp, Homo sapiens
tctgtctgggtgcctcgagtac

SEQ ID NO: 6899054 - DNA, 22 bp, Homo sapiens
aaaacagaggtgcctgggccca

SEQ ID NO: 6899055 - DNA, 22 bp, Homo sapiens
gttagagggaaaaatcatttgc

SEQ ID NO: 6899056 - DNA, 22 bp, Homo sapiens
agtgccctggcccagctggacc

SEQ ID NO: 6899057 - DNA, 22 bp, Homo sapiens
cgagcaccgcatctgctgcaga

SEQ ID NO: 6899058 - DNA, 22 bp, Homo sapiens
cctgggaaggtcttagcatcta

SEQ ID NO: 6899059 - DNA, 22 bp, Homo sapiens
ccaggcctttcttcttggtctg

SEQ ID NO: 6899060 - DNA, 22 bp, Homo sapiens
agcaaggagtagaacaagagtg

SEQ ID NO: 6899061 - DNA, 22 bp, Homo sapiens
tgttccatcagtttttggttga

SEQ ID NO: 6899062 - DNA, 22 bp, Homo sapiens
ttgtcgggcttacgcagggcca

SEQ ID NO: 6899063 - DNA, 22 bp, Homo sapiens
aggcagactggcagggcctgga

SEQ ID NO: 6899064 - DNA, 22 bp, Homo sapiens
gctgctttgcagtagagtaata

SEQ ID NO: 6899065 - DNA, 20 bp, Homo sapiens
ggactacaatttgcagtgtg

SEQ ID NO: 6899066 - DNA, 19 bp, Homo sapiens
tgccctgcccgcagccttg

SEQ ID NO: 6899067 - DNA, 22 bp, Homo sapiens
caggaatcctatggcttttgct

SEQ ID NO: 6899068 - DNA, 22 bp, Homo sapiens
acatgtgtggccgctgtagaca

SEQ ID NO: 6899069 - DNA, 22 bp, Homo sapiens
cagcaagatggtgaatgagacg

SEQ ID NO: 6899070 - DNA, 22 bp, Homo sapiens
ggtggcagtcttaagagatctt

SEQ ID NO: 6899071 - DNA, 22 bp, Homo sapiens
ttctgtcttctcggttgtttac

SEQ ID NO: 6899072 - DNA, 22 bp, Homo sapiens
cagtttccttgtttacctactg

SEQ ID NO: 6899073 - DNA, 22 bp, Homo sapiens
tcagcaggcggttccttgtggg

SEQ ID NO: 6899074 - DNA, 22 bp, Homo sapiens
agcacagtgctctggacagagt

SEQ ID NO: 6899075 - DNA, 22 bp, Homo sapiens
ctttccaactctagtgaaattt

SEQ ID NO: 6899076 - DNA, 22 bp, Homo sapiens
ttttcttatgtgcagctatatg

SEQ ID NO: 6899077 - DNA, 22 bp, Homo sapiens
tgggagctcagaaagggaggtc

SEQ ID NO: 6899078 - DNA, 22 bp, Homo sapiens
ttctggaacatagcaagaagtt

SEQ ID NO: 6899079 - DNA, 22 bp, Homo sapiens
tggcagtggtaccggctctcag

SEQ ID NO: 6899080 - DNA, 22 bp, Homo sapiens
gtttcctgcacacgtgttatat

SEQ ID NO: 6899081 - DNA, 23 bp, Homo sapiens
tcatgtggaaaaggatctggtct

SEQ ID NO: 6899082 - DNA, 22 bp, Homo sapiens
gtttcagaggtgttcattttca

SEQ ID NO: 6899083 - DNA, 19 bp, Homo sapiens
gtcttctgaatgtggctgc

SEQ ID NO: 6899084 - DNA, 22 bp, Homo sapiens
tggcatgcacagccctgttcgg

SEQ ID NO: 6899085 - DNA, 21 bp, Homo sapiens
ctcctgggctaagatatagtg

SEQ ID NO: 6899086 - DNA, 22 bp, Homo sapiens
agctgcagaggtttgtgcaaca

SEQ ID NO: 6899087 - DNA, 22 bp, Homo sapiens
atcaggatcactgggagtcttg

SEQ ID NO: 6899088 - DNA, 22 bp, Homo sapiens
caagttcacgttgctttttgag

SEQ ID NO: 6899089 - DNA, 22 bp, Homo sapiens
cttctgcagaattaattcacta

SEQ ID NO: 6899090 - DNA, 22 bp, Homo sapiens
ttttgtttgtgtccactgcagt

SEQ ID NO: 6899091 - DNA, 22 bp, Homo sapiens
aaaagtatccacagctcaggag

SEQ ID NO: 6899092 - DNA, 22 bp, Homo sapiens
aggcttcattgtggcatcagga

SEQ ID NO: 6899093 - DNA, 22 bp, Homo sapiens
cagaaatgtttgttaatattgt

SEQ ID NO: 6899094 - DNA, 22 bp, Homo sapiens
cttgccaatggtacaaacgatt

SEQ ID NO: 6899095 - DNA, 22 bp, Homo sapiens
agcaggctgctggcgttgaagt

SEQ ID NO: 6899096 - DNA, 22 bp, Homo sapiens
agagaccaagggaatagtctca

SEQ ID NO: 6899097 - DNA, 22 bp, Homo sapiens
cccaggaaggagctgtgtattt

SEQ ID NO: 6899098 - DNA, 20 bp, Homo sapiens
tgagcaccaagaatcaagaa

SEQ ID NO: 6899099 - DNA, 22 bp, Homo sapiens
tctaaactctctttgaattatg

SEQ ID NO: 6899100 - DNA, 22 bp, Homo sapiens
caaatgtgttttttcttctaca

SEQ ID NO: 6899101 - DNA, 22 bp, Homo sapiens
taaaggaatcagttttagagat

SEQ ID NO: 6899102 - DNA, 22 bp, Homo sapiens
caggtctggtgagagaacagtt

SEQ ID NO: 6899103 - DNA, 22 bp, Homo sapiens
tgtcatgcccaggagcaaggta

SEQ ID NO: 6899104 - DNA, 22 bp, Homo sapiens
agaattgctaactctcctcctg

SEQ ID NO: 6899105 - DNA, 17 bp, Homo sapiens
gccttccttcctccaca

SEQ ID NO: 6899106 - DNA, 17 bp, Homo sapiens
agtgtggccctggttaa

SEQ ID NO: 6899107 - DNA, 22 bp, Homo sapiens
ctttcttgcataatttgaaacc

SEQ ID NO: 6899108 - DNA, 22 bp, Homo sapiens
atcctctctgtgacagggaacg

SEQ ID NO: 6899109 - DNA, 22 bp, Homo sapiens
ttcatcattgccagtctttaaa

SEQ ID NO: 6899110 - DNA, 22 bp, Homo sapiens
taaatgttatgcccatcatcca

SEQ ID NO: 6899111 - DNA, 20 bp, Homo sapiens
ctctgctttaggagagtcag

SEQ ID NO: 6899112 - DNA, 22 bp, Homo sapiens
cgttagtggagtttgaagctgt

SEQ ID NO: 6899113 - DNA, 22 bp, Homo sapiens
ggaatcgttaggtaagcaggga

SEQ ID NO: 6899114 - DNA, 22 bp, Homo sapiens
acgaataagagataaagcaagg

SEQ ID NO: 6899115 - DNA, 22 bp, Homo sapiens
aatgacagccagattcttctct

SEQ ID NO: 6899116 - DNA, 22 bp, Homo sapiens
ccacatctatctttagtatgaa

SEQ ID NO: 6899117 - DNA, 17 bp, Homo sapiens
tggaagtgaggacactg

SEQ ID NO: 6899118 - DNA, 22 bp, Homo sapiens
atgtcacccagctcccaacttt

SEQ ID NO: 6899119 - DNA, 22 bp, Homo sapiens
atttgcaaaggttaacagcagt

SEQ ID NO: 6899120 - DNA, 22 bp, Homo sapiens
ttccagaggaaagaaaatgact

SEQ ID NO: 6899121 - DNA, 22 bp, Homo sapiens
aagcacctctatgattgctttt

SEQ ID NO: 6899122 - DNA, 21 bp, Homo sapiens
atcctgtgagtctcagtcccc

SEQ ID NO: 6899123 - DNA, 22 bp, Homo sapiens
acagtttgttccttttcattgc

SEQ ID NO: 6899124 - DNA, 22 bp, Homo sapiens
tgcttaaaatgatgattatttt

SEQ ID NO: 6899125 - DNA, 22 bp, Homo sapiens
caggaacaatgtaagtctcatt

SEQ ID NO: 6899126 - DNA, 22 bp, Homo sapiens
ataatttacaactgcttttaat

SEQ ID NO: 6899127 - DNA, 22 bp, Homo sapiens
cctgtcagttgctgtcagggat

SEQ ID NO: 6899128 - DNA, 22 bp, Homo sapiens
aagtccagggatcaaagtaggc

SEQ ID NO: 6899129 - DNA, 22 bp, Homo sapiens
ttgtctctgggacatggtatta

SEQ ID NO: 6899130 - DNA, 22 bp, Homo sapiens
ccagcctggggaggcagcttct

SEQ ID NO: 6899131 - DNA, 22 bp, Homo sapiens
atgagtgtttagaaaacactgg

SEQ ID NO: 6899132 - DNA, 22 bp, Homo sapiens
tgcctgtgatcagctgagttca

SEQ ID NO: 6899133 - DNA, 22 bp, Homo sapiens
ttttggggagaacggttgctat

SEQ ID NO: 6899134 - DNA, 22 bp, Homo sapiens
ctcatttactcatctgcaaaac

SEQ ID NO: 6899135 - DNA, 22 bp, Homo sapiens
acatttgtacattggcatgtct

SEQ ID NO: 6899136 - DNA, 22 bp, Homo sapiens
ggcttaagatggtagctttgag

SEQ ID NO: 6899137 - DNA, 22 bp, Homo sapiens
agcaaatctatgaatgtatatt

SEQ ID NO: 6899138 - DNA, 22 bp, Homo sapiens
ttcacgaccatcagagcttaga

SEQ ID NO: 6899139 - DNA, 22 bp, Homo sapiens
gctcccagcattgcttcccagg

SEQ ID NO: 6899140 - DNA, 22 bp, Homo sapiens
tctgagacaacttagccctcga

SEQ ID NO: 6899141 - DNA, 22 bp, Homo sapiens
gtgtccagagaactgtgggagc

SEQ ID NO: 6899142 - DNA, 22 bp, Homo sapiens
gggcagctgccaagtgcatcgc

SEQ ID NO: 6899143 - DNA, 20 bp, Homo sapiens
atctcctgctaccacccatt

SEQ ID NO: 6899144 - DNA, 22 bp, Homo sapiens
tacactgtgacaatcatgacag

SEQ ID NO: 6899145 - DNA, 22 bp, Homo sapiens
ggcatcaggatctgtcttgctt

SEQ ID NO: 6899146 - DNA, 22 bp, Homo sapiens
ctatcaagaggtagcagtgact

SEQ ID NO: 6899147 - DNA, 22 bp, Homo sapiens
cagctgcattaattttagtgaa

SEQ ID NO: 6899148 - DNA, 22 bp, Homo sapiens
gagaaagctaataggaatccta

SEQ ID NO: 6899149 - DNA, 22 bp, Homo sapiens
gcatgcactgtatttaagtatc

SEQ ID NO: 6899150 - DNA, 22 bp, Homo sapiens
gtgtttatacagcaaagagcat

SEQ ID NO: 6899151 - DNA, 22 bp, Homo sapiens
ccctgttttaagttgatattga

SEQ ID NO: 6899152 - DNA, 22 bp, Homo sapiens
gcaaatgtggcttcctttctag

SEQ ID NO: 6899153 - DNA, 22 bp, Homo sapiens
tataaagtttcgaaagatgtat

SEQ ID NO: 6899154 - DNA, 22 bp, Homo sapiens
aaatagttacttctgctgtctt

SEQ ID NO: 6899155 - DNA, 22 bp, Homo sapiens
tctgagcttactcagggataca

SEQ ID NO: 6899156 - DNA, 22 bp, Homo sapiens
aggccagtgccatcagggtttt

SEQ ID NO: 6899157 - DNA, 23 bp, Homo sapiens
tctgtggccccttcgccccactc

SEQ ID NO: 6899158 - DNA, 22 bp, Homo sapiens
caagagctgcaaatagcgtgac

SEQ ID NO: 6899159 - DNA, 22 bp, Homo sapiens
ctgggaggcggagcttgcagtg

SEQ ID NO: 6899160 - DNA, 22 bp, Homo sapiens
agctctgccttgacaccttctc

SEQ ID NO: 6899161 - DNA, 19 bp, Homo sapiens
aggcagcacccagtccttg

SEQ ID NO: 6899162 - DNA, 22 bp, Homo sapiens
atgttacatgaaacggcctact

SEQ ID NO: 6899163 - DNA, 22 bp, Homo sapiens
tactgtatttgataagtgaagt

SEQ ID NO: 6899164 - DNA, 22 bp, Homo sapiens
ttacaattgagtctattgtatg

SEQ ID NO: 6899165 - DNA, 19 bp, Homo sapiens
cctgtgagaggacaggtgt

SEQ ID NO: 6899166 - DNA, 22 bp, Homo sapiens
tctgaggttattgtctgccatt

SEQ ID NO: 6899167 - DNA, 22 bp, Homo sapiens
caaggcttcagtgtgacaaaac

SEQ ID NO: 6899168 - DNA, 22 bp, Homo sapiens
tgcagctagcgtgcctagtgaa

SEQ ID NO: 6899169 - DNA, 22 bp, Homo sapiens
cttggtccgagggcgcctaggc

SEQ ID NO: 6899170 - DNA, 22 bp, Homo sapiens
aactcagttctttccacaatgc

SEQ ID NO: 6899171 - DNA, 22 bp, Homo sapiens
tcaggacaggttcgggtgggta

SEQ ID NO: 6899172 - DNA, 18 bp, Homo sapiens
gcagggctggacaagtca

SEQ ID NO: 6899173 - DNA, 22 bp, Homo sapiens
gtgtttaacatctggtttatac

SEQ ID NO: 6899174 - DNA, 22 bp, Homo sapiens
caccctggctggaggtgcagtg

SEQ ID NO: 6899175 - DNA, 22 bp, Homo sapiens
ctgggctcagaaccttgttaag

SEQ ID NO: 6899176 - DNA, 22 bp, Homo sapiens
acttggaaaattcaaaatggca

SEQ ID NO: 6899177 - DNA, 22 bp, Homo sapiens
ttctggcttgacccctacttcc

SEQ ID NO: 6899178 - DNA, 22 bp, Homo sapiens
aagttcctgacattgccatggc

SEQ ID NO: 6899179 - DNA, 22 bp, Homo sapiens
agtatattgctcttaatcatag

SEQ ID NO: 6899180 - DNA, 22 bp, Homo sapiens
tacaagtatgttttaaaatgtt

SEQ ID NO: 6899181 - DNA, 22 bp, Homo sapiens
agaactgtccccagagagcact

SEQ ID NO: 6899182 - DNA, 22 bp, Homo sapiens
gagacatggcaaaagcactggt

SEQ ID NO: 6899183 - DNA, 22 bp, Homo sapiens
ccagagggaactgggcctcatt

SEQ ID NO: 6899184 - DNA, 22 bp, Homo sapiens
acaatatacacatcctaatggg

SEQ ID NO: 6899185 - DNA, 22 bp, Homo sapiens
attatatgtgggatagaattta

SEQ ID NO: 6899186 - DNA, 22 bp, Homo sapiens
tctgagaaagtactgtatgttc

SEQ ID NO: 6899187 - DNA, 17 bp, Homo sapiens
tctagagcactttgaga

SEQ ID NO: 6899188 - DNA, 22 bp, Homo sapiens
catggcctcaaaggactgcaga

SEQ ID NO: 6899189 - DNA, 22 bp, Homo sapiens
aaaacctaagccagtagctccc

SEQ ID NO: 6899190 - DNA, 22 bp, Homo sapiens
caggaaattcttttgtttgtgc

SEQ ID NO: 6899191 - DNA, 22 bp, Homo sapiens
acagaagacagagtgttcatct

SEQ ID NO: 6899192 - DNA, 22 bp, Homo sapiens
ttctccaacacaagcatgatgt

SEQ ID NO: 6899193 - DNA, 22 bp, Homo sapiens
ctccccatccaggcagcaggtg

SEQ ID NO: 6899194 - DNA, 22 bp, Homo sapiens
cagaagaaatcattatctggac

SEQ ID NO: 6899195 - DNA, 23 bp, Homo sapiens
tccagctcccttcaatggcactg

SEQ ID NO: 6899196 - DNA, 23 bp, Homo sapiens
taatgagaagctttgtttcctga

SEQ ID NO: 6899197 - DNA, 22 bp, Homo sapiens
tctgcaggaaaaaagtgcctgg

SEQ ID NO: 6899198 - DNA, 22 bp, Homo sapiens
cactgagaccagagtccctgac

SEQ ID NO: 6899199 - DNA, 22 bp, Homo sapiens
acatttcagtgagctattgaag

SEQ ID NO: 6899200 - DNA, 18 bp, Homo sapiens
acggatccgcgggaccgc

SEQ ID NO: 6899201 - DNA, 22 bp, Homo sapiens
tcaggagtttcaggtgtaagtg

SEQ ID NO: 6899202 - DNA, 22 bp, Homo sapiens
cacagttcctgaatatatcaca

SEQ ID NO: 6899203 - DNA, 22 bp, Homo sapiens
tgagtgagttttcacggtcagc

SEQ ID NO: 6899204 - DNA, 22 bp, Homo sapiens
tagaattatgccttgctgtcca

SEQ ID NO: 6899205 - DNA, 22 bp, Homo sapiens
gaagccaagtgcaaatgcctta

SEQ ID NO: 6899206 - DNA, 22 bp, Homo sapiens
atggctcagcccatggaagaaa

SEQ ID NO: 6899207 - DNA, 22 bp, Homo sapiens
ctctcctccaggaactcacagt

SEQ ID NO: 6899208 - DNA, 22 bp, Homo sapiens
aggctacaataattcccatgca

SEQ ID NO: 6899209 - DNA, 22 bp, Homo sapiens
gcagatcaattgattgttcact

SEQ ID NO: 6899210 - DNA, 22 bp, Homo sapiens
tggtaactttcagcatggtgac

SEQ ID NO: 6899211 - DNA, 22 bp, Homo sapiens
agaaataatcagcttaggggca

SEQ ID NO: 6899212 - DNA, 21 bp, Homo sapiens
ccagctttcccaagtcccttt

SEQ ID NO: 6899213 - DNA, 22 bp, Homo sapiens
tgcggcagccaccgcgtggccc

SEQ ID NO: 6899214 - DNA, 22 bp, Homo sapiens
agtgactactggatttgtttct

SEQ ID NO: 6899215 - DNA, 22 bp, Homo sapiens
gtggggtgcagcagtactgtgt

SEQ ID NO: 6899216 - DNA, 22 bp, Homo sapiens
caggcagccttctcgtctcaca

SEQ ID NO: 6899217 - DNA, 22 bp, Homo sapiens
acagctggtgaatgttctctgt

SEQ ID NO: 6899218 - DNA, 21 bp, Homo sapiens
ttggaatctcttcatctctgc

SEQ ID NO: 6899219 - DNA, 22 bp, Homo sapiens
tggactttctagggtagaggaa

SEQ ID NO: 6899220 - DNA, 22 bp, Homo sapiens
atttggcttggcaacaactttc

SEQ ID NO: 6899221 - DNA, 22 bp, Homo sapiens
cagctgctgtaacagaatactt

SEQ ID NO: 6899222 - DNA, 22 bp, Homo sapiens
gtgagcatgccgtccaagtcac

SEQ ID NO: 6899223 - DNA, 22 bp, Homo sapiens
gaatatctgggagtgggaagct

SEQ ID NO: 6899224 - DNA, 22 bp, Homo sapiens
ttccaaggctgtaaaattggtt

SEQ ID NO: 6899225 - DNA, 22 bp, Homo sapiens
ttgcattgatcccagcttgggc

SEQ ID NO: 6899226 - DNA, 21 bp, Homo sapiens
ctgcagcaaaactttgctcct

SEQ ID NO: 6899227 - DNA, 22 bp, Homo sapiens
actctggtagacaaggagaggt

SEQ ID NO: 6899228 - DNA, 22 bp, Homo sapiens
tagtatagattgaagcagatca

SEQ ID NO: 6899229 - DNA, 22 bp, Homo sapiens
tatgctttacttttcattgtga

SEQ ID NO: 6899230 - DNA, 22 bp, Homo sapiens
gtcaccaggtctgatgcagcca

SEQ ID NO: 6899231 - DNA, 22 bp, Homo sapiens
gccatgcatttcgctgggaggg

SEQ ID NO: 6899232 - DNA, 22 bp, Homo sapiens
tatgacattttttgtggccttc

SEQ ID NO: 6899233 - DNA, 23 bp, Homo sapiens
tggcttgctaatgttccaaataa

SEQ ID NO: 6899234 - DNA, 20 bp, Homo sapiens
gctctgaccatatcaagaca

SEQ ID NO: 6899235 - DNA, 22 bp, Homo sapiens
ataaagtagccactggaaagct

SEQ ID NO: 6899236 - DNA, 22 bp, Homo sapiens
gtaaggttaccaggttttgaga

SEQ ID NO: 6899237 - DNA, 22 bp, Homo sapiens
atgccaaagatgtttgatagaa

SEQ ID NO: 6899238 - DNA, 17 bp, Homo sapiens
cagaaggaagcatggca

SEQ ID NO: 6899239 - DNA, 22 bp, Homo sapiens
cagtgtgggtgaaatacaaagt

SEQ ID NO: 6899240 - DNA, 22 bp, Homo sapiens
tgattgctgaattttaggaact

SEQ ID NO: 6899241 - DNA, 21 bp, Homo sapiens
ttcagtatgcgtcatgctgtt

SEQ ID NO: 6899242 - DNA, 22 bp, Homo sapiens
ttcaccagcagctcactagtca

SEQ ID NO: 6899243 - DNA, 22 bp, Homo sapiens
aatgctttgattgattaaaaca

SEQ ID NO: 6899244 - DNA, 21 bp, Homo sapiens
tcttttcctttctgtgtgcaa

SEQ ID NO: 6899245 - DNA, 22 bp, Homo sapiens
tggctttagggttccttctacc

SEQ ID NO: 6899246 - DNA, 22 bp, Homo sapiens
cccagggtggatgcaagcagca

SEQ ID NO: 6899247 - DNA, 22 bp, Homo sapiens
tcaacaattgcatgttgatgtt

SEQ ID NO: 6899248 - DNA, 22 bp, Homo sapiens
tccttgagccgtggccagggcc

SEQ ID NO: 6899249 - DNA, 22 bp, Homo sapiens
taggcagagaggccataagaat

SEQ ID NO: 6899250 - DNA, 22 bp, Homo sapiens
aagctggctaaataaaaggtcc

SEQ ID NO: 6899251 - DNA, 22 bp, Homo sapiens
caccagtgtttacctgtgacaa

SEQ ID NO: 6899252 - DNA, 22 bp, Homo sapiens
tgttactgtctcatcattggat

SEQ ID NO: 6899253 - DNA, 22 bp, Homo sapiens
tcagtcatagtttggagagaat

SEQ ID NO: 6899254 - DNA, 22 bp, Homo sapiens
tagtgtcatcgttgcagctgag

SEQ ID NO: 6899255 - DNA, 22 bp, Homo sapiens
ttctgctggtaactatgtttca

SEQ ID NO: 6899256 - DNA, 22 bp, Homo sapiens
acttgtttacaagcagttctga

SEQ ID NO: 6899257 - DNA, 18 bp, Homo sapiens
tctaccctctcagagtct

SEQ ID NO: 6899258 - DNA, 22 bp, Homo sapiens
gatctgtcctggcagttaacac

SEQ ID NO: 6899259 - DNA, 22 bp, Homo sapiens
aaggctcatcagggcatttaga

SEQ ID NO: 6899260 - DNA, 22 bp, Homo sapiens
catgggctacagaagcatgctg

SEQ ID NO: 6899261 - DNA, 23 bp, Homo sapiens
ggcagcctctgactctgctttgc

SEQ ID NO: 6899262 - DNA, 23 bp, Homo sapiens
tttgtactgcattatgagacaca

SEQ ID NO: 6899263 - DNA, 22 bp, Homo sapiens
tccagggctcattccctctgca

SEQ ID NO: 6899264 - DNA, 22 bp, Homo sapiens
tctgcctgagcagagggaggcc

SEQ ID NO: 6899265 - DNA, 22 bp, Homo sapiens
ttagcatagccattgaaatatg

SEQ ID NO: 6899266 - DNA, 22 bp, Homo sapiens
ggtggctcccacccagctttga

SEQ ID NO: 6899267 - DNA, 22 bp, Homo sapiens
gaggcagaggttgttgcagtga

SEQ ID NO: 6899268 - DNA, 22 bp, Homo sapiens
atgtgccatctactgtcccaag

SEQ ID NO: 6899269 - DNA, 22 bp, Homo sapiens
aggatacacggggatttatgta

SEQ ID NO: 6899270 - DNA, 22 bp, Homo sapiens
tattgcttattcttgagagtca

SEQ ID NO: 6899271 - DNA, 22 bp, Homo sapiens
ggctcactgcaacctccacctc

SEQ ID NO: 6899272 - DNA, 22 bp, Homo sapiens
tgacacattaaatgctcacaaa

SEQ ID NO: 6899273 - DNA, 20 bp, Homo sapiens
gtcttgtagctcaagttatt

SEQ ID NO: 6899274 - DNA, 22 bp, Homo sapiens
tgcatggcttgtgagggtttga

SEQ ID NO: 6899275 - DNA, 22 bp, Homo sapiens
caaatacttttagcctattgag

SEQ ID NO: 6899276 - DNA, 22 bp, Homo sapiens
gctgaagtcctaatcccaagta

SEQ ID NO: 6899277 - DNA, 22 bp, Homo sapiens
tgatatgggaaaagggctcgga

SEQ ID NO: 6899278 - DNA, 22 bp, Homo sapiens
catcagaatgttatggggggct

SEQ ID NO: 6899279 - DNA, 23 bp, Homo sapiens
gaacccagctctgccacttgcca

SEQ ID NO: 6899280 - DNA, 22 bp, Homo sapiens
gcactggggtcatagcctccag

SEQ ID NO: 6899281 - DNA, 22 bp, Homo sapiens
tggttcctcaagcgctggcggc

SEQ ID NO: 6899282 - DNA, 22 bp, Homo sapiens
aatatcttggcccaactccaga

SEQ ID NO: 6899283 - DNA, 22 bp, Homo sapiens
gcagctgccccgactgtgagtc

SEQ ID NO: 6899284 - DNA, 22 bp, Homo sapiens
tctggattgaggtgcaggcatt

SEQ ID NO: 6899285 - DNA, 22 bp, Homo sapiens
attatttatcctcttggtctat

SEQ ID NO: 6899286 - DNA, 22 bp, Homo sapiens
ttcctgggactggagcagccca

SEQ ID NO: 6899287 - DNA, 22 bp, Homo sapiens
ttctaatgaaatctgtacagta

SEQ ID NO: 6899288 - DNA, 22 bp, Homo sapiens
gttattgctatacatgtacact

SEQ ID NO: 6899289 - DNA, 20 bp, Homo sapiens
gctcaagagcccattctgaa

SEQ ID NO: 6899290 - DNA, 23 bp, Homo sapiens
gctgttagatttaataagcattt

SEQ ID NO: 6899291 - DNA, 22 bp, Homo sapiens
aaagggctttgtaaacttcaag

SEQ ID NO: 6899292 - DNA, 22 bp, Homo sapiens
tagctcttcaggtgcctttcac

SEQ ID NO: 6899293 - DNA, 22 bp, Homo sapiens
agtctgaaagtatgttgtaatg

SEQ ID NO: 6899294 - DNA, 19 bp, Homo sapiens
ttgagaaagttgatttggg

SEQ ID NO: 6899295 - DNA, 22 bp, Homo sapiens
gtttgttcactatgactgtggt

SEQ ID NO: 6899296 - DNA, 22 bp, Homo sapiens
gccagagcagaatagagtggcc

SEQ ID NO: 6899297 - DNA, 22 bp, Homo sapiens
aggtcataatcagttattcaaa

SEQ ID NO: 6899298 - DNA, 22 bp, Homo sapiens
ccaggaggtgaaacttcaccag

SEQ ID NO: 6899299 - DNA, 22 bp, Homo sapiens
tgaggctcagaagtgccaagtg

SEQ ID NO: 6899300 - DNA, 20 bp, Homo sapiens
tttaggcattactcttttgt

SEQ ID NO: 6899301 - DNA, 22 bp, Homo sapiens
caagtactgtgatagctgaagt

SEQ ID NO: 6899302 - DNA, 19 bp, Homo sapiens
agaatctaaattatttctg

SEQ ID NO: 6899303 - DNA, 22 bp, Homo sapiens
agaccctggagaatgaaagtgc

SEQ ID NO: 6899304 - DNA, 22 bp, Homo sapiens
aggcaaggtgctcttgctctat

SEQ ID NO: 6899305 - DNA, 22 bp, Homo sapiens
tctcaacagtgaaatgtgtttg

SEQ ID NO: 6899306 - DNA, 22 bp, Homo sapiens
aacagtcttggaagtcttgtta

SEQ ID NO: 6899307 - DNA, 22 bp, Homo sapiens
atttgcttagattcagcacttt

SEQ ID NO: 6899308 - DNA, 22 bp, Homo sapiens
ggctcagaggttgaggccggca

SEQ ID NO: 6899309 - DNA, 22 bp, Homo sapiens
gggcctgctggtgcttccattg

SEQ ID NO: 6899310 - DNA, 22 bp, Homo sapiens
gcccaggagttggaggctgcag

SEQ ID NO: 6899311 - DNA, 22 bp, Homo sapiens
gctgagctcccagcagtatctg

SEQ ID NO: 6899312 - DNA, 22 bp, Homo sapiens
cagggtacagagttttctaaac

SEQ ID NO: 6899313 - DNA, 21 bp, Homo sapiens
atccattctccggttaatgag

SEQ ID NO: 6899314 - DNA, 22 bp, Homo sapiens
cagctctactgggcaccattcg

SEQ ID NO: 6899315 - DNA, 22 bp, Homo sapiens
ggaacactcagaaatgctcgtc

SEQ ID NO: 6899316 - DNA, 20 bp, Homo sapiens
ctgggctcggtggccctggc

SEQ ID NO: 6899317 - DNA, 22 bp, Homo sapiens
ctggctggaggtgagtcactga

SEQ ID NO: 6899318 - DNA, 19 bp, Homo sapiens
tctgaattatttatgtacc

SEQ ID NO: 6899319 - DNA, 15 bp, Homo sapiens
tttcaaaatgaggcc

SEQ ID NO: 6899320 - DNA, 19 bp, Homo sapiens
actcaggcttcctctgagg

SEQ ID NO: 6899321 - DNA, 22 bp, Homo sapiens
tgcaaagatatgagaagctgta

SEQ ID NO: 6899322 - DNA, 19 bp, Homo sapiens
cagtttgtccagaggggac

SEQ ID NO: 6899323 - DNA, 22 bp, Homo sapiens
taacaactcagtttgttccttg

SEQ ID NO: 6899324 - DNA, 22 bp, Homo sapiens
agatttctctttccctggctga

SEQ ID NO: 6899325 - DNA, 22 bp, Homo sapiens
ctgtaatcccagctactcggga

SEQ ID NO: 6899326 - DNA, 22 bp, Homo sapiens
ggctcacaacagttttctgtaa

SEQ ID NO: 6899327 - DNA, 22 bp, Homo sapiens
tctagaggccagggacactgct

SEQ ID NO: 6899328 - DNA, 22 bp, Homo sapiens
agttttcagaaattgcgaccca

SEQ ID NO: 6899329 - DNA, 22 bp, Homo sapiens
ttgaaagttaggatttagctgg

SEQ ID NO: 6899330 - DNA, 22 bp, Homo sapiens
ttaggcattggaaggtcagctt

SEQ ID NO: 6899331 - DNA, 22 bp, Homo sapiens
cagtagcaggcaggtgcttttg

SEQ ID NO: 6899332 - DNA, 19 bp, Homo sapiens
aaaggcagtgggtggcgtg

SEQ ID NO: 6899333 - DNA, 22 bp, Homo sapiens
caggcagggagctggaaaggat

SEQ ID NO: 6899334 - DNA, 18 bp, Homo sapiens
aaaatgcaggcgacatgg

SEQ ID NO: 6899335 - DNA, 22 bp, Homo sapiens
actgtgtattcctatatagtaa

SEQ ID NO: 6899336 - DNA, 22 bp, Homo sapiens
caaatctacatgaacccaaaga

SEQ ID NO: 6899337 - DNA, 22 bp, Homo sapiens
ttagttgatcattcaacatggg

SEQ ID NO: 6899338 - DNA, 22 bp, Homo sapiens
ggtggggccctggcactggtat

SEQ ID NO: 6899339 - DNA, 22 bp, Homo sapiens
aaggaaggtactcagtgattct

SEQ ID NO: 6899340 - DNA, 22 bp, Homo sapiens
caaatgtttgcatcacagggca

SEQ ID NO: 6899341 - DNA, 22 bp, Homo sapiens
gctaattcacagtaggaaattt

SEQ ID NO: 6899342 - DNA, 22 bp, Homo sapiens
tgacagtctgcagttttaaaaa

SEQ ID NO: 6899343 - DNA, 22 bp, Homo sapiens
aatgcacatgtcttggcctcac

SEQ ID NO: 6899344 - DNA, 22 bp, Homo sapiens
ctctccaggggtagatgccttc

SEQ ID NO: 6899345 - DNA, 22 bp, Homo sapiens
ggaatgtaacgtgaccaagttc

SEQ ID NO: 6899346 - DNA, 22 bp, Homo sapiens
caatgacactctgcacagtgct

SEQ ID NO: 6899347 - DNA, 22 bp, Homo sapiens
aaagctgctttggtttctggaa

SEQ ID NO: 6899348 - DNA, 22 bp, Homo sapiens
caggcaggctgctttttgttca

SEQ ID NO: 6899349 - DNA, 22 bp, Homo sapiens
aaagcctcccaggttatgagta

SEQ ID NO: 6899350 - DNA, 22 bp, Homo sapiens
aagaggcagaaatatcgctgaa

SEQ ID NO: 6899351 - DNA, 22 bp, Homo sapiens
tgtctgagtgcatatgtgctgg

SEQ ID NO: 6899352 - DNA, 22 bp, Homo sapiens
agacctaaagtacccagcatat

SEQ ID NO: 6899353 - DNA, 22 bp, Homo sapiens
tatgctttgaaaatgtgctgaa

SEQ ID NO: 6899354 - DNA, 22 bp, Homo sapiens
tttcttatactatattgtcatc

SEQ ID NO: 6899355 - DNA, 18 bp, Homo sapiens
tggcagctaggtaaagaa

SEQ ID NO: 6899356 - DNA, 22 bp, Homo sapiens
tggtggctaccaggtcctgggg

SEQ ID NO: 6899357 - DNA, 22 bp, Homo sapiens
acaggagaattatctggaacaa

SEQ ID NO: 6899358 - DNA, 22 bp, Homo sapiens
attagattgtaaatgttttcac

SEQ ID NO: 6899359 - DNA, 22 bp, Homo sapiens
tctcctggtttgttaaataatt

SEQ ID NO: 6899360 - DNA, 22 bp, Homo sapiens
gttcagaaaacattggaataca

SEQ ID NO: 6899361 - DNA, 22 bp, Homo sapiens
agaagtgaggaaatcctcttta

SEQ ID NO: 6899362 - DNA, 22 bp, Homo sapiens
gctccaggataataaagttgtt

SEQ ID NO: 6899363 - DNA, 22 bp, Homo sapiens
atgcactgcccctctgcacctc

SEQ ID NO: 6899364 - DNA, 22 bp, Homo sapiens
ggcactgacactagcatggcac

SEQ ID NO: 6899365 - DNA, 22 bp, Homo sapiens
taaatccttatcttctttgaat

SEQ ID NO: 6899366 - DNA, 22 bp, Homo sapiens
tccaggaatgtgtgtgggctag

SEQ ID NO: 6899367 - DNA, 22 bp, Homo sapiens
ctgctctgagtattaacggagg

SEQ ID NO: 6899368 - DNA, 22 bp, Homo sapiens
atttacaggacagcttggcatt

SEQ ID NO: 6899369 - DNA, 22 bp, Homo sapiens
tagtactgtaaaactggaaaac

SEQ ID NO: 6899370 - DNA, 22 bp, Homo sapiens
gtgaaatattttgtttatgtca

SEQ ID NO: 6899371 - DNA, 22 bp, Homo sapiens
ggaacttaataagttttgtaat

SEQ ID NO: 6899372 - DNA, 22 bp, Homo sapiens
ttatttatatctctgcagttta

SEQ ID NO: 6899373 - DNA, 22 bp, Homo sapiens
tgaatgtaggcacatgcaaatg

SEQ ID NO: 6899374 - DNA, 22 bp, Homo sapiens
actgccttcaaacagcgccacc

SEQ ID NO: 6899375 - DNA, 22 bp, Homo sapiens
ctcagccatggggtggatcagc

SEQ ID NO: 6899376 - DNA, 22 bp, Homo sapiens
ggctgagtgctgctgttcacga

SEQ ID NO: 6899377 - DNA, 22 bp, Homo sapiens
aaagagctcggaaagtgttgaa

SEQ ID NO: 6899378 - DNA, 22 bp, Homo sapiens
ccttagctggagtggtggaatg

SEQ ID NO: 6899379 - DNA, 22 bp, Homo sapiens
aaggcagcaactaatggatctc

SEQ ID NO: 6899380 - DNA, 22 bp, Homo sapiens
tcactacagtgtagagattagg

SEQ ID NO: 6899381 - DNA, 22 bp, Homo sapiens
agaggcaatgaaagcagtctct

SEQ ID NO: 6899382 - DNA, 20 bp, Homo sapiens
cagtcctgtccctgctgccc

SEQ ID NO: 6899383 - DNA, 22 bp, Homo sapiens
gagacggggtttgagacgggtt

SEQ ID NO: 6899384 - DNA, 22 bp, Homo sapiens
caggctcccgaaatcacccatg

SEQ ID NO: 6899385 - DNA, 22 bp, Homo sapiens
tggctttatgtgttacgaaaat

SEQ ID NO: 6899386 - DNA, 22 bp, Homo sapiens
agatttgccatggatgttcttt

SEQ ID NO: 6899387 - DNA, 22 bp, Homo sapiens
gtttgaatgcagtatgcatttt

SEQ ID NO: 6899388 - DNA, 22 bp, Homo sapiens
ggccacagtctctggaaggatg

SEQ ID NO: 6899389 - DNA, 22 bp, Homo sapiens
agggctgcaggcaagatatggc

SEQ ID NO: 6899390 - DNA, 22 bp, Homo sapiens
cggtctgagatttttaataggc

SEQ ID NO: 6899391 - DNA, 23 bp, Homo sapiens
aggtcctggacatatgtgcatca

SEQ ID NO: 6899392 - DNA, 22 bp, Homo sapiens
agcagcatgttgggatgtgaaa

SEQ ID NO: 6899393 - DNA, 22 bp, Homo sapiens
attagcttagtgtttccgtaat

SEQ ID NO: 6899394 - DNA, 22 bp, Homo sapiens
aaatgtctgttagtcatatcat

SEQ ID NO: 6899395 - DNA, 22 bp, Homo sapiens
ttctccaatagctgctcatggc

SEQ ID NO: 6899396 - DNA, 22 bp, Homo sapiens
agagatttgtcaatgatttcca

SEQ ID NO: 6899397 - DNA, 22 bp, Homo sapiens
ttggacacagctggcctttcca

SEQ ID NO: 6899398 - DNA, 22 bp, Homo sapiens
agggtcacaatgtgtgaattgg

SEQ ID NO: 6899399 - DNA, 22 bp, Homo sapiens
ggacccaggggtctctctgtcc

SEQ ID NO: 6899400 - DNA, 22 bp, Homo sapiens
tctggcccctggtctctggtgt

SEQ ID NO: 6899401 - DNA, 22 bp, Homo sapiens
gactcctctctaacccactgga

SEQ ID NO: 6899402 - DNA, 22 bp, Homo sapiens
tccctgcagacgtcctgcgggt

SEQ ID NO: 6899403 - DNA, 23 bp, Homo sapiens
tgctggagacaagtgtgagaagg

SEQ ID NO: 6899404 - DNA, 22 bp, Homo sapiens
gtgcctggtttggggaatgttc

SEQ ID NO: 6899405 - DNA, 22 bp, Homo sapiens
cactgcactccatcctgggaaa

SEQ ID NO: 6899406 - DNA, 18 bp, Homo sapiens
ggctccaggacctaccca

SEQ ID NO: 6899407 - DNA, 22 bp, Homo sapiens
cattcttgcaccgtgatggctt

SEQ ID NO: 6899408 - DNA, 22 bp, Homo sapiens
tttgaacatcactgtagggtga

SEQ ID NO: 6899409 - DNA, 22 bp, Homo sapiens
cagcccatccaaggcttggcat

SEQ ID NO: 6899410 - DNA, 22 bp, Homo sapiens
cagaggcctatccagtgtccat

SEQ ID NO: 6899411 - DNA, 20 bp, Homo sapiens
ctttagttattaacagcact

SEQ ID NO: 6899412 - DNA, 22 bp, Homo sapiens
acacagagtatcttttgcctag

SEQ ID NO: 6899413 - DNA, 22 bp, Homo sapiens
aagatatgaggtcacctgctgg

SEQ ID NO: 6899414 - DNA, 21 bp, Homo sapiens
tggctggtggcagggcttctc

SEQ ID NO: 6899415 - DNA, 22 bp, Homo sapiens
ttcattgatttaacaaacaagt

SEQ ID NO: 6899416 - DNA, 22 bp, Homo sapiens
tcctgggagcatggtgccgtga

SEQ ID NO: 6899417 - DNA, 22 bp, Homo sapiens
gatttgcattctgaaagctacc

SEQ ID NO: 6899418 - DNA, 22 bp, Homo sapiens
catcagtgtctctctggtactt

SEQ ID NO: 6899419 - DNA, 22 bp, Homo sapiens
gtcatgtatgttggaacagtgg

SEQ ID NO: 6899420 - DNA, 22 bp, Homo sapiens
ggagctgttgattgtttgagga

SEQ ID NO: 6899421 - DNA, 22 bp, Homo sapiens
gtacaactccccaggcactgct

SEQ ID NO: 6899422 - DNA, 22 bp, Homo sapiens
agctgcctggagtcatttcctg

SEQ ID NO: 6899423 - DNA, 22 bp, Homo sapiens
aaagcatggttaaagacagtgg

SEQ ID NO: 6899424 - DNA, 22 bp, Homo sapiens
tacaagaaatttctgcatatat

SEQ ID NO: 6899425 - DNA, 20 bp, Homo sapiens
ggaaggctgtttttccacca

SEQ ID NO: 6899426 - DNA, 22 bp, Homo sapiens
cactgagcaagtcagtacagca

SEQ ID NO: 6899427 - DNA, 22 bp, Homo sapiens
cctgcaggttgcagaggcggaa

SEQ ID NO: 6899428 - DNA, 18 bp, Homo sapiens
gtctgtgtggcttgggga

SEQ ID NO: 6899429 - DNA, 22 bp, Homo sapiens
aggatgaatatttagtgggata

SEQ ID NO: 6899430 - DNA, 20 bp, Homo sapiens
atccttggcagaatccagga

SEQ ID NO: 6899431 - DNA, 22 bp, Homo sapiens
atagaagcaagaacagaatgga

SEQ ID NO: 6899432 - DNA, 22 bp, Homo sapiens
agctaagatttattaaaggccc

SEQ ID NO: 6899433 - DNA, 14 bp, Homo sapiens
gcaggtggatcact

SEQ ID NO: 6899434 - DNA, 22 bp, Homo sapiens
tgatttaccagttactatcttg

SEQ ID NO: 6899435 - DNA, 22 bp, Homo sapiens
gctgcagggaatgtatggattt

SEQ ID NO: 6899436 - DNA, 22 bp, Homo sapiens
tttacagggttcaagaatgaaa

SEQ ID NO: 6899437 - DNA, 22 bp, Homo sapiens
tgatgtaggacattattatttc

SEQ ID NO: 6899438 - DNA, 22 bp, Homo sapiens
tattgcagaatgtgagttggca

SEQ ID NO: 6899439 - DNA, 21 bp, Homo sapiens
atttccacataatcataagac

SEQ ID NO: 6899440 - DNA, 22 bp, Homo sapiens
tacatctatctagatgctcaga

SEQ ID NO: 6899441 - DNA, 22 bp, Homo sapiens
ttgaaaacatttatattagaat

SEQ ID NO: 6899442 - DNA, 22 bp, Homo sapiens
atctggctcttcctggagttcc

SEQ ID NO: 6899443 - DNA, 22 bp, Homo sapiens
gtccttcttttcatccctggtt

SEQ ID NO: 6899444 - DNA, 21 bp, Homo sapiens
tccctgagttctctgagcatc

SEQ ID NO: 6899445 - DNA, 22 bp, Homo sapiens
tccaggcctttgcacatgttgt

SEQ ID NO: 6899446 - DNA, 22 bp, Homo sapiens
gtgagctttgtggtaatgaagt

SEQ ID NO: 6899447 - DNA, 22 bp, Homo sapiens
ggagtgagtggccttgtcactg

SEQ ID NO: 6899448 - DNA, 22 bp, Homo sapiens
acacttctcccatctcctgttg

SEQ ID NO: 6899449 - DNA, 22 bp, Homo sapiens
tcacgttaatatttgtcaggta

SEQ ID NO: 6899450 - DNA, 22 bp, Homo sapiens
cagttccctccgccagcacttc

SEQ ID NO: 6899451 - DNA, 22 bp, Homo sapiens
gcagtgccacaagatgggagga

SEQ ID NO: 6899452 - DNA, 22 bp, Homo sapiens
acatgctgggcaatgttgtttt

SEQ ID NO: 6899453 - DNA, 22 bp, Homo sapiens
tggggcagagtaggattttggc

SEQ ID NO: 6899454 - DNA, 22 bp, Homo sapiens
atgtgcagaggcttccttgact

SEQ ID NO: 6899455 - DNA, 22 bp, Homo sapiens
attgcagtgttgcctggggcct

SEQ ID NO: 6899456 - DNA, 22 bp, Homo sapiens
aaagttctctatggtgtaaaaa

SEQ ID NO: 6899457 - DNA, 22 bp, Homo sapiens
atctctagtcttctccatggga

SEQ ID NO: 6899458 - DNA, 20 bp, Homo sapiens
atgccctgtcctcttctgtt

SEQ ID NO: 6899459 - DNA, 20 bp, Homo sapiens
actttactgagctgtaattc

SEQ ID NO: 6899460 - DNA, 22 bp, Homo sapiens
gcaaagtgaaatggggcagaga

SEQ ID NO: 6899461 - DNA, 22 bp, Homo sapiens
gaagtccagatcaagtcaccag

SEQ ID NO: 6899462 - DNA, 22 bp, Homo sapiens
gtgaaggtggggagcctcagtt

SEQ ID NO: 6899463 - DNA, 23 bp, Homo sapiens
cagagggttccatggagcatggt

SEQ ID NO: 6899464 - DNA, 22 bp, Homo sapiens
tttcctttgagggtcctacact

SEQ ID NO: 6899465 - DNA, 22 bp, Homo sapiens
agctgcagcgttcatttttcca

SEQ ID NO: 6899466 - DNA, 22 bp, Homo sapiens
actcacaggactctgcatatag

SEQ ID NO: 6899467 - DNA, 22 bp, Homo sapiens
cccttcctggagtaccctctgt

SEQ ID NO: 6899468 - DNA, 22 bp, Homo sapiens
ggaccctgtaaagtcgtgtcca

SEQ ID NO: 6899469 - DNA, 22 bp, Homo sapiens
tctggaaggcttcaaggtctaa

SEQ ID NO: 6899470 - DNA, 22 bp, Homo sapiens
ttagccttagaagcttagcaaa

SEQ ID NO: 6899471 - DNA, 22 bp, Homo sapiens
aggcaggctctgggtatgtgca

SEQ ID NO: 6899472 - DNA, 22 bp, Homo sapiens
tggcagggttggccaccttacc

SEQ ID NO: 6899473 - DNA, 22 bp, Homo sapiens
atagattcattctatttctccg

SEQ ID NO: 6899474 - DNA, 22 bp, Homo sapiens
ttagaggcatgattcagtaaag

SEQ ID NO: 6899475 - DNA, 22 bp, Homo sapiens
gctcccagaaccaaggctgggg

SEQ ID NO: 6899476 - DNA, 22 bp, Homo sapiens
tgcagcaggttccaaagggtta

SEQ ID NO: 6899477 - DNA, 22 bp, Homo sapiens
cttagattttcaatgtgaacta

SEQ ID NO: 6899478 - DNA, 22 bp, Homo sapiens
tttctccagaagaggaagcgga

SEQ ID NO: 6899479 - DNA, 22 bp, Homo sapiens
atgtagagcagtgttgtccaat

SEQ ID NO: 6899480 - DNA, 22 bp, Homo sapiens
tgctggtgattaaatcctgaag

SEQ ID NO: 6899481 - DNA, 22 bp, Homo sapiens
gctgtgagggcttctgaggcat

SEQ ID NO: 6899482 - DNA, 22 bp, Homo sapiens
acccactgtagccactctgggt

SEQ ID NO: 6899483 - DNA, 22 bp, Homo sapiens
ttagcattcttctggggggcac

SEQ ID NO: 6899484 - DNA, 23 bp, Homo sapiens
agcttttaggtggaaatggcact

SEQ ID NO: 6899485 - DNA, 22 bp, Homo sapiens
cttctagagtaaggaacaaatg

SEQ ID NO: 6899486 - DNA, 20 bp, Homo sapiens
acattttggcatactctcaa

SEQ ID NO: 6899487 - DNA, 22 bp, Homo sapiens
tgcctgcccacgactacagcag

SEQ ID NO: 6899488 - DNA, 22 bp, Homo sapiens
ggtaggcaaactacagttagct

SEQ ID NO: 6899489 - DNA, 22 bp, Homo sapiens
gcattttataaagagttatttg

SEQ ID NO: 6899490 - DNA, 22 bp, Homo sapiens
cagtaataagctggagggtgtg

SEQ ID NO: 6899491 - DNA, 22 bp, Homo sapiens
aaattccattttgtgactattc

SEQ ID NO: 6899492 - DNA, 22 bp, Homo sapiens
acgaaggaatgtgcttgagcat

SEQ ID NO: 6899493 - DNA, 22 bp, Homo sapiens
tatcatcttgttgtcatgcagc

SEQ ID NO: 6899494 - DNA, 22 bp, Homo sapiens
taagacacattgagaaacacaa

SEQ ID NO: 6899495 - DNA, 22 bp, Homo sapiens
gattctggcaaaatcctggctt

SEQ ID NO: 6899496 - DNA, 22 bp, Homo sapiens
agtcccagatctccattcggtc

SEQ ID NO: 6899497 - DNA, 18 bp, Homo sapiens
aactgttgaaatagcttg

SEQ ID NO: 6899498 - DNA, 22 bp, Homo sapiens
ctgggcagtgggcaagttgtat

SEQ ID NO: 6899499 - DNA, 20 bp, Homo sapiens
aacagtcaaatgttgattgc

SEQ ID NO: 6899500 - DNA, 22 bp, Homo sapiens
gcaggtcttgaaggtgtgattt

SEQ ID NO: 6899501 - DNA, 22 bp, Homo sapiens
gggaatgtaattaatctccttc

SEQ ID NO: 6899502 - DNA, 22 bp, Homo sapiens
ctctgtagaaagagcccaggtg

SEQ ID NO: 6899503 - DNA, 22 bp, Homo sapiens
ttgatcatttttctggtaaaat

SEQ ID NO: 6899504 - DNA, 22 bp, Homo sapiens
aattgctttacaagccgtttaa

SEQ ID NO: 6899505 - DNA, 22 bp, Homo sapiens
gatgcagggggaacgacgccct

SEQ ID NO: 6899506 - DNA, 22 bp, Homo sapiens
agaagtccagtgtgtatcaggg

SEQ ID NO: 6899507 - DNA, 22 bp, Homo sapiens
gtgagtcttaagcaccaccttt

SEQ ID NO: 6899508 - DNA, 22 bp, Homo sapiens
cggagcagagccactcgggccg

SEQ ID NO: 6899509 - DNA, 22 bp, Homo sapiens
taaacagaaagcagatgtactt

SEQ ID NO: 6899510 - DNA, 22 bp, Homo sapiens
accagcaggtggcagtatgtat

SEQ ID NO: 6899511 - DNA, 22 bp, Homo sapiens
gtgacagagtgagaccctgtct

SEQ ID NO: 6899512 - DNA, 22 bp, Homo sapiens
acctggccccactgtgctgctg

SEQ ID NO: 6899513 - DNA, 20 bp, Homo sapiens
ttaggcatttggattggctt

SEQ ID NO: 6899514 - DNA, 23 bp, Homo sapiens
gtgaaggtttctgcatttattgg

SEQ ID NO: 6899515 - DNA, 22 bp, Homo sapiens
caggaaaaggagactttagcac

SEQ ID NO: 6899516 - DNA, 22 bp, Homo sapiens
agtgtatttgcctataaaaatg

SEQ ID NO: 6899517 - DNA, 22 bp, Homo sapiens
aggtctcaattcctgctcctgt

SEQ ID NO: 6899518 - DNA, 22 bp, Homo sapiens
aaatgtttaagtgtaggagcaa

SEQ ID NO: 6899519 - DNA, 22 bp, Homo sapiens
tctcattcttcagtggctttgt

SEQ ID NO: 6899520 - DNA, 22 bp, Homo sapiens
gcaggaatatagtatttcgagg

SEQ ID NO: 6899521 - DNA, 22 bp, Homo sapiens
ctatttgtaaagtgcctggtgt

SEQ ID NO: 6899522 - DNA, 22 bp, Homo sapiens
tactagaaaaacacatgctctg

SEQ ID NO: 6899523 - DNA, 22 bp, Homo sapiens
aaatctgagaaatattgtccag

SEQ ID NO: 6899524 - DNA, 22 bp, Homo sapiens
cagattctccaggggctgcaga

SEQ ID NO: 6899525 - DNA, 22 bp, Homo sapiens
tggagcagctctagcgggcgcc

SEQ ID NO: 6899526 - DNA, 22 bp, Homo sapiens
aaagatcacactgtggggcagt

SEQ ID NO: 6899527 - DNA, 22 bp, Homo sapiens
tagctacaatcactgtcctttg

SEQ ID NO: 6899528 - DNA, 22 bp, Homo sapiens
cagcagcctagaagctctacca

SEQ ID NO: 6899529 - DNA, 22 bp, Homo sapiens
ggccagctgtaagctgctgaat

SEQ ID NO: 6899530 - DNA, 22 bp, Homo sapiens
aaagatttgagttctgcttata

SEQ ID NO: 6899531 - DNA, 21 bp, Homo sapiens
aactaaggaactgaaaaatgg

SEQ ID NO: 6899532 - DNA, 22 bp, Homo sapiens
gcccttggaaagccaaggcagc

SEQ ID NO: 6899533 - DNA, 22 bp, Homo sapiens
ttgtggcatgtgagaactagaa

SEQ ID NO: 6899534 - DNA, 22 bp, Homo sapiens
ggaggccaaggaggagcttgcc

SEQ ID NO: 6899535 - DNA, 22 bp, Homo sapiens
gagtgagttggaaaacagacac

SEQ ID NO: 6899536 - DNA, 23 bp, Homo sapiens
tctcaaatctttgcgttgtatct

SEQ ID NO: 6899537 - DNA, 22 bp, Homo sapiens
aggccttcctcggagacaggga

SEQ ID NO: 6899538 - DNA, 22 bp, Homo sapiens
acactggttggttgaatttact

SEQ ID NO: 6899539 - DNA, 22 bp, Homo sapiens
ctctgggtgtcatggcctcagc

SEQ ID NO: 6899540 - DNA, 19 bp, Homo sapiens
tgttcagatatgtcagctt

SEQ ID NO: 6899541 - DNA, 17 bp, Homo sapiens
ttcttttctgagccttg

SEQ ID NO: 6899542 - DNA, 22 bp, Homo sapiens
tccggcggccggcctgagcccg

SEQ ID NO: 6899543 - DNA, 22 bp, Homo sapiens
aatattttaggctttccaggct

SEQ ID NO: 6899544 - DNA, 22 bp, Homo sapiens
ctaggtggtggtgggttgacat

SEQ ID NO: 6899545 - DNA, 22 bp, Homo sapiens
taagttctgaagataggaaatg

SEQ ID NO: 6899546 - DNA, 22 bp, Homo sapiens
acacatatggttggtaggagtt

SEQ ID NO: 6899547 - DNA, 22 bp, Homo sapiens
ctgtaaagatcacagagctggt

SEQ ID NO: 6899548 - DNA, 22 bp, Homo sapiens
agtgtattgattggaacagcct

SEQ ID NO: 6899549 - DNA, 18 bp, Homo sapiens
gccagctgcacggccctc

SEQ ID NO: 6899550 - DNA, 22 bp, Homo sapiens
gtcctaccatgaattcactcca

SEQ ID NO: 6899551 - DNA, 22 bp, Homo sapiens
acagtgttcttgatattacagt

SEQ ID NO: 6899552 - DNA, 22 bp, Homo sapiens
ccatcctgtctgtggcctcagg

SEQ ID NO: 6899553 - DNA, 22 bp, Homo sapiens
tccagagcctgcgcactggctg

SEQ ID NO: 6899554 - DNA, 22 bp, Homo sapiens
tctgcctgaaccactcttggag

SEQ ID NO: 6899555 - DNA, 22 bp, Homo sapiens
ctgaccagaccccaggaggctg

SEQ ID NO: 6899556 - DNA, 19 bp, Homo sapiens
atgtctgttgaatttcata

SEQ ID NO: 6899557 - DNA, 22 bp, Homo sapiens
atgctattttacataggaatgg

SEQ ID NO: 6899558 - DNA, 22 bp, Homo sapiens
gttacatttattagaggtctct

SEQ ID NO: 6899559 - DNA, 22 bp, Homo sapiens
attattagacttatatggtagt

SEQ ID NO: 6899560 - DNA, 22 bp, Homo sapiens
acagatatttggggaaagacgt

SEQ ID NO: 6899561 - DNA, 22 bp, Homo sapiens
aacagcagttacttttgcatca

SEQ ID NO: 6899562 - DNA, 22 bp, Homo sapiens
taacatcctacactgttgtctt

SEQ ID NO: 6899563 - DNA, 22 bp, Homo sapiens
ttgataaaatgatgaaatcact

SEQ ID NO: 6899564 - DNA, 19 bp, Homo sapiens
tttgacagagtttgagcat

SEQ ID NO: 6899565 - DNA, 22 bp, Homo sapiens
tctttggaagctttcagagaag

SEQ ID NO: 6899566 - DNA, 22 bp, Homo sapiens
agatttctgggcttcaccacct

SEQ ID NO: 6899567 - DNA, 22 bp, Homo sapiens
agtgcttttattatatacagga

SEQ ID NO: 6899568 - DNA, 22 bp, Homo sapiens
aatgaataacaatcctctggag

SEQ ID NO: 6899569 - DNA, 19 bp, Homo sapiens
atggctgctgattggggat

SEQ ID NO: 6899570 - DNA, 22 bp, Homo sapiens
gttcttcagcattagaagtcat

SEQ ID NO: 6899571 - DNA, 22 bp, Homo sapiens
cctacagttatattcttgattg

SEQ ID NO: 6899572 - DNA, 22 bp, Homo sapiens
cagcagtcaggcctgtgggaga

SEQ ID NO: 6899573 - DNA, 22 bp, Homo sapiens
tggctgaataaaatatggtgtt

SEQ ID NO: 6899574 - DNA, 22 bp, Homo sapiens
gtgctctatgttgattccttga

SEQ ID NO: 6899575 - DNA, 22 bp, Homo sapiens
ggacatctcttgccagggctgc

SEQ ID NO: 6899576 - DNA, 22 bp, Homo sapiens
gccagctcagtttcaaagtagg

SEQ ID NO: 6899577 - DNA, 22 bp, Homo sapiens
ctttagaatttgatataatcaa

SEQ ID NO: 6899578 - DNA, 22 bp, Homo sapiens
tggatcttcacaagagagggcg

SEQ ID NO: 6899579 - DNA, 22 bp, Homo sapiens
attactccttttctagcaggtg

SEQ ID NO: 6899580 - DNA, 22 bp, Homo sapiens
tcacggacctaagaggaagatt

SEQ ID NO: 6899581 - DNA, 22 bp, Homo sapiens
cccaggaaagaaagtatatggt

SEQ ID NO: 6899582 - DNA, 22 bp, Homo sapiens
caggcactgtgcctcgctccct

SEQ ID NO: 6899583 - DNA, 22 bp, Homo sapiens
agacaaatggtaattatgtcta

SEQ ID NO: 6899584 - DNA, 22 bp, Homo sapiens
cccagaggaggatctcggcccg

SEQ ID NO: 6899585 - DNA, 22 bp, Homo sapiens
ctggggatcctttttgcatcta

SEQ ID NO: 6899586 - DNA, 22 bp, Homo sapiens
tccagctcctctacccgatgcg

SEQ ID NO: 6899587 - DNA, 22 bp, Homo sapiens
ttcacaggagggtggatgcatg

SEQ ID NO: 6899588 - DNA, 22 bp, Homo sapiens
attactcctagaatgcatttag

SEQ ID NO: 6899589 - DNA, 22 bp, Homo sapiens
gagtcagctagtctccttcttt

SEQ ID NO: 6899590 - DNA, 22 bp, Homo sapiens
ggtcatagagctggaaattggc

SEQ ID NO: 6899591 - DNA, 22 bp, Homo sapiens
tttctatctgagaagatatcta

SEQ ID NO: 6899592 - DNA, 22 bp, Homo sapiens
cactgagagtagggcacaagtg

SEQ ID NO: 6899593 - DNA, 22 bp, Homo sapiens
tgcctgtctttcctccctcgta

SEQ ID NO: 6899594 - DNA, 22 bp, Homo sapiens
cattagacacagatgtataaat

SEQ ID NO: 6899595 - DNA, 22 bp, Homo sapiens
tacagtagctgaggttctcagg

SEQ ID NO: 6899596 - DNA, 22 bp, Homo sapiens
tgagccaggcactgctcctgga

SEQ ID NO: 6899597 - DNA, 22 bp, Homo sapiens
aaccccaaaacctctgaagtgg

SEQ ID NO: 6899598 - DNA, 22 bp, Homo sapiens
gggagggtctgccatgctccct

SEQ ID NO: 6899599 - DNA, 22 bp, Homo sapiens
acacagttcttagcaggtgtct

SEQ ID NO: 6899600 - DNA, 22 bp, Homo sapiens
ctgtgtttctcttgacccaagt

SEQ ID NO: 6899601 - DNA, 22 bp, Homo sapiens
aatctacatttcagttttgccc

SEQ ID NO: 6899602 - DNA, 16 bp, Homo sapiens
gggctgggggattctg

SEQ ID NO: 6899603 - DNA, 22 bp, Homo sapiens
gaaaatgttagcttcatagtca

SEQ ID NO: 6899604 - DNA, 22 bp, Homo sapiens
ctgggctgcagttcctggtcct

SEQ ID NO: 6899605 - DNA, 22 bp, Homo sapiens
tgcatccttccatgggtttcaa

SEQ ID NO: 6899606 - DNA, 22 bp, Homo sapiens
ctgcgcagatctgctgttctct

SEQ ID NO: 6899607 - DNA, 22 bp, Homo sapiens
gcaccagggagggtgtgcttca

SEQ ID NO: 6899608 - DNA, 22 bp, Homo sapiens
agtaatggagcaggaaatacat

SEQ ID NO: 6899609 - DNA, 22 bp, Homo sapiens
actgggaaaagctatggcaaat

SEQ ID NO: 6899610 - DNA, 22 bp, Homo sapiens
gagtccacttaagtatctgcag

SEQ ID NO: 6899611 - DNA, 22 bp, Homo sapiens
ctctggtttctgacctgaattt

SEQ ID NO: 6899612 - DNA, 21 bp, Homo sapiens
cagtggcagttcttgcctctg

SEQ ID NO: 6899613 - DNA, 23 bp, Homo sapiens
acaaatgtctagagagggtgtga

SEQ ID NO: 6899614 - DNA, 22 bp, Homo sapiens
catttcaagcattgacttctat

SEQ ID NO: 6899615 - DNA, 18 bp, Homo sapiens
aagtccttcctttgcttt

SEQ ID NO: 6899616 - DNA, 21 bp, Homo sapiens
tcagggactaggtactgggga

SEQ ID NO: 6899617 - DNA, 22 bp, Homo sapiens
tggcaggcgggagccatagagg

SEQ ID NO: 6899618 - DNA, 22 bp, Homo sapiens
ttgcacagaatgacaatatgta

SEQ ID NO: 6899619 - DNA, 22 bp, Homo sapiens
cacaagaaataagctgcctttc

SEQ ID NO: 6899620 - DNA, 22 bp, Homo sapiens
atttgcttgactatggcttgca

SEQ ID NO: 6899621 - DNA, 23 bp, Homo sapiens
ggacacatttatttcagaattca

SEQ ID NO: 6899622 - DNA, 22 bp, Homo sapiens
gcctggaagacgtcttggcttc

SEQ ID NO: 6899623 - DNA, 22 bp, Homo sapiens
gacgagagactccatccaccac

SEQ ID NO: 6899624 - DNA, 22 bp, Homo sapiens
tatgtgcaaaatgctagactag

SEQ ID NO: 6899625 - DNA, 22 bp, Homo sapiens
cccaggctggatttcggtggca

SEQ ID NO: 6899626 - DNA, 22 bp, Homo sapiens
atgtttactggtttatagaata

SEQ ID NO: 6899627 - DNA, 22 bp, Homo sapiens
tgcattcatcatttgaaagccc

SEQ ID NO: 6899628 - DNA, 22 bp, Homo sapiens
tccatcaggctcgtgggctctc

SEQ ID NO: 6899629 - DNA, 22 bp, Homo sapiens
gctgcaggctctgcaggaattg

SEQ ID NO: 6899630 - DNA, 22 bp, Homo sapiens
atgcagctgtcagggagaacat

SEQ ID NO: 6899631 - DNA, 22 bp, Homo sapiens
gctttatggattgtaaactgca

SEQ ID NO: 6899632 - DNA, 22 bp, Homo sapiens
gtctggagccactgctgctgct

SEQ ID NO: 6899633 - DNA, 22 bp, Homo sapiens
tctcctctactgggtctgcaga

SEQ ID NO: 6899634 - DNA, 22 bp, Homo sapiens
gctatttttgagccatttataa

SEQ ID NO: 6899635 - DNA, 22 bp, Homo sapiens
ggtcagtgcctatcatgtgggc

SEQ ID NO: 6899636 - DNA, 22 bp, Homo sapiens
atcttgggccacaatgagccga

SEQ ID NO: 6899637 - DNA, 21 bp, Homo sapiens
gccgctgctgcgtgtcccttt

SEQ ID NO: 6899638 - DNA, 22 bp, Homo sapiens
ttctggtggccagaagtctgaa

SEQ ID NO: 6899639 - DNA, 22 bp, Homo sapiens
aaatacagattcttgtgtctat

SEQ ID NO: 6899640 - DNA, 22 bp, Homo sapiens
taattgtgggaaggcttttaat

SEQ ID NO: 6899641 - DNA, 22 bp, Homo sapiens
tccattctatgcttacatttat

SEQ ID NO: 6899642 - DNA, 22 bp, Homo sapiens
tagctagggtaagacttggacc

SEQ ID NO: 6899643 - DNA, 22 bp, Homo sapiens
aagtgtgggaagttgctaaaat

SEQ ID NO: 6899644 - DNA, 22 bp, Homo sapiens
attgttccatgttatatcacga

SEQ ID NO: 6899645 - DNA, 22 bp, Homo sapiens
tggctgtagaacagtggatatt

SEQ ID NO: 6899646 - DNA, 18 bp, Homo sapiens
tgcaactgaaagctttgt

SEQ ID NO: 6899647 - DNA, 22 bp, Homo sapiens
ttattcattaacagggaccaaa

SEQ ID NO: 6899648 - DNA, 22 bp, Homo sapiens
actgttaacggtatgatgctcg

SEQ ID NO: 6899649 - DNA, 22 bp, Homo sapiens
tcaacattggaggcaacattca

SEQ ID NO: 6899650 - DNA, 23 bp, Homo sapiens
tcaaacaggtttcagagcatctt

SEQ ID NO: 6899651 - DNA, 22 bp, Homo sapiens
tagcaccatgatggaagagctg

SEQ ID NO: 6899652 - DNA, 23 bp, Homo sapiens
aacatggagttgttcctttggcc

SEQ ID NO: 6899653 - DNA, 22 bp, Homo sapiens
agtgtccttgaggttcctagga

SEQ ID NO: 6899654 - DNA, 20 bp, Homo sapiens
ttccatagcaccctgtgggt

SEQ ID NO: 6899655 - DNA, 22 bp, Homo sapiens
gttctagactttatcttaaaac

SEQ ID NO: 6899656 - DNA, 22 bp, Homo sapiens
ttgagatggagtctcactctgt

SEQ ID NO: 6899657 - DNA, 22 bp, Homo sapiens
atgaggtaacagcttatcaaca

SEQ ID NO: 6899658 - DNA, 22 bp, Homo sapiens
caggcatggagaggcagagact

SEQ ID NO: 6899659 - DNA, 22 bp, Homo sapiens
tgtgagaggagaaatgcattaa

SEQ ID NO: 6899660 - DNA, 22 bp, Homo sapiens
atgtcagtagtttctttgagtt

SEQ ID NO: 6899661 - DNA, 22 bp, Homo sapiens
cagtttagaagaatcatgaaca

SEQ ID NO: 6899662 - DNA, 22 bp, Homo sapiens
ctagaagcaatgtaggggagac

SEQ ID NO: 6899663 - DNA, 22 bp, Homo sapiens
tgagattttcctaaatataatg

SEQ ID NO: 6899664 - DNA, 22 bp, Homo sapiens
taagtcataagtcaacaaagga

SEQ ID NO: 6899665 - DNA, 22 bp, Homo sapiens
gctagtttcttgaatactctaa

SEQ ID NO: 6899666 - DNA, 21 bp, Homo sapiens
tccttgggcagtgcccagctt

SEQ ID NO: 6899667 - DNA, 22 bp, Homo sapiens
tggccttgccacatttgtcagc

SEQ ID NO: 6899668 - DNA, 22 bp, Homo sapiens
tattgaagattttgtggttgct

SEQ ID NO: 6899669 - DNA, 22 bp, Homo sapiens
agacatttcctagacatcaatg

SEQ ID NO: 6899670 - DNA, 22 bp, Homo sapiens
tccaggaatagatcagagattt

SEQ ID NO: 6899671 - DNA, 22 bp, Homo sapiens
agctgagcatttgatccacctc

SEQ ID NO: 6899672 - DNA, 22 bp, Homo sapiens
accagagcccatctgctcctag

SEQ ID NO: 6899673 - DNA, 22 bp, Homo sapiens
gcctatggattggagaaggagc

SEQ ID NO: 6899674 - DNA, 19 bp, Homo sapiens
tgtctttaactggaaccac

SEQ ID NO: 6899675 - DNA, 22 bp, Homo sapiens
agggccagggaagctgtatttt

SEQ ID NO: 6899676 - DNA, 22 bp, Homo sapiens
acacccagattatgcacacaaa

SEQ ID NO: 6899677 - DNA, 22 bp, Homo sapiens
tgttctgccagcacttctcagc

SEQ ID NO: 6899678 - DNA, 22 bp, Homo sapiens
caggctccaagccctctgatgt

SEQ ID NO: 6899679 - DNA, 21 bp, Homo sapiens
tcagtagttcggttttctcac

SEQ ID NO: 6899680 - DNA, 22 bp, Homo sapiens
taggattatttgttctatttct

SEQ ID NO: 6899681 - DNA, 22 bp, Homo sapiens
ccacatgtgcactgctgtatgg

SEQ ID NO: 6899682 - DNA, 22 bp, Homo sapiens
ttagcaccacacactttagagg

SEQ ID NO: 6899683 - DNA, 22 bp, Homo sapiens
acatgctgtcctgtctttgtca

SEQ ID NO: 6899684 - DNA, 22 bp, Homo sapiens
ggtttattgaaggccaccccac

SEQ ID NO: 6899685 - DNA, 22 bp, Homo sapiens
ggctcttctgtttcacaggcca

SEQ ID NO: 6899686 - DNA, 20 bp, Homo sapiens
ccctgagacaaaggaggggc

SEQ ID NO: 6899687 - DNA, 22 bp, Homo sapiens
tgctacaggcgatcctcaacta

SEQ ID NO: 6899688 - DNA, 22 bp, Homo sapiens
actgtcaatgggttcattgagt

SEQ ID NO: 6899689 - DNA, 22 bp, Homo sapiens
gccagaggcccaaggacagctg

SEQ ID NO: 6899690 - DNA, 22 bp, Homo sapiens
gaaatctgcttcttgcatagta

SEQ ID NO: 6899691 - DNA, 22 bp, Homo sapiens
tgtggctctcatgcactcccag

SEQ ID NO: 6899692 - DNA, 22 bp, Homo sapiens
acacagtatgcatctagaaatt

SEQ ID NO: 6899693 - DNA, 22 bp, Homo sapiens
aggctgcagtgcaggtaggatt

SEQ ID NO: 6899694 - DNA, 22 bp, Homo sapiens
actctgtaattctgaagcacct

SEQ ID NO: 6899695 - DNA, 22 bp, Homo sapiens
gctggagcgtgatccttgatct

SEQ ID NO: 6899696 - DNA, 22 bp, Homo sapiens
ggctgagttctcttgctgaatc

SEQ ID NO: 6899697 - DNA, 22 bp, Homo sapiens
cagtgggtgatgagtcctgggg

SEQ ID NO: 6899698 - DNA, 22 bp, Homo sapiens
gtgtggctttctgggtttaatt

SEQ ID NO: 6899699 - DNA, 22 bp, Homo sapiens
tagtcttcctggaagaagtgtt

SEQ ID NO: 6899700 - DNA, 18 bp, Homo sapiens
gcttctcatttctaagca

SEQ ID NO: 6899701 - DNA, 22 bp, Homo sapiens
agattggtgaatgaaaagtaga

SEQ ID NO: 6899702 - DNA, 22 bp, Homo sapiens
ccagcagctgctatgtggtttt

SEQ ID NO: 6899703 - DNA, 22 bp, Homo sapiens
cttaaagagtatttaatataat

SEQ ID NO: 6899704 - DNA, 22 bp, Homo sapiens
agctttatatgttgtttctcca

SEQ ID NO: 6899705 - DNA, 22 bp, Homo sapiens
tcagcattgtggcagagaatgg

SEQ ID NO: 6899706 - DNA, 22 bp, Homo sapiens
tggaatgcagtgggagcttacc

SEQ ID NO: 6899707 - DNA, 22 bp, Homo sapiens
tgagctggatccaactccgttt

SEQ ID NO: 6899708 - DNA, 22 bp, Homo sapiens
ccctacgcctcatacagaccag

SEQ ID NO: 6899709 - DNA, 22 bp, Homo sapiens
taagttcaccagttgtaataag

SEQ ID NO: 6899710 - DNA, 22 bp, Homo sapiens
gaatcagcctgagtttgcagct

SEQ ID NO: 6899711 - DNA, 22 bp, Homo sapiens
atgcatattttctactatatcg

SEQ ID NO: 6899712 - DNA, 22 bp, Homo sapiens
tcgtggagaggccatgtggagg

SEQ ID NO: 6899713 - DNA, 22 bp, Homo sapiens
taacagagtaacaggtatgtaa

SEQ ID NO: 6899714 - DNA, 22 bp, Homo sapiens
caatttttgtacttatagtact

SEQ ID NO: 6899715 - DNA, 22 bp, Homo sapiens
ccagagtctgtgtgtgtcatcc

SEQ ID NO: 6899716 - DNA, 19 bp, Homo sapiens
agatactggtctgtggtac

SEQ ID NO: 6899717 - DNA, 22 bp, Homo sapiens
actgttctgccaactttggtta

SEQ ID NO: 6899718 - DNA, 23 bp, Homo sapiens
gagctctgcactaggccctggga

SEQ ID NO: 6899719 - DNA, 22 bp, Homo sapiens
tccaaaggaagaggctgtcagt

SEQ ID NO: 6899720 - DNA, 20 bp, Homo sapiens
agacagtggggagctcctag

SEQ ID NO: 6899721 - DNA, 22 bp, Homo sapiens
ggtagccaaagagcctgggccc

SEQ ID NO: 6899722 - DNA, 22 bp, Homo sapiens
gcagctcacagtctccgccatc

SEQ ID NO: 6899723 - DNA, 22 bp, Homo sapiens
tggcagcctcccagctgcattc

SEQ ID NO: 6899724 - DNA, 22 bp, Homo sapiens
agctatgtgttgtgagaaggaa

SEQ ID NO: 6899725 - DNA, 22 bp, Homo sapiens
cattgcacatctgagaagagat

SEQ ID NO: 6899726 - DNA, 21 bp, Homo sapiens
cacagaggcgctgtatggctg

SEQ ID NO: 6899727 - DNA, 22 bp, Homo sapiens
ccatttggtatagtgaaaagga

SEQ ID NO: 6899728 - DNA, 22 bp, Homo sapiens
ctgttaggttaaggaatggcaa

SEQ ID NO: 6899729 - DNA, 22 bp, Homo sapiens
ttttggtcaggttggtctcgaa

SEQ ID NO: 6899730 - DNA, 22 bp, Homo sapiens
ttccttggaaagagacgtcgct

SEQ ID NO: 6899731 - DNA, 22 bp, Homo sapiens
ttaaccaaataaaagcagactc

SEQ ID NO: 6899732 - DNA, 22 bp, Homo sapiens
tgtccaccgttcagcaccagag

SEQ ID NO: 6899733 - DNA, 17 bp, Homo sapiens
tctcaggcacgtgtggc

SEQ ID NO: 6899734 - DNA, 19 bp, Homo sapiens
aagctgtcctgttggccct

SEQ ID NO: 6899735 - DNA, 22 bp, Homo sapiens
ttctctgtggattgggtgagag

SEQ ID NO: 6899736 - DNA, 20 bp, Homo sapiens
actggagttcatgctaagag

SEQ ID NO: 6899737 - DNA, 22 bp, Homo sapiens
agcttcttctattttggggcca

SEQ ID NO: 6899738 - DNA, 22 bp, Homo sapiens
caggcctgggttcaaatccctt

SEQ ID NO: 6899739 - DNA, 22 bp, Homo sapiens
gtttcacagcaaagttccctgt

SEQ ID NO: 6899740 - DNA, 22 bp, Homo sapiens
gccatcatatcccctgtgacct

SEQ ID NO: 6899741 - DNA, 22 bp, Homo sapiens
tagcttaaaccaatctgaataa

SEQ ID NO: 6899742 - DNA, 22 bp, Homo sapiens
tctacataaaaattcagaaggc

SEQ ID NO: 6899743 - DNA, 22 bp, Homo sapiens
aactggaaggattgcagatgtc

SEQ ID NO: 6899744 - DNA, 22 bp, Homo sapiens
tgtgaagatttggcatgcagaa

SEQ ID NO: 6899745 - DNA, 22 bp, Homo sapiens
gccaagatggctggaaggctag

SEQ ID NO: 6899746 - DNA, 22 bp, Homo sapiens
ctaggtatggtaattgacctct

SEQ ID NO: 6899747 - DNA, 16 bp, Homo sapiens
cttgtctgttgctcat

SEQ ID NO: 6899748 - DNA, 22 bp, Homo sapiens
gtgaataactttctatgttaat

SEQ ID NO: 6899749 - DNA, 22 bp, Homo sapiens
cagaggacatgaaaactcgctc

SEQ ID NO: 6899750 - DNA, 22 bp, Homo sapiens
tctgagctgcagagtggggtgg

SEQ ID NO: 6899751 - DNA, 22 bp, Homo sapiens
aataataagatactaagggagt

SEQ ID NO: 6899752 - DNA, 22 bp, Homo sapiens
gcaattacagtggcatgtattt

SEQ ID NO: 6899753 - DNA, 22 bp, Homo sapiens
attggcactgcacatgattgct

SEQ ID NO: 6899754 - DNA, 22 bp, Homo sapiens
ggctcctgtggcaagacagctt

SEQ ID NO: 6899755 - DNA, 22 bp, Homo sapiens
tagtgcttggccctaccagata

SEQ ID NO: 6899756 - DNA, 22 bp, Homo sapiens
tttatttaccttatgtcctcca

SEQ ID NO: 6899757 - DNA, 22 bp, Homo sapiens
aagtcatcttgagtctaagatt

SEQ ID NO: 6899758 - DNA, 22 bp, Homo sapiens
tcaggccaaagaaacagcatga

SEQ ID NO: 6899759 - DNA, 22 bp, Homo sapiens
tttgtacctgtgggaatacaga

SEQ ID NO: 6899760 - DNA, 22 bp, Homo sapiens
acagggcctttgatggattata

SEQ ID NO: 6899761 - DNA, 22 bp, Homo sapiens
gcggagggcgagcccgcggagc

SEQ ID NO: 6899762 - DNA, 22 bp, Homo sapiens
agcatgcacatgactggcttaa

SEQ ID NO: 6899763 - DNA, 22 bp, Homo sapiens
tggaagacactatttaccaggt

SEQ ID NO: 6899764 - DNA, 22 bp, Homo sapiens
gtagggacaatatgttattaga

SEQ ID NO: 6899765 - DNA, 22 bp, Homo sapiens
tgctctgtaaggtcagaaaagg

SEQ ID NO: 6899766 - DNA, 22 bp, Homo sapiens
aagcattgtaagcagaagatgc

SEQ ID NO: 6899767 - DNA, 22 bp, Homo sapiens
ccccaaggtgctcactgtctgg

SEQ ID NO: 6899768 - DNA, 22 bp, Homo sapiens
tatagacttggcatgcatgttc

SEQ ID NO: 6899769 - DNA, 22 bp, Homo sapiens
aatcaggatagaacctcacgtg

SEQ ID NO: 6899770 - DNA, 22 bp, Homo sapiens
gaagaagcctctgtggatctga

SEQ ID NO: 6899771 - DNA, 18 bp, Homo sapiens
cagtggtgctgggatgtg

SEQ ID NO: 6899772 - DNA, 22 bp, Homo sapiens
gactgtacgtcattgaaggcca

SEQ ID NO: 6899773 - DNA, 22 bp, Homo sapiens
ggctgagttgagaggattactt

SEQ ID NO: 6899774 - DNA, 20 bp, Homo sapiens
agaaaaagtgtggaaatttc

SEQ ID NO: 6899775 - DNA, 22 bp, Homo sapiens
gagctcctgaaacgttcctgcc

SEQ ID NO: 6899776 - DNA, 22 bp, Homo sapiens
gccctcaggacaaggttacgct

SEQ ID NO: 6899777 - DNA, 22 bp, Homo sapiens
ttggcactgcagatgaattgca

SEQ ID NO: 6899778 - DNA, 20 bp, Homo sapiens
taatcacttataagacaatg

SEQ ID NO: 6899779 - DNA, 22 bp, Homo sapiens
aatcagcaaatgcttactcagg

SEQ ID NO: 6899780 - DNA, 22 bp, Homo sapiens
taacactttggattaaaattct

SEQ ID NO: 6899781 - DNA, 22 bp, Homo sapiens
aatgttattgtcctttccaaaa

SEQ ID NO: 6899782 - DNA, 22 bp, Homo sapiens
agctgaagaaatgggaagcatt

SEQ ID NO: 6899783 - DNA, 22 bp, Homo sapiens
cctgtgatccataggcatccag

SEQ ID NO: 6899784 - DNA, 22 bp, Homo sapiens
tttggccatatctatactcagc

SEQ ID NO: 6899785 - DNA, 22 bp, Homo sapiens
tgtcattaagtcctttggcgga

SEQ ID NO: 6899786 - DNA, 22 bp, Homo sapiens
aatagcatagagttaaaatgca

SEQ ID NO: 6899787 - DNA, 22 bp, Homo sapiens
aagattatggcagataacaatt

SEQ ID NO: 6899788 - DNA, 22 bp, Homo sapiens
tgattctcacagtgggacctca

SEQ ID NO: 6899789 - DNA, 22 bp, Homo sapiens
gccctggacagtgacggtgacc

SEQ ID NO: 6899790 - DNA, 22 bp, Homo sapiens
tgctgcagatcagctgagtcct

SEQ ID NO: 6899791 - DNA, 22 bp, Homo sapiens
aaggaaagctgtggttctgaga

SEQ ID NO: 6899792 - DNA, 22 bp, Homo sapiens
tgaaatcaattgcaatgtttat

SEQ ID NO: 6899793 - DNA, 22 bp, Homo sapiens
gttttgttcatgaacattgggt

SEQ ID NO: 6899794 - DNA, 22 bp, Homo sapiens
ctcctgcctgtgggactgagga

SEQ ID NO: 6899795 - DNA, 22 bp, Homo sapiens
gtcttggatatgtttgccttca

SEQ ID NO: 6899796 - DNA, 22 bp, Homo sapiens
acacttcatgcattcttcactc

SEQ ID NO: 6899797 - DNA, 22 bp, Homo sapiens
tgattctgaggaccctgtgacg

SEQ ID NO: 6899798 - DNA, 22 bp, Homo sapiens
ggtggggtatttggtacttgta

SEQ ID NO: 6899799 - DNA, 22 bp, Homo sapiens
tcatccatgtcagagcatgtat

SEQ ID NO: 6899800 - DNA, 22 bp, Homo sapiens
tctgcccagctaaaaatgggag

SEQ ID NO: 6899801 - DNA, 22 bp, Homo sapiens
gaaagaagctttagatggctat

SEQ ID NO: 6899802 - DNA, 22 bp, Homo sapiens
gctctgtaaagaagagaaatgc

SEQ ID NO: 6899803 - DNA, 22 bp, Homo sapiens
ttcaataggatgcatgatataa

SEQ ID NO: 6899804 - DNA, 22 bp, Homo sapiens
aaattgtcatttctgtgcccta

SEQ ID NO: 6899805 - DNA, 22 bp, Homo sapiens
agcacagctgttcaacaggaat

SEQ ID NO: 6899806 - DNA, 22 bp, Homo sapiens
attttcagcccccactcgtggc

SEQ ID NO: 6899807 - DNA, 22 bp, Homo sapiens
ttcctggggcttagcaatggag

SEQ ID NO: 6899808 - DNA, 22 bp, Homo sapiens
tttatcatcttgtttttaaagc

SEQ ID NO: 6899809 - DNA, 22 bp, Homo sapiens
ggtctctgagtgaggacctggg

SEQ ID NO: 6899810 - DNA, 22 bp, Homo sapiens
ctgccagctagctcctagttga

SEQ ID NO: 6899811 - DNA, 21 bp, Homo sapiens
atgcaggctgctcagaagcaa

SEQ ID NO: 6899812 - DNA, 22 bp, Homo sapiens
ccaggtgtaggacaccaaggga

SEQ ID NO: 6899813 - DNA, 22 bp, Homo sapiens
ctgttaaagatagttaagcttc

SEQ ID NO: 6899814 - DNA, 22 bp, Homo sapiens
tatgttgagtgaaagaagctag

SEQ ID NO: 6899815 - DNA, 22 bp, Homo sapiens
tcccagagcctctgccactctg

SEQ ID NO: 6899816 - DNA, 22 bp, Homo sapiens
tgcacaataccatgcaggggcc

SEQ ID NO: 6899817 - DNA, 22 bp, Homo sapiens
aggtgactgagtttcagtgtga

SEQ ID NO: 6899818 - DNA, 22 bp, Homo sapiens
agagtcttttgtcagtaatgtt

SEQ ID NO: 6899819 - DNA, 22 bp, Homo sapiens
ttaatacagaagcaagacactg

SEQ ID NO: 6899820 - DNA, 22 bp, Homo sapiens
ggactgtctccttgctggtagg

SEQ ID NO: 6899821 - DNA, 22 bp, Homo sapiens
gacagtgagagtctacaccctc

SEQ ID NO: 6899822 - DNA, 22 bp, Homo sapiens
tacagttttggtgatgatgatg

SEQ ID NO: 6899823 - DNA, 22 bp, Homo sapiens
tttgaatgtgtgagttaacttt

SEQ ID NO: 6899824 - DNA, 22 bp, Homo sapiens
cctggagcgcgggtcaagctgg

SEQ ID NO: 6899825 - DNA, 22 bp, Homo sapiens
gtgcctccctgttgactagggt

SEQ ID NO: 6899826 - DNA, 21 bp, Homo sapiens
acgctgcaccacgttctgcgg

SEQ ID NO: 6899827 - DNA, 22 bp, Homo sapiens
gtgccttccccggtggtctgtt

SEQ ID NO: 6899828 - DNA, 22 bp, Homo sapiens
ccctgtatagatacaggtcata

SEQ ID NO: 6899829 - DNA, 22 bp, Homo sapiens
tgcacacactctgcatatactt

SEQ ID NO: 6899830 - DNA, 18 bp, Homo sapiens
gacacacttgcagtagtc

SEQ ID NO: 6899831 - DNA, 21 bp, Homo sapiens
ggtgagtcttttcaagaggag

SEQ ID NO: 6899832 - DNA, 22 bp, Homo sapiens
cattgacttacctagtatcacc

SEQ ID NO: 6899833 - DNA, 23 bp, Homo sapiens
agggaaatactgcaatttttgga

SEQ ID NO: 6899834 - DNA, 22 bp, Homo sapiens
tgcctgggcctctgaggaaggc

SEQ ID NO: 6899835 - DNA, 22 bp, Homo sapiens
tagtcacctctttaaatgtcct

SEQ ID NO: 6899836 - DNA, 20 bp, Homo sapiens
gcctgggattatccactggt

SEQ ID NO: 6899837 - DNA, 22 bp, Homo sapiens
agggctcagcatctcattctgt

SEQ ID NO: 6899838 - DNA, 22 bp, Homo sapiens
cagacactgcagcagtctccca

SEQ ID NO: 6899839 - DNA, 22 bp, Homo sapiens
acattagcaggtgcataaacac

SEQ ID NO: 6899840 - DNA, 22 bp, Homo sapiens
gatgcccaggcccaaccatgga

SEQ ID NO: 6899841 - DNA, 22 bp, Homo sapiens
aagtacatcctagtctctttca

SEQ ID NO: 6899842 - DNA, 22 bp, Homo sapiens
gtcatgagttctcggggcagac

SEQ ID NO: 6899843 - DNA, 22 bp, Homo sapiens
gcaggccacagtggagtctctg

SEQ ID NO: 6899844 - DNA, 22 bp, Homo sapiens
ataaaggataatccattagact

SEQ ID NO: 6899845 - DNA, 22 bp, Homo sapiens
tgtctgttattggtgtataaga

SEQ ID NO: 6899846 - DNA, 22 bp, Homo sapiens
tcattgttatgttttgctgtct

SEQ ID NO: 6899847 - DNA, 22 bp, Homo sapiens
tctcatctcaaattgtaatccc

SEQ ID NO: 6899848 - DNA, 22 bp, Homo sapiens
tggaaagaaagtaaaggcgtat

SEQ ID NO: 6899849 - DNA, 22 bp, Homo sapiens
acacaggtaatggttttggaag

SEQ ID NO: 6899850 - DNA, 22 bp, Homo sapiens
tctgaggcataacctgttctgc

SEQ ID NO: 6899851 - DNA, 22 bp, Homo sapiens
ctcagtgggaggagtcagttgc

SEQ ID NO: 6899852 - DNA, 22 bp, Homo sapiens
tttacagcttctatactatgtg

SEQ ID NO: 6899853 - DNA, 22 bp, Homo sapiens
gaaggcatcaccaacattgaaa

SEQ ID NO: 6899854 - DNA, 22 bp, Homo sapiens
caagagacttatgtggaaacct

SEQ ID NO: 6899855 - DNA, 22 bp, Homo sapiens
tcagcactgtctattagtgaga

SEQ ID NO: 6899856 - DNA, 20 bp, Homo sapiens
aatgggcagtgtgtgagata

SEQ ID NO: 6899857 - DNA, 22 bp, Homo sapiens
agggcagatggaacttccccga

SEQ ID NO: 6899858 - DNA, 22 bp, Homo sapiens
tttgatatgcaaaattatggac

SEQ ID NO: 6899859 - DNA, 19 bp, Homo sapiens
tgctaccgtgggatgctta

SEQ ID NO: 6899860 - DNA, 21 bp, Homo sapiens
agttcatactgagtaacaaaa

SEQ ID NO: 6899861 - DNA, 22 bp, Homo sapiens
tcctgggtaaacactgaccttt

SEQ ID NO: 6899862 - DNA, 22 bp, Homo sapiens
agcatcagcctctgtcctggag

SEQ ID NO: 6899863 - DNA, 23 bp, Homo sapiens
tggcttctgccccattctctcca

SEQ ID NO: 6899864 - DNA, 22 bp, Homo sapiens
tcatggcacttagcacagtcct

SEQ ID NO: 6899865 - DNA, 22 bp, Homo sapiens
tggctccatcatccatgcaaga

SEQ ID NO: 6899866 - DNA, 22 bp, Homo sapiens
aagccagatcaaagtgtccagg

SEQ ID NO: 6899867 - DNA, 22 bp, Homo sapiens
atgtctggctaaaatccctggt

SEQ ID NO: 6899868 - DNA, 22 bp, Homo sapiens
agtatatatgaggaaccacaaa

SEQ ID NO: 6899869 - DNA, 22 bp, Homo sapiens
ttagcaggtattctctttggtc

SEQ ID NO: 6899870 - DNA, 22 bp, Homo sapiens
actggaggattcctggaaggcg

SEQ ID NO: 6899871 - DNA, 22 bp, Homo sapiens
aattgcttagttgcaactatgc

SEQ ID NO: 6899872 - DNA, 22 bp, Homo sapiens
atgtattatggttttccttaag

SEQ ID NO: 6899873 - DNA, 22 bp, Homo sapiens
gagcccagctgcggccctcagc

SEQ ID NO: 6899874 - DNA, 22 bp, Homo sapiens
tagccatttttattaatgctgg

SEQ ID NO: 6899875 - DNA, 22 bp, Homo sapiens
agcttgttcaaatgcagaatac

SEQ ID NO: 6899876 - DNA, 22 bp, Homo sapiens
cacatccttcagctgagcccag

SEQ ID NO: 6899877 - DNA, 22 bp, Homo sapiens
gttcacatcctggctgtgccac

SEQ ID NO: 6899878 - DNA, 22 bp, Homo sapiens
gaggagaggggctcccaagagc

SEQ ID NO: 6899879 - DNA, 22 bp, Homo sapiens
tgtgtacatatacacaaataca

SEQ ID NO: 6899880 - DNA, 22 bp, Homo sapiens
cctgatagtattcattatttgc

SEQ ID NO: 6899881 - DNA, 23 bp, Homo sapiens
gccagaggaacgcagagctttct

SEQ ID NO: 6899882 - DNA, 20 bp, Homo sapiens
ggcttgagtcagatcttgga

SEQ ID NO: 6899883 - DNA, 22 bp, Homo sapiens
cttcatgttctgcctgtggaag

SEQ ID NO: 6899884 - DNA, 22 bp, Homo sapiens
aatatcagaatgtaatggtcct

SEQ ID NO: 6899885 - DNA, 22 bp, Homo sapiens
cagcagctggttatacctgtgg

SEQ ID NO: 6899886 - DNA, 22 bp, Homo sapiens
ctatgtgcagtagtttctttat

SEQ ID NO: 6899887 - DNA, 20 bp, Homo sapiens
ttccttttcgcctctctccc

SEQ ID NO: 6899888 - DNA, 22 bp, Homo sapiens
tttacacattattttcagtgtg

SEQ ID NO: 6899889 - DNA, 22 bp, Homo sapiens
aaggaattccctttctgacaga

SEQ ID NO: 6899890 - DNA, 22 bp, Homo sapiens
atacactggtttatgatattgt

SEQ ID NO: 6899891 - DNA, 22 bp, Homo sapiens
tggcctcagatttcaggggtgg

SEQ ID NO: 6899892 - DNA, 22 bp, Homo sapiens
tcagttactctgatgtcctgtg

SEQ ID NO: 6899893 - DNA, 22 bp, Homo sapiens
gccattaacaagaatatagtag

SEQ ID NO: 6899894 - DNA, 22 bp, Homo sapiens
gcagtaatctcatatcaatttc

SEQ ID NO: 6899895 - DNA, 22 bp, Homo sapiens
atcttttctgtttgctatgtct

SEQ ID NO: 6899896 - DNA, 22 bp, Homo sapiens
ggttcacaggtccgactgctgg

SEQ ID NO: 6899897 - DNA, 22 bp, Homo sapiens
aggtaatgcatataaagtgctt

SEQ ID NO: 6899898 - DNA, 22 bp, Homo sapiens
gggatggctcaaaggagtcagg

SEQ ID NO: 6899899 - DNA, 22 bp, Homo sapiens
ctgagcatggccggtccatggt

SEQ ID NO: 6899900 - DNA, 23 bp, Homo sapiens
ggaaccttcttagcccctgagca

SEQ ID NO: 6899901 - DNA, 22 bp, Homo sapiens
tggcactttacttcctcaggag

SEQ ID NO: 6899902 - DNA, 23 bp, Homo sapiens
taatactgcttcagaggcttaga

SEQ ID NO: 6899903 - DNA, 22 bp, Homo sapiens
gctgagctagaaaaggaccaca

SEQ ID NO: 6899904 - DNA, 22 bp, Homo sapiens
gcctgcaaacctgaagatttaa

SEQ ID NO: 6899905 - DNA, 22 bp, Homo sapiens
tgtgcaggatgcgggggtacca

SEQ ID NO: 6899906 - DNA, 22 bp, Homo sapiens
gccaggaagagagagccctcca

SEQ ID NO: 6899907 - DNA, 20 bp, Homo sapiens
tgcaggtgtgtccaagcact

SEQ ID NO: 6899908 - DNA, 22 bp, Homo sapiens
tgcagcagacataatgtggatt

SEQ ID NO: 6899909 - DNA, 22 bp, Homo sapiens
attcaaacaggaagaaatcatt

SEQ ID NO: 6899910 - DNA, 22 bp, Homo sapiens
tgcagaagcagagccggtggcc

SEQ ID NO: 6899911 - DNA, 22 bp, Homo sapiens
gctggctcttcagtggagatag

SEQ ID NO: 6899912 - DNA, 22 bp, Homo sapiens
aatccatctcaatttattccta

SEQ ID NO: 6899913 - DNA, 21 bp, Homo sapiens
agtttagaccaagcctttcca

SEQ ID NO: 6899914 - DNA, 22 bp, Homo sapiens
tctgagtgcactaggaggggca

SEQ ID NO: 6899915 - DNA, 22 bp, Homo sapiens
atctagaacaattattgtcaca

SEQ ID NO: 6899916 - DNA, 22 bp, Homo sapiens
gggctctggtgccttcacagaa

SEQ ID NO: 6899917 - DNA, 22 bp, Homo sapiens
tcagcagtcacatgttgtccca

SEQ ID NO: 6899918 - DNA, 22 bp, Homo sapiens
tcaggcactgctttctgatatg

SEQ ID NO: 6899919 - DNA, 22 bp, Homo sapiens
tacatctgatttacctactgaa

SEQ ID NO: 6899920 - DNA, 22 bp, Homo sapiens
tcacaggctggtctccgaggac

SEQ ID NO: 6899921 - DNA, 22 bp, Homo sapiens
gcagctctgtctttcttaaagt

SEQ ID NO: 6899922 - DNA, 22 bp, Homo sapiens
ggctggtcaggaaactaggctc

SEQ ID NO: 6899923 - DNA, 22 bp, Homo sapiens
atgctacactccgcgaaaatgt

SEQ ID NO: 6899924 - DNA, 22 bp, Homo sapiens
ttctctctgtgtcattatggac

SEQ ID NO: 6899925 - DNA, 22 bp, Homo sapiens
aagacattagaatcagcctgtt

SEQ ID NO: 6899926 - DNA, 20 bp, Homo sapiens
aggaaagcctgtgtgagtct

SEQ ID NO: 6899927 - DNA, 19 bp, Homo sapiens
agagccagacagcatagga

SEQ ID NO: 6899928 - DNA, 22 bp, Homo sapiens
tggaagacggaaatctgtagat

SEQ ID NO: 6899929 - DNA, 22 bp, Homo sapiens
caccagctacagactactgtgt

SEQ ID NO: 6899930 - DNA, 21 bp, Homo sapiens
gtgctgggacacagccaggct

SEQ ID NO: 6899931 - DNA, 22 bp, Homo sapiens
tttgagaagagtttgaggtatt

SEQ ID NO: 6899932 - DNA, 22 bp, Homo sapiens
cccaaccagaaattgacagaca

SEQ ID NO: 6899933 - DNA, 22 bp, Homo sapiens
aagctgatgtcccagtttgaag

SEQ ID NO: 6899934 - DNA, 22 bp, Homo sapiens
tacacagaagccagaaggcctg

SEQ ID NO: 6899935 - DNA, 22 bp, Homo sapiens
agggccctggggtgcactgaca

SEQ ID NO: 6899936 - DNA, 22 bp, Homo sapiens
atctattttaaatggcagtaaa

SEQ ID NO: 6899937 - DNA, 22 bp, Homo sapiens
gctggggagcaagagtagtgag

SEQ ID NO: 6899938 - DNA, 21 bp, Homo sapiens
cggaaactcggctctggttcc

SEQ ID NO: 6899939 - DNA, 22 bp, Homo sapiens
aaagttacagtaattcagtgta

SEQ ID NO: 6899940 - DNA, 22 bp, Homo sapiens
tgctcctgcttagccgtgtttt

SEQ ID NO: 6899941 - DNA, 22 bp, Homo sapiens
aactgtagtgcttatagactct

SEQ ID NO: 6899942 - DNA, 22 bp, Homo sapiens
tgtgtgtgtttctgctcataca

SEQ ID NO: 6899943 - DNA, 23 bp, Homo sapiens
atttttagcctctctgagctgag

SEQ ID NO: 6899944 - DNA, 22 bp, Homo sapiens
tcatatctttgtctaccaggaa

SEQ ID NO: 6899945 - DNA, 22 bp, Homo sapiens
taatcctgtgctgtgtaagtac

SEQ ID NO: 6899946 - DNA, 22 bp, Homo sapiens
tgctccagcccctggtgcacag

SEQ ID NO: 6899947 - DNA, 22 bp, Homo sapiens
aacggaattgtttcgtcaagca

SEQ ID NO: 6899948 - DNA, 22 bp, Homo sapiens
tcttgattttgtgaataagttg

SEQ ID NO: 6899949 - DNA, 22 bp, Homo sapiens
aatgcctcgccttatttatttt

SEQ ID NO: 6899950 - DNA, 22 bp, Homo sapiens
ctagttatttggtacctggccc

SEQ ID NO: 6899951 - DNA, 22 bp, Homo sapiens
agatgtaacggtaggtggcatt

SEQ ID NO: 6899952 - DNA, 22 bp, Homo sapiens
cctggagtaccgtggccatcca

SEQ ID NO: 6899953 - DNA, 22 bp, Homo sapiens
caaatgccaggaatctctgaag

SEQ ID NO: 6899954 - DNA, 22 bp, Homo sapiens
tcagcaaggcagaagggaggta

SEQ ID NO: 6899955 - DNA, 22 bp, Homo sapiens
ggtcacatggttgagcttgatc

SEQ ID NO: 6899956 - DNA, 22 bp, Homo sapiens
ttgaaagtctctgcatgtagga

SEQ ID NO: 6899957 - DNA, 22 bp, Homo sapiens
gaggaagcagggcttggctgag

SEQ ID NO: 6899958 - DNA, 22 bp, Homo sapiens
tccctagcttccgggggctgcc

SEQ ID NO: 6899959 - DNA, 23 bp, Homo sapiens
actagaaaatgactttctccctg

SEQ ID NO: 6899960 - DNA, 22 bp, Homo sapiens
gccaggtccagggtggagcgct

SEQ ID NO: 6899961 - DNA, 22 bp, Homo sapiens
gatagtattacaggaaatcata

SEQ ID NO: 6899962 - DNA, 22 bp, Homo sapiens
acatgattttagtatcataata

SEQ ID NO: 6899963 - DNA, 22 bp, Homo sapiens
tgaaacagtgcttcactcagcc

SEQ ID NO: 6899964 - DNA, 15 bp, Homo sapiens
tgatttcctactaac

SEQ ID NO: 6899965 - DNA, 22 bp, Homo sapiens
ctgcaggaggatcctgagagtg

SEQ ID NO: 6899966 - DNA, 21 bp, Homo sapiens
tcaagacagcatatttaagaa

SEQ ID NO: 6899967 - DNA, 22 bp, Homo sapiens
gagcccagcttgcacatggagc

SEQ ID NO: 6899968 - DNA, 21 bp, Homo sapiens
tcactacaatgttctcttata

SEQ ID NO: 6899969 - DNA, 22 bp, Homo sapiens
attcctcagcaggccttttgtt

SEQ ID NO: 6899970 - DNA, 22 bp, Homo sapiens
gtctggcctttttagcttgtgg

SEQ ID NO: 6899971 - DNA, 22 bp, Homo sapiens
agcatctggtcatgagtgagaa

SEQ ID NO: 6899972 - DNA, 22 bp, Homo sapiens
ttcagcatagcagcttcaggac

SEQ ID NO: 6899973 - DNA, 22 bp, Homo sapiens
tgagtccattgatggatagtga

SEQ ID NO: 6899974 - DNA, 22 bp, Homo sapiens
ggtctgaggtttgggattcact

SEQ ID NO: 6899975 - DNA, 22 bp, Homo sapiens
tttggcaagcgtgccttgtcgg

SEQ ID NO: 6899976 - DNA, 22 bp, Homo sapiens
gtctgaagccagtggtagtccg

SEQ ID NO: 6899977 - DNA, 22 bp, Homo sapiens
catgcagtgactcagacacagg

SEQ ID NO: 6899978 - DNA, 22 bp, Homo sapiens
catgcagttgaagcacagagag

SEQ ID NO: 6899979 - DNA, 22 bp, Homo sapiens
tgtgtcaaattgttttacacag

SEQ ID NO: 6899980 - DNA, 22 bp, Homo sapiens
gcagagcctgtgtctgagcaaa

SEQ ID NO: 6899981 - DNA, 22 bp, Homo sapiens
tgtgttttggaaggaacatgca

SEQ ID NO: 6899982 - DNA, 22 bp, Homo sapiens
gaggccagggtaccatcaacat

SEQ ID NO: 6899983 - DNA, 22 bp, Homo sapiens
tttcctggttggggacgtggtt

SEQ ID NO: 6899984 - DNA, 22 bp, Homo sapiens
tagatgttccacatatatatgt

SEQ ID NO: 6899985 - DNA, 22 bp, Homo sapiens
gatggacagcctggaaggaaag

SEQ ID NO: 6899986 - DNA, 21 bp, Homo sapiens
actggctgccatgatccaggg

SEQ ID NO: 6899987 - DNA, 22 bp, Homo sapiens
caataaagtggaggcccgggct

SEQ ID NO: 6899988 - DNA, 22 bp, Homo sapiens
ggcggaggttgcagtaagccga

SEQ ID NO: 6899989 - DNA, 22 bp, Homo sapiens
atgtacatttgtagtaatatca

SEQ ID NO: 6899990 - DNA, 21 bp, Homo sapiens
agaactaagactcagcagtac

SEQ ID NO: 6899991 - DNA, 19 bp, Homo sapiens
gaaagatttcagttgagga

SEQ ID NO: 6899992 - DNA, 22 bp, Homo sapiens
acatgcacagcaagggtgagag

SEQ ID NO: 6899993 - DNA, 22 bp, Homo sapiens
accaaggagacaaaggtgtatt

SEQ ID NO: 6899994 - DNA, 22 bp, Homo sapiens
tggaaggcgcagtgatgatgct

SEQ ID NO: 6899995 - DNA, 19 bp, Homo sapiens
taaaacgtgcatggcagca

SEQ ID NO: 6899996 - DNA, 22 bp, Homo sapiens
atgtatcacagcaatgtagtca

SEQ ID NO: 6899997 - DNA, 21 bp, Homo sapiens
acttgtaacttgaaggggcat

SEQ ID NO: 6899998 - DNA, 22 bp, Homo sapiens
ggcccacggcggcccgggcgtc

SEQ ID NO: 6899999 - DNA, 22 bp, Homo sapiens
caggcaccaacttcctggggag

SEQ ID NO: 6900000 - DNA, 22 bp, Homo sapiens
agagactgtggctctttgaagg

SEQ ID NO: 6900001 - DNA, 22 bp, Homo sapiens
gtgagagcctgtctggatgtcg

SEQ ID NO: 6900002 - DNA, 22 bp, Homo sapiens
cctgctttggcaggcagctcct

SEQ ID NO: 6900003 - DNA, 22 bp, Homo sapiens
cttcagagtgactcagcatctt

SEQ ID NO: 6900004 - DNA, 22 bp, Homo sapiens
tgattgtatgattgaaatattt

SEQ ID NO: 6900005 - DNA, 22 bp, Homo sapiens
tttttcatattcccctctctgg

SEQ ID NO: 6900006 - DNA, 22 bp, Homo sapiens
ctgtgcaaggcccatgctcaga

SEQ ID NO: 6900007 - DNA, 22 bp, Homo sapiens
gtcacaggaaagggtgtaaggg

SEQ ID NO: 6900008 - DNA, 22 bp, Homo sapiens
gagagtgctgaacggcaagggt

SEQ ID NO: 6900009 - DNA, 22 bp, Homo sapiens
tgctggagactcactcaggtgc

SEQ ID NO: 6900010 - DNA, 22 bp, Homo sapiens
ctgaatggcgagttagttagtt

SEQ ID NO: 6900011 - DNA, 22 bp, Homo sapiens
tggttttgctaaaatagaaaga

SEQ ID NO: 6900012 - DNA, 23 bp, Homo sapiens
tgaaacagatgccaatgatcaag

SEQ ID NO: 6900013 - DNA, 22 bp, Homo sapiens
tcagaagtactgtgctacaata

SEQ ID NO: 6900014 - DNA, 22 bp, Homo sapiens
caggtgtacacattgtgtttat

SEQ ID NO: 6900015 - DNA, 22 bp, Homo sapiens
tttatcttctgcagttctggct

SEQ ID NO: 6900016 - DNA, 22 bp, Homo sapiens
atgcagaaagcggcaaacaggt

SEQ ID NO: 6900017 - DNA, 18 bp, Homo sapiens
tctgtccttccattcttc

SEQ ID NO: 6900018 - DNA, 22 bp, Homo sapiens
agtgtgctctggttgccatgct

SEQ ID NO: 6900019 - DNA, 22 bp, Homo sapiens
gggtgctgggaggctgacatct

SEQ ID NO: 6900020 - DNA, 22 bp, Homo sapiens
agttatataactatctagatgc

SEQ ID NO: 6900021 - DNA, 22 bp, Homo sapiens
cttatctgtaaaatggatacaa

SEQ ID NO: 6900022 - DNA, 22 bp, Homo sapiens
gatgtgtctggctcccctgcaa

SEQ ID NO: 6900023 - DNA, 22 bp, Homo sapiens
ttcattcaaggggttcctgatt

SEQ ID NO: 6900024 - DNA, 22 bp, Homo sapiens
ctcacagtttcacagtgtagat

SEQ ID NO: 6900025 - DNA, 22 bp, Homo sapiens
atgatgaaatgataggtttgtt

SEQ ID NO: 6900026 - DNA, 22 bp, Homo sapiens
ctggaggtgcttcgctggccac

SEQ ID NO: 6900027 - DNA, 22 bp, Homo sapiens
caagctggagttcctcagagtg

SEQ ID NO: 6900028 - DNA, 22 bp, Homo sapiens
cattcacaatggattgcttcaa

SEQ ID NO: 6900029 - DNA, 22 bp, Homo sapiens
agctgggtgtagggctggacaa

SEQ ID NO: 6900030 - DNA, 22 bp, Homo sapiens
ctgggagacgcagctggggatc

SEQ ID NO: 6900031 - DNA, 22 bp, Homo sapiens
ttgcagacagtgagagtgaaag

SEQ ID NO: 6900032 - DNA, 22 bp, Homo sapiens
gcagccttcagtttggcaggag

SEQ ID NO: 6900033 - DNA, 22 bp, Homo sapiens
gtcctgaggatgcagagataaa

SEQ ID NO: 6900034 - DNA, 22 bp, Homo sapiens
atccttcaggaaaccatcctca

SEQ ID NO: 6900035 - DNA, 22 bp, Homo sapiens
tttccagagggtgctcagggcg

SEQ ID NO: 6900036 - DNA, 22 bp, Homo sapiens
cacagtttctataggtcagaat

SEQ ID NO: 6900037 - DNA, 22 bp, Homo sapiens
accttgaccttgagcacctgtt

SEQ ID NO: 6900038 - DNA, 22 bp, Homo sapiens
ttggttacacagactggtgctt

SEQ ID NO: 6900039 - DNA, 22 bp, Homo sapiens
gtagcagagggcccaggtaact

SEQ ID NO: 6900040 - DNA, 22 bp, Homo sapiens
tgggcctgattcttgaatcctg

SEQ ID NO: 6900041 - DNA, 23 bp, Homo sapiens
tctcctaaaatggcctgcctgca

SEQ ID NO: 6900042 - DNA, 22 bp, Homo sapiens
atcagaagtgatgtgtgttatt

SEQ ID NO: 6900043 - DNA, 22 bp, Homo sapiens
tacatgcttccaactgccccat

SEQ ID NO: 6900044 - DNA, 22 bp, Homo sapiens
gtgtgtaagtctcctcttcccg

SEQ ID NO: 6900045 - DNA, 22 bp, Homo sapiens
tgctggagtaacaagacactca

SEQ ID NO: 6900046 - DNA, 22 bp, Homo sapiens
cttttcagagctgagatcaccg

SEQ ID NO: 6900047 - DNA, 17 bp, Homo sapiens
gcccgtgggctacggta

SEQ ID NO: 6900048 - DNA, 22 bp, Homo sapiens
gcaaactggtagctcgcctgcc

SEQ ID NO: 6900049 - DNA, 22 bp, Homo sapiens
ctcagaagccttcagtcttggc

SEQ ID NO: 6900050 - DNA, 22 bp, Homo sapiens
gaaggtttgatccttatttata

SEQ ID NO: 6900051 - DNA, 22 bp, Homo sapiens
attagctttggtggaaaggagt

SEQ ID NO: 6900052 - DNA, 22 bp, Homo sapiens
taagattatacttaaagagaaa

SEQ ID NO: 6900053 - DNA, 22 bp, Homo sapiens
aggaaacagagtgaagcttggg

SEQ ID NO: 6900054 - DNA, 22 bp, Homo sapiens
tgaaggcctctggtacatgcca

SEQ ID NO: 6900055 - DNA, 22 bp, Homo sapiens
ctggttttgcccagtcttgcac

SEQ ID NO: 6900056 - DNA, 22 bp, Homo sapiens
gagctttgttccgtggtggcac

SEQ ID NO: 6900057 - DNA, 22 bp, Homo sapiens
agcagcttgggtctctcctgct

SEQ ID NO: 6900058 - DNA, 22 bp, Homo sapiens
gcagtaagatgtttcccagagc

SEQ ID NO: 6900059 - DNA, 22 bp, Homo sapiens
caaatacttactgaacctgtgc

SEQ ID NO: 6900060 - DNA, 22 bp, Homo sapiens
gccatacctgaggctcctatgg

SEQ ID NO: 6900061 - DNA, 22 bp, Homo sapiens
gcttgccataccccattgactt

SEQ ID NO: 6900062 - DNA, 22 bp, Homo sapiens
atacaaagctttctgtctggta

SEQ ID NO: 6900063 - DNA, 22 bp, Homo sapiens
agccagtgattctgatgtactg

SEQ ID NO: 6900064 - DNA, 22 bp, Homo sapiens
aaatagtcctgggaatagtact

SEQ ID NO: 6900065 - DNA, 23 bp, Homo sapiens
ggaggcacttaggcagagcagag

SEQ ID NO: 6900066 - DNA, 20 bp, Homo sapiens
gcagcctcaacaggcacagc

SEQ ID NO: 6900067 - DNA, 21 bp, Homo sapiens
tccagctgcacaagcatgggg

SEQ ID NO: 6900068 - DNA, 22 bp, Homo sapiens
caatttcaagattctgttcttt

SEQ ID NO: 6900069 - DNA, 22 bp, Homo sapiens
ttgctgccttgtctcagggtct

SEQ ID NO: 6900070 - DNA, 22 bp, Homo sapiens
actatccttatcctccaaagtt

SEQ ID NO: 6900071 - DNA, 22 bp, Homo sapiens
ttctgtgtgctgtcttggcttt

SEQ ID NO: 6900072 - DNA, 22 bp, Homo sapiens
tgtgcagagaagccactggggg

SEQ ID NO: 6900073 - DNA, 22 bp, Homo sapiens
ccaggaagctgtgagattccaa

SEQ ID NO: 6900074 - DNA, 22 bp, Homo sapiens
ctctgctaagcatgaacaatta

SEQ ID NO: 6900075 - DNA, 22 bp, Homo sapiens
ggcaggctgttcacctgctttt

SEQ ID NO: 6900076 - DNA, 22 bp, Homo sapiens
cagtgccagggttgtgtaaatc

SEQ ID NO: 6900077 - DNA, 22 bp, Homo sapiens
caggcagatatgttcgctttaa

SEQ ID NO: 6900078 - DNA, 18 bp, Homo sapiens
gggctctggcatctgggt

SEQ ID NO: 6900079 - DNA, 22 bp, Homo sapiens
aaggcactcattcaaggagata

SEQ ID NO: 6900080 - DNA, 22 bp, Homo sapiens
tcaggcaggttggctgcaggtc

SEQ ID NO: 6900081 - DNA, 22 bp, Homo sapiens
taagctggagcttcccccgtcc

SEQ ID NO: 6900082 - DNA, 22 bp, Homo sapiens
tccacagatgacagaggggatg

SEQ ID NO: 6900083 - DNA, 22 bp, Homo sapiens
tcgcatggtgtgccttaacatt

SEQ ID NO: 6900084 - DNA, 22 bp, Homo sapiens
caccagcagaagactgagggtg

SEQ ID NO: 6900085 - DNA, 22 bp, Homo sapiens
gtacaaatgcaggtttgttaca

SEQ ID NO: 6900086 - DNA, 22 bp, Homo sapiens
tctgtgctagaggagttggcca

SEQ ID NO: 6900087 - DNA, 22 bp, Homo sapiens
cattagaactaagatgtccagg

SEQ ID NO: 6900088 - DNA, 22 bp, Homo sapiens
tttacaccattagaagctactt

SEQ ID NO: 6900089 - DNA, 22 bp, Homo sapiens
gcgtggctcctaacagatctga

SEQ ID NO: 6900090 - DNA, 22 bp, Homo sapiens
gagttaattcgaatattctagc

SEQ ID NO: 6900091 - DNA, 22 bp, Homo sapiens
caggaatgggtgacagtcagct

SEQ ID NO: 6900092 - DNA, 22 bp, Homo sapiens
taagtacagaatgaggagatgt

SEQ ID NO: 6900093 - DNA, 22 bp, Homo sapiens
caaggctgtgcagggtccatat

SEQ ID NO: 6900094 - DNA, 23 bp, Homo sapiens
agatcagcatggatcagtcttct

SEQ ID NO: 6900095 - DNA, 22 bp, Homo sapiens
aagctcttcctggagcgcccac

SEQ ID NO: 6900096 - DNA, 22 bp, Homo sapiens
gcaactttcaagcaccatgggg

SEQ ID NO: 6900097 - DNA, 22 bp, Homo sapiens
aggcagaaccagctgggacttt

SEQ ID NO: 6900098 - DNA, 22 bp, Homo sapiens
tctaggagttgataaaagggct

SEQ ID NO: 6900099 - DNA, 22 bp, Homo sapiens
cagtcacataggtatacacata

SEQ ID NO: 6900100 - DNA, 22 bp, Homo sapiens
aagccactgttttggagtgctt

SEQ ID NO: 6900101 - DNA, 22 bp, Homo sapiens
tttcctaggagattgatcacat

SEQ ID NO: 6900102 - DNA, 22 bp, Homo sapiens
gtgtcttagaaagactgaatgc

SEQ ID NO: 6900103 - DNA, 22 bp, Homo sapiens
gacagaggtgtccttgagtcca

SEQ ID NO: 6900104 - DNA, 22 bp, Homo sapiens
ctgctttttctaggaggacaat

SEQ ID NO: 6900105 - DNA, 22 bp, Homo sapiens
tgtgcctactgatagagccaag

SEQ ID NO: 6900106 - DNA, 22 bp, Homo sapiens
taacaggctgatcatatatcct

SEQ ID NO: 6900107 - DNA, 22 bp, Homo sapiens
agggaatccatctatcttcatt

SEQ ID NO: 6900108 - DNA, 22 bp, Homo sapiens
ttcccttaaattatggcatcta

SEQ ID NO: 6900109 - DNA, 22 bp, Homo sapiens
ttaggcctttgattggggtgct

SEQ ID NO: 6900110 - DNA, 20 bp, Homo sapiens
gctggctgaactgaaagcaa

SEQ ID NO: 6900111 - DNA, 22 bp, Homo sapiens
attagcttatcccatttctgaa

SEQ ID NO: 6900112 - DNA, 22 bp, Homo sapiens
tgggtaaatatcctttgtgaaa

SEQ ID NO: 6900113 - DNA, 22 bp, Homo sapiens
aagagtttttaatgggtactgg

SEQ ID NO: 6900114 - DNA, 22 bp, Homo sapiens
atatagagtaattatttggtgt

SEQ ID NO: 6900115 - DNA, 22 bp, Homo sapiens
catcctgtgatgtctttggctg

SEQ ID NO: 6900116 - DNA, 22 bp, Homo sapiens
tcatagttctgttttgaaggat

SEQ ID NO: 6900117 - DNA, 22 bp, Homo sapiens
agtggcttttcttgcttctggc

SEQ ID NO: 6900118 - DNA, 22 bp, Homo sapiens
agatttgggggctagggctggt

SEQ ID NO: 6900119 - DNA, 22 bp, Homo sapiens
cctcgctgtgtgaccttgggtg

SEQ ID NO: 6900120 - DNA, 22 bp, Homo sapiens
atgaaagcaggaattgttctgt

SEQ ID NO: 6900121 - DNA, 22 bp, Homo sapiens
tactgtaatcagggcttaggta

SEQ ID NO: 6900122 - DNA, 22 bp, Homo sapiens
tacatcataataatacttagaa

SEQ ID NO: 6900123 - DNA, 22 bp, Homo sapiens
ggtcctggaaattgacggaaag

SEQ ID NO: 6900124 - DNA, 22 bp, Homo sapiens
ggggacgggacttagcatgagt

SEQ ID NO: 6900125 - DNA, 22 bp, Homo sapiens
aaccaaaggaacctgattttct

SEQ ID NO: 6900126 - DNA, 22 bp, Homo sapiens
agtcacttggattagcaattct

SEQ ID NO: 6900127 - DNA, 22 bp, Homo sapiens
gatcatgaaccactggaattcc

SEQ ID NO: 6900128 - DNA, 22 bp, Homo sapiens
tgctgactcctggctgtgacac

SEQ ID NO: 6900129 - DNA, 22 bp, Homo sapiens
atgctgaagagagaactactca

SEQ ID NO: 6900130 - DNA, 22 bp, Homo sapiens
cactctgattccacaaggctcc

SEQ ID NO: 6900131 - DNA, 22 bp, Homo sapiens
acagggttgccaaatactaatt

SEQ ID NO: 6900132 - DNA, 22 bp, Homo sapiens
atccatttgaaagaacagtcca

SEQ ID NO: 6900133 - DNA, 22 bp, Homo sapiens
ctggctttctatttggtgctat

SEQ ID NO: 6900134 - DNA, 19 bp, Homo sapiens
aggaaggaacctgagtctg

SEQ ID NO: 6900135 - DNA, 22 bp, Homo sapiens
ttttggtagccaacaaaatgtt

SEQ ID NO: 6900136 - DNA, 22 bp, Homo sapiens
agtgccttgtgtgtgggcagcc

SEQ ID NO: 6900137 - DNA, 23 bp, Homo sapiens
tcctccttttgcttgtgcttccc

SEQ ID NO: 6900138 - DNA, 22 bp, Homo sapiens
tgacctgtcacattttgatgaa

SEQ ID NO: 6900139 - DNA, 22 bp, Homo sapiens
gatgtcttggtcaacttgggct

SEQ ID NO: 6900140 - DNA, 22 bp, Homo sapiens
cccaggaggccaaggttgcagt

SEQ ID NO: 6900141 - DNA, 22 bp, Homo sapiens
gctgtatttaacaactggctca

SEQ ID NO: 6900142 - DNA, 22 bp, Homo sapiens
tgaaattcaaaacacatttgtc

SEQ ID NO: 6900143 - DNA, 22 bp, Homo sapiens
tccaggaagaggtgtgttggga

SEQ ID NO: 6900144 - DNA, 22 bp, Homo sapiens
tgcttaaagtagtggattgtta

SEQ ID NO: 6900145 - DNA, 21 bp, Homo sapiens
gctgggtcagcaggtcctctg

SEQ ID NO: 6900146 - DNA, 22 bp, Homo sapiens
aagagctggagtttgcagccct

SEQ ID NO: 6900147 - DNA, 22 bp, Homo sapiens
caggttcttgtttcaaacagac

SEQ ID NO: 6900148 - DNA, 22 bp, Homo sapiens
agaggaaaatgagttccagaat

SEQ ID NO: 6900149 - DNA, 22 bp, Homo sapiens
agtgctgagtgattgcaaagga

SEQ ID NO: 6900150 - DNA, 22 bp, Homo sapiens
agcagcacatggggctggcaac

SEQ ID NO: 6900151 - DNA, 22 bp, Homo sapiens
agtcttacatgagaaagaacct

SEQ ID NO: 6900152 - DNA, 22 bp, Homo sapiens
acatagttcagagcagcagacc

SEQ ID NO: 6900153 - DNA, 22 bp, Homo sapiens
ctggcacgcccacgtaggcact

SEQ ID NO: 6900154 - DNA, 23 bp, Homo sapiens
tttctctgagaagcagttctcta

SEQ ID NO: 6900155 - DNA, 22 bp, Homo sapiens
cagatgcatgtacagtgttgct

SEQ ID NO: 6900156 - DNA, 20 bp, Homo sapiens
ccatggccacatctgtgctg

SEQ ID NO: 6900157 - DNA, 22 bp, Homo sapiens
acagagacaatatttgtaaagt

SEQ ID NO: 6900158 - DNA, 22 bp, Homo sapiens
ccactgagtacccgatggctgc

SEQ ID NO: 6900159 - DNA, 22 bp, Homo sapiens
taactgtagttataaagctatc

SEQ ID NO: 6900160 - DNA, 22 bp, Homo sapiens
taaagtgtggacagtatctata

SEQ ID NO: 6900161 - DNA, 22 bp, Homo sapiens
tctgcagaattgtctcaagcta

SEQ ID NO: 6900162 - DNA, 22 bp, Homo sapiens
cccgagcctcggtttcttttct

SEQ ID NO: 6900163 - DNA, 22 bp, Homo sapiens
aagcaaaggaaagctgactttt

SEQ ID NO: 6900164 - DNA, 22 bp, Homo sapiens
aattttatctctaagcaggctt

SEQ ID NO: 6900165 - DNA, 22 bp, Homo sapiens
cctgctctaaatctcatggaac

SEQ ID NO: 6900166 - DNA, 22 bp, Homo sapiens
tacaacctctgcctcccaagtt

SEQ ID NO: 6900167 - DNA, 22 bp, Homo sapiens
cagtgcataatctaaatggggg

SEQ ID NO: 6900168 - DNA, 22 bp, Homo sapiens
gtgatgtacttggaaaagtcct

SEQ ID NO: 6900169 - DNA, 22 bp, Homo sapiens
attccagatgcttgtatttaaa

SEQ ID NO: 6900170 - DNA, 22 bp, Homo sapiens
agccagtggtgtaatgccgtct

SEQ ID NO: 6900171 - DNA, 22 bp, Homo sapiens
tcagactggattttcacgtttt

SEQ ID NO: 6900172 - DNA, 22 bp, Homo sapiens
tgaaggtacagatattttgtaa

SEQ ID NO: 6900173 - DNA, 22 bp, Homo sapiens
cgctaaaggatgctgtgcgcgg

SEQ ID NO: 6900174 - DNA, 22 bp, Homo sapiens
agttctcgagcgtccctgtttc

SEQ ID NO: 6900175 - DNA, 22 bp, Homo sapiens
gaagctgcgtgtagccatactt

SEQ ID NO: 6900176 - DNA, 22 bp, Homo sapiens
agagagttctttctagttgaag

SEQ ID NO: 6900177 - DNA, 22 bp, Homo sapiens
ctcccctccttaggtcttctag

SEQ ID NO: 6900178 - DNA, 22 bp, Homo sapiens
tttctagtaatcaatataaagt

SEQ ID NO: 6900179 - DNA, 22 bp, Homo sapiens
agagcctggctcccagctaccg

SEQ ID NO: 6900180 - DNA, 22 bp, Homo sapiens
ctggcaggtttggtgtctggtg

SEQ ID NO: 6900181 - DNA, 18 bp, Homo sapiens
agggatgtatgctggtgg

SEQ ID NO: 6900182 - DNA, 18 bp, Homo sapiens
atgtgtggcttggggtcc

SEQ ID NO: 6900183 - DNA, 22 bp, Homo sapiens
attcctatgttacagcgatcca

SEQ ID NO: 6900184 - DNA, 22 bp, Homo sapiens
agtcagttttaccaatctcagt

SEQ ID NO: 6900185 - DNA, 20 bp, Homo sapiens
gaattttatgaacactacca

SEQ ID NO: 6900186 - DNA, 22 bp, Homo sapiens
tttgctttcttgattcagatta

SEQ ID NO: 6900187 - DNA, 22 bp, Homo sapiens
tgaacacacacatcttaataat

SEQ ID NO: 6900188 - DNA, 23 bp, Homo sapiens
tctcctcctagatacagtcatgg

SEQ ID NO: 6900189 - DNA, 22 bp, Homo sapiens
taggttcagagaactgaaaata

SEQ ID NO: 6900190 - DNA, 22 bp, Homo sapiens
ctgctggcccccatttcagggt

SEQ ID NO: 6900191 - DNA, 22 bp, Homo sapiens
cagggcacttaaattgcctcgt

SEQ ID NO: 6900192 - DNA, 22 bp, Homo sapiens
agtttgggtggaacagagtcgt

SEQ ID NO: 6900193 - DNA, 17 bp, Homo sapiens
tgcaggctcctgtccct

SEQ ID NO: 6900194 - DNA, 22 bp, Homo sapiens
cttcattaatgtctataagttt

SEQ ID NO: 6900195 - DNA, 22 bp, Homo sapiens
agtctggtgctcgctctgcttc

SEQ ID NO: 6900196 - DNA, 22 bp, Homo sapiens
cctgggttagtatctgtttcca

SEQ ID NO: 6900197 - DNA, 22 bp, Homo sapiens
gtcattaaaggttttaaatgct

SEQ ID NO: 6900198 - DNA, 22 bp, Homo sapiens
aacactcaatttacaaactctg

SEQ ID NO: 6900199 - DNA, 22 bp, Homo sapiens
tctcaatttgattacattcata

SEQ ID NO: 6900200 - DNA, 22 bp, Homo sapiens
tggcaccagggaacaagcattt

SEQ ID NO: 6900201 - DNA, 20 bp, Homo sapiens
gaacagtcttctgagccaca

SEQ ID NO: 6900202 - DNA, 22 bp, Homo sapiens
cattacaaccccaaattacaaa

SEQ ID NO: 6900203 - DNA, 22 bp, Homo sapiens
atgaatgctgggacaaatatat

SEQ ID NO: 6900204 - DNA, 22 bp, Homo sapiens
tatagaggtggaaactgaggtt

SEQ ID NO: 6900205 - DNA, 22 bp, Homo sapiens
agatatgtttgtatatatttgt

SEQ ID NO: 6900206 - DNA, 22 bp, Homo sapiens
tcctgtggtctggaaggaatgg

SEQ ID NO: 6900207 - DNA, 21 bp, Homo sapiens
aaaaggaggcaggtgaacagc

SEQ ID NO: 6900208 - DNA, 22 bp, Homo sapiens
aagatcaagtgctggcagtgtt

SEQ ID NO: 6900209 - DNA, 22 bp, Homo sapiens
gattccacggctcagcctcaac

SEQ ID NO: 6900210 - DNA, 19 bp, Homo sapiens
gcttttctccttcaagcca

SEQ ID NO: 6900211 - DNA, 22 bp, Homo sapiens
cagctcctgttggtcttgagga

SEQ ID NO: 6900212 - DNA, 22 bp, Homo sapiens
gctctgagtgcatgcttttggg

SEQ ID NO: 6900213 - DNA, 22 bp, Homo sapiens
agccaggacagggcagctcgct

SEQ ID NO: 6900214 - DNA, 22 bp, Homo sapiens
tacatgcattggatggcaatag

SEQ ID NO: 6900215 - DNA, 22 bp, Homo sapiens
caaatgatccttgcaagctgtg

SEQ ID NO: 6900216 - DNA, 22 bp, Homo sapiens
gtctgccccacaggctcagttg

SEQ ID NO: 6900217 - DNA, 22 bp, Homo sapiens
atgttatttattatcctcggtt

SEQ ID NO: 6900218 - DNA, 20 bp, Homo sapiens
gggtaaaaggcagtgttgca

SEQ ID NO: 6900219 - DNA, 20 bp, Homo sapiens
agtgtggttttcaggaatat

SEQ ID NO: 6900220 - DNA, 22 bp, Homo sapiens
tcagtgaatgagataactttag

SEQ ID NO: 6900221 - DNA, 22 bp, Homo sapiens
cccttagctcaatttcttgccc

SEQ ID NO: 6900222 - DNA, 22 bp, Homo sapiens
ctgggagtcagtataagaagca

SEQ ID NO: 6900223 - DNA, 22 bp, Homo sapiens
taaaagattttataggaacaag

SEQ ID NO: 6900224 - DNA, 22 bp, Homo sapiens
actggagttattatttgcagct

SEQ ID NO: 6900225 - DNA, 22 bp, Homo sapiens
tgataggtcctcgggcactgga

SEQ ID NO: 6900226 - DNA, 22 bp, Homo sapiens
tctggctaacattttgtggaga

SEQ ID NO: 6900227 - DNA, 22 bp, Homo sapiens
tgtgaaatattggcaatttcat

SEQ ID NO: 6900228 - DNA, 22 bp, Homo sapiens
tgctagatggagcagaatagct

SEQ ID NO: 6900229 - DNA, 19 bp, Homo sapiens
tgctgcagtcaggcgaggg

SEQ ID NO: 6900230 - DNA, 22 bp, Homo sapiens
gtctcctggcttttgtcccagt

SEQ ID NO: 6900231 - DNA, 22 bp, Homo sapiens
aaactgattttaacattgatat

SEQ ID NO: 6900232 - DNA, 22 bp, Homo sapiens
ggcttctcgtgccgaagcaaga

SEQ ID NO: 6900233 - DNA, 22 bp, Homo sapiens
gtcacgtgcgggtttactgaga

SEQ ID NO: 6900234 - DNA, 22 bp, Homo sapiens
cagcccagcgcaaacaactggc

SEQ ID NO: 6900235 - DNA, 22 bp, Homo sapiens
tgagctttgtgggtaaagagag

SEQ ID NO: 6900236 - DNA, 19 bp, Homo sapiens
aaatactgaagttgttcat

SEQ ID NO: 6900237 - DNA, 20 bp, Homo sapiens
taaatggtgcatttcttata

SEQ ID NO: 6900238 - DNA, 22 bp, Homo sapiens
aattagcatttcccatataaat

SEQ ID NO: 6900239 - DNA, 22 bp, Homo sapiens
ttctggagaatcaccaccaggc

SEQ ID NO: 6900240 - DNA, 22 bp, Homo sapiens
tgtctggcatagttgctccctg

SEQ ID NO: 6900241 - DNA, 22 bp, Homo sapiens
ctgggcctcatccccagagttt

SEQ ID NO: 6900242 - DNA, 22 bp, Homo sapiens
ttgccactgaaccagtcttgca

SEQ ID NO: 6900243 - DNA, 22 bp, Homo sapiens
gaggctatgaggagtgaggttt

SEQ ID NO: 6900244 - DNA, 22 bp, Homo sapiens
atgctgataactttcagtgaca

SEQ ID NO: 6900245 - DNA, 22 bp, Homo sapiens
cctcttgaagagaagagttact

SEQ ID NO: 6900246 - DNA, 22 bp, Homo sapiens
agtttcagtgttgacagatggt

SEQ ID NO: 6900247 - DNA, 22 bp, Homo sapiens
tgaggtagctgtttagaaagac

SEQ ID NO: 6900248 - DNA, 22 bp, Homo sapiens
tccccagctctgtgcttccact

SEQ ID NO: 6900249 - DNA, 20 bp, Homo sapiens
tacaggaccttctttgtatc

SEQ ID NO: 6900250 - DNA, 22 bp, Homo sapiens
aagctgttgttcatcctgaatt

SEQ ID NO: 6900251 - DNA, 22 bp, Homo sapiens
cagtagttattagttgccactg

SEQ ID NO: 6900252 - DNA, 22 bp, Homo sapiens
gtactttaaatcaatgtagatt

SEQ ID NO: 6900253 - DNA, 22 bp, Homo sapiens
gctgttcacggaggaggatggg

SEQ ID NO: 6900254 - DNA, 22 bp, Homo sapiens
ccagggctctgcttctgccatg

SEQ ID NO: 6900255 - DNA, 22 bp, Homo sapiens
tagctagtagatggggaagctg

SEQ ID NO: 6900256 - DNA, 22 bp, Homo sapiens
cagtggcctttcctgctgctca

SEQ ID NO: 6900257 - DNA, 22 bp, Homo sapiens
tgtgtttaaagaggaagtgaga

SEQ ID NO: 6900258 - DNA, 22 bp, Homo sapiens
gtagggataggtgtccagagac

SEQ ID NO: 6900259 - DNA, 22 bp, Homo sapiens
attccttgggctgccttattat

SEQ ID NO: 6900260 - DNA, 22 bp, Homo sapiens
tgtgacgttcctgctggcgacc

SEQ ID NO: 6900261 - DNA, 22 bp, Homo sapiens
tgcctgaattcaattcctggct

SEQ ID NO: 6900262 - DNA, 22 bp, Homo sapiens
catcttcaccagagacaagcaa

SEQ ID NO: 6900263 - DNA, 21 bp, Homo sapiens
agtgggacacctaagagattt

SEQ ID NO: 6900264 - DNA, 23 bp, Homo sapiens
tccaggcatgagctctggatgga

SEQ ID NO: 6900265 - DNA, 22 bp, Homo sapiens
atatttgcattttaaacaggca

SEQ ID NO: 6900266 - DNA, 22 bp, Homo sapiens
tagctctgtcacatacactgca

SEQ ID NO: 6900267 - DNA, 22 bp, Homo sapiens
tattagcagccaacttagctgt

SEQ ID NO: 6900268 - DNA, 22 bp, Homo sapiens
aaggaccacctagggtgggggt

SEQ ID NO: 6900269 - DNA, 22 bp, Homo sapiens
ccagggctttatctgcctttga

SEQ ID NO: 6900270 - DNA, 22 bp, Homo sapiens
acaggagtggctctaccagacc

SEQ ID NO: 6900271 - DNA, 22 bp, Homo sapiens
gaggtggctccttcagggaata

SEQ ID NO: 6900272 - DNA, 22 bp, Homo sapiens
tatttctgtatgcataaaagga

SEQ ID NO: 6900273 - DNA, 22 bp, Homo sapiens
atgctgaattgatgcgagggag

SEQ ID NO: 6900274 - DNA, 22 bp, Homo sapiens
agctctgtaacccattccctgt

SEQ ID NO: 6900275 - DNA, 22 bp, Homo sapiens
agccctgggttagggtgggagc

SEQ ID NO: 6900276 - DNA, 22 bp, Homo sapiens
tgagcttttaatatacaggtgt

SEQ ID NO: 6900277 - DNA, 20 bp, Homo sapiens
tcccactgggcctcagtttc

SEQ ID NO: 6900278 - DNA, 22 bp, Homo sapiens
gaagagctaaaggcacaggctt

SEQ ID NO: 6900279 - DNA, 22 bp, Homo sapiens
ggagaaggtgctggtcactgtg

SEQ ID NO: 6900280 - DNA, 22 bp, Homo sapiens
ggccagagagccgctgttagga

SEQ ID NO: 6900281 - DNA, 22 bp, Homo sapiens
tggagtccccgagaggcctgca

SEQ ID NO: 6900282 - DNA, 20 bp, Homo sapiens
tgtggactcagtttcttgct

SEQ ID NO: 6900283 - DNA, 22 bp, Homo sapiens
tttttcatgagactagaagtca

SEQ ID NO: 6900284 - DNA, 22 bp, Homo sapiens
gctctgagaggtgcagcagtaa

SEQ ID NO: 6900285 - DNA, 22 bp, Homo sapiens
ttggctcctgttcctctgtctg

SEQ ID NO: 6900286 - DNA, 22 bp, Homo sapiens
caggtattcatagaattcagag

SEQ ID NO: 6900287 - DNA, 22 bp, Homo sapiens
ccaatgttaggctctggtttta

SEQ ID NO: 6900288 - DNA, 23 bp, Homo sapiens
aattgtgcttcccaggggctatt

SEQ ID NO: 6900289 - DNA, 22 bp, Homo sapiens
tgtgcctctgcctcatgccctg

SEQ ID NO: 6900290 - DNA, 22 bp, Homo sapiens
catgatggctcatgcttgtaat

SEQ ID NO: 6900291 - DNA, 22 bp, Homo sapiens
aaagcagctgatctcagagcct

SEQ ID NO: 6900292 - DNA, 22 bp, Homo sapiens
ctgttcacagaatcctcccctg

SEQ ID NO: 6900293 - DNA, 22 bp, Homo sapiens
tggtgttctgtgcacttggccc

SEQ ID NO: 6900294 - DNA, 22 bp, Homo sapiens
aggcacataatcatcctagcta

SEQ ID NO: 6900295 - DNA, 22 bp, Homo sapiens
tagaactacaagcattaaaagt

SEQ ID NO: 6900296 - DNA, 22 bp, Homo sapiens
atgaagcattacaggatgacag

SEQ ID NO: 6900297 - DNA, 22 bp, Homo sapiens
gagctgcagagctcgaaggaac

SEQ ID NO: 6900298 - DNA, 22 bp, Homo sapiens
gaagagaaggtgtaggccatcc

SEQ ID NO: 6900299 - DNA, 22 bp, Homo sapiens
cctggaagagctgaatcaggca

SEQ ID NO: 6900300 - DNA, 22 bp, Homo sapiens
gagaggcaggaatcctgggtga

SEQ ID NO: 6900301 - DNA, 22 bp, Homo sapiens
tgaagcacagacctgggcatca

SEQ ID NO: 6900302 - DNA, 22 bp, Homo sapiens
gctgagagtgagcactggatat

SEQ ID NO: 6900303 - DNA, 22 bp, Homo sapiens
tctgccaccttcatcctccact

SEQ ID NO: 6900304 - DNA, 22 bp, Homo sapiens
cccaggcttttaagttagacag

SEQ ID NO: 6900305 - DNA, 22 bp, Homo sapiens
tatctccagtttctgagcctca

SEQ ID NO: 6900306 - DNA, 22 bp, Homo sapiens
gcacatggtaggcatttgatgt

SEQ ID NO: 6900307 - DNA, 22 bp, Homo sapiens
gggtgcaagcaagtggcacaga

SEQ ID NO: 6900308 - DNA, 22 bp, Homo sapiens
tgccaggctgtcaattcaccca

SEQ ID NO: 6900309 - DNA, 22 bp, Homo sapiens
tagtctatcgcctctcacacgt

SEQ ID NO: 6900310 - DNA, 22 bp, Homo sapiens
ttgtctgtcccagcttgtgcat

SEQ ID NO: 6900311 - DNA, 22 bp, Homo sapiens
aggcttaaatgctgtaaccgaa

SEQ ID NO: 6900312 - DNA, 22 bp, Homo sapiens
aagatgtggacccagccaggct

SEQ ID NO: 6900313 - DNA, 22 bp, Homo sapiens
ttggctgtgaggggttgcacag

SEQ ID NO: 6900314 - DNA, 22 bp, Homo sapiens
atagcaacaccccaattttcta

SEQ ID NO: 6900315 - DNA, 22 bp, Homo sapiens
tcttttatagtgaattttcttg

SEQ ID NO: 6900316 - DNA, 22 bp, Homo sapiens
ttagtctaagcttgttcccttc

SEQ ID NO: 6900317 - DNA, 22 bp, Homo sapiens
cagactgtagagtttgagaagt

SEQ ID NO: 6900318 - DNA, 22 bp, Homo sapiens
aatagccactttagagcaggtg

SEQ ID NO: 6900319 - DNA, 22 bp, Homo sapiens
cagcccttggcccagggcacag

SEQ ID NO: 6900320 - DNA, 16 bp, Homo sapiens
atgttacagaagtaat

SEQ ID NO: 6900321 - DNA, 22 bp, Homo sapiens
aagtgcttggattgcaggtatg

SEQ ID NO: 6900322 - DNA, 22 bp, Homo sapiens
ggctccaggtacgtatgggagg

SEQ ID NO: 6900323 - DNA, 22 bp, Homo sapiens
tcaggtcttttgtctcctagaa

SEQ ID NO: 6900324 - DNA, 22 bp, Homo sapiens
ggcagttgttggccacgggtgg

SEQ ID NO: 6900325 - DNA, 20 bp, Homo sapiens
actgtgaatgctgaattagc

SEQ ID NO: 6900326 - DNA, 22 bp, Homo sapiens
ttggtcctgcagaggggtctgg

SEQ ID NO: 6900327 - DNA, 22 bp, Homo sapiens
tgatatggaaggaagatgtaca

SEQ ID NO: 6900328 - DNA, 22 bp, Homo sapiens
ctgatctaggttaggcctatat

SEQ ID NO: 6900329 - DNA, 22 bp, Homo sapiens
ttctaactttcaaggtcctttc

SEQ ID NO: 6900330 - DNA, 22 bp, Homo sapiens
acatattggcaaactggaggca

SEQ ID NO: 6900331 - DNA, 22 bp, Homo sapiens
agagctggaaaagttgttttaa

SEQ ID NO: 6900332 - DNA, 22 bp, Homo sapiens
agcacagagaaactaagacatt

SEQ ID NO: 6900333 - DNA, 22 bp, Homo sapiens
tttcagagttgtcttcttgacc

SEQ ID NO: 6900334 - DNA, 22 bp, Homo sapiens
ctgtttcaatttgaggatcagc

SEQ ID NO: 6900335 - DNA, 22 bp, Homo sapiens
agggctcagaaatgtctacggg

SEQ ID NO: 6900336 - DNA, 22 bp, Homo sapiens
tcttgcttctgctcaaggggag

SEQ ID NO: 6900337 - DNA, 22 bp, Homo sapiens
aggttacagtgattataggttt

SEQ ID NO: 6900338 - DNA, 22 bp, Homo sapiens
tggcttgggtgtctcagctctt

SEQ ID NO: 6900339 - DNA, 20 bp, Homo sapiens
tgtgttccctccgagacagc

SEQ ID NO: 6900340 - DNA, 22 bp, Homo sapiens
tcatttaattggttttgctcgt

SEQ ID NO: 6900341 - DNA, 22 bp, Homo sapiens
ccaaggagtagagcaggaagct

SEQ ID NO: 6900342 - DNA, 22 bp, Homo sapiens
ccaggttggagttcagtggcgc

SEQ ID NO: 6900343 - DNA, 22 bp, Homo sapiens
tctttgatgcttctgaaggtgt

SEQ ID NO: 6900344 - DNA, 22 bp, Homo sapiens
ttccttgggaaatgctcgttta

SEQ ID NO: 6900345 - DNA, 22 bp, Homo sapiens
gaaagtttctcacacatgcaga

SEQ ID NO: 6900346 - DNA, 22 bp, Homo sapiens
atgtacaatttttgcttagggg

SEQ ID NO: 6900347 - DNA, 22 bp, Homo sapiens
cagaacattcactcatatgtgg

SEQ ID NO: 6900348 - DNA, 19 bp, Homo sapiens
aactggataatggccacat

SEQ ID NO: 6900349 - DNA, 20 bp, Homo sapiens
ttacttgtctcagcatggag

SEQ ID NO: 6900350 - DNA, 22 bp, Homo sapiens
gttaaagtgatcttgtcaggtt

SEQ ID NO: 6900351 - DNA, 22 bp, Homo sapiens
tcaagcaaagatacaaatggaa

SEQ ID NO: 6900352 - DNA, 22 bp, Homo sapiens
tgaaacaatgtgaagttgctga

SEQ ID NO: 6900353 - DNA, 22 bp, Homo sapiens
acaggatcgccctgttgcccag

SEQ ID NO: 6900354 - DNA, 22 bp, Homo sapiens
gaacaaactgggtcccaatgat

SEQ ID NO: 6900355 - DNA, 22 bp, Homo sapiens
ggtccaggtcctgtgacagcag

SEQ ID NO: 6900356 - DNA, 22 bp, Homo sapiens
ttgttcttgccaagacatgaag

SEQ ID NO: 6900357 - DNA, 22 bp, Homo sapiens
tttcattgtcaataaactgtat

SEQ ID NO: 6900358 - DNA, 22 bp, Homo sapiens
atcaggcagaagcagaaagatg

SEQ ID NO: 6900359 - DNA, 22 bp, Homo sapiens
atacagatgctcatatgcccca

SEQ ID NO: 6900360 - DNA, 22 bp, Homo sapiens
tcccagcccagacttctccagt

SEQ ID NO: 6900361 - DNA, 22 bp, Homo sapiens
aaggtcgtgtgggggttgctgc

SEQ ID NO: 6900362 - DNA, 22 bp, Homo sapiens
catcaaataaagaaattccttg

SEQ ID NO: 6900363 - DNA, 22 bp, Homo sapiens
tggttaacttctgagcaggctg

SEQ ID NO: 6900364 - DNA, 22 bp, Homo sapiens
tggcacagccactgaatcggga

SEQ ID NO: 6900365 - DNA, 21 bp, Homo sapiens
ccacaggggctcccctgtcag

SEQ ID NO: 6900366 - DNA, 22 bp, Homo sapiens
ctcagccaggtgggggtcggga

SEQ ID NO: 6900367 - DNA, 22 bp, Homo sapiens
tccacgtttccccgagtccatc

SEQ ID NO: 6900368 - DNA, 22 bp, Homo sapiens
aagccaatcgtgtgaacttagt

SEQ ID NO: 6900369 - DNA, 22 bp, Homo sapiens
cagacttttgacattaatacag

SEQ ID NO: 6900370 - DNA, 22 bp, Homo sapiens
tggcaatgttagcaaagcattt

SEQ ID NO: 6900371 - DNA, 20 bp, Homo sapiens
atggcagtccgtgttcaggg

SEQ ID NO: 6900372 - DNA, 22 bp, Homo sapiens
ttagtgaatcacagagtacata

SEQ ID NO: 6900373 - DNA, 22 bp, Homo sapiens
tgtgtgtatgtttacttttcct

SEQ ID NO: 6900374 - DNA, 19 bp, Homo sapiens
tatgtgtatatgtatctgt

SEQ ID NO: 6900375 - DNA, 21 bp, Homo sapiens
caagttctgctgaatcttctt

SEQ ID NO: 6900376 - DNA, 20 bp, Homo sapiens
ggctcatcttgtctgctgac

SEQ ID NO: 6900377 - DNA, 22 bp, Homo sapiens
ggatcaggcgccatgggaagtg

SEQ ID NO: 6900378 - DNA, 22 bp, Homo sapiens
ctttaacctgtgcattttatat

SEQ ID NO: 6900379 - DNA, 22 bp, Homo sapiens
tggcatccaacggctcgctttc

SEQ ID NO: 6900380 - DNA, 22 bp, Homo sapiens
ggctgcctcctgctgggctgga

SEQ ID NO: 6900381 - DNA, 22 bp, Homo sapiens
ttatagtattaggtactcaaca

SEQ ID NO: 6900382 - DNA, 22 bp, Homo sapiens
gtccagtgtgtttatcttggat

SEQ ID NO: 6900383 - DNA, 22 bp, Homo sapiens
ctggtcaaaaattatgcttact

SEQ ID NO: 6900384 - DNA, 18 bp, Homo sapiens
ctctgtgttggtgtgaag

SEQ ID NO: 6900385 - DNA, 20 bp, Homo sapiens
tgtcctaatagacaagcaga

SEQ ID NO: 6900386 - DNA, 19 bp, Homo sapiens
tttcctaaaaagctgtgct

SEQ ID NO: 6900387 - DNA, 22 bp, Homo sapiens
tgagtccattctgttttcctgg

SEQ ID NO: 6900388 - DNA, 22 bp, Homo sapiens
atggcctttctcagtggtgctt

SEQ ID NO: 6900389 - DNA, 22 bp, Homo sapiens
acccaggaggcagaggttgcag

SEQ ID NO: 6900390 - DNA, 22 bp, Homo sapiens
ggccatgcctgtgggtgcaggc

SEQ ID NO: 6900391 - DNA, 22 bp, Homo sapiens
atctggagatttcttttcaata

SEQ ID NO: 6900392 - DNA, 22 bp, Homo sapiens
caggatggtggcatgatcagaa

SEQ ID NO: 6900393 - DNA, 22 bp, Homo sapiens
gctgctctgttaattgctgtaa

SEQ ID NO: 6900394 - DNA, 22 bp, Homo sapiens
atgcacaaggtagattattatt

SEQ ID NO: 6900395 - DNA, 22 bp, Homo sapiens
ttacaacagacacatattctaa

SEQ ID NO: 6900396 - DNA, 22 bp, Homo sapiens
tctgccatcaagatgctctggc

SEQ ID NO: 6900397 - DNA, 22 bp, Homo sapiens
aaggcagtggctggaaaacctg

SEQ ID NO: 6900398 - DNA, 22 bp, Homo sapiens
tccagagctgtcctactgtgag

SEQ ID NO: 6900399 - DNA, 22 bp, Homo sapiens
tgaagctagaatgtccatattt

SEQ ID NO: 6900400 - DNA, 22 bp, Homo sapiens
tccattcagaaatctggctaca

SEQ ID NO: 6900401 - DNA, 22 bp, Homo sapiens
caattaccagtaattgaggttt

SEQ ID NO: 6900402 - DNA, 22 bp, Homo sapiens
gttcctcaaaaaggagagcccc

SEQ ID NO: 6900403 - DNA, 22 bp, Homo sapiens
atccacttgccactgtatagtt

SEQ ID NO: 6900404 - DNA, 22 bp, Homo sapiens
aactgaacagaactcagagatt

SEQ ID NO: 6900405 - DNA, 19 bp, Homo sapiens
ctctgggcaagtcacttaa

SEQ ID NO: 6900406 - DNA, 22 bp, Homo sapiens
tggtggccgaagccctctctca

SEQ ID NO: 6900407 - DNA, 22 bp, Homo sapiens
gcttcaaagaacaaagggaggc

SEQ ID NO: 6900408 - DNA, 22 bp, Homo sapiens
tggctcaggagggatctttgct

SEQ ID NO: 6900409 - DNA, 22 bp, Homo sapiens
ttatggcttgtgcaggatctag

SEQ ID NO: 6900410 - DNA, 22 bp, Homo sapiens
agaggcatgcacagatgtgctg

SEQ ID NO: 6900411 - DNA, 22 bp, Homo sapiens
aagttctacagcttcgcaggca

SEQ ID NO: 6900412 - DNA, 22 bp, Homo sapiens
agtgtgggcccccaggttagcc

SEQ ID NO: 6900413 - DNA, 22 bp, Homo sapiens
tccagggacagcgctggagcta

SEQ ID NO: 6900414 - DNA, 22 bp, Homo sapiens
ggcccctcttgtggcacatacg

SEQ ID NO: 6900415 - DNA, 21 bp, Homo sapiens
ggcagcctgacccccagagag

SEQ ID NO: 6900416 - DNA, 19 bp, Homo sapiens
ggagcttggtggctgtggc

SEQ ID NO: 6900417 - DNA, 22 bp, Homo sapiens
tgggcctccgcatggcccagcg

SEQ ID NO: 6900418 - DNA, 22 bp, Homo sapiens
gacccagaaggagtgccctaga

SEQ ID NO: 6900419 - DNA, 22 bp, Homo sapiens
agccatctaagaaatacaaaat

SEQ ID NO: 6900420 - DNA, 22 bp, Homo sapiens
cctgaagagcactctagagttg

SEQ ID NO: 6900421 - DNA, 22 bp, Homo sapiens
ctcagacttttgttcaacgagt

SEQ ID NO: 6900422 - DNA, 22 bp, Homo sapiens
ttgggcaggtgtggctctcctt

SEQ ID NO: 6900423 - DNA, 21 bp, Homo sapiens
tacaacaggttttatttcgat

SEQ ID NO: 6900424 - DNA, 22 bp, Homo sapiens
ttaaagcatgttgcttaacagg

SEQ ID NO: 6900425 - DNA, 22 bp, Homo sapiens
acagtgaaaataatatcttcaa

SEQ ID NO: 6900426 - DNA, 18 bp, Homo sapiens
agccattacagacttgaa

SEQ ID NO: 6900427 - DNA, 22 bp, Homo sapiens
tgcatacacttcaaatgagcat

SEQ ID NO: 6900428 - DNA, 22 bp, Homo sapiens
taatcctttatggttttcctcc

SEQ ID NO: 6900429 - DNA, 22 bp, Homo sapiens
tgctttcagtttacatcagaac

SEQ ID NO: 6900430 - DNA, 22 bp, Homo sapiens
agagagtttaagtgacttgccg

SEQ ID NO: 6900431 - DNA, 22 bp, Homo sapiens
tgtaggtcacagtccctatccc

SEQ ID NO: 6900432 - DNA, 22 bp, Homo sapiens
catttgattcctttactcttat

SEQ ID NO: 6900433 - DNA, 22 bp, Homo sapiens
acatggaagataaaaatactca

SEQ ID NO: 6900434 - DNA, 21 bp, Homo sapiens
aaacagagctgagtaatagat

SEQ ID NO: 6900435 - DNA, 22 bp, Homo sapiens
tccttcgagacttccagatcct

SEQ ID NO: 6900436 - DNA, 22 bp, Homo sapiens
aaatgttctgaaagacccgctc

SEQ ID NO: 6900437 - DNA, 22 bp, Homo sapiens
cagcagatcaatgtagaatatt

SEQ ID NO: 6900438 - DNA, 22 bp, Homo sapiens
cacagggcaccagttggccatc

SEQ ID NO: 6900439 - DNA, 23 bp, Homo sapiens
cttcagtgtgggactgcagcgtg

SEQ ID NO: 6900440 - DNA, 22 bp, Homo sapiens
gcagtcatctgagctaactact

SEQ ID NO: 6900441 - DNA, 22 bp, Homo sapiens
attaacttttgatcagtgtggt

SEQ ID NO: 6900442 - DNA, 22 bp, Homo sapiens
agagttaagctttgcctaaaga

SEQ ID NO: 6900443 - DNA, 22 bp, Homo sapiens
tctggagtctggtggttatggt

SEQ ID NO: 6900444 - DNA, 22 bp, Homo sapiens
atattcctgacttaatttttga

SEQ ID NO: 6900445 - DNA, 22 bp, Homo sapiens
atagatcatttgcattggtcgt

SEQ ID NO: 6900446 - DNA, 22 bp, Homo sapiens
ttggatggaggttcaagcacta

SEQ ID NO: 6900447 - DNA, 22 bp, Homo sapiens
tatttactgtatttgaagttga

SEQ ID NO: 6900448 - DNA, 22 bp, Homo sapiens
ctacataatctggatttgtctg

SEQ ID NO: 6900449 - DNA, 22 bp, Homo sapiens
atataggcttcatgacagaggg

SEQ ID NO: 6900450 - DNA, 22 bp, Homo sapiens
taaagacaaacccactagggtt

SEQ ID NO: 6900451 - DNA, 22 bp, Homo sapiens
aaatgcatggtaaatgattgcc

SEQ ID NO: 6900452 - DNA, 22 bp, Homo sapiens
ggaatgcactgaaaattgtgct

SEQ ID NO: 6900453 - DNA, 22 bp, Homo sapiens
tcccattgccatagataggaca

SEQ ID NO: 6900454 - DNA, 22 bp, Homo sapiens
gtgatgaagtaaatgttattta

SEQ ID NO: 6900455 - DNA, 22 bp, Homo sapiens
attttcctccatgtgagcagtt

SEQ ID NO: 6900456 - DNA, 18 bp, Homo sapiens
aaattattcttccttttc

SEQ ID NO: 6900457 - DNA, 22 bp, Homo sapiens
ggcttctgaaactgtattgaga

SEQ ID NO: 6900458 - DNA, 20 bp, Homo sapiens
tcagtttaaatcctggcttt

SEQ ID NO: 6900459 - DNA, 22 bp, Homo sapiens
agttgctcaatgtggctgtgga

SEQ ID NO: 6900460 - DNA, 22 bp, Homo sapiens
tctaagtaaaatttgtcatttc

SEQ ID NO: 6900461 - DNA, 17 bp, Homo sapiens
ttctcttcctggatagt

SEQ ID NO: 6900462 - DNA, 18 bp, Homo sapiens
cctcagggagagagacgc

SEQ ID NO: 6900463 - DNA, 20 bp, Homo sapiens
tgtaacacatgagctttgag

SEQ ID NO: 6900464 - DNA, 22 bp, Homo sapiens
agtatgcaaatgtcataagcat

SEQ ID NO: 6900465 - DNA, 20 bp, Homo sapiens
agcactataaggggaaaggg

SEQ ID NO: 6900466 - DNA, 22 bp, Homo sapiens
tgtgatagatatgcacatagct

SEQ ID NO: 6900467 - DNA, 19 bp, Homo sapiens
ggttcctcacgctaagggc

SEQ ID NO: 6900468 - DNA, 22 bp, Homo sapiens
gccagggaggctgtagggtcct

SEQ ID NO: 6900469 - DNA, 22 bp, Homo sapiens
agtttcacagaatatgaaggtt

SEQ ID NO: 6900470 - DNA, 22 bp, Homo sapiens
ttagttgatgttctggaggtag

SEQ ID NO: 6900471 - DNA, 16 bp, Homo sapiens
agcagccagcactgga

SEQ ID NO: 6900472 - DNA, 23 bp, Homo sapiens
ttcaggaaatgaatacagacaca

SEQ ID NO: 6900473 - DNA, 22 bp, Homo sapiens
acgcagtctttgctctctgtca

SEQ ID NO: 6900474 - DNA, 22 bp, Homo sapiens
tgcctgggactgtactaaattt

SEQ ID NO: 6900475 - DNA, 22 bp, Homo sapiens
tgccagtgcttgtgtctgagca

SEQ ID NO: 6900476 - DNA, 21 bp, Homo sapiens
gtcctgttcctgaaccttccc

SEQ ID NO: 6900477 - DNA, 22 bp, Homo sapiens
tcccttaaaactcatgtgttgt

SEQ ID NO: 6900478 - DNA, 22 bp, Homo sapiens
gatgggggccagggcctgcttt

SEQ ID NO: 6900479 - DNA, 22 bp, Homo sapiens
gctggggcctgaacagtcagct

SEQ ID NO: 6900480 - DNA, 22 bp, Homo sapiens
acaggtctggtctgggtgggac

SEQ ID NO: 6900481 - DNA, 19 bp, Homo sapiens
gtgtacacttggccatggt

SEQ ID NO: 6900482 - DNA, 22 bp, Homo sapiens
ggagctctcttgtggtactccc

SEQ ID NO: 6900483 - DNA, 22 bp, Homo sapiens
gaaacatttgttgagtacttgc

SEQ ID NO: 6900484 - DNA, 22 bp, Homo sapiens
tttgcaggcacggaggcagctg

SEQ ID NO: 6900485 - DNA, 22 bp, Homo sapiens
ctcagacaaatgattaaggtta

SEQ ID NO: 6900486 - DNA, 22 bp, Homo sapiens
caaagaccatgtggcctgaaaa

SEQ ID NO: 6900487 - DNA, 22 bp, Homo sapiens
gaaatgattttagtttatcatg

SEQ ID NO: 6900488 - DNA, 19 bp, Homo sapiens
cgtggagctggcaggcagg

SEQ ID NO: 6900489 - DNA, 20 bp, Homo sapiens
aacttgttttgttttctaat

SEQ ID NO: 6900490 - DNA, 22 bp, Homo sapiens
tcctggtgatcaaaattcattt

SEQ ID NO: 6900491 - DNA, 22 bp, Homo sapiens
tgcctgtgaaaaccctggggtt

SEQ ID NO: 6900492 - DNA, 22 bp, Homo sapiens
ctgagctatagaattgtcagca

SEQ ID NO: 6900493 - DNA, 22 bp, Homo sapiens
cctagcagggaagcagtgagga

SEQ ID NO: 6900494 - DNA, 22 bp, Homo sapiens
cacttttaaatgggtccgtgtt

SEQ ID NO: 6900495 - DNA, 22 bp, Homo sapiens
gccagctgaggccgtgcaggct

SEQ ID NO: 6900496 - DNA, 22 bp, Homo sapiens
actgaattcctctttcttatcc

SEQ ID NO: 6900497 - DNA, 22 bp, Homo sapiens
aagagcacttttcttatctgca

SEQ ID NO: 6900498 - DNA, 22 bp, Homo sapiens
acagacctgggcacagaaagga

SEQ ID NO: 6900499 - DNA, 22 bp, Homo sapiens
gcctcagacactgcctgggtgt

SEQ ID NO: 6900500 - DNA, 22 bp, Homo sapiens
gcagggcagggcaagaactggg

SEQ ID NO: 6900501 - DNA, 22 bp, Homo sapiens
actgaggtagggcacacctagg

SEQ ID NO: 6900502 - DNA, 22 bp, Homo sapiens
tcctgctgagcgtctgtcattt

SEQ ID NO: 6900503 - DNA, 22 bp, Homo sapiens
aatggcagaggcaaagatggta

SEQ ID NO: 6900504 - DNA, 22 bp, Homo sapiens
taagtagcctacaagtatattt

SEQ ID NO: 6900505 - DNA, 22 bp, Homo sapiens
cctctggggtctagcaatagca

SEQ ID NO: 6900506 - DNA, 22 bp, Homo sapiens
aggtaaggctgtaagctaagcc

SEQ ID NO: 6900507 - DNA, 22 bp, Homo sapiens
tgtgtcctcagggaagcagaga

SEQ ID NO: 6900508 - DNA, 22 bp, Homo sapiens
ataatctggtctttgtatgagt

SEQ ID NO: 6900509 - DNA, 22 bp, Homo sapiens
gtgcctaggatggaggtgggtt

SEQ ID NO: 6900510 - DNA, 22 bp, Homo sapiens
agcagcagttgctgacgttcta

SEQ ID NO: 6900511 - DNA, 22 bp, Homo sapiens
ggtggggtcacgacagagggaa

SEQ ID NO: 6900512 - DNA, 22 bp, Homo sapiens
acatcccttgctcggggcccct

SEQ ID NO: 6900513 - DNA, 22 bp, Homo sapiens
gtacaaattgatacaggttttc

SEQ ID NO: 6900514 - DNA, 22 bp, Homo sapiens
aaaggctgaaggagttgtcata

SEQ ID NO: 6900515 - DNA, 22 bp, Homo sapiens
acctttatatatcaacttctcc

SEQ ID NO: 6900516 - DNA, 22 bp, Homo sapiens
aggtggtccagagtaggaagtg

SEQ ID NO: 6900517 - DNA, 22 bp, Homo sapiens
agcagctgtcccttaacatcag

SEQ ID NO: 6900518 - DNA, 22 bp, Homo sapiens
cctgtgggttttctgtagaaat

SEQ ID NO: 6900519 - DNA, 21 bp, Homo sapiens
gagtgggctgagatggggctg

SEQ ID NO: 6900520 - DNA, 22 bp, Homo sapiens
ctgagagagtaaagtagaatta

SEQ ID NO: 6900521 - DNA, 22 bp, Homo sapiens
tgcctgtgggtgatgatttgat

SEQ ID NO: 6900522 - DNA, 22 bp, Homo sapiens
aggcatggctttaggcaggcgt

SEQ ID NO: 6900523 - DNA, 22 bp, Homo sapiens
acttctggaggcctagggaaga

SEQ ID NO: 6900524 - DNA, 22 bp, Homo sapiens
gggtgctcatggataaggcgaa

SEQ ID NO: 6900525 - DNA, 22 bp, Homo sapiens
ttgagaaatacttttgtagcct

SEQ ID NO: 6900526 - DNA, 22 bp, Homo sapiens
agtggtagacaatttaaaaata

SEQ ID NO: 6900527 - DNA, 22 bp, Homo sapiens
gaatgataaatggaagcagcat

SEQ ID NO: 6900528 - DNA, 22 bp, Homo sapiens
tctgtgccgcgccggagaccct

SEQ ID NO: 6900529 - DNA, 20 bp, Homo sapiens
cctaaatacctgtcaccagg

SEQ ID NO: 6900530 - DNA, 22 bp, Homo sapiens
gatgcctggcacccagcaagga

SEQ ID NO: 6900531 - DNA, 22 bp, Homo sapiens
tctcagaatccttgcccaggtg

SEQ ID NO: 6900532 - DNA, 22 bp, Homo sapiens
gaggcccggcgcaggcggactt

SEQ ID NO: 6900533 - DNA, 20 bp, Homo sapiens
cacgtttttccactagcaaa

SEQ ID NO: 6900534 - DNA, 22 bp, Homo sapiens
ggtacaaggagtgaaggtttgg

SEQ ID NO: 6900535 - DNA, 22 bp, Homo sapiens
tgtataaaccatggacagcttt

SEQ ID NO: 6900536 - DNA, 22 bp, Homo sapiens
gtctcgtcaatggcaggttccc

SEQ ID NO: 6900537 - DNA, 22 bp, Homo sapiens
tagagctatttagagcatttta

SEQ ID NO: 6900538 - DNA, 22 bp, Homo sapiens
ccagaaaactctacatgcttgt

SEQ ID NO: 6900539 - DNA, 19 bp, Homo sapiens
tttctctccctcatcccga

SEQ ID NO: 6900540 - DNA, 22 bp, Homo sapiens
taacttttctaggtgtgataat

SEQ ID NO: 6900541 - DNA, 21 bp, Homo sapiens
aagaagtttggattttgtcct

SEQ ID NO: 6900542 - DNA, 22 bp, Homo sapiens
actaaatgctgcataaatgctt

SEQ ID NO: 6900543 - DNA, 22 bp, Homo sapiens
ttgtaacttgtgattataatct

SEQ ID NO: 6900544 - DNA, 22 bp, Homo sapiens
aataggaagtcacatcaaggga

SEQ ID NO: 6900545 - DNA, 22 bp, Homo sapiens
ggaatcagcaaggaggctcacc

SEQ ID NO: 6900546 - DNA, 22 bp, Homo sapiens
tcctttctatcttgggtatcta

SEQ ID NO: 6900547 - DNA, 22 bp, Homo sapiens
agcaggtttgttttcttctgag

SEQ ID NO: 6900548 - DNA, 22 bp, Homo sapiens
tagctcctggctgcagggcctc

SEQ ID NO: 6900549 - DNA, 22 bp, Homo sapiens
tttgtttgcggcacatagtttg

SEQ ID NO: 6900550 - DNA, 22 bp, Homo sapiens
tagttcagggttatttcaaggt

SEQ ID NO: 6900551 - DNA, 22 bp, Homo sapiens
attttagatttaagaataaggt

SEQ ID NO: 6900552 - DNA, 22 bp, Homo sapiens
agggtcaagaataaagattaca

SEQ ID NO: 6900553 - DNA, 22 bp, Homo sapiens
gctctgtgttttgcccaggaga

SEQ ID NO: 6900554 - DNA, 22 bp, Homo sapiens
aagtgaatgtagcaaacttgaa

SEQ ID NO: 6900555 - DNA, 21 bp, Homo sapiens
agagcacaggtggacaatgct

SEQ ID NO: 6900556 - DNA, 22 bp, Homo sapiens
tgagagcctgtgttcaaatgcc

SEQ ID NO: 6900557 - DNA, 22 bp, Homo sapiens
ctagtagcccattttggatacc

SEQ ID NO: 6900558 - DNA, 22 bp, Homo sapiens
ctagatctgcccactgaagttc

SEQ ID NO: 6900559 - DNA, 22 bp, Homo sapiens
gctgtcatagagtgggtgggcc

SEQ ID NO: 6900560 - DNA, 22 bp, Homo sapiens
tttgtaagagcatatgtaaagg

SEQ ID NO: 6900561 - DNA, 22 bp, Homo sapiens
tctggcatggatttgagtgtct

SEQ ID NO: 6900562 - DNA, 22 bp, Homo sapiens
caatgtgtgcttacaggccagt

SEQ ID NO: 6900563 - DNA, 22 bp, Homo sapiens
catgtggattcctgcttagaaa

SEQ ID NO: 6900564 - DNA, 22 bp, Homo sapiens
aacatctaggttctcatcgata

SEQ ID NO: 6900565 - DNA, 22 bp, Homo sapiens
gaaaccagctagaggcagaggg

SEQ ID NO: 6900566 - DNA, 22 bp, Homo sapiens
gatctatttactcttttcctag

SEQ ID NO: 6900567 - DNA, 22 bp, Homo sapiens
tgtgggctctaatggcagcaga

SEQ ID NO: 6900568 - DNA, 22 bp, Homo sapiens
cttaggatttaatttcagactc

SEQ ID NO: 6900569 - DNA, 22 bp, Homo sapiens
aagccttgattcactctgtgga

SEQ ID NO: 6900570 - DNA, 22 bp, Homo sapiens
gatctgtttcaattgtcttagt

SEQ ID NO: 6900571 - DNA, 22 bp, Homo sapiens
tgcttgtccgaggtgagtactt

SEQ ID NO: 6900572 - DNA, 22 bp, Homo sapiens
ctgtgggagaagggctttttct

SEQ ID NO: 6900573 - DNA, 22 bp, Homo sapiens
aatggtaatggagagaactact

SEQ ID NO: 6900574 - DNA, 22 bp, Homo sapiens
cttgggagacacaagaagacat

SEQ ID NO: 6900575 - DNA, 22 bp, Homo sapiens
agcactttattcaggaactcca

SEQ ID NO: 6900576 - DNA, 22 bp, Homo sapiens
tttgggtagataacaaagatct

SEQ ID NO: 6900577 - DNA, 22 bp, Homo sapiens
tgctagggaagaacgagggaat

SEQ ID NO: 6900578 - DNA, 22 bp, Homo sapiens
aaattctaaggtcacaatgttg

SEQ ID NO: 6900579 - DNA, 22 bp, Homo sapiens
cattgcacgggcgtctgtctgt

SEQ ID NO: 6900580 - DNA, 22 bp, Homo sapiens
cagtgctatgttggttttctgg

SEQ ID NO: 6900581 - DNA, 22 bp, Homo sapiens
catgtggagaattaaaaaatac

SEQ ID NO: 6900582 - DNA, 22 bp, Homo sapiens
agattgtatcctcggagacttc

SEQ ID NO: 6900583 - DNA, 22 bp, Homo sapiens
ctgctgagccctggcacaggtg

SEQ ID NO: 6900584 - DNA, 22 bp, Homo sapiens
aggccagccctcacctgtgttc

SEQ ID NO: 6900585 - DNA, 22 bp, Homo sapiens
gtccagctgcagctgggcagaa

SEQ ID NO: 6900586 - DNA, 22 bp, Homo sapiens
ttccagtcgcttaaacctgagc

SEQ ID NO: 6900587 - DNA, 22 bp, Homo sapiens
atattacacacggtatcacggg

SEQ ID NO: 6900588 - DNA, 22 bp, Homo sapiens
taaacaattcctctctaggcat

SEQ ID NO: 6900589 - DNA, 22 bp, Homo sapiens
caggcagcgtcctgcttcctgt

SEQ ID NO: 6900590 - DNA, 22 bp, Homo sapiens
tctgtccaacactctctagaca

SEQ ID NO: 6900591 - DNA, 22 bp, Homo sapiens
agctcctgttctgagagcagga

SEQ ID NO: 6900592 - DNA, 22 bp, Homo sapiens
agaatagtggcaatgactgcac

SEQ ID NO: 6900593 - DNA, 22 bp, Homo sapiens
atgttttctccatgttatgctt

SEQ ID NO: 6900594 - DNA, 22 bp, Homo sapiens
catgagggttggggtggagctt

SEQ ID NO: 6900595 - DNA, 22 bp, Homo sapiens
aataggctgagccatttcaagt

SEQ ID NO: 6900596 - DNA, 22 bp, Homo sapiens
agagtctgtgagtccctgagca

SEQ ID NO: 6900597 - DNA, 22 bp, Homo sapiens
atcaaattggaatgaaaggctc

SEQ ID NO: 6900598 - DNA, 22 bp, Homo sapiens
ctgaattctgccttgaggcctt

SEQ ID NO: 6900599 - DNA, 23 bp, Homo sapiens
gaggagggtcgtgctgtgttcct

SEQ ID NO: 6900600 - DNA, 22 bp, Homo sapiens
aatagcagaagactagtagaca

SEQ ID NO: 6900601 - DNA, 22 bp, Homo sapiens
tcatgtgtgtttcatgtatgga

SEQ ID NO: 6900602 - DNA, 22 bp, Homo sapiens
actgtgttcacacttacaaatg

SEQ ID NO: 6900603 - DNA, 19 bp, Homo sapiens
tcagatgcttctcgtctca

SEQ ID NO: 6900604 - DNA, 22 bp, Homo sapiens
agctccactaaacagaatactc

SEQ ID NO: 6900605 - DNA, 22 bp, Homo sapiens
ttgatttcttactcttccaagg

SEQ ID NO: 6900606 - DNA, 22 bp, Homo sapiens
atgttttccattgccatggaaa

SEQ ID NO: 6900607 - DNA, 22 bp, Homo sapiens
tttcagtttagactaaaggtag

SEQ ID NO: 6900608 - DNA, 22 bp, Homo sapiens
gctgggcaacggaagagagaaa

SEQ ID NO: 6900609 - DNA, 21 bp, Homo sapiens
atctttgaagcatgcagtgag

SEQ ID NO: 6900610 - DNA, 22 bp, Homo sapiens
acagtggaaagaaacgaattag

SEQ ID NO: 6900611 - DNA, 22 bp, Homo sapiens
ccaggcttcccccatcctagga

SEQ ID NO: 6900612 - DNA, 22 bp, Homo sapiens
agctggcagttgcgataatgca

SEQ ID NO: 6900613 - DNA, 22 bp, Homo sapiens
ttgaaatgagactaattgattg

SEQ ID NO: 6900614 - DNA, 22 bp, Homo sapiens
tctctggtggctccatcagtag

SEQ ID NO: 6900615 - DNA, 22 bp, Homo sapiens
gagctgggatttgaacctggga

SEQ ID NO: 6900616 - DNA, 22 bp, Homo sapiens
gctgcagagggtcttagagagg

SEQ ID NO: 6900617 - DNA, 22 bp, Homo sapiens
tcacccctacatttcccttgct

SEQ ID NO: 6900618 - DNA, 20 bp, Homo sapiens
ttgtttattatgttctgatc

SEQ ID NO: 6900619 - DNA, 21 bp, Homo sapiens
gggccacaccttctgcagacc

SEQ ID NO: 6900620 - DNA, 22 bp, Homo sapiens
tttgtaatgataatgttaaatt

SEQ ID NO: 6900621 - DNA, 22 bp, Homo sapiens
tagaatgtggaggtaacagact

SEQ ID NO: 6900622 - DNA, 22 bp, Homo sapiens
acaggtgtaggtacatttgcat

SEQ ID NO: 6900623 - DNA, 22 bp, Homo sapiens
agcagcaggaggccattgtctt

SEQ ID NO: 6900624 - DNA, 22 bp, Homo sapiens
ccttacaatgcagtttacttag

SEQ ID NO: 6900625 - DNA, 22 bp, Homo sapiens
aagagaatatcgatagcactct

SEQ ID NO: 6900626 - DNA, 22 bp, Homo sapiens
ttgagtggttcctcagttgact

SEQ ID NO: 6900627 - DNA, 22 bp, Homo sapiens
tgcacacacggagataggcttt

SEQ ID NO: 6900628 - DNA, 23 bp, Homo sapiens
tctctggaactggagagtacggt

SEQ ID NO: 6900629 - DNA, 22 bp, Homo sapiens
tgagggattgatgtttgacatg

SEQ ID NO: 6900630 - DNA, 22 bp, Homo sapiens
ttgtattggcaaagaacttgag

SEQ ID NO: 6900631 - DNA, 22 bp, Homo sapiens
cacagaggatgcccaagcgatc

SEQ ID NO: 6900632 - DNA, 22 bp, Homo sapiens
ctgagaagcactgtctgcaaga

SEQ ID NO: 6900633 - DNA, 22 bp, Homo sapiens
agggcttttgcaatccaagtct

SEQ ID NO: 6900634 - DNA, 23 bp, Homo sapiens
atctggagtgttgagtaggtact

SEQ ID NO: 6900635 - DNA, 21 bp, Homo sapiens
agtgtctgagcgctgcttctg

SEQ ID NO: 6900636 - DNA, 22 bp, Homo sapiens
atattactctgatttagtaaat

SEQ ID NO: 6900637 - DNA, 22 bp, Homo sapiens
agccccagtaagggagggcctg

SEQ ID NO: 6900638 - DNA, 22 bp, Homo sapiens
aagcacatgagctattcatgct

SEQ ID NO: 6900639 - DNA, 22 bp, Homo sapiens
gcaagctgtgatttatgtgaat

SEQ ID NO: 6900640 - DNA, 22 bp, Homo sapiens
ggccggctgccgtagggctcag

SEQ ID NO: 6900641 - DNA, 23 bp, Homo sapiens
ttttgcaataagtcactggaata

SEQ ID NO: 6900642 - DNA, 22 bp, Homo sapiens
tgatttgaaacctttggcaaga

SEQ ID NO: 6900643 - DNA, 22 bp, Homo sapiens
ctgaggcctgggggcgtggacg

SEQ ID NO: 6900644 - DNA, 22 bp, Homo sapiens
tagccagtttctttaacagcaa

SEQ ID NO: 6900645 - DNA, 22 bp, Homo sapiens
cttgcacatgttttactctcca

SEQ ID NO: 6900646 - DNA, 22 bp, Homo sapiens
actgagctctgatgagatttgg

SEQ ID NO: 6900647 - DNA, 18 bp, Homo sapiens
tgctctggtctcacttgg

SEQ ID NO: 6900648 - DNA, 22 bp, Homo sapiens
ccagctccggtgtgcttatttc

SEQ ID NO: 6900649 - DNA, 22 bp, Homo sapiens
tcttaccagctgagaagagggt

SEQ ID NO: 6900650 - DNA, 22 bp, Homo sapiens
catgaaaaatttactgttaaca

SEQ ID NO: 6900651 - DNA, 22 bp, Homo sapiens
attttcttctctccctggctgc

SEQ ID NO: 6900652 - DNA, 22 bp, Homo sapiens
atgtgcacacagtgtcatgcaa

SEQ ID NO: 6900653 - DNA, 22 bp, Homo sapiens
ccagccttgaatcagttgctgc

SEQ ID NO: 6900654 - DNA, 22 bp, Homo sapiens
agtatttagcatagtggttagt

SEQ ID NO: 6900655 - DNA, 22 bp, Homo sapiens
aactgcaatcacttttgcacca

SEQ ID NO: 6900656 - DNA, 22 bp, Homo sapiens
ttagtggtactcagggagggaa

SEQ ID NO: 6900657 - DNA, 22 bp, Homo sapiens
acgttttattcccatgcagcat

SEQ ID NO: 6900658 - DNA, 22 bp, Homo sapiens
gtgggcagatacatttgatatg

SEQ ID NO: 6900659 - DNA, 22 bp, Homo sapiens
aggtggcatgagactgtaccag

SEQ ID NO: 6900660 - DNA, 23 bp, Homo sapiens
cagtgccatttgtcttgcctatg

SEQ ID NO: 6900661 - DNA, 22 bp, Homo sapiens
taatatgggcagtctgaatata

SEQ ID NO: 6900662 - DNA, 22 bp, Homo sapiens
taactgagcctaaggcagtaga

SEQ ID NO: 6900663 - DNA, 17 bp, Homo sapiens
atgattacatctttcct

SEQ ID NO: 6900664 - DNA, 22 bp, Homo sapiens
aggtaggcctgacgctggggtg

SEQ ID NO: 6900665 - DNA, 22 bp, Homo sapiens
acatgccaagatcctcgtcttt

SEQ ID NO: 6900666 - DNA, 22 bp, Homo sapiens
tgcctttaaaaaggaagtcatt

SEQ ID NO: 6900667 - DNA, 22 bp, Homo sapiens
tgtgccagggcctccaaaagcc

SEQ ID NO: 6900668 - DNA, 22 bp, Homo sapiens
agcttgatgaaagtgggtgctc

SEQ ID NO: 6900669 - DNA, 22 bp, Homo sapiens
aatatctggagatgctttttgt

SEQ ID NO: 6900670 - DNA, 22 bp, Homo sapiens
ggctcctgggagaagttttatt

SEQ ID NO: 6900671 - DNA, 22 bp, Homo sapiens
gtgggatgcttaggatcttgcc

SEQ ID NO: 6900672 - DNA, 22 bp, Homo sapiens
ctgtacagaagctagagcaaat

SEQ ID NO: 6900673 - DNA, 22 bp, Homo sapiens
agttgacagaggtatgaggttt

SEQ ID NO: 6900674 - DNA, 22 bp, Homo sapiens
tcaggtgtgttgtattttacca

SEQ ID NO: 6900675 - DNA, 22 bp, Homo sapiens
gaagtgatgctggttgagatct

SEQ ID NO: 6900676 - DNA, 22 bp, Homo sapiens
tggataaaatctgtaaggctca

SEQ ID NO: 6900677 - DNA, 22 bp, Homo sapiens
cttagcaagcattcaagtgcct

SEQ ID NO: 6900678 - DNA, 22 bp, Homo sapiens
atctcaaaaatgacctagagaa

SEQ ID NO: 6900679 - DNA, 22 bp, Homo sapiens
ctgaggaaagctgcagcggtac

SEQ ID NO: 6900680 - DNA, 16 bp, Homo sapiens
tctgagcacaaaacac

SEQ ID NO: 6900681 - DNA, 22 bp, Homo sapiens
catctggctagctatcattgtg

SEQ ID NO: 6900682 - DNA, 22 bp, Homo sapiens
ctctggaggtcaggtgtggtgg

SEQ ID NO: 6900683 - DNA, 22 bp, Homo sapiens
acagggctctgacaccaaggta

SEQ ID NO: 6900684 - DNA, 22 bp, Homo sapiens
tctgcagagacaaagtgttatt

SEQ ID NO: 6900685 - DNA, 22 bp, Homo sapiens
cttctataggttgttgtgactt

SEQ ID NO: 6900686 - DNA, 22 bp, Homo sapiens
atcttgttaaaatgcagattct

SEQ ID NO: 6900687 - DNA, 22 bp, Homo sapiens
atttatcaccagttagctgact

SEQ ID NO: 6900688 - DNA, 22 bp, Homo sapiens
cacatgatcacttcttgaaaat

SEQ ID NO: 6900689 - DNA, 22 bp, Homo sapiens
cagggaacaagatgagaatgga

SEQ ID NO: 6900690 - DNA, 22 bp, Homo sapiens
atgcaatggtatatggtcacct

SEQ ID NO: 6900691 - DNA, 22 bp, Homo sapiens
tcatacacaagagcatgtaaca

SEQ ID NO: 6900692 - DNA, 22 bp, Homo sapiens
tgaggctcacaaatctgcattt

SEQ ID NO: 6900693 - DNA, 22 bp, Homo sapiens
tttaaatgtttatagagagtac

SEQ ID NO: 6900694 - DNA, 22 bp, Homo sapiens
tgtcactgcagaaattttctcc

SEQ ID NO: 6900695 - DNA, 22 bp, Homo sapiens
attcagttaagggtcttgagat

SEQ ID NO: 6900696 - DNA, 22 bp, Homo sapiens
gccaggcattattccgatccct

SEQ ID NO: 6900697 - DNA, 20 bp, Homo sapiens
cagaagcaaggcaggtacct

SEQ ID NO: 6900698 - DNA, 22 bp, Homo sapiens
gtgaggcaagggcatactaggc

SEQ ID NO: 6900699 - DNA, 22 bp, Homo sapiens
ttggctgatgcaagagcttcct

SEQ ID NO: 6900700 - DNA, 22 bp, Homo sapiens
ggctctgggtctgtggggagcg

SEQ ID NO: 6900701 - DNA, 23 bp, Homo sapiens
ttgttctatcaacctagacttag

SEQ ID NO: 6900702 - DNA, 22 bp, Homo sapiens
tgcatgacaattgccgtcaagt

SEQ ID NO: 6900703 - DNA, 22 bp, Homo sapiens
cttctcagcatggttactgtga

SEQ ID NO: 6900704 - DNA, 14 bp, Homo sapiens
gccataagggatgc

SEQ ID NO: 6900705 - DNA, 22 bp, Homo sapiens
gtttttgtcgagttccttgacc

SEQ ID NO: 6900706 - DNA, 19 bp, Homo sapiens
ctttccagctcgagcaatt

SEQ ID NO: 6900707 - DNA, 22 bp, Homo sapiens
atgatggctaggctggttttga

SEQ ID NO: 6900708 - DNA, 22 bp, Homo sapiens
aaactgaggtgaggccatcgct

SEQ ID NO: 6900709 - DNA, 17 bp, Homo sapiens
ggctgctgtgctggtgc

SEQ ID NO: 6900710 - DNA, 22 bp, Homo sapiens
aggcccagggctgctctctgaa

SEQ ID NO: 6900711 - DNA, 23 bp, Homo sapiens
ctctgcaggagagtgggcagggc

SEQ ID NO: 6900712 - DNA, 22 bp, Homo sapiens
actgagctctaggttttgaacc

SEQ ID NO: 6900713 - DNA, 22 bp, Homo sapiens
gagactgcatagatggccacaa

SEQ ID NO: 6900714 - DNA, 22 bp, Homo sapiens
taacttgataagtattctctgc

SEQ ID NO: 6900715 - DNA, 22 bp, Homo sapiens
ggagctgagacccagtggctga

SEQ ID NO: 6900716 - DNA, 22 bp, Homo sapiens
cagacagacagccgtggccacc

SEQ ID NO: 6900717 - DNA, 22 bp, Homo sapiens
tacttcatgggacagagagctg

SEQ ID NO: 6900718 - DNA, 22 bp, Homo sapiens
tcagaaagctatatggtgtgtc

SEQ ID NO: 6900719 - DNA, 22 bp, Homo sapiens
gcaggggcggctgggtttccag

SEQ ID NO: 6900720 - DNA, 22 bp, Homo sapiens
tggaataaagcagctttagttc

SEQ ID NO: 6900721 - DNA, 22 bp, Homo sapiens
tctaaactagggttaaaggaaa

SEQ ID NO: 6900722 - DNA, 22 bp, Homo sapiens
cctttgtgaggtcctgtggggg

SEQ ID NO: 6900723 - DNA, 22 bp, Homo sapiens
atacagtattacctgttcagga

SEQ ID NO: 6900724 - DNA, 22 bp, Homo sapiens
tagcagcaatttcagaagtttg

SEQ ID NO: 6900725 - DNA, 22 bp, Homo sapiens
tctctgagaatatcccataaga

SEQ ID NO: 6900726 - DNA, 22 bp, Homo sapiens
tcattgataaagtactgctttt

SEQ ID NO: 6900727 - DNA, 22 bp, Homo sapiens
tgctggaggccgagaagcagca

SEQ ID NO: 6900728 - DNA, 22 bp, Homo sapiens
tatgcctgataactgtgtctct

SEQ ID NO: 6900729 - DNA, 22 bp, Homo sapiens
taacatgcatagatttgtatta

SEQ ID NO: 6900730 - DNA, 22 bp, Homo sapiens
aaagacacacagccagcaagtg

SEQ ID NO: 6900731 - DNA, 20 bp, Homo sapiens
tgcatacgtatgtatttgga

SEQ ID NO: 6900732 - DNA, 20 bp, Homo sapiens
cctaggccctccggctgccc

SEQ ID NO: 6900733 - DNA, 20 bp, Homo sapiens
gtcgaaaaagataaacaggc

SEQ ID NO: 6900734 - DNA, 22 bp, Homo sapiens
ggagagaggagcccactgctgt

SEQ ID NO: 6900735 - DNA, 22 bp, Homo sapiens
agcagtcaggacctgtgatttt

SEQ ID NO: 6900736 - DNA, 22 bp, Homo sapiens
gactccaggtgcaggaggagcc

SEQ ID NO: 6900737 - DNA, 22 bp, Homo sapiens
accctccccaagaggtcgtgcc

SEQ ID NO: 6900738 - DNA, 22 bp, Homo sapiens
ttgtctttggaaatttaatgtt

SEQ ID NO: 6900739 - DNA, 22 bp, Homo sapiens
gcaagggtgtgaaccaatgaga

SEQ ID NO: 6900740 - DNA, 23 bp, Homo sapiens
agtttcacattttacatgtggct

SEQ ID NO: 6900741 - DNA, 23 bp, Homo sapiens
tatgtcatgagcatattgaatgt

SEQ ID NO: 6900742 - DNA, 22 bp, Homo sapiens
gctgggcaaggctgaagctacc

SEQ ID NO: 6900743 - DNA, 22 bp, Homo sapiens
tagcacactaaagatattaaca

SEQ ID NO: 6900744 - DNA, 22 bp, Homo sapiens
tagtctcttatcaggcacacac

SEQ ID NO: 6900745 - DNA, 21 bp, Homo sapiens
gacttcatgggtcaaccaatt

SEQ ID NO: 6900746 - DNA, 22 bp, Homo sapiens
ctggtgctggcaacagagtagg

SEQ ID NO: 6900747 - DNA, 22 bp, Homo sapiens
ttgtggattgtgttaaattcct

SEQ ID NO: 6900748 - DNA, 22 bp, Homo sapiens
gcatggcaagaccctgtctcta

SEQ ID NO: 6900749 - DNA, 22 bp, Homo sapiens
tctggagtttgaggacaagctt

SEQ ID NO: 6900750 - DNA, 21 bp, Homo sapiens
tcaaatcatgtactgaccaca

SEQ ID NO: 6900751 - DNA, 22 bp, Homo sapiens
ctgggtctaaaaattctcagat

SEQ ID NO: 6900752 - DNA, 22 bp, Homo sapiens
acaggactagatgataaaatgt

SEQ ID NO: 6900753 - DNA, 22 bp, Homo sapiens
tagaaaatccagtgtggggaga

SEQ ID NO: 6900754 - DNA, 22 bp, Homo sapiens
ccgctgtcctggagctgctgct

SEQ ID NO: 6900755 - DNA, 22 bp, Homo sapiens
ttgtgagacacaaatcaatgca

SEQ ID NO: 6900756 - DNA, 22 bp, Homo sapiens
cacagcttagaaaagaagccat

SEQ ID NO: 6900757 - DNA, 22 bp, Homo sapiens
atttggtcccttgttgtgtccc

SEQ ID NO: 6900758 - DNA, 22 bp, Homo sapiens
cctggtgcaggtgtgttgccag

SEQ ID NO: 6900759 - DNA, 21 bp, Homo sapiens
gagctgttactctctctggag

SEQ ID NO: 6900760 - DNA, 22 bp, Homo sapiens
ggcaggcaccagctcagcaata

SEQ ID NO: 6900761 - DNA, 22 bp, Homo sapiens
cacctgttagctctaattttct

SEQ ID NO: 6900762 - DNA, 22 bp, Homo sapiens
tgagccctggctctttcactta

SEQ ID NO: 6900763 - DNA, 21 bp, Homo sapiens
tgccagcatgtaggctagttg

SEQ ID NO: 6900764 - DNA, 22 bp, Homo sapiens
tcaaaagtctgcattcttcaca

SEQ ID NO: 6900765 - DNA, 22 bp, Homo sapiens
tgtggctgactcctggtcccca

SEQ ID NO: 6900766 - DNA, 22 bp, Homo sapiens
ctctgggcactgtatgggttct

SEQ ID NO: 6900767 - DNA, 22 bp, Homo sapiens
atacaagacagtaggaaactga

SEQ ID NO: 6900768 - DNA, 22 bp, Homo sapiens
agaccaggtctttatggctcca

SEQ ID NO: 6900769 - DNA, 22 bp, Homo sapiens
tggctgctactgagggggtctg

SEQ ID NO: 6900770 - DNA, 22 bp, Homo sapiens
tacaggagagatttagtaatca

SEQ ID NO: 6900771 - DNA, 22 bp, Homo sapiens
aagctagattggcattcatttc

SEQ ID NO: 6900772 - DNA, 22 bp, Homo sapiens
aactccttaatgaagtccagtt

SEQ ID NO: 6900773 - DNA, 22 bp, Homo sapiens
gatcttgagcaagttgtgtaac

SEQ ID NO: 6900774 - DNA, 22 bp, Homo sapiens
ttggggcagttattctgtgccc

SEQ ID NO: 6900775 - DNA, 22 bp, Homo sapiens
cagtaatagcagagtcttccat

SEQ ID NO: 6900776 - DNA, 22 bp, Homo sapiens
taaatgtttagtcttatttggg

SEQ ID NO: 6900777 - DNA, 22 bp, Homo sapiens
tggagctgtcactcagaaccaa

SEQ ID NO: 6900778 - DNA, 22 bp, Homo sapiens
gctgttctagcttcagtttcgc

SEQ ID NO: 6900779 - DNA, 22 bp, Homo sapiens
gtaaatgtgcttcttttaactt

SEQ ID NO: 6900780 - DNA, 22 bp, Homo sapiens
gatcctgtctccgcaccgtgtt

SEQ ID NO: 6900781 - DNA, 22 bp, Homo sapiens
gttttccatggaggtctgacct

SEQ ID NO: 6900782 - DNA, 22 bp, Homo sapiens
gcaaggtctttcagaaaggaaa

SEQ ID NO: 6900783 - DNA, 22 bp, Homo sapiens
attgcaggccagtgtcctgggc

SEQ ID NO: 6900784 - DNA, 19 bp, Homo sapiens
tttagtatgagctccaggg

SEQ ID NO: 6900785 - DNA, 22 bp, Homo sapiens
aggctctgtgacaatcaagctg

SEQ ID NO: 6900786 - DNA, 22 bp, Homo sapiens
cccatggcagtcagagataaga

SEQ ID NO: 6900787 - DNA, 22 bp, Homo sapiens
ttctgcagatcaacttgactgc

SEQ ID NO: 6900788 - DNA, 22 bp, Homo sapiens
taaaagtatactttcaaaggag

SEQ ID NO: 6900789 - DNA, 22 bp, Homo sapiens
gcctgtcctcccctgcgctgag

SEQ ID NO: 6900790 - DNA, 22 bp, Homo sapiens
gccagctgtctaagagagtaaa

SEQ ID NO: 6900791 - DNA, 22 bp, Homo sapiens
ttgtacatttgttcagttctga

SEQ ID NO: 6900792 - DNA, 22 bp, Homo sapiens
ttcatggcctactttgcttcaa

SEQ ID NO: 6900793 - DNA, 22 bp, Homo sapiens
tgtaacaagtaatccatgggag

SEQ ID NO: 6900794 - DNA, 22 bp, Homo sapiens
taagacatccgttgcttataat

SEQ ID NO: 6900795 - DNA, 22 bp, Homo sapiens
tggccagagttgagggggtttc

SEQ ID NO: 6900796 - DNA, 22 bp, Homo sapiens
agtcagttgcaaacatcaggca

SEQ ID NO: 6900797 - DNA, 22 bp, Homo sapiens
cagttttcttgttatatttggg

SEQ ID NO: 6900798 - DNA, 22 bp, Homo sapiens
gaattgtaagtaccagcatgct

SEQ ID NO: 6900799 - DNA, 21 bp, Homo sapiens
ggcatgctgctgctacttggc

SEQ ID NO: 6900800 - DNA, 22 bp, Homo sapiens
ttggttatgcaatttctttgct

SEQ ID NO: 6900801 - DNA, 22 bp, Homo sapiens
gagccaatctttgggctcttgg

SEQ ID NO: 6900802 - DNA, 22 bp, Homo sapiens
tcatatttcaaaatggctggag

SEQ ID NO: 6900803 - DNA, 22 bp, Homo sapiens
tggcagaggagaattaagatta

SEQ ID NO: 6900804 - DNA, 22 bp, Homo sapiens
atgctgtgtcaccttaggattt

SEQ ID NO: 6900805 - DNA, 22 bp, Homo sapiens
agttacagtgttctattactct

SEQ ID NO: 6900806 - DNA, 22 bp, Homo sapiens
gctactgtgaaggagtctttct

SEQ ID NO: 6900807 - DNA, 22 bp, Homo sapiens
cgtcagggttgagcaggtagat

SEQ ID NO: 6900808 - DNA, 22 bp, Homo sapiens
gagggagagtgatggaccattg

SEQ ID NO: 6900809 - DNA, 22 bp, Homo sapiens
agtgccttctctgggctaggtc

SEQ ID NO: 6900810 - DNA, 22 bp, Homo sapiens
acattgtgcctgtgatattaca

SEQ ID NO: 6900811 - DNA, 22 bp, Homo sapiens
acatggtaaattggtaaaggac

SEQ ID NO: 6900812 - DNA, 22 bp, Homo sapiens
tcatggggtttggctggatgtc

SEQ ID NO: 6900813 - DNA, 17 bp, Homo sapiens
ccctgggtgagttctca

SEQ ID NO: 6900814 - DNA, 22 bp, Homo sapiens
tttatctgtatatctcaagtgt

SEQ ID NO: 6900815 - DNA, 22 bp, Homo sapiens
ttggaatcctgagatgagaatt

SEQ ID NO: 6900816 - DNA, 22 bp, Homo sapiens
ctgaagctgcataccaaagact

SEQ ID NO: 6900817 - DNA, 22 bp, Homo sapiens
atgcaaataagtgcaggcgtgg

SEQ ID NO: 6900818 - DNA, 22 bp, Homo sapiens
ctgacccatataagagtggagg

SEQ ID NO: 6900819 - DNA, 22 bp, Homo sapiens
aggagccaaattactagctctg

SEQ ID NO: 6900820 - DNA, 22 bp, Homo sapiens
aagttcctgggtgatcctgatg

SEQ ID NO: 6900821 - DNA, 21 bp, Homo sapiens
tttctaagtgcttggtttggg

SEQ ID NO: 6900822 - DNA, 22 bp, Homo sapiens
tcagtttataaattgtatttag

SEQ ID NO: 6900823 - DNA, 22 bp, Homo sapiens
cagtccctgggggagtcaccag

SEQ ID NO: 6900824 - DNA, 22 bp, Homo sapiens
gtggtcagagatgacagtgggt

SEQ ID NO: 6900825 - DNA, 22 bp, Homo sapiens
gagccacagtggtggcccacgt

SEQ ID NO: 6900826 - DNA, 22 bp, Homo sapiens
aattgcaattttcttaaggtct

SEQ ID NO: 6900827 - DNA, 22 bp, Homo sapiens
atttagtagagaaattaagaaa

SEQ ID NO: 6900828 - DNA, 22 bp, Homo sapiens
tttgcttcacaagtatggttct

SEQ ID NO: 6900829 - DNA, 22 bp, Homo sapiens
agagaacatattttgtatgatt

SEQ ID NO: 6900830 - DNA, 22 bp, Homo sapiens
aatgtatgaaggttccagtttc

SEQ ID NO: 6900831 - DNA, 22 bp, Homo sapiens
tctcaatgactcctatttacat

SEQ ID NO: 6900832 - DNA, 22 bp, Homo sapiens
tcagaacattaaggatttgaag

SEQ ID NO: 6900833 - DNA, 22 bp, Homo sapiens
acaacagtgtggtggaaggagc

SEQ ID NO: 6900834 - DNA, 22 bp, Homo sapiens
aaagtcttgcattgatcttgaa

SEQ ID NO: 6900835 - DNA, 19 bp, Homo sapiens
tgtgccccctccagcctgc

SEQ ID NO: 6900836 - DNA, 22 bp, Homo sapiens
tttttacctggaggataaatgt

SEQ ID NO: 6900837 - DNA, 20 bp, Homo sapiens
attgtgaatactgcatatgt

SEQ ID NO: 6900838 - DNA, 22 bp, Homo sapiens
gttggtcatatcattgaagctt

SEQ ID NO: 6900839 - DNA, 22 bp, Homo sapiens
ctgctgtcaaaaatcactccat

SEQ ID NO: 6900840 - DNA, 22 bp, Homo sapiens
cctgggagtgcacaggtttcgt

SEQ ID NO: 6900841 - DNA, 22 bp, Homo sapiens
ttccttagctgtccctggaaat

SEQ ID NO: 6900842 - DNA, 22 bp, Homo sapiens
gtcaatgaccctatgtggatgg

SEQ ID NO: 6900843 - DNA, 22 bp, Homo sapiens
ggtgctgatattgttttggtga

SEQ ID NO: 6900844 - DNA, 21 bp, Homo sapiens
tgctgagatttgcctgattac

SEQ ID NO: 6900845 - DNA, 22 bp, Homo sapiens
tcaccggcagacgtggcctgat

SEQ ID NO: 6900846 - DNA, 22 bp, Homo sapiens
tgtcagcagaaatctggtctgc

SEQ ID NO: 6900847 - DNA, 22 bp, Homo sapiens
tcctggccatgcaagatgagga

SEQ ID NO: 6900848 - DNA, 20 bp, Homo sapiens
tctgtgctacactccagatt

SEQ ID NO: 6900849 - DNA, 22 bp, Homo sapiens
caaggcctgactgcttgtctaa

SEQ ID NO: 6900850 - DNA, 21 bp, Homo sapiens
attctaaccaggagaggctga

SEQ ID NO: 6900851 - DNA, 23 bp, Homo sapiens
ctatggttttaaaggtggatatc

SEQ ID NO: 6900852 - DNA, 19 bp, Homo sapiens
cacagctctgctcagggaa

SEQ ID NO: 6900853 - DNA, 22 bp, Homo sapiens
gggctggctaagacttttctgt

SEQ ID NO: 6900854 - DNA, 20 bp, Homo sapiens
taagttgtatttgtcatgaa

SEQ ID NO: 6900855 - DNA, 22 bp, Homo sapiens
ttagtagagagtcatgttttta

SEQ ID NO: 6900856 - DNA, 22 bp, Homo sapiens
atgggctgcttctccagcacct

SEQ ID NO: 6900857 - DNA, 22 bp, Homo sapiens
tctgaagtgatcatcatttctc

SEQ ID NO: 6900858 - DNA, 22 bp, Homo sapiens
gtggccagaatcttgaggcctt

SEQ ID NO: 6900859 - DNA, 22 bp, Homo sapiens
tccctgcagcaggtgatcaatg

SEQ ID NO: 6900860 - DNA, 22 bp, Homo sapiens
atagcttcagaattgagatatc

SEQ ID NO: 6900861 - DNA, 22 bp, Homo sapiens
tggcaaggccacaggtgcagtt

SEQ ID NO: 6900862 - DNA, 22 bp, Homo sapiens
gtgataagacagtaggcacaag

SEQ ID NO: 6900863 - DNA, 22 bp, Homo sapiens
tcaatgttctgattcttttgca

SEQ ID NO: 6900864 - DNA, 22 bp, Homo sapiens
ttctgctgtagttgcatctgtt

SEQ ID NO: 6900865 - DNA, 22 bp, Homo sapiens
catttgaaacctggaatctacc

SEQ ID NO: 6900866 - DNA, 22 bp, Homo sapiens
tggtatggctaacgaggtcaag

SEQ ID NO: 6900867 - DNA, 22 bp, Homo sapiens
gggcactcctctggtccagccc

SEQ ID NO: 6900868 - DNA, 22 bp, Homo sapiens
gaactgtataggagcagtgttt

SEQ ID NO: 6900869 - DNA, 22 bp, Homo sapiens
gagtgagtggccaggaggcaga

SEQ ID NO: 6900870 - DNA, 23 bp, Homo sapiens
attgattccctcttggaagggat

SEQ ID NO: 6900871 - DNA, 22 bp, Homo sapiens
agcaagctacctagatagtcta

SEQ ID NO: 6900872 - DNA, 22 bp, Homo sapiens
gacagtggagccacgttgggag

SEQ ID NO: 6900873 - DNA, 22 bp, Homo sapiens
aggctcagcctgggcctagagc

SEQ ID NO: 6900874 - DNA, 22 bp, Homo sapiens
catactgtgaagcttactattt

SEQ ID NO: 6900875 - DNA, 22 bp, Homo sapiens
atcacatttatagtggcacgca

SEQ ID NO: 6900876 - DNA, 22 bp, Homo sapiens
ggagagctagtgcctgccagta

SEQ ID NO: 6900877 - DNA, 22 bp, Homo sapiens
tggcagcactaggtactgagct

SEQ ID NO: 6900878 - DNA, 22 bp, Homo sapiens
gtgtgggaatggcggtcgtgca

SEQ ID NO: 6900879 - DNA, 19 bp, Homo sapiens
gcagctgtgggaagagcca

SEQ ID NO: 6900880 - DNA, 22 bp, Homo sapiens
cacagtgtagttaatgtgacat

SEQ ID NO: 6900881 - DNA, 22 bp, Homo sapiens
aaatgtcaaagacgtgtttttg

SEQ ID NO: 6900882 - DNA, 22 bp, Homo sapiens
tgaaagtatttgatttctatta

SEQ ID NO: 6900883 - DNA, 22 bp, Homo sapiens
aattccagggggtaccattcat

SEQ ID NO: 6900884 - DNA, 22 bp, Homo sapiens
tagggatgagccagtgggtagt

SEQ ID NO: 6900885 - DNA, 22 bp, Homo sapiens
cagtgtctttcagactcagaaa

SEQ ID NO: 6900886 - DNA, 22 bp, Homo sapiens
ccctgcagtgtgacctcaccta

SEQ ID NO: 6900887 - DNA, 22 bp, Homo sapiens
tgtcagcagtttttagtggagg

SEQ ID NO: 6900888 - DNA, 22 bp, Homo sapiens
tgctccattctctagccagtgc

SEQ ID NO: 6900889 - DNA, 22 bp, Homo sapiens
aaagtgctgaaattacaggtgt

SEQ ID NO: 6900890 - DNA, 23 bp, Homo sapiens
aaaggcaggcctaggacatattg

SEQ ID NO: 6900891 - DNA, 22 bp, Homo sapiens
ctctgggcaaagatgcctcatc

SEQ ID NO: 6900892 - DNA, 18 bp, Homo sapiens
agccaaggaggaggagga

SEQ ID NO: 6900893 - DNA, 22 bp, Homo sapiens
tgaagacccctgctagtgtcat

SEQ ID NO: 6900894 - DNA, 22 bp, Homo sapiens
gtgtgctcaagggcaggaacct

SEQ ID NO: 6900895 - DNA, 22 bp, Homo sapiens
aaaagggcaaaaccatcatgga

SEQ ID NO: 6900896 - DNA, 22 bp, Homo sapiens
gacctggggtggaaggaaggca

SEQ ID NO: 6900897 - DNA, 22 bp, Homo sapiens
ctttctaaatgttccttgatta

SEQ ID NO: 6900898 - DNA, 22 bp, Homo sapiens
gaggtggctgggagtagggaat

SEQ ID NO: 6900899 - DNA, 22 bp, Homo sapiens
gaatgcaagttgcatgaaggca

SEQ ID NO: 6900900 - DNA, 22 bp, Homo sapiens
gctttctggagcctgggggaac

SEQ ID NO: 6900901 - DNA, 20 bp, Homo sapiens
gggtgggagagtctgagggt

SEQ ID NO: 6900902 - DNA, 23 bp, Homo sapiens
acttccagttgcttcagcatatg

SEQ ID NO: 6900903 - DNA, 17 bp, Homo sapiens
ccttagggcagtgtggt

SEQ ID NO: 6900904 - DNA, 21 bp, Homo sapiens
caggctctgctgggtgctggg

SEQ ID NO: 6900905 - DNA, 22 bp, Homo sapiens
cagcatctgtttttctgaccca

SEQ ID NO: 6900906 - DNA, 19 bp, Homo sapiens
ctgggatgtctcctcccag

SEQ ID NO: 6900907 - DNA, 22 bp, Homo sapiens
gtgctggccctgtcctcgagct

SEQ ID NO: 6900908 - DNA, 22 bp, Homo sapiens
acatttctcttagagttggact

SEQ ID NO: 6900909 - DNA, 22 bp, Homo sapiens
gctccagcacctagagcaggtc

SEQ ID NO: 6900910 - DNA, 22 bp, Homo sapiens
agatggtgtttccccaggtgga

SEQ ID NO: 6900911 - DNA, 19 bp, Homo sapiens
agatgtggagtttgatttc

SEQ ID NO: 6900912 - DNA, 22 bp, Homo sapiens
atgctggggcctcagaccagaa

SEQ ID NO: 6900913 - DNA, 22 bp, Homo sapiens
gcttccaatgcttctatcacat

SEQ ID NO: 6900914 - DNA, 19 bp, Homo sapiens
ggcatggggtccggggacc

SEQ ID NO: 6900915 - DNA, 22 bp, Homo sapiens
agtttgaaagtattgacagaag

SEQ ID NO: 6900916 - DNA, 22 bp, Homo sapiens
atagtgcattttattatcagca

SEQ ID NO: 6900917 - DNA, 22 bp, Homo sapiens
tgtggacaccactgggactgga

SEQ ID NO: 6900918 - DNA, 22 bp, Homo sapiens
ttcttcatctgtaagataagca

SEQ ID NO: 6900919 - DNA, 22 bp, Homo sapiens
tacatgcaaggatatttgtgcg

SEQ ID NO: 6900920 - DNA, 22 bp, Homo sapiens
tgtcatgtataagacactgtgt

SEQ ID NO: 6900921 - DNA, 22 bp, Homo sapiens
tcggagtgaatcttcacaatgt

SEQ ID NO: 6900922 - DNA, 22 bp, Homo sapiens
cagggacataagaggaacatgg

SEQ ID NO: 6900923 - DNA, 22 bp, Homo sapiens
atgaggtttaggttcctcctct

SEQ ID NO: 6900924 - DNA, 18 bp, Homo sapiens
aatgtttgtcctctctaa

SEQ ID NO: 6900925 - DNA, 23 bp, Homo sapiens
tctgtccacgcgaggcccttgct

SEQ ID NO: 6900926 - DNA, 22 bp, Homo sapiens
tcacatctatacccaataattt

SEQ ID NO: 6900927 - DNA, 22 bp, Homo sapiens
tccatcatgttcacagctatat

SEQ ID NO: 6900928 - DNA, 22 bp, Homo sapiens
tgcattctgacttagttaatat

SEQ ID NO: 6900929 - DNA, 22 bp, Homo sapiens
gtccagaaggaggtcaagttgg

SEQ ID NO: 6900930 - DNA, 22 bp, Homo sapiens
gtccctgccctcctgggactca

SEQ ID NO: 6900931 - DNA, 22 bp, Homo sapiens
gtggccctttgttttgatacct

SEQ ID NO: 6900932 - DNA, 22 bp, Homo sapiens
aactgtcttaataacaaaagct

SEQ ID NO: 6900933 - DNA, 22 bp, Homo sapiens
gcctttgtaactcttttattgt

SEQ ID NO: 6900934 - DNA, 22 bp, Homo sapiens
cagctctttattgaaacaaaaa

SEQ ID NO: 6900935 - DNA, 22 bp, Homo sapiens
agatcttgttaaatgctgcctc

SEQ ID NO: 6900936 - DNA, 22 bp, Homo sapiens
ttcataagggtggccatataaa

SEQ ID NO: 6900937 - DNA, 22 bp, Homo sapiens
gtgtggactctctggtgcacag

SEQ ID NO: 6900938 - DNA, 22 bp, Homo sapiens
cctcttgacagcctctgtttcc

SEQ ID NO: 6900939 - DNA, 19 bp, Homo sapiens
ggtgctgacatcatgcttt

SEQ ID NO: 6900940 - DNA, 22 bp, Homo sapiens
agcacagggcccagcctaggcc

SEQ ID NO: 6900941 - DNA, 22 bp, Homo sapiens
ggccaccaaagtcctgtggctt

SEQ ID NO: 6900942 - DNA, 22 bp, Homo sapiens
gcttcccattatggaaactctt

SEQ ID NO: 6900943 - DNA, 22 bp, Homo sapiens
ctgggaggattcattgaggtga

SEQ ID NO: 6900944 - DNA, 22 bp, Homo sapiens
tcagtcccttctccaggtcagc

SEQ ID NO: 6900945 - DNA, 22 bp, Homo sapiens
atttcttaaaacttcagggaga

SEQ ID NO: 6900946 - DNA, 22 bp, Homo sapiens
caggctgccgaggctgcagaat

SEQ ID NO: 6900947 - DNA, 22 bp, Homo sapiens
tccaaggcctggcagcacaaag

SEQ ID NO: 6900948 - DNA, 22 bp, Homo sapiens
cttatactgaaaaattatttgt

SEQ ID NO: 6900949 - DNA, 22 bp, Homo sapiens
tggcaggtggcacagcctggga

SEQ ID NO: 6900950 - DNA, 22 bp, Homo sapiens
tttgaaatatgtgtcttttgaa

SEQ ID NO: 6900951 - DNA, 22 bp, Homo sapiens
atgggggcggctgaagcccagg

SEQ ID NO: 6900952 - DNA, 22 bp, Homo sapiens
ggccagccctcctccctgggtt

SEQ ID NO: 6900953 - DNA, 22 bp, Homo sapiens
tcaagacagtgtgatactggcc

SEQ ID NO: 6900954 - DNA, 23 bp, Homo sapiens
acgggagggctgtttgcttggtg

SEQ ID NO: 6900955 - DNA, 22 bp, Homo sapiens
ttctgggctctctttctgtgtg

SEQ ID NO: 6900956 - DNA, 22 bp, Homo sapiens
tcatgtttggagtttgctcact

SEQ ID NO: 6900957 - DNA, 22 bp, Homo sapiens
tccttgagcctcccagactcag

SEQ ID NO: 6900958 - DNA, 22 bp, Homo sapiens
cagtgggtgaaagatggctaag

SEQ ID NO: 6900959 - DNA, 22 bp, Homo sapiens
attattagtgatgttgttactg

SEQ ID NO: 6900960 - DNA, 22 bp, Homo sapiens
tgcctgaaataccatcatgagt

SEQ ID NO: 6900961 - DNA, 22 bp, Homo sapiens
tgtagctatagaggctgtacct

SEQ ID NO: 6900962 - DNA, 22 bp, Homo sapiens
ttcttttctttaggcattgtgt

SEQ ID NO: 6900963 - DNA, 22 bp, Homo sapiens
actgcagcaggtaagagcattt

SEQ ID NO: 6900964 - DNA, 22 bp, Homo sapiens
aggttcagtgcctggaacaggg

SEQ ID NO: 6900965 - DNA, 22 bp, Homo sapiens
atggaatgcggtagtatgtgca

SEQ ID NO: 6900966 - DNA, 22 bp, Homo sapiens
tgaaagcaggcgggctacttta

SEQ ID NO: 6900967 - DNA, 22 bp, Homo sapiens
tccctcagaaattctctctgaa

SEQ ID NO: 6900968 - DNA, 22 bp, Homo sapiens
ttcaaacagtgtagaatatatg

SEQ ID NO: 6900969 - DNA, 22 bp, Homo sapiens
tattgcagaagaaatgaatgaa

SEQ ID NO: 6900970 - DNA, 22 bp, Homo sapiens
tttttcttgtgctggatctaat

SEQ ID NO: 6900971 - DNA, 22 bp, Homo sapiens
cctcctgggctcctgtctgcac

SEQ ID NO: 6900972 - DNA, 22 bp, Homo sapiens
tgcttatcgtttagtacattgc

SEQ ID NO: 6900973 - DNA, 18 bp, Homo sapiens
ggagcccagaggtgagtt

SEQ ID NO: 6900974 - DNA, 22 bp, Homo sapiens
tgggaggtctcttgcggcctag

SEQ ID NO: 6900975 - DNA, 18 bp, Homo sapiens
gcagggacacagggtcac

SEQ ID NO: 6900976 - DNA, 22 bp, Homo sapiens
aagccaggggttggtatgctat

SEQ ID NO: 6900977 - DNA, 22 bp, Homo sapiens
tgcaactaggaggttcttagct

SEQ ID NO: 6900978 - DNA, 22 bp, Homo sapiens
ctgagggcatgaacattccata

SEQ ID NO: 6900979 - DNA, 22 bp, Homo sapiens
tcagagaactgcagcccttcct

SEQ ID NO: 6900980 - DNA, 20 bp, Homo sapiens
aggggtgatcgggtgacact

SEQ ID NO: 6900981 - DNA, 22 bp, Homo sapiens
taggcctggtactgtgttaata

SEQ ID NO: 6900982 - DNA, 22 bp, Homo sapiens
gcagcgctgtaggcccaaggca

SEQ ID NO: 6900983 - DNA, 22 bp, Homo sapiens
ttcttgcctgcttcaggagaaa

SEQ ID NO: 6900984 - DNA, 21 bp, Homo sapiens
agctttgaaagtgattcagtt

SEQ ID NO: 6900985 - DNA, 22 bp, Homo sapiens
cttacgtgataacttctcaaaa

SEQ ID NO: 6900986 - DNA, 22 bp, Homo sapiens
tgaggaagccaaacagctacac

SEQ ID NO: 6900987 - DNA, 22 bp, Homo sapiens
agcactaagtaatctcacagga

SEQ ID NO: 6900988 - DNA, 22 bp, Homo sapiens
gcctgcttccttttcatagatg

SEQ ID NO: 6900989 - DNA, 22 bp, Homo sapiens
aggaactggggctattcaccct

SEQ ID NO: 6900990 - DNA, 22 bp, Homo sapiens
tgcatccttaaccagcatcact

SEQ ID NO: 6900991 - DNA, 22 bp, Homo sapiens
cagtggtccctgaggttgctgg

SEQ ID NO: 6900992 - DNA, 22 bp, Homo sapiens
aggattcagaatgtatgcagtg

SEQ ID NO: 6900993 - DNA, 22 bp, Homo sapiens
ccagaatccacattccccagag

SEQ ID NO: 6900994 - DNA, 22 bp, Homo sapiens
ccaagcaaataatcacccacta

SEQ ID NO: 6900995 - DNA, 22 bp, Homo sapiens
aatagtccttagtaagctgtga

SEQ ID NO: 6900996 - DNA, 22 bp, Homo sapiens
tcactagtcgcggggggaggta

SEQ ID NO: 6900997 - DNA, 22 bp, Homo sapiens
aacttgtattgaaaatgggtaa

SEQ ID NO: 6900998 - DNA, 22 bp, Homo sapiens
taagacatgagactcagccagt

SEQ ID NO: 6900999 - DNA, 22 bp, Homo sapiens
agactgtagcttctgtcttgag

SEQ ID NO: 6901000 - DNA, 22 bp, Homo sapiens
tggaggtcctggctgggtttta

SEQ ID NO: 6901001 - DNA, 22 bp, Homo sapiens
actgttatgggtgtcagcttaa

SEQ ID NO: 6901002 - DNA, 22 bp, Homo sapiens
aggctgtggatgcttaacaaat

SEQ ID NO: 6901003 - DNA, 22 bp, Homo sapiens
gagctgtctctatatgaatgct

SEQ ID NO: 6901004 - DNA, 22 bp, Homo sapiens
agggcagcctgagtgctggccc

SEQ ID NO: 6901005 - DNA, 22 bp, Homo sapiens
tcaacatataggcaacctgtaa

SEQ ID NO: 6901006 - DNA, 22 bp, Homo sapiens
atccagcacttgttcatgtgaa

SEQ ID NO: 6901007 - DNA, 19 bp, Homo sapiens
gtctgtccccacgagtggc

SEQ ID NO: 6901008 - DNA, 19 bp, Homo sapiens
tccttaaaaaagcagttct

SEQ ID NO: 6901009 - DNA, 22 bp, Homo sapiens
ggggtggccctaccctctggaa

SEQ ID NO: 6901010 - DNA, 22 bp, Homo sapiens
tgtcatggctgaaagtgggggc

SEQ ID NO: 6901011 - DNA, 22 bp, Homo sapiens
ttccacaggtttcagactgttc

SEQ ID NO: 6901012 - DNA, 22 bp, Homo sapiens
tgctgcaggaattctcaaggga

SEQ ID NO: 6901013 - DNA, 22 bp, Homo sapiens
gtgtatggacacatgtcatgtt

SEQ ID NO: 6901014 - DNA, 22 bp, Homo sapiens
taaggctagtgcctgactgggt

SEQ ID NO: 6901015 - DNA, 22 bp, Homo sapiens
aattggaagaattgatttgctt

SEQ ID NO: 6901016 - DNA, 22 bp, Homo sapiens
gacactatatgacacttcagtt

SEQ ID NO: 6901017 - DNA, 23 bp, Homo sapiens
tccagactctaaagccctccaca

SEQ ID NO: 6901018 - DNA, 23 bp, Homo sapiens
caaacctgttctccccacatgca

SEQ ID NO: 6901019 - DNA, 22 bp, Homo sapiens
ctgcagcttatttgctgtgtga

SEQ ID NO: 6901020 - DNA, 22 bp, Homo sapiens
aacagttaacattttgggagct

SEQ ID NO: 6901021 - DNA, 22 bp, Homo sapiens
gtgcaaaaatctatcaccagca

SEQ ID NO: 6901022 - DNA, 22 bp, Homo sapiens
tagggaaatatagatttagggc

SEQ ID NO: 6901023 - DNA, 22 bp, Homo sapiens
tctgtggctgttatctttatat

SEQ ID NO: 6901024 - DNA, 23 bp, Homo sapiens
ggcaataacgagcttgtctctga

SEQ ID NO: 6901025 - DNA, 22 bp, Homo sapiens
aggctgcatcccactttgtgta

SEQ ID NO: 6901026 - DNA, 22 bp, Homo sapiens
gaggttaggtgacttgttcaga

SEQ ID NO: 6901027 - DNA, 22 bp, Homo sapiens
ttatcatgacttcaagcatcca

SEQ ID NO: 6901028 - DNA, 20 bp, Homo sapiens
tattcaactttaaaaactta

SEQ ID NO: 6901029 - DNA, 22 bp, Homo sapiens
cacagcttccattagaatgaga

SEQ ID NO: 6901030 - DNA, 22 bp, Homo sapiens
gggcttcagatccagggacctc

SEQ ID NO: 6901031 - DNA, 22 bp, Homo sapiens
tattgtgaatttggaagcaatg

SEQ ID NO: 6901032 - DNA, 22 bp, Homo sapiens
tgcatgtttataacagatgagg

SEQ ID NO: 6901033 - DNA, 22 bp, Homo sapiens
atgaactagccaggttgtgctg

SEQ ID NO: 6901034 - DNA, 20 bp, Homo sapiens
aaatgcagttctgccttggc

SEQ ID NO: 6901035 - DNA, 22 bp, Homo sapiens
tcatgaaaatagatcagaaatt

SEQ ID NO: 6901036 - DNA, 22 bp, Homo sapiens
gatattttgagaaatcctatga

SEQ ID NO: 6901037 - DNA, 22 bp, Homo sapiens
aggcattgctggtattggaagt

SEQ ID NO: 6901038 - DNA, 22 bp, Homo sapiens
catcagagttaacatcatgact

SEQ ID NO: 6901039 - DNA, 20 bp, Homo sapiens
atgcctttgatagtcaggct

SEQ ID NO: 6901040 - DNA, 22 bp, Homo sapiens
gaagaggtagcattggcaggtg

SEQ ID NO: 6901041 - DNA, 22 bp, Homo sapiens
atgtcctggagcagaggcaagg

SEQ ID NO: 6901042 - DNA, 22 bp, Homo sapiens
agcttctccctttcctattggt

SEQ ID NO: 6901043 - DNA, 22 bp, Homo sapiens
tcctgcagccaagggtcatcga

SEQ ID NO: 6901044 - DNA, 22 bp, Homo sapiens
ctattaaacactactgtgcact

SEQ ID NO: 6901045 - DNA, 22 bp, Homo sapiens
tgtatgctttggttgtttctct

SEQ ID NO: 6901046 - DNA, 22 bp, Homo sapiens
tctagcttggcgtttgccttct

SEQ ID NO: 6901047 - DNA, 22 bp, Homo sapiens
gtgggtggagactgggtgcaag

SEQ ID NO: 6901048 - DNA, 22 bp, Homo sapiens
atatgtgtatggatttctatct

SEQ ID NO: 6901049 - DNA, 22 bp, Homo sapiens
tagaaaccatctcactgctcag

SEQ ID NO: 6901050 - DNA, 22 bp, Homo sapiens
gtcatctcttatcactgacttc

SEQ ID NO: 6901051 - DNA, 23 bp, Homo sapiens
gggaccagctagggctgtgacct

SEQ ID NO: 6901052 - DNA, 22 bp, Homo sapiens
gttctaggagccaagaatatag

SEQ ID NO: 6901053 - DNA, 22 bp, Homo sapiens
agactgaataggaaagagggaa

SEQ ID NO: 6901054 - DNA, 22 bp, Homo sapiens
gtccattccttgcctctgggcc

SEQ ID NO: 6901055 - DNA, 22 bp, Homo sapiens
ctacctaataatttgatattca

SEQ ID NO: 6901056 - DNA, 22 bp, Homo sapiens
acagaggtgttccagacctagg

SEQ ID NO: 6901057 - DNA, 22 bp, Homo sapiens
aaattggctgagtaatattgga

SEQ ID NO: 6901058 - DNA, 22 bp, Homo sapiens
tagtcaccagctacaggacagc

SEQ ID NO: 6901059 - DNA, 20 bp, Homo sapiens
aaatggcacatgggaagtcc

SEQ ID NO: 6901060 - DNA, 20 bp, Homo sapiens
acaacttagttgagagacta

SEQ ID NO: 6901061 - DNA, 22 bp, Homo sapiens
ggagccaggcaatctgtacttt

SEQ ID NO: 6901062 - DNA, 22 bp, Homo sapiens
acacagggaggaggtgctgtgc

SEQ ID NO: 6901063 - DNA, 22 bp, Homo sapiens
gagctgcatagctgggatcctc

SEQ ID NO: 6901064 - DNA, 19 bp, Homo sapiens
agtagacattttcatgttt

SEQ ID NO: 6901065 - DNA, 22 bp, Homo sapiens
caaagtgggtgccctgatgctc

SEQ ID NO: 6901066 - DNA, 22 bp, Homo sapiens
tactccctttcacagtctgttt

SEQ ID NO: 6901067 - DNA, 22 bp, Homo sapiens
aaattcacaagagcattgcctg

SEQ ID NO: 6901068 - DNA, 22 bp, Homo sapiens
tgttaaggcagattgcctggcc

SEQ ID NO: 6901069 - DNA, 22 bp, Homo sapiens
tcctgaggctaaagtgcagtgg

SEQ ID NO: 6901070 - DNA, 22 bp, Homo sapiens
aagttcactaagaccatagaat

SEQ ID NO: 6901071 - DNA, 22 bp, Homo sapiens
agttatcatcccttacactttg

SEQ ID NO: 6901072 - DNA, 22 bp, Homo sapiens
gtgcatgctgcagtatgatttc

SEQ ID NO: 6901073 - DNA, 22 bp, Homo sapiens
tactggggtatgctcagatata

SEQ ID NO: 6901074 - DNA, 22 bp, Homo sapiens
gaggcagaagttgcagtgagca

SEQ ID NO: 6901075 - DNA, 22 bp, Homo sapiens
aaggcactcagccttgggacag

SEQ ID NO: 6901076 - DNA, 22 bp, Homo sapiens
cttcaaacccagattaaatgca

SEQ ID NO: 6901077 - DNA, 22 bp, Homo sapiens
caaaagttctcacccagacatg

SEQ ID NO: 6901078 - DNA, 22 bp, Homo sapiens
aggtatattgaatgcttactta

SEQ ID NO: 6901079 - DNA, 22 bp, Homo sapiens
ttgccaggagacaaagtgggcc

SEQ ID NO: 6901080 - DNA, 22 bp, Homo sapiens
tctggtggtatacatctaggag

SEQ ID NO: 6901081 - DNA, 22 bp, Homo sapiens
tacattgaattttttagcatgt

SEQ ID NO: 6901082 - DNA, 22 bp, Homo sapiens
ccttggagttctgtttggctta

SEQ ID NO: 6901083 - DNA, 22 bp, Homo sapiens
cagaaagcagttgtcaatgggc

SEQ ID NO: 6901084 - DNA, 22 bp, Homo sapiens
gcagtgtctttgacctccaccc

SEQ ID NO: 6901085 - DNA, 22 bp, Homo sapiens
tctccaggactgagctccagcc

SEQ ID NO: 6901086 - DNA, 20 bp, Homo sapiens
cctagggcaagtgggtgggc

SEQ ID NO: 6901087 - DNA, 22 bp, Homo sapiens
gtttaaccattgcatatccata

SEQ ID NO: 6901088 - DNA, 22 bp, Homo sapiens
agtcaaataagactgtcataag

SEQ ID NO: 6901089 - DNA, 22 bp, Homo sapiens
atttgtaaagtgcttaaaagta

SEQ ID NO: 6901090 - DNA, 22 bp, Homo sapiens
aacagttgatgtagctttggag

SEQ ID NO: 6901091 - DNA, 22 bp, Homo sapiens
aatgaacggtgtccatctgttt

SEQ ID NO: 6901092 - DNA, 19 bp, Homo sapiens
tgaatacagagatacagaa

SEQ ID NO: 6901093 - DNA, 22 bp, Homo sapiens
atgaggtcttattgcagtagtt

SEQ ID NO: 6901094 - DNA, 22 bp, Homo sapiens
cagaaatggaattttccatcac

SEQ ID NO: 6901095 - DNA, 22 bp, Homo sapiens
ctgcagagcaagtaacatcctc

SEQ ID NO: 6901096 - DNA, 22 bp, Homo sapiens
cagtaacatttcaaggtagagg

SEQ ID NO: 6901097 - DNA, 22 bp, Homo sapiens
tcacattgtaggtcatttgcaa

SEQ ID NO: 6901098 - DNA, 22 bp, Homo sapiens
actgagactttgttgagttctt

SEQ ID NO: 6901099 - DNA, 22 bp, Homo sapiens
tcctctgctccaggctggactt

SEQ ID NO: 6901100 - DNA, 22 bp, Homo sapiens
ttctggaaaagaaagttaagat

SEQ ID NO: 6901101 - DNA, 22 bp, Homo sapiens
agttctcataaacgtccttgga

SEQ ID NO: 6901102 - DNA, 22 bp, Homo sapiens
gcagagtgccgagatggaagcg

SEQ ID NO: 6901103 - DNA, 22 bp, Homo sapiens
ctgatatgatgggtgattttca

SEQ ID NO: 6901104 - DNA, 22 bp, Homo sapiens
tgggaatgctgagcccatgtat

SEQ ID NO: 6901105 - DNA, 22 bp, Homo sapiens
tctgatccaatctgtgggctgt

SEQ ID NO: 6901106 - DNA, 22 bp, Homo sapiens
aacagtggggaaaagagttggt

SEQ ID NO: 6901107 - DNA, 22 bp, Homo sapiens
gttattccttaactgcatgaac

SEQ ID NO: 6901108 - DNA, 20 bp, Homo sapiens
gcttcagtttcctcactggt

SEQ ID NO: 6901109 - DNA, 22 bp, Homo sapiens
ctttgcactccagtctcctgct

SEQ ID NO: 6901110 - DNA, 22 bp, Homo sapiens
gagcaggcaactctgcagtgcc

SEQ ID NO: 6901111 - DNA, 22 bp, Homo sapiens
gtggaagaggcaagatagctct

SEQ ID NO: 6901112 - DNA, 20 bp, Homo sapiens
tcctggagctgcttgaattc

SEQ ID NO: 6901113 - DNA, 22 bp, Homo sapiens
agtgtacacttgcagcctcaag

SEQ ID NO: 6901114 - DNA, 22 bp, Homo sapiens
tctcagtgtgttgagaggtctg

SEQ ID NO: 6901115 - DNA, 22 bp, Homo sapiens
cacctctgcctcaagcttccca

SEQ ID NO: 6901116 - DNA, 22 bp, Homo sapiens
gagtgagggccaacatccagct

SEQ ID NO: 6901117 - DNA, 22 bp, Homo sapiens
tggtgttttagcattaaagacc

SEQ ID NO: 6901118 - DNA, 22 bp, Homo sapiens
cactgcagttccccagtgcgca

SEQ ID NO: 6901119 - DNA, 22 bp, Homo sapiens
tgagtctgggcatgttcacttt

SEQ ID NO: 6901120 - DNA, 22 bp, Homo sapiens
catcttgctgttatgtttatgt

SEQ ID NO: 6901121 - DNA, 22 bp, Homo sapiens
actagcttgggcctgggtcaga

SEQ ID NO: 6901122 - DNA, 22 bp, Homo sapiens
agggctcattgacatggaaaag

SEQ ID NO: 6901123 - DNA, 22 bp, Homo sapiens
agtttattctgcttggccctcc

SEQ ID NO: 6901124 - DNA, 22 bp, Homo sapiens
catccaagaaaattttctctct

SEQ ID NO: 6901125 - DNA, 22 bp, Homo sapiens
ggctgatctcgtgtgaccttgt

SEQ ID NO: 6901126 - DNA, 22 bp, Homo sapiens
acgaggtgcttccaccatttca

SEQ ID NO: 6901127 - DNA, 22 bp, Homo sapiens
gcactgccctcttcggggttcc

SEQ ID NO: 6901128 - DNA, 22 bp, Homo sapiens
catctgaagagctttgcaagag

SEQ ID NO: 6901129 - DNA, 22 bp, Homo sapiens
ggtttcctggtcagctgaggca

SEQ ID NO: 6901130 - DNA, 22 bp, Homo sapiens
aaggtttaaggtctataaatgt

SEQ ID NO: 6901131 - DNA, 22 bp, Homo sapiens
aggtcacatacaaatgctcctt

SEQ ID NO: 6901132 - DNA, 22 bp, Homo sapiens
gggtagggtgacttaggctggc

SEQ ID NO: 6901133 - DNA, 22 bp, Homo sapiens
tgaaggtaatggaatctcctga

SEQ ID NO: 6901134 - DNA, 23 bp, Homo sapiens
ctctgggcgggcaggtcagcctc

SEQ ID NO: 6901135 - DNA, 21 bp, Homo sapiens
aagtgccacccacagatgcat

SEQ ID NO: 6901136 - DNA, 22 bp, Homo sapiens
tcctggcatccgtgggtctgtg

SEQ ID NO: 6901137 - DNA, 22 bp, Homo sapiens
tcctgcagatcaaagcctttga

SEQ ID NO: 6901138 - DNA, 22 bp, Homo sapiens
aagccgaggccacacagcagga

SEQ ID NO: 6901139 - DNA, 22 bp, Homo sapiens
gatctttcatctatgtatttag

SEQ ID NO: 6901140 - DNA, 22 bp, Homo sapiens
ttctaactctacactagctttg

SEQ ID NO: 6901141 - DNA, 22 bp, Homo sapiens
agcagtgtgcttcgtttcatga

SEQ ID NO: 6901142 - DNA, 22 bp, Homo sapiens
accttcaagaaacatttccttg

SEQ ID NO: 6901143 - DNA, 21 bp, Homo sapiens
taacagtctccagtgcccgct

SEQ ID NO: 6901144 - DNA, 19 bp, Homo sapiens
aggcagaggcttggctagc

SEQ ID NO: 6901145 - DNA, 22 bp, Homo sapiens
ttttggtctccaagccatgtgt

SEQ ID NO: 6901146 - DNA, 22 bp, Homo sapiens
aagtacatgctgtaatgattgg

SEQ ID NO: 6901147 - DNA, 22 bp, Homo sapiens
gatggagtgccagggtggaact

SEQ ID NO: 6901148 - DNA, 20 bp, Homo sapiens
aaagtctgtttatctctgga

SEQ ID NO: 6901149 - DNA, 20 bp, Homo sapiens
ctggcacagggtccgtcctt

SEQ ID NO: 6901150 - DNA, 22 bp, Homo sapiens
atgcagtataaatcatttctgg

SEQ ID NO: 6901151 - DNA, 22 bp, Homo sapiens
cagccaggacagggaaactagt

SEQ ID NO: 6901152 - DNA, 16 bp, Homo sapiens
ggaggaaggcatagtg

SEQ ID NO: 6901153 - DNA, 22 bp, Homo sapiens
caggccattaccgctgagaccc

SEQ ID NO: 6901154 - DNA, 22 bp, Homo sapiens
catgtgaattccaaagctaggt

SEQ ID NO: 6901155 - DNA, 22 bp, Homo sapiens
gatgaggtttttgaaatgtgga

SEQ ID NO: 6901156 - DNA, 22 bp, Homo sapiens
tcactccatctttgctactggt

SEQ ID NO: 6901157 - DNA, 22 bp, Homo sapiens
tagaaggctttgagagatactt

SEQ ID NO: 6901158 - DNA, 22 bp, Homo sapiens
agtgaagatatactgttgtcct

SEQ ID NO: 6901159 - DNA, 20 bp, Homo sapiens
tggcctttaaatagtattcc

SEQ ID NO: 6901160 - DNA, 22 bp, Homo sapiens
tacttataaggaggcacacaaa

SEQ ID NO: 6901161 - DNA, 22 bp, Homo sapiens
cagagctggacttaaatatatt

SEQ ID NO: 6901162 - DNA, 22 bp, Homo sapiens
tctcctgaagtttatgaaaact

SEQ ID NO: 6901163 - DNA, 22 bp, Homo sapiens
tttggaattggcattctattct

SEQ ID NO: 6901164 - DNA, 22 bp, Homo sapiens
ttagtgtgtccagttctgaaaa

SEQ ID NO: 6901165 - DNA, 22 bp, Homo sapiens
ccagtccacgtcaagaagaggt

SEQ ID NO: 6901166 - DNA, 23 bp, Homo sapiens
atctgttgtgcctcttatatgta

SEQ ID NO: 6901167 - DNA, 21 bp, Homo sapiens
tccaccagctcttcctcttca

SEQ ID NO: 6901168 - DNA, 22 bp, Homo sapiens
cagtttctgaggttccaggttt

SEQ ID NO: 6901169 - DNA, 20 bp, Homo sapiens
tcttcagatgcttttggagt

SEQ ID NO: 6901170 - DNA, 22 bp, Homo sapiens
agcccttgcagactgtcagcat

SEQ ID NO: 6901171 - DNA, 22 bp, Homo sapiens
gttctcgtttctgaagaaaagt

SEQ ID NO: 6901172 - DNA, 22 bp, Homo sapiens
ggcactggcctggggccaagag

SEQ ID NO: 6901173 - DNA, 22 bp, Homo sapiens
tagtatgggaagaactttgtag

SEQ ID NO: 6901174 - DNA, 22 bp, Homo sapiens
tgctatttctatctcatttaaa

SEQ ID NO: 6901175 - DNA, 21 bp, Homo sapiens
cgaggtgagctcttggctcag

SEQ ID NO: 6901176 - DNA, 22 bp, Homo sapiens
ctgactcccaagctagtgctct

SEQ ID NO: 6901177 - DNA, 22 bp, Homo sapiens
tctcgggtttaggtgatagtat

SEQ ID NO: 6901178 - DNA, 22 bp, Homo sapiens
ccctggctggaaattaagtagt

SEQ ID NO: 6901179 - DNA, 22 bp, Homo sapiens
agggagctattgtgttactttg

SEQ ID NO: 6901180 - DNA, 22 bp, Homo sapiens
tccttgcacattatctgggaaa

SEQ ID NO: 6901181 - DNA, 22 bp, Homo sapiens
gatcctgacatcctgacatgga

SEQ ID NO: 6901182 - DNA, 22 bp, Homo sapiens
ttggctcccactaactccagca

SEQ ID NO: 6901183 - DNA, 22 bp, Homo sapiens
cccatttatgactacacaggtg

SEQ ID NO: 6901184 - DNA, 22 bp, Homo sapiens
aatggcaacatggtatagtgag

SEQ ID NO: 6901185 - DNA, 22 bp, Homo sapiens
aatgttcagtatctggtccacc

SEQ ID NO: 6901186 - DNA, 22 bp, Homo sapiens
aggttatttgcagatggaattc

SEQ ID NO: 6901187 - DNA, 22 bp, Homo sapiens
agccctggggctggtgcttacc

SEQ ID NO: 6901188 - DNA, 22 bp, Homo sapiens
gagtgtgtgacttcactttagc

SEQ ID NO: 6901189 - DNA, 22 bp, Homo sapiens
acttggtggaacgtgtatttta

SEQ ID NO: 6901190 - DNA, 22 bp, Homo sapiens
tatatccatttgtctgctaatt

SEQ ID NO: 6901191 - DNA, 22 bp, Homo sapiens
agcgggtgctgtgtcagccctc

SEQ ID NO: 6901192 - DNA, 22 bp, Homo sapiens
cacaatttccttgcttcacttt

SEQ ID NO: 6901193 - DNA, 23 bp, Homo sapiens
gagcaaacccgtctatgccctcc

SEQ ID NO: 6901194 - DNA, 22 bp, Homo sapiens
catgtggatcggcctgggtagt

SEQ ID NO: 6901195 - DNA, 22 bp, Homo sapiens
agctgtggcagcactttggagt

SEQ ID NO: 6901196 - DNA, 22 bp, Homo sapiens
tgcagtgttcctgtagcctgcc

SEQ ID NO: 6901197 - DNA, 21 bp, Homo sapiens
caggactttcctccaaagtta

SEQ ID NO: 6901198 - DNA, 22 bp, Homo sapiens
tggcacgacaattggcaccaat

SEQ ID NO: 6901199 - DNA, 22 bp, Homo sapiens
ggctgggcaggtctgcacaggg

SEQ ID NO: 6901200 - DNA, 22 bp, Homo sapiens
gctcttgatgttcattgacttg

SEQ ID NO: 6901201 - DNA, 22 bp, Homo sapiens
ctcaggctccagacttccgtcc

SEQ ID NO: 6901202 - DNA, 22 bp, Homo sapiens
gtgggaagaacttcaagtggct

SEQ ID NO: 6901203 - DNA, 23 bp, Homo sapiens
actgggcttatgaggaggcttgt

SEQ ID NO: 6901204 - DNA, 22 bp, Homo sapiens
cagctagtacaatgggagagca

SEQ ID NO: 6901205 - DNA, 22 bp, Homo sapiens
ttgaagtcctagcccctggtaa

SEQ ID NO: 6901206 - DNA, 22 bp, Homo sapiens
acacagaggcatgacagtggct

SEQ ID NO: 6901207 - DNA, 22 bp, Homo sapiens
gtgctcaataaatgtttataga

SEQ ID NO: 6901208 - DNA, 22 bp, Homo sapiens
agaatacaattgttcagtaata

SEQ ID NO: 6901209 - DNA, 23 bp, Homo sapiens
agcttctggttcaggtcaagcag

SEQ ID NO: 6901210 - DNA, 22 bp, Homo sapiens
atatggcagaccaattagaagc

SEQ ID NO: 6901211 - DNA, 22 bp, Homo sapiens
ggcttcctatcccatctgagtg

SEQ ID NO: 6901212 - DNA, 22 bp, Homo sapiens
tcacttgagatgtaccacaaac

SEQ ID NO: 6901213 - DNA, 22 bp, Homo sapiens
atctctggcccctggggtccga

SEQ ID NO: 6901214 - DNA, 22 bp, Homo sapiens
tctggaagctggagtccaggaa

SEQ ID NO: 6901215 - DNA, 22 bp, Homo sapiens
tacttggagttcataatctggt

SEQ ID NO: 6901216 - DNA, 22 bp, Homo sapiens
tgtcaggttggttttcagagaa

SEQ ID NO: 6901217 - DNA, 22 bp, Homo sapiens
tggccttgcccagcgcctaggt

SEQ ID NO: 6901218 - DNA, 22 bp, Homo sapiens
ttgtgcaatagttttctcatga

SEQ ID NO: 6901219 - DNA, 22 bp, Homo sapiens
tgctttattgcatcagtgtggg

SEQ ID NO: 6901220 - DNA, 22 bp, Homo sapiens
gtatttctagaatggtagcact

SEQ ID NO: 6901221 - DNA, 22 bp, Homo sapiens
gaggtcctctcggaaccccttt

SEQ ID NO: 6901222 - DNA, 22 bp, Homo sapiens
cctttgttcactggagagtgga

SEQ ID NO: 6901223 - DNA, 22 bp, Homo sapiens
cgcagagggagccgcgggctgc

SEQ ID NO: 6901224 - DNA, 22 bp, Homo sapiens
agtcttctgggtgtttccagag

SEQ ID NO: 6901225 - DNA, 22 bp, Homo sapiens
agtttctatgtaagctacgtga

SEQ ID NO: 6901226 - DNA, 22 bp, Homo sapiens
ccttttctgtttcctgtcactg

SEQ ID NO: 6901227 - DNA, 22 bp, Homo sapiens
tatattgtaggtgctatttgaa

SEQ ID NO: 6901228 - DNA, 22 bp, Homo sapiens
aggtatttgttacagcagcacc

SEQ ID NO: 6901229 - DNA, 22 bp, Homo sapiens
aagtccattaggcccctgcctg

SEQ ID NO: 6901230 - DNA, 22 bp, Homo sapiens
atttacacattcataagatttc

SEQ ID NO: 6901231 - DNA, 23 bp, Homo sapiens
ggtcctgcccccggtcgcccaaa

SEQ ID NO: 6901232 - DNA, 21 bp, Homo sapiens
catcacattactcaaagtcct

SEQ ID NO: 6901233 - DNA, 22 bp, Homo sapiens
gtttacaacatgccaactgggc

SEQ ID NO: 6901234 - DNA, 23 bp, Homo sapiens
agcttggaacaatgcaaatacag

SEQ ID NO: 6901235 - DNA, 22 bp, Homo sapiens
aaaaatctatgactgcttctcc

SEQ ID NO: 6901236 - DNA, 20 bp, Homo sapiens
aaagcatttacttgtgattg

SEQ ID NO: 6901237 - DNA, 22 bp, Homo sapiens
ttctggaatcctcaaaacatga

SEQ ID NO: 6901238 - DNA, 22 bp, Homo sapiens
ttacccagtgtggtttatagca

SEQ ID NO: 6901239 - DNA, 20 bp, Homo sapiens
acacatgcattcatgtgggc

SEQ ID NO: 6901240 - DNA, 22 bp, Homo sapiens
ttgaataattaattacactcag

SEQ ID NO: 6901241 - DNA, 22 bp, Homo sapiens
acccagcaaagataaacttatg

SEQ ID NO: 6901242 - DNA, 22 bp, Homo sapiens
tgaggctcagagaagtgctgtt

SEQ ID NO: 6901243 - DNA, 22 bp, Homo sapiens
ggtcacaaggcagataataagg

SEQ ID NO: 6901244 - DNA, 22 bp, Homo sapiens
atgtaacttcctcagggatggt

SEQ ID NO: 6901245 - DNA, 22 bp, Homo sapiens
ctatttacgctgctggggatca

SEQ ID NO: 6901246 - DNA, 22 bp, Homo sapiens
tgggctgagcagtgaagctcat

SEQ ID NO: 6901247 - DNA, 22 bp, Homo sapiens
tgtaggtaagttcgtagatttg

SEQ ID NO: 6901248 - DNA, 21 bp, Homo sapiens
ttcagaagttgagggcaggtt

SEQ ID NO: 6901249 - DNA, 22 bp, Homo sapiens
tgggcagacgctgttggaaggc

SEQ ID NO: 6901250 - DNA, 19 bp, Homo sapiens
atctcaaccctactctctg

SEQ ID NO: 6901251 - DNA, 22 bp, Homo sapiens
ttcctacaattagagcctcttt

SEQ ID NO: 6901252 - DNA, 22 bp, Homo sapiens
gttcttcagtaaaattaaatgt

SEQ ID NO: 6901253 - DNA, 22 bp, Homo sapiens
tttctggaaagcaagatacatt

SEQ ID NO: 6901254 - DNA, 22 bp, Homo sapiens
gggaggtagcaagcctgcagct

SEQ ID NO: 6901255 - DNA, 22 bp, Homo sapiens
aaagtggtgggcgaactcatca

SEQ ID NO: 6901256 - DNA, 22 bp, Homo sapiens
aaggtgtcgggttagctcagcc

SEQ ID NO: 6901257 - DNA, 22 bp, Homo sapiens
agaggctgatggagtagtgtct

SEQ ID NO: 6901258 - DNA, 22 bp, Homo sapiens
tctcagaaggcaagggctgggg

SEQ ID NO: 6901259 - DNA, 22 bp, Homo sapiens
gtggcagcaaatgcctggacta

SEQ ID NO: 6901260 - DNA, 22 bp, Homo sapiens
acagagagaattgggtttacag

SEQ ID NO: 6901261 - DNA, 22 bp, Homo sapiens
cttacatatgcaagacaaaggg

SEQ ID NO: 6901262 - DNA, 22 bp, Homo sapiens
cagggatggcgctggctgcccg

SEQ ID NO: 6901263 - DNA, 22 bp, Homo sapiens
cactaggcatctgtgagggtag

SEQ ID NO: 6901264 - DNA, 22 bp, Homo sapiens
cttgagatgtcatctgctttgg

SEQ ID NO: 6901265 - DNA, 22 bp, Homo sapiens
taatttcagtgcaagctcacgg

SEQ ID NO: 6901266 - DNA, 22 bp, Homo sapiens
tccttctttcacctcatagtca

SEQ ID NO: 6901267 - DNA, 22 bp, Homo sapiens
caggaagttgtgtgttcgaggc

SEQ ID NO: 6901268 - DNA, 22 bp, Homo sapiens
actggcagctgtaggatgcatg

SEQ ID NO: 6901269 - DNA, 22 bp, Homo sapiens
acagtgtgacaattgtgtcaga

SEQ ID NO: 6901270 - DNA, 22 bp, Homo sapiens
agtctctgggcatggttgtgac

SEQ ID NO: 6901271 - DNA, 22 bp, Homo sapiens
agcaggtcttgctctcaacagg

SEQ ID NO: 6901272 - DNA, 23 bp, Homo sapiens
aaatggctttagacgtgccttat

SEQ ID NO: 6901273 - DNA, 22 bp, Homo sapiens
tggtataatacagtaagtgttg

SEQ ID NO: 6901274 - DNA, 16 bp, Homo sapiens
ctctttggcttccaag

SEQ ID NO: 6901275 - DNA, 22 bp, Homo sapiens
ggctggagacaacgtcctgccc

SEQ ID NO: 6901276 - DNA, 22 bp, Homo sapiens
tcaggacagagatcagaacttc

SEQ ID NO: 6901277 - DNA, 22 bp, Homo sapiens
agcctgtggatccctgcactgg

SEQ ID NO: 6901278 - DNA, 22 bp, Homo sapiens
agcctggtgtggggctgcagag

SEQ ID NO: 6901279 - DNA, 22 bp, Homo sapiens
gagctgcagagtaacctttgca

SEQ ID NO: 6901280 - DNA, 22 bp, Homo sapiens
taaggcacctgtccaggctggg

SEQ ID NO: 6901281 - DNA, 22 bp, Homo sapiens
tagcttaaggagtaccagatca

SEQ ID NO: 6901282 - DNA, 22 bp, Homo sapiens
agtgtctggtctctgaactaaa

SEQ ID NO: 6901283 - DNA, 22 bp, Homo sapiens
tgggttttatatgtggtggaca

SEQ ID NO: 6901284 - DNA, 22 bp, Homo sapiens
aggcctctgctggaaagagttg

SEQ ID NO: 6901285 - DNA, 22 bp, Homo sapiens
gccctggagctagactaggaca

SEQ ID NO: 6901286 - DNA, 22 bp, Homo sapiens
gccatctgctgctctccagtgt

SEQ ID NO: 6901287 - DNA, 22 bp, Homo sapiens
ctggctttacctcactggggct

SEQ ID NO: 6901288 - DNA, 22 bp, Homo sapiens
acccagcatgacacctgcacat

SEQ ID NO: 6901289 - DNA, 19 bp, Homo sapiens
atgcagagaatggcagtag

SEQ ID NO: 6901290 - DNA, 22 bp, Homo sapiens
gggatggggtcaacatgtacct

SEQ ID NO: 6901291 - DNA, 22 bp, Homo sapiens
agccctgagccagcctggtcag

SEQ ID NO: 6901292 - DNA, 22 bp, Homo sapiens
ctgccccagtgccaggcaggtg

SEQ ID NO: 6901293 - DNA, 22 bp, Homo sapiens
tttgtgtttgtacaatgcacta

SEQ ID NO: 6901294 - DNA, 22 bp, Homo sapiens
atcaggtgaagtcactgagtgg

SEQ ID NO: 6901295 - DNA, 22 bp, Homo sapiens
ctactgagtccttcagctgcca

SEQ ID NO: 6901296 - DNA, 22 bp, Homo sapiens
gccttcagagtaccatgtcctc

SEQ ID NO: 6901297 - DNA, 22 bp, Homo sapiens
acagacctggccccgcacggtg

SEQ ID NO: 6901298 - DNA, 22 bp, Homo sapiens
ttccagaaaaaaatgtatatct

SEQ ID NO: 6901299 - DNA, 22 bp, Homo sapiens
aaaatgctcatcagcgatggct

SEQ ID NO: 6901300 - DNA, 19 bp, Homo sapiens
aacaccagagtcaggagtc

SEQ ID NO: 6901301 - DNA, 22 bp, Homo sapiens
attattaggactactggggttg

SEQ ID NO: 6901302 - DNA, 22 bp, Homo sapiens
cagagtgttgaccataagccca

SEQ ID NO: 6901303 - DNA, 22 bp, Homo sapiens
aggagtgcaaatagtccagaga

SEQ ID NO: 6901304 - DNA, 22 bp, Homo sapiens
aaagcatcagatctgacacttc

SEQ ID NO: 6901305 - DNA, 22 bp, Homo sapiens
atctgggccagccccaagagac

SEQ ID NO: 6901306 - DNA, 22 bp, Homo sapiens
tgtgttttaaatggaaatttga

SEQ ID NO: 6901307 - DNA, 22 bp, Homo sapiens
cagacctgaggttgagtaccag

SEQ ID NO: 6901308 - DNA, 22 bp, Homo sapiens
taatcactgtcaacctttgttc

SEQ ID NO: 6901309 - DNA, 22 bp, Homo sapiens
tgtgcatagactttcaccacct

SEQ ID NO: 6901310 - DNA, 22 bp, Homo sapiens
tgggctccaatttgtcctttca

SEQ ID NO: 6901311 - DNA, 22 bp, Homo sapiens
atctgtggcgcaaacaaaggct

SEQ ID NO: 6901312 - DNA, 22 bp, Homo sapiens
cttctgacttgagaccagttag

SEQ ID NO: 6901313 - DNA, 22 bp, Homo sapiens
gccaggtatgaattacgcacga

SEQ ID NO: 6901314 - DNA, 22 bp, Homo sapiens
tggccacttggcatgtgtgcca

SEQ ID NO: 6901315 - DNA, 22 bp, Homo sapiens
tttcatctctctaaaagacagt

SEQ ID NO: 6901316 - DNA, 21 bp, Homo sapiens
ttcaaagagtgggcattgtca

SEQ ID NO: 6901317 - DNA, 21 bp, Homo sapiens
actttaatatacatgaggagg

SEQ ID NO: 6901318 - DNA, 22 bp, Homo sapiens
aattcagtaatcattaatgatg

SEQ ID NO: 6901319 - DNA, 22 bp, Homo sapiens
tgggtgccaacctctggtggcc

SEQ ID NO: 6901320 - DNA, 22 bp, Homo sapiens
tcttttgtactcagtattgaca

SEQ ID NO: 6901321 - DNA, 22 bp, Homo sapiens
ttactgactattctttgggaac

SEQ ID NO: 6901322 - DNA, 22 bp, Homo sapiens
ttcttctgacactgatgctgta

SEQ ID NO: 6901323 - DNA, 22 bp, Homo sapiens
caggaaatgaggctgaagggtg

SEQ ID NO: 6901324 - DNA, 17 bp, Homo sapiens
aacactgggtgagcctc

SEQ ID NO: 6901325 - DNA, 22 bp, Homo sapiens
tgggtagtttcccctgccctgc

SEQ ID NO: 6901326 - DNA, 17 bp, Homo sapiens
caggtatttaggcattg

SEQ ID NO: 6901327 - DNA, 22 bp, Homo sapiens
aaatgcagatccctgaatctca

SEQ ID NO: 6901328 - DNA, 19 bp, Homo sapiens
ctgagcctcagtttcctag

SEQ ID NO: 6901329 - DNA, 22 bp, Homo sapiens
gggagctgtgggattggttgag

SEQ ID NO: 6901330 - DNA, 22 bp, Homo sapiens
agcaggcacgctccctgcgcga

SEQ ID NO: 6901331 - DNA, 22 bp, Homo sapiens
actgtcatgtgctaactgtcca

SEQ ID NO: 6901332 - DNA, 22 bp, Homo sapiens
tctgaaataggaaagcaaatgg

SEQ ID NO: 6901333 - DNA, 22 bp, Homo sapiens
ccaggaggcaatatcaagtcca

SEQ ID NO: 6901334 - DNA, 22 bp, Homo sapiens
tatgctgattatatctttggtt

SEQ ID NO: 6901335 - DNA, 17 bp, Homo sapiens
tctactcctgaaggaag

SEQ ID NO: 6901336 - DNA, 22 bp, Homo sapiens
tcattacagtgtttatatgtct

SEQ ID NO: 6901337 - DNA, 22 bp, Homo sapiens
tccaagcactgttaattaaact

SEQ ID NO: 6901338 - DNA, 22 bp, Homo sapiens
cgtcctcagaggccatccgaaa

SEQ ID NO: 6901339 - DNA, 22 bp, Homo sapiens
catgctgggtaaaggtggtgaa

SEQ ID NO: 6901340 - DNA, 18 bp, Homo sapiens
agaacacttggttagatc

SEQ ID NO: 6901341 - DNA, 17 bp, Homo sapiens
tgattcaactagaaact

SEQ ID NO: 6901342 - DNA, 22 bp, Homo sapiens
ttgtcccaggacttgcatagat

SEQ ID NO: 6901343 - DNA, 22 bp, Homo sapiens
gcctgctgtcctgattcccatg

SEQ ID NO: 6901344 - DNA, 22 bp, Homo sapiens
agggtgcagaaggagcctagga

SEQ ID NO: 6901345 - DNA, 22 bp, Homo sapiens
acctttggagcatgcattttct

SEQ ID NO: 6901346 - DNA, 22 bp, Homo sapiens
tcaagacatcactgtgcatttt

SEQ ID NO: 6901347 - DNA, 22 bp, Homo sapiens
tgggaagcattaatgatagggg

SEQ ID NO: 6901348 - DNA, 22 bp, Homo sapiens
gcagatgccagatcatgcaggg

SEQ ID NO: 6901349 - DNA, 22 bp, Homo sapiens
gtggcgaggggaggtcctggcg

SEQ ID NO: 6901350 - DNA, 22 bp, Homo sapiens
gtgaatattctttgtgcagtat

SEQ ID NO: 6901351 - DNA, 22 bp, Homo sapiens
gggtccagtagttggtggccgt

SEQ ID NO: 6901352 - DNA, 22 bp, Homo sapiens
cagcagggctgtgctaccccat

SEQ ID NO: 6901353 - DNA, 22 bp, Homo sapiens
aatgtttgaccaaaaaactgca

SEQ ID NO: 6901354 - DNA, 18 bp, Homo sapiens
tccaccgcgtgcacctct

SEQ ID NO: 6901355 - DNA, 22 bp, Homo sapiens
actggaaataaattttgaatgt

SEQ ID NO: 6901356 - DNA, 22 bp, Homo sapiens
cacttgaatgaaagagactcct

SEQ ID NO: 6901357 - DNA, 22 bp, Homo sapiens
cttccagagatccatgaatacc

SEQ ID NO: 6901358 - DNA, 22 bp, Homo sapiens
caggattaaggtgaggggagta

SEQ ID NO: 6901359 - DNA, 23 bp, Homo sapiens
catattcaaaactggaccactct

SEQ ID NO: 6901360 - DNA, 22 bp, Homo sapiens
tgaggtatgaggttctatgatc

SEQ ID NO: 6901361 - DNA, 22 bp, Homo sapiens
tctttgaccaaattatcctgtt

SEQ ID NO: 6901362 - DNA, 22 bp, Homo sapiens
gaatatttttaaagggactaat

SEQ ID NO: 6901363 - DNA, 22 bp, Homo sapiens
tctgttatggaagtttcctttt

SEQ ID NO: 6901364 - DNA, 21 bp, Homo sapiens
accagcaggagatcagaagga

SEQ ID NO: 6901365 - DNA, 22 bp, Homo sapiens
aagcacccaatttacagcagtt

SEQ ID NO: 6901366 - DNA, 22 bp, Homo sapiens
acccctgtgggctcagagcctg

SEQ ID NO: 6901367 - DNA, 22 bp, Homo sapiens
gaggctgtgtcttggggtggaa

SEQ ID NO: 6901368 - DNA, 22 bp, Homo sapiens
agcctgtgttttttctattgca

SEQ ID NO: 6901369 - DNA, 20 bp, Homo sapiens
taggcaattagtagataaca

SEQ ID NO: 6901370 - DNA, 22 bp, Homo sapiens
atttgcacacagtctcctgtgg

SEQ ID NO: 6901371 - DNA, 22 bp, Homo sapiens
ccctgccagggtcctgacagac

SEQ ID NO: 6901372 - DNA, 22 bp, Homo sapiens
ctcattgcccagatccccacag

SEQ ID NO: 6901373 - DNA, 20 bp, Homo sapiens
ggcaggacccggtagggagc

SEQ ID NO: 6901374 - DNA, 18 bp, Homo sapiens
caggtctgtctgcctccc

SEQ ID NO: 6901375 - DNA, 22 bp, Homo sapiens
tcaattatgccattgcaatatt

SEQ ID NO: 6901376 - DNA, 22 bp, Homo sapiens
tctgggctggtgctcatgaatt

SEQ ID NO: 6901377 - DNA, 22 bp, Homo sapiens
tgctgttgacggactggctgct

SEQ ID NO: 6901378 - DNA, 22 bp, Homo sapiens
aggaggcctgcagctgccattc

SEQ ID NO: 6901379 - DNA, 22 bp, Homo sapiens
tttgagaaaggggatttaattc

SEQ ID NO: 6901380 - DNA, 22 bp, Homo sapiens
caattttactcttcctcttcca

SEQ ID NO: 6901381 - DNA, 22 bp, Homo sapiens
tcactcaatggtatcaggaggt

SEQ ID NO: 6901382 - DNA, 22 bp, Homo sapiens
gtcaggagatagggcaagcttc

SEQ ID NO: 6901383 - DNA, 22 bp, Homo sapiens
atacaggtaggggacatacatc

SEQ ID NO: 6901384 - DNA, 22 bp, Homo sapiens
atggccagattatatggttttt

SEQ ID NO: 6901385 - DNA, 22 bp, Homo sapiens
tgtgtcaattttcattcctact

SEQ ID NO: 6901386 - DNA, 22 bp, Homo sapiens
cagatatgtggattctattagc

SEQ ID NO: 6901387 - DNA, 22 bp, Homo sapiens
gtgaaggccgtccttggggact

SEQ ID NO: 6901388 - DNA, 22 bp, Homo sapiens
gccagatctgacatagtggaag

SEQ ID NO: 6901389 - DNA, 22 bp, Homo sapiens
tgcttctttactataggcaatt

SEQ ID NO: 6901390 - DNA, 22 bp, Homo sapiens
catctgctgctacaaaaagctt

SEQ ID NO: 6901391 - DNA, 22 bp, Homo sapiens
ccaggaacaaagccccatccac

SEQ ID NO: 6901392 - DNA, 22 bp, Homo sapiens
cacaggtgtccaatacctgctt

SEQ ID NO: 6901393 - DNA, 22 bp, Homo sapiens
atatggagaactcaaaaagtga

SEQ ID NO: 6901394 - DNA, 22 bp, Homo sapiens
aaagctctttcacttccgttct

SEQ ID NO: 6901395 - DNA, 22 bp, Homo sapiens
agggagagaagttatacaagat

SEQ ID NO: 6901396 - DNA, 22 bp, Homo sapiens
aggaaactcccctacatctcaa

SEQ ID NO: 6901397 - DNA, 19 bp, Homo sapiens
ttgtgcatatgcagtgcat

SEQ ID NO: 6901398 - DNA, 22 bp, Homo sapiens
ttattaggtttacataaaggtt

SEQ ID NO: 6901399 - DNA, 22 bp, Homo sapiens
ctatcaaacagccattaatata

SEQ ID NO: 6901400 - DNA, 22 bp, Homo sapiens
ggagggctccctgggagtggat

SEQ ID NO: 6901401 - DNA, 22 bp, Homo sapiens
tagaggagcggcgagctgagct

SEQ ID NO: 6901402 - DNA, 22 bp, Homo sapiens
ccagatgtctgagccacactcc

SEQ ID NO: 6901403 - DNA, 22 bp, Homo sapiens
gctggggactccccaccatagc

SEQ ID NO: 6901404 - DNA, 22 bp, Homo sapiens
acatttgtgcaacgtatccaca

SEQ ID NO: 6901405 - DNA, 22 bp, Homo sapiens
cagctggctggtcagtgcacaa

SEQ ID NO: 6901406 - DNA, 21 bp, Homo sapiens
gtttacaaggctttgctcctg

SEQ ID NO: 6901407 - DNA, 22 bp, Homo sapiens
aggagggtggggtctgcctgtc

SEQ ID NO: 6901408 - DNA, 22 bp, Homo sapiens
tataggaaatttatctcctggg

SEQ ID NO: 6901409 - DNA, 22 bp, Homo sapiens
tccagagatcacactgggcagg

SEQ ID NO: 6901410 - DNA, 22 bp, Homo sapiens
tgagaataagagatagtttatt

SEQ ID NO: 6901411 - DNA, 22 bp, Homo sapiens
tctggagcgaggtccctgtctg

SEQ ID NO: 6901412 - DNA, 22 bp, Homo sapiens
gtctgaaatggaggtgggaact

SEQ ID NO: 6901413 - DNA, 22 bp, Homo sapiens
cattcagagctttcttatcata

SEQ ID NO: 6901414 - DNA, 22 bp, Homo sapiens
caggaaattcccagaaggactg

SEQ ID NO: 6901415 - DNA, 22 bp, Homo sapiens
ccgtccattgcccaacagcatg

SEQ ID NO: 6901416 - DNA, 22 bp, Homo sapiens
acatgggggctgctgccagcga

SEQ ID NO: 6901417 - DNA, 22 bp, Homo sapiens
agcccagaggctgggcgtgcat

SEQ ID NO: 6901418 - DNA, 22 bp, Homo sapiens
accagcagggctgggccaatgg

SEQ ID NO: 6901419 - DNA, 22 bp, Homo sapiens
tacagatatttctcttcaacaa

SEQ ID NO: 6901420 - DNA, 22 bp, Homo sapiens
tctctgagtaagtgacagttca

SEQ ID NO: 6901421 - DNA, 21 bp, Homo sapiens
gtctaactggtctccttgctt

SEQ ID NO: 6901422 - DNA, 22 bp, Homo sapiens
aatcctggcatgtgccttggga

SEQ ID NO: 6901423 - DNA, 22 bp, Homo sapiens
ttttttagttaggtcagaatgt

SEQ ID NO: 6901424 - DNA, 22 bp, Homo sapiens
tattcccacagttgtctaccta

SEQ ID NO: 6901425 - DNA, 22 bp, Homo sapiens
agcaattatggagttgttgacg

SEQ ID NO: 6901426 - DNA, 22 bp, Homo sapiens
cttgggggccattaaggggcct

SEQ ID NO: 6901427 - DNA, 22 bp, Homo sapiens
aatgggaaagagactagatgct

SEQ ID NO: 6901428 - DNA, 22 bp, Homo sapiens
ttgttgtttccaggatactgtg

SEQ ID NO: 6901429 - DNA, 22 bp, Homo sapiens
gtctcttttatggtgagttgat

SEQ ID NO: 6901430 - DNA, 22 bp, Homo sapiens
tgactttagacttagtcaagtt

SEQ ID NO: 6901431 - DNA, 22 bp, Homo sapiens
tcagtctccatctgcttgtctt

SEQ ID NO: 6901432 - DNA, 22 bp, Homo sapiens
tcgctggcctggaggggagcca

SEQ ID NO: 6901433 - DNA, 22 bp, Homo sapiens
gaagttaccgaacctctccatg

SEQ ID NO: 6901434 - DNA, 22 bp, Homo sapiens
tgtaggattttcaccagacctt

SEQ ID NO: 6901435 - DNA, 22 bp, Homo sapiens
atctttggtgcttggtgctccc

SEQ ID NO: 6901436 - DNA, 22 bp, Homo sapiens
ttcattcaggtgtatttatggg

SEQ ID NO: 6901437 - DNA, 22 bp, Homo sapiens
ggctacagaggccgtgagcctg

SEQ ID NO: 6901438 - DNA, 22 bp, Homo sapiens
gaggacgggcttcatggggcct

SEQ ID NO: 6901439 - DNA, 22 bp, Homo sapiens
ttccacaagacttgggttaaga

SEQ ID NO: 6901440 - DNA, 22 bp, Homo sapiens
gctgaataggggtcccaaagat

SEQ ID NO: 6901441 - DNA, 22 bp, Homo sapiens
cagtggatcctctgactccctc

SEQ ID NO: 6901442 - DNA, 22 bp, Homo sapiens
ttctgtcaaagactttttcagg

SEQ ID NO: 6901443 - DNA, 22 bp, Homo sapiens
tccttattgatagtgccaccta

SEQ ID NO: 6901444 - DNA, 22 bp, Homo sapiens
acttccaagtgacattcatatc

SEQ ID NO: 6901445 - DNA, 22 bp, Homo sapiens
tagcgggtcaccctgctgtgaa

SEQ ID NO: 6901446 - DNA, 22 bp, Homo sapiens
tcagccaagctgtgagagagta

SEQ ID NO: 6901447 - DNA, 22 bp, Homo sapiens
caggaggttgtaagagcaggcc

SEQ ID NO: 6901448 - DNA, 22 bp, Homo sapiens
tgtagaagtttatgaacacatt

SEQ ID NO: 6901449 - DNA, 22 bp, Homo sapiens
ctgagggagagaatggggcaaa

SEQ ID NO: 6901450 - DNA, 22 bp, Homo sapiens
gtggcattatcttaagacgatt

SEQ ID NO: 6901451 - DNA, 22 bp, Homo sapiens
tgacaagaagacctggtaatga

SEQ ID NO: 6901452 - DNA, 22 bp, Homo sapiens
agtaaactttctcaggctccct

SEQ ID NO: 6901453 - DNA, 20 bp, Homo sapiens
aggcagtttcaattttgtta

SEQ ID NO: 6901454 - DNA, 22 bp, Homo sapiens
tgcagagaaaccagtggaggac

SEQ ID NO: 6901455 - DNA, 22 bp, Homo sapiens
cagatttattttacatccttca

SEQ ID NO: 6901456 - DNA, 22 bp, Homo sapiens
atttacagccttgaaaacagca

SEQ ID NO: 6901457 - DNA, 22 bp, Homo sapiens
ttacatcagaatcacccaggaa

SEQ ID NO: 6901458 - DNA, 22 bp, Homo sapiens
tggaaggctaggtgctaggccc

SEQ ID NO: 6901459 - DNA, 22 bp, Homo sapiens
gagagtgattccctcccataga

SEQ ID NO: 6901460 - DNA, 22 bp, Homo sapiens
ccaggcaccatgttcttaggac

SEQ ID NO: 6901461 - DNA, 22 bp, Homo sapiens
gtcactttacactcctactaaa

SEQ ID NO: 6901462 - DNA, 22 bp, Homo sapiens
tttaggctgcagcagggatgga

SEQ ID NO: 6901463 - DNA, 22 bp, Homo sapiens
aggagagttcacactggtcaga

SEQ ID NO: 6901464 - DNA, 19 bp, Homo sapiens
aggtgtgggggctgcagac

SEQ ID NO: 6901465 - DNA, 22 bp, Homo sapiens
ggtcagtgaatgtttgagcaga

SEQ ID NO: 6901466 - DNA, 17 bp, Homo sapiens
gcactgaacaatcctgt

SEQ ID NO: 6901467 - DNA, 17 bp, Homo sapiens
tggtagaatgacaggcc

SEQ ID NO: 6901468 - DNA, 23 bp, Homo sapiens
tggcacagaggaccatgctttgc

SEQ ID NO: 6901469 - DNA, 22 bp, Homo sapiens
tgtcttcatctcagacacagtt

SEQ ID NO: 6901470 - DNA, 23 bp, Homo sapiens
ttattttgtcagaagggactttt

SEQ ID NO: 6901471 - DNA, 22 bp, Homo sapiens
tctgggagtgggtccaaggaat

SEQ ID NO: 6901472 - DNA, 22 bp, Homo sapiens
tgcagcctagacattctggtca

SEQ ID NO: 6901473 - DNA, 22 bp, Homo sapiens
aggtctcactttgtggaagtga

SEQ ID NO: 6901474 - DNA, 22 bp, Homo sapiens
tgtttctttgtagatattcttt

SEQ ID NO: 6901475 - DNA, 22 bp, Homo sapiens
gctgtattcaacagtgaaaaga

SEQ ID NO: 6901476 - DNA, 22 bp, Homo sapiens
tggctgagaccttcccaaattc

SEQ ID NO: 6901477 - DNA, 22 bp, Homo sapiens
ttgattcagagaagattggccc

SEQ ID NO: 6901478 - DNA, 22 bp, Homo sapiens
gtctggtttatgaagatcccgt

SEQ ID NO: 6901479 - DNA, 22 bp, Homo sapiens
tctaagaatactcatatcttct

SEQ ID NO: 6901480 - DNA, 22 bp, Homo sapiens
tgcaggcctatggtggggcccc

SEQ ID NO: 6901481 - DNA, 22 bp, Homo sapiens
tcaggcctggagaaaggaatga

SEQ ID NO: 6901482 - DNA, 19 bp, Homo sapiens
ttaacagtcaccaaggaga

SEQ ID NO: 6901483 - DNA, 22 bp, Homo sapiens
ctggattttagaaggcttccta

SEQ ID NO: 6901484 - DNA, 22 bp, Homo sapiens
ctggtttagtgaaataggccag

SEQ ID NO: 6901485 - DNA, 22 bp, Homo sapiens
taaggctttggtcaccatggag

SEQ ID NO: 6901486 - DNA, 22 bp, Homo sapiens
acacatatgtggcaactgtaga

SEQ ID NO: 6901487 - DNA, 22 bp, Homo sapiens
agcagagcggggcctccggaag

SEQ ID NO: 6901488 - DNA, 22 bp, Homo sapiens
agcaagaagctttgctgtgata

SEQ ID NO: 6901489 - DNA, 22 bp, Homo sapiens
tagtgcttggtggagatggaga

SEQ ID NO: 6901490 - DNA, 22 bp, Homo sapiens
gagctggcacagaaggatctta

SEQ ID NO: 6901491 - DNA, 22 bp, Homo sapiens
ggataagcaactatgatggaga

SEQ ID NO: 6901492 - DNA, 22 bp, Homo sapiens
atcttatgagacccataaagat

SEQ ID NO: 6901493 - DNA, 22 bp, Homo sapiens
cagtatttttaagctgctttgt

SEQ ID NO: 6901494 - DNA, 22 bp, Homo sapiens
gcaggggagtggatgatggatt

SEQ ID NO: 6901495 - DNA, 22 bp, Homo sapiens
gtggcatttggaaagagcacta

SEQ ID NO: 6901496 - DNA, 22 bp, Homo sapiens
gctgcaaacctgccacctggtg

SEQ ID NO: 6901497 - DNA, 22 bp, Homo sapiens
atacagagggtttcatgggcag

SEQ ID NO: 6901498 - DNA, 22 bp, Homo sapiens
atgctttattattttgcaggga

SEQ ID NO: 6901499 - DNA, 22 bp, Homo sapiens
gctagtccacagccatccaggc

SEQ ID NO: 6901500 - DNA, 22 bp, Homo sapiens
caaaggtaaagatctgctgtgg

SEQ ID NO: 6901501 - DNA, 22 bp, Homo sapiens
gggccccttgctgctctgctgg

SEQ ID NO: 6901502 - DNA, 22 bp, Homo sapiens
ttcttgggtcctgtcgttgccc

SEQ ID NO: 6901503 - DNA, 22 bp, Homo sapiens
ccacctgagataagagagctca

SEQ ID NO: 6901504 - DNA, 22 bp, Homo sapiens
tgctcctgctgcatgcatctcc

SEQ ID NO: 6901505 - DNA, 19 bp, Homo sapiens
agcatggcctacagtgtgc

SEQ ID NO: 6901506 - DNA, 22 bp, Homo sapiens
tttcagatggtatatacagtag

SEQ ID NO: 6901507 - DNA, 22 bp, Homo sapiens
tggctgattgatttcctatgta

SEQ ID NO: 6901508 - DNA, 21 bp, Homo sapiens
tctgcctgagactttgctggt

SEQ ID NO: 6901509 - DNA, 18 bp, Homo sapiens
ggctgtgcgtggaggctg

SEQ ID NO: 6901510 - DNA, 22 bp, Homo sapiens
ggtttctctgggtgtgggtgct

SEQ ID NO: 6901511 - DNA, 22 bp, Homo sapiens
agtcctggttctgattctgaca

SEQ ID NO: 6901512 - DNA, 22 bp, Homo sapiens
ttagcttgcaaatggaaatgat

SEQ ID NO: 6901513 - DNA, 22 bp, Homo sapiens
aggatgtggctgagacttctgg

SEQ ID NO: 6901514 - DNA, 22 bp, Homo sapiens
acttccagctttataattcagt

SEQ ID NO: 6901515 - DNA, 22 bp, Homo sapiens
ttgtctgaaaaggtaaatattt

SEQ ID NO: 6901516 - DNA, 22 bp, Homo sapiens
ttctcacactttccactgaggt

SEQ ID NO: 6901517 - DNA, 22 bp, Homo sapiens
atgttaaataatcccttaaagc

SEQ ID NO: 6901518 - DNA, 22 bp, Homo sapiens
gcagagccgtgaatggatttca

SEQ ID NO: 6901519 - DNA, 22 bp, Homo sapiens
agcactattccaatgatccaat

SEQ ID NO: 6901520 - DNA, 19 bp, Homo sapiens
atcatcctgggtcatgcac

SEQ ID NO: 6901521 - DNA, 22 bp, Homo sapiens
ccaccttgggactgctcacccc

SEQ ID NO: 6901522 - DNA, 22 bp, Homo sapiens
gtctgagacccactcccagaga

SEQ ID NO: 6901523 - DNA, 22 bp, Homo sapiens
cacactgacctgaacttagcat

SEQ ID NO: 6901524 - DNA, 22 bp, Homo sapiens
cactatttcagtgattctgcag

SEQ ID NO: 6901525 - DNA, 22 bp, Homo sapiens
gtaacacagaaatgaaattcca

SEQ ID NO: 6901526 - DNA, 22 bp, Homo sapiens
aaagtgctgaagacctagctgt

SEQ ID NO: 6901527 - DNA, 22 bp, Homo sapiens
gcaatgaataaataatgtttag

SEQ ID NO: 6901528 - DNA, 22 bp, Homo sapiens
gtgtgtgtctccgcggccgtag

SEQ ID NO: 6901529 - DNA, 22 bp, Homo sapiens
gctggctggaatgggagaagaa

SEQ ID NO: 6901530 - DNA, 22 bp, Homo sapiens
gggaaactagaagcagggttat

SEQ ID NO: 6901531 - DNA, 22 bp, Homo sapiens
ttctagaagctctaggggagaa

SEQ ID NO: 6901532 - DNA, 22 bp, Homo sapiens
tcactcctcaggctagcatcat

SEQ ID NO: 6901533 - DNA, 22 bp, Homo sapiens
ttcctaacaaacttcagtgaat

SEQ ID NO: 6901534 - DNA, 20 bp, Homo sapiens
tcctttcctccttctaaatg

SEQ ID NO: 6901535 - DNA, 20 bp, Homo sapiens
ttgtttcctggctgttctgc

SEQ ID NO: 6901536 - DNA, 22 bp, Homo sapiens
aggcttagactacctggtctgt

SEQ ID NO: 6901537 - DNA, 22 bp, Homo sapiens
acagcttgctgtgccccctgcc

SEQ ID NO: 6901538 - DNA, 19 bp, Homo sapiens
cttcagcatctccggagct

SEQ ID NO: 6901539 - DNA, 17 bp, Homo sapiens
gacagctggttcctggc

SEQ ID NO: 6901540 - DNA, 22 bp, Homo sapiens
agccaggatcacccggggctgt

SEQ ID NO: 6901541 - DNA, 22 bp, Homo sapiens
cggaatgtcccaggtcctgatc

SEQ ID NO: 6901542 - DNA, 22 bp, Homo sapiens
tgaagctgcctgctcacagcca

SEQ ID NO: 6901543 - DNA, 22 bp, Homo sapiens
aaatgttcattaagggcctgtt

SEQ ID NO: 6901544 - DNA, 22 bp, Homo sapiens
ggctgcaggatgcccagccgtg

SEQ ID NO: 6901545 - DNA, 22 bp, Homo sapiens
ggaagtttgagcatctgtttcc

SEQ ID NO: 6901546 - DNA, 22 bp, Homo sapiens
gtggggacgggatggctcactg

SEQ ID NO: 6901547 - DNA, 22 bp, Homo sapiens
atgctatacatatgacatcaca

SEQ ID NO: 6901548 - DNA, 22 bp, Homo sapiens
cagcatgactcactgtggtcac

SEQ ID NO: 6901549 - DNA, 22 bp, Homo sapiens
tatgacttttcccaattcagga

SEQ ID NO: 6901550 - DNA, 22 bp, Homo sapiens
gccacatgtcatgtgctcagta

SEQ ID NO: 6901551 - DNA, 22 bp, Homo sapiens
gcctgctctggaatccatgtaa

SEQ ID NO: 6901552 - DNA, 22 bp, Homo sapiens
ctgctgagccgcacccaggagc

SEQ ID NO: 6901553 - DNA, 22 bp, Homo sapiens
ttattctttaaacatatatgtt

SEQ ID NO: 6901554 - DNA, 22 bp, Homo sapiens
agtgtaagtgatcattgatagt

SEQ ID NO: 6901555 - DNA, 22 bp, Homo sapiens
taggcatgtgtttgccatagcc

SEQ ID NO: 6901556 - DNA, 21 bp, Homo sapiens
tgcaggattccaggtcagtat

SEQ ID NO: 6901557 - DNA, 22 bp, Homo sapiens
tggtaaagtgtactgaatatga

SEQ ID NO: 6901558 - DNA, 22 bp, Homo sapiens
actgtgtcctatttccttgaca

SEQ ID NO: 6901559 - DNA, 21 bp, Homo sapiens
aagatttatgggacttgccaa

SEQ ID NO: 6901560 - DNA, 22 bp, Homo sapiens
agctccttgaattaatgctgct

SEQ ID NO: 6901561 - DNA, 22 bp, Homo sapiens
gctcctcttctcccactgaatg

SEQ ID NO: 6901562 - DNA, 22 bp, Homo sapiens
tggaagcgagacagagatctcc

SEQ ID NO: 6901563 - DNA, 22 bp, Homo sapiens
tacatcaaatcaatgttccagt

SEQ ID NO: 6901564 - DNA, 19 bp, Homo sapiens
ctgtacaggttgcttctgg

SEQ ID NO: 6901565 - DNA, 22 bp, Homo sapiens
cttagaaataatggtttcagtt

SEQ ID NO: 6901566 - DNA, 22 bp, Homo sapiens
agctcagaaatgccagtaggta

SEQ ID NO: 6901567 - DNA, 22 bp, Homo sapiens
tgggacatgcttggaatctaga

SEQ ID NO: 6901568 - DNA, 22 bp, Homo sapiens
agctgaagcaacaacaggatgg

SEQ ID NO: 6901569 - DNA, 22 bp, Homo sapiens
tattgtacatttcaaaattgct

SEQ ID NO: 6901570 - DNA, 22 bp, Homo sapiens
cagggactcccagggtagctcc

SEQ ID NO: 6901571 - DNA, 22 bp, Homo sapiens
gtctgggcaggaatctgcattc

SEQ ID NO: 6901572 - DNA, 22 bp, Homo sapiens
ttgagcaggaactagaagatag

SEQ ID NO: 6901573 - DNA, 22 bp, Homo sapiens
tagacacatccgtggaagcttc

SEQ ID NO: 6901574 - DNA, 22 bp, Homo sapiens
gccctttgaagtaagctggtgt

SEQ ID NO: 6901575 - DNA, 22 bp, Homo sapiens
gagccctctctgtaggcaagta

SEQ ID NO: 6901576 - DNA, 17 bp, Homo sapiens
ggactttaggttcttcc

SEQ ID NO: 6901577 - DNA, 22 bp, Homo sapiens
ctggccatatccaccagatgga

SEQ ID NO: 6901578 - DNA, 22 bp, Homo sapiens
gagagctatttggcaagcattt

SEQ ID NO: 6901579 - DNA, 22 bp, Homo sapiens
tacaggggtaacagtggggaat

SEQ ID NO: 6901580 - DNA, 22 bp, Homo sapiens
ctctggaaatggccatagtcat

SEQ ID NO: 6901581 - DNA, 22 bp, Homo sapiens
ccagctgtgcctaggagcaggg

SEQ ID NO: 6901582 - DNA, 22 bp, Homo sapiens
gagaaaggcattcctatgcaaa

SEQ ID NO: 6901583 - DNA, 22 bp, Homo sapiens
gctaatgaaaaatagattatag

SEQ ID NO: 6901584 - DNA, 22 bp, Homo sapiens
ttctccgctaagttctctgcag

SEQ ID NO: 6901585 - DNA, 22 bp, Homo sapiens
cccaggaggcgcaggttgcggt

SEQ ID NO: 6901586 - DNA, 22 bp, Homo sapiens
ccccggaggcggaggttgcagt

SEQ ID NO: 6901587 - DNA, 22 bp, Homo sapiens
atttcaggatagcctagttttg

SEQ ID NO: 6901588 - DNA, 22 bp, Homo sapiens
gcacatgccccattcttgtcac

SEQ ID NO: 6901589 - DNA, 22 bp, Homo sapiens
cagtgggtgcctctcattatat

SEQ ID NO: 6901590 - DNA, 22 bp, Homo sapiens
ggcatgctacttcttcaatttt

SEQ ID NO: 6901591 - DNA, 22 bp, Homo sapiens
tccagcttgggtgggaggaggt

SEQ ID NO: 6901592 - DNA, 22 bp, Homo sapiens
ttagccattaaattacaaggtg

SEQ ID NO: 6901593 - DNA, 22 bp, Homo sapiens
ccaggaggcggaggttgcagtg

SEQ ID NO: 6901594 - DNA, 22 bp, Homo sapiens
cacagatacctagtgaaacata

SEQ ID NO: 6901595 - DNA, 21 bp, Homo sapiens
ataccatttgccaaaaggatc

SEQ ID NO: 6901596 - DNA, 22 bp, Homo sapiens
agctagaagtacagccatatga

SEQ ID NO: 6901597 - DNA, 23 bp, Homo sapiens
atatttccaggttagtgaggtaa

SEQ ID NO: 6901598 - DNA, 22 bp, Homo sapiens
ttggcactcaaagccctctgca

SEQ ID NO: 6901599 - DNA, 22 bp, Homo sapiens
tggtcaaaaaggcctagacaca

SEQ ID NO: 6901600 - DNA, 22 bp, Homo sapiens
aaacctgaaggatgatacaaca

SEQ ID NO: 6901601 - DNA, 22 bp, Homo sapiens
gctgcagggggtgggcgtctcc

SEQ ID NO: 6901602 - DNA, 22 bp, Homo sapiens
ctggcttccaccatggcccctg

SEQ ID NO: 6901603 - DNA, 22 bp, Homo sapiens
tagaggggaatctgcctcctct

SEQ ID NO: 6901604 - DNA, 22 bp, Homo sapiens
ttctctgacccccttaaatatt

SEQ ID NO: 6901605 - DNA, 22 bp, Homo sapiens
tttgggaagtgggagcaaggtg

SEQ ID NO: 6901606 - DNA, 20 bp, Homo sapiens
gtgctgagtgaaatgagatt

SEQ ID NO: 6901607 - DNA, 22 bp, Homo sapiens
accctggattgggaaccagaag

SEQ ID NO: 6901608 - DNA, 22 bp, Homo sapiens
attgttctggatatttacattg

SEQ ID NO: 6901609 - DNA, 22 bp, Homo sapiens
tgtctgaaacttggtcctatgc

SEQ ID NO: 6901610 - DNA, 22 bp, Homo sapiens
tgtaagacatatcttagtgatg

SEQ ID NO: 6901611 - DNA, 22 bp, Homo sapiens
gtaaacaaactctcaggccagt

SEQ ID NO: 6901612 - DNA, 21 bp, Homo sapiens
agggttttatagatctcttcc

SEQ ID NO: 6901613 - DNA, 22 bp, Homo sapiens
ttgggtaggagaaagaacagat

SEQ ID NO: 6901614 - DNA, 22 bp, Homo sapiens
ctactgtattatggacattacg

SEQ ID NO: 6901615 - DNA, 22 bp, Homo sapiens
ttggcactgtgcctggcacatt

SEQ ID NO: 6901616 - DNA, 22 bp, Homo sapiens
ctgggcctcacacccaccaaat

SEQ ID NO: 6901617 - DNA, 22 bp, Homo sapiens
ttgaagcagctcaggaggctta

SEQ ID NO: 6901618 - DNA, 22 bp, Homo sapiens
tgcaggctggcagtgctgaaat

SEQ ID NO: 6901619 - DNA, 22 bp, Homo sapiens
cagaggtgcatacaggtcatta

SEQ ID NO: 6901620 - DNA, 22 bp, Homo sapiens
tatgtgtggcagctgggagtgt

SEQ ID NO: 6901621 - DNA, 22 bp, Homo sapiens
tcagatggcataggttggaatt

SEQ ID NO: 6901622 - DNA, 22 bp, Homo sapiens
tgggcaatatgactcagtattt

SEQ ID NO: 6901623 - DNA, 22 bp, Homo sapiens
caggtggttatgaggaaggtga

SEQ ID NO: 6901624 - DNA, 22 bp, Homo sapiens
ggctgagcactttaggcaggag

SEQ ID NO: 6901625 - DNA, 22 bp, Homo sapiens
ccaggccccagggctggctttc

SEQ ID NO: 6901626 - DNA, 22 bp, Homo sapiens
cagccctggaacagctgactca

SEQ ID NO: 6901627 - DNA, 22 bp, Homo sapiens
cacaaatgtagtagcttaaaac

SEQ ID NO: 6901628 - DNA, 22 bp, Homo sapiens
ctggtgcaaggctttggaatcc

SEQ ID NO: 6901629 - DNA, 22 bp, Homo sapiens
atgcagggttctgggctagaga

SEQ ID NO: 6901630 - DNA, 22 bp, Homo sapiens
ccagtgtttgatgggattttca

SEQ ID NO: 6901631 - DNA, 20 bp, Homo sapiens
agccagggttctggatgcac

SEQ ID NO: 6901632 - DNA, 22 bp, Homo sapiens
ctgagcgcgggacctgaggctg

SEQ ID NO: 6901633 - DNA, 22 bp, Homo sapiens
aaggccagcgcagaccattgtc

SEQ ID NO: 6901634 - DNA, 22 bp, Homo sapiens
gaagcagtagcaactgtgtctt

SEQ ID NO: 6901635 - DNA, 22 bp, Homo sapiens
atcctttcatctggtaatatat

SEQ ID NO: 6901636 - DNA, 22 bp, Homo sapiens
tcatcaaaggattgcatgattt

SEQ ID NO: 6901637 - DNA, 22 bp, Homo sapiens
gtttccacgtctcagttccaaa

SEQ ID NO: 6901638 - DNA, 22 bp, Homo sapiens
tctcagtggcttcctcactttt

SEQ ID NO: 6901639 - DNA, 22 bp, Homo sapiens
aggaggactctctgagccagcc

SEQ ID NO: 6901640 - DNA, 22 bp, Homo sapiens
tactatgttcttcctaaatagt

SEQ ID NO: 6901641 - DNA, 22 bp, Homo sapiens
ttggaagaaatatcaatagtgt

SEQ ID NO: 6901642 - DNA, 20 bp, Homo sapiens
gttaagccatgccagacttc

SEQ ID NO: 6901643 - DNA, 22 bp, Homo sapiens
acactgagtgtagaaatagcca

SEQ ID NO: 6901644 - DNA, 22 bp, Homo sapiens
tccagtggaacagatgttgcct

SEQ ID NO: 6901645 - DNA, 22 bp, Homo sapiens
gtccccttggtaaccttcagct

SEQ ID NO: 6901646 - DNA, 22 bp, Homo sapiens
tgagagttattctgaatttagc

SEQ ID NO: 6901647 - DNA, 22 bp, Homo sapiens
gacatgttgaagaatatttgga

SEQ ID NO: 6901648 - DNA, 22 bp, Homo sapiens
tacaacatttacgttaggctgt

SEQ ID NO: 6901649 - DNA, 22 bp, Homo sapiens
actttggaataagctatataac

SEQ ID NO: 6901650 - DNA, 22 bp, Homo sapiens
tgaatgcaagtcacacatttct

SEQ ID NO: 6901651 - DNA, 23 bp, Homo sapiens
agtgacccatttcagggtgtctt

SEQ ID NO: 6901652 - DNA, 22 bp, Homo sapiens
tctcaggggcagtgatcctaag

SEQ ID NO: 6901653 - DNA, 22 bp, Homo sapiens
cagagacaggaatcagctgcag

SEQ ID NO: 6901654 - DNA, 22 bp, Homo sapiens
ctggctgtggattatcacaggc

SEQ ID NO: 6901655 - DNA, 22 bp, Homo sapiens
acaagagacaagaggttcttct

SEQ ID NO: 6901656 - DNA, 22 bp, Homo sapiens
tactgtctttccatccttgcct

SEQ ID NO: 6901657 - DNA, 22 bp, Homo sapiens
gttaacataggcttaggggttt

SEQ ID NO: 6901658 - DNA, 22 bp, Homo sapiens
ggatgcatgtgcattttgaaaa

SEQ ID NO: 6901659 - DNA, 22 bp, Homo sapiens
cacatctatagggacagcaaca

SEQ ID NO: 6901660 - DNA, 22 bp, Homo sapiens
tggaagtgattacaatgtagta

SEQ ID NO: 6901661 - DNA, 22 bp, Homo sapiens
ttcaatttagtgatgttgttgg

SEQ ID NO: 6901662 - DNA, 22 bp, Homo sapiens
tctgataagtggtgtatactgt

SEQ ID NO: 6901663 - DNA, 22 bp, Homo sapiens
atttcagctctgccggagagag

SEQ ID NO: 6901664 - DNA, 22 bp, Homo sapiens
agaattggttggggaatgtgga

SEQ ID NO: 6901665 - DNA, 22 bp, Homo sapiens
ctcagtttcttcatattgtagg

SEQ ID NO: 6901666 - DNA, 22 bp, Homo sapiens
tagatgttgaagtcatatttgg

SEQ ID NO: 6901667 - DNA, 22 bp, Homo sapiens
tccacaggcaagtctcttggca

SEQ ID NO: 6901668 - DNA, 22 bp, Homo sapiens
agaatacagtatgcaaaaagat

SEQ ID NO: 6901669 - DNA, 22 bp, Homo sapiens
tgttcctgaggcatgtgtcaat

SEQ ID NO: 6901670 - DNA, 19 bp, Homo sapiens
tgatgccctgacctgagcc

SEQ ID NO: 6901671 - DNA, 22 bp, Homo sapiens
gatgttttctggaaaatgaatg

SEQ ID NO: 6901672 - DNA, 22 bp, Homo sapiens
cagatttaggcttagtccaagc

SEQ ID NO: 6901673 - DNA, 22 bp, Homo sapiens
gtgctggaccctggaaggtggt

SEQ ID NO: 6901674 - DNA, 22 bp, Homo sapiens
actatgatgtattttgcatcta

SEQ ID NO: 6901675 - DNA, 20 bp, Homo sapiens
tgcacagggtgggaagcaac

SEQ ID NO: 6901676 - DNA, 22 bp, Homo sapiens
acatgtgagtaaatttaatgtt

SEQ ID NO: 6901677 - DNA, 22 bp, Homo sapiens
ttgagatggagcttcactcttg

SEQ ID NO: 6901678 - DNA, 22 bp, Homo sapiens
aggtatttcatggagcaagcag

SEQ ID NO: 6901679 - DNA, 22 bp, Homo sapiens
gctcctgcagagatgttccatg

SEQ ID NO: 6901680 - DNA, 22 bp, Homo sapiens
atagaatagcatagaaaattga

SEQ ID NO: 6901681 - DNA, 22 bp, Homo sapiens
aatgagttttagggccattaaa

SEQ ID NO: 6901682 - DNA, 22 bp, Homo sapiens
tgaagaaaggtgtgggatactc

SEQ ID NO: 6901683 - DNA, 22 bp, Homo sapiens
aaactaaacctggcttagtaag

SEQ ID NO: 6901684 - DNA, 22 bp, Homo sapiens
acatacttaacattaaagtcat

SEQ ID NO: 6901685 - DNA, 22 bp, Homo sapiens
tggaagaataggatagaagaac

SEQ ID NO: 6901686 - DNA, 22 bp, Homo sapiens
tactctggccttcctgatttct

SEQ ID NO: 6901687 - DNA, 22 bp, Homo sapiens
ctgactttagaacccaaaaagt

SEQ ID NO: 6901688 - DNA, 22 bp, Homo sapiens
tgggaactggggcattgtttct

SEQ ID NO: 6901689 - DNA, 22 bp, Homo sapiens
cagctctgatgaaatgtaccag

SEQ ID NO: 6901690 - DNA, 22 bp, Homo sapiens
aagaacagttgggaggtgagcc

SEQ ID NO: 6901691 - DNA, 22 bp, Homo sapiens
aagcactgtacaaatgtcactt

SEQ ID NO: 6901692 - DNA, 22 bp, Homo sapiens
taggcactgagtacatattggt

SEQ ID NO: 6901693 - DNA, 22 bp, Homo sapiens
gtccatggcagagcccttctgc

SEQ ID NO: 6901694 - DNA, 22 bp, Homo sapiens
acagtatatatagtctaaaagc

SEQ ID NO: 6901695 - DNA, 22 bp, Homo sapiens
atgaatgcagcactgtttttct

SEQ ID NO: 6901696 - DNA, 22 bp, Homo sapiens
ctcagctctgacaggaggcatc

SEQ ID NO: 6901697 - DNA, 22 bp, Homo sapiens
ttctgcatgaaaagaactgaac

SEQ ID NO: 6901698 - DNA, 22 bp, Homo sapiens
tctagattcctcctgcatcctg

SEQ ID NO: 6901699 - DNA, 22 bp, Homo sapiens
aatcacaattacttttgcacca

SEQ ID NO: 6901700 - DNA, 22 bp, Homo sapiens
atcagccaattacagaacatga

SEQ ID NO: 6901701 - DNA, 23 bp, Homo sapiens
ttgaaaggtagctggcagctaga

SEQ ID NO: 6901702 - DNA, 22 bp, Homo sapiens
gtagtgtgtaggcactgtgctc

SEQ ID NO: 6901703 - DNA, 22 bp, Homo sapiens
gcagcaaacttccacaagtaga

SEQ ID NO: 6901704 - DNA, 22 bp, Homo sapiens
attggttttgttatctccattc

SEQ ID NO: 6901705 - DNA, 15 bp, Homo sapiens
gcattcctcatttcc

SEQ ID NO: 6901706 - DNA, 20 bp, Homo sapiens
gcctagagatggaaggcgca

SEQ ID NO: 6901707 - DNA, 22 bp, Homo sapiens
aaacggaatgagtaagagtatc

SEQ ID NO: 6901708 - DNA, 17 bp, Homo sapiens
tggcttcaggctgagca

SEQ ID NO: 6901709 - DNA, 22 bp, Homo sapiens
ataatggcttctgagtattagg

SEQ ID NO: 6901710 - DNA, 22 bp, Homo sapiens
tgaagatattttaaaatactga

SEQ ID NO: 6901711 - DNA, 22 bp, Homo sapiens
tagttatggagtaattttaagc

SEQ ID NO: 6901712 - DNA, 22 bp, Homo sapiens
tgggggactgcactggcgtcag

SEQ ID NO: 6901713 - DNA, 22 bp, Homo sapiens
agccagtggaattcccaggggt

SEQ ID NO: 6901714 - DNA, 22 bp, Homo sapiens
tctgtccagctctggggctcac

SEQ ID NO: 6901715 - DNA, 22 bp, Homo sapiens
ctacatcagaacatttacccta

SEQ ID NO: 6901716 - DNA, 22 bp, Homo sapiens
agaaatgttacagttgttattt

SEQ ID NO: 6901717 - DNA, 22 bp, Homo sapiens
tgtggcttccacgatggtcacc

SEQ ID NO: 6901718 - DNA, 22 bp, Homo sapiens
tcatcagtcagaacttaagctt

SEQ ID NO: 6901719 - DNA, 22 bp, Homo sapiens
gtggagccctggtagggacccc

SEQ ID NO: 6901720 - DNA, 22 bp, Homo sapiens
gccagaattttgagactacttg

SEQ ID NO: 6901721 - DNA, 22 bp, Homo sapiens
gccacctgtttcgcttgcccag

SEQ ID NO: 6901722 - DNA, 22 bp, Homo sapiens
tacacactgtgataatgaagca

SEQ ID NO: 6901723 - DNA, 22 bp, Homo sapiens
ttgtttacactgcagaattggg

SEQ ID NO: 6901724 - DNA, 23 bp, Homo sapiens
tcagggacatgatgtgtcatatc

SEQ ID NO: 6901725 - DNA, 22 bp, Homo sapiens
agacctggagtgaagagttccc

SEQ ID NO: 6901726 - DNA, 22 bp, Homo sapiens
gctccaggccacggcttcttgg

SEQ ID NO: 6901727 - DNA, 19 bp, Homo sapiens
tctccaggcaggtgagcga

SEQ ID NO: 6901728 - DNA, 19 bp, Homo sapiens
ggccatctctgccccagca

SEQ ID NO: 6901729 - DNA, 22 bp, Homo sapiens
tgccatctctgcaatgcctggg

SEQ ID NO: 6901730 - DNA, 22 bp, Homo sapiens
acaacttctcacagataaattt

SEQ ID NO: 6901731 - DNA, 22 bp, Homo sapiens
gtacatgttggttgtttccagt

SEQ ID NO: 6901732 - DNA, 22 bp, Homo sapiens
gtttgacacggtgcgtcttcag

SEQ ID NO: 6901733 - DNA, 22 bp, Homo sapiens
tttaggcagcacgggcagccct

SEQ ID NO: 6901734 - DNA, 22 bp, Homo sapiens
acaaagtttgtggtattccaag

SEQ ID NO: 6901735 - DNA, 22 bp, Homo sapiens
atccatgattagtaggataaag

SEQ ID NO: 6901736 - DNA, 22 bp, Homo sapiens
gaagtctgaaatcggtttgttt

SEQ ID NO: 6901737 - DNA, 22 bp, Homo sapiens
tgctctgggtcctgggcctcct

SEQ ID NO: 6901738 - DNA, 22 bp, Homo sapiens
aataatacatgagattaatgtt

SEQ ID NO: 6901739 - DNA, 22 bp, Homo sapiens
caagtggaatgctcttcctccc

SEQ ID NO: 6901740 - DNA, 22 bp, Homo sapiens
tccagcagtccatgtgagacac

SEQ ID NO: 6901741 - DNA, 23 bp, Homo sapiens
aggctgccagaaattgggtaagg

SEQ ID NO: 6901742 - DNA, 22 bp, Homo sapiens
tcaggctgcagctgtcagcagc

SEQ ID NO: 6901743 - DNA, 22 bp, Homo sapiens
tttaagactcttgtagtacaca

SEQ ID NO: 6901744 - DNA, 22 bp, Homo sapiens
tgacaaagaccttcaacaagat

SEQ ID NO: 6901745 - DNA, 22 bp, Homo sapiens
ctggaaagtgcatgtaatgagg

SEQ ID NO: 6901746 - DNA, 22 bp, Homo sapiens
atttcatgaatgctgctgttga

SEQ ID NO: 6901747 - DNA, 23 bp, Homo sapiens
agaatacaggctttgtataggca

SEQ ID NO: 6901748 - DNA, 22 bp, Homo sapiens
acttgttcattgagtacatatg

SEQ ID NO: 6901749 - DNA, 21 bp, Homo sapiens
tgtcacatgtggatggtattt

SEQ ID NO: 6901750 - DNA, 22 bp, Homo sapiens
tctttattgctactggtttgtc

SEQ ID NO: 6901751 - DNA, 22 bp, Homo sapiens
tgactgccccttccattcctgc

SEQ ID NO: 6901752 - DNA, 22 bp, Homo sapiens
ctggtttaaccatgtatcctgg

SEQ ID NO: 6901753 - DNA, 22 bp, Homo sapiens
tcaatgagctggggacgtgtac

SEQ ID NO: 6901754 - DNA, 22 bp, Homo sapiens
aaactgtgcttcccaaatgccc

SEQ ID NO: 6901755 - DNA, 22 bp, Homo sapiens
aaggcacacagttagatagagc

SEQ ID NO: 6901756 - DNA, 22 bp, Homo sapiens
tctttggaaggagcagtttttg

SEQ ID NO: 6901757 - DNA, 22 bp, Homo sapiens
tgaggtcaagcccagagcagca

SEQ ID NO: 6901758 - DNA, 22 bp, Homo sapiens
agtcaacacctggttctattac

SEQ ID NO: 6901759 - DNA, 22 bp, Homo sapiens
gggatggggggaagcgtccatg

SEQ ID NO: 6901760 - DNA, 21 bp, Homo sapiens
ctgcatctcatagaacatgtc

SEQ ID NO: 6901761 - DNA, 22 bp, Homo sapiens
gcctggcattacagcactcctg

SEQ ID NO: 6901762 - DNA, 22 bp, Homo sapiens
tgtggctgggctaataggcaaa

SEQ ID NO: 6901763 - DNA, 22 bp, Homo sapiens
tctagtctcagccttcacctaa

SEQ ID NO: 6901764 - DNA, 22 bp, Homo sapiens
gcgtattttagtctatgtgcat

SEQ ID NO: 6901765 - DNA, 18 bp, Homo sapiens
acccattatatttgtagc

SEQ ID NO: 6901766 - DNA, 22 bp, Homo sapiens
tatgctacatcctgggggatgt

SEQ ID NO: 6901767 - DNA, 22 bp, Homo sapiens
ctccaaggtttcagaacaaatg

SEQ ID NO: 6901768 - DNA, 22 bp, Homo sapiens
cctttggccgctttatggagga

SEQ ID NO: 6901769 - DNA, 22 bp, Homo sapiens
agctgaatcgaatggcccagtg

SEQ ID NO: 6901770 - DNA, 22 bp, Homo sapiens
gattaggctttgtttatagcaa

SEQ ID NO: 6901771 - DNA, 22 bp, Homo sapiens
taagattacagtgagaaataaa

SEQ ID NO: 6901772 - DNA, 22 bp, Homo sapiens
tgcttctcccaaccagggcctg

SEQ ID NO: 6901773 - DNA, 22 bp, Homo sapiens
gagactgaggtcaccaggctgt

SEQ ID NO: 6901774 - DNA, 22 bp, Homo sapiens
gtaaagtttctcagtgatgttc

SEQ ID NO: 6901775 - DNA, 22 bp, Homo sapiens
gtaacattctagaaacttaaca

SEQ ID NO: 6901776 - DNA, 22 bp, Homo sapiens
aaactttgttcgtccagactca

SEQ ID NO: 6901777 - DNA, 22 bp, Homo sapiens
tttctcttaatgtctctgtgct

SEQ ID NO: 6901778 - DNA, 22 bp, Homo sapiens
ttcaaactagttaaaagtcaga

SEQ ID NO: 6901779 - DNA, 22 bp, Homo sapiens
gctcgcgccgcaccggtccacc

SEQ ID NO: 6901780 - DNA, 22 bp, Homo sapiens
tgccagctgcttgtcccccaca

SEQ ID NO: 6901781 - DNA, 22 bp, Homo sapiens
gggatctggaattttggtatgt

SEQ ID NO: 6901782 - DNA, 18 bp, Homo sapiens
aaacccactcagcgctga

SEQ ID NO: 6901783 - DNA, 22 bp, Homo sapiens
ttcaaactgtgtaatttataaa

SEQ ID NO: 6901784 - DNA, 22 bp, Homo sapiens
gctctcagaagtaacttgtcca

SEQ ID NO: 6901785 - DNA, 22 bp, Homo sapiens
tcactggtctttggcttctcag

SEQ ID NO: 6901786 - DNA, 22 bp, Homo sapiens
actctccctgctatccacttcc

SEQ ID NO: 6901787 - DNA, 23 bp, Homo sapiens
aatcagcatgctctgtggctggc

SEQ ID NO: 6901788 - DNA, 22 bp, Homo sapiens
gggcaggtacaagatgcttctt

SEQ ID NO: 6901789 - DNA, 22 bp, Homo sapiens
cttgggaatgctaacagatgac

SEQ ID NO: 6901790 - DNA, 22 bp, Homo sapiens
ccctgagccgctgctccaacct

SEQ ID NO: 6901791 - DNA, 22 bp, Homo sapiens
gggcacttgtgttcttcacttt

SEQ ID NO: 6901792 - DNA, 17 bp, Homo sapiens
ccaggagcgtgggtctc

SEQ ID NO: 6901793 - DNA, 22 bp, Homo sapiens
tggatcatggctaaggcgatgg

SEQ ID NO: 6901794 - DNA, 22 bp, Homo sapiens
ggggagcttcaggtggcttaca

SEQ ID NO: 6901795 - DNA, 22 bp, Homo sapiens
gatagtcgaaattgatggagag

SEQ ID NO: 6901796 - DNA, 21 bp, Homo sapiens
agcaagaatcaggaaggctct

SEQ ID NO: 6901797 - DNA, 22 bp, Homo sapiens
ggagttaaggcctaagaaatag

SEQ ID NO: 6901798 - DNA, 22 bp, Homo sapiens
ttactgttggtgtatccatagc

SEQ ID NO: 6901799 - DNA, 22 bp, Homo sapiens
gtacatgtatgagatatgtgta

SEQ ID NO: 6901800 - DNA, 23 bp, Homo sapiens
ttcaagggttatttgttagcact

SEQ ID NO: 6901801 - DNA, 22 bp, Homo sapiens
cattcgtggccctctggataag

SEQ ID NO: 6901802 - DNA, 22 bp, Homo sapiens
aacaagtctaagagaatggcag

SEQ ID NO: 6901803 - DNA, 22 bp, Homo sapiens
tcaggatggagggaagcacaga

SEQ ID NO: 6901804 - DNA, 22 bp, Homo sapiens
acagtaatgcatacaagttagt

SEQ ID NO: 6901805 - DNA, 22 bp, Homo sapiens
tgtacacctgtctttacacata

SEQ ID NO: 6901806 - DNA, 22 bp, Homo sapiens
cctgtctgaggaggtgctcttt

SEQ ID NO: 6901807 - DNA, 22 bp, Homo sapiens
tggtctctgactctgaagaccc

SEQ ID NO: 6901808 - DNA, 22 bp, Homo sapiens
attttttagaacctggcctgat

SEQ ID NO: 6901809 - DNA, 22 bp, Homo sapiens
ggccctctgatccaactggtat

SEQ ID NO: 6901810 - DNA, 22 bp, Homo sapiens
ggttcctgtgcccatgtcatgg

SEQ ID NO: 6901811 - DNA, 22 bp, Homo sapiens
ctgatcccaggcactgtcgcaa

SEQ ID NO: 6901812 - DNA, 22 bp, Homo sapiens
actgtttctcaaattatgtggt

SEQ ID NO: 6901813 - DNA, 22 bp, Homo sapiens
atcagcagtgagtggctttcat

SEQ ID NO: 6901814 - DNA, 22 bp, Homo sapiens
aatgatcattataaagtgctct

SEQ ID NO: 6901815 - DNA, 22 bp, Homo sapiens
tttcattgagactatagacatc

SEQ ID NO: 6901816 - DNA, 23 bp, Homo sapiens
cctgcaaagaaacaagccacctg

SEQ ID NO: 6901817 - DNA, 22 bp, Homo sapiens
aaatggtgctactaggagtcag

SEQ ID NO: 6901818 - DNA, 22 bp, Homo sapiens
catgcacaagggatgatgaaat

SEQ ID NO: 6901819 - DNA, 22 bp, Homo sapiens
ccctgagaagatcattgccacg

SEQ ID NO: 6901820 - DNA, 22 bp, Homo sapiens
gcctgcactcaaacactctctt

SEQ ID NO: 6901821 - DNA, 22 bp, Homo sapiens
gggtgtagacacatgttcatct

SEQ ID NO: 6901822 - DNA, 22 bp, Homo sapiens
cccaggctcttatgtgacttgc

SEQ ID NO: 6901823 - DNA, 22 bp, Homo sapiens
cccaaccagaaattgacagaga

SEQ ID NO: 6901824 - DNA, 22 bp, Homo sapiens
ttgagatggagtctcgcactgt

SEQ ID NO: 6901825 - DNA, 22 bp, Homo sapiens
taatttcttcatctctgcagct

SEQ ID NO: 6901826 - DNA, 22 bp, Homo sapiens
gctggcttttgaagtctagcta

SEQ ID NO: 6901827 - DNA, 22 bp, Homo sapiens
atcatgttttaattagcaaact

SEQ ID NO: 6901828 - DNA, 22 bp, Homo sapiens
actctgcctgaacctcctgcaa

SEQ ID NO: 6901829 - DNA, 22 bp, Homo sapiens
atacaagttgtgataatgtaaa

SEQ ID NO: 6901830 - DNA, 22 bp, Homo sapiens
cacatactgagaatcacaccca

SEQ ID NO: 6901831 - DNA, 17 bp, Homo sapiens
acacagtacttttttgc

SEQ ID NO: 6901832 - DNA, 22 bp, Homo sapiens
tgaacttagtgggaatatctct

SEQ ID NO: 6901833 - DNA, 22 bp, Homo sapiens
tcatggctttttcactgttcgc

SEQ ID NO: 6901834 - DNA, 22 bp, Homo sapiens
ctagtagcccggtgtcctctga

SEQ ID NO: 6901835 - DNA, 22 bp, Homo sapiens
acctgaattgatttgacctgta

SEQ ID NO: 6901836 - DNA, 23 bp, Homo sapiens
ttgcttgagcccaggaagtggag

SEQ ID NO: 6901837 - DNA, 22 bp, Homo sapiens
ttatcataagtaattgaaataa

SEQ ID NO: 6901838 - DNA, 22 bp, Homo sapiens
gaacatcatgaagaaaacatat

SEQ ID NO: 6901839 - DNA, 22 bp, Homo sapiens
aacacagtcattagaggcagcc

SEQ ID NO: 6901840 - DNA, 22 bp, Homo sapiens
ggcaggggtggccttcctttgg

SEQ ID NO: 6901841 - DNA, 22 bp, Homo sapiens
ggaatcctcattacatcagggt

SEQ ID NO: 6901842 - DNA, 22 bp, Homo sapiens
cattgcattggattgtacttgt

SEQ ID NO: 6901843 - DNA, 22 bp, Homo sapiens
agaacagaggccttatgtttca

SEQ ID NO: 6901844 - DNA, 22 bp, Homo sapiens
tattgagttacagaaaatactt

SEQ ID NO: 6901845 - DNA, 23 bp, Homo sapiens
gcacttttataggtggggaaaca

SEQ ID NO: 6901846 - DNA, 22 bp, Homo sapiens
catgcagtgctttgcgccgggc

SEQ ID NO: 6901847 - DNA, 22 bp, Homo sapiens
tgttatagttaggagtgggttt

SEQ ID NO: 6901848 - DNA, 22 bp, Homo sapiens
ggcaggtacagcaagaggacaa

SEQ ID NO: 6901849 - DNA, 22 bp, Homo sapiens
acagccagaggagccaggctgg

SEQ ID NO: 6901850 - DNA, 22 bp, Homo sapiens
gggtgcaggcagcccaggcagg

SEQ ID NO: 6901851 - DNA, 22 bp, Homo sapiens
aggatttattacaagccatggt

SEQ ID NO: 6901852 - DNA, 22 bp, Homo sapiens
ggctgcctctatttaggatcaa

SEQ ID NO: 6901853 - DNA, 22 bp, Homo sapiens
acacttcatagcaaggttggag

SEQ ID NO: 6901854 - DNA, 22 bp, Homo sapiens
accagagcttacatgctagaaa

SEQ ID NO: 6901855 - DNA, 22 bp, Homo sapiens
gctttgcactctgatccttccc

SEQ ID NO: 6901856 - DNA, 18 bp, Homo sapiens
gctggggttgagctctcc

SEQ ID NO: 6901857 - DNA, 22 bp, Homo sapiens
tttatagggacagttcttggag

SEQ ID NO: 6901858 - DNA, 22 bp, Homo sapiens
acacattatgagcagttgtctt

SEQ ID NO: 6901859 - DNA, 22 bp, Homo sapiens
atgcctttctctgtagaaagaa

SEQ ID NO: 6901860 - DNA, 22 bp, Homo sapiens
gggctctcccacaacgtgccag

SEQ ID NO: 6901861 - DNA, 22 bp, Homo sapiens
ttacacttatctagagccatgg

SEQ ID NO: 6901862 - DNA, 22 bp, Homo sapiens
ttccaactttgtcatatattat

SEQ ID NO: 6901863 - DNA, 22 bp, Homo sapiens
gccagctcttgatgggtgggta

SEQ ID NO: 6901864 - DNA, 22 bp, Homo sapiens
tgtgcctttaaggggagctgag

SEQ ID NO: 6901865 - DNA, 22 bp, Homo sapiens
agagaaggggtaaagagtcctg

SEQ ID NO: 6901866 - DNA, 22 bp, Homo sapiens
tcaaggctaaactttcagagta

SEQ ID NO: 6901867 - DNA, 22 bp, Homo sapiens
cacatccgaggagggtgagatg

SEQ ID NO: 6901868 - DNA, 22 bp, Homo sapiens
tatatgtaaataagtctaatgt

SEQ ID NO: 6901869 - DNA, 22 bp, Homo sapiens
tgcatgtgtgtgtatttataaa

SEQ ID NO: 6901870 - DNA, 22 bp, Homo sapiens
gcctggggcatgcagctgatac

SEQ ID NO: 6901871 - DNA, 22 bp, Homo sapiens
tgctttgctggcactcctggct

SEQ ID NO: 6901872 - DNA, 22 bp, Homo sapiens
tgagcttattcataaaagtgca

SEQ ID NO: 6901873 - DNA, 22 bp, Homo sapiens
agctgttttctaatgcatttga

SEQ ID NO: 6901874 - DNA, 22 bp, Homo sapiens
tacaacattgtgttgcttcata

SEQ ID NO: 6901875 - DNA, 22 bp, Homo sapiens
aactttgggtaatgcttcaatt

SEQ ID NO: 6901876 - DNA, 22 bp, Homo sapiens
cagcaaaggtagaagcacagga

SEQ ID NO: 6901877 - DNA, 22 bp, Homo sapiens
ctgattcctgattcatgctctt

SEQ ID NO: 6901878 - DNA, 23 bp, Homo sapiens
tctggctttcacgggtattctta

SEQ ID NO: 6901879 - DNA, 22 bp, Homo sapiens
ctacatacatatacatgcagtt

SEQ ID NO: 6901880 - DNA, 22 bp, Homo sapiens
gtctacaaagcttcaagtctct

SEQ ID NO: 6901881 - DNA, 22 bp, Homo sapiens
cagcttacctcccacagctctc

SEQ ID NO: 6901882 - DNA, 22 bp, Homo sapiens
aggcagaccatgaatcatgacc

SEQ ID NO: 6901883 - DNA, 22 bp, Homo sapiens
aagaagaattattccctaatca

SEQ ID NO: 6901884 - DNA, 22 bp, Homo sapiens
gcacagcagctgctcagttgct

SEQ ID NO: 6901885 - DNA, 22 bp, Homo sapiens
tttttcttaaatgtgggttggc

SEQ ID NO: 6901886 - DNA, 22 bp, Homo sapiens
actggtaaattatgcgactttg

SEQ ID NO: 6901887 - DNA, 22 bp, Homo sapiens
agtgaaggaagtttgtcttggg

SEQ ID NO: 6901888 - DNA, 22 bp, Homo sapiens
tggcaggaagcatctataggtc

SEQ ID NO: 6901889 - DNA, 22 bp, Homo sapiens
cagctctgccacttcctagcta

SEQ ID NO: 6901890 - DNA, 22 bp, Homo sapiens
tctggattttggatatcaggct

SEQ ID NO: 6901891 - DNA, 22 bp, Homo sapiens
atggccaagcatatacagattg

SEQ ID NO: 6901892 - DNA, 23 bp, Homo sapiens
tattcctggtaagcctgtcactg

SEQ ID NO: 6901893 - DNA, 22 bp, Homo sapiens
gtcttcagtggcaaatggatct

SEQ ID NO: 6901894 - DNA, 21 bp, Homo sapiens
cagcagtgtgtctgagctaga

SEQ ID NO: 6901895 - DNA, 22 bp, Homo sapiens
ttgctgtgtctgatggctgaga

SEQ ID NO: 6901896 - DNA, 22 bp, Homo sapiens
gtcctcttagccacttaattat

SEQ ID NO: 6901897 - DNA, 22 bp, Homo sapiens
cttgggtcatctcttgcttctg

SEQ ID NO: 6901898 - DNA, 22 bp, Homo sapiens
agagcctggttcaaattttacc

SEQ ID NO: 6901899 - DNA, 23 bp, Homo sapiens
aactctggctagcatagaataga

SEQ ID NO: 6901900 - DNA, 22 bp, Homo sapiens
ctgtggctgcgccatcgaaaac

SEQ ID NO: 6901901 - DNA, 22 bp, Homo sapiens
ctgtgagactgatagggaagag

SEQ ID NO: 6901902 - DNA, 22 bp, Homo sapiens
atgaacaatctggcaagaactt

SEQ ID NO: 6901903 - DNA, 22 bp, Homo sapiens
gattctcttcatatggcaaagg

SEQ ID NO: 6901904 - DNA, 22 bp, Homo sapiens
tggcatttatatcccagtttat

SEQ ID NO: 6901905 - DNA, 20 bp, Homo sapiens
ggaagcagagaactgttttc

SEQ ID NO: 6901906 - DNA, 22 bp, Homo sapiens
tggaagagacacttacattcag

SEQ ID NO: 6901907 - DNA, 22 bp, Homo sapiens
tgatttgttacacaggtgtgtg

SEQ ID NO: 6901908 - DNA, 22 bp, Homo sapiens
gaccaagatacagcatcataga

SEQ ID NO: 6901909 - DNA, 19 bp, Homo sapiens
atataggctgaaccatgct

SEQ ID NO: 6901910 - DNA, 22 bp, Homo sapiens
cctgagagcagcttcctgctta

SEQ ID NO: 6901911 - DNA, 22 bp, Homo sapiens
tttataagaagcaatgtctgag

SEQ ID NO: 6901912 - DNA, 22 bp, Homo sapiens
gtctgaggggtttcccaggaca

SEQ ID NO: 6901913 - DNA, 18 bp, Homo sapiens
gcagcccctcttccttcc

SEQ ID NO: 6901914 - DNA, 22 bp, Homo sapiens
caatgaaattgagatccagaga

SEQ ID NO: 6901915 - DNA, 22 bp, Homo sapiens
ttactcagtctcccatacattg

SEQ ID NO: 6901916 - DNA, 16 bp, Homo sapiens
caggaaacttaaagac

SEQ ID NO: 6901917 - DNA, 22 bp, Homo sapiens
catctgtctcctcatcgcctgt

SEQ ID NO: 6901918 - DNA, 20 bp, Homo sapiens
agcagctgtgttttcatcct

SEQ ID NO: 6901919 - DNA, 22 bp, Homo sapiens
attctcatttgctggctatatg

SEQ ID NO: 6901920 - DNA, 22 bp, Homo sapiens
tgtttgtactcaaagccatgag

SEQ ID NO: 6901921 - DNA, 20 bp, Homo sapiens
tcaaaggcaaaggtgggtgt

SEQ ID NO: 6901922 - DNA, 22 bp, Homo sapiens
tttcaggaatacacacacatct

SEQ ID NO: 6901923 - DNA, 22 bp, Homo sapiens
gccctgtatccaagtcccatct

SEQ ID NO: 6901924 - DNA, 22 bp, Homo sapiens
agatgaattgatgttggacaga

SEQ ID NO: 6901925 - DNA, 22 bp, Homo sapiens
gtttggcagtgttatgtaggtt

SEQ ID NO: 6901926 - DNA, 22 bp, Homo sapiens
gtcttccacatttcaagaggct

SEQ ID NO: 6901927 - DNA, 22 bp, Homo sapiens
atattgggtgtgggcatcaggg

SEQ ID NO: 6901928 - DNA, 22 bp, Homo sapiens
actgcaaaaatgggtgcattca

SEQ ID NO: 6901929 - DNA, 19 bp, Homo sapiens
tctccaggtgccccaaaca

SEQ ID NO: 6901930 - DNA, 22 bp, Homo sapiens
tagcaaagggaaagaagggcct

SEQ ID NO: 6901931 - DNA, 22 bp, Homo sapiens
attctctggtcattgagcatat

SEQ ID NO: 6901932 - DNA, 22 bp, Homo sapiens
gaagcagttcgaaagcagttgg

SEQ ID NO: 6901933 - DNA, 22 bp, Homo sapiens
gaagttactctcgttaaatatg

SEQ ID NO: 6901934 - DNA, 22 bp, Homo sapiens
aggctgcctcttttgagagggt

SEQ ID NO: 6901935 - DNA, 22 bp, Homo sapiens
ctgccctgctctccgggatctt

SEQ ID NO: 6901936 - DNA, 22 bp, Homo sapiens
tctccagaaatggggctgggga

SEQ ID NO: 6901937 - DNA, 22 bp, Homo sapiens
taggaatccagatctagactgt

SEQ ID NO: 6901938 - DNA, 20 bp, Homo sapiens
tcctggagtctggtttggct

SEQ ID NO: 6901939 - DNA, 22 bp, Homo sapiens
aaagtttgagtgatttgacaca

SEQ ID NO: 6901940 - DNA, 22 bp, Homo sapiens
gattctctgctatctatcacct

SEQ ID NO: 6901941 - DNA, 22 bp, Homo sapiens
actgcactccagcctgggtgat

SEQ ID NO: 6901942 - DNA, 22 bp, Homo sapiens
ggagtggtggtcaggccatggc

SEQ ID NO: 6901943 - DNA, 22 bp, Homo sapiens
tttcattaaagtcaaatctggt

SEQ ID NO: 6901944 - DNA, 22 bp, Homo sapiens
ccaccctaacaatccttactgt

SEQ ID NO: 6901945 - DNA, 17 bp, Homo sapiens
gctgcctgcaactgact

SEQ ID NO: 6901946 - DNA, 22 bp, Homo sapiens
ccagatgtgagcagagccttga

SEQ ID NO: 6901947 - DNA, 22 bp, Homo sapiens
gactgttattgttaatagcatg

SEQ ID NO: 6901948 - DNA, 22 bp, Homo sapiens
agatgctgaagctgaggcaaca

SEQ ID NO: 6901949 - DNA, 22 bp, Homo sapiens
tgaatatgttcctcacaagttc

SEQ ID NO: 6901950 - DNA, 22 bp, Homo sapiens
tattctctccccaatcttgctt

SEQ ID NO: 6901951 - DNA, 22 bp, Homo sapiens
aagtcattggtagcttgatagg

SEQ ID NO: 6901952 - DNA, 22 bp, Homo sapiens
acagtcttatgcatacactatt

SEQ ID NO: 6901953 - DNA, 21 bp, Homo sapiens
aagcttccctgctctccaggg

SEQ ID NO: 6901954 - DNA, 22 bp, Homo sapiens
gagtcataaggtgagtagcggt

SEQ ID NO: 6901955 - DNA, 22 bp, Homo sapiens
acataggccaatatccagagct

SEQ ID NO: 6901956 - DNA, 22 bp, Homo sapiens
ggatttgggcttgcagcagagc

SEQ ID NO: 6901957 - DNA, 22 bp, Homo sapiens
cactgcctggaaggagagacat

SEQ ID NO: 6901958 - DNA, 22 bp, Homo sapiens
aaggcactacgctgctggggcg

SEQ ID NO: 6901959 - DNA, 22 bp, Homo sapiens
atcataggtgtgttaccagtta

SEQ ID NO: 6901960 - DNA, 22 bp, Homo sapiens
aatgttcagctttcttacttaa

SEQ ID NO: 6901961 - DNA, 22 bp, Homo sapiens
tccagttgtttgtattaactct

SEQ ID NO: 6901962 - DNA, 22 bp, Homo sapiens
tagcttttatccactgcttttg

SEQ ID NO: 6901963 - DNA, 22 bp, Homo sapiens
cagcagggttaagtgactcacc

SEQ ID NO: 6901964 - DNA, 22 bp, Homo sapiens
agtttctctttgacaccaaaat

SEQ ID NO: 6901965 - DNA, 22 bp, Homo sapiens
cacatgttaacttcctacagtg

SEQ ID NO: 6901966 - DNA, 22 bp, Homo sapiens
cctgtaatcccagctactcggg

SEQ ID NO: 6901967 - DNA, 22 bp, Homo sapiens
tggcagtggctcagagtgcaga

SEQ ID NO: 6901968 - DNA, 22 bp, Homo sapiens
tgtgtataagtgagaatgctgt

SEQ ID NO: 6901969 - DNA, 19 bp, Homo sapiens
gtgtagctattggtcaaaa

SEQ ID NO: 6901970 - DNA, 22 bp, Homo sapiens
atctgcttgagtttgaagtcag

SEQ ID NO: 6901971 - DNA, 22 bp, Homo sapiens
ttggcagcacggggaacgtctg

SEQ ID NO: 6901972 - DNA, 22 bp, Homo sapiens
tgtaagttttgtgaaacaaaca

SEQ ID NO: 6901973 - DNA, 22 bp, Homo sapiens
ttggggagaaatgaaatgaagt

SEQ ID NO: 6901974 - DNA, 22 bp, Homo sapiens
ttctcattctgactcagtgtag

SEQ ID NO: 6901975 - DNA, 22 bp, Homo sapiens
gggcactgagaattttccactt

SEQ ID NO: 6901976 - DNA, 22 bp, Homo sapiens
gacagccaggtctgatgaccca

SEQ ID NO: 6901977 - DNA, 19 bp, Homo sapiens
tctccaaaaccaatcacta

SEQ ID NO: 6901978 - DNA, 22 bp, Homo sapiens
tgagtcctgtctttgtcactta

SEQ ID NO: 6901979 - DNA, 17 bp, Homo sapiens
tccagagaggcttccct

SEQ ID NO: 6901980 - DNA, 22 bp, Homo sapiens
tctgtcaaaagttttcaataaa

SEQ ID NO: 6901981 - DNA, 22 bp, Homo sapiens
caggctgtccaggctcctttgg

SEQ ID NO: 6901982 - DNA, 22 bp, Homo sapiens
tttaactcctagtgtgtattag

SEQ ID NO: 6901983 - DNA, 22 bp, Homo sapiens
tggagaaggccggccaggagtg

SEQ ID NO: 6901984 - DNA, 22 bp, Homo sapiens
ctattacagggaagccttggga

SEQ ID NO: 6901985 - DNA, 22 bp, Homo sapiens
gcctggccgctccgagctccgc

SEQ ID NO: 6901986 - DNA, 22 bp, Homo sapiens
aggaccagcctccaggtctctt

SEQ ID NO: 6901987 - DNA, 22 bp, Homo sapiens
tgttacttggtgtctctggctg

SEQ ID NO: 6901988 - DNA, 22 bp, Homo sapiens
ttctggttttactgaggaaatc

SEQ ID NO: 6901989 - DNA, 22 bp, Homo sapiens
agctggcactagcgtttccaag

SEQ ID NO: 6901990 - DNA, 21 bp, Homo sapiens
ctgctctgacagtgaggccag

SEQ ID NO: 6901991 - DNA, 22 bp, Homo sapiens
tggacagtaggaagagtgtggg

SEQ ID NO: 6901992 - DNA, 22 bp, Homo sapiens
tagcattcagaactgagagcaa

SEQ ID NO: 6901993 - DNA, 22 bp, Homo sapiens
caggaaattttgtgatctgttc

SEQ ID NO: 6901994 - DNA, 22 bp, Homo sapiens
agcgcaggaacacgtctgcctt

SEQ ID NO: 6901995 - DNA, 22 bp, Homo sapiens
agcaccaggatattgttggaga

SEQ ID NO: 6901996 - DNA, 23 bp, Homo sapiens
ctccttggtatgccatgcccagc

SEQ ID NO: 6901997 - DNA, 22 bp, Homo sapiens
agctcctgattctcagagatag

SEQ ID NO: 6901998 - DNA, 22 bp, Homo sapiens
atgtagagtagaatagtacaac

SEQ ID NO: 6901999 - DNA, 22 bp, Homo sapiens
ttgcacagtggtttagagcctg

SEQ ID NO: 6902000 - DNA, 21 bp, Homo sapiens
agcaccagttttatgccaggc

SEQ ID NO: 6902001 - DNA, 21 bp, Homo sapiens
tgtaggaggcatctggggctg

SEQ ID NO: 6902002 - DNA, 22 bp, Homo sapiens
aaaagcagtaaatgtatgacct

SEQ ID NO: 6902003 - DNA, 22 bp, Homo sapiens
gcagagtttctggcacattgga

SEQ ID NO: 6902004 - DNA, 21 bp, Homo sapiens
ggcaggtgggtctctgttgct

SEQ ID NO: 6902005 - DNA, 22 bp, Homo sapiens
tcctgggcaaaagtatctgtga

SEQ ID NO: 6902006 - DNA, 21 bp, Homo sapiens
tagaatgctattgtcttttct

SEQ ID NO: 6902007 - DNA, 22 bp, Homo sapiens
gcagtacacacatatgtattcg

SEQ ID NO: 6902008 - DNA, 18 bp, Homo sapiens
acagaactgagatttgag

SEQ ID NO: 6902009 - DNA, 22 bp, Homo sapiens
catcaggatctctctggaatgc

SEQ ID NO: 6902010 - DNA, 22 bp, Homo sapiens
ttgaagcagagaaatacttgaa

SEQ ID NO: 6902011 - DNA, 22 bp, Homo sapiens
cagggctgtggctttgtgctgt

SEQ ID NO: 6902012 - DNA, 22 bp, Homo sapiens
ctgtgggaacactgaggacttc

SEQ ID NO: 6902013 - DNA, 22 bp, Homo sapiens
tggaaggaacagagtttgaaac

SEQ ID NO: 6902014 - DNA, 22 bp, Homo sapiens
ctctttgtagcctttgcatatt

SEQ ID NO: 6902015 - DNA, 22 bp, Homo sapiens
ctagataaggatttctcaactt

SEQ ID NO: 6902016 - DNA, 20 bp, Homo sapiens
taaggctgttttgtattcct

SEQ ID NO: 6902017 - DNA, 22 bp, Homo sapiens
ctgtgggcagctcctcctgtca

SEQ ID NO: 6902018 - DNA, 22 bp, Homo sapiens
atgaagtcgttactaccaattg

SEQ ID NO: 6902019 - DNA, 22 bp, Homo sapiens
gtagtacatgaagcacttggca

SEQ ID NO: 6902020 - DNA, 22 bp, Homo sapiens
tgtcatggacagattagatgag

SEQ ID NO: 6902021 - DNA, 22 bp, Homo sapiens
cagatatagtggcttgcctggg

SEQ ID NO: 6902022 - DNA, 22 bp, Homo sapiens
atgcagatttaattagtatagg

SEQ ID NO: 6902023 - DNA, 22 bp, Homo sapiens
tattttggctgattcatcatgt

SEQ ID NO: 6902024 - DNA, 22 bp, Homo sapiens
tttagtgcctgggccagttcca

SEQ ID NO: 6902025 - DNA, 22 bp, Homo sapiens
ctcaggaggtggtagaggccct

SEQ ID NO: 6902026 - DNA, 22 bp, Homo sapiens
aagccctgataggaaaatgctg

SEQ ID NO: 6902027 - DNA, 22 bp, Homo sapiens
gagggaccccaggctggccctt

SEQ ID NO: 6902028 - DNA, 22 bp, Homo sapiens
agaaattgccagaatgtcaggc

SEQ ID NO: 6902029 - DNA, 22 bp, Homo sapiens
aggcaactgacagcatatcctg

SEQ ID NO: 6902030 - DNA, 22 bp, Homo sapiens
cctgcaagacctgagacacacc

SEQ ID NO: 6902031 - DNA, 23 bp, Homo sapiens
gagctgtttgtgcagagagccct

SEQ ID NO: 6902032 - DNA, 19 bp, Homo sapiens
tggaatgttccaaggaggc

SEQ ID NO: 6902033 - DNA, 22 bp, Homo sapiens
tatatgctaatggtgccattcc

SEQ ID NO: 6902034 - DNA, 22 bp, Homo sapiens
agctctgatccataatttatac

SEQ ID NO: 6902035 - DNA, 22 bp, Homo sapiens
tttagcaatttctaaaagtgtt

SEQ ID NO: 6902036 - DNA, 22 bp, Homo sapiens
caattcaaaccagtctgtctct

SEQ ID NO: 6902037 - DNA, 22 bp, Homo sapiens
ttcaggaagtgctgcctggtgt

SEQ ID NO: 6902038 - DNA, 22 bp, Homo sapiens
ttcatttgtctgctatagatcc

SEQ ID NO: 6902039 - DNA, 22 bp, Homo sapiens
gactttctgatgtaaacattta

SEQ ID NO: 6902040 - DNA, 22 bp, Homo sapiens
aaagaagacagacatttctttc

SEQ ID NO: 6902041 - DNA, 22 bp, Homo sapiens
aggtacatttgataaaaatagc

SEQ ID NO: 6902042 - DNA, 18 bp, Homo sapiens
ctgggccagagtttctgc

SEQ ID NO: 6902043 - DNA, 22 bp, Homo sapiens
gcagtaagttaatagtgctggt

SEQ ID NO: 6902044 - DNA, 22 bp, Homo sapiens
tcactctgttagaggaaagtgc

SEQ ID NO: 6902045 - DNA, 22 bp, Homo sapiens
tgggccagttggtgactacaaa

SEQ ID NO: 6902046 - DNA, 22 bp, Homo sapiens
taattcaggtagaacttaccag

SEQ ID NO: 6902047 - DNA, 22 bp, Homo sapiens
aagaatctccatctgattcact

SEQ ID NO: 6902048 - DNA, 22 bp, Homo sapiens
gacacagaccaccaggccctgg

SEQ ID NO: 6902049 - DNA, 20 bp, Homo sapiens
aaacaaggttgctctgagga

SEQ ID NO: 6902050 - DNA, 22 bp, Homo sapiens
aactctttcatctgtggcctgg

SEQ ID NO: 6902051 - DNA, 22 bp, Homo sapiens
agatttagtggtggaattttgg

SEQ ID NO: 6902052 - DNA, 22 bp, Homo sapiens
ggtgaaggaggaagctgatgga

SEQ ID NO: 6902053 - DNA, 22 bp, Homo sapiens
tagaatgacctcctcttagctt

SEQ ID NO: 6902054 - DNA, 23 bp, Homo sapiens
atgccaggctgcctggccagcct

SEQ ID NO: 6902055 - DNA, 22 bp, Homo sapiens
actttaactgttattactcacc

SEQ ID NO: 6902056 - DNA, 21 bp, Homo sapiens
tactgtatagatgtgttcttg

SEQ ID NO: 6902057 - DNA, 22 bp, Homo sapiens
gcctgtgcttaactgacgtgag

SEQ ID NO: 6902058 - DNA, 22 bp, Homo sapiens
tcgctgtggtttctgtacatgg

SEQ ID NO: 6902059 - DNA, 22 bp, Homo sapiens
ctgcctgggccatgcccagtcc

SEQ ID NO: 6902060 - DNA, 22 bp, Homo sapiens
atcagagcaatggataaaatca

SEQ ID NO: 6902061 - DNA, 22 bp, Homo sapiens
tagaaagctgagtaatacattt

SEQ ID NO: 6902062 - DNA, 22 bp, Homo sapiens
ccagagatgttcacattctaat

SEQ ID NO: 6902063 - DNA, 22 bp, Homo sapiens
gagctcctcccagggtagcact

SEQ ID NO: 6902064 - DNA, 22 bp, Homo sapiens
tcagtggattggatgagatctg

SEQ ID NO: 6902065 - DNA, 22 bp, Homo sapiens
gtatttccattagtgtgtgcac

SEQ ID NO: 6902066 - DNA, 22 bp, Homo sapiens
tttatgacccaagaagatacca

SEQ ID NO: 6902067 - DNA, 22 bp, Homo sapiens
cctggagagagaggccaactgc

SEQ ID NO: 6902068 - DNA, 22 bp, Homo sapiens
ggactgaaatctttccatgtca

SEQ ID NO: 6902069 - DNA, 19 bp, Homo sapiens
ggtgcactgggaatgcagc

SEQ ID NO: 6902070 - DNA, 22 bp, Homo sapiens
tcactgcaagctcctcctcctg

SEQ ID NO: 6902071 - DNA, 22 bp, Homo sapiens
acttagaaagggattctagatt

SEQ ID NO: 6902072 - DNA, 22 bp, Homo sapiens
cacatgcttagatttcagtgga

SEQ ID NO: 6902073 - DNA, 22 bp, Homo sapiens
cctggctttgcggatttacagg

SEQ ID NO: 6902074 - DNA, 18 bp, Homo sapiens
tgcactgtgctgagtggc

SEQ ID NO: 6902075 - DNA, 22 bp, Homo sapiens
aagagtttctgggtcaaggatt

SEQ ID NO: 6902076 - DNA, 22 bp, Homo sapiens
tagatgatttatgactatacct

SEQ ID NO: 6902077 - DNA, 22 bp, Homo sapiens
atccaagcagaatcacgtgaga

SEQ ID NO: 6902078 - DNA, 22 bp, Homo sapiens
ttccacaggactaaatgtcatc

SEQ ID NO: 6902079 - DNA, 22 bp, Homo sapiens
tttgcagtttgttcagctcttt

SEQ ID NO: 6902080 - DNA, 22 bp, Homo sapiens
agtgaaggaaacaattggttga

SEQ ID NO: 6902081 - DNA, 22 bp, Homo sapiens
ttctcccctgaccctgatgagg

SEQ ID NO: 6902082 - DNA, 22 bp, Homo sapiens
agtgatttgggagagccagctg

SEQ ID NO: 6902083 - DNA, 22 bp, Homo sapiens
ctggtgtccagcatgtgtggaa

SEQ ID NO: 6902084 - DNA, 22 bp, Homo sapiens
gagctgcagacttgatacagga

SEQ ID NO: 6902085 - DNA, 22 bp, Homo sapiens
ttggcacacagtaagccctaag

SEQ ID NO: 6902086 - DNA, 22 bp, Homo sapiens
agacaatacatttattcccttt

SEQ ID NO: 6902087 - DNA, 22 bp, Homo sapiens
tgtgaaagtcaaattaattgaa

SEQ ID NO: 6902088 - DNA, 22 bp, Homo sapiens
ggagatctcagttttataatca

SEQ ID NO: 6902089 - DNA, 22 bp, Homo sapiens
tctgcctatgctgtacctttgt

SEQ ID NO: 6902090 - DNA, 22 bp, Homo sapiens
taggaagtgcattgttttccta

SEQ ID NO: 6902091 - DNA, 18 bp, Homo sapiens
atatctgtgggatggaga

SEQ ID NO: 6902092 - DNA, 20 bp, Homo sapiens
tagtccagtaggggggcttt

SEQ ID NO: 6902093 - DNA, 22 bp, Homo sapiens
atacttatactaagaatgtact

SEQ ID NO: 6902094 - DNA, 22 bp, Homo sapiens
tgtaaacagccccatggagagc

SEQ ID NO: 6902095 - DNA, 22 bp, Homo sapiens
gtccaggctgacccctagagga

SEQ ID NO: 6902096 - DNA, 22 bp, Homo sapiens
agctcacacctcatcagggtgg

SEQ ID NO: 6902097 - DNA, 22 bp, Homo sapiens
gttcacagcaaacctatgaact

SEQ ID NO: 6902098 - DNA, 22 bp, Homo sapiens
ctagaaggtctgggcctgggaa

SEQ ID NO: 6902099 - DNA, 22 bp, Homo sapiens
agaagatttaggttgacgctat

SEQ ID NO: 6902100 - DNA, 22 bp, Homo sapiens
taggtcccttctgtcctggtct

SEQ ID NO: 6902101 - DNA, 22 bp, Homo sapiens
tgctgaatcaaaacaaaggttt

SEQ ID NO: 6902102 - DNA, 22 bp, Homo sapiens
gtttttctagaaatctcctcct

SEQ ID NO: 6902103 - DNA, 22 bp, Homo sapiens
caggtggggcgccctcaggcag

SEQ ID NO: 6902104 - DNA, 22 bp, Homo sapiens
acactgaataattgagagttga

SEQ ID NO: 6902105 - DNA, 22 bp, Homo sapiens
acagtcctagctgcaaagaagt

SEQ ID NO: 6902106 - DNA, 22 bp, Homo sapiens
tctggctctgaattcacttctg

SEQ ID NO: 6902107 - DNA, 22 bp, Homo sapiens
caaagggcatggcctgagcact

SEQ ID NO: 6902108 - DNA, 22 bp, Homo sapiens
ataacccattggccaggcttca

SEQ ID NO: 6902109 - DNA, 22 bp, Homo sapiens
ggctgagactagagtgaggcat

SEQ ID NO: 6902110 - DNA, 22 bp, Homo sapiens
gagtgtggtgaacaggagcacc

SEQ ID NO: 6902111 - DNA, 22 bp, Homo sapiens
gcagtgtttacatattagaaac

SEQ ID NO: 6902112 - DNA, 22 bp, Homo sapiens
ttccagaactcaagaaatgccc

SEQ ID NO: 6902113 - DNA, 22 bp, Homo sapiens
gaggttcagtaaggaatactga

SEQ ID NO: 6902114 - DNA, 22 bp, Homo sapiens
ggtgccaatttatttagccaag

SEQ ID NO: 6902115 - DNA, 22 bp, Homo sapiens
gagggtctcttaatgccagggg

SEQ ID NO: 6902116 - DNA, 22 bp, Homo sapiens
ttgactatactctggcggaaaa

SEQ ID NO: 6902117 - DNA, 22 bp, Homo sapiens
gtgtaattgaaattgagaacca

SEQ ID NO: 6902118 - DNA, 23 bp, Homo sapiens
agtgctggagaagcttctggctt

SEQ ID NO: 6902119 - DNA, 22 bp, Homo sapiens
tcgcttcacaccatcagcgagg

SEQ ID NO: 6902120 - DNA, 22 bp, Homo sapiens
atgaatttttctaagcttttgt

SEQ ID NO: 6902121 - DNA, 22 bp, Homo sapiens
tctgttttgtgtctctctggtg

SEQ ID NO: 6902122 - DNA, 22 bp, Homo sapiens
ggtgctgcctatagtctgaaac

SEQ ID NO: 6902123 - DNA, 22 bp, Homo sapiens
tctgacagtctcttctttagct

SEQ ID NO: 6902124 - DNA, 19 bp, Homo sapiens
gtcacatttgtctcccagg

SEQ ID NO: 6902125 - DNA, 22 bp, Homo sapiens
tcatgcaacaacacattctggc

SEQ ID NO: 6902126 - DNA, 22 bp, Homo sapiens
aatatagctcactataccatgg

SEQ ID NO: 6902127 - DNA, 22 bp, Homo sapiens
cataaagtgtataagtgaagaa

SEQ ID NO: 6902128 - DNA, 22 bp, Homo sapiens
cagagattattataactaatta

SEQ ID NO: 6902129 - DNA, 22 bp, Homo sapiens
agtcagagctatgttgttatat

SEQ ID NO: 6902130 - DNA, 22 bp, Homo sapiens
tgggaaggtgtagaaagaacaa

SEQ ID NO: 6902131 - DNA, 22 bp, Homo sapiens
ctgtgggatcccatgactttcc

SEQ ID NO: 6902132 - DNA, 22 bp, Homo sapiens
tgtgacccagactcatcttctt

SEQ ID NO: 6902133 - DNA, 23 bp, Homo sapiens
tcagagcaagatgatgtatgagc

SEQ ID NO: 6902134 - DNA, 22 bp, Homo sapiens
tctgcccagggcagggcttgca

SEQ ID NO: 6902135 - DNA, 22 bp, Homo sapiens
tcttccagccaatagcgtcctt

SEQ ID NO: 6902136 - DNA, 20 bp, Homo sapiens
aaacagctaaaccagctctc

SEQ ID NO: 6902137 - DNA, 22 bp, Homo sapiens
ctctgaggtttcctcacaagct

SEQ ID NO: 6902138 - DNA, 21 bp, Homo sapiens
gattaaatttaagctacatgc

SEQ ID NO: 6902139 - DNA, 19 bp, Homo sapiens
ccctgccctggtgactggg

SEQ ID NO: 6902140 - DNA, 22 bp, Homo sapiens
gttgtttataaaaatatctagc

SEQ ID NO: 6902141 - DNA, 22 bp, Homo sapiens
gtattgcttgagcccaggagtt

SEQ ID NO: 6902142 - DNA, 20 bp, Homo sapiens
taccatcatatgcatttaat

SEQ ID NO: 6902143 - DNA, 22 bp, Homo sapiens
ctcacaggcatctcatcaggct

SEQ ID NO: 6902144 - DNA, 22 bp, Homo sapiens
ttcctatatgtgatctcatttg

SEQ ID NO: 6902145 - DNA, 22 bp, Homo sapiens
ttcctggcgccacggagccggt

SEQ ID NO: 6902146 - DNA, 22 bp, Homo sapiens
ctgtccctcagttctgggcaaa

SEQ ID NO: 6902147 - DNA, 22 bp, Homo sapiens
caaacctgttagaggtcatcgt

SEQ ID NO: 6902148 - DNA, 22 bp, Homo sapiens
ggctagggagacagagggcatg

SEQ ID NO: 6902149 - DNA, 22 bp, Homo sapiens
ttacttgatttgaaaatcatag

SEQ ID NO: 6902150 - DNA, 18 bp, Homo sapiens
ctcctggctgatggtgag

SEQ ID NO: 6902151 - DNA, 22 bp, Homo sapiens
ttcccctgtcacagtggttctc

SEQ ID NO: 6902152 - DNA, 22 bp, Homo sapiens
tacagtttcccagcagatgcaa

SEQ ID NO: 6902153 - DNA, 22 bp, Homo sapiens
agcctgagtgcttaggactgtt

SEQ ID NO: 6902154 - DNA, 22 bp, Homo sapiens
catgggcagaagtggcatcatt

SEQ ID NO: 6902155 - DNA, 22 bp, Homo sapiens
ctggctggtctgagcagtcgca

SEQ ID NO: 6902156 - DNA, 22 bp, Homo sapiens
acgccctttttctctagagtag

SEQ ID NO: 6902157 - DNA, 22 bp, Homo sapiens
gctggaggcagttcagacacca

SEQ ID NO: 6902158 - DNA, 21 bp, Homo sapiens
acaggcaccatgcctgtgcct

SEQ ID NO: 6902159 - DNA, 22 bp, Homo sapiens
atgacatgattgccatttgata

SEQ ID NO: 6902160 - DNA, 22 bp, Homo sapiens
tgtttactggaccagggagggg

SEQ ID NO: 6902161 - DNA, 22 bp, Homo sapiens
actggtacctgtcttgaatttt

SEQ ID NO: 6902162 - DNA, 22 bp, Homo sapiens
ttcacagacattgcagactgaa

SEQ ID NO: 6902163 - DNA, 22 bp, Homo sapiens
ggttaccagttctgtcgtttta

SEQ ID NO: 6902164 - DNA, 22 bp, Homo sapiens
gtctctctcccaagattggcta

SEQ ID NO: 6902165 - DNA, 22 bp, Homo sapiens
atttaggtagctgtctaagtgt

SEQ ID NO: 6902166 - DNA, 22 bp, Homo sapiens
gagagctgcaaggtagggcggg

SEQ ID NO: 6902167 - DNA, 22 bp, Homo sapiens
tgtgtagctttcttctgtgggg

SEQ ID NO: 6902168 - DNA, 22 bp, Homo sapiens
gcacttgaggacgactcagctg

SEQ ID NO: 6902169 - DNA, 20 bp, Homo sapiens
gatttgctgaacttttatga

SEQ ID NO: 6902170 - DNA, 22 bp, Homo sapiens
gagtgttcccacaccccagttg

SEQ ID NO: 6902171 - DNA, 22 bp, Homo sapiens
gtagatcagtttttgtctataa

SEQ ID NO: 6902172 - DNA, 22 bp, Homo sapiens
gctgtatttattttctagggtt

SEQ ID NO: 6902173 - DNA, 22 bp, Homo sapiens
ttgcatttcaattgctcaggaa

SEQ ID NO: 6902174 - DNA, 22 bp, Homo sapiens
atctggagagctggcagcccag

SEQ ID NO: 6902175 - DNA, 22 bp, Homo sapiens
cttctagctatagtgttttctt

SEQ ID NO: 6902176 - DNA, 22 bp, Homo sapiens
ctggtttacccaagatttgctg

SEQ ID NO: 6902177 - DNA, 22 bp, Homo sapiens
catgtgcagtgtaagacatgct

SEQ ID NO: 6902178 - DNA, 22 bp, Homo sapiens
accttaaaggccgaagtaaaga

SEQ ID NO: 6902179 - DNA, 22 bp, Homo sapiens
gattggaaatggaaatggtaaa

SEQ ID NO: 6902180 - DNA, 22 bp, Homo sapiens
tcagggtgaaccaggcaggaat

SEQ ID NO: 6902181 - DNA, 21 bp, Homo sapiens
gaccacagggaaggtcttgca

SEQ ID NO: 6902182 - DNA, 22 bp, Homo sapiens
tggcagctgtcagaatgcaaat

SEQ ID NO: 6902183 - DNA, 19 bp, Homo sapiens
gctggggcctgaccagaca

SEQ ID NO: 6902184 - DNA, 22 bp, Homo sapiens
cccagcctgtctttcccaatga

SEQ ID NO: 6902185 - DNA, 22 bp, Homo sapiens
tccttaggaaaatgatgagggg

SEQ ID NO: 6902186 - DNA, 21 bp, Homo sapiens
tctgaaggcttgactggggct

SEQ ID NO: 6902187 - DNA, 22 bp, Homo sapiens
aggtaaacaggagaaaatgaga

SEQ ID NO: 6902188 - DNA, 21 bp, Homo sapiens
ctgtggtacagctgggacgga

SEQ ID NO: 6902189 - DNA, 22 bp, Homo sapiens
cttcagtttacaatgcattggc

SEQ ID NO: 6902190 - DNA, 22 bp, Homo sapiens
tgaggtatacgttggttcagtc

SEQ ID NO: 6902191 - DNA, 22 bp, Homo sapiens
attgacaagacaatggctctta

SEQ ID NO: 6902192 - DNA, 22 bp, Homo sapiens
agggtagctacccaactccaga

SEQ ID NO: 6902193 - DNA, 22 bp, Homo sapiens
atagtcactgccttccatttgt

SEQ ID NO: 6902194 - DNA, 22 bp, Homo sapiens
ggcagccatgtgggcagcgagt

SEQ ID NO: 6902195 - DNA, 22 bp, Homo sapiens
atcttgcttccttttaattacc

SEQ ID NO: 6902196 - DNA, 22 bp, Homo sapiens
ccagctgtaggcagggggttta

SEQ ID NO: 6902197 - DNA, 22 bp, Homo sapiens
aggcactgttcccagttatcct

SEQ ID NO: 6902198 - DNA, 22 bp, Homo sapiens
ttgctttacctgtggtatattt

SEQ ID NO: 6902199 - DNA, 23 bp, Homo sapiens
ttggggacaaacatgctactttc

SEQ ID NO: 6902200 - DNA, 22 bp, Homo sapiens
acagacttgttccctagtgagt

SEQ ID NO: 6902201 - DNA, 22 bp, Homo sapiens
cagctgcccatcctgggaaatg

SEQ ID NO: 6902202 - DNA, 22 bp, Homo sapiens
aggtcctgactccacgttctag

SEQ ID NO: 6902203 - DNA, 22 bp, Homo sapiens
ccccaggacgtggccctcatag

SEQ ID NO: 6902204 - DNA, 22 bp, Homo sapiens
tcatttgtgcaatgtagatgaa

SEQ ID NO: 6902205 - DNA, 22 bp, Homo sapiens
cccaggaaagaatttagagcca

SEQ ID NO: 6902206 - DNA, 22 bp, Homo sapiens
ggcagttctcagccaaggcaat

SEQ ID NO: 6902207 - DNA, 22 bp, Homo sapiens
cactgaagccactggaagagga

SEQ ID NO: 6902208 - DNA, 22 bp, Homo sapiens
ccctttctgccttctaaaataa

SEQ ID NO: 6902209 - DNA, 22 bp, Homo sapiens
aactttatcggaacaggtactc

SEQ ID NO: 6902210 - DNA, 22 bp, Homo sapiens
gccagcagcgagagtttaacct

SEQ ID NO: 6902211 - DNA, 22 bp, Homo sapiens
aggagctggtagtctcattggg

SEQ ID NO: 6902212 - DNA, 22 bp, Homo sapiens
atgtctctcaggtttaacttta

SEQ ID NO: 6902213 - DNA, 22 bp, Homo sapiens
gatgaaatagaattaatttagg

SEQ ID NO: 6902214 - DNA, 22 bp, Homo sapiens
cctcgtgtgctaggatccaggt

SEQ ID NO: 6902215 - DNA, 22 bp, Homo sapiens
gtgtttgtttgggtagctagac

SEQ ID NO: 6902216 - DNA, 19 bp, Homo sapiens
acagcacagaaatatttca

SEQ ID NO: 6902217 - DNA, 22 bp, Homo sapiens
cagcttgcactatattaaggag

SEQ ID NO: 6902218 - DNA, 22 bp, Homo sapiens
ctgagaagagggtatgtggcgc

SEQ ID NO: 6902219 - DNA, 22 bp, Homo sapiens
taactccagagaatccatccat

SEQ ID NO: 6902220 - DNA, 22 bp, Homo sapiens
tagctcctggtgagcctactct

SEQ ID NO: 6902221 - DNA, 19 bp, Homo sapiens
ctctctggcggtgtctgcg

SEQ ID NO: 6902222 - DNA, 22 bp, Homo sapiens
gacacagtggttctgtgagtaa

SEQ ID NO: 6902223 - DNA, 20 bp, Homo sapiens
gcagtctgtcacagagcatg

SEQ ID NO: 6902224 - DNA, 22 bp, Homo sapiens
ttcagtgtggaatgtgaactgc

SEQ ID NO: 6902225 - DNA, 22 bp, Homo sapiens
ggcaagagttgaagctccagga

SEQ ID NO: 6902226 - DNA, 22 bp, Homo sapiens
ttagaaaggaatcttcatttca

SEQ ID NO: 6902227 - DNA, 22 bp, Homo sapiens
ttaggaaagcattgtgtaaaag

SEQ ID NO: 6902228 - DNA, 22 bp, Homo sapiens
attcagaattttggggagctaa

SEQ ID NO: 6902229 - DNA, 22 bp, Homo sapiens
tctgcacaaaactgtcgcagaa

SEQ ID NO: 6902230 - DNA, 22 bp, Homo sapiens
ctttcctagttggtcccagcac

SEQ ID NO: 6902231 - DNA, 22 bp, Homo sapiens
tggagagcgtgcttagcactct

SEQ ID NO: 6902232 - DNA, 22 bp, Homo sapiens
gagatgacatgcctgttgtagg

SEQ ID NO: 6902233 - DNA, 22 bp, Homo sapiens
tcccttctggcagcagtgtgag

SEQ ID NO: 6902234 - DNA, 22 bp, Homo sapiens
acagtatttgcgatactgatga

SEQ ID NO: 6902235 - DNA, 22 bp, Homo sapiens
gtggctgcagctctgaacggac

SEQ ID NO: 6902236 - DNA, 22 bp, Homo sapiens
gcagctgtatcacttttaaaca

SEQ ID NO: 6902237 - DNA, 21 bp, Homo sapiens
tctaattgtaaatgaggctgt

SEQ ID NO: 6902238 - DNA, 22 bp, Homo sapiens
gcctggcatatagtagttgtgc

SEQ ID NO: 6902239 - DNA, 22 bp, Homo sapiens
tcagctgttatcactgtctgtc

SEQ ID NO: 6902240 - DNA, 22 bp, Homo sapiens
atgtgccctttctgctttgcag

SEQ ID NO: 6902241 - DNA, 22 bp, Homo sapiens
agtcaaccatttagaagagtgt

SEQ ID NO: 6902242 - DNA, 22 bp, Homo sapiens
tgtgggcaaagggtagctgggt

SEQ ID NO: 6902243 - DNA, 22 bp, Homo sapiens
acagaactgagaattctctatc

SEQ ID NO: 6902244 - DNA, 22 bp, Homo sapiens
ctctgtgattttgtgagccaga

SEQ ID NO: 6902245 - DNA, 22 bp, Homo sapiens
tattattgcaagtatataaagt

SEQ ID NO: 6902246 - DNA, 20 bp, Homo sapiens
tgcatttacagtgtggatac

SEQ ID NO: 6902247 - DNA, 22 bp, Homo sapiens
atgacactgtcctagtaaggaa

SEQ ID NO: 6902248 - DNA, 22 bp, Homo sapiens
cagagctggagaagtggattta

SEQ ID NO: 6902249 - DNA, 22 bp, Homo sapiens
aggttctggagaacttggaggt

SEQ ID NO: 6902250 - DNA, 22 bp, Homo sapiens
tgaagtgggaatacttcttccc

SEQ ID NO: 6902251 - DNA, 22 bp, Homo sapiens
gccagctgctcgcgtagggtag

SEQ ID NO: 6902252 - DNA, 21 bp, Homo sapiens
ctgattgtgaaagtcatcatt

SEQ ID NO: 6902253 - DNA, 22 bp, Homo sapiens
tgtctccatgtgatagtggcct

SEQ ID NO: 6902254 - DNA, 22 bp, Homo sapiens
agggtcccgtccctctgcaccc

SEQ ID NO: 6902255 - DNA, 20 bp, Homo sapiens
tttgatttcacaaggccagt

SEQ ID NO: 6902256 - DNA, 22 bp, Homo sapiens
taactggtatatcagtgtacac

SEQ ID NO: 6902257 - DNA, 21 bp, Homo sapiens
ccaggccaggcctacggggat

SEQ ID NO: 6902258 - DNA, 22 bp, Homo sapiens
ccctggctgataccggaaaggc

SEQ ID NO: 6902259 - DNA, 22 bp, Homo sapiens
aatcagacacctggatggtctg

SEQ ID NO: 6902260 - DNA, 22 bp, Homo sapiens
gagggtggaagagctgctgaga

SEQ ID NO: 6902261 - DNA, 22 bp, Homo sapiens
tggttacataagaatagcactg

SEQ ID NO: 6902262 - DNA, 22 bp, Homo sapiens
caggaaatgggtcgttttataa

SEQ ID NO: 6902263 - DNA, 22 bp, Homo sapiens
ggagctgtgcagtgactacaga

SEQ ID NO: 6902264 - DNA, 22 bp, Homo sapiens
tggcttctgctcccagaatgat

SEQ ID NO: 6902265 - DNA, 22 bp, Homo sapiens
actcagcacagcactgggaacc

SEQ ID NO: 6902266 - DNA, 22 bp, Homo sapiens
ctggtctgtggtattttattat

SEQ ID NO: 6902267 - DNA, 21 bp, Homo sapiens
aaggctggagatgcaggtctg

SEQ ID NO: 6902268 - DNA, 22 bp, Homo sapiens
gtacaattatttaaatggtgaa

SEQ ID NO: 6902269 - DNA, 22 bp, Homo sapiens
tgctaacaaagtctaaatcata

SEQ ID NO: 6902270 - DNA, 19 bp, Homo sapiens
tccctggcgcctctcgggc

SEQ ID NO: 6902271 - DNA, 22 bp, Homo sapiens
agcgggcagaagtggggtctgc

SEQ ID NO: 6902272 - DNA, 22 bp, Homo sapiens
ctgccttggttcccagccagca

SEQ ID NO: 6902273 - DNA, 22 bp, Homo sapiens
ctataattatgctcaaaatgta

SEQ ID NO: 6902274 - DNA, 22 bp, Homo sapiens
ttacaagggtcagtgtgtttgt

SEQ ID NO: 6902275 - DNA, 22 bp, Homo sapiens
ggagctgtagatcagctaatct

SEQ ID NO: 6902276 - DNA, 22 bp, Homo sapiens
tgtcctcatcctccagtctgtc

SEQ ID NO: 6902277 - DNA, 22 bp, Homo sapiens
aggaagatgtgcaaagttggaa

SEQ ID NO: 6902278 - DNA, 22 bp, Homo sapiens
gtggcctggatgagcttcgaca

SEQ ID NO: 6902279 - DNA, 22 bp, Homo sapiens
taacaagatttgtaaaattgta

SEQ ID NO: 6902280 - DNA, 22 bp, Homo sapiens
aggcatttgagtccatgggtga

SEQ ID NO: 6902281 - DNA, 22 bp, Homo sapiens
gacaggtgtgatgatttaggct

SEQ ID NO: 6902282 - DNA, 22 bp, Homo sapiens
tggtaaagaaatgtcagggcag

SEQ ID NO: 6902283 - DNA, 22 bp, Homo sapiens
gagtctggactattctggtctt

SEQ ID NO: 6902284 - DNA, 22 bp, Homo sapiens
tgtgtgccagggcatgcacagg

SEQ ID NO: 6902285 - DNA, 22 bp, Homo sapiens
tcatgccagctttgcttgtccc

SEQ ID NO: 6902286 - DNA, 23 bp, Homo sapiens
tcatttcatccagccttgagagt

SEQ ID NO: 6902287 - DNA, 22 bp, Homo sapiens
catggtgtgcagcgtcaaatgt

SEQ ID NO: 6902288 - DNA, 22 bp, Homo sapiens
tcatcagggatattggcctgaa

SEQ ID NO: 6902289 - DNA, 22 bp, Homo sapiens
gacctggttgactgtgagcagg

SEQ ID NO: 6902290 - DNA, 22 bp, Homo sapiens
atagcacaatgacttgggtatc

SEQ ID NO: 6902291 - DNA, 20 bp, Homo sapiens
gcctgtcctgagtgtcatgg

SEQ ID NO: 6902292 - DNA, 22 bp, Homo sapiens
gaggagggcagttcctctttta

SEQ ID NO: 6902293 - DNA, 22 bp, Homo sapiens
tgcatttacggtacaacagcag

SEQ ID NO: 6902294 - DNA, 22 bp, Homo sapiens
aattagctgtcaatgaggatct

SEQ ID NO: 6902295 - DNA, 22 bp, Homo sapiens
agcattgatttgtgaccaacaa

SEQ ID NO: 6902296 - DNA, 22 bp, Homo sapiens
tgcaactggaagggttatgtgg

SEQ ID NO: 6902297 - DNA, 23 bp, Homo sapiens
ctgtccttggtcttggctgagtg

SEQ ID NO: 6902298 - DNA, 22 bp, Homo sapiens
acaagaagggtgattaggggca

SEQ ID NO: 6902299 - DNA, 22 bp, Homo sapiens
gtgggggcaggcagtgctagga

SEQ ID NO: 6902300 - DNA, 22 bp, Homo sapiens
gctctgggctgccctctggaca

SEQ ID NO: 6902301 - DNA, 21 bp, Homo sapiens
ctgcaaatacctagttatctg

SEQ ID NO: 6902302 - DNA, 22 bp, Homo sapiens
ggtaaactaaccattttaattt

SEQ ID NO: 6902303 - DNA, 23 bp, Homo sapiens
atcaaactggtgagaatgtcagt

SEQ ID NO: 6902304 - DNA, 22 bp, Homo sapiens
gagaaagatgtaggctgggagg

SEQ ID NO: 6902305 - DNA, 22 bp, Homo sapiens
taggactttggcgtcagaactg

SEQ ID NO: 6902306 - DNA, 22 bp, Homo sapiens
gccctcaggcagggagtctttc

SEQ ID NO: 6902307 - DNA, 22 bp, Homo sapiens
ggcagggaggaggtgaaagtga

SEQ ID NO: 6902308 - DNA, 22 bp, Homo sapiens
aaagagttccaagtcattttat

SEQ ID NO: 6902309 - DNA, 22 bp, Homo sapiens
tggcatggtggagtgacgggca

SEQ ID NO: 6902310 - DNA, 22 bp, Homo sapiens
gtcctctggaggtttttaggtg

SEQ ID NO: 6902311 - DNA, 22 bp, Homo sapiens
ggacctgtgtctacagcatgtg

SEQ ID NO: 6902312 - DNA, 22 bp, Homo sapiens
tgctcagactagctccagggaa

SEQ ID NO: 6902313 - DNA, 22 bp, Homo sapiens
ctgccaggcacgtgcagcatca

SEQ ID NO: 6902314 - DNA, 22 bp, Homo sapiens
ttgtcttaaatggatggacaat

SEQ ID NO: 6902315 - DNA, 22 bp, Homo sapiens
actaaggaatatgacaaactca

SEQ ID NO: 6902316 - DNA, 22 bp, Homo sapiens
aaggcgtaggagattttcaaag

SEQ ID NO: 6902317 - DNA, 19 bp, Homo sapiens
ttgtccagaaaggcattgc

SEQ ID NO: 6902318 - DNA, 22 bp, Homo sapiens
catgtcttccttgcacacacac

SEQ ID NO: 6902319 - DNA, 22 bp, Homo sapiens
acttgacattaatttaggttgt

SEQ ID NO: 6902320 - DNA, 22 bp, Homo sapiens
acttgccaagttctgtgctgtt

SEQ ID NO: 6902321 - DNA, 22 bp, Homo sapiens
gtgaaatatttaacgtccaggt

SEQ ID NO: 6902322 - DNA, 22 bp, Homo sapiens
tccagtggcactggagactaga

SEQ ID NO: 6902323 - DNA, 22 bp, Homo sapiens
ttattgtgaggaataagtgaga

SEQ ID NO: 6902324 - DNA, 22 bp, Homo sapiens
cagccaggcccagatcatgctg

SEQ ID NO: 6902325 - DNA, 22 bp, Homo sapiens
aatgtgtataagggagagctaa

SEQ ID NO: 6902326 - DNA, 22 bp, Homo sapiens
caggagtgagttggggtctaca

SEQ ID NO: 6902327 - DNA, 22 bp, Homo sapiens
tctaaggacagttattactggg

SEQ ID NO: 6902328 - DNA, 18 bp, Homo sapiens
aatgcaatgtatttgcag

SEQ ID NO: 6902329 - DNA, 22 bp, Homo sapiens
gaactgggaatgctgtcccatc

SEQ ID NO: 6902330 - DNA, 22 bp, Homo sapiens
gctgagcagggtggggaaaggc

SEQ ID NO: 6902331 - DNA, 22 bp, Homo sapiens
ctgtgtgctcggatggactcgt

SEQ ID NO: 6902332 - DNA, 22 bp, Homo sapiens
tgtagcttcagtctgatctcat

SEQ ID NO: 6902333 - DNA, 22 bp, Homo sapiens
ttcattcccaagagtaaacata

SEQ ID NO: 6902334 - DNA, 22 bp, Homo sapiens
tgaagtctattctatgccaggt

SEQ ID NO: 6902335 - DNA, 22 bp, Homo sapiens
gcctgccagccacagtggcagc

SEQ ID NO: 6902336 - DNA, 22 bp, Homo sapiens
gcttattttcaccttctctcag

SEQ ID NO: 6902337 - DNA, 22 bp, Homo sapiens
ttattatagattatgcaagatt

SEQ ID NO: 6902338 - DNA, 22 bp, Homo sapiens
aaaagtaattgcggtttttgcc

SEQ ID NO: 6902339 - DNA, 22 bp, Homo sapiens
gtctcttagtctcattttctgc

SEQ ID NO: 6902340 - DNA, 22 bp, Homo sapiens
gtgcaccagtcacatgggcaga

SEQ ID NO: 6902341 - DNA, 22 bp, Homo sapiens
tcttgggcctcaccccagacat

SEQ ID NO: 6902342 - DNA, 22 bp, Homo sapiens
ttagcacccgggccagcggctg

SEQ ID NO: 6902343 - DNA, 22 bp, Homo sapiens
gggaggcagtgctggaggctgg

SEQ ID NO: 6902344 - DNA, 22 bp, Homo sapiens
gagtgtgggggtgctgaggaca

SEQ ID NO: 6902345 - DNA, 22 bp, Homo sapiens
tagaggtgagccatcaaggggc

SEQ ID NO: 6902346 - DNA, 22 bp, Homo sapiens
aggctggagggcaatggcaaga

SEQ ID NO: 6902347 - DNA, 22 bp, Homo sapiens
gaatgtcttattgctcgttgta

SEQ ID NO: 6902348 - DNA, 22 bp, Homo sapiens
aggactgacttttgccatgaaa

SEQ ID NO: 6902349 - DNA, 22 bp, Homo sapiens
cagctttccccgtgcctcagcc

SEQ ID NO: 6902350 - DNA, 22 bp, Homo sapiens
cctagccccagatatctcacac

SEQ ID NO: 6902351 - DNA, 22 bp, Homo sapiens
aaagggagcatggctgcaggga

SEQ ID NO: 6902352 - DNA, 22 bp, Homo sapiens
agtccagtgtcaaggtgccatt

SEQ ID NO: 6902353 - DNA, 18 bp, Homo sapiens
actgttctctcctgccct

SEQ ID NO: 6902354 - DNA, 22 bp, Homo sapiens
tcataatgacaaacatactcag

SEQ ID NO: 6902355 - DNA, 22 bp, Homo sapiens
taagttcagttggtcgaagtag

SEQ ID NO: 6902356 - DNA, 22 bp, Homo sapiens
tctcagaaatactatgttgtca

SEQ ID NO: 6902357 - DNA, 22 bp, Homo sapiens
ccagctagttgggtattataag

SEQ ID NO: 6902358 - DNA, 22 bp, Homo sapiens
aagggaggggatgtaagcctgg

SEQ ID NO: 6902359 - DNA, 22 bp, Homo sapiens
tgttttctgtgtagagatcaca

SEQ ID NO: 6902360 - DNA, 22 bp, Homo sapiens
gcacatgttgctagttacttgc

SEQ ID NO: 6902361 - DNA, 22 bp, Homo sapiens
gatgcactttcttttcaacagt

SEQ ID NO: 6902362 - DNA, 22 bp, Homo sapiens
tgtctctgctgcaccttctggg

SEQ ID NO: 6902363 - DNA, 22 bp, Homo sapiens
gcatgaggttcttggccagcat

SEQ ID NO: 6902364 - DNA, 22 bp, Homo sapiens
ctcagtttttttaagagccatg

SEQ ID NO: 6902365 - DNA, 22 bp, Homo sapiens
ctgaagcagatgtggctgagat

SEQ ID NO: 6902366 - DNA, 22 bp, Homo sapiens
taacttctttggtttaaagaga

SEQ ID NO: 6902367 - DNA, 22 bp, Homo sapiens
attggatagacataagaaaaat

SEQ ID NO: 6902368 - DNA, 22 bp, Homo sapiens
tggcatggggcagaacattaca

SEQ ID NO: 6902369 - DNA, 22 bp, Homo sapiens
acagctatctgactttgactca

SEQ ID NO: 6902370 - DNA, 22 bp, Homo sapiens
ttggttacttcagtggagaaag

SEQ ID NO: 6902371 - DNA, 22 bp, Homo sapiens
taagaacagtgtttcatctcta

SEQ ID NO: 6902372 - DNA, 22 bp, Homo sapiens
ttctcagctttccttgcagtta

SEQ ID NO: 6902373 - DNA, 22 bp, Homo sapiens
gcaccttagcctgaatttgtgt

SEQ ID NO: 6902374 - DNA, 22 bp, Homo sapiens
tactggaatcccgggtggctgg

SEQ ID NO: 6902375 - DNA, 22 bp, Homo sapiens
gcttgaaaattcataggtattt

SEQ ID NO: 6902376 - DNA, 22 bp, Homo sapiens
cagctgccttctgcgggaagtc

SEQ ID NO: 6902377 - DNA, 22 bp, Homo sapiens
agcaccagctcaaggtgcacct

SEQ ID NO: 6902378 - DNA, 22 bp, Homo sapiens
cagggtttctgttgagaagtcc

SEQ ID NO: 6902379 - DNA, 22 bp, Homo sapiens
tctgtacttttattttggcact

SEQ ID NO: 6902380 - DNA, 22 bp, Homo sapiens
agccatgaccttgcagacctgc

SEQ ID NO: 6902381 - DNA, 22 bp, Homo sapiens
ctcacacacgaagcccttggcc

SEQ ID NO: 6902382 - DNA, 22 bp, Homo sapiens
ttagcaaacaaatgaaatggtt

SEQ ID NO: 6902383 - DNA, 17 bp, Homo sapiens
ccagccctcgcgctttt

SEQ ID NO: 6902384 - DNA, 22 bp, Homo sapiens
tgttctttggcttcctttccgt

SEQ ID NO: 6902385 - DNA, 18 bp, Homo sapiens
tggcgatggtcatttttc

SEQ ID NO: 6902386 - DNA, 22 bp, Homo sapiens
tgagaaaagtacatggagaagc

SEQ ID NO: 6902387 - DNA, 22 bp, Homo sapiens
ctctgcttcatccaccactggc

SEQ ID NO: 6902388 - DNA, 22 bp, Homo sapiens
ggattctaactgaacagaatat

SEQ ID NO: 6902389 - DNA, 19 bp, Homo sapiens
tcctagaatgagggtgttg

SEQ ID NO: 6902390 - DNA, 22 bp, Homo sapiens
cagaatgcaaattttataatat

SEQ ID NO: 6902391 - DNA, 22 bp, Homo sapiens
ctccggagagcagacgagggca

SEQ ID NO: 6902392 - DNA, 22 bp, Homo sapiens
tgacagggcttccctttaatca

SEQ ID NO: 6902393 - DNA, 22 bp, Homo sapiens
gcatgcagtgcaattcaatgta

SEQ ID NO: 6902394 - DNA, 22 bp, Homo sapiens
gggactcctgcatttcaagtcc

SEQ ID NO: 6902395 - DNA, 22 bp, Homo sapiens
actgtcactgtgatgttagaga

SEQ ID NO: 6902396 - DNA, 22 bp, Homo sapiens
tgtctctgaactgggttttctt

SEQ ID NO: 6902397 - DNA, 18 bp, Homo sapiens
aagctcttaaatggttca

SEQ ID NO: 6902398 - DNA, 17 bp, Homo sapiens
gcaattattgggcattt

SEQ ID NO: 6902399 - DNA, 22 bp, Homo sapiens
acagtacaggacgagttttcct

SEQ ID NO: 6902400 - DNA, 22 bp, Homo sapiens
gctgctttgtctgtaaaatgga

SEQ ID NO: 6902401 - DNA, 23 bp, Homo sapiens
acagaggtccaaacagtataagc

SEQ ID NO: 6902402 - DNA, 22 bp, Homo sapiens
atgtgctgaaataaatgtggga

SEQ ID NO: 6902403 - DNA, 22 bp, Homo sapiens
acaggtggaggctttaggaggt

SEQ ID NO: 6902404 - DNA, 22 bp, Homo sapiens
ttctagtttagggctcttcaac

SEQ ID NO: 6902405 - DNA, 22 bp, Homo sapiens
gcacagagtgggtgagatgtgg

SEQ ID NO: 6902406 - DNA, 22 bp, Homo sapiens
tgatacacagatttacatcaat

SEQ ID NO: 6902407 - DNA, 22 bp, Homo sapiens
actgcccattatggtagtcact

SEQ ID NO: 6902408 - DNA, 22 bp, Homo sapiens
acttatactaaagtattatttg

SEQ ID NO: 6902409 - DNA, 22 bp, Homo sapiens
caggaagattgtggaggtggtt

SEQ ID NO: 6902410 - DNA, 22 bp, Homo sapiens
acagtgatgagggaattttgtg

SEQ ID NO: 6902411 - DNA, 22 bp, Homo sapiens
ccagttccagtgctcacatcca

SEQ ID NO: 6902412 - DNA, 22 bp, Homo sapiens
tcttcagtcaatccagatgttt

SEQ ID NO: 6902413 - DNA, 22 bp, Homo sapiens
gccaggaacacaatgccaagct

SEQ ID NO: 6902414 - DNA, 22 bp, Homo sapiens
cgtgtaacccctgaactcgcat

SEQ ID NO: 6902415 - DNA, 22 bp, Homo sapiens
aagacaatctaaggggaatggt

SEQ ID NO: 6902416 - DNA, 22 bp, Homo sapiens
atgtgtctgatggccctgaatt

SEQ ID NO: 6902417 - DNA, 22 bp, Homo sapiens
ctgggcctcaatctcagagttt

SEQ ID NO: 6902418 - DNA, 22 bp, Homo sapiens
ttccacatagatcacaggtgtt

SEQ ID NO: 6902419 - DNA, 22 bp, Homo sapiens
ccctggaggctggaggcagtag

SEQ ID NO: 6902420 - DNA, 22 bp, Homo sapiens
ttggcatttattctaaggtcaa

SEQ ID NO: 6902421 - DNA, 22 bp, Homo sapiens
tgtgtgagacaattggctgtgg

SEQ ID NO: 6902422 - DNA, 22 bp, Homo sapiens
aaatgcaaggattttgttaggc

SEQ ID NO: 6902423 - DNA, 19 bp, Homo sapiens
gctgtgtcatttcttagga

SEQ ID NO: 6902424 - DNA, 22 bp, Homo sapiens
gttcttcaggctgtgctctaga

SEQ ID NO: 6902425 - DNA, 22 bp, Homo sapiens
agcttagaatgtgttaggaaag

SEQ ID NO: 6902426 - DNA, 18 bp, Homo sapiens
tttccttgtatgaacata

SEQ ID NO: 6902427 - DNA, 22 bp, Homo sapiens
ccagtctcgttgaggcgcttgt

SEQ ID NO: 6902428 - DNA, 22 bp, Homo sapiens
ttagtgtccttatgtcacaagc

SEQ ID NO: 6902429 - DNA, 22 bp, Homo sapiens
tgcagcagtgttccttggcttg

SEQ ID NO: 6902430 - DNA, 22 bp, Homo sapiens
gaatcttaaatcggaatcttaa

SEQ ID NO: 6902431 - DNA, 22 bp, Homo sapiens
tggcagcctcagacaaggacct

SEQ ID NO: 6902432 - DNA, 20 bp, Homo sapiens
cagtagcaataattagaagc

SEQ ID NO: 6902433 - DNA, 22 bp, Homo sapiens
gaaaatgtgtcatccctactgt

SEQ ID NO: 6902434 - DNA, 22 bp, Homo sapiens
agcattagaagaaatgattata

SEQ ID NO: 6902435 - DNA, 22 bp, Homo sapiens
aaactgagtacctctgcattca

SEQ ID NO: 6902436 - DNA, 22 bp, Homo sapiens
cttatcttacttccccttcatg

SEQ ID NO: 6902437 - DNA, 22 bp, Homo sapiens
gaacatacaagaattaagtaca

SEQ ID NO: 6902438 - DNA, 21 bp, Homo sapiens
tgtcagcacgcatgaggccag

SEQ ID NO: 6902439 - DNA, 22 bp, Homo sapiens
gtgcagaggacgtggcggcctc

SEQ ID NO: 6902440 - DNA, 20 bp, Homo sapiens
tttgtctgttaagtgtttct

SEQ ID NO: 6902441 - DNA, 22 bp, Homo sapiens
aggaacaactgattcagtcaac

SEQ ID NO: 6902442 - DNA, 23 bp, Homo sapiens
gcccagggactgggaatcagtgg

SEQ ID NO: 6902443 - DNA, 22 bp, Homo sapiens
tagatgaagcaacatgtgtaat

SEQ ID NO: 6902444 - DNA, 17 bp, Homo sapiens
cagctctgcagacttcc

SEQ ID NO: 6902445 - DNA, 22 bp, Homo sapiens
tccaagctttccatgccctcac

SEQ ID NO: 6902446 - DNA, 22 bp, Homo sapiens
aacatacttatactaaataatg

SEQ ID NO: 6902447 - DNA, 22 bp, Homo sapiens
aggcaggtgttacctctggttt

SEQ ID NO: 6902448 - DNA, 22 bp, Homo sapiens
ccttcacaccatctttaccagg

SEQ ID NO: 6902449 - DNA, 22 bp, Homo sapiens
cctaagtattttcagtgttaac

SEQ ID NO: 6902450 - DNA, 22 bp, Homo sapiens
ttccttgaaagtttgaactgac

SEQ ID NO: 6902451 - DNA, 22 bp, Homo sapiens
tagatgcttgctatgtatagag

SEQ ID NO: 6902452 - DNA, 22 bp, Homo sapiens
gtatacatgtggtaaaatgcac

SEQ ID NO: 6902453 - DNA, 22 bp, Homo sapiens
ctcagataatctttgagtcttc

SEQ ID NO: 6902454 - DNA, 22 bp, Homo sapiens
aattgtcaaaaattgcaattgt

SEQ ID NO: 6902455 - DNA, 21 bp, Homo sapiens
atctagaatctctctccccac

SEQ ID NO: 6902456 - DNA, 22 bp, Homo sapiens
gaggctgcactggctaaaggct

SEQ ID NO: 6902457 - DNA, 22 bp, Homo sapiens
aacagtatgtgagatttacaca

SEQ ID NO: 6902458 - DNA, 22 bp, Homo sapiens
gctgcctggatttgcaatcctc

SEQ ID NO: 6902459 - DNA, 22 bp, Homo sapiens
ccagcagcagcgtccaaggaga

SEQ ID NO: 6902460 - DNA, 21 bp, Homo sapiens
ggcatcccaggccagtgactg

SEQ ID NO: 6902461 - DNA, 22 bp, Homo sapiens
gtcttggccgtgcagatgaaga

SEQ ID NO: 6902462 - DNA, 22 bp, Homo sapiens
aagttgaagcatgaaccaaggt

SEQ ID NO: 6902463 - DNA, 22 bp, Homo sapiens
agtccgcgctccatgggagtcc

SEQ ID NO: 6902464 - DNA, 22 bp, Homo sapiens
aggccacaagaactaccccatc

SEQ ID NO: 6902465 - DNA, 17 bp, Homo sapiens
ttattgtcaaggttcca

SEQ ID NO: 6902466 - DNA, 22 bp, Homo sapiens
cagagcctaaaacgactccact

SEQ ID NO: 6902467 - DNA, 22 bp, Homo sapiens
agataatgaatttattgaatgt

SEQ ID NO: 6902468 - DNA, 22 bp, Homo sapiens
tacggataatgctcttagcacg

SEQ ID NO: 6902469 - DNA, 22 bp, Homo sapiens
tctgtattgattctgttaggca

SEQ ID NO: 6902470 - DNA, 22 bp, Homo sapiens
acaggtggggaggctgaggttc

SEQ ID NO: 6902471 - DNA, 22 bp, Homo sapiens
acttttaaatgagtttcagttg

SEQ ID NO: 6902472 - DNA, 22 bp, Homo sapiens
gctctgtacgcaggatgagggg

SEQ ID NO: 6902473 - DNA, 22 bp, Homo sapiens
agttctctggctcctttccaga

SEQ ID NO: 6902474 - DNA, 22 bp, Homo sapiens
agggccagtaccaggtgggtgg

SEQ ID NO: 6902475 - DNA, 22 bp, Homo sapiens
cccaggggttctagaccagctt

SEQ ID NO: 6902476 - DNA, 22 bp, Homo sapiens
tccaaatagctggatgatggtg

SEQ ID NO: 6902477 - DNA, 22 bp, Homo sapiens
cttgccttctgttcctatagaa

SEQ ID NO: 6902478 - DNA, 22 bp, Homo sapiens
tggcagaggaaaaagtcactgg

SEQ ID NO: 6902479 - DNA, 22 bp, Homo sapiens
tacctgttttaaagctaaaagg

SEQ ID NO: 6902480 - DNA, 22 bp, Homo sapiens
ggcccagtctggggccctgtga

SEQ ID NO: 6902481 - DNA, 22 bp, Homo sapiens
tggccacccaccctaatctttc

SEQ ID NO: 6902482 - DNA, 19 bp, Homo sapiens
gaaatctctttcttgtctt

SEQ ID NO: 6902483 - DNA, 22 bp, Homo sapiens
cctcagagccatgcctgagttc

SEQ ID NO: 6902484 - DNA, 22 bp, Homo sapiens
aacaggtacagtttccctctgg

SEQ ID NO: 6902485 - DNA, 22 bp, Homo sapiens
ttacagtggtcatttgggaaaa

SEQ ID NO: 6902486 - DNA, 22 bp, Homo sapiens
tcagccagttaagtcaagaaat

SEQ ID NO: 6902487 - DNA, 21 bp, Homo sapiens
tctctcctcaagctcgacccc

SEQ ID NO: 6902488 - DNA, 23 bp, Homo sapiens
gcgtgtgggatgaggggagatta

SEQ ID NO: 6902489 - DNA, 22 bp, Homo sapiens
tctggtcagtaataagaagtgg

SEQ ID NO: 6902490 - DNA, 22 bp, Homo sapiens
tcagaatctgaaaagcgcttgg

SEQ ID NO: 6902491 - DNA, 22 bp, Homo sapiens
aataatgtctatggttccaaaa

SEQ ID NO: 6902492 - DNA, 22 bp, Homo sapiens
atccccagactttagatttctc

SEQ ID NO: 6902493 - DNA, 22 bp, Homo sapiens
ttgcaattaacatatgtcaact

SEQ ID NO: 6902494 - DNA, 22 bp, Homo sapiens
caaattaatgtgtctcaaaata

SEQ ID NO: 6902495 - DNA, 22 bp, Homo sapiens
ctggcacacaagtatttccttt

SEQ ID NO: 6902496 - DNA, 22 bp, Homo sapiens
tcaccagacgcgtgggtctgag

SEQ ID NO: 6902497 - DNA, 22 bp, Homo sapiens
gcctgtggtttgattaagcatt

SEQ ID NO: 6902498 - DNA, 22 bp, Homo sapiens
ctgagaaggtgtggagatgggc

SEQ ID NO: 6902499 - DNA, 22 bp, Homo sapiens
tctctcactggtgcctctgttg

SEQ ID NO: 6902500 - DNA, 22 bp, Homo sapiens
tttcaatgtatgtctttctgag

SEQ ID NO: 6902501 - DNA, 22 bp, Homo sapiens
tagtcacttttttaccatgtgc

SEQ ID NO: 6902502 - DNA, 22 bp, Homo sapiens
tgctacaattcacatctggata

SEQ ID NO: 6902503 - DNA, 22 bp, Homo sapiens
ccatttggttatgtatcgaaac

SEQ ID NO: 6902504 - DNA, 22 bp, Homo sapiens
ttgaggactgtggtccccaaag

SEQ ID NO: 6902505 - DNA, 22 bp, Homo sapiens
ttatgcttgcagatttaagggt

SEQ ID NO: 6902506 - DNA, 22 bp, Homo sapiens
atgcccgatacctagttaactc

SEQ ID NO: 6902507 - DNA, 22 bp, Homo sapiens
tgggcagcagcaaagccagact

SEQ ID NO: 6902508 - DNA, 22 bp, Homo sapiens
tagctttggattctttggggaa

SEQ ID NO: 6902509 - DNA, 22 bp, Homo sapiens
gcacctggggtacacagctaca

SEQ ID NO: 6902510 - DNA, 22 bp, Homo sapiens
ggctgagaggacgtcgggctca

SEQ ID NO: 6902511 - DNA, 22 bp, Homo sapiens
tgagaacattgggaaagctatg

SEQ ID NO: 6902512 - DNA, 22 bp, Homo sapiens
caggctgggaacgccacccgct

SEQ ID NO: 6902513 - DNA, 22 bp, Homo sapiens
ttgctttacggcaaggccccag

SEQ ID NO: 6902514 - DNA, 22 bp, Homo sapiens
tcagaagtccccagtcaaggag

SEQ ID NO: 6902515 - DNA, 22 bp, Homo sapiens
ttggtgtacatctccccttcat

SEQ ID NO: 6902516 - DNA, 22 bp, Homo sapiens
gtcctgctaccatgctgtgtga

SEQ ID NO: 6902517 - DNA, 22 bp, Homo sapiens
tctgacttatttgtccttggtg

SEQ ID NO: 6902518 - DNA, 22 bp, Homo sapiens
aaggagggaaagcagtgcttct

SEQ ID NO: 6902519 - DNA, 15 bp, Homo sapiens
cccaggagttcgaga

SEQ ID NO: 6902520 - DNA, 19 bp, Homo sapiens
ttctggtctggaatcaagg

SEQ ID NO: 6902521 - DNA, 20 bp, Homo sapiens
gcttccagaggaggccccgt

SEQ ID NO: 6902522 - DNA, 22 bp, Homo sapiens
tctaaaaaagtctgttcacttg

SEQ ID NO: 6902523 - DNA, 22 bp, Homo sapiens
tttggggactgttagagaaaat

SEQ ID NO: 6902524 - DNA, 22 bp, Homo sapiens
ggtacagaaggccaccgagtgc

SEQ ID NO: 6902525 - DNA, 22 bp, Homo sapiens
cttctttgtgcctattggtgac

SEQ ID NO: 6902526 - DNA, 22 bp, Homo sapiens
tgggcgaggagaatgctgtgaa

SEQ ID NO: 6902527 - DNA, 22 bp, Homo sapiens
gctgagtgaaagtttgctgtgt

SEQ ID NO: 6902528 - DNA, 22 bp, Homo sapiens
ggcagtgggttccccaaggcac

SEQ ID NO: 6902529 - DNA, 22 bp, Homo sapiens
gagtctggaatgatgaagacct

SEQ ID NO: 6902530 - DNA, 22 bp, Homo sapiens
ctggctgtggtcacaggtaact

SEQ ID NO: 6902531 - DNA, 22 bp, Homo sapiens
ctgaggagtgggtgggcagtga

SEQ ID NO: 6902532 - DNA, 22 bp, Homo sapiens
gtttggcacatgaacctatttt

SEQ ID NO: 6902533 - DNA, 22 bp, Homo sapiens
tgaagcatctggtctgagaatt

SEQ ID NO: 6902534 - DNA, 19 bp, Homo sapiens
cctgtgcacatgtgtcctt

SEQ ID NO: 6902535 - DNA, 22 bp, Homo sapiens
tttatctgtcatttcccatatc

SEQ ID NO: 6902536 - DNA, 18 bp, Homo sapiens
ggagcccacggcgtccca

SEQ ID NO: 6902537 - DNA, 22 bp, Homo sapiens
aacagatttgtgaagctactca

SEQ ID NO: 6902538 - DNA, 22 bp, Homo sapiens
tgggctagatatttttgggctg

SEQ ID NO: 6902539 - DNA, 22 bp, Homo sapiens
caggtgaagaggataaaaagtt

SEQ ID NO: 6902540 - DNA, 18 bp, Homo sapiens
tgattcaagttgccctcc

SEQ ID NO: 6902541 - DNA, 22 bp, Homo sapiens
ggggccttggatctgtgccccg

SEQ ID NO: 6902542 - DNA, 22 bp, Homo sapiens
ttaatgtggaaagctcttgagt

SEQ ID NO: 6902543 - DNA, 22 bp, Homo sapiens
tctgaggttaatcctgctgcat

SEQ ID NO: 6902544 - DNA, 22 bp, Homo sapiens
gacagggcatggtgcagagttc

SEQ ID NO: 6902545 - DNA, 22 bp, Homo sapiens
acactgtgagctgaagggctgc

SEQ ID NO: 6902546 - DNA, 21 bp, Homo sapiens
tacaagttcatgttgaaggaa

SEQ ID NO: 6902547 - DNA, 22 bp, Homo sapiens
tatgtttcttccttttcataca

SEQ ID NO: 6902548 - DNA, 22 bp, Homo sapiens
agggccagcccataatgccaaa

SEQ ID NO: 6902549 - DNA, 22 bp, Homo sapiens
cactaggaagggatcagcctca

SEQ ID NO: 6902550 - DNA, 22 bp, Homo sapiens
tgatccctcacttctctttggg

SEQ ID NO: 6902551 - DNA, 22 bp, Homo sapiens
ctggcttttgcctgtaattcta

SEQ ID NO: 6902552 - DNA, 22 bp, Homo sapiens
caaatactttatatacttcaaa

SEQ ID NO: 6902553 - DNA, 22 bp, Homo sapiens
cagatctagagcttttccatct

SEQ ID NO: 6902554 - DNA, 21 bp, Homo sapiens
cggcttcattttcttctggtt

SEQ ID NO: 6902555 - DNA, 22 bp, Homo sapiens
caagttaatatatagaattttg

SEQ ID NO: 6902556 - DNA, 22 bp, Homo sapiens
tgaaatactttttgtacctgtc

SEQ ID NO: 6902557 - DNA, 22 bp, Homo sapiens
agaggcagaagtgttcaaaccc

SEQ ID NO: 6902558 - DNA, 22 bp, Homo sapiens
cctccaggaggaaatggaacac

SEQ ID NO: 6902559 - DNA, 22 bp, Homo sapiens
ccaggagcattaagagaacata

SEQ ID NO: 6902560 - DNA, 22 bp, Homo sapiens
ttggaaagtctcacccagttga

SEQ ID NO: 6902561 - DNA, 22 bp, Homo sapiens
aagcggagcatttgaacttgaa

SEQ ID NO: 6902562 - DNA, 22 bp, Homo sapiens
tggccctcgtccgacaggtggg

SEQ ID NO: 6902563 - DNA, 22 bp, Homo sapiens
gatgaacatattcctctccaga

SEQ ID NO: 6902564 - DNA, 22 bp, Homo sapiens
ttgtatgaatgtatcctaattt

SEQ ID NO: 6902565 - DNA, 22 bp, Homo sapiens
tagattctggagagacagcagt

SEQ ID NO: 6902566 - DNA, 22 bp, Homo sapiens
gcccaagcaaaatggttcctgt

SEQ ID NO: 6902567 - DNA, 22 bp, Homo sapiens
atcaggatcatgctgggtggga

SEQ ID NO: 6902568 - DNA, 22 bp, Homo sapiens
ttcctggagagttttcccaaag

SEQ ID NO: 6902569 - DNA, 22 bp, Homo sapiens
tccatgttaggtaaaggcactg

SEQ ID NO: 6902570 - DNA, 22 bp, Homo sapiens
cattatgaagcatcatcttatt

SEQ ID NO: 6902571 - DNA, 22 bp, Homo sapiens
gtgtgccaacaaaagacagtgc

SEQ ID NO: 6902572 - DNA, 22 bp, Homo sapiens
ggggcgtcaccggggcacctgg

SEQ ID NO: 6902573 - DNA, 22 bp, Homo sapiens
catttacagtgagagtttttac

SEQ ID NO: 6902574 - DNA, 22 bp, Homo sapiens
tagttctagaccagttaatagt

SEQ ID NO: 6902575 - DNA, 22 bp, Homo sapiens
agtataatgaaatgtgtcagta

SEQ ID NO: 6902576 - DNA, 22 bp, Homo sapiens
tatttctaagagatatctgtac

SEQ ID NO: 6902577 - DNA, 22 bp, Homo sapiens
actgggccgaaatggacagaat

SEQ ID NO: 6902578 - DNA, 22 bp, Homo sapiens
catgaatgagtaatttacaaag

SEQ ID NO: 6902579 - DNA, 22 bp, Homo sapiens
ggggatggtggcatttgtaaaa

SEQ ID NO: 6902580 - DNA, 22 bp, Homo sapiens
ccagggcagccaacccagatgc

SEQ ID NO: 6902581 - DNA, 22 bp, Homo sapiens
aaatttcttgaggctctctagc

SEQ ID NO: 6902582 - DNA, 22 bp, Homo sapiens
agttaaatgtgttagccagggt

SEQ ID NO: 6902583 - DNA, 22 bp, Homo sapiens
tggctctgttcgccatcaggag

SEQ ID NO: 6902584 - DNA, 22 bp, Homo sapiens
ataatgcgcctcagaaaacaga

SEQ ID NO: 6902585 - DNA, 22 bp, Homo sapiens
gcattggcagggatgcattacg

SEQ ID NO: 6902586 - DNA, 22 bp, Homo sapiens
cagtgccacaggaatggccaat

SEQ ID NO: 6902587 - DNA, 22 bp, Homo sapiens
gcctaggattgtaaaagagctt

SEQ ID NO: 6902588 - DNA, 22 bp, Homo sapiens
ctgtccttgctggccaggtatg

SEQ ID NO: 6902589 - DNA, 22 bp, Homo sapiens
cagaggcagccgggggagaacg

SEQ ID NO: 6902590 - DNA, 22 bp, Homo sapiens
gaaataagagtccatgccaggt

SEQ ID NO: 6902591 - DNA, 22 bp, Homo sapiens
ttcctgcaggccccagttcaca

SEQ ID NO: 6902592 - DNA, 22 bp, Homo sapiens
gaccagagaaaggcactggaag

SEQ ID NO: 6902593 - DNA, 21 bp, Homo sapiens
atgttattctgttcctccagc

SEQ ID NO: 6902594 - DNA, 22 bp, Homo sapiens
ccagtgtcttcagagtaaatct

SEQ ID NO: 6902595 - DNA, 22 bp, Homo sapiens
ctgcattgatcaggcagaatct

SEQ ID NO: 6902596 - DNA, 22 bp, Homo sapiens
aactggattttgatgagcagtt

SEQ ID NO: 6902597 - DNA, 22 bp, Homo sapiens
caaattctcaccctgtttgatt

SEQ ID NO: 6902598 - DNA, 22 bp, Homo sapiens
tctctagtataatatagcaaaa

SEQ ID NO: 6902599 - DNA, 22 bp, Homo sapiens
gtggtccagaagagcgcatatg

SEQ ID NO: 6902600 - DNA, 22 bp, Homo sapiens
tgtgatttattgaaaagagctt

SEQ ID NO: 6902601 - DNA, 22 bp, Homo sapiens
gtgcaggctagatccttcctac

SEQ ID NO: 6902602 - DNA, 22 bp, Homo sapiens
aggctccatgcaaaggctgttt

SEQ ID NO: 6902603 - DNA, 22 bp, Homo sapiens
cagaggtccctgttcttaagga

SEQ ID NO: 6902604 - DNA, 22 bp, Homo sapiens
tcttcaatgcattctcttgttt

SEQ ID NO: 6902605 - DNA, 22 bp, Homo sapiens
ttgtacctcttacctctatagc

SEQ ID NO: 6902606 - DNA, 21 bp, Homo sapiens
acacactgagttttccactgt

SEQ ID NO: 6902607 - DNA, 22 bp, Homo sapiens
gagaggccatggctgtgcagtg

SEQ ID NO: 6902608 - DNA, 22 bp, Homo sapiens
aaggcaaatgtgttcttttagt

SEQ ID NO: 6902609 - DNA, 22 bp, Homo sapiens
tgggtcagaatcagagagttgc

SEQ ID NO: 6902610 - DNA, 22 bp, Homo sapiens
tcttaacaagctcctcagtgct

SEQ ID NO: 6902611 - DNA, 22 bp, Homo sapiens
tagcaatgtgttgacttggtca

SEQ ID NO: 6902612 - DNA, 22 bp, Homo sapiens
tggaaatgtcaaaacctctgat

SEQ ID NO: 6902613 - DNA, 22 bp, Homo sapiens
tccctggagataacttctggga

SEQ ID NO: 6902614 - DNA, 22 bp, Homo sapiens
aaagctcttaatgagattatcc

SEQ ID NO: 6902615 - DNA, 22 bp, Homo sapiens
gggagtcagagaggtaatggga

SEQ ID NO: 6902616 - DNA, 19 bp, Homo sapiens
atctttagggatgtggctt

SEQ ID NO: 6902617 - DNA, 22 bp, Homo sapiens
tgttatgaactgcctatggact

SEQ ID NO: 6902618 - DNA, 22 bp, Homo sapiens
gccttgctgattaccttccttt

SEQ ID NO: 6902619 - DNA, 22 bp, Homo sapiens
gcaggctgccaccttctgagtt

SEQ ID NO: 6902620 - DNA, 22 bp, Homo sapiens
tctggagttgaagttcttcccc

SEQ ID NO: 6902621 - DNA, 22 bp, Homo sapiens
tttggcagaggaagaaggcaca

SEQ ID NO: 6902622 - DNA, 22 bp, Homo sapiens
tttctgcatcttgaaacagagc

SEQ ID NO: 6902623 - DNA, 22 bp, Homo sapiens
aatgtcatttaaaataattctg

SEQ ID NO: 6902624 - DNA, 22 bp, Homo sapiens
aaagttccttttatagacatga

SEQ ID NO: 6902625 - DNA, 22 bp, Homo sapiens
gacttttccatcatccccctta

SEQ ID NO: 6902626 - DNA, 22 bp, Homo sapiens
tcagaaggtacagaagggaggt

SEQ ID NO: 6902627 - DNA, 17 bp, Homo sapiens
ccatactgacatattga

SEQ ID NO: 6902628 - DNA, 22 bp, Homo sapiens
taagggcaggttccaaaagggt

SEQ ID NO: 6902629 - DNA, 22 bp, Homo sapiens
gcgttaataacattaataatgc

SEQ ID NO: 6902630 - DNA, 22 bp, Homo sapiens
gtctcctgccacactcagtccc

SEQ ID NO: 6902631 - DNA, 22 bp, Homo sapiens
agggctaggaatggaactggag

SEQ ID NO: 6902632 - DNA, 22 bp, Homo sapiens
gatggctaggggactggagtta

SEQ ID NO: 6902633 - DNA, 22 bp, Homo sapiens
ctcagaagaatcagcagctatt

SEQ ID NO: 6902634 - DNA, 22 bp, Homo sapiens
gtgcctggtttggggagtgttc

SEQ ID NO: 6902635 - DNA, 22 bp, Homo sapiens
gagaacagagataattttactt

SEQ ID NO: 6902636 - DNA, 22 bp, Homo sapiens
agaagccaatccttgtctctct

SEQ ID NO: 6902637 - DNA, 22 bp, Homo sapiens
gagcataggacacagaggtgtg

SEQ ID NO: 6902638 - DNA, 22 bp, Homo sapiens
gacttctcatgaggggaggtca

SEQ ID NO: 6902639 - DNA, 22 bp, Homo sapiens
acagccttctctattggcctca

SEQ ID NO: 6902640 - DNA, 22 bp, Homo sapiens
tcagccaggcagccccctggtc

SEQ ID NO: 6902641 - DNA, 22 bp, Homo sapiens
tgtctcttctgcctccagctgt

SEQ ID NO: 6902642 - DNA, 22 bp, Homo sapiens
agtgtgagctaatagcagagcc

SEQ ID NO: 6902643 - DNA, 22 bp, Homo sapiens
tctttgtatgtatgtttcaaag

SEQ ID NO: 6902644 - DNA, 22 bp, Homo sapiens
gctgggctgtagtttgctgacc

SEQ ID NO: 6902645 - DNA, 22 bp, Homo sapiens
gatgtccagcgtctggctgcct

SEQ ID NO: 6902646 - DNA, 22 bp, Homo sapiens
ttctggagtttgaagatcaggt

SEQ ID NO: 6902647 - DNA, 22 bp, Homo sapiens
ctcctaggtgctcactggggtc

SEQ ID NO: 6902648 - DNA, 22 bp, Homo sapiens
gttctaggttagaaggacagat

SEQ ID NO: 6902649 - DNA, 22 bp, Homo sapiens
aagcaatgttagaggccttagg

SEQ ID NO: 6902650 - DNA, 22 bp, Homo sapiens
ttagaacttaaacttcagaaag

SEQ ID NO: 6902651 - DNA, 22 bp, Homo sapiens
aggtaaggaaattgaggcaatt

SEQ ID NO: 6902652 - DNA, 22 bp, Homo sapiens
ctatctcttgttttcctgaagc

SEQ ID NO: 6902653 - DNA, 22 bp, Homo sapiens
agaggtatatattctccatatt

SEQ ID NO: 6902654 - DNA, 22 bp, Homo sapiens
attgtttctgctttatttaggg

SEQ ID NO: 6902655 - DNA, 22 bp, Homo sapiens
taaggcatgctagcagtatgaa

SEQ ID NO: 6902656 - DNA, 22 bp, Homo sapiens
gaggaacatgaggtgacctggg

SEQ ID NO: 6902657 - DNA, 22 bp, Homo sapiens
caaaagcaaagtccctgaatgt

SEQ ID NO: 6902658 - DNA, 22 bp, Homo sapiens
gtggcttctgcggtgtgcgcag

SEQ ID NO: 6902659 - DNA, 22 bp, Homo sapiens
ctcactgcaacctctgccccca

SEQ ID NO: 6902660 - DNA, 22 bp, Homo sapiens
agatgtaagttgtttaaaagga

SEQ ID NO: 6902661 - DNA, 22 bp, Homo sapiens
ttattttaccttcctctgagct

SEQ ID NO: 6902662 - DNA, 22 bp, Homo sapiens
gctgagcacagcctgtgtcctc

SEQ ID NO: 6902663 - DNA, 22 bp, Homo sapiens
acagctttttactaatagattg

SEQ ID NO: 6902664 - DNA, 22 bp, Homo sapiens
aaaccggggcctttccacaatg

SEQ ID NO: 6902665 - DNA, 20 bp, Homo sapiens
cagcccttgatttacaatcc

SEQ ID NO: 6902666 - DNA, 22 bp, Homo sapiens
atttcctgcaggggctggtggg

SEQ ID NO: 6902667 - DNA, 21 bp, Homo sapiens
ggcctgagtataggacaggcc

SEQ ID NO: 6902668 - DNA, 22 bp, Homo sapiens
tttaagtaataaagtagcagct

SEQ ID NO: 6902669 - DNA, 21 bp, Homo sapiens
cagagcagcgttctgctgtgg

SEQ ID NO: 6902670 - DNA, 22 bp, Homo sapiens
ttattaggttattctctgtact

SEQ ID NO: 6902671 - DNA, 22 bp, Homo sapiens
attctgtgatagttgatcctta

SEQ ID NO: 6902672 - DNA, 22 bp, Homo sapiens
aaccaacaggagtggggattgg

SEQ ID NO: 6902673 - DNA, 22 bp, Homo sapiens
aactctggattttagatcaggg

SEQ ID NO: 6902674 - DNA, 22 bp, Homo sapiens
aaggcactgactgtgcagggga

SEQ ID NO: 6902675 - DNA, 22 bp, Homo sapiens
ctagaagcaactagatctgttt

SEQ ID NO: 6902676 - DNA, 22 bp, Homo sapiens
atgcacgccccacactggtgtg

SEQ ID NO: 6902677 - DNA, 22 bp, Homo sapiens
cctcagagaaaggtatggctga

SEQ ID NO: 6902678 - DNA, 19 bp, Homo sapiens
ccgtcatggagagtggggt

SEQ ID NO: 6902679 - DNA, 22 bp, Homo sapiens
aactagctttagttttggaagg

SEQ ID NO: 6902680 - DNA, 22 bp, Homo sapiens
ctgtgccactgccctgccacgc

SEQ ID NO: 6902681 - DNA, 22 bp, Homo sapiens
tttgatttactggatattctca

SEQ ID NO: 6902682 - DNA, 23 bp, Homo sapiens
ggtccctgacagcgggcaagttg

SEQ ID NO: 6902683 - DNA, 22 bp, Homo sapiens
cctgagggctcagcccccagcc

SEQ ID NO: 6902684 - DNA, 22 bp, Homo sapiens
atctttgatgactaatgctttg

SEQ ID NO: 6902685 - DNA, 22 bp, Homo sapiens
aataatcttgactactgaatca

SEQ ID NO: 6902686 - DNA, 22 bp, Homo sapiens
gtgacaaatgcaaattgggctg

SEQ ID NO: 6902687 - DNA, 22 bp, Homo sapiens
gaattgctgaatcatatgttta

SEQ ID NO: 6902688 - DNA, 22 bp, Homo sapiens
ggagctcaccttggagtctctg

SEQ ID NO: 6902689 - DNA, 22 bp, Homo sapiens
catgataggtatttaattaaat

SEQ ID NO: 6902690 - DNA, 22 bp, Homo sapiens
caggaaatgctatcatagctga

SEQ ID NO: 6902691 - DNA, 22 bp, Homo sapiens
tgtgattctcagaagagggaag

SEQ ID NO: 6902692 - DNA, 21 bp, Homo sapiens
acagacagtccagagaaaaga

SEQ ID NO: 6902693 - DNA, 22 bp, Homo sapiens
tcatggcttgcagatggccacc

SEQ ID NO: 6902694 - DNA, 22 bp, Homo sapiens
tcttcccccgtgctccagtgca

SEQ ID NO: 6902695 - DNA, 22 bp, Homo sapiens
caagctttccattacacacatt

SEQ ID NO: 6902696 - DNA, 22 bp, Homo sapiens
ctagcagctctgatatttacaa

SEQ ID NO: 6902697 - DNA, 22 bp, Homo sapiens
ccaggtgggcgtgtcttcacct

SEQ ID NO: 6902698 - DNA, 22 bp, Homo sapiens
tagagtaaatagtatgagaaag

SEQ ID NO: 6902699 - DNA, 22 bp, Homo sapiens
ttatagtgggcccaacatggcg

SEQ ID NO: 6902700 - DNA, 22 bp, Homo sapiens
tatggcaattgtctaagtttta

SEQ ID NO: 6902701 - DNA, 22 bp, Homo sapiens
acaatagatactgggcacatat

SEQ ID NO: 6902702 - DNA, 22 bp, Homo sapiens
tatcaagtgactatcacagaac

SEQ ID NO: 6902703 - DNA, 22 bp, Homo sapiens
aacagcataagtatttatttca

SEQ ID NO: 6902704 - DNA, 22 bp, Homo sapiens
gccttttgaaatagaaatctga

SEQ ID NO: 6902705 - DNA, 22 bp, Homo sapiens
tttatctgtcctttgccagtga

SEQ ID NO: 6902706 - DNA, 23 bp, Homo sapiens
caccactttctccttctccttgg

SEQ ID NO: 6902707 - DNA, 22 bp, Homo sapiens
attcaaagtactagctattttt

SEQ ID NO: 6902708 - DNA, 22 bp, Homo sapiens
gttattctaccactatgtacag

SEQ ID NO: 6902709 - DNA, 22 bp, Homo sapiens
gggcctcagctggagtctgcct

SEQ ID NO: 6902710 - DNA, 22 bp, Homo sapiens
tggtgctgataatggcaggatt

SEQ ID NO: 6902711 - DNA, 19 bp, Homo sapiens
gcagagatgtggtagcttg

SEQ ID NO: 6902712 - DNA, 22 bp, Homo sapiens
ccaggagagcgccctcccggcc

SEQ ID NO: 6902713 - DNA, 22 bp, Homo sapiens
gaaggctctggggattgagata

SEQ ID NO: 6902714 - DNA, 22 bp, Homo sapiens
gcagccctggcctggcctactt

SEQ ID NO: 6902715 - DNA, 22 bp, Homo sapiens
gtaagcatctgtctcttctgca

SEQ ID NO: 6902716 - DNA, 22 bp, Homo sapiens
gatcccttgggccaaggagttg

SEQ ID NO: 6902717 - DNA, 22 bp, Homo sapiens
tcacatctgcctccatagcacc

SEQ ID NO: 6902718 - DNA, 22 bp, Homo sapiens
aagaacataacagaagctgtgt

SEQ ID NO: 6902719 - DNA, 22 bp, Homo sapiens
gggaacttcagaaagtcgctgc

SEQ ID NO: 6902720 - DNA, 22 bp, Homo sapiens
caggtgttgggagaagagataa

SEQ ID NO: 6902721 - DNA, 22 bp, Homo sapiens
acaggcagccctctccctggtt

SEQ ID NO: 6902722 - DNA, 19 bp, Homo sapiens
ttaggggtatgaagtggta

SEQ ID NO: 6902723 - DNA, 23 bp, Homo sapiens
tgacagagcaagacttggtctca

SEQ ID NO: 6902724 - DNA, 22 bp, Homo sapiens
aggtatttacccacttttgttt

SEQ ID NO: 6902725 - DNA, 20 bp, Homo sapiens
aattccagcatgatatttat

SEQ ID NO: 6902726 - DNA, 22 bp, Homo sapiens
ttacttgagctgctttttgtat

SEQ ID NO: 6902727 - DNA, 22 bp, Homo sapiens
acaagagagacactaggaatgt

SEQ ID NO: 6902728 - DNA, 22 bp, Homo sapiens
gcctggatcccagggagtcagg

SEQ ID NO: 6902729 - DNA, 22 bp, Homo sapiens
tccacaggctgaggcccttctg

SEQ ID NO: 6902730 - DNA, 22 bp, Homo sapiens
acacactggcaggagctataaa

SEQ ID NO: 6902731 - DNA, 22 bp, Homo sapiens
agcacagtttcttttccttgtc

SEQ ID NO: 6902732 - DNA, 22 bp, Homo sapiens
aagcaaggcaacctatgtccag

SEQ ID NO: 6902733 - DNA, 22 bp, Homo sapiens
ttttcagctaagtcacacgctg

SEQ ID NO: 6902734 - DNA, 22 bp, Homo sapiens
gttcacaaagtactgtatgcat

SEQ ID NO: 6902735 - DNA, 22 bp, Homo sapiens
gacatagtctctgtcttcatgg

SEQ ID NO: 6902736 - DNA, 22 bp, Homo sapiens
tctgggccctaaaccagctcta

SEQ ID NO: 6902737 - DNA, 22 bp, Homo sapiens
ccacaagtttcagcacccagag

SEQ ID NO: 6902738 - DNA, 22 bp, Homo sapiens
gctgcctctgtagctttggacc

SEQ ID NO: 6902739 - DNA, 22 bp, Homo sapiens
gccctggttttagaggagcagg

SEQ ID NO: 6902740 - DNA, 20 bp, Homo sapiens
cctctgcctttctagtctga

SEQ ID NO: 6902741 - DNA, 21 bp, Homo sapiens
aaagatgagaactggatggct

SEQ ID NO: 6902742 - DNA, 22 bp, Homo sapiens
tcctggtttacagagtaaacca

SEQ ID NO: 6902743 - DNA, 22 bp, Homo sapiens
tccaaataccagatgggctaat

SEQ ID NO: 6902744 - DNA, 22 bp, Homo sapiens
acaaagtgctgacattacaggc

SEQ ID NO: 6902745 - DNA, 22 bp, Homo sapiens
ttagacattaaatgccatttaa

SEQ ID NO: 6902746 - DNA, 22 bp, Homo sapiens
ttacacatgaaggtccaatgtt

SEQ ID NO: 6902747 - DNA, 22 bp, Homo sapiens
tccattcattcattgatgaaca

SEQ ID NO: 6902748 - DNA, 22 bp, Homo sapiens
cataacacattcatcagcagag

SEQ ID NO: 6902749 - DNA, 22 bp, Homo sapiens
atctgttgttttctcatatgtt

SEQ ID NO: 6902750 - DNA, 15 bp, Homo sapiens
tgcagaggtacctgg

SEQ ID NO: 6902751 - DNA, 20 bp, Homo sapiens
tggagacaattgcccttttt

SEQ ID NO: 6902752 - DNA, 22 bp, Homo sapiens
actccaggtgtgttggactcta

SEQ ID NO: 6902753 - DNA, 22 bp, Homo sapiens
aagctgccagctgagctgaggc

SEQ ID NO: 6902754 - DNA, 22 bp, Homo sapiens
cagggacaaggaataagattag

SEQ ID NO: 6902755 - DNA, 22 bp, Homo sapiens
tccaaatagttctggaagactg

SEQ ID NO: 6902756 - DNA, 22 bp, Homo sapiens
tgcagcttccacatccacactc

SEQ ID NO: 6902757 - DNA, 22 bp, Homo sapiens
tcagctggtgagtggatagaca

SEQ ID NO: 6902758 - DNA, 22 bp, Homo sapiens
gagtgtgtgcatgatctcttat

SEQ ID NO: 6902759 - DNA, 22 bp, Homo sapiens
caagcagagaggttagaacaca

SEQ ID NO: 6902760 - DNA, 22 bp, Homo sapiens
ttgacattttgtcatattgaca

SEQ ID NO: 6902761 - DNA, 22 bp, Homo sapiens
agcttattaatttttctgcatg

SEQ ID NO: 6902762 - DNA, 22 bp, Homo sapiens
aagatgcctgtagcaggaagat

SEQ ID NO: 6902763 - DNA, 17 bp, Homo sapiens
tgagtaaagcacatggt

SEQ ID NO: 6902764 - DNA, 22 bp, Homo sapiens
aatggtcactatgtaaggtgat

SEQ ID NO: 6902765 - DNA, 22 bp, Homo sapiens
tagaaacaaaatctgatgactc

SEQ ID NO: 6902766 - DNA, 22 bp, Homo sapiens
gctgtctgttcgagcgtgtgtt

SEQ ID NO: 6902767 - DNA, 22 bp, Homo sapiens
tttgactttgggctctaactca

SEQ ID NO: 6902768 - DNA, 22 bp, Homo sapiens
gctattgtgacagcttttcgcc

SEQ ID NO: 6902769 - DNA, 22 bp, Homo sapiens
tttagcagaatttctctagaag

SEQ ID NO: 6902770 - DNA, 22 bp, Homo sapiens
ctggaaagctgcaggacccaga

SEQ ID NO: 6902771 - DNA, 22 bp, Homo sapiens
ttggactcctctttcctcttgg

SEQ ID NO: 6902772 - DNA, 22 bp, Homo sapiens
ctggatggaaggaggatagtat

SEQ ID NO: 6902773 - DNA, 22 bp, Homo sapiens
agctttatgcttcctacaagct

SEQ ID NO: 6902774 - DNA, 22 bp, Homo sapiens
tcagcaatcctcccacaggtgg

SEQ ID NO: 6902775 - DNA, 22 bp, Homo sapiens
taattttaatagtatgtggcat

SEQ ID NO: 6902776 - DNA, 22 bp, Homo sapiens
tcttagatggcagctagagctc

SEQ ID NO: 6902777 - DNA, 22 bp, Homo sapiens
aattgacagaaagtttacgagg

SEQ ID NO: 6902778 - DNA, 22 bp, Homo sapiens
gtgccagatgctgctttgtttt

SEQ ID NO: 6902779 - DNA, 22 bp, Homo sapiens
cgcagctctggccgagggcggc

SEQ ID NO: 6902780 - DNA, 22 bp, Homo sapiens
acaggtgacctgctcatatgaa

SEQ ID NO: 6902781 - DNA, 22 bp, Homo sapiens
tctggaggccatagggaaggat

SEQ ID NO: 6902782 - DNA, 22 bp, Homo sapiens
gagctggctcctccgaggatgg

SEQ ID NO: 6902783 - DNA, 22 bp, Homo sapiens
agaaatagtcacattggaggaa

SEQ ID NO: 6902784 - DNA, 22 bp, Homo sapiens
cagaatccatgacagacgttga

SEQ ID NO: 6902785 - DNA, 22 bp, Homo sapiens
agctgacagtgcatggagggac

SEQ ID NO: 6902786 - DNA, 22 bp, Homo sapiens
aggctgtcttcctccctcttgg

SEQ ID NO: 6902787 - DNA, 22 bp, Homo sapiens
agcttcttgggctttacacaaa

SEQ ID NO: 6902788 - DNA, 22 bp, Homo sapiens
gcacatgagaagctggcgatgc

SEQ ID NO: 6902789 - DNA, 22 bp, Homo sapiens
ctcttcttgtctctggttagaa

SEQ ID NO: 6902790 - DNA, 22 bp, Homo sapiens
gttgcaggaggatggctgcata

SEQ ID NO: 6902791 - DNA, 22 bp, Homo sapiens
tcaatattcttctttagtagga

SEQ ID NO: 6902792 - DNA, 23 bp, Homo sapiens
ttgcaaaatgcaattgagttaga

SEQ ID NO: 6902793 - DNA, 18 bp, Homo sapiens
tccctggggctgccaccc

SEQ ID NO: 6902794 - DNA, 22 bp, Homo sapiens
cccaggggaggtcctcagggaa

SEQ ID NO: 6902795 - DNA, 22 bp, Homo sapiens
tcctggctccactgagcaggcc

SEQ ID NO: 6902796 - DNA, 22 bp, Homo sapiens
ttgattctgggctcatttcttt

SEQ ID NO: 6902797 - DNA, 22 bp, Homo sapiens
atccagagtaatacagaatgca

SEQ ID NO: 6902798 - DNA, 22 bp, Homo sapiens
gcgtgcatgcatgtatatgtgt

SEQ ID NO: 6902799 - DNA, 22 bp, Homo sapiens
ctctgggcttacctgcttcctg

SEQ ID NO: 6902800 - DNA, 22 bp, Homo sapiens
ctgaggggatgtttttgacgga

SEQ ID NO: 6902801 - DNA, 22 bp, Homo sapiens
ctggaatggcaatgggaagtcc

SEQ ID NO: 6902802 - DNA, 22 bp, Homo sapiens
cttgtttttaagagatgtttac

SEQ ID NO: 6902803 - DNA, 21 bp, Homo sapiens
attttcattaattcagtgtgg

SEQ ID NO: 6902804 - DNA, 22 bp, Homo sapiens
accagtcatagaaagcagtggt

SEQ ID NO: 6902805 - DNA, 22 bp, Homo sapiens
tctgctcagccgatctgctccg

SEQ ID NO: 6902806 - DNA, 22 bp, Homo sapiens
gatttatttttaatcagcaggg

SEQ ID NO: 6902807 - DNA, 22 bp, Homo sapiens
gggctaggaaatgtagttttaa

SEQ ID NO: 6902808 - DNA, 22 bp, Homo sapiens
ggtcccaggctccctcttgtcc

SEQ ID NO: 6902809 - DNA, 22 bp, Homo sapiens
acagctatagacgatgtataga

SEQ ID NO: 6902810 - DNA, 22 bp, Homo sapiens
gaaatgcatggatcttggcaga

SEQ ID NO: 6902811 - DNA, 22 bp, Homo sapiens
atacttgtcaacattttatcca

SEQ ID NO: 6902812 - DNA, 22 bp, Homo sapiens
tgtcataatcagttttgcatgt

SEQ ID NO: 6902813 - DNA, 22 bp, Homo sapiens
aagcagatgccaagatttacca

SEQ ID NO: 6902814 - DNA, 22 bp, Homo sapiens
ttcctgaggaggaccaggacca

SEQ ID NO: 6902815 - DNA, 22 bp, Homo sapiens
taattgctccaaggagaactaa

SEQ ID NO: 6902816 - DNA, 22 bp, Homo sapiens
ttttctattcattgtctatggt

SEQ ID NO: 6902817 - DNA, 22 bp, Homo sapiens
accttttatgtaaatatatgtt

SEQ ID NO: 6902818 - DNA, 20 bp, Homo sapiens
catgcatgacactggaaagg

SEQ ID NO: 6902819 - DNA, 22 bp, Homo sapiens
gccagcaccagctactagtcac

SEQ ID NO: 6902820 - DNA, 22 bp, Homo sapiens
tccaggcatctgtattttttaa

SEQ ID NO: 6902821 - DNA, 22 bp, Homo sapiens
gggcaggtgtttccaaggtgag

SEQ ID NO: 6902822 - DNA, 22 bp, Homo sapiens
tgccaaatttgtatcttaagga

SEQ ID NO: 6902823 - DNA, 22 bp, Homo sapiens
tctctctgagccctgctttttc

SEQ ID NO: 6902824 - DNA, 22 bp, Homo sapiens
ctgggtgttcacccgaggcgct

SEQ ID NO: 6902825 - DNA, 22 bp, Homo sapiens
ctctccaggttagagcacttat

SEQ ID NO: 6902826 - DNA, 22 bp, Homo sapiens
ttggtaaattatttcttccaat

SEQ ID NO: 6902827 - DNA, 22 bp, Homo sapiens
agccttggactgaatactttag

SEQ ID NO: 6902828 - DNA, 21 bp, Homo sapiens
tgagcaccagctgcatgcccc

SEQ ID NO: 6902829 - DNA, 22 bp, Homo sapiens
ttcaagttttgcctccccatcc

SEQ ID NO: 6902830 - DNA, 22 bp, Homo sapiens
ttggaagggaacaccatttgac

SEQ ID NO: 6902831 - DNA, 22 bp, Homo sapiens
gtgtgctctggaggctagattt

SEQ ID NO: 6902832 - DNA, 22 bp, Homo sapiens
gaggagccatagatagtgctgc

SEQ ID NO: 6902833 - DNA, 20 bp, Homo sapiens
tgaagccttgggcattgatg

SEQ ID NO: 6902834 - DNA, 22 bp, Homo sapiens
catgtgctgtagcagagaggaa

SEQ ID NO: 6902835 - DNA, 22 bp, Homo sapiens
tggccttgagtggtctccgccc

SEQ ID NO: 6902836 - DNA, 22 bp, Homo sapiens
gactgagaatcatagaaggcaa

SEQ ID NO: 6902837 - DNA, 22 bp, Homo sapiens
aggatttagcatgaaatgtgaa

SEQ ID NO: 6902838 - DNA, 21 bp, Homo sapiens
tgtgtaattggccaaatgcac

SEQ ID NO: 6902839 - DNA, 22 bp, Homo sapiens
gcttctggaggagctgggctga

SEQ ID NO: 6902840 - DNA, 22 bp, Homo sapiens
ccctgaggaccaggaaggaggg

SEQ ID NO: 6902841 - DNA, 22 bp, Homo sapiens
agtaagttccaggttgctcttc

SEQ ID NO: 6902842 - DNA, 22 bp, Homo sapiens
gctgtgtgccaggggaaggctg

SEQ ID NO: 6902843 - DNA, 22 bp, Homo sapiens
agagcttttgggaattcaggta

SEQ ID NO: 6902844 - DNA, 21 bp, Homo sapiens
tcagaacaattccatgcctcc

SEQ ID NO: 6902845 - DNA, 22 bp, Homo sapiens
ctgtggcattgccgaggctggc

SEQ ID NO: 6902846 - DNA, 22 bp, Homo sapiens
ctcacattccacttgtgccaac

SEQ ID NO: 6902847 - DNA, 22 bp, Homo sapiens
ggtctgagtgccagggagagaa

SEQ ID NO: 6902848 - DNA, 22 bp, Homo sapiens
cagcagcaggcgcacggccgtc

SEQ ID NO: 6902849 - DNA, 22 bp, Homo sapiens
ctaaacaagatactaatgaggt

SEQ ID NO: 6902850 - DNA, 22 bp, Homo sapiens
atgccatcacttttccttttgt

SEQ ID NO: 6902851 - DNA, 22 bp, Homo sapiens
ctaaggaattcaaatagttagt

SEQ ID NO: 6902852 - DNA, 21 bp, Homo sapiens
atatttcagatttccgtaatc

SEQ ID NO: 6902853 - DNA, 21 bp, Homo sapiens
tttgatgattgattctctggc

SEQ ID NO: 6902854 - DNA, 22 bp, Homo sapiens
ttgcactagacacatttcaagt

SEQ ID NO: 6902855 - DNA, 22 bp, Homo sapiens
cttctattttcatgcctgggtc

SEQ ID NO: 6902856 - DNA, 22 bp, Homo sapiens
aaactctgccatttttggcctg

SEQ ID NO: 6902857 - DNA, 22 bp, Homo sapiens
aggaggggttctcgggtgctga

SEQ ID NO: 6902858 - DNA, 22 bp, Homo sapiens
gtagaccatttatctggggagt

SEQ ID NO: 6902859 - DNA, 18 bp, Homo sapiens
cctacatcattgtgagag

SEQ ID NO: 6902860 - DNA, 21 bp, Homo sapiens
ttaagagcttagcagtaggcc

SEQ ID NO: 6902861 - DNA, 22 bp, Homo sapiens
aaaaccacaattacttttgcac

SEQ ID NO: 6902862 - DNA, 22 bp, Homo sapiens
tgagaaccacgactgtgcttaa

SEQ ID NO: 6902863 - DNA, 22 bp, Homo sapiens
gcaatacagtaagagtactgta

SEQ ID NO: 6902864 - DNA, 22 bp, Homo sapiens
tagagaattgtagcctgcaaga

SEQ ID NO: 6902865 - DNA, 22 bp, Homo sapiens
gaaggctggctttctgagagca

SEQ ID NO: 6902866 - DNA, 22 bp, Homo sapiens
tcatttctgttgtgcatcactg

SEQ ID NO: 6902867 - DNA, 22 bp, Homo sapiens
actcaccacagagcagggaacc

SEQ ID NO: 6902868 - DNA, 23 bp, Homo sapiens
agcccctttaagtccggctgatg

SEQ ID NO: 6902869 - DNA, 22 bp, Homo sapiens
taatctgtattcctactttgca

SEQ ID NO: 6902870 - DNA, 22 bp, Homo sapiens
ctgcctgcttttctgggagccg

SEQ ID NO: 6902871 - DNA, 22 bp, Homo sapiens
tgagctggcttgtcaaccaggg

SEQ ID NO: 6902872 - DNA, 20 bp, Homo sapiens
agattaggggctttcttctt

SEQ ID NO: 6902873 - DNA, 22 bp, Homo sapiens
gagacagcctactccagtctca

SEQ ID NO: 6902874 - DNA, 22 bp, Homo sapiens
agctgcccaatcctgcagggcg

SEQ ID NO: 6902875 - DNA, 22 bp, Homo sapiens
ctaaatgttcacatgcaatttt

SEQ ID NO: 6902876 - DNA, 22 bp, Homo sapiens
aaagcactgcacatatatttgc

SEQ ID NO: 6902877 - DNA, 22 bp, Homo sapiens
cctgtggtttactctgtggcta

SEQ ID NO: 6902878 - DNA, 22 bp, Homo sapiens
atctatccagcgccaggcagag

SEQ ID NO: 6902879 - DNA, 22 bp, Homo sapiens
ggctgagggtcccagaccctaa

SEQ ID NO: 6902880 - DNA, 21 bp, Homo sapiens
atggctggtggctcagcctcc

SEQ ID NO: 6902881 - DNA, 22 bp, Homo sapiens
ggctgcctgttgagtatgtccc

SEQ ID NO: 6902882 - DNA, 22 bp, Homo sapiens
aagtccagtttttccaggtggt

SEQ ID NO: 6902883 - DNA, 19 bp, Homo sapiens
attgccacattgggtcagg

SEQ ID NO: 6902884 - DNA, 20 bp, Homo sapiens
cagtgcctgccccttgggtt

SEQ ID NO: 6902885 - DNA, 22 bp, Homo sapiens
tcgctgaggctgcacggctgcc

SEQ ID NO: 6902886 - DNA, 22 bp, Homo sapiens
agattacagaagaataagtaga

SEQ ID NO: 6902887 - DNA, 22 bp, Homo sapiens
atgttctgtttcttaatcttga

SEQ ID NO: 6902888 - DNA, 22 bp, Homo sapiens
atttaagactgacttcaccagt

SEQ ID NO: 6902889 - DNA, 18 bp, Homo sapiens
tggcaggaaatgcacttt

SEQ ID NO: 6902890 - DNA, 22 bp, Homo sapiens
aatccatgttgatgtatatttt

SEQ ID NO: 6902891 - DNA, 22 bp, Homo sapiens
acaaggctttggagggttctta

SEQ ID NO: 6902892 - DNA, 22 bp, Homo sapiens
tcacattgaatggaagaataga

SEQ ID NO: 6902893 - DNA, 23 bp, Homo sapiens
tggctagacaaatcatccaaggg

SEQ ID NO: 6902894 - DNA, 22 bp, Homo sapiens
gggccaggtggaccccagcctc

SEQ ID NO: 6902895 - DNA, 22 bp, Homo sapiens
ctgaagagctctcctgtcccct

SEQ ID NO: 6902896 - DNA, 20 bp, Homo sapiens
tctaggctagattttgtcat

SEQ ID NO: 6902897 - DNA, 22 bp, Homo sapiens
atgatgtctggaggcatgctgt

SEQ ID NO: 6902898 - DNA, 23 bp, Homo sapiens
ttggaccactactgttttctctt

SEQ ID NO: 6902899 - DNA, 22 bp, Homo sapiens
gcaggcttgcccggcctccttc

SEQ ID NO: 6902900 - DNA, 22 bp, Homo sapiens
gagcttggcctcttgaacgtgg

SEQ ID NO: 6902901 - DNA, 22 bp, Homo sapiens
agccactcagtgctgtattgac

SEQ ID NO: 6902902 - DNA, 22 bp, Homo sapiens
gggccacttctagtgcctcaga

SEQ ID NO: 6902903 - DNA, 22 bp, Homo sapiens
ggtggggccagggctccaacct

SEQ ID NO: 6902904 - DNA, 22 bp, Homo sapiens
cagctggccctttggtagcctt

SEQ ID NO: 6902905 - DNA, 22 bp, Homo sapiens
acaacttggctgtaaagaagaa

SEQ ID NO: 6902906 - DNA, 22 bp, Homo sapiens
aatggctttgacattttcaaat

SEQ ID NO: 6902907 - DNA, 22 bp, Homo sapiens
aagaatctatggtacatccaag

SEQ ID NO: 6902908 - DNA, 22 bp, Homo sapiens
gatgtacactcagaaaagtcat

SEQ ID NO: 6902909 - DNA, 22 bp, Homo sapiens
tgagtactcggagtgctttgga

SEQ ID NO: 6902910 - DNA, 22 bp, Homo sapiens
tggttggggtctgcagccatcc

SEQ ID NO: 6902911 - DNA, 22 bp, Homo sapiens
atgtgcaaagtaaagtaatttt

SEQ ID NO: 6902912 - DNA, 22 bp, Homo sapiens
gtgtttcccctcctggagaagg

SEQ ID NO: 6902913 - DNA, 22 bp, Homo sapiens
ttatccaacatgacttatgtcc

SEQ ID NO: 6902914 - DNA, 22 bp, Homo sapiens
agagatttatactgcaccagaa

SEQ ID NO: 6902915 - DNA, 22 bp, Homo sapiens
agggagttccgatctgtgcacc

SEQ ID NO: 6902916 - DNA, 20 bp, Homo sapiens
ttctgagattaggttacaaa

SEQ ID NO: 6902917 - DNA, 21 bp, Homo sapiens
ttccagagattgtttcacctg

SEQ ID NO: 6902918 - DNA, 22 bp, Homo sapiens
tcttggctgtgcatgcatcttc

SEQ ID NO: 6902919 - DNA, 22 bp, Homo sapiens
tcatttcacttctctagggaga

SEQ ID NO: 6902920 - DNA, 22 bp, Homo sapiens
gtggcctcatgtctataaagag

SEQ ID NO: 6902921 - DNA, 22 bp, Homo sapiens
attagcaagttttccagctaat

SEQ ID NO: 6902922 - DNA, 22 bp, Homo sapiens
ctcaggaggtttcctgtctagg

SEQ ID NO: 6902923 - DNA, 15 bp, Homo sapiens
caggttagtttccag

SEQ ID NO: 6902924 - DNA, 22 bp, Homo sapiens
tgtcaccatgccagcttctgcc

SEQ ID NO: 6902925 - DNA, 21 bp, Homo sapiens
tctaatgacatcctctgacaa

SEQ ID NO: 6902926 - DNA, 22 bp, Homo sapiens
tggctgagtgaacatgtccatt

SEQ ID NO: 6902927 - DNA, 22 bp, Homo sapiens
ctgtgtctttcctactttgtgg

SEQ ID NO: 6902928 - DNA, 22 bp, Homo sapiens
cagcacttgagctttcatgtaa

SEQ ID NO: 6902929 - DNA, 22 bp, Homo sapiens
gttcatgtttgtgtattgctca

SEQ ID NO: 6902930 - DNA, 22 bp, Homo sapiens
actgccagaatcattcaaggaa

SEQ ID NO: 6902931 - DNA, 22 bp, Homo sapiens
tgtgctcactctaaattaagat

SEQ ID NO: 6902932 - DNA, 18 bp, Homo sapiens
tgagaactaggcattgca

SEQ ID NO: 6902933 - DNA, 18 bp, Homo sapiens
ctttagctgtcatctttg

SEQ ID NO: 6902934 - DNA, 22 bp, Homo sapiens
tatttcttgttattctcgttga

SEQ ID NO: 6902935 - DNA, 21 bp, Homo sapiens
gactctgcaccaaattaagcc

SEQ ID NO: 6902936 - DNA, 18 bp, Homo sapiens
tatcttttccagtggtat

SEQ ID NO: 6902937 - DNA, 22 bp, Homo sapiens
ggggaatattggatacgtatct

SEQ ID NO: 6902938 - DNA, 22 bp, Homo sapiens
ctgccagctggagaccaaggaa

SEQ ID NO: 6902939 - DNA, 22 bp, Homo sapiens
cttctagaggtgcaagggaaga

SEQ ID NO: 6902940 - DNA, 22 bp, Homo sapiens
cagcatgtggattcctcccact

SEQ ID NO: 6902941 - DNA, 22 bp, Homo sapiens
gttcatattactttgagtgcag

SEQ ID NO: 6902942 - DNA, 22 bp, Homo sapiens
tggcttcggcattgctacaccc

SEQ ID NO: 6902943 - DNA, 22 bp, Homo sapiens
tctggagtggagctgatcattt

SEQ ID NO: 6902944 - DNA, 22 bp, Homo sapiens
tctgtcaattattcacataggc

SEQ ID NO: 6902945 - DNA, 22 bp, Homo sapiens
tgagaaaagtgtggaggtcaat

SEQ ID NO: 6902946 - DNA, 22 bp, Homo sapiens
taatacacaagggccagctctt

SEQ ID NO: 6902947 - DNA, 22 bp, Homo sapiens
tccatggagatggatgactgta

SEQ ID NO: 6902948 - DNA, 22 bp, Homo sapiens
tgtgtatagatgcatgcatata

SEQ ID NO: 6902949 - DNA, 22 bp, Homo sapiens
tttttgagatggatttagctct

SEQ ID NO: 6902950 - DNA, 22 bp, Homo sapiens
atataattaatttagctgcctc

SEQ ID NO: 6902951 - DNA, 22 bp, Homo sapiens
cagggacaaacaaggttgggga

SEQ ID NO: 6902952 - DNA, 22 bp, Homo sapiens
tctgcatttttacaagatcccc

SEQ ID NO: 6902953 - DNA, 22 bp, Homo sapiens
taaaccattcagactgaaccac

SEQ ID NO: 6902954 - DNA, 22 bp, Homo sapiens
ggtcgcacccgggcgctgctgg

SEQ ID NO: 6902955 - DNA, 22 bp, Homo sapiens
gcggggcccggacccagcctct

SEQ ID NO: 6902956 - DNA, 23 bp, Homo sapiens
aaagatgttcccaaagttcacgt

SEQ ID NO: 6902957 - DNA, 22 bp, Homo sapiens
tttcaaggctagttttaattag

SEQ ID NO: 6902958 - DNA, 22 bp, Homo sapiens
gacagggccgcagatggagact

SEQ ID NO: 6902959 - DNA, 21 bp, Homo sapiens
ccaaaggctatgtatcttctg

SEQ ID NO: 6902960 - DNA, 20 bp, Homo sapiens
tcaatttcaggtagcatagt

SEQ ID NO: 6902961 - DNA, 22 bp, Homo sapiens
gagcaggaaggccagaagggtc

SEQ ID NO: 6902962 - DNA, 22 bp, Homo sapiens
cagctaagccacactcagatgg

SEQ ID NO: 6902963 - DNA, 22 bp, Homo sapiens
aacctctttgtgaatgtcatga

SEQ ID NO: 6902964 - DNA, 23 bp, Homo sapiens
tcattcaaggctggtatctttca

SEQ ID NO: 6902965 - DNA, 22 bp, Homo sapiens
atggaatatagtcttatatctc

SEQ ID NO: 6902966 - DNA, 22 bp, Homo sapiens
tactgcttcatatatgggagac

SEQ ID NO: 6902967 - DNA, 22 bp, Homo sapiens
attgtaaagtactgtgtacaat

SEQ ID NO: 6902968 - DNA, 22 bp, Homo sapiens
tctctgaccaagagaattggta

SEQ ID NO: 6902969 - DNA, 23 bp, Homo sapiens
tcctcccaaatttcagcctcatt

SEQ ID NO: 6902970 - DNA, 22 bp, Homo sapiens
tagcgaggtgtttctaggactg

SEQ ID NO: 6902971 - DNA, 20 bp, Homo sapiens
cgctttcctcaaactctgtt

SEQ ID NO: 6902972 - DNA, 22 bp, Homo sapiens
acatgattaaaagattttaaag

SEQ ID NO: 6902973 - DNA, 22 bp, Homo sapiens
atgtgaaatattaagccgagga

SEQ ID NO: 6902974 - DNA, 22 bp, Homo sapiens
tagtgattcctgttgccctgga

SEQ ID NO: 6902975 - DNA, 22 bp, Homo sapiens
gatggcctgggtccccttccgg

SEQ ID NO: 6902976 - DNA, 22 bp, Homo sapiens
aagctgtacttagcattgactc

SEQ ID NO: 6902977 - DNA, 22 bp, Homo sapiens
tattgcatccccattgtgcccc

SEQ ID NO: 6902978 - DNA, 22 bp, Homo sapiens
tcagtcttgcttctcttgggtc

SEQ ID NO: 6902979 - DNA, 22 bp, Homo sapiens
agaggtcagatttctcctggtg

SEQ ID NO: 6902980 - DNA, 22 bp, Homo sapiens
gctgatgtaagacttttggttt

SEQ ID NO: 6902981 - DNA, 22 bp, Homo sapiens
agcaactttattccactgggca

SEQ ID NO: 6902982 - DNA, 19 bp, Homo sapiens
gtgcactgtcactttgctc

SEQ ID NO: 6902983 - DNA, 22 bp, Homo sapiens
tgtttgcacattcgtttcaata

SEQ ID NO: 6902984 - DNA, 22 bp, Homo sapiens
ctgtccacctttgataggctct

SEQ ID NO: 6902985 - DNA, 22 bp, Homo sapiens
tttcctgttgccatcaagaatg

SEQ ID NO: 6902986 - DNA, 22 bp, Homo sapiens
atgatgctgtttatcatatact

SEQ ID NO: 6902987 - DNA, 22 bp, Homo sapiens
cctctgcacttcaccttagctc

SEQ ID NO: 6902988 - DNA, 22 bp, Homo sapiens
ggagctgtgttatccattccca

SEQ ID NO: 6902989 - DNA, 22 bp, Homo sapiens
ttcctaggatggtgaagcagga

SEQ ID NO: 6902990 - DNA, 22 bp, Homo sapiens
tgtgcgtggttcccggggccat

SEQ ID NO: 6902991 - DNA, 22 bp, Homo sapiens
gccatgcagcttattaaagtgg

SEQ ID NO: 6902992 - DNA, 22 bp, Homo sapiens
atatgtatagccagtctttagg

SEQ ID NO: 6902993 - DNA, 22 bp, Homo sapiens
agggctccaaggaagtgtagct

SEQ ID NO: 6902994 - DNA, 22 bp, Homo sapiens
tcctgaggaccctgtcaggggc

SEQ ID NO: 6902995 - DNA, 22 bp, Homo sapiens
aggcagcagtgataagatagga

SEQ ID NO: 6902996 - DNA, 21 bp, Homo sapiens
tttctcaccatggtatggaaa

SEQ ID NO: 6902997 - DNA, 22 bp, Homo sapiens
atatgagttgatttttagaata

SEQ ID NO: 6902998 - DNA, 22 bp, Homo sapiens
ccagcttttgcactggactggg

SEQ ID NO: 6902999 - DNA, 22 bp, Homo sapiens
gtcacttttaagggccttttct

SEQ ID NO: 6903000 - DNA, 22 bp, Homo sapiens
agtgatattagcaaatggttat

SEQ ID NO: 6903001 - DNA, 22 bp, Homo sapiens
gaggcaacaatgatggtgtgta

SEQ ID NO: 6903002 - DNA, 22 bp, Homo sapiens
ggctgggttctgagaaagagta

SEQ ID NO: 6903003 - DNA, 22 bp, Homo sapiens
ctaagccactcaaatcttgtgg

SEQ ID NO: 6903004 - DNA, 22 bp, Homo sapiens
attcctagatgaattacattgc

SEQ ID NO: 6903005 - DNA, 22 bp, Homo sapiens
cactgttttacatgttatttaa

SEQ ID NO: 6903006 - DNA, 22 bp, Homo sapiens
gtgttaatggtagaatctgagt

SEQ ID NO: 6903007 - DNA, 22 bp, Homo sapiens
acacagcaaggtctgactttgg

SEQ ID NO: 6903008 - DNA, 22 bp, Homo sapiens
caccctgctacaaagcctcctg

SEQ ID NO: 6903009 - DNA, 22 bp, Homo sapiens
acagctacatggaatttcattt

SEQ ID NO: 6903010 - DNA, 22 bp, Homo sapiens
ttcacagtgtgatctatgggca

SEQ ID NO: 6903011 - DNA, 22 bp, Homo sapiens
caacctgagactccaggcacct

SEQ ID NO: 6903012 - DNA, 22 bp, Homo sapiens
ccagccctgattagagaatgtc

SEQ ID NO: 6903013 - DNA, 22 bp, Homo sapiens
agagtgcatgttttatctttgt

SEQ ID NO: 6903014 - DNA, 20 bp, Homo sapiens
cgtaaggcaagtgctgcatc

SEQ ID NO: 6903015 - DNA, 22 bp, Homo sapiens
ggtggagcgcagggtgctggcg

SEQ ID NO: 6903016 - DNA, 21 bp, Homo sapiens
actggcttggctctggctgaa

SEQ ID NO: 6903017 - DNA, 22 bp, Homo sapiens
ttcctcctctgtaaaacgggca

SEQ ID NO: 6903018 - DNA, 22 bp, Homo sapiens
ttttcttactgtctgtgatcct

SEQ ID NO: 6903019 - DNA, 22 bp, Homo sapiens
gcctggctgctcagccactcac

SEQ ID NO: 6903020 - DNA, 22 bp, Homo sapiens
cagtacagaatctattcctgca

SEQ ID NO: 6903021 - DNA, 22 bp, Homo sapiens
tattataaaattactggcaggg

SEQ ID NO: 6903022 - DNA, 22 bp, Homo sapiens
tttttgatctgagcagttggag

SEQ ID NO: 6903023 - DNA, 22 bp, Homo sapiens
tgcagtgatttgtacaattaga

SEQ ID NO: 6903024 - DNA, 22 bp, Homo sapiens
tacttctgaatgtgagtttgtt

SEQ ID NO: 6903025 - DNA, 22 bp, Homo sapiens
tgggaagcacgctcagcagaaa

SEQ ID NO: 6903026 - DNA, 22 bp, Homo sapiens
ttttattcatagggatggagag

SEQ ID NO: 6903027 - DNA, 22 bp, Homo sapiens
tacgctccaaaatcagaattga

SEQ ID NO: 6903028 - DNA, 22 bp, Homo sapiens
aggcagttgttgctgagcagct

SEQ ID NO: 6903029 - DNA, 22 bp, Homo sapiens
tagaaatgggttacatttagag

SEQ ID NO: 6903030 - DNA, 23 bp, Homo sapiens
agctgaggcagaggggcattctc

SEQ ID NO: 6903031 - DNA, 22 bp, Homo sapiens
gctctgtatgtagttcttgctt

SEQ ID NO: 6903032 - DNA, 23 bp, Homo sapiens
catgtgtaatttctggttgggtg

SEQ ID NO: 6903033 - DNA, 22 bp, Homo sapiens
gtgtggctgtttagtgactttc

SEQ ID NO: 6903034 - DNA, 22 bp, Homo sapiens
ctggtgcacattcgctctcata

SEQ ID NO: 6903035 - DNA, 22 bp, Homo sapiens
aggtgtccaatcctggttggat

SEQ ID NO: 6903036 - DNA, 22 bp, Homo sapiens
tggtggcagctgagtgtcaggt

SEQ ID NO: 6903037 - DNA, 22 bp, Homo sapiens
aagaggagtagatgtggttggt

SEQ ID NO: 6903038 - DNA, 22 bp, Homo sapiens
cagtgggagcaaatacactcat

SEQ ID NO: 6903039 - DNA, 22 bp, Homo sapiens
agacagtgcaagaagagcaggc

SEQ ID NO: 6903040 - DNA, 22 bp, Homo sapiens
attgttgaggagactcttcaat

SEQ ID NO: 6903041 - DNA, 22 bp, Homo sapiens
aagaattttccagcatgtcagt

SEQ ID NO: 6903042 - DNA, 22 bp, Homo sapiens
acattcaaggcagcactgagtg

SEQ ID NO: 6903043 - DNA, 22 bp, Homo sapiens
aagatgctaattgtggaagttg

SEQ ID NO: 6903044 - DNA, 22 bp, Homo sapiens
taaagacataggatcagggaga

SEQ ID NO: 6903045 - DNA, 22 bp, Homo sapiens
gcaaagacggactcaggagtgc

SEQ ID NO: 6903046 - DNA, 22 bp, Homo sapiens
acttggctagagccaggaggct

SEQ ID NO: 6903047 - DNA, 22 bp, Homo sapiens
gggcggggtggctcatgcctgt

SEQ ID NO: 6903048 - DNA, 22 bp, Homo sapiens
aaccaggtgactcatggtgagc

SEQ ID NO: 6903049 - DNA, 21 bp, Homo sapiens
ggctgctcacctaggtcccaa

SEQ ID NO: 6903050 - DNA, 22 bp, Homo sapiens
ctcctgagaggatctctgttgt

SEQ ID NO: 6903051 - DNA, 22 bp, Homo sapiens
tgagcatggtgggtgcagagca

SEQ ID NO: 6903052 - DNA, 22 bp, Homo sapiens
taaaatgtttgcaagagaccag

SEQ ID NO: 6903053 - DNA, 22 bp, Homo sapiens
cagggtgcttccgtggagctgt

SEQ ID NO: 6903054 - DNA, 22 bp, Homo sapiens
agcaagtgtaagaatgcagaat

SEQ ID NO: 6903055 - DNA, 22 bp, Homo sapiens
tgttctgcaagccctgccacct

SEQ ID NO: 6903056 - DNA, 22 bp, Homo sapiens
agggagcacagtaagttagtct

SEQ ID NO: 6903057 - DNA, 22 bp, Homo sapiens
atcaaagttcgtaactgataac

SEQ ID NO: 6903058 - DNA, 22 bp, Homo sapiens
aattatgtttgctttagatgga

SEQ ID NO: 6903059 - DNA, 22 bp, Homo sapiens
ttgaagtctcatgatttaaaga

SEQ ID NO: 6903060 - DNA, 19 bp, Homo sapiens
gcacacatacaccctttgg

SEQ ID NO: 6903061 - DNA, 22 bp, Homo sapiens
cagtgataggacagctagaact

SEQ ID NO: 6903062 - DNA, 22 bp, Homo sapiens
tgcaaatcctgtttggagtaag

SEQ ID NO: 6903063 - DNA, 22 bp, Homo sapiens
aggatacatgttttttatcaat

SEQ ID NO: 6903064 - DNA, 22 bp, Homo sapiens
acaacaaagacacttgaaatga

SEQ ID NO: 6903065 - DNA, 22 bp, Homo sapiens
aggccagcttctaccctctgtt

SEQ ID NO: 6903066 - DNA, 22 bp, Homo sapiens
attttatgacacgattcttcca

SEQ ID NO: 6903067 - DNA, 22 bp, Homo sapiens
tccagcactcgcccagggcttg

SEQ ID NO: 6903068 - DNA, 22 bp, Homo sapiens
tgaaaggtagctggcctcatag

SEQ ID NO: 6903069 - DNA, 22 bp, Homo sapiens
gagacctgcagctgtagtctgc

SEQ ID NO: 6903070 - DNA, 22 bp, Homo sapiens
aaactgaagtagattctgaaat

SEQ ID NO: 6903071 - DNA, 22 bp, Homo sapiens
aagagcagcctccaggggtgga

SEQ ID NO: 6903072 - DNA, 22 bp, Homo sapiens
tgcagatgagagggagttttta

SEQ ID NO: 6903073 - DNA, 22 bp, Homo sapiens
gcatgtgttattttatgtatga

SEQ ID NO: 6903074 - DNA, 23 bp, Homo sapiens
cattagaaggtagagtggaatga

SEQ ID NO: 6903075 - DNA, 22 bp, Homo sapiens
agtctctaggatcagacaccca

SEQ ID NO: 6903076 - DNA, 22 bp, Homo sapiens
aggtctgagtttgttgttggct

SEQ ID NO: 6903077 - DNA, 22 bp, Homo sapiens
ttgaatgaccatgatgcaaggg

SEQ ID NO: 6903078 - DNA, 22 bp, Homo sapiens
tcacttaggtgcaaagggaact

SEQ ID NO: 6903079 - DNA, 22 bp, Homo sapiens
caagagcctttgggcagaagga

SEQ ID NO: 6903080 - DNA, 22 bp, Homo sapiens
tcccaagactatgttctgtgtg

SEQ ID NO: 6903081 - DNA, 22 bp, Homo sapiens
gatgctgactggtgtttgcctt

SEQ ID NO: 6903082 - DNA, 22 bp, Homo sapiens
gatctttagccaagacacacca

SEQ ID NO: 6903083 - DNA, 22 bp, Homo sapiens
attggggagagctaatatttta

SEQ ID NO: 6903084 - DNA, 17 bp, Homo sapiens
accctcaatctcctgca

SEQ ID NO: 6903085 - DNA, 22 bp, Homo sapiens
cgccgtcccctaggaaagagct

SEQ ID NO: 6903086 - DNA, 18 bp, Homo sapiens
aggcttgggcccagcagc

SEQ ID NO: 6903087 - DNA, 20 bp, Homo sapiens
gctgccttgtcctgcttggt

SEQ ID NO: 6903088 - DNA, 22 bp, Homo sapiens
gaagcagaacccactccccaac

SEQ ID NO: 6903089 - DNA, 22 bp, Homo sapiens
ttcttaggactagtatagcatg

SEQ ID NO: 6903090 - DNA, 22 bp, Homo sapiens
gcctggtggtgtgctcaagtgg

SEQ ID NO: 6903091 - DNA, 22 bp, Homo sapiens
aagcacatacataataaagtcc

SEQ ID NO: 6903092 - DNA, 22 bp, Homo sapiens
tccagtttacagggttgctttt

SEQ ID NO: 6903093 - DNA, 22 bp, Homo sapiens
tgagatcattgacttgttcctg

SEQ ID NO: 6903094 - DNA, 19 bp, Homo sapiens
aaggctggtaccataggtt

SEQ ID NO: 6903095 - DNA, 22 bp, Homo sapiens
acatgatttttctttgactcta

SEQ ID NO: 6903096 - DNA, 22 bp, Homo sapiens
catgtatcttaattgctttgga

SEQ ID NO: 6903097 - DNA, 22 bp, Homo sapiens
agtcttggtccaggctcatttc

SEQ ID NO: 6903098 - DNA, 22 bp, Homo sapiens
gctggctgtgggctccacgctc

SEQ ID NO: 6903099 - DNA, 22 bp, Homo sapiens
gaagcggggagggtgagcccgg

SEQ ID NO: 6903100 - DNA, 22 bp, Homo sapiens
tacatgacatttctttctgttc

SEQ ID NO: 6903101 - DNA, 22 bp, Homo sapiens
ttgctttgtttaaaagtggtat

SEQ ID NO: 6903102 - DNA, 22 bp, Homo sapiens
tgacatcagggcaggggttgag

SEQ ID NO: 6903103 - DNA, 22 bp, Homo sapiens
gaattgctaatccaagtgactg

SEQ ID NO: 6903104 - DNA, 22 bp, Homo sapiens
cacttgagttcttaatagtcag

SEQ ID NO: 6903105 - DNA, 22 bp, Homo sapiens
aaagcttgtgctgtagtattta

SEQ ID NO: 6903106 - DNA, 22 bp, Homo sapiens
gctggcagtgtattgttagctg

SEQ ID NO: 6903107 - DNA, 22 bp, Homo sapiens
gctgaaggcccggaggacaggg

SEQ ID NO: 6903108 - DNA, 22 bp, Homo sapiens
tgtggaaggggccccatgacca

SEQ ID NO: 6903109 - DNA, 22 bp, Homo sapiens
tctgggcagcctcaggccaggg

SEQ ID NO: 6903110 - DNA, 22 bp, Homo sapiens
tgagtgtatatgaaggttgtaa

SEQ ID NO: 6903111 - DNA, 22 bp, Homo sapiens
tatgtgcactttgggtctggga

SEQ ID NO: 6903112 - DNA, 22 bp, Homo sapiens
gttatcatgcttcatcatcact

SEQ ID NO: 6903113 - DNA, 22 bp, Homo sapiens
gcagggctagatatttgcaagt

SEQ ID NO: 6903114 - DNA, 22 bp, Homo sapiens
gctccccattgatctgcaggct

SEQ ID NO: 6903115 - DNA, 22 bp, Homo sapiens
ctatttattgtgggtatccagg

SEQ ID NO: 6903116 - DNA, 22 bp, Homo sapiens
tcttggaataccccgaaggtca

SEQ ID NO: 6903117 - DNA, 23 bp, Homo sapiens
taactaggaatagtttaccctta

SEQ ID NO: 6903118 - DNA, 22 bp, Homo sapiens
catctctgtgtccccagagctt

SEQ ID NO: 6903119 - DNA, 22 bp, Homo sapiens
gaatggcatagctttctttaca

SEQ ID NO: 6903120 - DNA, 22 bp, Homo sapiens
cagactgtgtctgaacctggtc

SEQ ID NO: 6903121 - DNA, 19 bp, Homo sapiens
ccagtgtctagcgcacagc

SEQ ID NO: 6903122 - DNA, 22 bp, Homo sapiens
agccaggccttttctcaaggtt

SEQ ID NO: 6903123 - DNA, 22 bp, Homo sapiens
tcctggaagatctctgtgagat

SEQ ID NO: 6903124 - DNA, 23 bp, Homo sapiens
tggtcagtgccttgcatgtggga

SEQ ID NO: 6903125 - DNA, 22 bp, Homo sapiens
aaattatcatgattattgtgta

SEQ ID NO: 6903126 - DNA, 22 bp, Homo sapiens
cgctgcagacgcgctggcgaaa

SEQ ID NO: 6903127 - DNA, 22 bp, Homo sapiens
gtgactcacacaggcctgggct

SEQ ID NO: 6903128 - DNA, 22 bp, Homo sapiens
agccagtatcactctgtgttct

SEQ ID NO: 6903129 - DNA, 22 bp, Homo sapiens
atttgcagaagggagggggacc

SEQ ID NO: 6903130 - DNA, 22 bp, Homo sapiens
atctcatcagatctgtataagc

SEQ ID NO: 6903131 - DNA, 22 bp, Homo sapiens
aggagcactaattcctgcagag

SEQ ID NO: 6903132 - DNA, 22 bp, Homo sapiens
attcagttactctagacacttc

SEQ ID NO: 6903133 - DNA, 22 bp, Homo sapiens
agtgcctctgcaggtccgagtt

SEQ ID NO: 6903134 - DNA, 22 bp, Homo sapiens
ataagagtcttgttttcttatt

SEQ ID NO: 6903135 - DNA, 22 bp, Homo sapiens
aaatcgtggaagacaccagtgg

SEQ ID NO: 6903136 - DNA, 22 bp, Homo sapiens
gcattctctctctaaatgttgt

SEQ ID NO: 6903137 - DNA, 22 bp, Homo sapiens
agcccagcagaaagtccagcct

SEQ ID NO: 6903138 - DNA, 22 bp, Homo sapiens
acagtgtggaaagtcaacttga

SEQ ID NO: 6903139 - DNA, 22 bp, Homo sapiens
cctgattgtctcttgcagcact

SEQ ID NO: 6903140 - DNA, 22 bp, Homo sapiens
attcagttattcagagaaggga

SEQ ID NO: 6903141 - DNA, 22 bp, Homo sapiens
tgagtaggggtagaaagtttag

SEQ ID NO: 6903142 - DNA, 19 bp, Homo sapiens
gcgaggaagtcactgtggc

SEQ ID NO: 6903143 - DNA, 22 bp, Homo sapiens
gcagtgaacataacacagaagg

SEQ ID NO: 6903144 - DNA, 22 bp, Homo sapiens
aggctctgagtctggtgtctgc

SEQ ID NO: 6903145 - DNA, 21 bp, Homo sapiens
aggctcagcaggtgtataaag

SEQ ID NO: 6903146 - DNA, 22 bp, Homo sapiens
tgcagaatattctggtgacaat

SEQ ID NO: 6903147 - DNA, 22 bp, Homo sapiens
taactggtgagttggttgagtg

SEQ ID NO: 6903148 - DNA, 22 bp, Homo sapiens
ctggcctcatagccaagctgtg

SEQ ID NO: 6903149 - DNA, 22 bp, Homo sapiens
gcacaggctgttggccttcaga

SEQ ID NO: 6903150 - DNA, 22 bp, Homo sapiens
tcgtgaagtcacaataaagtct

SEQ ID NO: 6903151 - DNA, 22 bp, Homo sapiens
cagagatgtgatccagctgtct

SEQ ID NO: 6903152 - DNA, 22 bp, Homo sapiens
agagacctttgttattctagga

SEQ ID NO: 6903153 - DNA, 22 bp, Homo sapiens
agtcaaagctacaggcatttga

SEQ ID NO: 6903154 - DNA, 22 bp, Homo sapiens
gcaggcagttatttagtagaat

SEQ ID NO: 6903155 - DNA, 22 bp, Homo sapiens
gctctgttaacagtccagcttt

SEQ ID NO: 6903156 - DNA, 22 bp, Homo sapiens
ttgtgctccagacagtcccagg

SEQ ID NO: 6903157 - DNA, 22 bp, Homo sapiens
tggtctgcagacatgtgggtgt

SEQ ID NO: 6903158 - DNA, 22 bp, Homo sapiens
actgcctgcctctgattctgca

SEQ ID NO: 6903159 - DNA, 20 bp, Homo sapiens
aggccccaggtggacactag

SEQ ID NO: 6903160 - DNA, 18 bp, Homo sapiens
ggaacaaggctctgactc

SEQ ID NO: 6903161 - DNA, 22 bp, Homo sapiens
tgaggtggtttgtatcactggg

SEQ ID NO: 6903162 - DNA, 22 bp, Homo sapiens
ttgtgctaagcaatttgcttaa

SEQ ID NO: 6903163 - DNA, 22 bp, Homo sapiens
ttatttcctctctaatagggta

SEQ ID NO: 6903164 - DNA, 22 bp, Homo sapiens
aacactttgttgcctatgaacg

SEQ ID NO: 6903165 - DNA, 22 bp, Homo sapiens
tttcagagttatgtaagaaaat

SEQ ID NO: 6903166 - DNA, 22 bp, Homo sapiens
cagtcctcagtgagtgatcctg

SEQ ID NO: 6903167 - DNA, 22 bp, Homo sapiens
aatctagtctccttaagtcttt

SEQ ID NO: 6903168 - DNA, 22 bp, Homo sapiens
cttgcaagggcagggaggtggc

SEQ ID NO: 6903169 - DNA, 19 bp, Homo sapiens
tccatacaaactgttgaaa

SEQ ID NO: 6903170 - DNA, 22 bp, Homo sapiens
ctgaatatcatttacatttgga

SEQ ID NO: 6903171 - DNA, 22 bp, Homo sapiens
agtttcgaagagactaaatagg

SEQ ID NO: 6903172 - DNA, 22 bp, Homo sapiens
attgtgcagctctgctcttatt

SEQ ID NO: 6903173 - DNA, 22 bp, Homo sapiens
gttgaagtaaggcagccacagg

SEQ ID NO: 6903174 - DNA, 22 bp, Homo sapiens
agctgagattatgctcttctca

SEQ ID NO: 6903175 - DNA, 22 bp, Homo sapiens
agaggcacaacagtcccattgt

SEQ ID NO: 6903176 - DNA, 22 bp, Homo sapiens
attagtgtctgtgaataattct

SEQ ID NO: 6903177 - DNA, 22 bp, Homo sapiens
ctggttattattcttggaatgc

SEQ ID NO: 6903178 - DNA, 22 bp, Homo sapiens
gtggccttataagaagagacat

SEQ ID NO: 6903179 - DNA, 22 bp, Homo sapiens
tagagaatggccttgaagtagt

SEQ ID NO: 6903180 - DNA, 22 bp, Homo sapiens
tcatggatgatagcttcattgc

SEQ ID NO: 6903181 - DNA, 20 bp, Homo sapiens
tgagccaaacgatgaagagc

SEQ ID NO: 6903182 - DNA, 22 bp, Homo sapiens
tgggtgtgagcccgggagccgc

SEQ ID NO: 6903183 - DNA, 22 bp, Homo sapiens
gtagttacccagaacactggaa

SEQ ID NO: 6903184 - DNA, 22 bp, Homo sapiens
caagtcacttatgtgcagatat

SEQ ID NO: 6903185 - DNA, 22 bp, Homo sapiens
tgaaggtgaaagattgaagcca

SEQ ID NO: 6903186 - DNA, 22 bp, Homo sapiens
ggctgaagtgtagtggctcact

SEQ ID NO: 6903187 - DNA, 22 bp, Homo sapiens
taatactgactaaagatatcaa

SEQ ID NO: 6903188 - DNA, 22 bp, Homo sapiens
cttggatatcactcagaaagat

SEQ ID NO: 6903189 - DNA, 22 bp, Homo sapiens
gggacgagccccaggctggagg

SEQ ID NO: 6903190 - DNA, 22 bp, Homo sapiens
ttgtcacatgtagttcattctc

SEQ ID NO: 6903191 - DNA, 22 bp, Homo sapiens
cgcctggagaggaggcgacgcg

SEQ ID NO: 6903192 - DNA, 22 bp, Homo sapiens
tgctctgtccagtgcaccatca

SEQ ID NO: 6903193 - DNA, 22 bp, Homo sapiens
tccctgtctccttgtgtgtcct

SEQ ID NO: 6903194 - DNA, 22 bp, Homo sapiens
aagtgtgtgagcctgtcaggct

SEQ ID NO: 6903195 - DNA, 22 bp, Homo sapiens
gactgagaaacagtacattacc

SEQ ID NO: 6903196 - DNA, 22 bp, Homo sapiens
gcggaggtggagcaccaagggc

SEQ ID NO: 6903197 - DNA, 20 bp, Homo sapiens
ccctgtatgtggatgagtgg

SEQ ID NO: 6903198 - DNA, 22 bp, Homo sapiens
gctctgcttgcatcatgactgc

SEQ ID NO: 6903199 - DNA, 22 bp, Homo sapiens
attagatacacagatttccact

SEQ ID NO: 6903200 - DNA, 20 bp, Homo sapiens
ctcttttgactctttgcaag

SEQ ID NO: 6903201 - DNA, 19 bp, Homo sapiens
gaggatgctcggtcccagg

SEQ ID NO: 6903202 - DNA, 21 bp, Homo sapiens
tgacatttagtagcattgtca

SEQ ID NO: 6903203 - DNA, 22 bp, Homo sapiens
tgggcctcggggaagcccgtgt

SEQ ID NO: 6903204 - DNA, 22 bp, Homo sapiens
cagggacaatggcagagcctga

SEQ ID NO: 6903205 - DNA, 22 bp, Homo sapiens
taaagtgcaggctactcagaag

SEQ ID NO: 6903206 - DNA, 22 bp, Homo sapiens
agggctcttcctttgcctctca

SEQ ID NO: 6903207 - DNA, 22 bp, Homo sapiens
tttatccactcatccatgcctc

SEQ ID NO: 6903208 - DNA, 22 bp, Homo sapiens
ggtctgcccactactctccatt

SEQ ID NO: 6903209 - DNA, 22 bp, Homo sapiens
gggaatgaccttaataagtagg

SEQ ID NO: 6903210 - DNA, 22 bp, Homo sapiens
agacttgatgttaaaagaaact

SEQ ID NO: 6903211 - DNA, 22 bp, Homo sapiens
gctgtctgcaagccaggaaatg

SEQ ID NO: 6903212 - DNA, 22 bp, Homo sapiens
acaactttgacccttgttctta

SEQ ID NO: 6903213 - DNA, 22 bp, Homo sapiens
cctacattctctgagttttcct

SEQ ID NO: 6903214 - DNA, 22 bp, Homo sapiens
tgattctcttgtaagctatgtt

SEQ ID NO: 6903215 - DNA, 19 bp, Homo sapiens
ggtttatctgtttcttctc

SEQ ID NO: 6903216 - DNA, 22 bp, Homo sapiens
agactaagcggttcttttcaat

SEQ ID NO: 6903217 - DNA, 22 bp, Homo sapiens
agctgcctgtgtagaaccatct

SEQ ID NO: 6903218 - DNA, 20 bp, Homo sapiens
ggatggccggaccagagcct

SEQ ID NO: 6903219 - DNA, 22 bp, Homo sapiens
ttgcaaattcgtcactgttaaa

SEQ ID NO: 6903220 - DNA, 22 bp, Homo sapiens
ccagctgagaagtgtaaagtga

SEQ ID NO: 6903221 - DNA, 22 bp, Homo sapiens
agtgatgggtaatgggaacaga

SEQ ID NO: 6903222 - DNA, 22 bp, Homo sapiens
acaactgttagacacttctaag

SEQ ID NO: 6903223 - DNA, 23 bp, Homo sapiens
aagtaacagggataatagcagtt

SEQ ID NO: 6903224 - DNA, 22 bp, Homo sapiens
tggccttgattatgccagtaga

SEQ ID NO: 6903225 - DNA, 22 bp, Homo sapiens
agaagcagcaagcccttcaaag

SEQ ID NO: 6903226 - DNA, 22 bp, Homo sapiens
tctgccagctctgtgggtctcg

SEQ ID NO: 6903227 - DNA, 22 bp, Homo sapiens
tgggtcctcgtcttccaaggca

SEQ ID NO: 6903228 - DNA, 22 bp, Homo sapiens
tgttcacacagtctatacggat

SEQ ID NO: 6903229 - DNA, 22 bp, Homo sapiens
tttgttcatgcctatattctca

SEQ ID NO: 6903230 - DNA, 19 bp, Homo sapiens
taatactggctgtagctgg

SEQ ID NO: 6903231 - DNA, 22 bp, Homo sapiens
gttacataggtgtgttcagttt

SEQ ID NO: 6903232 - DNA, 19 bp, Homo sapiens
tttctgcagcccagcagca

SEQ ID NO: 6903233 - DNA, 22 bp, Homo sapiens
gagccacagcaacctcaaagga

SEQ ID NO: 6903234 - DNA, 22 bp, Homo sapiens
tgttactttgattggtattcta

SEQ ID NO: 6903235 - DNA, 23 bp, Homo sapiens
gcctggattaaggcagtgacttc

SEQ ID NO: 6903236 - DNA, 22 bp, Homo sapiens
gaagtccgggaggatcatgttc

SEQ ID NO: 6903237 - DNA, 22 bp, Homo sapiens
aggaattttaatatgcttgtct

SEQ ID NO: 6903238 - DNA, 22 bp, Homo sapiens
ttgattcatcttctaataccca

SEQ ID NO: 6903239 - DNA, 21 bp, Homo sapiens
aagaggaagcattatggcata

SEQ ID NO: 6903240 - DNA, 22 bp, Homo sapiens
tgagccagaggaggctgtgtgg

SEQ ID NO: 6903241 - DNA, 22 bp, Homo sapiens
aggaagtgggaagggtctgcca

SEQ ID NO: 6903242 - DNA, 22 bp, Homo sapiens
gttattagaagtgaaggattgt

SEQ ID NO: 6903243 - DNA, 22 bp, Homo sapiens
aagagtcatagagacattgatt

SEQ ID NO: 6903244 - DNA, 20 bp, Homo sapiens
tggctagcattaaaatgact

SEQ ID NO: 6903245 - DNA, 22 bp, Homo sapiens
tatttccatgttagaactaagt

SEQ ID NO: 6903246 - DNA, 22 bp, Homo sapiens
aacaatgccacattaagtgtat

SEQ ID NO: 6903247 - DNA, 22 bp, Homo sapiens
ggcagctttgagtcttagagta

SEQ ID NO: 6903248 - DNA, 16 bp, Homo sapiens
ggagctcctcgacttt

SEQ ID NO: 6903249 - DNA, 22 bp, Homo sapiens
agaagccacaggaaagcagctt

SEQ ID NO: 6903250 - DNA, 22 bp, Homo sapiens
ttgccctgcagcggtgagtggt

SEQ ID NO: 6903251 - DNA, 22 bp, Homo sapiens
tcagaggctgcatttttatcca

SEQ ID NO: 6903252 - DNA, 22 bp, Homo sapiens
tggcttaatttctctgtgcctc

SEQ ID NO: 6903253 - DNA, 22 bp, Homo sapiens
gaaagggcatgggcatgacaac

SEQ ID NO: 6903254 - DNA, 22 bp, Homo sapiens
ggacaccccgggtaccaggtct

SEQ ID NO: 6903255 - DNA, 22 bp, Homo sapiens
tctatgaagttcagagatctat

SEQ ID NO: 6903256 - DNA, 23 bp, Homo sapiens
catgggagtgagaatgccagctc

SEQ ID NO: 6903257 - DNA, 22 bp, Homo sapiens
ctccaggatgttagacgtccag

SEQ ID NO: 6903258 - DNA, 22 bp, Homo sapiens
ttccatatttgtgtggcaaaag

SEQ ID NO: 6903259 - DNA, 21 bp, Homo sapiens
gcagaggcacggcaccaaggg

SEQ ID NO: 6903260 - DNA, 22 bp, Homo sapiens
gtgggcagcctcctttattttc

SEQ ID NO: 6903261 - DNA, 17 bp, Homo sapiens
tagagctggttcaggag

SEQ ID NO: 6903262 - DNA, 23 bp, Homo sapiens
agctccagctgacgtgggcagcc

SEQ ID NO: 6903263 - DNA, 22 bp, Homo sapiens
gaaggctggggcatcagtgaaa

SEQ ID NO: 6903264 - DNA, 22 bp, Homo sapiens
ggaatctagaaagggagcaagg

SEQ ID NO: 6903265 - DNA, 22 bp, Homo sapiens
atggttttcctctgctgcttaa

SEQ ID NO: 6903266 - DNA, 22 bp, Homo sapiens
tggcattttgttcagtatatgg

SEQ ID NO: 6903267 - DNA, 22 bp, Homo sapiens
atcatgttgctcaaaattaaac

SEQ ID NO: 6903268 - DNA, 22 bp, Homo sapiens
gtgctctaataaagcctgacat

SEQ ID NO: 6903269 - DNA, 22 bp, Homo sapiens
agctgcctagtagattgattgg

SEQ ID NO: 6903270 - DNA, 22 bp, Homo sapiens
gcctggcccagggctccgcagg

SEQ ID NO: 6903271 - DNA, 22 bp, Homo sapiens
gagtttagatggcattaaggta

SEQ ID NO: 6903272 - DNA, 22 bp, Homo sapiens
tgagttagtcactttgtacatc

SEQ ID NO: 6903273 - DNA, 22 bp, Homo sapiens
gaaggagccgagctcttcccca

SEQ ID NO: 6903274 - DNA, 22 bp, Homo sapiens
ttcatgtgatcacagattgtaa

SEQ ID NO: 6903275 - DNA, 22 bp, Homo sapiens
ctgcagtttcagcctttctggc

SEQ ID NO: 6903276 - DNA, 22 bp, Homo sapiens
gctttggaatctgcatcctctt

SEQ ID NO: 6903277 - DNA, 22 bp, Homo sapiens
tctgaggcagcttgccactcta

SEQ ID NO: 6903278 - DNA, 22 bp, Homo sapiens
tgtgtggcaagctgtatgctag

SEQ ID NO: 6903279 - DNA, 22 bp, Homo sapiens
gacagagccagttggaggtagg

SEQ ID NO: 6903280 - DNA, 22 bp, Homo sapiens
ttcattacattcaaaaggcatt

SEQ ID NO: 6903281 - DNA, 22 bp, Homo sapiens
agttaataatggaaagacacat

SEQ ID NO: 6903282 - DNA, 22 bp, Homo sapiens
tgacatgcttgttttccttgaa

SEQ ID NO: 6903283 - DNA, 22 bp, Homo sapiens
agagagctctgctgctgcccag

SEQ ID NO: 6903284 - DNA, 22 bp, Homo sapiens
tcataacaggctgagaggattt

SEQ ID NO: 6903285 - DNA, 22 bp, Homo sapiens
gggcctcactatgtggtccagg

SEQ ID NO: 6903286 - DNA, 22 bp, Homo sapiens
ctgtccatggcaatgatgcaga

SEQ ID NO: 6903287 - DNA, 22 bp, Homo sapiens
cagcccaggtctctcttccagt

SEQ ID NO: 6903288 - DNA, 22 bp, Homo sapiens
aggatttacctccagctaggct

SEQ ID NO: 6903289 - DNA, 22 bp, Homo sapiens
tcctgtgtaaatagatctggtt

SEQ ID NO: 6903290 - DNA, 22 bp, Homo sapiens
taggtctctcttcttgatggga

SEQ ID NO: 6903291 - DNA, 22 bp, Homo sapiens
ctctgtgtcagctgggtgtgca

SEQ ID NO: 6903292 - DNA, 22 bp, Homo sapiens
tgcaggaaacagaggctcaaat

SEQ ID NO: 6903293 - DNA, 22 bp, Homo sapiens
gaagtcttcattctctctgaga

SEQ ID NO: 6903294 - DNA, 22 bp, Homo sapiens
agagttactgcagagatgaata

SEQ ID NO: 6903295 - DNA, 22 bp, Homo sapiens
cgtgattggcttctgcattgga

SEQ ID NO: 6903296 - DNA, 22 bp, Homo sapiens
ggaggcctagccagctccagtt

SEQ ID NO: 6903297 - DNA, 22 bp, Homo sapiens
aataaatgaacaaagcaggttg

SEQ ID NO: 6903298 - DNA, 19 bp, Homo sapiens
acacatgtgtgttatgtgc

SEQ ID NO: 6903299 - DNA, 18 bp, Homo sapiens
agagagaattccagtagg

SEQ ID NO: 6903300 - DNA, 22 bp, Homo sapiens
tgggaactgtactgccttgaac

SEQ ID NO: 6903301 - DNA, 22 bp, Homo sapiens
aaggtggcggctgccaggtcct

SEQ ID NO: 6903302 - DNA, 22 bp, Homo sapiens
ggcaaactacatttttgaaata

SEQ ID NO: 6903303 - DNA, 22 bp, Homo sapiens
gctcccaccaggcagacctacc

SEQ ID NO: 6903304 - DNA, 22 bp, Homo sapiens
cctctgttgaaaattacaaaca

SEQ ID NO: 6903305 - DNA, 22 bp, Homo sapiens
agctgctatgagaaaggcactg

SEQ ID NO: 6903306 - DNA, 22 bp, Homo sapiens
gcagaatactgagagctgattg

SEQ ID NO: 6903307 - DNA, 22 bp, Homo sapiens
attcccagatttatattgatag

SEQ ID NO: 6903308 - DNA, 22 bp, Homo sapiens
aacacttctgttgataataagc

SEQ ID NO: 6903309 - DNA, 22 bp, Homo sapiens
cttccccaggacctctgctaaa

SEQ ID NO: 6903310 - DNA, 19 bp, Homo sapiens
aactagaaaggttttgaga

SEQ ID NO: 6903311 - DNA, 22 bp, Homo sapiens
aggtgaacccaggtgcttcacg

SEQ ID NO: 6903312 - DNA, 22 bp, Homo sapiens
tgcatacacacatcaaatgttt

SEQ ID NO: 6903313 - DNA, 17 bp, Homo sapiens
tcggtttgccaggcttc

SEQ ID NO: 6903314 - DNA, 22 bp, Homo sapiens
atatgcattaacattgtaggag

SEQ ID NO: 6903315 - DNA, 22 bp, Homo sapiens
gcctggctgtcaaacccagaag

SEQ ID NO: 6903316 - DNA, 22 bp, Homo sapiens
ggacaggcctggcacagtactg

SEQ ID NO: 6903317 - DNA, 22 bp, Homo sapiens
catgtgcagactctgacaggct

SEQ ID NO: 6903318 - DNA, 22 bp, Homo sapiens
tgggggcatggaccagcctggc

SEQ ID NO: 6903319 - DNA, 22 bp, Homo sapiens
ggctctggcaaggggaggctac

SEQ ID NO: 6903320 - DNA, 22 bp, Homo sapiens
tgaattgactggctcagaattg

SEQ ID NO: 6903321 - DNA, 22 bp, Homo sapiens
tcaggtccaagatggccatcca

SEQ ID NO: 6903322 - DNA, 22 bp, Homo sapiens
ttagtgattactacatagatga

SEQ ID NO: 6903323 - DNA, 22 bp, Homo sapiens
agatacaaaagataagatttag

SEQ ID NO: 6903324 - DNA, 17 bp, Homo sapiens
aagtccagcctgcagct

SEQ ID NO: 6903325 - DNA, 22 bp, Homo sapiens
ggaggaagggtagcataatgta

SEQ ID NO: 6903326 - DNA, 22 bp, Homo sapiens
ctcaggcaaggcccgcattctc

SEQ ID NO: 6903327 - DNA, 22 bp, Homo sapiens
ggcaggctagcactgatgtcct

SEQ ID NO: 6903328 - DNA, 22 bp, Homo sapiens
ataaggtatgagcaatgagttt

SEQ ID NO: 6903329 - DNA, 22 bp, Homo sapiens
tacactgagatgactttggttt

SEQ ID NO: 6903330 - DNA, 22 bp, Homo sapiens
actgtaaaggtttgtagcccag

SEQ ID NO: 6903331 - DNA, 21 bp, Homo sapiens
agattcataatctgtaaaatg

SEQ ID NO: 6903332 - DNA, 18 bp, Homo sapiens
acagaggcagacatgtat

SEQ ID NO: 6903333 - DNA, 22 bp, Homo sapiens
ctgtgcagtgtggggtaggcct

SEQ ID NO: 6903334 - DNA, 22 bp, Homo sapiens
aagcaaattggatgtctgtgag

SEQ ID NO: 6903335 - DNA, 22 bp, Homo sapiens
gcctggcttgccagccctggcg

SEQ ID NO: 6903336 - DNA, 23 bp, Homo sapiens
cttcacaggttcaggggattaag

SEQ ID NO: 6903337 - DNA, 22 bp, Homo sapiens
caagaggattattaataaataa

SEQ ID NO: 6903338 - DNA, 22 bp, Homo sapiens
taatgatgtgtgcaaactgaat

SEQ ID NO: 6903339 - DNA, 23 bp, Homo sapiens
tgggtgctaatctgctctgtgga

SEQ ID NO: 6903340 - DNA, 22 bp, Homo sapiens
ttgcttaattctgaaaatatag

SEQ ID NO: 6903341 - DNA, 22 bp, Homo sapiens
gtcctggtgctggtcattgtcg

SEQ ID NO: 6903342 - DNA, 22 bp, Homo sapiens
aaggagacttggcatcacttaa

SEQ ID NO: 6903343 - DNA, 22 bp, Homo sapiens
ttcccagtgaggaagcaatgca

SEQ ID NO: 6903344 - DNA, 18 bp, Homo sapiens
gcgggcggtgcagtgggc

SEQ ID NO: 6903345 - DNA, 22 bp, Homo sapiens
ggcggcttattcactctgggga

SEQ ID NO: 6903346 - DNA, 22 bp, Homo sapiens
agtaaacagtttcttagaagaa

SEQ ID NO: 6903347 - DNA, 22 bp, Homo sapiens
ctggagctgtcttcacaggcct

SEQ ID NO: 6903348 - DNA, 22 bp, Homo sapiens
agagcatccatcggccaggacc

SEQ ID NO: 6903349 - DNA, 22 bp, Homo sapiens
gctgggagacagacttggaacc

SEQ ID NO: 6903350 - DNA, 22 bp, Homo sapiens
gtgttcatcccaatgctgatag

SEQ ID NO: 6903351 - DNA, 22 bp, Homo sapiens
gtgtgcctatgagtggtgaaca

SEQ ID NO: 6903352 - DNA, 22 bp, Homo sapiens
tctcctctcttacctggtacaa

SEQ ID NO: 6903353 - DNA, 22 bp, Homo sapiens
catgctaaccagagacataaag

SEQ ID NO: 6903354 - DNA, 22 bp, Homo sapiens
ttatcttagaggtgattgtatt

SEQ ID NO: 6903355 - DNA, 22 bp, Homo sapiens
cctgtttatctatctagagatg

SEQ ID NO: 6903356 - DNA, 21 bp, Homo sapiens
tgactgaaatagaatttagct

SEQ ID NO: 6903357 - DNA, 22 bp, Homo sapiens
accctgaggggtatagcagaag

SEQ ID NO: 6903358 - DNA, 22 bp, Homo sapiens
cacaggaatctgcattttgacc

SEQ ID NO: 6903359 - DNA, 22 bp, Homo sapiens
tgtatttcaattttagcaccaa

SEQ ID NO: 6903360 - DNA, 22 bp, Homo sapiens
tgggttagggcctggtctctga

SEQ ID NO: 6903361 - DNA, 22 bp, Homo sapiens
gccgtggcttctccagctggct

SEQ ID NO: 6903362 - DNA, 22 bp, Homo sapiens
agctctgagttggggaggagca

SEQ ID NO: 6903363 - DNA, 22 bp, Homo sapiens
ctggaaggtctgtccccactgc

SEQ ID NO: 6903364 - DNA, 22 bp, Homo sapiens
gaggttagtgatttgtcattga

SEQ ID NO: 6903365 - DNA, 22 bp, Homo sapiens
aatcagtattggtatagaatga

SEQ ID NO: 6903366 - DNA, 22 bp, Homo sapiens
atgggtagactgacaaagtcaa

SEQ ID NO: 6903367 - DNA, 21 bp, Homo sapiens
gaccaaagggctggcactgcc

SEQ ID NO: 6903368 - DNA, 22 bp, Homo sapiens
ggaggtatgatagctgtgtcct

SEQ ID NO: 6903369 - DNA, 22 bp, Homo sapiens
acttccagcccctgtcagcaaa

SEQ ID NO: 6903370 - DNA, 22 bp, Homo sapiens
gcagcagtgctttggaatcctg

SEQ ID NO: 6903371 - DNA, 22 bp, Homo sapiens
tgtggcaaagaccatttctttc

SEQ ID NO: 6903372 - DNA, 20 bp, Homo sapiens
atgccaagctatctagaatc

SEQ ID NO: 6903373 - DNA, 22 bp, Homo sapiens
ctcagtagaaaatacatggact

SEQ ID NO: 6903374 - DNA, 22 bp, Homo sapiens
agagaagtgtcatttcagtttt

SEQ ID NO: 6903375 - DNA, 22 bp, Homo sapiens
tgactaaacgcatgaatagctc

SEQ ID NO: 6903376 - DNA, 22 bp, Homo sapiens
attattatggttgctcttttcc

SEQ ID NO: 6903377 - DNA, 18 bp, Homo sapiens
tcctggtattgcaagcac

SEQ ID NO: 6903378 - DNA, 22 bp, Homo sapiens
tctgtggcctgcctcctcattt

SEQ ID NO: 6903379 - DNA, 22 bp, Homo sapiens
tagacagtgagctatgagtggt

SEQ ID NO: 6903380 - DNA, 22 bp, Homo sapiens
tcatgcagcttttccattcagc

SEQ ID NO: 6903381 - DNA, 22 bp, Homo sapiens
ggatgcaggacggcatggatgt

SEQ ID NO: 6903382 - DNA, 20 bp, Homo sapiens
ctgctctgctttgcaggtgg

SEQ ID NO: 6903383 - DNA, 22 bp, Homo sapiens
accaagagtccaagtgaggttg

SEQ ID NO: 6903384 - DNA, 22 bp, Homo sapiens
atttgtgcatatcccatccacc

SEQ ID NO: 6903385 - DNA, 22 bp, Homo sapiens
tgcaaacaatttcctataaagt

SEQ ID NO: 6903386 - DNA, 22 bp, Homo sapiens
atattctgggttagatatgttt

SEQ ID NO: 6903387 - DNA, 22 bp, Homo sapiens
accaggctctgccagtgtttac

SEQ ID NO: 6903388 - DNA, 22 bp, Homo sapiens
gtgctgaggatataaaactcag

SEQ ID NO: 6903389 - DNA, 21 bp, Homo sapiens
atactacatttctctgacttt

SEQ ID NO: 6903390 - DNA, 21 bp, Homo sapiens
ttctcagagtctattacagtt

SEQ ID NO: 6903391 - DNA, 22 bp, Homo sapiens
tctggctctgacactactgtta

SEQ ID NO: 6903392 - DNA, 21 bp, Homo sapiens
tagaactgacgatttcagagt

SEQ ID NO: 6903393 - DNA, 22 bp, Homo sapiens
tccacagatgcctttaggagta

SEQ ID NO: 6903394 - DNA, 22 bp, Homo sapiens
atggctgtgaaggtcacaccct

SEQ ID NO: 6903395 - DNA, 21 bp, Homo sapiens
tgcaggaaagtgctgcgaccc

SEQ ID NO: 6903396 - DNA, 22 bp, Homo sapiens
agtgtgtactcatatacttcca

SEQ ID NO: 6903397 - DNA, 22 bp, Homo sapiens
aaactgaggcaggggatgatta

SEQ ID NO: 6903398 - DNA, 22 bp, Homo sapiens
agagagcagtctggaagaaaca

SEQ ID NO: 6903399 - DNA, 22 bp, Homo sapiens
tgggctcaagtgatgctcctgt

SEQ ID NO: 6903400 - DNA, 22 bp, Homo sapiens
gcctggtggtatcctggcaaga

SEQ ID NO: 6903401 - DNA, 22 bp, Homo sapiens
atgtcaaatgctgcaaactcat

SEQ ID NO: 6903402 - DNA, 22 bp, Homo sapiens
tctgcaggatgcaaagtgtaca

SEQ ID NO: 6903403 - DNA, 22 bp, Homo sapiens
cttctgactctgtttttgagca

SEQ ID NO: 6903404 - DNA, 22 bp, Homo sapiens
agtcccagcctgtaggattggg

SEQ ID NO: 6903405 - DNA, 22 bp, Homo sapiens
tgtcatgttttcctacaaggta

SEQ ID NO: 6903406 - DNA, 22 bp, Homo sapiens
agcacaatataaagtgaacgca

SEQ ID NO: 6903407 - DNA, 22 bp, Homo sapiens
gctgctctcatagatggcttca

SEQ ID NO: 6903408 - DNA, 22 bp, Homo sapiens
tcttctccagttcatcctacca

SEQ ID NO: 6903409 - DNA, 22 bp, Homo sapiens
ggcagcgcccgagtccgcagct

SEQ ID NO: 6903410 - DNA, 22 bp, Homo sapiens
atatttcaggttttgcaggccg

SEQ ID NO: 6903411 - DNA, 22 bp, Homo sapiens
cagttagtaaagcttgttcatg

SEQ ID NO: 6903412 - DNA, 22 bp, Homo sapiens
tagcaaggacaacatatgagag

SEQ ID NO: 6903413 - DNA, 22 bp, Homo sapiens
ggcagctttccttatcctaggg

SEQ ID NO: 6903414 - DNA, 22 bp, Homo sapiens
tacattgcttatttgatagtac

SEQ ID NO: 6903415 - DNA, 22 bp, Homo sapiens
cccaggaggcagaggttggagc

SEQ ID NO: 6903416 - DNA, 22 bp, Homo sapiens
gtcagtcatattgtacagatat

SEQ ID NO: 6903417 - DNA, 22 bp, Homo sapiens
acagatccttcttctgcattgc

SEQ ID NO: 6903418 - DNA, 22 bp, Homo sapiens
aactgctgtggcctagtactta

SEQ ID NO: 6903419 - DNA, 22 bp, Homo sapiens
ccatttgtcacctctgcactcc

SEQ ID NO: 6903420 - DNA, 20 bp, Homo sapiens
gcagatgagactcacagagg

SEQ ID NO: 6903421 - DNA, 22 bp, Homo sapiens
tgtgtgttaacttatttaatgt

SEQ ID NO: 6903422 - DNA, 22 bp, Homo sapiens
tgcattgcatagcatgcaccaa

SEQ ID NO: 6903423 - DNA, 19 bp, Homo sapiens
ttcagacagactaggtata

SEQ ID NO: 6903424 - DNA, 22 bp, Homo sapiens
agttcttacaggggacctttga

SEQ ID NO: 6903425 - DNA, 22 bp, Homo sapiens
ctgggctgtttgtttagaatgg

SEQ ID NO: 6903426 - DNA, 21 bp, Homo sapiens
agttacaagtttattcagagg

SEQ ID NO: 6903427 - DNA, 19 bp, Homo sapiens
agtctggtggcgtgcatgt

SEQ ID NO: 6903428 - DNA, 22 bp, Homo sapiens
gctgtgcataagtataataaac

SEQ ID NO: 6903429 - DNA, 22 bp, Homo sapiens
attttaataagattcccaagta

SEQ ID NO: 6903430 - DNA, 22 bp, Homo sapiens
aaaactcaaacattttggcata

SEQ ID NO: 6903431 - DNA, 22 bp, Homo sapiens
tcagcagtgtgcccagaggctg

SEQ ID NO: 6903432 - DNA, 22 bp, Homo sapiens
tccaggtaatttggatgctagt

SEQ ID NO: 6903433 - DNA, 22 bp, Homo sapiens
atctggaggattctgggacttg

SEQ ID NO: 6903434 - DNA, 17 bp, Homo sapiens
agcctgctgatctcaca

SEQ ID NO: 6903435 - DNA, 22 bp, Homo sapiens
gggctgatgtgctcccaggtgg

SEQ ID NO: 6903436 - DNA, 20 bp, Homo sapiens
tagctgcacagccctaggag

SEQ ID NO: 6903437 - DNA, 21 bp, Homo sapiens
agtagtatcctggagggacaa

SEQ ID NO: 6903438 - DNA, 22 bp, Homo sapiens
cctgagaatgtttaacagagaa

SEQ ID NO: 6903439 - DNA, 22 bp, Homo sapiens
actgtactttagaaagtgtagt

SEQ ID NO: 6903440 - DNA, 19 bp, Homo sapiens
tttgtaagtccttactgat

SEQ ID NO: 6903441 - DNA, 22 bp, Homo sapiens
cagtggttatacttactgtttc

SEQ ID NO: 6903442 - DNA, 22 bp, Homo sapiens
attcagtattcttgaaaggttc

SEQ ID NO: 6903443 - DNA, 19 bp, Homo sapiens
actagatacaacatgcaga

SEQ ID NO: 6903444 - DNA, 20 bp, Homo sapiens
agcagcattgttctagagca

SEQ ID NO: 6903445 - DNA, 22 bp, Homo sapiens
gctgcctgcctagttccacagt

SEQ ID NO: 6903446 - DNA, 22 bp, Homo sapiens
tctgagcatatgcagcacctgg

SEQ ID NO: 6903447 - DNA, 22 bp, Homo sapiens
ctcattcattcccgcagccacc

SEQ ID NO: 6903448 - DNA, 22 bp, Homo sapiens
ttcagacatgcaggctgaggct

SEQ ID NO: 6903449 - DNA, 22 bp, Homo sapiens
aggaaactaaggctcagtgaag

SEQ ID NO: 6903450 - DNA, 22 bp, Homo sapiens
tgggttcgatgtatatgtagcc

SEQ ID NO: 6903451 - DNA, 22 bp, Homo sapiens
tcccagaaaaaggaggctatga

SEQ ID NO: 6903452 - DNA, 22 bp, Homo sapiens
agttaagagtgtgaaaatgtta

SEQ ID NO: 6903453 - DNA, 22 bp, Homo sapiens
tcacagtgagccatgtcagaga

SEQ ID NO: 6903454 - DNA, 22 bp, Homo sapiens
ctactgtagttaaagttttgta

SEQ ID NO: 6903455 - DNA, 22 bp, Homo sapiens
aaggccatacaatgaaaggggc

SEQ ID NO: 6903456 - DNA, 22 bp, Homo sapiens
tgggctctctggcaggaaggct

SEQ ID NO: 6903457 - DNA, 22 bp, Homo sapiens
caggggacagtatggtggatga

SEQ ID NO: 6903458 - DNA, 22 bp, Homo sapiens
ctccaggagggcttcctgtgat

SEQ ID NO: 6903459 - DNA, 22 bp, Homo sapiens
aatatttctgtagctatgttct

SEQ ID NO: 6903460 - DNA, 22 bp, Homo sapiens
tcatctgttgattttaagtctt

SEQ ID NO: 6903461 - DNA, 22 bp, Homo sapiens
gaaaggctaaaattataagggt

SEQ ID NO: 6903462 - DNA, 22 bp, Homo sapiens
cccagtggcaaagcagcttaga

SEQ ID NO: 6903463 - DNA, 22 bp, Homo sapiens
tgaaggcaactgagaaaaagca

SEQ ID NO: 6903464 - DNA, 22 bp, Homo sapiens
agatcaaaaacttaatggcttt

SEQ ID NO: 6903465 - DNA, 22 bp, Homo sapiens
ctctggccgcagctcagctctg

SEQ ID NO: 6903466 - DNA, 22 bp, Homo sapiens
tctgggaagcaaatatgtaaga

SEQ ID NO: 6903467 - DNA, 22 bp, Homo sapiens
agaaaataaattgatggtggaa

SEQ ID NO: 6903468 - DNA, 22 bp, Homo sapiens
agtgccctgctggggcaggaga

SEQ ID NO: 6903469 - DNA, 22 bp, Homo sapiens
caggtgtttcaatcccaagtca

SEQ ID NO: 6903470 - DNA, 22 bp, Homo sapiens
aggggcgtctgtaggcagtggg

SEQ ID NO: 6903471 - DNA, 22 bp, Homo sapiens
tacaagtgtggctcctctgtct

SEQ ID NO: 6903472 - DNA, 22 bp, Homo sapiens
cacaggcagccttgtagaagaa

SEQ ID NO: 6903473 - DNA, 22 bp, Homo sapiens
cctgcctggctgtcagcagagc

SEQ ID NO: 6903474 - DNA, 22 bp, Homo sapiens
tgagaaatccagatgtgcagtt

SEQ ID NO: 6903475 - DNA, 22 bp, Homo sapiens
gcgtctgagttgcgggggctca

SEQ ID NO: 6903476 - DNA, 22 bp, Homo sapiens
agctccctgagatgccacagca

SEQ ID NO: 6903477 - DNA, 22 bp, Homo sapiens
agatcacagtcaattgcaagtt

SEQ ID NO: 6903478 - DNA, 22 bp, Homo sapiens
tgagttctagtggctgcagatt

SEQ ID NO: 6903479 - DNA, 22 bp, Homo sapiens
cagtttcttatcttcaaaattg

SEQ ID NO: 6903480 - DNA, 22 bp, Homo sapiens
caggaatggttaatctaaagtg

SEQ ID NO: 6903481 - DNA, 22 bp, Homo sapiens
tggtcagcgtttgtcagagcag

SEQ ID NO: 6903482 - DNA, 22 bp, Homo sapiens
cctcagggttcggatgagaaca

SEQ ID NO: 6903483 - DNA, 22 bp, Homo sapiens
ccatcacagtccccatcgtgat

SEQ ID NO: 6903484 - DNA, 22 bp, Homo sapiens
ttattgtcaaaaacaggacact

SEQ ID NO: 6903485 - DNA, 22 bp, Homo sapiens
atactgaattaggtaaagcata

SEQ ID NO: 6903486 - DNA, 22 bp, Homo sapiens
cagaaatatgtgccatgcctta

SEQ ID NO: 6903487 - DNA, 22 bp, Homo sapiens
tggcaatttcacatggcttaac

SEQ ID NO: 6903488 - DNA, 22 bp, Homo sapiens
ttagaaccactgaagactcaca

SEQ ID NO: 6903489 - DNA, 22 bp, Homo sapiens
aggctttgtacctggggtctta

SEQ ID NO: 6903490 - DNA, 22 bp, Homo sapiens
tgcagacagagaaatgaggccc

SEQ ID NO: 6903491 - DNA, 17 bp, Homo sapiens
cccgttctcttcgctgg

SEQ ID NO: 6903492 - DNA, 22 bp, Homo sapiens
tgccctgcagtgagtgcgtctg

SEQ ID NO: 6903493 - DNA, 23 bp, Homo sapiens
tggccctgtgcatgctgcttccc

SEQ ID NO: 6903494 - DNA, 22 bp, Homo sapiens
cagctgttcagcaactcgcaga

SEQ ID NO: 6903495 - DNA, 22 bp, Homo sapiens
gtccacttcaggactggccgct

SEQ ID NO: 6903496 - DNA, 22 bp, Homo sapiens
gtgtgtggggccttcgggtcct

SEQ ID NO: 6903497 - DNA, 22 bp, Homo sapiens
agaagcagggcagggaaaagca

SEQ ID NO: 6903498 - DNA, 22 bp, Homo sapiens
ctgaggcacagtgaacttctcc

SEQ ID NO: 6903499 - DNA, 22 bp, Homo sapiens
aaagcacttcaggagcagtttg

SEQ ID NO: 6903500 - DNA, 22 bp, Homo sapiens
taagcaaagtttataaggctct

SEQ ID NO: 6903501 - DNA, 22 bp, Homo sapiens
cctccctctgttagagctgtct

SEQ ID NO: 6903502 - DNA, 22 bp, Homo sapiens
ggctgagtggaggtagccctgt

SEQ ID NO: 6903503 - DNA, 22 bp, Homo sapiens
agagacagacacatcgggctgc

SEQ ID NO: 6903504 - DNA, 21 bp, Homo sapiens
gtcaggttttgtatcaatatt

SEQ ID NO: 6903505 - DNA, 20 bp, Homo sapiens
tacatgagccctggcctcac

SEQ ID NO: 6903506 - DNA, 22 bp, Homo sapiens
aatcaacattgttttaagtcaa

SEQ ID NO: 6903507 - DNA, 22 bp, Homo sapiens
acagatagcactaagggatctg

SEQ ID NO: 6903508 - DNA, 22 bp, Homo sapiens
ggtatactgcatgacattgggg

SEQ ID NO: 6903509 - DNA, 22 bp, Homo sapiens
cagtgcctgccttttattttgt

SEQ ID NO: 6903510 - DNA, 22 bp, Homo sapiens
ccacctctgagcccaaaccctg

SEQ ID NO: 6903511 - DNA, 22 bp, Homo sapiens
tgatactttggagacttgagta

SEQ ID NO: 6903512 - DNA, 22 bp, Homo sapiens
aagattctagaggaacttctta

SEQ ID NO: 6903513 - DNA, 22 bp, Homo sapiens
acatttggacaatagtagacaa

SEQ ID NO: 6903514 - DNA, 22 bp, Homo sapiens
tgaaggcatttgagttggtgag

SEQ ID NO: 6903515 - DNA, 22 bp, Homo sapiens
gaattgctgatgaatctgattg

SEQ ID NO: 6903516 - DNA, 22 bp, Homo sapiens
atgacgtgtcactttgtaagaa

SEQ ID NO: 6903517 - DNA, 22 bp, Homo sapiens
acctagaatttaaaacattgct

SEQ ID NO: 6903518 - DNA, 22 bp, Homo sapiens
gaaaggagtcagtcttactgaa

SEQ ID NO: 6903519 - DNA, 18 bp, Homo sapiens
gccaggaagaggaatgtg

SEQ ID NO: 6903520 - DNA, 22 bp, Homo sapiens
gtggcagaggttcctcagtgtg

SEQ ID NO: 6903521 - DNA, 22 bp, Homo sapiens
tgcatcttcagtaggaactctc

SEQ ID NO: 6903522 - DNA, 22 bp, Homo sapiens
tctggtccctgtgtcacctctc

SEQ ID NO: 6903523 - DNA, 22 bp, Homo sapiens
ttctgaaaggcaggttgtttgc

SEQ ID NO: 6903524 - DNA, 22 bp, Homo sapiens
gaatttaaggaccaagcatttt

SEQ ID NO: 6903525 - DNA, 22 bp, Homo sapiens
taacagagttgtacagttacgt

SEQ ID NO: 6903526 - DNA, 17 bp, Homo sapiens
cttggctgctgtgcgat

SEQ ID NO: 6903527 - DNA, 21 bp, Homo sapiens
ctgtttatttcacctgggtgc

SEQ ID NO: 6903528 - DNA, 22 bp, Homo sapiens
cggggccctggggctgaaggtc

SEQ ID NO: 6903529 - DNA, 22 bp, Homo sapiens
atcagacagggaattatagcag

SEQ ID NO: 6903530 - DNA, 22 bp, Homo sapiens
agctactactaccaaactaaag

SEQ ID NO: 6903531 - DNA, 22 bp, Homo sapiens
agctgccatcctgttcagcacc

SEQ ID NO: 6903532 - DNA, 22 bp, Homo sapiens
aagcagcatgtgggttatcggg

SEQ ID NO: 6903533 - DNA, 22 bp, Homo sapiens
tgccaccaggagaaccagtgca

SEQ ID NO: 6903534 - DNA, 22 bp, Homo sapiens
aatgggctcacaagacctgaat

SEQ ID NO: 6903535 - DNA, 22 bp, Homo sapiens
gccttaatacagatgggtggtg

SEQ ID NO: 6903536 - DNA, 22 bp, Homo sapiens
tcagtggagtatggatgaagtc

SEQ ID NO: 6903537 - DNA, 22 bp, Homo sapiens
aagtagcaatctcattagttgg

SEQ ID NO: 6903538 - DNA, 22 bp, Homo sapiens
ccctgagtcatcattgcggaag

SEQ ID NO: 6903539 - DNA, 22 bp, Homo sapiens
aaattcactctgttcctcatgg

SEQ ID NO: 6903540 - DNA, 22 bp, Homo sapiens
gctgccagtgtggcatgatgca

SEQ ID NO: 6903541 - DNA, 22 bp, Homo sapiens
agaaatgttgtgggttttgtta

SEQ ID NO: 6903542 - DNA, 22 bp, Homo sapiens
cagcaagtcatccaggatgatg

SEQ ID NO: 6903543 - DNA, 22 bp, Homo sapiens
ctagattctttctactattatc

SEQ ID NO: 6903544 - DNA, 22 bp, Homo sapiens
ggctggaaggtagaagatgagg

SEQ ID NO: 6903545 - DNA, 22 bp, Homo sapiens
tggtctgaggaacaccagcact

SEQ ID NO: 6903546 - DNA, 22 bp, Homo sapiens
agtgtactgctgcggccgggac

SEQ ID NO: 6903547 - DNA, 22 bp, Homo sapiens
actgaacagcctttcaaactta

SEQ ID NO: 6903548 - DNA, 22 bp, Homo sapiens
aagctgccttgctgaggagaaa

SEQ ID NO: 6903549 - DNA, 22 bp, Homo sapiens
ctgtatggtccacgtgggtgcc

SEQ ID NO: 6903550 - DNA, 22 bp, Homo sapiens
aaagaatctatatatcaccacc

SEQ ID NO: 6903551 - DNA, 22 bp, Homo sapiens
ataaatagtgtgtcataaagtc

SEQ ID NO: 6903552 - DNA, 22 bp, Homo sapiens
tcacattttatatctctggttt

SEQ ID NO: 6903553 - DNA, 22 bp, Homo sapiens
cacagggaaccaaggctgggcc

SEQ ID NO: 6903554 - DNA, 22 bp, Homo sapiens
gttcattgtcatgtttcattgc

SEQ ID NO: 6903555 - DNA, 22 bp, Homo sapiens
ccagtgtatttttgggacctgc

SEQ ID NO: 6903556 - DNA, 22 bp, Homo sapiens
tgggccagcaattgctgctcag

SEQ ID NO: 6903557 - DNA, 22 bp, Homo sapiens
aatgaacatcaaatgcctacca

SEQ ID NO: 6903558 - DNA, 22 bp, Homo sapiens
ggctcctgtcctcctggagctc

SEQ ID NO: 6903559 - DNA, 22 bp, Homo sapiens
gattgtgtctcactgtgatgct

SEQ ID NO: 6903560 - DNA, 23 bp, Homo sapiens
gacattggctgtctgatgcaggg

SEQ ID NO: 6903561 - DNA, 22 bp, Homo sapiens
aagctgcctagagttgaatgtc

SEQ ID NO: 6903562 - DNA, 17 bp, Homo sapiens
agagggctcaaggcatc

SEQ ID NO: 6903563 - DNA, 22 bp, Homo sapiens
gggcagtgtctggcccccaggc

SEQ ID NO: 6903564 - DNA, 22 bp, Homo sapiens
gggccagtagcacctgtgtgga

SEQ ID NO: 6903565 - DNA, 22 bp, Homo sapiens
ggcagccagcaatgagaagttt

SEQ ID NO: 6903566 - DNA, 22 bp, Homo sapiens
tagctttcagaatccactgagt

SEQ ID NO: 6903567 - DNA, 22 bp, Homo sapiens
ctgggtcataaacaatgcgtgt

SEQ ID NO: 6903568 - DNA, 22 bp, Homo sapiens
agccagttggctatgaggagga

SEQ ID NO: 6903569 - DNA, 22 bp, Homo sapiens
ttacactttaaatccagcttgt

SEQ ID NO: 6903570 - DNA, 22 bp, Homo sapiens
ctttggcagacattaggggtga

SEQ ID NO: 6903571 - DNA, 23 bp, Homo sapiens
tctgtgtcctcctggaccacaga

SEQ ID NO: 6903572 - DNA, 22 bp, Homo sapiens
atacaggttaagccaaggctgg

SEQ ID NO: 6903573 - DNA, 22 bp, Homo sapiens
atatgcttacagcttaaaatcc

SEQ ID NO: 6903574 - DNA, 22 bp, Homo sapiens
tgtggccagccacaggcatggt

SEQ ID NO: 6903575 - DNA, 22 bp, Homo sapiens
acttctctggttgaggtccaat

SEQ ID NO: 6903576 - DNA, 21 bp, Homo sapiens
ttccagaaatctctttcttca

SEQ ID NO: 6903577 - DNA, 22 bp, Homo sapiens
ggaaggctttgtagaagtgcca

SEQ ID NO: 6903578 - DNA, 19 bp, Homo sapiens
ccaggaacccctagctacc

SEQ ID NO: 6903579 - DNA, 22 bp, Homo sapiens
tgacatttaagcctctgatttc

SEQ ID NO: 6903580 - DNA, 22 bp, Homo sapiens
gcactgctatttagctccatca

SEQ ID NO: 6903581 - DNA, 22 bp, Homo sapiens
acttagcaatttgattaaaaga

SEQ ID NO: 6903582 - DNA, 22 bp, Homo sapiens
tgcctgtaataatgctaagcac

SEQ ID NO: 6903583 - DNA, 22 bp, Homo sapiens
caagattatcttcttcttgtta

SEQ ID NO: 6903584 - DNA, 22 bp, Homo sapiens
tagtgtacatgaaggagcctaa

SEQ ID NO: 6903585 - DNA, 22 bp, Homo sapiens
cacttctctgataatctcagtt

SEQ ID NO: 6903586 - DNA, 22 bp, Homo sapiens
acccaggaggtgacacagggct

SEQ ID NO: 6903587 - DNA, 22 bp, Homo sapiens
aatgtggacatctttgccttgt

SEQ ID NO: 6903588 - DNA, 22 bp, Homo sapiens
gcggaaatgcagggctagggtg

SEQ ID NO: 6903589 - DNA, 22 bp, Homo sapiens
ggagttcaggaaaggagccaga

SEQ ID NO: 6903590 - DNA, 22 bp, Homo sapiens
cccagagcataacgtatcttga

SEQ ID NO: 6903591 - DNA, 23 bp, Homo sapiens
gctgggcttactctttcagtgag

SEQ ID NO: 6903592 - DNA, 22 bp, Homo sapiens
ttcactgctacatccaggtgcc

SEQ ID NO: 6903593 - DNA, 22 bp, Homo sapiens
agggaaatggagagtgtagttt

SEQ ID NO: 6903594 - DNA, 22 bp, Homo sapiens
atagttttctatgcactgttat

SEQ ID NO: 6903595 - DNA, 22 bp, Homo sapiens
tcatgattaacatttccaagca

SEQ ID NO: 6903596 - DNA, 22 bp, Homo sapiens
gcatgcatggtttgtgactgtg

SEQ ID NO: 6903597 - DNA, 22 bp, Homo sapiens
tgaagtttcttgaatcttggag

SEQ ID NO: 6903598 - DNA, 22 bp, Homo sapiens
atatgctagtgtgcttatactt

SEQ ID NO: 6903599 - DNA, 22 bp, Homo sapiens
agattgtcactgttgacagggt

SEQ ID NO: 6903600 - DNA, 22 bp, Homo sapiens
tggggaaggcggagcttgcagc

SEQ ID NO: 6903601 - DNA, 22 bp, Homo sapiens
atggcattcacatttccagaga

SEQ ID NO: 6903602 - DNA, 22 bp, Homo sapiens
tgtgtgtactctccagtcctga

SEQ ID NO: 6903603 - DNA, 22 bp, Homo sapiens
aatctggtttgacaacttttgt

SEQ ID NO: 6903604 - DNA, 18 bp, Homo sapiens
tcttttgtcccctgctgc

SEQ ID NO: 6903605 - DNA, 22 bp, Homo sapiens
ggatgctgtctaagctgaggac

SEQ ID NO: 6903606 - DNA, 22 bp, Homo sapiens
tgtgagtactgctatttatata

SEQ ID NO: 6903607 - DNA, 22 bp, Homo sapiens
ctgcctgctctatccaggcctg

SEQ ID NO: 6903608 - DNA, 22 bp, Homo sapiens
cacatctactgatattccagga

SEQ ID NO: 6903609 - DNA, 22 bp, Homo sapiens
tgccagctactctgtaggctga

SEQ ID NO: 6903610 - DNA, 22 bp, Homo sapiens
ctttcagaagaggacctttcca

SEQ ID NO: 6903611 - DNA, 22 bp, Homo sapiens
aacatacttgtactatgcatat

SEQ ID NO: 6903612 - DNA, 22 bp, Homo sapiens
actgatggatagtcaagatact

SEQ ID NO: 6903613 - DNA, 21 bp, Homo sapiens
tgaatttccctctatcattct

SEQ ID NO: 6903614 - DNA, 22 bp, Homo sapiens
tcactcagcctgcctggttcct

SEQ ID NO: 6903615 - DNA, 22 bp, Homo sapiens
ctctgaaactccagccccaggt

SEQ ID NO: 6903616 - DNA, 22 bp, Homo sapiens
cccaggctcctgactcattcta

SEQ ID NO: 6903617 - DNA, 22 bp, Homo sapiens
atagcaagcgttcccaagccac

SEQ ID NO: 6903618 - DNA, 22 bp, Homo sapiens
acggcgggagggtcactggcca

SEQ ID NO: 6903619 - DNA, 22 bp, Homo sapiens
ctttacaattcaagggaactct

SEQ ID NO: 6903620 - DNA, 21 bp, Homo sapiens
ccagtattatttctctatgta

SEQ ID NO: 6903621 - DNA, 22 bp, Homo sapiens
tctttatgtaagactgggcttg

SEQ ID NO: 6903622 - DNA, 22 bp, Homo sapiens
tccatgtggcaataggagacag

SEQ ID NO: 6903623 - DNA, 22 bp, Homo sapiens
gtgtgggtgggacatcatcttt

SEQ ID NO: 6903624 - DNA, 22 bp, Homo sapiens
gagataatgatgctaacccagt

SEQ ID NO: 6903625 - DNA, 22 bp, Homo sapiens
taaactctgcattcttttaaaa

SEQ ID NO: 6903626 - DNA, 22 bp, Homo sapiens
agagaagggtgtagcctgggcc

SEQ ID NO: 6903627 - DNA, 22 bp, Homo sapiens
ggtcagcccctgctcaaggccg

SEQ ID NO: 6903628 - DNA, 22 bp, Homo sapiens
tcaactcacaagaatgagcaag

SEQ ID NO: 6903629 - DNA, 22 bp, Homo sapiens
agttcagtgttggttaagatga

SEQ ID NO: 6903630 - DNA, 18 bp, Homo sapiens
tttttctgataaaacaag

SEQ ID NO: 6903631 - DNA, 22 bp, Homo sapiens
ttggatgagagggtgtggtaca

SEQ ID NO: 6903632 - DNA, 22 bp, Homo sapiens
tggctgagggcactatgaagcc

SEQ ID NO: 6903633 - DNA, 22 bp, Homo sapiens
tgcttaaagctgctcagttgta

SEQ ID NO: 6903634 - DNA, 22 bp, Homo sapiens
gtttactgttaaccaacgaatg

SEQ ID NO: 6903635 - DNA, 22 bp, Homo sapiens
gtagcagcttcagcccaaatta

SEQ ID NO: 6903636 - DNA, 22 bp, Homo sapiens
gcaagctgtgccttctcaggat

SEQ ID NO: 6903637 - DNA, 22 bp, Homo sapiens
aagcaggacgtatttctatcct

SEQ ID NO: 6903638 - DNA, 22 bp, Homo sapiens
gatttgtccacagagtgatgaa

SEQ ID NO: 6903639 - DNA, 22 bp, Homo sapiens
attgcaaatggtttggtcatct

SEQ ID NO: 6903640 - DNA, 22 bp, Homo sapiens
gtgattctgcacgtcattcctg

SEQ ID NO: 6903641 - DNA, 22 bp, Homo sapiens
tttcctgagccagagtttcatt

SEQ ID NO: 6903642 - DNA, 22 bp, Homo sapiens
tggcagggtcttgctgtgttgc

SEQ ID NO: 6903643 - DNA, 22 bp, Homo sapiens
tggagagcaagtcgcagacatg

SEQ ID NO: 6903644 - DNA, 22 bp, Homo sapiens
gtgtgcagtagagaaagagcag

SEQ ID NO: 6903645 - DNA, 22 bp, Homo sapiens
tggaatccaattatcagcatgg

SEQ ID NO: 6903646 - DNA, 22 bp, Homo sapiens
acagggctcccagcaggtctgt

SEQ ID NO: 6903647 - DNA, 22 bp, Homo sapiens
acagagatgaataatacaggtg

SEQ ID NO: 6903648 - DNA, 22 bp, Homo sapiens
agatgactaacatagtattgct

SEQ ID NO: 6903649 - DNA, 22 bp, Homo sapiens
tgggctcaatctgcttctgttt

SEQ ID NO: 6903650 - DNA, 22 bp, Homo sapiens
taggaggctcatgttacaggaa

SEQ ID NO: 6903651 - DNA, 22 bp, Homo sapiens
acattatagttgctacagagta

SEQ ID NO: 6903652 - DNA, 22 bp, Homo sapiens
tgctgaattccagggccccact

SEQ ID NO: 6903653 - DNA, 22 bp, Homo sapiens
tatactctgagaaacgtgtcac

SEQ ID NO: 6903654 - DNA, 22 bp, Homo sapiens
atatggcattctttttaagggt

SEQ ID NO: 6903655 - DNA, 22 bp, Homo sapiens
tgcagggcagatatgactgtag

SEQ ID NO: 6903656 - DNA, 22 bp, Homo sapiens
acaggctgctgggctccgtgct

SEQ ID NO: 6903657 - DNA, 21 bp, Homo sapiens
agaaaaacacgatataagccc

SEQ ID NO: 6903658 - DNA, 22 bp, Homo sapiens
aacatcttgaagattgggaaag

SEQ ID NO: 6903659 - DNA, 22 bp, Homo sapiens
tctcacactatttattctgctt

SEQ ID NO: 6903660 - DNA, 22 bp, Homo sapiens
tttaattttctgggcccagcag

SEQ ID NO: 6903661 - DNA, 22 bp, Homo sapiens
gtaataatggtccccaaacact

SEQ ID NO: 6903662 - DNA, 22 bp, Homo sapiens
cactgccttcacctgccctatc

SEQ ID NO: 6903663 - DNA, 22 bp, Homo sapiens
ttcacatttcataccacagctt

SEQ ID NO: 6903664 - DNA, 22 bp, Homo sapiens
ataggctttcctgattctcagg

SEQ ID NO: 6903665 - DNA, 22 bp, Homo sapiens
cacatttaggttcctatagcca

SEQ ID NO: 6903666 - DNA, 22 bp, Homo sapiens
tgttagaagttaatcactaatt

SEQ ID NO: 6903667 - DNA, 22 bp, Homo sapiens
tatgggtatctgtactgattgt

SEQ ID NO: 6903668 - DNA, 22 bp, Homo sapiens
tgcagacaagaagaaccaagga

SEQ ID NO: 6903669 - DNA, 22 bp, Homo sapiens
aggccctgcaggaagcaggatg

SEQ ID NO: 6903670 - DNA, 22 bp, Homo sapiens
ctgtgagatatgcatatgctct

SEQ ID NO: 6903671 - DNA, 22 bp, Homo sapiens
gcctaatatgcaaaattgatac

SEQ ID NO: 6903672 - DNA, 17 bp, Homo sapiens
atggtctcactgagcaa

SEQ ID NO: 6903673 - DNA, 22 bp, Homo sapiens
atttgttaattatgaggcatac

SEQ ID NO: 6903674 - DNA, 22 bp, Homo sapiens
ggtggacttctgtttttctctc

SEQ ID NO: 6903675 - DNA, 22 bp, Homo sapiens
gtatttgtcttgttggtctcca

SEQ ID NO: 6903676 - DNA, 22 bp, Homo sapiens
atgtttcctgttggattggccc

SEQ ID NO: 6903677 - DNA, 22 bp, Homo sapiens
aaacagctaagtacattcaagg

SEQ ID NO: 6903678 - DNA, 22 bp, Homo sapiens
ccaggatagtatgagtagggat

SEQ ID NO: 6903679 - DNA, 22 bp, Homo sapiens
actgggtggctgcctccttctc

SEQ ID NO: 6903680 - DNA, 23 bp, Homo sapiens
taatagctgatgttggttttaat

SEQ ID NO: 6903681 - DNA, 22 bp, Homo sapiens
gggagctgaactgctgaagttg

SEQ ID NO: 6903682 - DNA, 22 bp, Homo sapiens
gggctctggggaggacccttca

SEQ ID NO: 6903683 - DNA, 22 bp, Homo sapiens
gtggttttgctttatgagtgaa

SEQ ID NO: 6903684 - DNA, 22 bp, Homo sapiens
tggctctggggacagtaagtcc

SEQ ID NO: 6903685 - DNA, 22 bp, Homo sapiens
gacacagaatttactcccgata

SEQ ID NO: 6903686 - DNA, 23 bp, Homo sapiens
cccaggagtttcactgcaaaggt

SEQ ID NO: 6903687 - DNA, 22 bp, Homo sapiens
catttgttcaaccattctcgct

SEQ ID NO: 6903688 - DNA, 22 bp, Homo sapiens
tgtttttaaaatgtcctggtta

SEQ ID NO: 6903689 - DNA, 22 bp, Homo sapiens
ctttttctgatgttccatgatt

SEQ ID NO: 6903690 - DNA, 22 bp, Homo sapiens
agctctaaatggaattttgcct

SEQ ID NO: 6903691 - DNA, 22 bp, Homo sapiens
atgctgtatacatatgaaatta

SEQ ID NO: 6903692 - DNA, 22 bp, Homo sapiens
atacatcatgctccatatattt

SEQ ID NO: 6903693 - DNA, 22 bp, Homo sapiens
cagcctttccaattgctgctgc

SEQ ID NO: 6903694 - DNA, 17 bp, Homo sapiens
ttggaccagattctaaa

SEQ ID NO: 6903695 - DNA, 22 bp, Homo sapiens
aatgagttatttaatagaaagg

SEQ ID NO: 6903696 - DNA, 22 bp, Homo sapiens
ctgtttctttgctgtcagagag

SEQ ID NO: 6903697 - DNA, 22 bp, Homo sapiens
aaagttctgagaagcagtttac

SEQ ID NO: 6903698 - DNA, 22 bp, Homo sapiens
ctgctgggcagaggctgcatga

SEQ ID NO: 6903699 - DNA, 22 bp, Homo sapiens
attaggcagggcatggtggctc

SEQ ID NO: 6903700 - DNA, 22 bp, Homo sapiens
actggggagtggttttgggaag

SEQ ID NO: 6903701 - DNA, 22 bp, Homo sapiens
tgcctaccagtgttctcccttc

SEQ ID NO: 6903702 - DNA, 22 bp, Homo sapiens
gatgaggccacacggggtgggc

SEQ ID NO: 6903703 - DNA, 22 bp, Homo sapiens
tccctgtacactaacttgagac

SEQ ID NO: 6903704 - DNA, 19 bp, Homo sapiens
gataggcagccatgagccc

SEQ ID NO: 6903705 - DNA, 22 bp, Homo sapiens
ctgttaattgtgaattttacat

SEQ ID NO: 6903706 - DNA, 22 bp, Homo sapiens
ctgaaattgatgacagggatgg

SEQ ID NO: 6903707 - DNA, 20 bp, Homo sapiens
tatagatcacatcttctagc

SEQ ID NO: 6903708 - DNA, 22 bp, Homo sapiens
ttctgtatacgttacaattgag

SEQ ID NO: 6903709 - DNA, 22 bp, Homo sapiens
aaatgtctttatctcatgtaac

SEQ ID NO: 6903710 - DNA, 22 bp, Homo sapiens
cagttgcactagccacatttca

SEQ ID NO: 6903711 - DNA, 22 bp, Homo sapiens
tgacagtgcatgtgacaaagga

SEQ ID NO: 6903712 - DNA, 22 bp, Homo sapiens
gagctgaattgctgccatttgc

SEQ ID NO: 6903713 - DNA, 20 bp, Homo sapiens
ggagagccacatagtctccc

SEQ ID NO: 6903714 - DNA, 22 bp, Homo sapiens
tccttaaacaacacactttgta

SEQ ID NO: 6903715 - DNA, 22 bp, Homo sapiens
cttcagttatgtgccaaggaca

SEQ ID NO: 6903716 - DNA, 22 bp, Homo sapiens
agagtccaccctggggtcaggc

SEQ ID NO: 6903717 - DNA, 22 bp, Homo sapiens
gccatggggagggcagcgcctg

SEQ ID NO: 6903718 - DNA, 22 bp, Homo sapiens
agagtctggcgctgagatgaca

SEQ ID NO: 6903719 - DNA, 19 bp, Homo sapiens
atggccagtttagaggttt

SEQ ID NO: 6903720 - DNA, 22 bp, Homo sapiens
caatgttttcaactgacaagta

SEQ ID NO: 6903721 - DNA, 22 bp, Homo sapiens
gctactgatcaggtttgcttta

SEQ ID NO: 6903722 - DNA, 21 bp, Homo sapiens
aatgtggtacattacatgcat

SEQ ID NO: 6903723 - DNA, 22 bp, Homo sapiens
ttcagtgtgtcagtttcagcag

SEQ ID NO: 6903724 - DNA, 22 bp, Homo sapiens
ccctcagtctggctgggaagac

SEQ ID NO: 6903725 - DNA, 22 bp, Homo sapiens
taatgcagagtgcactcacctg

SEQ ID NO: 6903726 - DNA, 22 bp, Homo sapiens
ggaggggccggctgcctgccac

SEQ ID NO: 6903727 - DNA, 22 bp, Homo sapiens
atggcagggactgtggcccttg

SEQ ID NO: 6903728 - DNA, 22 bp, Homo sapiens
tcatatttatatgttggcacag

SEQ ID NO: 6903729 - DNA, 22 bp, Homo sapiens
tgtgagggttttaagggaatga

SEQ ID NO: 6903730 - DNA, 22 bp, Homo sapiens
tctcaggatctaatacatggta

SEQ ID NO: 6903731 - DNA, 22 bp, Homo sapiens
ataggtcagagccacagtgaag

SEQ ID NO: 6903732 - DNA, 22 bp, Homo sapiens
caagagctaccctgtgccatat

SEQ ID NO: 6903733 - DNA, 22 bp, Homo sapiens
tgatggaacagcctttgccaaa

SEQ ID NO: 6903734 - DNA, 22 bp, Homo sapiens
atattcactgagcataaagcca

SEQ ID NO: 6903735 - DNA, 22 bp, Homo sapiens
tttggtcccagttctgtcatgg

SEQ ID NO: 6903736 - DNA, 22 bp, Homo sapiens
ttagcaagaaagattgcagcac

SEQ ID NO: 6903737 - DNA, 22 bp, Homo sapiens
gagggggagatgtgcacacact

SEQ ID NO: 6903738 - DNA, 22 bp, Homo sapiens
ggtaacacaggtgcagttttaa

SEQ ID NO: 6903739 - DNA, 22 bp, Homo sapiens
ctcagccctccccggggaataa

SEQ ID NO: 6903740 - DNA, 20 bp, Homo sapiens
tgtaggtgtacagtaaggag

SEQ ID NO: 6903741 - DNA, 22 bp, Homo sapiens
agtcactgtttcagaactgagt

SEQ ID NO: 6903742 - DNA, 22 bp, Homo sapiens
aaggcctttgggggcctggtcc

SEQ ID NO: 6903743 - DNA, 22 bp, Homo sapiens
acattcaaccaatgtttgctat

SEQ ID NO: 6903744 - DNA, 22 bp, Homo sapiens
cttctgggattaatttttcctg

SEQ ID NO: 6903745 - DNA, 22 bp, Homo sapiens
ctcacaggtagaataacaacat

SEQ ID NO: 6903746 - DNA, 22 bp, Homo sapiens
atgcacaagcaagagataatgg

SEQ ID NO: 6903747 - DNA, 22 bp, Homo sapiens
gcactaaaccaacatgtaataa

SEQ ID NO: 6903748 - DNA, 22 bp, Homo sapiens
aggcagctggaaaactccaggc

SEQ ID NO: 6903749 - DNA, 22 bp, Homo sapiens
tgtttatagggtctgtcacttg

SEQ ID NO: 6903750 - DNA, 22 bp, Homo sapiens
acacagctatggggtaggaaac

SEQ ID NO: 6903751 - DNA, 22 bp, Homo sapiens
gcattttaatgaggtttatgag

SEQ ID NO: 6903752 - DNA, 22 bp, Homo sapiens
ggccagaagttggaaaagagcc

SEQ ID NO: 6903753 - DNA, 22 bp, Homo sapiens
atcaaaatggaagaatttggct

SEQ ID NO: 6903754 - DNA, 22 bp, Homo sapiens
ggcgcccatcggtgcagagggc

SEQ ID NO: 6903755 - DNA, 22 bp, Homo sapiens
ttgtcctgtgtctgtttggatt

SEQ ID NO: 6903756 - DNA, 22 bp, Homo sapiens
atcactagagttacattgccag

SEQ ID NO: 6903757 - DNA, 22 bp, Homo sapiens
acttttgaggactttattgtat

SEQ ID NO: 6903758 - DNA, 22 bp, Homo sapiens
tccacagtctatttttagtcta

SEQ ID NO: 6903759 - DNA, 22 bp, Homo sapiens
aatgtctttgccagggtcgggc

SEQ ID NO: 6903760 - DNA, 20 bp, Homo sapiens
aggaggcatgaggggattta

SEQ ID NO: 6903761 - DNA, 22 bp, Homo sapiens
ggtcccagctggtcactgtcag

SEQ ID NO: 6903762 - DNA, 22 bp, Homo sapiens
ccagctctctgcagaaaggact

SEQ ID NO: 6903763 - DNA, 22 bp, Homo sapiens
atcattagcaattttcaataag

SEQ ID NO: 6903764 - DNA, 22 bp, Homo sapiens
tggcggtgacggcggcgcctgg

SEQ ID NO: 6903765 - DNA, 22 bp, Homo sapiens
tgttcacacacggaggccacag

SEQ ID NO: 6903766 - DNA, 22 bp, Homo sapiens
atgcatcaaagtctgaaatttc

SEQ ID NO: 6903767 - DNA, 22 bp, Homo sapiens
caggtctccagctcagggtcca

SEQ ID NO: 6903768 - DNA, 22 bp, Homo sapiens
tctggacaggggcgctttgggg

SEQ ID NO: 6903769 - DNA, 21 bp, Homo sapiens
tgtctgcagacttgcttgttg

SEQ ID NO: 6903770 - DNA, 22 bp, Homo sapiens
cctgttcaccctccatgcacag

SEQ ID NO: 6903771 - DNA, 22 bp, Homo sapiens
ttgggcaggaacagatgcttga

SEQ ID NO: 6903772 - DNA, 22 bp, Homo sapiens
ctccctcacaaagcattctctt

SEQ ID NO: 6903773 - DNA, 22 bp, Homo sapiens
tttctctcctccaaaccaaaga

SEQ ID NO: 6903774 - DNA, 22 bp, Homo sapiens
tatttcaccttactaagctgtg

SEQ ID NO: 6903775 - DNA, 22 bp, Homo sapiens
agacattatggctttcactggg

SEQ ID NO: 6903776 - DNA, 23 bp, Homo sapiens
actttcccatagcatggcttcct

SEQ ID NO: 6903777 - DNA, 22 bp, Homo sapiens
gtgtgtatttaaaggatagttg

SEQ ID NO: 6903778 - DNA, 22 bp, Homo sapiens
ctagaacagaaagtacaggaaa

SEQ ID NO: 6903779 - DNA, 22 bp, Homo sapiens
ctctgtgtggtcctctgtattg

SEQ ID NO: 6903780 - DNA, 22 bp, Homo sapiens
gggtggaggagaacaggcccca

SEQ ID NO: 6903781 - DNA, 22 bp, Homo sapiens
caagatgggcaccccagcacct

SEQ ID NO: 6903782 - DNA, 23 bp, Homo sapiens
acagagacaatggtttcatcttg

SEQ ID NO: 6903783 - DNA, 22 bp, Homo sapiens
ggttcctgatcgttgtctctct

SEQ ID NO: 6903784 - DNA, 18 bp, Homo sapiens
gtgcaaatacttgctgac

SEQ ID NO: 6903785 - DNA, 22 bp, Homo sapiens
ccacccctgggtgcagggagcg

SEQ ID NO: 6903786 - DNA, 23 bp, Homo sapiens
atttgacagagcatagcatttct

SEQ ID NO: 6903787 - DNA, 22 bp, Homo sapiens
attcttttttaaggaatagaac

SEQ ID NO: 6903788 - DNA, 22 bp, Homo sapiens
gtggacaggcaggctgtcgggg

SEQ ID NO: 6903789 - DNA, 22 bp, Homo sapiens
aacttacgataatgttaaatgg

SEQ ID NO: 6903790 - DNA, 22 bp, Homo sapiens
caaggcttattttcctccttcc

SEQ ID NO: 6903791 - DNA, 22 bp, Homo sapiens
tctctgggctcaggagcccggc

SEQ ID NO: 6903792 - DNA, 22 bp, Homo sapiens
ggctgcttgctgtttcttggat

SEQ ID NO: 6903793 - DNA, 22 bp, Homo sapiens
acacagccgtgaatctgcttct

SEQ ID NO: 6903794 - DNA, 23 bp, Homo sapiens
ttctaaccttaaagccctttgga

SEQ ID NO: 6903795 - DNA, 22 bp, Homo sapiens
tcatattttgcaaggtcagcta

SEQ ID NO: 6903796 - DNA, 22 bp, Homo sapiens
ggagctgtctgtagggcacagg

SEQ ID NO: 6903797 - DNA, 22 bp, Homo sapiens
gtggcattctcggcaccatctg

SEQ ID NO: 6903798 - DNA, 22 bp, Homo sapiens
gctctctgccatatgaggatac

SEQ ID NO: 6903799 - DNA, 22 bp, Homo sapiens
accttggcagtttctacctttt

SEQ ID NO: 6903800 - DNA, 22 bp, Homo sapiens
tccctggccattcctctaggcc

SEQ ID NO: 6903801 - DNA, 22 bp, Homo sapiens
cttccttctgaagcatagaagc

SEQ ID NO: 6903802 - DNA, 22 bp, Homo sapiens
ggaagcactgaggcagagaggg

SEQ ID NO: 6903803 - DNA, 22 bp, Homo sapiens
gaggtagtttagttttggggaa

SEQ ID NO: 6903804 - DNA, 22 bp, Homo sapiens
tggactaaagaggaagcaaata

SEQ ID NO: 6903805 - DNA, 22 bp, Homo sapiens
agtaaataacagagaaaatggg

SEQ ID NO: 6903806 - DNA, 22 bp, Homo sapiens
actcacagcagactatgaggga

SEQ ID NO: 6903807 - DNA, 22 bp, Homo sapiens
taaagtgtggatatgattagta

SEQ ID NO: 6903808 - DNA, 22 bp, Homo sapiens
tattgtgagggcaaagtttcta

SEQ ID NO: 6903809 - DNA, 22 bp, Homo sapiens
acagcccgtgtcatcagctgct

SEQ ID NO: 6903810 - DNA, 22 bp, Homo sapiens
tctgctgctacagactctctag

SEQ ID NO: 6903811 - DNA, 22 bp, Homo sapiens
caaatcctggagccatggtaac

SEQ ID NO: 6903812 - DNA, 22 bp, Homo sapiens
ctggcatggaggactactgagc

SEQ ID NO: 6903813 - DNA, 22 bp, Homo sapiens
tttcctttctggtttggtcata

SEQ ID NO: 6903814 - DNA, 22 bp, Homo sapiens
accttatccacatcttgggaag

SEQ ID NO: 6903815 - DNA, 22 bp, Homo sapiens
cttcctgggccctgcttaagca

SEQ ID NO: 6903816 - DNA, 22 bp, Homo sapiens
aaatagcagctttgacagcaca

SEQ ID NO: 6903817 - DNA, 22 bp, Homo sapiens
gaaaaatgctccaaatctgtgg

SEQ ID NO: 6903818 - DNA, 22 bp, Homo sapiens
atgccatcttcattctcacact

SEQ ID NO: 6903819 - DNA, 22 bp, Homo sapiens
atgagtaagaccataatttttg

SEQ ID NO: 6903820 - DNA, 22 bp, Homo sapiens
tagcacagagcttttaaacttc

SEQ ID NO: 6903821 - DNA, 22 bp, Homo sapiens
aacctttatttggtactattct

SEQ ID NO: 6903822 - DNA, 21 bp, Homo sapiens
tctgcaccccagcctgagtga

SEQ ID NO: 6903823 - DNA, 22 bp, Homo sapiens
aatcaggatgactgtcatttca

SEQ ID NO: 6903824 - DNA, 22 bp, Homo sapiens
acaccaggtcccgtctgtacct

SEQ ID NO: 6903825 - DNA, 22 bp, Homo sapiens
cagcaagggataaacaaggacg

SEQ ID NO: 6903826 - DNA, 22 bp, Homo sapiens
acagtttatgcctctgagcctg

SEQ ID NO: 6903827 - DNA, 22 bp, Homo sapiens
gctctctgggtggtgggcaaca

SEQ ID NO: 6903828 - DNA, 22 bp, Homo sapiens
gccagaccagctgtgattccag

SEQ ID NO: 6903829 - DNA, 22 bp, Homo sapiens
gcttccaaacaaaattttgatg

SEQ ID NO: 6903830 - DNA, 22 bp, Homo sapiens
taccaattctattttggattga

SEQ ID NO: 6903831 - DNA, 22 bp, Homo sapiens
ggctgtgtttctgtttgacatt

SEQ ID NO: 6903832 - DNA, 22 bp, Homo sapiens
atgtgcaattattaagaagaga

SEQ ID NO: 6903833 - DNA, 22 bp, Homo sapiens
gccaggaatggagaggtggcct

SEQ ID NO: 6903834 - DNA, 22 bp, Homo sapiens
gtgcagggagcccagaaggtcc

SEQ ID NO: 6903835 - DNA, 17 bp, Homo sapiens
tgaaagaatcagggaga

SEQ ID NO: 6903836 - DNA, 22 bp, Homo sapiens
tcagtgttagacaagtttggaa

SEQ ID NO: 6903837 - DNA, 22 bp, Homo sapiens
atgacatgttccctttttctca

SEQ ID NO: 6903838 - DNA, 22 bp, Homo sapiens
tgtagtaaacactattctgatc

SEQ ID NO: 6903839 - DNA, 22 bp, Homo sapiens
tggctttgatggacagaggtca

SEQ ID NO: 6903840 - DNA, 22 bp, Homo sapiens
gcctctggggttaatagagttt

SEQ ID NO: 6903841 - DNA, 22 bp, Homo sapiens
cagctcctgcctgggcagctgt

SEQ ID NO: 6903842 - DNA, 22 bp, Homo sapiens
gggtggcaggattggcaggagt

SEQ ID NO: 6903843 - DNA, 22 bp, Homo sapiens
agcaattttcccttagtctttg

SEQ ID NO: 6903844 - DNA, 22 bp, Homo sapiens
tgttcccattttctgcataatc

SEQ ID NO: 6903845 - DNA, 22 bp, Homo sapiens
tgttaagagagtttctaatatt

SEQ ID NO: 6903846 - DNA, 22 bp, Homo sapiens
ttccaaggcccagcagagagga

SEQ ID NO: 6903847 - DNA, 22 bp, Homo sapiens
ccttccaggagtctctgcaggt

SEQ ID NO: 6903848 - DNA, 22 bp, Homo sapiens
caggtggttgtttggattctaa

SEQ ID NO: 6903849 - DNA, 22 bp, Homo sapiens
aagctatgagctaggcatctct

SEQ ID NO: 6903850 - DNA, 18 bp, Homo sapiens
agaaataccagtattgga

SEQ ID NO: 6903851 - DNA, 22 bp, Homo sapiens
aagatgttagattatggggaca

SEQ ID NO: 6903852 - DNA, 22 bp, Homo sapiens
tggctagagaactttgaagtag

SEQ ID NO: 6903853 - DNA, 22 bp, Homo sapiens
aggagaaaacagtgttttgcct

SEQ ID NO: 6903854 - DNA, 19 bp, Homo sapiens
tcacattcagccttgctga

SEQ ID NO: 6903855 - DNA, 22 bp, Homo sapiens
aatcagcaggcttctaaatttt

SEQ ID NO: 6903856 - DNA, 22 bp, Homo sapiens
tctgcagagattctgggctgag

SEQ ID NO: 6903857 - DNA, 22 bp, Homo sapiens
tgggtcaggctgggagtcctga

SEQ ID NO: 6903858 - DNA, 22 bp, Homo sapiens
cattagcattcagtgacttgta

SEQ ID NO: 6903859 - DNA, 20 bp, Homo sapiens
acagtttattttacttggtt

SEQ ID NO: 6903860 - DNA, 22 bp, Homo sapiens
tcttccaatacctagattttgg

SEQ ID NO: 6903861 - DNA, 22 bp, Homo sapiens
gacctatttaagtgtagttcaa

SEQ ID NO: 6903862 - DNA, 22 bp, Homo sapiens
caggacagtataggctttagga

SEQ ID NO: 6903863 - DNA, 22 bp, Homo sapiens
ggctggatttttggaaggagag

SEQ ID NO: 6903864 - DNA, 22 bp, Homo sapiens
ctgtcctcatctgccccaaggg

SEQ ID NO: 6903865 - DNA, 22 bp, Homo sapiens
cattggaatgatcgttttgctg

SEQ ID NO: 6903866 - DNA, 20 bp, Homo sapiens
acatgcttgagaggatgcag

SEQ ID NO: 6903867 - DNA, 22 bp, Homo sapiens
agggcctggcgcgtggccgccg

SEQ ID NO: 6903868 - DNA, 22 bp, Homo sapiens
acatgctttgatgtattttgca

SEQ ID NO: 6903869 - DNA, 22 bp, Homo sapiens
actgatattaaacacaatttaa

SEQ ID NO: 6903870 - DNA, 22 bp, Homo sapiens
atagaataatggttgtcaggag

SEQ ID NO: 6903871 - DNA, 18 bp, Homo sapiens
gcacatgtaagagtaaag

SEQ ID NO: 6903872 - DNA, 23 bp, Homo sapiens
ttatgcaagcttcctggtctcag

SEQ ID NO: 6903873 - DNA, 22 bp, Homo sapiens
tgcttgaagcctacattcgtca

SEQ ID NO: 6903874 - DNA, 22 bp, Homo sapiens
tactgtgtggtgagctgtctcc

SEQ ID NO: 6903875 - DNA, 22 bp, Homo sapiens
tgtctgaatcgcttcctagagg

SEQ ID NO: 6903876 - DNA, 22 bp, Homo sapiens
tgctgggggttcagatgagtaa

SEQ ID NO: 6903877 - DNA, 22 bp, Homo sapiens
acaaggaggtctggggggccct

SEQ ID NO: 6903878 - DNA, 22 bp, Homo sapiens
tggcagtgatgcggcaggacat

SEQ ID NO: 6903879 - DNA, 22 bp, Homo sapiens
gttgggcagaagcttgttgtgc

SEQ ID NO: 6903880 - DNA, 22 bp, Homo sapiens
tcaccaggctggaatgcagtgg

SEQ ID NO: 6903881 - DNA, 22 bp, Homo sapiens
tgattctcaaaggtagactggg

SEQ ID NO: 6903882 - DNA, 22 bp, Homo sapiens
acttgatttttataataaatgg

SEQ ID NO: 6903883 - DNA, 20 bp, Homo sapiens
ctcatgtggcaccaggcact

SEQ ID NO: 6903884 - DNA, 22 bp, Homo sapiens
gtacacaaagtgagacttgata

SEQ ID NO: 6903885 - DNA, 22 bp, Homo sapiens
gtttccagcctcctgggtaaag

SEQ ID NO: 6903886 - DNA, 22 bp, Homo sapiens
gccagtgtgtcatccggctgca

SEQ ID NO: 6903887 - DNA, 22 bp, Homo sapiens
aacttattgaacattctcgaat

SEQ ID NO: 6903888 - DNA, 22 bp, Homo sapiens
agagcacagggttttgtgccgg

SEQ ID NO: 6903889 - DNA, 22 bp, Homo sapiens
cttgggtcacaactctgaggtg

SEQ ID NO: 6903890 - DNA, 22 bp, Homo sapiens
tttcctcttatacagtgtttat

SEQ ID NO: 6903891 - DNA, 22 bp, Homo sapiens
ccactggttttattctctttca

SEQ ID NO: 6903892 - DNA, 22 bp, Homo sapiens
agagtgctagcctgagggaggt

SEQ ID NO: 6903893 - DNA, 22 bp, Homo sapiens
tacagcaatggttctaagagtc

SEQ ID NO: 6903894 - DNA, 23 bp, Homo sapiens
tgtgctcccaaatgtaggtctat

SEQ ID NO: 6903895 - DNA, 22 bp, Homo sapiens
tctcctgggcttggttgaagtt

SEQ ID NO: 6903896 - DNA, 22 bp, Homo sapiens
tcacatgcacatctctggaacc

SEQ ID NO: 6903897 - DNA, 22 bp, Homo sapiens
aagaaatacatggtttttgagt

SEQ ID NO: 6903898 - DNA, 22 bp, Homo sapiens
ttatcctggattatatatgtga

SEQ ID NO: 6903899 - DNA, 22 bp, Homo sapiens
tgttatctgcacgtagagtttt

SEQ ID NO: 6903900 - DNA, 18 bp, Homo sapiens
gcaaagacaggctgggct

SEQ ID NO: 6903901 - DNA, 22 bp, Homo sapiens
tcacccaggctggactgcagtg

SEQ ID NO: 6903902 - DNA, 20 bp, Homo sapiens
agccccacccttgtcctggc

SEQ ID NO: 6903903 - DNA, 22 bp, Homo sapiens
ttgagggaacatgagaatcatc

SEQ ID NO: 6903904 - DNA, 22 bp, Homo sapiens
actataaggttcatgtgagaat

SEQ ID NO: 6903905 - DNA, 22 bp, Homo sapiens
ggaggtgggctaaggactctct

SEQ ID NO: 6903906 - DNA, 22 bp, Homo sapiens
aagctcaaaccttggggctcag

SEQ ID NO: 6903907 - DNA, 22 bp, Homo sapiens
cactgatttagtttgtgttacc

SEQ ID NO: 6903908 - DNA, 22 bp, Homo sapiens
cctcaagtcattccggagacct

SEQ ID NO: 6903909 - DNA, 22 bp, Homo sapiens
agtgatggtttccagtcactga

SEQ ID NO: 6903910 - DNA, 22 bp, Homo sapiens
atctgtatatttttcaatgcaa

SEQ ID NO: 6903911 - DNA, 19 bp, Homo sapiens
agtctcagtgtacagaggc

SEQ ID NO: 6903912 - DNA, 22 bp, Homo sapiens
attttgttataggagctgaaat

SEQ ID NO: 6903913 - DNA, 22 bp, Homo sapiens
caggctgtgggagtcaggaccc

SEQ ID NO: 6903914 - DNA, 22 bp, Homo sapiens
ctgcagtctgacatacgaggac

SEQ ID NO: 6903915 - DNA, 22 bp, Homo sapiens
tctgtggctgtgctgggccaga

SEQ ID NO: 6903916 - DNA, 22 bp, Homo sapiens
gcacagtaggtatttacccagt

SEQ ID NO: 6903917 - DNA, 22 bp, Homo sapiens
catttgcaaaccaacaagatga

SEQ ID NO: 6903918 - DNA, 22 bp, Homo sapiens
aggcaactggttaagtaaattg

SEQ ID NO: 6903919 - DNA, 23 bp, Homo sapiens
atgtaagagttccagttactttg

SEQ ID NO: 6903920 - DNA, 22 bp, Homo sapiens
gaaacattggtctgccccttat

SEQ ID NO: 6903921 - DNA, 20 bp, Homo sapiens
cttcactaggagaaagagaa

SEQ ID NO: 6903922 - DNA, 22 bp, Homo sapiens
ttgtccttggatgaagctggga

SEQ ID NO: 6903923 - DNA, 22 bp, Homo sapiens
tgtgactggcagaggtgtctgg

SEQ ID NO: 6903924 - DNA, 22 bp, Homo sapiens
cagtcacaagcgtacctaattt

SEQ ID NO: 6903925 - DNA, 22 bp, Homo sapiens
acattgtatacagacttagtca

SEQ ID NO: 6903926 - DNA, 18 bp, Homo sapiens
ggactacaggcacaggga

SEQ ID NO: 6903927 - DNA, 22 bp, Homo sapiens
aatgtctttacttttgtgggca

SEQ ID NO: 6903928 - DNA, 22 bp, Homo sapiens
taaagtatccagttattcttct

SEQ ID NO: 6903929 - DNA, 22 bp, Homo sapiens
ccagaagtcaatgcagatgtga

SEQ ID NO: 6903930 - DNA, 22 bp, Homo sapiens
gtcactgactctgggagatgtg

SEQ ID NO: 6903931 - DNA, 22 bp, Homo sapiens
acaacagagctggactgagagg

SEQ ID NO: 6903932 - DNA, 23 bp, Homo sapiens
atattcacgccgccagaggtccc

SEQ ID NO: 6903933 - DNA, 22 bp, Homo sapiens
taccactacatttgctaatggc

SEQ ID NO: 6903934 - DNA, 20 bp, Homo sapiens
tctgaattgagtgaatgtct

SEQ ID NO: 6903935 - DNA, 22 bp, Homo sapiens
atgtgttttggtaatttctgct

SEQ ID NO: 6903936 - DNA, 22 bp, Homo sapiens
ctgaggtgtggtctgggagtat

SEQ ID NO: 6903937 - DNA, 22 bp, Homo sapiens
agaacaaatcgatggaagcctg

SEQ ID NO: 6903938 - DNA, 22 bp, Homo sapiens
taaaaagcagctgagattttct

SEQ ID NO: 6903939 - DNA, 20 bp, Homo sapiens
gggcagttcaatgccactct

SEQ ID NO: 6903940 - DNA, 16 bp, Homo sapiens
agtgggaggagaaaga

SEQ ID NO: 6903941 - DNA, 22 bp, Homo sapiens
agggtcaggagacactggcaac

SEQ ID NO: 6903942 - DNA, 22 bp, Homo sapiens
actcagacatgccttttacttc

SEQ ID NO: 6903943 - DNA, 22 bp, Homo sapiens
ggagcccttctattccatggag

SEQ ID NO: 6903944 - DNA, 22 bp, Homo sapiens
tctggctcaggtcagacaggga

SEQ ID NO: 6903945 - DNA, 22 bp, Homo sapiens
agaaactttctagggcttcagg

SEQ ID NO: 6903946 - DNA, 22 bp, Homo sapiens
gagcctgatgaaacaggcagac

SEQ ID NO: 6903947 - DNA, 22 bp, Homo sapiens
accctgagtcagacagcctgac

SEQ ID NO: 6903948 - DNA, 22 bp, Homo sapiens
tcactttactttgttaatctgg

SEQ ID NO: 6903949 - DNA, 23 bp, Homo sapiens
gcctctgctctgcgttggggact

SEQ ID NO: 6903950 - DNA, 22 bp, Homo sapiens
caaggccactccagagactggt

SEQ ID NO: 6903951 - DNA, 22 bp, Homo sapiens
tctctacagattccatggggaa

SEQ ID NO: 6903952 - DNA, 22 bp, Homo sapiens
tttaacactagtttctttaact

SEQ ID NO: 6903953 - DNA, 22 bp, Homo sapiens
aaccaccaccatctagttccaa

SEQ ID NO: 6903954 - DNA, 22 bp, Homo sapiens
tggcccaggaggccagagggca

SEQ ID NO: 6903955 - DNA, 22 bp, Homo sapiens
aatcacatttgcccccatattc

SEQ ID NO: 6903956 - DNA, 18 bp, Homo sapiens
atgctctagtctttcctg

SEQ ID NO: 6903957 - DNA, 22 bp, Homo sapiens
aacagtaggtgtaaccaaacaa

SEQ ID NO: 6903958 - DNA, 22 bp, Homo sapiens
gcccaaggtcacacacaggaag

SEQ ID NO: 6903959 - DNA, 22 bp, Homo sapiens
ctttgcaaactgtcacactttc

SEQ ID NO: 6903960 - DNA, 22 bp, Homo sapiens
ccagcttctccttatgtcctca

SEQ ID NO: 6903961 - DNA, 22 bp, Homo sapiens
attttactaagtggatatctgt

SEQ ID NO: 6903962 - DNA, 22 bp, Homo sapiens
tcctgccagcaggaggtggcag

SEQ ID NO: 6903963 - DNA, 22 bp, Homo sapiens
agtccttcccatctgacaccct

SEQ ID NO: 6903964 - DNA, 22 bp, Homo sapiens
aggggtggagagtgttgccagt

SEQ ID NO: 6903965 - DNA, 22 bp, Homo sapiens
atttcacaaaccatcctgattt

SEQ ID NO: 6903966 - DNA, 22 bp, Homo sapiens
aagtagcatcaaggaggatcca

SEQ ID NO: 6903967 - DNA, 22 bp, Homo sapiens
caggccttgggacccagactgg

SEQ ID NO: 6903968 - DNA, 22 bp, Homo sapiens
tgcttggcctacttgtcctttg

SEQ ID NO: 6903969 - DNA, 22 bp, Homo sapiens
cggagtggagaaggtcacagaa

SEQ ID NO: 6903970 - DNA, 22 bp, Homo sapiens
ttttaccactgggtgacatgga

SEQ ID NO: 6903971 - DNA, 22 bp, Homo sapiens
gtaacattattcatgagataca

SEQ ID NO: 6903972 - DNA, 22 bp, Homo sapiens
cacttagagccagatgcatagt

SEQ ID NO: 6903973 - DNA, 22 bp, Homo sapiens
actgagctccctgagggcaggc

SEQ ID NO: 6903974 - DNA, 22 bp, Homo sapiens
agggcctgggaagaggaaccct

SEQ ID NO: 6903975 - DNA, 22 bp, Homo sapiens
aaggtggtttgcagacagaata

SEQ ID NO: 6903976 - DNA, 22 bp, Homo sapiens
tgctgcctgtgccaggagggtc

SEQ ID NO: 6903977 - DNA, 22 bp, Homo sapiens
atccttaatttacttgcatctt

SEQ ID NO: 6903978 - DNA, 22 bp, Homo sapiens
ccaaggatgacagtacagtcac

SEQ ID NO: 6903979 - DNA, 22 bp, Homo sapiens
agaagtataaagaatgtttatg

SEQ ID NO: 6903980 - DNA, 22 bp, Homo sapiens
gagtgctgaatgcgagaacaga

SEQ ID NO: 6903981 - DNA, 21 bp, Homo sapiens
gcctgccccatgtttctgttg

SEQ ID NO: 6903982 - DNA, 22 bp, Homo sapiens
gagatgctttatctcctttgtc

SEQ ID NO: 6903983 - DNA, 22 bp, Homo sapiens
ttgtgttgcatcttattcttct

SEQ ID NO: 6903984 - DNA, 21 bp, Homo sapiens
taaggaagagcattttaggtc

SEQ ID NO: 6903985 - DNA, 22 bp, Homo sapiens
gagctgctggttgctggtgcct

SEQ ID NO: 6903986 - DNA, 22 bp, Homo sapiens
cagtttagcaaatttgtatcaa

SEQ ID NO: 6903987 - DNA, 22 bp, Homo sapiens
taacaagtttcatttatagaat

SEQ ID NO: 6903988 - DNA, 22 bp, Homo sapiens
agccaagcaccactggcactcg

SEQ ID NO: 6903989 - DNA, 22 bp, Homo sapiens
gctgaggcaaaccaagaatgta

SEQ ID NO: 6903990 - DNA, 22 bp, Homo sapiens
agatgccaggttgggaagtgat

SEQ ID NO: 6903991 - DNA, 22 bp, Homo sapiens
tgggaaagtaattgtcatcctt

SEQ ID NO: 6903992 - DNA, 22 bp, Homo sapiens
gatgttcgagcagaagaccagg

SEQ ID NO: 6903993 - DNA, 22 bp, Homo sapiens
tagctgaatataggcacaacag

SEQ ID NO: 6903994 - DNA, 22 bp, Homo sapiens
ttatttgattagtaaacctgta

SEQ ID NO: 6903995 - DNA, 22 bp, Homo sapiens
caggagatgcggtgtttgctct

SEQ ID NO: 6903996 - DNA, 22 bp, Homo sapiens
ttcctacatcaccagggggagt

SEQ ID NO: 6903997 - DNA, 22 bp, Homo sapiens
aggaccctgctcaagcatctcc

SEQ ID NO: 6903998 - DNA, 22 bp, Homo sapiens
aactgcttgtagtgacttgcct

SEQ ID NO: 6903999 - DNA, 22 bp, Homo sapiens
cttacatactgagaaaatatcc

SEQ ID NO: 6904000 - DNA, 22 bp, Homo sapiens
atttcctgggtctcactccaga

SEQ ID NO: 6904001 - DNA, 22 bp, Homo sapiens
gccagctgcttctccagaattt

SEQ ID NO: 6904002 - DNA, 22 bp, Homo sapiens
tagcagactttgtgtctggttt

SEQ ID NO: 6904003 - DNA, 20 bp, Homo sapiens
cccagagcactttttcatgt

SEQ ID NO: 6904004 - DNA, 19 bp, Homo sapiens
tggagcacctaggaataga

SEQ ID NO: 6904005 - DNA, 22 bp, Homo sapiens
tctgcagcaacctttcacctcc

SEQ ID NO: 6904006 - DNA, 22 bp, Homo sapiens
ttgttggtggaattgatgctag

SEQ ID NO: 6904007 - DNA, 22 bp, Homo sapiens
gcctttggagaatccagtcatg

SEQ ID NO: 6904008 - DNA, 22 bp, Homo sapiens
catcctgactgggtaaagctta

SEQ ID NO: 6904009 - DNA, 22 bp, Homo sapiens
atgtctttcaaattctgcctag

SEQ ID NO: 6904010 - DNA, 22 bp, Homo sapiens
cgggccctactcaaagcttgca

SEQ ID NO: 6904011 - DNA, 22 bp, Homo sapiens
gaattagacatgctttgctttt

SEQ ID NO: 6904012 - DNA, 22 bp, Homo sapiens
ggcaggtgacctggcctcccag

SEQ ID NO: 6904013 - DNA, 22 bp, Homo sapiens
gatgcctcttttggctgaatta

SEQ ID NO: 6904014 - DNA, 22 bp, Homo sapiens
ctagagctttctgctggtgttg

SEQ ID NO: 6904015 - DNA, 22 bp, Homo sapiens
ggctggactttctgctgggctc

SEQ ID NO: 6904016 - DNA, 22 bp, Homo sapiens
agctttacatcgaagttcagtc

SEQ ID NO: 6904017 - DNA, 22 bp, Homo sapiens
ggagaagcaggtgctttgggtc

SEQ ID NO: 6904018 - DNA, 22 bp, Homo sapiens
aggcaggtcccctggaaggcac

SEQ ID NO: 6904019 - DNA, 22 bp, Homo sapiens
cagggcctcatcctcagagatt

SEQ ID NO: 6904020 - DNA, 22 bp, Homo sapiens
tgcatgttttataccaaagctt

SEQ ID NO: 6904021 - DNA, 20 bp, Homo sapiens
tgagacaaggctggagagac

SEQ ID NO: 6904022 - DNA, 22 bp, Homo sapiens
cccttcctcctcgcctgtcaga

SEQ ID NO: 6904023 - DNA, 22 bp, Homo sapiens
gagccttcatcgcagccttgtt

SEQ ID NO: 6904024 - DNA, 22 bp, Homo sapiens
atctgggttccctcccccaatt

SEQ ID NO: 6904025 - DNA, 22 bp, Homo sapiens
ggtgtgtgtggattagcatgcc

SEQ ID NO: 6904026 - DNA, 20 bp, Homo sapiens
aggctgagttctatgcactt

SEQ ID NO: 6904027 - DNA, 21 bp, Homo sapiens
gggaaattaggattgctcatc

SEQ ID NO: 6904028 - DNA, 22 bp, Homo sapiens
aaggcccagcgtgacctcagtg

SEQ ID NO: 6904029 - DNA, 22 bp, Homo sapiens
tatgtacatggagagcaattga

SEQ ID NO: 6904030 - DNA, 22 bp, Homo sapiens
accagtttctgggggaggttgg

SEQ ID NO: 6904031 - DNA, 22 bp, Homo sapiens
tctgtccagaacgtacatcttg

SEQ ID NO: 6904032 - DNA, 22 bp, Homo sapiens
tattgcgaatgtggtgataaat

SEQ ID NO: 6904033 - DNA, 22 bp, Homo sapiens
ttaaggaaacatttttccatag

SEQ ID NO: 6904034 - DNA, 22 bp, Homo sapiens
tgccagaacagctcatctggcc

SEQ ID NO: 6904035 - DNA, 22 bp, Homo sapiens
actgcaaagggaagccctttct

SEQ ID NO: 6904036 - DNA, 22 bp, Homo sapiens
tacggtcagtccgtgccccaag

SEQ ID NO: 6904037 - DNA, 20 bp, Homo sapiens
aaacttgttggtggatgagg

SEQ ID NO: 6904038 - DNA, 22 bp, Homo sapiens
gaggaacttatgatattctact

SEQ ID NO: 6904039 - DNA, 22 bp, Homo sapiens
ttctccagtttctcccttcagt

SEQ ID NO: 6904040 - DNA, 22 bp, Homo sapiens
tcaagataccaccattatatgt

SEQ ID NO: 6904041 - DNA, 22 bp, Homo sapiens
atcttctcaagcagcatcctgt

SEQ ID NO: 6904042 - DNA, 22 bp, Homo sapiens
taggagtcatttggtccctctt

SEQ ID NO: 6904043 - DNA, 22 bp, Homo sapiens
ccttccagaaagcacttagtta

SEQ ID NO: 6904044 - DNA, 22 bp, Homo sapiens
gtgtcttaattcttgttgttca

SEQ ID NO: 6904045 - DNA, 22 bp, Homo sapiens
gactgcaaccttagactagaaa

SEQ ID NO: 6904046 - DNA, 17 bp, Homo sapiens
tgaggctcggtgaggag

SEQ ID NO: 6904047 - DNA, 22 bp, Homo sapiens
gtacaaagtggacctgatagta

SEQ ID NO: 6904048 - DNA, 22 bp, Homo sapiens
gttttcagccaggagcacattt

SEQ ID NO: 6904049 - DNA, 22 bp, Homo sapiens
tcacccagacttgtgaatgtgt

SEQ ID NO: 6904050 - DNA, 22 bp, Homo sapiens
gacactgttatggtgaggtaag

SEQ ID NO: 6904051 - DNA, 22 bp, Homo sapiens
ctttggaaggaagacctttcag

SEQ ID NO: 6904052 - DNA, 22 bp, Homo sapiens
gtggcagctgtgttgcagtttt

SEQ ID NO: 6904053 - DNA, 22 bp, Homo sapiens
cccagggtagctgagctggcag

SEQ ID NO: 6904054 - DNA, 22 bp, Homo sapiens
ccatttttgacagaaggcctaa

SEQ ID NO: 6904055 - DNA, 23 bp, Homo sapiens
tggttgcagtgccaagtatcacg

SEQ ID NO: 6904056 - DNA, 18 bp, Homo sapiens
cagaaagttatttactct

SEQ ID NO: 6904057 - DNA, 22 bp, Homo sapiens
agagtgcatgacatgatcttgg

SEQ ID NO: 6904058 - DNA, 22 bp, Homo sapiens
cagaaatgacaaagtaagagga

SEQ ID NO: 6904059 - DNA, 22 bp, Homo sapiens
tgtacatgtgtctgtatatctt

SEQ ID NO: 6904060 - DNA, 22 bp, Homo sapiens
tggggccaagaaggtctcatgt

SEQ ID NO: 6904061 - DNA, 22 bp, Homo sapiens
cctcctctggtgctgccaaccc

SEQ ID NO: 6904062 - DNA, 22 bp, Homo sapiens
aagttaaggatcttgagatgat

SEQ ID NO: 6904063 - DNA, 22 bp, Homo sapiens
caaatgtgacttttgggcttct

SEQ ID NO: 6904064 - DNA, 22 bp, Homo sapiens
attgcagctcagggtgatgact

SEQ ID NO: 6904065 - DNA, 22 bp, Homo sapiens
cactgccatgttgatagatgtg

SEQ ID NO: 6904066 - DNA, 22 bp, Homo sapiens
tatgagaaggtatggtgacttg

SEQ ID NO: 6904067 - DNA, 22 bp, Homo sapiens
gagatttagagagacttaaaca

SEQ ID NO: 6904068 - DNA, 22 bp, Homo sapiens
gcagtgtgtagagtttaggaaa

SEQ ID NO: 6904069 - DNA, 22 bp, Homo sapiens
gtgctgaaatagaggaggtggc

SEQ ID NO: 6904070 - DNA, 22 bp, Homo sapiens
ggtggcctctgcaggcctcgac

SEQ ID NO: 6904071 - DNA, 22 bp, Homo sapiens
caccagctaattaaaacagcag

SEQ ID NO: 6904072 - DNA, 17 bp, Homo sapiens
tggttccaaccatacgc

SEQ ID NO: 6904073 - DNA, 22 bp, Homo sapiens
gaagtttattttacacatccat

SEQ ID NO: 6904074 - DNA, 22 bp, Homo sapiens
agaggtcttaagatctagactg

SEQ ID NO: 6904075 - DNA, 22 bp, Homo sapiens
caggaaccaggagagtccctga

SEQ ID NO: 6904076 - DNA, 22 bp, Homo sapiens
tgagccacagtgagagctcctg

SEQ ID NO: 6904077 - DNA, 22 bp, Homo sapiens
agcacttgtagactagaatttt

SEQ ID NO: 6904078 - DNA, 17 bp, Homo sapiens
aggcatgaggcatcact

SEQ ID NO: 6904079 - DNA, 22 bp, Homo sapiens
gaaacatgtctgacaatttacc

SEQ ID NO: 6904080 - DNA, 20 bp, Homo sapiens
tctgtcctttctgctaaggc

SEQ ID NO: 6904081 - DNA, 18 bp, Homo sapiens
ggccagccccaggccagc

SEQ ID NO: 6904082 - DNA, 22 bp, Homo sapiens
agcgccactgcactccagcctg

SEQ ID NO: 6904083 - DNA, 22 bp, Homo sapiens
tggctaggtagctttctgctgt

SEQ ID NO: 6904084 - DNA, 22 bp, Homo sapiens
gccccaccgagggtgcagtcct

SEQ ID NO: 6904085 - DNA, 22 bp, Homo sapiens
ttcctctttgcatcctcaactc

SEQ ID NO: 6904086 - DNA, 22 bp, Homo sapiens
tctgagtgagcacatggttaga

SEQ ID NO: 6904087 - DNA, 21 bp, Homo sapiens
aggtgggcaggtggagtggcc

SEQ ID NO: 6904088 - DNA, 22 bp, Homo sapiens
cagctctgcctctggggctgag

SEQ ID NO: 6904089 - DNA, 22 bp, Homo sapiens
ctacccaggctggagtgcagta

SEQ ID NO: 6904090 - DNA, 19 bp, Homo sapiens
cactaagaagcaggggagc

SEQ ID NO: 6904091 - DNA, 22 bp, Homo sapiens
gttatgaagtcattcacaaata

SEQ ID NO: 6904092 - DNA, 22 bp, Homo sapiens
tgctccatgcgctcggccggcg

SEQ ID NO: 6904093 - DNA, 22 bp, Homo sapiens
atacatgatacttagtacgtag

SEQ ID NO: 6904094 - DNA, 22 bp, Homo sapiens
ttgcagacattccagagctttt

SEQ ID NO: 6904095 - DNA, 22 bp, Homo sapiens
caggagccacattccaccttga

SEQ ID NO: 6904096 - DNA, 22 bp, Homo sapiens
tgcctaggctggagtgcagtga

SEQ ID NO: 6904097 - DNA, 22 bp, Homo sapiens
tgcctaggctggaatgcagtgg

SEQ ID NO: 6904098 - DNA, 22 bp, Homo sapiens
ctagagtcctcctggaaaaggt

SEQ ID NO: 6904099 - DNA, 22 bp, Homo sapiens
caggaggagggtacaccatcag

SEQ ID NO: 6904100 - DNA, 22 bp, Homo sapiens
taacagcatttgaatgagtaac

SEQ ID NO: 6904101 - DNA, 22 bp, Homo sapiens
cttggctctgtgttgatgggac

SEQ ID NO: 6904102 - DNA, 22 bp, Homo sapiens
tttgcataagtcatgtccagtg

SEQ ID NO: 6904103 - DNA, 22 bp, Homo sapiens
ccagctttaggttgcctgccag

SEQ ID NO: 6904104 - DNA, 22 bp, Homo sapiens
ggaaccaggagttacacgagtt

SEQ ID NO: 6904105 - DNA, 22 bp, Homo sapiens
cagcacagctggctctggaagc

SEQ ID NO: 6904106 - DNA, 22 bp, Homo sapiens
acattaacaccataagtgtgtt

SEQ ID NO: 6904107 - DNA, 22 bp, Homo sapiens
tcccctttgtaagatggaaacg

SEQ ID NO: 6904108 - DNA, 22 bp, Homo sapiens
ctggagagttggaagatggact

SEQ ID NO: 6904109 - DNA, 18 bp, Homo sapiens
tcccatcatcctctccag

SEQ ID NO: 6904110 - DNA, 22 bp, Homo sapiens
gactctggcagcactagggggc

SEQ ID NO: 6904111 - DNA, 21 bp, Homo sapiens
aaagaaatctcccattggtag

SEQ ID NO: 6904112 - DNA, 22 bp, Homo sapiens
gccaacagctgggtgcatgtcc

SEQ ID NO: 6904113 - DNA, 20 bp, Homo sapiens
cccaggagctgtgccccatc

SEQ ID NO: 6904114 - DNA, 21 bp, Homo sapiens
tgccctggggctcttccctca

SEQ ID NO: 6904115 - DNA, 22 bp, Homo sapiens
ataattcgtataaggggaaaag

SEQ ID NO: 6904116 - DNA, 19 bp, Homo sapiens
gttttgtttgcagaactta

SEQ ID NO: 6904117 - DNA, 20 bp, Homo sapiens
tacaggtagaactccctggc

SEQ ID NO: 6904118 - DNA, 22 bp, Homo sapiens
tggctcagtttcagtcctggtt

SEQ ID NO: 6904119 - DNA, 22 bp, Homo sapiens
tcacacacatggatagtatttt

SEQ ID NO: 6904120 - DNA, 22 bp, Homo sapiens
gccagcatcctgcattagggtg

SEQ ID NO: 6904121 - DNA, 22 bp, Homo sapiens
aacagtcaaagtttggttcctt

SEQ ID NO: 6904122 - DNA, 19 bp, Homo sapiens
ctggaggtagagggttagt

SEQ ID NO: 6904123 - DNA, 22 bp, Homo sapiens
tggcaggagcctgcggggaggt

SEQ ID NO: 6904124 - DNA, 22 bp, Homo sapiens
gcacaattccatgggacagccc

SEQ ID NO: 6904125 - DNA, 22 bp, Homo sapiens
acagatggcactttttaggact

SEQ ID NO: 6904126 - DNA, 20 bp, Homo sapiens
aggacttgtttgggcagagt

SEQ ID NO: 6904127 - DNA, 22 bp, Homo sapiens
gaatttggggtgtgttatttca

SEQ ID NO: 6904128 - DNA, 22 bp, Homo sapiens
gtctgccctcacgccagctggg

SEQ ID NO: 6904129 - DNA, 22 bp, Homo sapiens
cctgagggaaggatgctaccca

SEQ ID NO: 6904130 - DNA, 23 bp, Homo sapiens
cagagctggctcagagctgcctg

SEQ ID NO: 6904131 - DNA, 19 bp, Homo sapiens
tgcccaggcctcccaaaag

SEQ ID NO: 6904132 - DNA, 22 bp, Homo sapiens
tgctgctcaagctgcagcaaaa

SEQ ID NO: 6904133 - DNA, 22 bp, Homo sapiens
actctgagttcctacttgctcc

SEQ ID NO: 6904134 - DNA, 17 bp, Homo sapiens
tccagctcctcattgtt

SEQ ID NO: 6904135 - DNA, 22 bp, Homo sapiens
ctgtggagtggggagtactggt

SEQ ID NO: 6904136 - DNA, 22 bp, Homo sapiens
atcttgttaaagtgcagattct

SEQ ID NO: 6904137 - DNA, 22 bp, Homo sapiens
tcttcactgtgaatttgttctt

SEQ ID NO: 6904138 - DNA, 22 bp, Homo sapiens
ctcagtttctgacattaaaatc

SEQ ID NO: 6904139 - DNA, 22 bp, Homo sapiens
tccagtcccattacccacattt

SEQ ID NO: 6904140 - DNA, 22 bp, Homo sapiens
attggtagttttgtatttctct

SEQ ID NO: 6904141 - DNA, 22 bp, Homo sapiens
ggtgcagaggagccagctgggg

SEQ ID NO: 6904142 - DNA, 22 bp, Homo sapiens
cactggcattagtcacgaggca

SEQ ID NO: 6904143 - DNA, 22 bp, Homo sapiens
agcacagttttcattgcagggt

SEQ ID NO: 6904144 - DNA, 22 bp, Homo sapiens
gcaaatcctggaccagcctctt

SEQ ID NO: 6904145 - DNA, 22 bp, Homo sapiens
ggtggcggccacttcagccctg

SEQ ID NO: 6904146 - DNA, 22 bp, Homo sapiens
gtttcctttaatagtgatattg

SEQ ID NO: 6904147 - DNA, 22 bp, Homo sapiens
tagggctgccatttgcttttct

SEQ ID NO: 6904148 - DNA, 22 bp, Homo sapiens
tgcaggtgtctctgtctagcgt

SEQ ID NO: 6904149 - DNA, 22 bp, Homo sapiens
ggttattagtttcacctggact

SEQ ID NO: 6904150 - DNA, 22 bp, Homo sapiens
caccagcttgggctgtggaaat

SEQ ID NO: 6904151 - DNA, 22 bp, Homo sapiens
tgcatactgtggagatttttca

SEQ ID NO: 6904152 - DNA, 22 bp, Homo sapiens
cagaaaggtatgtgtgcctttg

SEQ ID NO: 6904153 - DNA, 22 bp, Homo sapiens
actgactgtggatggcagcagc

SEQ ID NO: 6904154 - DNA, 22 bp, Homo sapiens
tgtcttcaaatattgaaatcct

SEQ ID NO: 6904155 - DNA, 22 bp, Homo sapiens
ttaaatgctcacataaaggtag

SEQ ID NO: 6904156 - DNA, 22 bp, Homo sapiens
gggtaggccagaagggcctgga

SEQ ID NO: 6904157 - DNA, 22 bp, Homo sapiens
aaggctgagagtcacagtccta

SEQ ID NO: 6904158 - DNA, 22 bp, Homo sapiens
caggaagtggggtcatggagta

SEQ ID NO: 6904159 - DNA, 22 bp, Homo sapiens
tgtgtctttggcgatgtctgga

SEQ ID NO: 6904160 - DNA, 22 bp, Homo sapiens
aacactgaaacattgattgaca

SEQ ID NO: 6904161 - DNA, 22 bp, Homo sapiens
tgcatgcagctggtcgggcgcc

SEQ ID NO: 6904162 - DNA, 22 bp, Homo sapiens
aagtttatgaagtctaagccaa

SEQ ID NO: 6904163 - DNA, 22 bp, Homo sapiens
ctattgctatcattctggtggt

SEQ ID NO: 6904164 - DNA, 22 bp, Homo sapiens
actcctgtgaggtaggtggcaa

SEQ ID NO: 6904165 - DNA, 22 bp, Homo sapiens
tctattttgtttccagctctac

SEQ ID NO: 6904166 - DNA, 20 bp, Homo sapiens
tttgcccttcctctgccttt

SEQ ID NO: 6904167 - DNA, 22 bp, Homo sapiens
cctgggtctgtattggtaggta

SEQ ID NO: 6904168 - DNA, 22 bp, Homo sapiens
tatcctgtgtactgtctagtac

SEQ ID NO: 6904169 - DNA, 22 bp, Homo sapiens
ctaggctcttctggaaggttgt

SEQ ID NO: 6904170 - DNA, 19 bp, Homo sapiens
aaactcatagactcatatt

SEQ ID NO: 6904171 - DNA, 19 bp, Homo sapiens
ggtagaagggaagtgtttt

SEQ ID NO: 6904172 - DNA, 22 bp, Homo sapiens
tagatgaaggctgagcacctgt

SEQ ID NO: 6904173 - DNA, 22 bp, Homo sapiens
gaggcagtggtctgatgcaagg

SEQ ID NO: 6904174 - DNA, 21 bp, Homo sapiens
gctgtgcagaggatggagtgg

SEQ ID NO: 6904175 - DNA, 22 bp, Homo sapiens
cccagagctgagggggcacgtt

SEQ ID NO: 6904176 - DNA, 22 bp, Homo sapiens
gtatactagatagacagtatca

SEQ ID NO: 6904177 - DNA, 23 bp, Homo sapiens
gctgaattaagcaatgaagaaat

SEQ ID NO: 6904178 - DNA, 22 bp, Homo sapiens
atctgggtgtggaatatatagg

SEQ ID NO: 6904179 - DNA, 22 bp, Homo sapiens
ttcatgttttgagccattctga

SEQ ID NO: 6904180 - DNA, 22 bp, Homo sapiens
ttgctaaaggattttgtattta

SEQ ID NO: 6904181 - DNA, 22 bp, Homo sapiens
aagaacttttggcaagtgttat

SEQ ID NO: 6904182 - DNA, 22 bp, Homo sapiens
ttcctggggcgactgtatctga

SEQ ID NO: 6904183 - DNA, 22 bp, Homo sapiens
ctgctacttttgcctgagtaac

SEQ ID NO: 6904184 - DNA, 22 bp, Homo sapiens
agccagataaaagcatttaaag

SEQ ID NO: 6904185 - DNA, 22 bp, Homo sapiens
acctgtgcaaagactggtcagg

SEQ ID NO: 6904186 - DNA, 22 bp, Homo sapiens
agtgatggggccctgcactgat

SEQ ID NO: 6904187 - DNA, 22 bp, Homo sapiens
ataagtgtgtaaggcattctgt

SEQ ID NO: 6904188 - DNA, 21 bp, Homo sapiens
atacacatacacataaatgtg

SEQ ID NO: 6904189 - DNA, 22 bp, Homo sapiens
tattatgcaaatattcctacct

SEQ ID NO: 6904190 - DNA, 22 bp, Homo sapiens
gtgacaatattagctcaggggc

SEQ ID NO: 6904191 - DNA, 22 bp, Homo sapiens
tgcaaacagaaagtttattgtg

SEQ ID NO: 6904192 - DNA, 22 bp, Homo sapiens
gtgtgacctcatcttaactgga

SEQ ID NO: 6904193 - DNA, 22 bp, Homo sapiens
gtgcaggatgttgggaatcagg

SEQ ID NO: 6904194 - DNA, 22 bp, Homo sapiens
cgcccaggctggagtgcagtga

SEQ ID NO: 6904195 - DNA, 22 bp, Homo sapiens
ggccagaaagttaagctgtggc

SEQ ID NO: 6904196 - DNA, 22 bp, Homo sapiens
gtggtgtgtgcttagggctagg

SEQ ID NO: 6904197 - DNA, 22 bp, Homo sapiens
attcacaatgatacataagcga

SEQ ID NO: 6904198 - DNA, 22 bp, Homo sapiens
agcaaggattatcctgggaagg

SEQ ID NO: 6904199 - DNA, 22 bp, Homo sapiens
cccaagttaaaattcagtgctc

SEQ ID NO: 6904200 - DNA, 22 bp, Homo sapiens
gttcctgttgatttcccaggag

SEQ ID NO: 6904201 - DNA, 22 bp, Homo sapiens
tagtgtcaggagggaaatgcaa

SEQ ID NO: 6904202 - DNA, 22 bp, Homo sapiens
gggaagtgtggtttctttacag

SEQ ID NO: 6904203 - DNA, 22 bp, Homo sapiens
ttagtcaaatcattctgtttct

SEQ ID NO: 6904204 - DNA, 22 bp, Homo sapiens
tgcattaaaaccatcgaccatc

SEQ ID NO: 6904205 - DNA, 22 bp, Homo sapiens
agttgtgtccaagggagagcag

SEQ ID NO: 6904206 - DNA, 22 bp, Homo sapiens
ttaaaccactttgttgcaagta

SEQ ID NO: 6904207 - DNA, 22 bp, Homo sapiens
gcctcagaaagtggcaggtagg

SEQ ID NO: 6904208 - DNA, 21 bp, Homo sapiens
atgacagatgctgcagatcgt

SEQ ID NO: 6904209 - DNA, 22 bp, Homo sapiens
tgacttctgggtgagccagcat

SEQ ID NO: 6904210 - DNA, 22 bp, Homo sapiens
ccattgtaaagagtatactttg

SEQ ID NO: 6904211 - DNA, 22 bp, Homo sapiens
tatttcagctctttggattatc

SEQ ID NO: 6904212 - DNA, 22 bp, Homo sapiens
gctgtgggccacacggctgagt

SEQ ID NO: 6904213 - DNA, 22 bp, Homo sapiens
aagcatgtactcaagcaaatgt

SEQ ID NO: 6904214 - DNA, 22 bp, Homo sapiens
ataaactgtgctggatgatgag

SEQ ID NO: 6904215 - DNA, 19 bp, Homo sapiens
agatggcaaaatgcaaaga

SEQ ID NO: 6904216 - DNA, 22 bp, Homo sapiens
attgcacatctgcactacagcc

SEQ ID NO: 6904217 - DNA, 22 bp, Homo sapiens
ctgggagcttttagaaatgcag

SEQ ID NO: 6904218 - DNA, 22 bp, Homo sapiens
acacacgtatatatacgtatgt

SEQ ID NO: 6904219 - DNA, 22 bp, Homo sapiens
tgctgccttagaaatggctata

SEQ ID NO: 6904220 - DNA, 21 bp, Homo sapiens
cacacagtgatctatccacat

SEQ ID NO: 6904221 - DNA, 22 bp, Homo sapiens
gcatggcttctgccaggcacct

SEQ ID NO: 6904222 - DNA, 22 bp, Homo sapiens
ggatgccaactctgtttctgtg

SEQ ID NO: 6904223 - DNA, 22 bp, Homo sapiens
tgacacaaaggaaagcataatc

SEQ ID NO: 6904224 - DNA, 22 bp, Homo sapiens
gagcagcaggtggggctggctt

SEQ ID NO: 6904225 - DNA, 23 bp, Homo sapiens
gctccctgtgctccaggagatgc

SEQ ID NO: 6904226 - DNA, 22 bp, Homo sapiens
ttcatgtaccgtgtaccaggca

SEQ ID NO: 6904227 - DNA, 22 bp, Homo sapiens
cagctattggcaagaagtggtg

SEQ ID NO: 6904228 - DNA, 22 bp, Homo sapiens
aagcaccttccagatttgcacg

SEQ ID NO: 6904229 - DNA, 22 bp, Homo sapiens
ctgagggaaggggtacatggct

SEQ ID NO: 6904230 - DNA, 22 bp, Homo sapiens
acatgtgtaaggtctctcagtc

SEQ ID NO: 6904231 - DNA, 22 bp, Homo sapiens
attcccaccaagcaggccatgc

SEQ ID NO: 6904232 - DNA, 22 bp, Homo sapiens
tgttggcagattgtctagggtt

SEQ ID NO: 6904233 - DNA, 22 bp, Homo sapiens
tcagtacagcttagtcttctca

SEQ ID NO: 6904234 - DNA, 22 bp, Homo sapiens
ttacatctgcactccaggacag

SEQ ID NO: 6904235 - DNA, 22 bp, Homo sapiens
aggctcagcccaaggtggagag

SEQ ID NO: 6904236 - DNA, 22 bp, Homo sapiens
atcttggctgcatttctattcc

SEQ ID NO: 6904237 - DNA, 19 bp, Homo sapiens
gggctttactccaagtggg

SEQ ID NO: 6904238 - DNA, 22 bp, Homo sapiens
caggactggctcgcagtgggtg

SEQ ID NO: 6904239 - DNA, 22 bp, Homo sapiens
atgaactgagcttaattgctga

SEQ ID NO: 6904240 - DNA, 22 bp, Homo sapiens
atgttgtaggtctcatggtaca

SEQ ID NO: 6904241 - DNA, 22 bp, Homo sapiens
accctgtatacgctacattttt

SEQ ID NO: 6904242 - DNA, 22 bp, Homo sapiens
tcacagtgtcacaatgcctgga

SEQ ID NO: 6904243 - DNA, 22 bp, Homo sapiens
gagaagggcttgggagtcaaca

SEQ ID NO: 6904244 - DNA, 22 bp, Homo sapiens
acgcctctgcagctgccgggcc

SEQ ID NO: 6904245 - DNA, 22 bp, Homo sapiens
acactttacagcttcctttgca

SEQ ID NO: 6904246 - DNA, 21 bp, Homo sapiens
attcttggcttagctctctgg

SEQ ID NO: 6904247 - DNA, 22 bp, Homo sapiens
tactgcatcgaaatgcttttat

SEQ ID NO: 6904248 - DNA, 22 bp, Homo sapiens
gcagtattgccctgcctgcagg

SEQ ID NO: 6904249 - DNA, 22 bp, Homo sapiens
tgtacagattgatcatggagag

SEQ ID NO: 6904250 - DNA, 22 bp, Homo sapiens
ggctgtgatgcaattaacacgg

SEQ ID NO: 6904251 - DNA, 22 bp, Homo sapiens
aggtttgtttatgtatcattgg

SEQ ID NO: 6904252 - DNA, 22 bp, Homo sapiens
tctgggacattctctccatagt

SEQ ID NO: 6904253 - DNA, 22 bp, Homo sapiens
gctgttcagggcactcatgggc

SEQ ID NO: 6904254 - DNA, 22 bp, Homo sapiens
aatggcaaagtgttttcatacc

SEQ ID NO: 6904255 - DNA, 22 bp, Homo sapiens
tgtgtctaatgactatttcttc

SEQ ID NO: 6904256 - DNA, 22 bp, Homo sapiens
aacaaagtgtacttccatactg

SEQ ID NO: 6904257 - DNA, 22 bp, Homo sapiens
tggagcagggcatcactgtgcg

SEQ ID NO: 6904258 - DNA, 22 bp, Homo sapiens
ctataaatctacccagcattgg

SEQ ID NO: 6904259 - DNA, 22 bp, Homo sapiens
tagtgggtggaggccagggatg

SEQ ID NO: 6904260 - DNA, 22 bp, Homo sapiens
atgggcaggcactggctctcag

SEQ ID NO: 6904261 - DNA, 22 bp, Homo sapiens
ccaggctttcccagcctctcca

SEQ ID NO: 6904262 - DNA, 21 bp, Homo sapiens
gaaaatacaatgagcttgacc

SEQ ID NO: 6904263 - DNA, 22 bp, Homo sapiens
aggctgtcatggctataggccc

SEQ ID NO: 6904264 - DNA, 22 bp, Homo sapiens
ctttatggaatcaaagactgga

SEQ ID NO: 6904265 - DNA, 22 bp, Homo sapiens
ctggttggaagtgcagactctc

SEQ ID NO: 6904266 - DNA, 22 bp, Homo sapiens
tgctctctcaggcctggcccac

SEQ ID NO: 6904267 - DNA, 22 bp, Homo sapiens
tccagccctgtggcttccaccc

SEQ ID NO: 6904268 - DNA, 22 bp, Homo sapiens
acagcctgagagtggagctggc

SEQ ID NO: 6904269 - DNA, 22 bp, Homo sapiens
ctggagggcttctgcaggttac

SEQ ID NO: 6904270 - DNA, 22 bp, Homo sapiens
attttttgttaactcaggatag

SEQ ID NO: 6904271 - DNA, 22 bp, Homo sapiens
tggtcagcttcagagtgttcca

SEQ ID NO: 6904272 - DNA, 22 bp, Homo sapiens
ttttcctttcatcaggacaaag

SEQ ID NO: 6904273 - DNA, 22 bp, Homo sapiens
gctgttagtcagtggatgcccc

SEQ ID NO: 6904274 - DNA, 22 bp, Homo sapiens
ttgggacagctgtggtagtgag

SEQ ID NO: 6904275 - DNA, 21 bp, Homo sapiens
atttcatggtgcttttaagaa

SEQ ID NO: 6904276 - DNA, 22 bp, Homo sapiens
aagacaggaaaagctccaggcc

SEQ ID NO: 6904277 - DNA, 22 bp, Homo sapiens
gctccacttccttctgccctca

SEQ ID NO: 6904278 - DNA, 22 bp, Homo sapiens
gagcaggccagcaatggaaggg

SEQ ID NO: 6904279 - DNA, 22 bp, Homo sapiens
agtgcttaaaaccctgcactag

SEQ ID NO: 6904280 - DNA, 22 bp, Homo sapiens
ttggaattttccaggtacagtg

SEQ ID NO: 6904281 - DNA, 22 bp, Homo sapiens
tggctaagatttaaatgtttgc

SEQ ID NO: 6904282 - DNA, 22 bp, Homo sapiens
cctcagggaatgggaggctggg

SEQ ID NO: 6904283 - DNA, 22 bp, Homo sapiens
tactgcagatggccttgttctt

SEQ ID NO: 6904284 - DNA, 20 bp, Homo sapiens
aggaaaaatggaaactggag

SEQ ID NO: 6904285 - DNA, 17 bp, Homo sapiens
tcttggccagcttgctg

SEQ ID NO: 6904286 - DNA, 22 bp, Homo sapiens
aggcactgaagaactctttttg

SEQ ID NO: 6904287 - DNA, 22 bp, Homo sapiens
tgcaattaatttacatgcttaa

SEQ ID NO: 6904288 - DNA, 22 bp, Homo sapiens
tgaataaatcaaagactgccct

SEQ ID NO: 6904289 - DNA, 22 bp, Homo sapiens
aaggtgaaactggaagctggcc

SEQ ID NO: 6904290 - DNA, 23 bp, Homo sapiens
atttttcctggaacagtcaccca

SEQ ID NO: 6904291 - DNA, 22 bp, Homo sapiens
aaatgacactaggctttttgca

SEQ ID NO: 6904292 - DNA, 22 bp, Homo sapiens
agtgtgttgtaggctcaaatgg

SEQ ID NO: 6904293 - DNA, 22 bp, Homo sapiens
tgctgccagggctctgcccaca

SEQ ID NO: 6904294 - DNA, 22 bp, Homo sapiens
gtcagcttcctcatctagcctt

SEQ ID NO: 6904295 - DNA, 22 bp, Homo sapiens
ataaaaactgacccatcctttg

SEQ ID NO: 6904296 - DNA, 22 bp, Homo sapiens
gcaggaagcatagaagaatgcc

SEQ ID NO: 6904297 - DNA, 22 bp, Homo sapiens
agtataatttacatttggtatt

SEQ ID NO: 6904298 - DNA, 22 bp, Homo sapiens
gggctgtgtatcagttatctat

SEQ ID NO: 6904299 - DNA, 18 bp, Homo sapiens
ggagactaaactgttgac

SEQ ID NO: 6904300 - DNA, 22 bp, Homo sapiens
ccttggcatgtggcatgtggct

SEQ ID NO: 6904301 - DNA, 20 bp, Homo sapiens
agtcatctcctctactgctt

SEQ ID NO: 6904302 - DNA, 22 bp, Homo sapiens
gaggcaagagaagccagctttc

SEQ ID NO: 6904303 - DNA, 22 bp, Homo sapiens
tggttttgccctctttatgatt

SEQ ID NO: 6904304 - DNA, 22 bp, Homo sapiens
tcattgcactccagcctgggca

SEQ ID NO: 6904305 - DNA, 22 bp, Homo sapiens
aggagccgggcctgggccctgc

SEQ ID NO: 6904306 - DNA, 22 bp, Homo sapiens
tttcacaattttaaggagcaaa

SEQ ID NO: 6904307 - DNA, 22 bp, Homo sapiens
gttgcaggcattaattaaaact

SEQ ID NO: 6904308 - DNA, 23 bp, Homo sapiens
cctggcacacaaggggtgctgca

SEQ ID NO: 6904309 - DNA, 22 bp, Homo sapiens
tcctcagtcagctccgttcttg

SEQ ID NO: 6904310 - DNA, 22 bp, Homo sapiens
ctttgccagagaggctggcaca

SEQ ID NO: 6904311 - DNA, 22 bp, Homo sapiens
gcagaggacagggatttagatt

SEQ ID NO: 6904312 - DNA, 23 bp, Homo sapiens
aggtgcactgtggtggcagtggc

SEQ ID NO: 6904313 - DNA, 22 bp, Homo sapiens
ggcccagaaaaaggcttagaat

SEQ ID NO: 6904314 - DNA, 22 bp, Homo sapiens
agagtggagagaaacaactctg

SEQ ID NO: 6904315 - DNA, 22 bp, Homo sapiens
ctggagcccaggcctggtgtct

SEQ ID NO: 6904316 - DNA, 22 bp, Homo sapiens
cgcatacatagaaacacacaga

SEQ ID NO: 6904317 - DNA, 23 bp, Homo sapiens
aaggatctctgagatcatggctt

SEQ ID NO: 6904318 - DNA, 22 bp, Homo sapiens
gccaagcttggaaggatcatgg

SEQ ID NO: 6904319 - DNA, 22 bp, Homo sapiens
ctcccggctgctccggctcccg

SEQ ID NO: 6904320 - DNA, 22 bp, Homo sapiens
cagctgcagtcatcttctagaa

SEQ ID NO: 6904321 - DNA, 22 bp, Homo sapiens
tcactgaagtcttcaagtagga

SEQ ID NO: 6904322 - DNA, 22 bp, Homo sapiens
gaatatgttctggaagttcttg

SEQ ID NO: 6904323 - DNA, 22 bp, Homo sapiens
gtaggggatggttccctagaaa

SEQ ID NO: 6904324 - DNA, 22 bp, Homo sapiens
cctgaaaatcaaggtagtttgg

SEQ ID NO: 6904325 - DNA, 23 bp, Homo sapiens
gcaccccagatgtgattagttag

SEQ ID NO: 6904326 - DNA, 22 bp, Homo sapiens
gtctttctctggaacagtaaaa

SEQ ID NO: 6904327 - DNA, 22 bp, Homo sapiens
gtacaaattttgacatctagga

SEQ ID NO: 6904328 - DNA, 18 bp, Homo sapiens
aggcaggatcctggcctc

SEQ ID NO: 6904329 - DNA, 17 bp, Homo sapiens
cagtagtggcactggag

SEQ ID NO: 6904330 - DNA, 22 bp, Homo sapiens
ggtgctgatagtaacaataata

SEQ ID NO: 6904331 - DNA, 22 bp, Homo sapiens
agtggcagaactacctttttat

SEQ ID NO: 6904332 - DNA, 22 bp, Homo sapiens
gaccctggtgggcactggcacc

SEQ ID NO: 6904333 - DNA, 20 bp, Homo sapiens
gatgaaatcactgggcagcc

SEQ ID NO: 6904334 - DNA, 22 bp, Homo sapiens
gtatgtatacattgtggaatgg

SEQ ID NO: 6904335 - DNA, 20 bp, Homo sapiens
ttactgtagtactacatttt

SEQ ID NO: 6904336 - DNA, 22 bp, Homo sapiens
cttctccagccacgcccactcc

SEQ ID NO: 6904337 - DNA, 22 bp, Homo sapiens
tgtcctgggtcaaatcctggtc

SEQ ID NO: 6904338 - DNA, 21 bp, Homo sapiens
ggaaaccttccaagcagagac

SEQ ID NO: 6904339 - DNA, 22 bp, Homo sapiens
aggaagcttagtgaaaggacca

SEQ ID NO: 6904340 - DNA, 22 bp, Homo sapiens
ttaaagcaggcatcattcctca

SEQ ID NO: 6904341 - DNA, 22 bp, Homo sapiens
aatgggaagccagaagacaagg

SEQ ID NO: 6904342 - DNA, 22 bp, Homo sapiens
aaacatcttctcttgattcttt

SEQ ID NO: 6904343 - DNA, 22 bp, Homo sapiens
ctgctaaacctctctgagagct

SEQ ID NO: 6904344 - DNA, 22 bp, Homo sapiens
gagtggctattgatccgtgatg

SEQ ID NO: 6904345 - DNA, 22 bp, Homo sapiens
gtgagacacgtgtgtgacctgg

SEQ ID NO: 6904346 - DNA, 22 bp, Homo sapiens
ggcttccagtgatgcctctttg

SEQ ID NO: 6904347 - DNA, 22 bp, Homo sapiens
ctgaagttaacatcttgatgtc

SEQ ID NO: 6904348 - DNA, 22 bp, Homo sapiens
gctctcagcccactgaggggaa

SEQ ID NO: 6904349 - DNA, 22 bp, Homo sapiens
tctggttgtcgaccaccaatgc

SEQ ID NO: 6904350 - DNA, 22 bp, Homo sapiens
ggtctgagtggtgctgactcag

SEQ ID NO: 6904351 - DNA, 20 bp, Homo sapiens
aactgagagttcaggaggag

SEQ ID NO: 6904352 - DNA, 22 bp, Homo sapiens
agctgctgaatgacactgcaag

SEQ ID NO: 6904353 - DNA, 22 bp, Homo sapiens
gccactgtcatcttgtgaagca

SEQ ID NO: 6904354 - DNA, 22 bp, Homo sapiens
cagcaggtctcagcagctcctt

SEQ ID NO: 6904355 - DNA, 22 bp, Homo sapiens
ttccatgaaggagactgagaag

SEQ ID NO: 6904356 - DNA, 22 bp, Homo sapiens
aggcctggtgtgccggatgcag

SEQ ID NO: 6904357 - DNA, 23 bp, Homo sapiens
tttgtacattgaggaggcagaat

SEQ ID NO: 6904358 - DNA, 22 bp, Homo sapiens
taaacctgcaactatagccacc

SEQ ID NO: 6904359 - DNA, 22 bp, Homo sapiens
tgtgacatgtgtcatcttttct

SEQ ID NO: 6904360 - DNA, 23 bp, Homo sapiens
catccaggagctgagtctgactg

SEQ ID NO: 6904361 - DNA, 22 bp, Homo sapiens
cacagcaaaggcttcggctgat

SEQ ID NO: 6904362 - DNA, 17 bp, Homo sapiens
tgggttggggatttgga

SEQ ID NO: 6904363 - DNA, 22 bp, Homo sapiens
tttgaatgacatgattcaggca

SEQ ID NO: 6904364 - DNA, 22 bp, Homo sapiens
atgattcaggattgaaccattt

SEQ ID NO: 6904365 - DNA, 21 bp, Homo sapiens
tagcagagagttaacttctcc

SEQ ID NO: 6904366 - DNA, 22 bp, Homo sapiens
gatatcattgagcccaggagtt

SEQ ID NO: 6904367 - DNA, 22 bp, Homo sapiens
tgatggctatccctggaagggc

SEQ ID NO: 6904368 - DNA, 22 bp, Homo sapiens
tgttcttaacttttgtgtatat

SEQ ID NO: 6904369 - DNA, 22 bp, Homo sapiens
gtgttttatggagtcataacgt

SEQ ID NO: 6904370 - DNA, 22 bp, Homo sapiens
agcctcttattctccaggactt

SEQ ID NO: 6904371 - DNA, 22 bp, Homo sapiens
tcaagaaagggcttcaccagga

SEQ ID NO: 6904372 - DNA, 22 bp, Homo sapiens
aatgaggtacagggccttggaa

SEQ ID NO: 6904373 - DNA, 22 bp, Homo sapiens
cagtaaatagtggagatgtggg

SEQ ID NO: 6904374 - DNA, 22 bp, Homo sapiens
tttgggaaacttaggggtcaga

SEQ ID NO: 6904375 - DNA, 22 bp, Homo sapiens
tgtggacagagccctggtttgg

SEQ ID NO: 6904376 - DNA, 22 bp, Homo sapiens
ccagcttctctctgatgcagct

SEQ ID NO: 6904377 - DNA, 22 bp, Homo sapiens
atctacaggatagtttaatatt

SEQ ID NO: 6904378 - DNA, 22 bp, Homo sapiens
ttctgagggaaccttgttcttg

SEQ ID NO: 6904379 - DNA, 22 bp, Homo sapiens
gatgtctgggtcttcctggctt

SEQ ID NO: 6904380 - DNA, 18 bp, Homo sapiens
ggaaggtgctggagtgca

SEQ ID NO: 6904381 - DNA, 22 bp, Homo sapiens
cacccagggctgtgcctgccca

SEQ ID NO: 6904382 - DNA, 19 bp, Homo sapiens
aagggctgggcacctcact

SEQ ID NO: 6904383 - DNA, 21 bp, Homo sapiens
tgaaacagatggaagtatttg

SEQ ID NO: 6904384 - DNA, 22 bp, Homo sapiens
tctgagagcatcactggggtac

SEQ ID NO: 6904385 - DNA, 21 bp, Homo sapiens
acagccttgtgatggagacag

SEQ ID NO: 6904386 - DNA, 22 bp, Homo sapiens
tagtgtacatttaattttgcaa

SEQ ID NO: 6904387 - DNA, 22 bp, Homo sapiens
ggctggttagttgaggaggact

SEQ ID NO: 6904388 - DNA, 22 bp, Homo sapiens
aggcaataagcctcaactgtct

SEQ ID NO: 6904389 - DNA, 22 bp, Homo sapiens
agacagacgtagtgtgagagta

SEQ ID NO: 6904390 - DNA, 22 bp, Homo sapiens
tggctgccaagcaggtcagaga

SEQ ID NO: 6904391 - DNA, 22 bp, Homo sapiens
ttgattctaaaataggaggaaa

SEQ ID NO: 6904392 - DNA, 22 bp, Homo sapiens
tcatgatttacttggtggatga

SEQ ID NO: 6904393 - DNA, 22 bp, Homo sapiens
tgaggcaggacttgcataaagt

SEQ ID NO: 6904394 - DNA, 23 bp, Homo sapiens
tttgaaagtatcaactcgcctga

SEQ ID NO: 6904395 - DNA, 22 bp, Homo sapiens
tttccagggctctgtagaagaa

SEQ ID NO: 6904396 - DNA, 22 bp, Homo sapiens
taaatgcaatgtgctttaccag

SEQ ID NO: 6904397 - DNA, 22 bp, Homo sapiens
aatgctttaaatcctagtgtaa

SEQ ID NO: 6904398 - DNA, 22 bp, Homo sapiens
atgggagtccaacatcaaggac

SEQ ID NO: 6904399 - DNA, 22 bp, Homo sapiens
agaagcacaggtaaagtgattt

SEQ ID NO: 6904400 - DNA, 22 bp, Homo sapiens
ggtgccaagttgcaactcgcca

SEQ ID NO: 6904401 - DNA, 22 bp, Homo sapiens
aagatacatgttaggagcaacc

SEQ ID NO: 6904402 - DNA, 22 bp, Homo sapiens
agcttcttaagttcctgcagca

SEQ ID NO: 6904403 - DNA, 22 bp, Homo sapiens
attattgcaagcagtgaaggga

SEQ ID NO: 6904404 - DNA, 22 bp, Homo sapiens
tcattcttgcgtatgccatggt

SEQ ID NO: 6904405 - DNA, 22 bp, Homo sapiens
agcagggctctgtggagggtgg

SEQ ID NO: 6904406 - DNA, 22 bp, Homo sapiens
ctgggaccagtgaagcaactca

SEQ ID NO: 6904407 - DNA, 22 bp, Homo sapiens
tgttttctgattctcgtgtggt

SEQ ID NO: 6904408 - DNA, 22 bp, Homo sapiens
aatgaaaattggaccctagaac

SEQ ID NO: 6904409 - DNA, 22 bp, Homo sapiens
tcaggcagagggagaagccaag

SEQ ID NO: 6904410 - DNA, 22 bp, Homo sapiens
catgggtagtaacagagggata

SEQ ID NO: 6904411 - DNA, 22 bp, Homo sapiens
tgcagctttgctctggtcccca

SEQ ID NO: 6904412 - DNA, 19 bp, Homo sapiens
tcttggctttgtctactgt

SEQ ID NO: 6904413 - DNA, 22 bp, Homo sapiens
ttccagtccagggctgtttcca

SEQ ID NO: 6904414 - DNA, 22 bp, Homo sapiens
caaagagtccagcaccctctcc

SEQ ID NO: 6904415 - DNA, 22 bp, Homo sapiens
ccagcagaagctcccgctgggt

SEQ ID NO: 6904416 - DNA, 23 bp, Homo sapiens
gcagaaattctcacactgaggcc

SEQ ID NO: 6904417 - DNA, 22 bp, Homo sapiens
ttggaatatgtgtatgaaaagc

SEQ ID NO: 6904418 - DNA, 22 bp, Homo sapiens
caccagggccccaggctgtgcc

SEQ ID NO: 6904419 - DNA, 22 bp, Homo sapiens
cagtgtttagatcaagaaggcc

SEQ ID NO: 6904420 - DNA, 22 bp, Homo sapiens
gtcacaaaggtgagggacatga

SEQ ID NO: 6904421 - DNA, 22 bp, Homo sapiens
tggaatgatctgatgtatttta

SEQ ID NO: 6904422 - DNA, 22 bp, Homo sapiens
tctcttggaacacttgctctta

SEQ ID NO: 6904423 - DNA, 22 bp, Homo sapiens
agagttctgaattttattctct

SEQ ID NO: 6904424 - DNA, 22 bp, Homo sapiens
ttaaaaccatcagctgtaagat

SEQ ID NO: 6904425 - DNA, 19 bp, Homo sapiens
atacagagcttcctaattt

SEQ ID NO: 6904426 - DNA, 22 bp, Homo sapiens
ggaaaggggcctggatcttttg

SEQ ID NO: 6904427 - DNA, 22 bp, Homo sapiens
tatcaagagtctctacattaat

SEQ ID NO: 6904428 - DNA, 22 bp, Homo sapiens
attttcagaacattcattcact

SEQ ID NO: 6904429 - DNA, 22 bp, Homo sapiens
ggggtactggctggagccccac

SEQ ID NO: 6904430 - DNA, 22 bp, Homo sapiens
tagctttgcaaaggaagtttta

SEQ ID NO: 6904431 - DNA, 22 bp, Homo sapiens
ttgacagaaatgtatttgcatg

SEQ ID NO: 6904432 - DNA, 23 bp, Homo sapiens
ccacaggagggttcatttattca

SEQ ID NO: 6904433 - DNA, 22 bp, Homo sapiens
aagtcactaagtgaaccactgg

SEQ ID NO: 6904434 - DNA, 19 bp, Homo sapiens
agcagctggaggtggagtg

SEQ ID NO: 6904435 - DNA, 22 bp, Homo sapiens
aaaatctggtaatttgaatgtg

SEQ ID NO: 6904436 - DNA, 22 bp, Homo sapiens
aaaccgggtccagatcttcagg

SEQ ID NO: 6904437 - DNA, 22 bp, Homo sapiens
tttggaggggaagaccttggag

SEQ ID NO: 6904438 - DNA, 22 bp, Homo sapiens
agttctgggaggtgcacgtcca

SEQ ID NO: 6904439 - DNA, 22 bp, Homo sapiens
tggcactgggacagatgctctc

SEQ ID NO: 6904440 - DNA, 22 bp, Homo sapiens
tgttggcttgaccttcgctgtt

SEQ ID NO: 6904441 - DNA, 22 bp, Homo sapiens
actgagcatcagggctgggaac

SEQ ID NO: 6904442 - DNA, 20 bp, Homo sapiens
aggagggacctggattggcg

SEQ ID NO: 6904443 - DNA, 22 bp, Homo sapiens
ttttccttctgatactccattt

SEQ ID NO: 6904444 - DNA, 22 bp, Homo sapiens
tttcagtttccagctttgtcat

SEQ ID NO: 6904445 - DNA, 22 bp, Homo sapiens
gtgcttctctgctctacccggc

SEQ ID NO: 6904446 - DNA, 22 bp, Homo sapiens
cgtcacttcttagtctattttc

SEQ ID NO: 6904447 - DNA, 22 bp, Homo sapiens
ggcaaggtgctacagacagtga

SEQ ID NO: 6904448 - DNA, 22 bp, Homo sapiens
gcagcagcagggagtctgactt

SEQ ID NO: 6904449 - DNA, 22 bp, Homo sapiens
gaggggtggccctggcgtgtac

SEQ ID NO: 6904450 - DNA, 22 bp, Homo sapiens
ccttccagagttcagtctgccc

SEQ ID NO: 6904451 - DNA, 22 bp, Homo sapiens
gatgaggtcatgttttacatat

SEQ ID NO: 6904452 - DNA, 22 bp, Homo sapiens
ttcagagggcttgctatgtaca

SEQ ID NO: 6904453 - DNA, 22 bp, Homo sapiens
gaggttagaggtcagtgcagtc

SEQ ID NO: 6904454 - DNA, 18 bp, Homo sapiens
gagcatgggcagtgggga

SEQ ID NO: 6904455 - DNA, 22 bp, Homo sapiens
tctgatgtctgaaatgctcttg

SEQ ID NO: 6904456 - DNA, 22 bp, Homo sapiens
agagaaagtcctgatctctcta

SEQ ID NO: 6904457 - DNA, 17 bp, Homo sapiens
attgactcatttatcat

SEQ ID NO: 6904458 - DNA, 22 bp, Homo sapiens
agtagtttgggcagtgacagat

SEQ ID NO: 6904459 - DNA, 20 bp, Homo sapiens
tgcaaacacagagtgtatga

SEQ ID NO: 6904460 - DNA, 17 bp, Homo sapiens
aggcctctgccggtgcc

SEQ ID NO: 6904461 - DNA, 22 bp, Homo sapiens
acctttggaaataaacactctg

SEQ ID NO: 6904462 - DNA, 22 bp, Homo sapiens
cactgggagtcgtaagacacgg

SEQ ID NO: 6904463 - DNA, 22 bp, Homo sapiens
aggaagctttatgaccagctaa

SEQ ID NO: 6904464 - DNA, 22 bp, Homo sapiens
tagatgtaaaattgagactatt

SEQ ID NO: 6904465 - DNA, 22 bp, Homo sapiens
agcagttgtagtcatggaaaat

SEQ ID NO: 6904466 - DNA, 22 bp, Homo sapiens
gagtggcatatgtgcctgtgaa

SEQ ID NO: 6904467 - DNA, 22 bp, Homo sapiens
gcagacacagggaaggcaagga

SEQ ID NO: 6904468 - DNA, 21 bp, Homo sapiens
tattgtcaatctgctttcaga

SEQ ID NO: 6904469 - DNA, 22 bp, Homo sapiens
tttactcttgctacacaactgt

SEQ ID NO: 6904470 - DNA, 22 bp, Homo sapiens
ctgtcccagatgttctcagcac

SEQ ID NO: 6904471 - DNA, 22 bp, Homo sapiens
tttgttcagctctcattgatta

SEQ ID NO: 6904472 - DNA, 22 bp, Homo sapiens
tgctggaggagaaggttgctca

SEQ ID NO: 6904473 - DNA, 22 bp, Homo sapiens
tattactgtcaatatcacagaa

SEQ ID NO: 6904474 - DNA, 22 bp, Homo sapiens
ttgtctatttgttcaggtaagg

SEQ ID NO: 6904475 - DNA, 22 bp, Homo sapiens
tggtcctggagatcaatatgca

SEQ ID NO: 6904476 - DNA, 22 bp, Homo sapiens
cagaaacacttgtagagaagtt

SEQ ID NO: 6904477 - DNA, 22 bp, Homo sapiens
cgttttcttcactttgcaagtt

SEQ ID NO: 6904478 - DNA, 22 bp, Homo sapiens
cctgagctcaaagggtgcctgg

SEQ ID NO: 6904479 - DNA, 22 bp, Homo sapiens
tgtcccacaacatttgaggagg

SEQ ID NO: 6904480 - DNA, 22 bp, Homo sapiens
taagtgcatgattgaacttggc

SEQ ID NO: 6904481 - DNA, 22 bp, Homo sapiens
ggctccaccctgcttccagaag

SEQ ID NO: 6904482 - DNA, 23 bp, Homo sapiens
tcagcttcattgtcttctatggc

SEQ ID NO: 6904483 - DNA, 22 bp, Homo sapiens
ggcaacatgatgtcaaccagga

SEQ ID NO: 6904484 - DNA, 22 bp, Homo sapiens
acaatttcaccttttggttcaa

SEQ ID NO: 6904485 - DNA, 22 bp, Homo sapiens
ttttggtagcttatgtgcagtt

SEQ ID NO: 6904486 - DNA, 22 bp, Homo sapiens
gagcaagactacaggcagatga

SEQ ID NO: 6904487 - DNA, 20 bp, Homo sapiens
tcaaagcaaagggagatgat

SEQ ID NO: 6904488 - DNA, 22 bp, Homo sapiens
gaggctgacggcaccatcttct

SEQ ID NO: 6904489 - DNA, 22 bp, Homo sapiens
aggtcttgtgaaggactgtgcc

SEQ ID NO: 6904490 - DNA, 22 bp, Homo sapiens
gggaaaaataatgcacagatat

SEQ ID NO: 6904491 - DNA, 22 bp, Homo sapiens
gcctcagtaaccttaggggata

SEQ ID NO: 6904492 - DNA, 22 bp, Homo sapiens
gagggagggccaggtcccaacc

SEQ ID NO: 6904493 - DNA, 22 bp, Homo sapiens
gaatgtctgtttcaacaagcac

SEQ ID NO: 6904494 - DNA, 22 bp, Homo sapiens
tagtaaaaggtcttcctttgtt

SEQ ID NO: 6904495 - DNA, 22 bp, Homo sapiens
agagggagctttatttttctgt

SEQ ID NO: 6904496 - DNA, 18 bp, Homo sapiens
ttaatgtggcttactatg

SEQ ID NO: 6904497 - DNA, 22 bp, Homo sapiens
tagtgccatgcgaggggtggga

SEQ ID NO: 6904498 - DNA, 22 bp, Homo sapiens
actctgaatgtgcatgtaaatc

SEQ ID NO: 6904499 - DNA, 22 bp, Homo sapiens
gcagacgtcaccgagtcgatgg

SEQ ID NO: 6904500 - DNA, 22 bp, Homo sapiens
ttgcttcctctgtgcaatcctc

SEQ ID NO: 6904501 - DNA, 22 bp, Homo sapiens
tagcatgtcagtcgccacacgt

SEQ ID NO: 6904502 - DNA, 22 bp, Homo sapiens
agtgtggatttagttgtgcttt

SEQ ID NO: 6904503 - DNA, 22 bp, Homo sapiens
tcctgtagctgtcactgggggc

SEQ ID NO: 6904504 - DNA, 21 bp, Homo sapiens
agaggcaggcattaagtacac

SEQ ID NO: 6904505 - DNA, 22 bp, Homo sapiens
tcagctctgcactccactgtgg

SEQ ID NO: 6904506 - DNA, 22 bp, Homo sapiens
gaccttctgttggaggcattta

SEQ ID NO: 6904507 - DNA, 22 bp, Homo sapiens
cctgctgtgtgacgggatgtta

SEQ ID NO: 6904508 - DNA, 22 bp, Homo sapiens
cgcacagctgcaaggagttgca

SEQ ID NO: 6904509 - DNA, 22 bp, Homo sapiens
ctgcaaggtccacctgctacat

SEQ ID NO: 6904510 - DNA, 22 bp, Homo sapiens
caggcacggtggctcatgcctg

SEQ ID NO: 6904511 - DNA, 22 bp, Homo sapiens
tttattgaacacttgcactggc

SEQ ID NO: 6904512 - DNA, 22 bp, Homo sapiens
aatgaacaagaaagactttgag

SEQ ID NO: 6904513 - DNA, 22 bp, Homo sapiens
gtggccctgtcccaggcctcct

SEQ ID NO: 6904514 - DNA, 23 bp, Homo sapiens
tatgatggtatcaggagatgggg

SEQ ID NO: 6904515 - DNA, 22 bp, Homo sapiens
atgacaagggagggtcctgcta

SEQ ID NO: 6904516 - DNA, 22 bp, Homo sapiens
ttttgcttatctgagtgcagcc

SEQ ID NO: 6904517 - DNA, 17 bp, Homo sapiens
cttctctggcagaagat

SEQ ID NO: 6904518 - DNA, 22 bp, Homo sapiens
aataatgagcttgtctaattgt

SEQ ID NO: 6904519 - DNA, 22 bp, Homo sapiens
tagtgtcagagaatcttggttt

SEQ ID NO: 6904520 - DNA, 20 bp, Homo sapiens
gtagggaaggaatctgcagg

SEQ ID NO: 6904521 - DNA, 23 bp, Homo sapiens
tctggtactattgctgttgagca

SEQ ID NO: 6904522 - DNA, 22 bp, Homo sapiens
cttgcagggctgatgggaagtg

SEQ ID NO: 6904523 - DNA, 22 bp, Homo sapiens
gctctggggatgcttctgccgt

SEQ ID NO: 6904524 - DNA, 22 bp, Homo sapiens
ctagcttagtcttggatatgta

SEQ ID NO: 6904525 - DNA, 19 bp, Homo sapiens
acagtccagctgtttgtac

SEQ ID NO: 6904526 - DNA, 22 bp, Homo sapiens
actgtttcaggcaaggcaggcc

SEQ ID NO: 6904527 - DNA, 22 bp, Homo sapiens
acagatggagctactaggtaaa

SEQ ID NO: 6904528 - DNA, 22 bp, Homo sapiens
aatggcctggagggaatacaga

SEQ ID NO: 6904529 - DNA, 22 bp, Homo sapiens
ctcttaaaattacctttgcaaa

SEQ ID NO: 6904530 - DNA, 22 bp, Homo sapiens
ctggctgtgtgtcttcattcag

SEQ ID NO: 6904531 - DNA, 22 bp, Homo sapiens
agggacatctcacaaacaactt

SEQ ID NO: 6904532 - DNA, 22 bp, Homo sapiens
tgctcttaattccattagactt

SEQ ID NO: 6904533 - DNA, 22 bp, Homo sapiens
gtagacaggttataaatcagtg

SEQ ID NO: 6904534 - DNA, 22 bp, Homo sapiens
tattcacatgaaaacaaatttt

SEQ ID NO: 6904535 - DNA, 22 bp, Homo sapiens
tcagggacagggtgctgctgcg

SEQ ID NO: 6904536 - DNA, 22 bp, Homo sapiens
tggatcctcttaatgtgtaagg

SEQ ID NO: 6904537 - DNA, 22 bp, Homo sapiens
ggcaggcactgtgttttgtgtt

SEQ ID NO: 6904538 - DNA, 22 bp, Homo sapiens
tggtgttgcaaataaagtccaa

SEQ ID NO: 6904539 - DNA, 22 bp, Homo sapiens
tcttgtaattaactagaaagat

SEQ ID NO: 6904540 - DNA, 22 bp, Homo sapiens
attgatttgtagtgcctgcact

SEQ ID NO: 6904541 - DNA, 22 bp, Homo sapiens
gtataactgctaccacctgatg

SEQ ID NO: 6904542 - DNA, 22 bp, Homo sapiens
gtgggtgcggggagccgaggcg

SEQ ID NO: 6904543 - DNA, 22 bp, Homo sapiens
gatagcaacatagaacagaatt

SEQ ID NO: 6904544 - DNA, 22 bp, Homo sapiens
caaagtggaggctctggggcca

SEQ ID NO: 6904545 - DNA, 22 bp, Homo sapiens
ctttggaaagtggttcaggtga

SEQ ID NO: 6904546 - DNA, 22 bp, Homo sapiens
agggcagctggaaggtggcttc

SEQ ID NO: 6904547 - DNA, 22 bp, Homo sapiens
tttaattgttgtgggtacatag

SEQ ID NO: 6904548 - DNA, 22 bp, Homo sapiens
atgtccttcgtaggggcagcag

SEQ ID NO: 6904549 - DNA, 22 bp, Homo sapiens
tgcaccagtttctcagagaatc

SEQ ID NO: 6904550 - DNA, 22 bp, Homo sapiens
cacatgcaccagaaatcaacat

SEQ ID NO: 6904551 - DNA, 22 bp, Homo sapiens
aaagaggaaccaagagcacgtg

SEQ ID NO: 6904552 - DNA, 22 bp, Homo sapiens
agtcttgggagaggctggcagt

SEQ ID NO: 6904553 - DNA, 20 bp, Homo sapiens
taacaggaagcattatttta

SEQ ID NO: 6904554 - DNA, 19 bp, Homo sapiens
gccaggtcttgggtccagg

SEQ ID NO: 6904555 - DNA, 22 bp, Homo sapiens
tttcccttctttcctgagtaat

SEQ ID NO: 6904556 - DNA, 22 bp, Homo sapiens
acttcagagactttatggtcca

SEQ ID NO: 6904557 - DNA, 22 bp, Homo sapiens
gttataaatacctaataggatt

SEQ ID NO: 6904558 - DNA, 22 bp, Homo sapiens
ctacagaagtttcccttgctta

SEQ ID NO: 6904559 - DNA, 22 bp, Homo sapiens
acccagggaccccgctgacgcc

SEQ ID NO: 6904560 - DNA, 22 bp, Homo sapiens
ctctgaaactcctgcaccttct

SEQ ID NO: 6904561 - DNA, 16 bp, Homo sapiens
tgtgcatgttctgtgt

SEQ ID NO: 6904562 - DNA, 22 bp, Homo sapiens
ttgaagatggatcgccactctc

SEQ ID NO: 6904563 - DNA, 22 bp, Homo sapiens
gcagatctttaacagggtcact

SEQ ID NO: 6904564 - DNA, 22 bp, Homo sapiens
actgccagcaatgtgaaagaaa

SEQ ID NO: 6904565 - DNA, 22 bp, Homo sapiens
ggtgcaagttttttgaggaagt

SEQ ID NO: 6904566 - DNA, 22 bp, Homo sapiens
cagggagcggagtcccatgcct

SEQ ID NO: 6904567 - DNA, 22 bp, Homo sapiens
atgacaggttttgtggattata

SEQ ID NO: 6904568 - DNA, 22 bp, Homo sapiens
gcttcagccgggcacttaatga

SEQ ID NO: 6904569 - DNA, 22 bp, Homo sapiens
gattgggcctcattttcaccct

SEQ ID NO: 6904570 - DNA, 22 bp, Homo sapiens
agtgtgttctcaatgaaaagaa

SEQ ID NO: 6904571 - DNA, 22 bp, Homo sapiens
atttcagtgtcttcttctccct

SEQ ID NO: 6904572 - DNA, 22 bp, Homo sapiens
acatgtaaaaggaacatgcatg

SEQ ID NO: 6904573 - DNA, 22 bp, Homo sapiens
ggtaggggcagggccaagctgt

SEQ ID NO: 6904574 - DNA, 22 bp, Homo sapiens
ctgatgcctctcttcttggctt

SEQ ID NO: 6904575 - DNA, 22 bp, Homo sapiens
gaggctcagagggactttcaag

SEQ ID NO: 6904576 - DNA, 22 bp, Homo sapiens
tgtcttcattctgtatgtccag

SEQ ID NO: 6904577 - DNA, 22 bp, Homo sapiens
gcaaaatgatcttcttcaggct

SEQ ID NO: 6904578 - DNA, 22 bp, Homo sapiens
tgtctctgtgactccttccgcc

SEQ ID NO: 6904579 - DNA, 22 bp, Homo sapiens
tcctgggctgtgtgccactctg

SEQ ID NO: 6904580 - DNA, 22 bp, Homo sapiens
tgcagcatccatatattattag

SEQ ID NO: 6904581 - DNA, 22 bp, Homo sapiens
acttggaaagatgcaacacagt

SEQ ID NO: 6904582 - DNA, 22 bp, Homo sapiens
cggcatccccacttcctcctgc

SEQ ID NO: 6904583 - DNA, 22 bp, Homo sapiens
tcatgcatcaatttctctttag

SEQ ID NO: 6904584 - DNA, 22 bp, Homo sapiens
atttcctaatttatgcaggagt

SEQ ID NO: 6904585 - DNA, 22 bp, Homo sapiens
tttaggcagcagtgaggatgaa

SEQ ID NO: 6904586 - DNA, 22 bp, Homo sapiens
agaaagggagagccagcacacg

SEQ ID NO: 6904587 - DNA, 22 bp, Homo sapiens
tctgagagagcacctatccact

SEQ ID NO: 6904588 - DNA, 22 bp, Homo sapiens
ccaggccaggagagcgaggttt

SEQ ID NO: 6904589 - DNA, 22 bp, Homo sapiens
aatgtttgcctgactagagtgg

SEQ ID NO: 6904590 - DNA, 18 bp, Homo sapiens
tgaggccagagtgggcat

SEQ ID NO: 6904591 - DNA, 22 bp, Homo sapiens
tttccttgttattatttgtcct

SEQ ID NO: 6904592 - DNA, 22 bp, Homo sapiens
acagattttaaatgacactccc

SEQ ID NO: 6904593 - DNA, 22 bp, Homo sapiens
tggaggaagttgctggaagtca

SEQ ID NO: 6904594 - DNA, 22 bp, Homo sapiens
tcaatttcattctattagttaa

SEQ ID NO: 6904595 - DNA, 22 bp, Homo sapiens
aaagtaattgtggttcttgcca

SEQ ID NO: 6904596 - DNA, 22 bp, Homo sapiens
tgtggaatgggagtgagaagac

SEQ ID NO: 6904597 - DNA, 22 bp, Homo sapiens
agtgataatgtggtaattattt

SEQ ID NO: 6904598 - DNA, 22 bp, Homo sapiens
gtgcagagaggtggagggactt

SEQ ID NO: 6904599 - DNA, 22 bp, Homo sapiens
ctgctgtgcaacattgcaccta

SEQ ID NO: 6904600 - DNA, 22 bp, Homo sapiens
tgtcatggaggcctcccctaaa

SEQ ID NO: 6904601 - DNA, 17 bp, Homo sapiens
cagtgcagataagtgag

SEQ ID NO: 6904602 - DNA, 22 bp, Homo sapiens
aagtttctgccatactgtggtg

SEQ ID NO: 6904603 - DNA, 21 bp, Homo sapiens
gtgtgtctaatgtagtggaaa

SEQ ID NO: 6904604 - DNA, 22 bp, Homo sapiens
aaggcagtctggtttcaaagca

SEQ ID NO: 6904605 - DNA, 22 bp, Homo sapiens
ctggctctcaggctggtcccca

SEQ ID NO: 6904606 - DNA, 22 bp, Homo sapiens
ccagcatccctggggttggcca

SEQ ID NO: 6904607 - DNA, 22 bp, Homo sapiens
aggacaatctctcctttatcag

SEQ ID NO: 6904608 - DNA, 22 bp, Homo sapiens
atctccagctcgcagagctcct

SEQ ID NO: 6904609 - DNA, 22 bp, Homo sapiens
ggcggagcttgcagtgagccga

SEQ ID NO: 6904610 - DNA, 21 bp, Homo sapiens
caggtctggtgaacactctca

SEQ ID NO: 6904611 - DNA, 23 bp, Homo sapiens
tgatgccaagcatggagatacaa

SEQ ID NO: 6904612 - DNA, 22 bp, Homo sapiens
taaaggctcactggcttggggt

SEQ ID NO: 6904613 - DNA, 22 bp, Homo sapiens
cttgtctttatttcatattcca

SEQ ID NO: 6904614 - DNA, 22 bp, Homo sapiens
tggtaaggattgtagaaacgaa

SEQ ID NO: 6904615 - DNA, 22 bp, Homo sapiens
atctgaagtggagaaaaatata

SEQ ID NO: 6904616 - DNA, 22 bp, Homo sapiens
cctggctcccggaacagggtct

SEQ ID NO: 6904617 - DNA, 22 bp, Homo sapiens
gcctcagggggagaggccagct

SEQ ID NO: 6904618 - DNA, 22 bp, Homo sapiens
atctgacaagttgtgtgtatag

SEQ ID NO: 6904619 - DNA, 22 bp, Homo sapiens
tggttaagtccagaaaggaagc

SEQ ID NO: 6904620 - DNA, 22 bp, Homo sapiens
aagtttttcacattgctgttgt

SEQ ID NO: 6904621 - DNA, 22 bp, Homo sapiens
tgatgggactgccagctgctga

SEQ ID NO: 6904622 - DNA, 22 bp, Homo sapiens
ttggcagtagtggtagtacatt

SEQ ID NO: 6904623 - DNA, 22 bp, Homo sapiens
gctgctttactgaagagatatg

SEQ ID NO: 6904624 - DNA, 22 bp, Homo sapiens
tgagatcatatgtacaaggtct

SEQ ID NO: 6904625 - DNA, 22 bp, Homo sapiens
ttgtgagcattttggtgagctt

SEQ ID NO: 6904626 - DNA, 20 bp, Homo sapiens
ttgagcagcagtgctgtgtc

SEQ ID NO: 6904627 - DNA, 22 bp, Homo sapiens
atgagacaagagtctaaattca

SEQ ID NO: 6904628 - DNA, 22 bp, Homo sapiens
cccagtgtctcttgtgcctttc

SEQ ID NO: 6904629 - DNA, 22 bp, Homo sapiens
ggccaccttcctgtggtctctg

SEQ ID NO: 6904630 - DNA, 22 bp, Homo sapiens
agattaagaactcctggactgg

SEQ ID NO: 6904631 - DNA, 22 bp, Homo sapiens
tgtttagtaggagtttaatact

SEQ ID NO: 6904632 - DNA, 22 bp, Homo sapiens
aggaacacttaattcgatacta

SEQ ID NO: 6904633 - DNA, 22 bp, Homo sapiens
ggcccagagctctgggggagct

SEQ ID NO: 6904634 - DNA, 22 bp, Homo sapiens
acagttaggtcctaaaattctg

SEQ ID NO: 6904635 - DNA, 22 bp, Homo sapiens
aaccctgggaaacttaatgtca

SEQ ID NO: 6904636 - DNA, 22 bp, Homo sapiens
tatgactttggaaaaattactt

SEQ ID NO: 6904637 - DNA, 22 bp, Homo sapiens
ctgctactggttctgcttgttc

SEQ ID NO: 6904638 - DNA, 23 bp, Homo sapiens
aggaggaaaagttatctgctgag

SEQ ID NO: 6904639 - DNA, 22 bp, Homo sapiens
tatcagcaggccaaagctgcaa

SEQ ID NO: 6904640 - DNA, 20 bp, Homo sapiens
aacattgaaagtctagaaga

SEQ ID NO: 6904641 - DNA, 22 bp, Homo sapiens
gtgtcatgcacactcagtgttg

SEQ ID NO: 6904642 - DNA, 22 bp, Homo sapiens
atcattagaccaaactagagct

SEQ ID NO: 6904643 - DNA, 18 bp, Homo sapiens
gacactgagcattttgag

SEQ ID NO: 6904644 - DNA, 22 bp, Homo sapiens
ctacaccttgatctaacatttt

SEQ ID NO: 6904645 - DNA, 22 bp, Homo sapiens
agtacatattgagtggtgatat

SEQ ID NO: 6904646 - DNA, 22 bp, Homo sapiens
tctggccagtagatgtgggttg

SEQ ID NO: 6904647 - DNA, 22 bp, Homo sapiens
tatcacacataactaagctgca

SEQ ID NO: 6904648 - DNA, 22 bp, Homo sapiens
tcagaaaatgaaatggactctc

SEQ ID NO: 6904649 - DNA, 22 bp, Homo sapiens
taaagatcttaggaagattttc

SEQ ID NO: 6904650 - DNA, 22 bp, Homo sapiens
gaaacagtcaactttctttccc

SEQ ID NO: 6904651 - DNA, 22 bp, Homo sapiens
gtctgagaggaggcagcctcgg

SEQ ID NO: 6904652 - DNA, 22 bp, Homo sapiens
actggggctgatgcgttcgtgt

SEQ ID NO: 6904653 - DNA, 22 bp, Homo sapiens
ccttccagggctctccagaacc

SEQ ID NO: 6904654 - DNA, 23 bp, Homo sapiens
tcttgtttcctttgcgctatcca

SEQ ID NO: 6904655 - DNA, 22 bp, Homo sapiens
aatggctctgatgttgttgtga

SEQ ID NO: 6904656 - DNA, 22 bp, Homo sapiens
aatgtaccagcctaagaagtgg

SEQ ID NO: 6904657 - DNA, 23 bp, Homo sapiens
tttgaagttgactgccttccaga

SEQ ID NO: 6904658 - DNA, 22 bp, Homo sapiens
tctgtgccaagcttatatctgt

SEQ ID NO: 6904659 - DNA, 22 bp, Homo sapiens
ctgtagaacgatccaggcattt

SEQ ID NO: 6904660 - DNA, 22 bp, Homo sapiens
tcagaagttaatacgaggagaa

SEQ ID NO: 6904661 - DNA, 22 bp, Homo sapiens
tgggcctgagctcaccaggggc

SEQ ID NO: 6904662 - DNA, 19 bp, Homo sapiens
agcagtgtagaagtgttcc

SEQ ID NO: 6904663 - DNA, 22 bp, Homo sapiens
tgtcagtagattattacaataa

SEQ ID NO: 6904664 - DNA, 22 bp, Homo sapiens
ctgggccacatcagatgaagac

SEQ ID NO: 6904665 - DNA, 22 bp, Homo sapiens
actgggccagatcagagcaact

SEQ ID NO: 6904666 - DNA, 22 bp, Homo sapiens
tttgcttgttcaagatttctgt

SEQ ID NO: 6904667 - DNA, 22 bp, Homo sapiens
atggttttgtcctctttggttc

SEQ ID NO: 6904668 - DNA, 23 bp, Homo sapiens
tgatgctgctttcttgaagtatg

SEQ ID NO: 6904669 - DNA, 22 bp, Homo sapiens
ggcctcatcacagtgcattagt

SEQ ID NO: 6904670 - DNA, 22 bp, Homo sapiens
gtgcccttcagctttgctgaaa

SEQ ID NO: 6904671 - DNA, 22 bp, Homo sapiens
ctgagctgctcccgctgcagcg

SEQ ID NO: 6904672 - DNA, 22 bp, Homo sapiens
gccccaggggaggtgccctgca

SEQ ID NO: 6904673 - DNA, 22 bp, Homo sapiens
gaccacagcagtgcaagaggag

SEQ ID NO: 6904674 - DNA, 21 bp, Homo sapiens
aggctgtgacttacactatct

SEQ ID NO: 6904675 - DNA, 22 bp, Homo sapiens
atgccaggtacaggggtagggt

SEQ ID NO: 6904676 - DNA, 22 bp, Homo sapiens
caagttaattggtattttgatc

SEQ ID NO: 6904677 - DNA, 22 bp, Homo sapiens
ctggctggtcctcggggacagc

SEQ ID NO: 6904678 - DNA, 22 bp, Homo sapiens
tcagcacttggatttcagagat

SEQ ID NO: 6904679 - DNA, 21 bp, Homo sapiens
ccagagcctgctgagccccct

SEQ ID NO: 6904680 - DNA, 22 bp, Homo sapiens
ttaaggagcacagtgtattaat

SEQ ID NO: 6904681 - DNA, 22 bp, Homo sapiens
aacactatctgccttacaggga

SEQ ID NO: 6904682 - DNA, 22 bp, Homo sapiens
tctcttcacatgcttgctccaa

SEQ ID NO: 6904683 - DNA, 22 bp, Homo sapiens
accagctgagttctcggatggt

SEQ ID NO: 6904684 - DNA, 21 bp, Homo sapiens
gggtagcgtgtggaagatccg

SEQ ID NO: 6904685 - DNA, 22 bp, Homo sapiens
ggcagagcttgttccttctgtt

SEQ ID NO: 6904686 - DNA, 20 bp, Homo sapiens
tcacctttgttggtattcat

SEQ ID NO: 6904687 - DNA, 22 bp, Homo sapiens
taggtacatggaattggacatt

SEQ ID NO: 6904688 - DNA, 22 bp, Homo sapiens
gagggggctagcgcagtgccca

SEQ ID NO: 6904689 - DNA, 22 bp, Homo sapiens
tctcaaatttatacagagttca

SEQ ID NO: 6904690 - DNA, 22 bp, Homo sapiens
tgatggtagtttatcaaaaaga

SEQ ID NO: 6904691 - DNA, 22 bp, Homo sapiens
gccccttctctgaggaacctgc

SEQ ID NO: 6904692 - DNA, 22 bp, Homo sapiens
cacacattccaaaatcaagggt

SEQ ID NO: 6904693 - DNA, 22 bp, Homo sapiens
atggatagtggtgaaggctgta

SEQ ID NO: 6904694 - DNA, 16 bp, Homo sapiens
tggagcaggcaggatg

SEQ ID NO: 6904695 - DNA, 18 bp, Homo sapiens
gatggaaagtgtatgagt

SEQ ID NO: 6904696 - DNA, 22 bp, Homo sapiens
aggctgatgctggctgaggctg

SEQ ID NO: 6904697 - DNA, 23 bp, Homo sapiens
agggtctgctcagtgtcgttcaa

SEQ ID NO: 6904698 - DNA, 22 bp, Homo sapiens
aggtttatgccttggagctggg

SEQ ID NO: 6904699 - DNA, 22 bp, Homo sapiens
tctgcctgcggctgcaggtggc

SEQ ID NO: 6904700 - DNA, 22 bp, Homo sapiens
attctgtctttttaaaataata

SEQ ID NO: 6904701 - DNA, 22 bp, Homo sapiens
gtcagaaaccagtcaaacaaga

SEQ ID NO: 6904702 - DNA, 22 bp, Homo sapiens
taggcttgttacaaaacagtca

SEQ ID NO: 6904703 - DNA, 22 bp, Homo sapiens
gtggctgcagagccagcaagct

SEQ ID NO: 6904704 - DNA, 22 bp, Homo sapiens
gcagacaccttgtaggtgtgta

SEQ ID NO: 6904705 - DNA, 22 bp, Homo sapiens
tagctgcccatctttcctttag

SEQ ID NO: 6904706 - DNA, 22 bp, Homo sapiens
ataggactgagattgtcagttt

SEQ ID NO: 6904707 - DNA, 22 bp, Homo sapiens
ttgtctgctcctcccagcctca

SEQ ID NO: 6904708 - DNA, 22 bp, Homo sapiens
cctgaccctttccagtgttggc

SEQ ID NO: 6904709 - DNA, 19 bp, Homo sapiens
gccgggggcgccccgctct

SEQ ID NO: 6904710 - DNA, 22 bp, Homo sapiens
agtggctgaatatattttacta

SEQ ID NO: 6904711 - DNA, 22 bp, Homo sapiens
aatatgtgggtgctaatcaaaa

SEQ ID NO: 6904712 - DNA, 22 bp, Homo sapiens
agaaagggttctctgaggtgct

SEQ ID NO: 6904713 - DNA, 22 bp, Homo sapiens
atgactgattacccaagcctct

SEQ ID NO: 6904714 - DNA, 22 bp, Homo sapiens
gtgcctggcagggtcagctgct

SEQ ID NO: 6904715 - DNA, 22 bp, Homo sapiens
ggcttgagacccgggagccaga

SEQ ID NO: 6904716 - DNA, 22 bp, Homo sapiens
ctttggagggcctttcctagcc

SEQ ID NO: 6904717 - DNA, 19 bp, Homo sapiens
tggaaggctaagacacttg

SEQ ID NO: 6904718 - DNA, 22 bp, Homo sapiens
gttactcctggttgagcttggt

SEQ ID NO: 6904719 - DNA, 22 bp, Homo sapiens
ggagtgaatcactagatgcaga

SEQ ID NO: 6904720 - DNA, 22 bp, Homo sapiens
aaggccatgcacatcctaggca

SEQ ID NO: 6904721 - DNA, 22 bp, Homo sapiens
ccatcttacttggagagccatt

SEQ ID NO: 6904722 - DNA, 22 bp, Homo sapiens
tgttatataacttacaacctgt

SEQ ID NO: 6904723 - DNA, 22 bp, Homo sapiens
aaatcagatgcttcctagttgg

SEQ ID NO: 6904724 - DNA, 22 bp, Homo sapiens
actaaatacacacatttgttca

SEQ ID NO: 6904725 - DNA, 22 bp, Homo sapiens
ctaggctgttcatgctcagacc

SEQ ID NO: 6904726 - DNA, 22 bp, Homo sapiens
tgtttgaaactttgatcactaa

SEQ ID NO: 6904727 - DNA, 21 bp, Homo sapiens
tctacatatcaatatgtaatt

SEQ ID NO: 6904728 - DNA, 23 bp, Homo sapiens
ttgtgagaccttggaagaagtat

SEQ ID NO: 6904729 - DNA, 22 bp, Homo sapiens
gaagcagctttctggtgaggag

SEQ ID NO: 6904730 - DNA, 22 bp, Homo sapiens
agccctggggtgcagaaccatg

SEQ ID NO: 6904731 - DNA, 22 bp, Homo sapiens
gcaccaggaagctgttatagca

SEQ ID NO: 6904732 - DNA, 23 bp, Homo sapiens
cactgccttcagttgcttcacct

SEQ ID NO: 6904733 - DNA, 22 bp, Homo sapiens
tcccttgtcctcttcgtcactg

SEQ ID NO: 6904734 - DNA, 22 bp, Homo sapiens
cagcagctggtgagacacagcc

SEQ ID NO: 6904735 - DNA, 22 bp, Homo sapiens
agcagttatgttctataaagtc

SEQ ID NO: 6904736 - DNA, 22 bp, Homo sapiens
cagaccctcgggtgagttggcc

SEQ ID NO: 6904737 - DNA, 22 bp, Homo sapiens
cagggctttcctgagaagtgat

SEQ ID NO: 6904738 - DNA, 22 bp, Homo sapiens
aaaggcctgtgcttctaatgtg

SEQ ID NO: 6904739 - DNA, 22 bp, Homo sapiens
tttgaactgttctaggatttaa

SEQ ID NO: 6904740 - DNA, 22 bp, Homo sapiens
cagtttatattctagtgctgtt

SEQ ID NO: 6904741 - DNA, 21 bp, Homo sapiens
tctgtggtatggccatcttcc

SEQ ID NO: 6904742 - DNA, 22 bp, Homo sapiens
tcagaattttaaaccaaggaaa

SEQ ID NO: 6904743 - DNA, 17 bp, Homo sapiens
tctgccgactgccagct

SEQ ID NO: 6904744 - DNA, 22 bp, Homo sapiens
ctgataatgtcctgcagtaaat

SEQ ID NO: 6904745 - DNA, 22 bp, Homo sapiens
tgattcagttggttttgttcag

SEQ ID NO: 6904746 - DNA, 22 bp, Homo sapiens
gtgcctttgtgtctaaaacagc

SEQ ID NO: 6904747 - DNA, 22 bp, Homo sapiens
ataggaaagaatggagggtggg

SEQ ID NO: 6904748 - DNA, 22 bp, Homo sapiens
cggctcagacttcccaagaaca

SEQ ID NO: 6904749 - DNA, 20 bp, Homo sapiens
aagagcatagtacaggaaga

SEQ ID NO: 6904750 - DNA, 22 bp, Homo sapiens
cactgcactccagcttgggtga

SEQ ID NO: 6904751 - DNA, 22 bp, Homo sapiens
acagagtctcaaacctacaaag

SEQ ID NO: 6904752 - DNA, 22 bp, Homo sapiens
gttagagcacatactttgcatg

SEQ ID NO: 6904753 - DNA, 22 bp, Homo sapiens
aagctgcactacttgagggacc

SEQ ID NO: 6904754 - DNA, 21 bp, Homo sapiens
tgaattcccatgtgagcagca

SEQ ID NO: 6904755 - DNA, 22 bp, Homo sapiens
gccaaggataccagctgtgaga

SEQ ID NO: 6904756 - DNA, 22 bp, Homo sapiens
tatgtatctggatacatcagtg

SEQ ID NO: 6904757 - DNA, 20 bp, Homo sapiens
ctctcccagcacagcttcct

SEQ ID NO: 6904758 - DNA, 22 bp, Homo sapiens
gaaagcacaggctcaggaacag

SEQ ID NO: 6904759 - DNA, 22 bp, Homo sapiens
tgggaggatcgcttgagcccag

SEQ ID NO: 6904760 - DNA, 22 bp, Homo sapiens
agaaatgtatagtgaatttttc

SEQ ID NO: 6904761 - DNA, 21 bp, Homo sapiens
tgtcagaaataagcatgtgat

SEQ ID NO: 6904762 - DNA, 22 bp, Homo sapiens
ttctgccctttggtaggtaaag

SEQ ID NO: 6904763 - DNA, 22 bp, Homo sapiens
aactggaagagtgaatataact

SEQ ID NO: 6904764 - DNA, 22 bp, Homo sapiens
ttctgcatacactgaatgtagt

SEQ ID NO: 6904765 - DNA, 22 bp, Homo sapiens
atgaaacaacagacttggtcaa

SEQ ID NO: 6904766 - DNA, 19 bp, Homo sapiens
gttcatgtgaggaaggaac

SEQ ID NO: 6904767 - DNA, 22 bp, Homo sapiens
cccagaggggtcgtctgagggg

SEQ ID NO: 6904768 - DNA, 22 bp, Homo sapiens
tcagatgcttagagattagact

SEQ ID NO: 6904769 - DNA, 22 bp, Homo sapiens
cacacaggtaagcctctttcaa

SEQ ID NO: 6904770 - DNA, 22 bp, Homo sapiens
atagaagcttttaaataacagg

SEQ ID NO: 6904771 - DNA, 23 bp, Homo sapiens
aggcactcgacagaaatattgga

SEQ ID NO: 6904772 - DNA, 21 bp, Homo sapiens
aataagatggtatttggaggt

SEQ ID NO: 6904773 - DNA, 22 bp, Homo sapiens
acagtggcctcaaagaaagaga

SEQ ID NO: 6904774 - DNA, 22 bp, Homo sapiens
tcctttttctcacacaacgaac

SEQ ID NO: 6904775 - DNA, 22 bp, Homo sapiens
ctggcctgggagctgctagcgt

SEQ ID NO: 6904776 - DNA, 22 bp, Homo sapiens
gacaggaggcagagctcaggtg

SEQ ID NO: 6904777 - DNA, 22 bp, Homo sapiens
agtcttcagagaaattaactct

SEQ ID NO: 6904778 - DNA, 22 bp, Homo sapiens
cattgttcaacactgacttgca

SEQ ID NO: 6904779 - DNA, 22 bp, Homo sapiens
agcccaagcataggagggaggc

SEQ ID NO: 6904780 - DNA, 22 bp, Homo sapiens
gttgagcaaggccagagaagcc

SEQ ID NO: 6904781 - DNA, 22 bp, Homo sapiens
gaccttagaacgtgacacaaga

SEQ ID NO: 6904782 - DNA, 19 bp, Homo sapiens
taccatgaccctctttccc

SEQ ID NO: 6904783 - DNA, 22 bp, Homo sapiens
agtttacataaaaaggcagagg

SEQ ID NO: 6904784 - DNA, 22 bp, Homo sapiens
gcctccagcccacgcaggcctg

SEQ ID NO: 6904785 - DNA, 22 bp, Homo sapiens
tagttcaggaagagaaacaaca

SEQ ID NO: 6904786 - DNA, 22 bp, Homo sapiens
cagctttattaatgattgtctt

SEQ ID NO: 6904787 - DNA, 22 bp, Homo sapiens
tgaacaaactgcattcttcact

SEQ ID NO: 6904788 - DNA, 22 bp, Homo sapiens
actctgagaatccctggacttt

SEQ ID NO: 6904789 - DNA, 21 bp, Homo sapiens
ggaattgcaggctgtcttttg

SEQ ID NO: 6904790 - DNA, 22 bp, Homo sapiens
tattcctataagacgtggccag

SEQ ID NO: 6904791 - DNA, 23 bp, Homo sapiens
aaatcctgcctcttgtatttatc

SEQ ID NO: 6904792 - DNA, 22 bp, Homo sapiens
tccaggcttcacgtctgccctc

SEQ ID NO: 6904793 - DNA, 21 bp, Homo sapiens
gggtgctgtggtcatgcagga

SEQ ID NO: 6904794 - DNA, 22 bp, Homo sapiens
acactttagatattcccttctg

SEQ ID NO: 6904795 - DNA, 22 bp, Homo sapiens
cacctgccccagtcttggagct

SEQ ID NO: 6904796 - DNA, 19 bp, Homo sapiens
tggcagacacaccttcttc

SEQ ID NO: 6904797 - DNA, 22 bp, Homo sapiens
actgtgcatttgaagggatcat

SEQ ID NO: 6904798 - DNA, 22 bp, Homo sapiens
gggcctcagctctgctctgcaa

SEQ ID NO: 6904799 - DNA, 22 bp, Homo sapiens
caggctggagtgagtgtagtgg

SEQ ID NO: 6904800 - DNA, 22 bp, Homo sapiens
cacaggtaatagcctaggctat

SEQ ID NO: 6904801 - DNA, 22 bp, Homo sapiens
gcttaaggaattggagagtctg

SEQ ID NO: 6904802 - DNA, 22 bp, Homo sapiens
ttccaagttaggcgagctggtg

SEQ ID NO: 6904803 - DNA, 23 bp, Homo sapiens
tgaaatcagaacccttacctctc

SEQ ID NO: 6904804 - DNA, 19 bp, Homo sapiens
tgcaaattctaaaaactga

SEQ ID NO: 6904805 - DNA, 22 bp, Homo sapiens
aagggcaggcagagatcatata

SEQ ID NO: 6904806 - DNA, 22 bp, Homo sapiens
gctttacatgagatgaggacaa

SEQ ID NO: 6904807 - DNA, 22 bp, Homo sapiens
ttgctgtaggctgattgctgaa

SEQ ID NO: 6904808 - DNA, 22 bp, Homo sapiens
cttggctgggaactgtgattca

SEQ ID NO: 6904809 - DNA, 22 bp, Homo sapiens
gtgcaaaagcaattgcagtttt

SEQ ID NO: 6904810 - DNA, 22 bp, Homo sapiens
caagtattttaaggactagtgg

SEQ ID NO: 6904811 - DNA, 22 bp, Homo sapiens
cagagctggctctgcatgtaca

SEQ ID NO: 6904812 - DNA, 22 bp, Homo sapiens
aactagaaccacttgtatttcc

SEQ ID NO: 6904813 - DNA, 19 bp, Homo sapiens
agcccggagactcggaggc

SEQ ID NO: 6904814 - DNA, 22 bp, Homo sapiens
aatgttaatgtgtttgcttatg

SEQ ID NO: 6904815 - DNA, 22 bp, Homo sapiens
tcaaagcacacttagtggtaga

SEQ ID NO: 6904816 - DNA, 22 bp, Homo sapiens
aagagcaggacagaatcagaac

SEQ ID NO: 6904817 - DNA, 22 bp, Homo sapiens
ggtgtgaattggcatggtgctt

SEQ ID NO: 6904818 - DNA, 22 bp, Homo sapiens
ccatccctcctccaccagctag

SEQ ID NO: 6904819 - DNA, 22 bp, Homo sapiens
tgtacatatatgtatgtacgca

SEQ ID NO: 6904820 - DNA, 22 bp, Homo sapiens
atgcagagacagatgtggcatg

SEQ ID NO: 6904821 - DNA, 22 bp, Homo sapiens
ttttgggtggaagctgttatgg

SEQ ID NO: 6904822 - DNA, 22 bp, Homo sapiens
accatttgactctctaaggata

SEQ ID NO: 6904823 - DNA, 22 bp, Homo sapiens
atagaaatgtattttggactag

SEQ ID NO: 6904824 - DNA, 23 bp, Homo sapiens
tatttgtctcttaccactgctgt

SEQ ID NO: 6904825 - DNA, 22 bp, Homo sapiens
tgaattcttatctgggctgtgc

SEQ ID NO: 6904826 - DNA, 22 bp, Homo sapiens
tgcagggcacacgcacgggtgt

SEQ ID NO: 6904827 - DNA, 22 bp, Homo sapiens
catgaacattgcagggatgtga

SEQ ID NO: 6904828 - DNA, 22 bp, Homo sapiens
tcagagaaaggccaaaatatca

SEQ ID NO: 6904829 - DNA, 22 bp, Homo sapiens
tgcagagggacagccacagctc

SEQ ID NO: 6904830 - DNA, 22 bp, Homo sapiens
agaaattaggaaagtaacactt

SEQ ID NO: 6904831 - DNA, 22 bp, Homo sapiens
tattttctgtggaggaccagat

SEQ ID NO: 6904832 - DNA, 22 bp, Homo sapiens
aatgtaaacagcaagagaaggg

SEQ ID NO: 6904833 - DNA, 22 bp, Homo sapiens
tgcatttaagaaaacatgagtc

SEQ ID NO: 6904834 - DNA, 22 bp, Homo sapiens
agacttagtgagttctaagttt

SEQ ID NO: 6904835 - DNA, 22 bp, Homo sapiens
acagatggaggttattatgaac

SEQ ID NO: 6904836 - DNA, 22 bp, Homo sapiens
ttcagggtctagagtatctacc

SEQ ID NO: 6904837 - DNA, 22 bp, Homo sapiens
ttggcttcccagagcttacgct

SEQ ID NO: 6904838 - DNA, 22 bp, Homo sapiens
taactcaaatacttatgttact

SEQ ID NO: 6904839 - DNA, 22 bp, Homo sapiens
tctttaagccaagatatattta

SEQ ID NO: 6904840 - DNA, 22 bp, Homo sapiens
tgaacctttgtgttggacctgg

SEQ ID NO: 6904841 - DNA, 22 bp, Homo sapiens
ggagagagagctcattagctgc

SEQ ID NO: 6904842 - DNA, 22 bp, Homo sapiens
ttgcagctagaagattcactgt

SEQ ID NO: 6904843 - DNA, 22 bp, Homo sapiens
gacaatgtgcaattgcagctag

SEQ ID NO: 6904844 - DNA, 22 bp, Homo sapiens
actcggcagcctgagagttcac

SEQ ID NO: 6904845 - DNA, 21 bp, Homo sapiens
aggtgctggcgccccaggaga

SEQ ID NO: 6904846 - DNA, 22 bp, Homo sapiens
ttttgaaagccaggtttgtatg

SEQ ID NO: 6904847 - DNA, 21 bp, Homo sapiens
agatgcagttatgagatgcag

SEQ ID NO: 6904848 - DNA, 22 bp, Homo sapiens
tcctgagccccagggaggttgg

SEQ ID NO: 6904849 - DNA, 22 bp, Homo sapiens
gaaggcagtaaatggctgtttt

SEQ ID NO: 6904850 - DNA, 23 bp, Homo sapiens
catgtacagagtttgataaagtg

SEQ ID NO: 6904851 - DNA, 22 bp, Homo sapiens
atgaaatgtaagtagagagttt

SEQ ID NO: 6904852 - DNA, 22 bp, Homo sapiens
tgcaggtgtgtgcaagggaggg

SEQ ID NO: 6904853 - DNA, 22 bp, Homo sapiens
gcacagggctgccaggcggctt

SEQ ID NO: 6904854 - DNA, 22 bp, Homo sapiens
actttaaaactgatcatcagag

SEQ ID NO: 6904855 - DNA, 22 bp, Homo sapiens
ctgtttatctaggagttgcagg

SEQ ID NO: 6904856 - DNA, 22 bp, Homo sapiens
gaaaagtatgtttattttgact

SEQ ID NO: 6904857 - DNA, 20 bp, Homo sapiens
ttgcaagctttcaagatagc

SEQ ID NO: 6904858 - DNA, 22 bp, Homo sapiens
tctgttcaggtttcagagaact

SEQ ID NO: 6904859 - DNA, 23 bp, Homo sapiens
agcccagcagagaacctaggtcc

SEQ ID NO: 6904860 - DNA, 22 bp, Homo sapiens
ctggccaggcttgggacagaca

SEQ ID NO: 6904861 - DNA, 22 bp, Homo sapiens
atgttagaatctctgaatgtgg

SEQ ID NO: 6904862 - DNA, 22 bp, Homo sapiens
ttatgacagaaatgaaaagctg

SEQ ID NO: 6904863 - DNA, 22 bp, Homo sapiens
tcttgggatagtgtctcatggc

SEQ ID NO: 6904864 - DNA, 22 bp, Homo sapiens
caaggcagcgttcctttctgga

SEQ ID NO: 6904865 - DNA, 22 bp, Homo sapiens
gaaagaccgtttgggctctaaa

SEQ ID NO: 6904866 - DNA, 22 bp, Homo sapiens
ggctgcagaggcgatctgaggt

SEQ ID NO: 6904867 - DNA, 22 bp, Homo sapiens
ggcagaagataggacagggaat

SEQ ID NO: 6904868 - DNA, 22 bp, Homo sapiens
tgaataaagtatgtcctgggaa

SEQ ID NO: 6904869 - DNA, 22 bp, Homo sapiens
ggaagggcggatagtataagtt

SEQ ID NO: 6904870 - DNA, 18 bp, Homo sapiens
gtcatgggtagtttagta

SEQ ID NO: 6904871 - DNA, 22 bp, Homo sapiens
cctcacagagcccagatgtcta

SEQ ID NO: 6904872 - DNA, 19 bp, Homo sapiens
aggctagtgttacacctgc

SEQ ID NO: 6904873 - DNA, 22 bp, Homo sapiens
atgacacaagagcagaagccat

SEQ ID NO: 6904874 - DNA, 22 bp, Homo sapiens
ttattgagaccgtaagtcaggt

SEQ ID NO: 6904875 - DNA, 22 bp, Homo sapiens
tcagtttcctggttttgacatt

SEQ ID NO: 6904876 - DNA, 22 bp, Homo sapiens
tgtctgtctgtccttctcatta

SEQ ID NO: 6904877 - DNA, 22 bp, Homo sapiens
cagtcctggagcccttcttggc

SEQ ID NO: 6904878 - DNA, 22 bp, Homo sapiens
gctgccctgtggtccagcaggt

SEQ ID NO: 6904879 - DNA, 22 bp, Homo sapiens
taggctcacatagcactaagtg

SEQ ID NO: 6904880 - DNA, 22 bp, Homo sapiens
gccctggccttcatctcagaca

SEQ ID NO: 6904881 - DNA, 22 bp, Homo sapiens
attctacagatgaaagcggctg

SEQ ID NO: 6904882 - DNA, 21 bp, Homo sapiens
tagagcttggcacagagtaga

SEQ ID NO: 6904883 - DNA, 22 bp, Homo sapiens
cagggactacagccagccctcc

SEQ ID NO: 6904884 - DNA, 22 bp, Homo sapiens
ccagttacaagtgattcttggt

SEQ ID NO: 6904885 - DNA, 22 bp, Homo sapiens
ttacacaacatctgtattatta

SEQ ID NO: 6904886 - DNA, 22 bp, Homo sapiens
ggagaaaggataggaatgtgct

SEQ ID NO: 6904887 - DNA, 22 bp, Homo sapiens
tatatgcttgtgcatgtctttg

SEQ ID NO: 6904888 - DNA, 20 bp, Homo sapiens
tagagagatatgggggttcc

SEQ ID NO: 6904889 - DNA, 19 bp, Homo sapiens
tgtttacatgtttcttcag

SEQ ID NO: 6904890 - DNA, 22 bp, Homo sapiens
cccagacattgcagggactggt

SEQ ID NO: 6904891 - DNA, 17 bp, Homo sapiens
tttcaaggttacgttcc

SEQ ID NO: 6904892 - DNA, 22 bp, Homo sapiens
ttataactttggatatgacaag

SEQ ID NO: 6904893 - DNA, 22 bp, Homo sapiens
tgtccaagaacagactgccagg

SEQ ID NO: 6904894 - DNA, 22 bp, Homo sapiens
agctgttggagtaaagcactta

SEQ ID NO: 6904895 - DNA, 22 bp, Homo sapiens
cagggcacagatcggggcgcac

SEQ ID NO: 6904896 - DNA, 22 bp, Homo sapiens
ttctgtcatgctcatgtaattg

SEQ ID NO: 6904897 - DNA, 22 bp, Homo sapiens
caacagttctcatagcagattc

SEQ ID NO: 6904898 - DNA, 20 bp, Homo sapiens
actctttagaagggaaaaca

SEQ ID NO: 6904899 - DNA, 22 bp, Homo sapiens
tcccagacaatcattggccacc

SEQ ID NO: 6904900 - DNA, 22 bp, Homo sapiens
gtattcatttatttactcatcc

SEQ ID NO: 6904901 - DNA, 22 bp, Homo sapiens
attgattctcataggaccatct

SEQ ID NO: 6904902 - DNA, 22 bp, Homo sapiens
ttcatgcttttaccgctgttaa

SEQ ID NO: 6904903 - DNA, 22 bp, Homo sapiens
ctgggcaaattgtgccagctat

SEQ ID NO: 6904904 - DNA, 22 bp, Homo sapiens
cttaggaagcttttgaggacaa

SEQ ID NO: 6904905 - DNA, 22 bp, Homo sapiens
tgcctaaaccattccccttcct

SEQ ID NO: 6904906 - DNA, 23 bp, Homo sapiens
gtcctagtgcttggtgcccaggc

SEQ ID NO: 6904907 - DNA, 22 bp, Homo sapiens
tggctgatggagattttaggac

SEQ ID NO: 6904908 - DNA, 22 bp, Homo sapiens
aggcagtgctgtgccctgaacc

SEQ ID NO: 6904909 - DNA, 22 bp, Homo sapiens
ttacttgatgtatgatgagtag

SEQ ID NO: 6904910 - DNA, 21 bp, Homo sapiens
tgctcagattctccatctgga

SEQ ID NO: 6904911 - DNA, 22 bp, Homo sapiens
gggcgcaagcatgtgtctgggt

SEQ ID NO: 6904912 - DNA, 22 bp, Homo sapiens
gtcctggtggagtctctgggga

SEQ ID NO: 6904913 - DNA, 22 bp, Homo sapiens
gctgagattggttattccatta

SEQ ID NO: 6904914 - DNA, 17 bp, Homo sapiens
cactggattcgcagagc

SEQ ID NO: 6904915 - DNA, 23 bp, Homo sapiens
tacagctgcagaatcaggctaag

SEQ ID NO: 6904916 - DNA, 22 bp, Homo sapiens
gaggactacatgagccacatca

SEQ ID NO: 6904917 - DNA, 22 bp, Homo sapiens
atttcttttcaagagggtgctt

SEQ ID NO: 6904918 - DNA, 22 bp, Homo sapiens
cacaggttgggggagttgataa

SEQ ID NO: 6904919 - DNA, 22 bp, Homo sapiens
catactcactgttgtatcttcg

SEQ ID NO: 6904920 - DNA, 22 bp, Homo sapiens
tgggcaagcaggagggcctcag

SEQ ID NO: 6904921 - DNA, 22 bp, Homo sapiens
caggccttgggacacccttcac

SEQ ID NO: 6904922 - DNA, 22 bp, Homo sapiens
gtctgagctacttaggatataa

SEQ ID NO: 6904923 - DNA, 22 bp, Homo sapiens
caagttttgattttgcagtaaa

SEQ ID NO: 6904924 - DNA, 22 bp, Homo sapiens
ggccttcacgtgacctggcgtg

SEQ ID NO: 6904925 - DNA, 19 bp, Homo sapiens
tgctttgctcttggactca

SEQ ID NO: 6904926 - DNA, 22 bp, Homo sapiens
agtgtgtaagggatcaaagagt

SEQ ID NO: 6904927 - DNA, 22 bp, Homo sapiens
ctattaggtatgtggttgctat

SEQ ID NO: 6904928 - DNA, 22 bp, Homo sapiens
tgggcctcatcttcaatgagtc

SEQ ID NO: 6904929 - DNA, 22 bp, Homo sapiens
cattatggaagtgaagagctct

SEQ ID NO: 6904930 - DNA, 22 bp, Homo sapiens
gatgcacattgaacaatcacaa

SEQ ID NO: 6904931 - DNA, 22 bp, Homo sapiens
atattataagttatttcaagtt

SEQ ID NO: 6904932 - DNA, 22 bp, Homo sapiens
agcctggcactgccccatccat

SEQ ID NO: 6904933 - DNA, 22 bp, Homo sapiens
ggtctggatttctgcttctttc

SEQ ID NO: 6904934 - DNA, 22 bp, Homo sapiens
cactggaaccaagacccagggc

SEQ ID NO: 6904935 - DNA, 22 bp, Homo sapiens
acaaagtcttttacaacagtca

SEQ ID NO: 6904936 - DNA, 22 bp, Homo sapiens
agtgatttatggaaggccaaaa

SEQ ID NO: 6904937 - DNA, 22 bp, Homo sapiens
ctggtgtctactacatggttga

SEQ ID NO: 6904938 - DNA, 22 bp, Homo sapiens
ctcctgcaagcctccccaagca

SEQ ID NO: 6904939 - DNA, 23 bp, Homo sapiens
tatgtgtgggtctactagaagtc

SEQ ID NO: 6904940 - DNA, 22 bp, Homo sapiens
atttagacttcccagcactgtg

SEQ ID NO: 6904941 - DNA, 22 bp, Homo sapiens
gtgcaaatgagatggattcaag

SEQ ID NO: 6904942 - DNA, 22 bp, Homo sapiens
ttcacacctgctcaattatgag

SEQ ID NO: 6904943 - DNA, 22 bp, Homo sapiens
agctgttgttaattaactcatt

SEQ ID NO: 6904944 - DNA, 20 bp, Homo sapiens
ctctggcaaaggatgcctat

SEQ ID NO: 6904945 - DNA, 22 bp, Homo sapiens
agcctgcttggcagccctccca

SEQ ID NO: 6904946 - DNA, 22 bp, Homo sapiens
aacaacagtgagtgctgggagg

SEQ ID NO: 6904947 - DNA, 21 bp, Homo sapiens
gtagatttggcccaaagccat

SEQ ID NO: 6904948 - DNA, 21 bp, Homo sapiens
aagctacagaaaataatttga

SEQ ID NO: 6904949 - DNA, 21 bp, Homo sapiens
ttcagcttatgtgtcacttgc

SEQ ID NO: 6904950 - DNA, 22 bp, Homo sapiens
agcagagaggaggtggccctgt

SEQ ID NO: 6904951 - DNA, 21 bp, Homo sapiens
tgaatagggccagaaccaaag

SEQ ID NO: 6904952 - DNA, 22 bp, Homo sapiens
agtgagcactgttgttggttcc

SEQ ID NO: 6904953 - DNA, 22 bp, Homo sapiens
ggcggctactcctcctggtgag

SEQ ID NO: 6904954 - DNA, 17 bp, Homo sapiens
ttattctggcatatgtg

SEQ ID NO: 6904955 - DNA, 22 bp, Homo sapiens
ggctctgcttcagaaggctcat

SEQ ID NO: 6904956 - DNA, 22 bp, Homo sapiens
agttcagcttcaagctatgagg

SEQ ID NO: 6904957 - DNA, 15 bp, Homo sapiens
tggccttgtggttgt

SEQ ID NO: 6904958 - DNA, 22 bp, Homo sapiens
tcaatcattcttgccatttatt

SEQ ID NO: 6904959 - DNA, 22 bp, Homo sapiens
ctcatctgataaatcactctta

SEQ ID NO: 6904960 - DNA, 19 bp, Homo sapiens
agctggcactagaatccag

SEQ ID NO: 6904961 - DNA, 22 bp, Homo sapiens
tccatctggatggtatgtgtaa

SEQ ID NO: 6904962 - DNA, 18 bp, Homo sapiens
gaatactgagagcacaaa

SEQ ID NO: 6904963 - DNA, 22 bp, Homo sapiens
atagaacagaaacagatgcaca

SEQ ID NO: 6904964 - DNA, 22 bp, Homo sapiens
agaaagggaactggcaaagcca

SEQ ID NO: 6904965 - DNA, 22 bp, Homo sapiens
atgcaaaagtaattgcaatttt

SEQ ID NO: 6904966 - DNA, 22 bp, Homo sapiens
tccagagacttgcatgtgcttg

SEQ ID NO: 6904967 - DNA, 22 bp, Homo sapiens
aggtttgggttcattgctggct

SEQ ID NO: 6904968 - DNA, 19 bp, Homo sapiens
tgggctctcaagagcggaa

SEQ ID NO: 6904969 - DNA, 22 bp, Homo sapiens
ttgttgccaaatgtaaaatatg

SEQ ID NO: 6904970 - DNA, 22 bp, Homo sapiens
tgaatgtttatattggccaaaa

SEQ ID NO: 6904971 - DNA, 22 bp, Homo sapiens
acaattagtgatcagtgatgcc

SEQ ID NO: 6904972 - DNA, 22 bp, Homo sapiens
ccagataaatgagttcatattt

SEQ ID NO: 6904973 - DNA, 23 bp, Homo sapiens
gttccttcatgtggtcattggtt

SEQ ID NO: 6904974 - DNA, 22 bp, Homo sapiens
agggccagccaggccctacaaa

SEQ ID NO: 6904975 - DNA, 22 bp, Homo sapiens
tggcaggtagagttctgagatg

SEQ ID NO: 6904976 - DNA, 22 bp, Homo sapiens
tgtgataacttttacattttcg

SEQ ID NO: 6904977 - DNA, 22 bp, Homo sapiens
tatctagcaagtaacatgctga

SEQ ID NO: 6904978 - DNA, 22 bp, Homo sapiens
atggagacgcaagggacctagg

SEQ ID NO: 6904979 - DNA, 19 bp, Homo sapiens
tggtactagcgctgtctat

SEQ ID NO: 6904980 - DNA, 22 bp, Homo sapiens
gctttaggaatgaataaaaatc

SEQ ID NO: 6904981 - DNA, 22 bp, Homo sapiens
gaagtgaaggttactctagatt

SEQ ID NO: 6904982 - DNA, 22 bp, Homo sapiens
tcgcctgcagtggtttagggac

SEQ ID NO: 6904983 - DNA, 22 bp, Homo sapiens
atgtccagggggcttgactggt

SEQ ID NO: 6904984 - DNA, 22 bp, Homo sapiens
agctctggttattgaagcaggg

SEQ ID NO: 6904985 - DNA, 18 bp, Homo sapiens
tcaagacatcatgaaata

SEQ ID NO: 6904986 - DNA, 22 bp, Homo sapiens
tactactttggatctggcacca

SEQ ID NO: 6904987 - DNA, 22 bp, Homo sapiens
ctgcttggaggcctgggtgcta

SEQ ID NO: 6904988 - DNA, 22 bp, Homo sapiens
tggcacagactgggccaaggaa

SEQ ID NO: 6904989 - DNA, 22 bp, Homo sapiens
acagctcactcacagggctagt

SEQ ID NO: 6904990 - DNA, 22 bp, Homo sapiens
tggatttaccacagggccacag

SEQ ID NO: 6904991 - DNA, 22 bp, Homo sapiens
aagtccagcagtgcttgttgat

SEQ ID NO: 6904992 - DNA, 22 bp, Homo sapiens
cgtctttattgattccttcaag

SEQ ID NO: 6904993 - DNA, 19 bp, Homo sapiens
aaagttttattctcatttg

SEQ ID NO: 6904994 - DNA, 22 bp, Homo sapiens
gcagcctcagggcactcagatg

SEQ ID NO: 6904995 - DNA, 22 bp, Homo sapiens
gacagactgcgtagtccccaaa

SEQ ID NO: 6904996 - DNA, 22 bp, Homo sapiens
ctttcaggaaggttaaatataa

SEQ ID NO: 6904997 - DNA, 19 bp, Homo sapiens
ttcataacttttatatcct

SEQ ID NO: 6904998 - DNA, 22 bp, Homo sapiens
gaattgtattgatttttcagag

SEQ ID NO: 6904999 - DNA, 22 bp, Homo sapiens
ttttaaaggatagctctggttg

SEQ ID NO: 6905000 - DNA, 22 bp, Homo sapiens
tcacagaataaatgtactggcc

SEQ ID NO: 6905001 - DNA, 22 bp, Homo sapiens
taggctgctcaccaggctcaga

SEQ ID NO: 6905002 - DNA, 22 bp, Homo sapiens
ttgaggtattgatattttatga

SEQ ID NO: 6905003 - DNA, 22 bp, Homo sapiens
gtattattgggtagtatggtaa

SEQ ID NO: 6905004 - DNA, 22 bp, Homo sapiens
tctgggcagccatgtgcctggc

SEQ ID NO: 6905005 - DNA, 22 bp, Homo sapiens
gaaacattgagcagaaggagaa

SEQ ID NO: 6905006 - DNA, 22 bp, Homo sapiens
tgggaataggcttggtaggcac

SEQ ID NO: 6905007 - DNA, 22 bp, Homo sapiens
aacctgtacctggctgtgctca

SEQ ID NO: 6905008 - DNA, 22 bp, Homo sapiens
ttgaggaggacagaaacattta

SEQ ID NO: 6905009 - DNA, 22 bp, Homo sapiens
caccatgactggttgagagagg

SEQ ID NO: 6905010 - DNA, 23 bp, Homo sapiens
ggccatggagacttagaatgggc

SEQ ID NO: 6905011 - DNA, 22 bp, Homo sapiens
tgtctaggggcaggggtttgaa

SEQ ID NO: 6905012 - DNA, 22 bp, Homo sapiens
tcattgaagtgactgaaagatt

SEQ ID NO: 6905013 - DNA, 22 bp, Homo sapiens
ctcagagctgaggccagggaca

SEQ ID NO: 6905014 - DNA, 22 bp, Homo sapiens
taaggtctttaacaggtctttt

SEQ ID NO: 6905015 - DNA, 22 bp, Homo sapiens
tgtggggcctcgtgctagctgg

SEQ ID NO: 6905016 - DNA, 22 bp, Homo sapiens
tgccaggctcaggatgtccctg

SEQ ID NO: 6905017 - DNA, 22 bp, Homo sapiens
aagagggagggcaaaggcactg

SEQ ID NO: 6905018 - DNA, 22 bp, Homo sapiens
tgcaagagggtgttcagtttgt

SEQ ID NO: 6905019 - DNA, 22 bp, Homo sapiens
tttaagctaatgtcataattag

SEQ ID NO: 6905020 - DNA, 23 bp, Homo sapiens
attgaacagagagaaaaacatcc

SEQ ID NO: 6905021 - DNA, 22 bp, Homo sapiens
atgacattgacagacctgctgc

SEQ ID NO: 6905022 - DNA, 22 bp, Homo sapiens
gaatcatgctcaataatgcttg

SEQ ID NO: 6905023 - DNA, 22 bp, Homo sapiens
cccgtttaattactcgagctgt

SEQ ID NO: 6905024 - DNA, 22 bp, Homo sapiens
agtcaggtgaatgttatacaca

SEQ ID NO: 6905025 - DNA, 22 bp, Homo sapiens
gcctgatgagcttccagctgag

SEQ ID NO: 6905026 - DNA, 22 bp, Homo sapiens
aaagttgcaggtggtgagaggt

SEQ ID NO: 6905027 - DNA, 17 bp, Homo sapiens
agatggcaggaggcaga

SEQ ID NO: 6905028 - DNA, 22 bp, Homo sapiens
gtgctggatgaaataactggaa

SEQ ID NO: 6905029 - DNA, 22 bp, Homo sapiens
aagcaggcttggtgtggccgct

SEQ ID NO: 6905030 - DNA, 22 bp, Homo sapiens
attctgagtggaaactatcaat

SEQ ID NO: 6905031 - DNA, 22 bp, Homo sapiens
atagccaggagatgatggggga

SEQ ID NO: 6905032 - DNA, 22 bp, Homo sapiens
aaagcagtatgaaaggcaataa

SEQ ID NO: 6905033 - DNA, 22 bp, Homo sapiens
tgcagcagggcccaggcacaga

SEQ ID NO: 6905034 - DNA, 22 bp, Homo sapiens
agtatgaagatgatgaaaaata

SEQ ID NO: 6905035 - DNA, 22 bp, Homo sapiens
cacagggctttgatggctgagt

SEQ ID NO: 6905036 - DNA, 22 bp, Homo sapiens
tccctcaatgtgggtcaagacc

SEQ ID NO: 6905037 - DNA, 19 bp, Homo sapiens
cctcaccctgcagaggagg

SEQ ID NO: 6905038 - DNA, 22 bp, Homo sapiens
gacttgggcttgggcgtgggtt

SEQ ID NO: 6905039 - DNA, 22 bp, Homo sapiens
agtcagagagctctcagcatag

SEQ ID NO: 6905040 - DNA, 22 bp, Homo sapiens
accttgaacccagcttgctgca

SEQ ID NO: 6905041 - DNA, 22 bp, Homo sapiens
gctgtaaataagcttacttgaa

SEQ ID NO: 6905042 - DNA, 22 bp, Homo sapiens
tctcttaactggttcagcaatt

SEQ ID NO: 6905043 - DNA, 22 bp, Homo sapiens
catcagagtggtggcctggtgt

SEQ ID NO: 6905044 - DNA, 22 bp, Homo sapiens
atgtagtctctttgggaaactc

SEQ ID NO: 6905045 - DNA, 22 bp, Homo sapiens
tgtgcttttctctgctcctgga

SEQ ID NO: 6905046 - DNA, 22 bp, Homo sapiens
gcagaggtggcatctgggctct

SEQ ID NO: 6905047 - DNA, 22 bp, Homo sapiens
tactgtcattagcattaacttt

SEQ ID NO: 6905048 - DNA, 22 bp, Homo sapiens
tgtgactggagtccagcccact

SEQ ID NO: 6905049 - DNA, 22 bp, Homo sapiens
catgctgtgcatcttgatgacc

SEQ ID NO: 6905050 - DNA, 22 bp, Homo sapiens
gggtccaggcactatgctaagt

SEQ ID NO: 6905051 - DNA, 22 bp, Homo sapiens
ccattagataatgcacaccctc

SEQ ID NO: 6905052 - DNA, 22 bp, Homo sapiens
aggacagagggaccagagccca

SEQ ID NO: 6905053 - DNA, 22 bp, Homo sapiens
aagtccagactcctttgcgtgg

SEQ ID NO: 6905054 - DNA, 22 bp, Homo sapiens
gagagctaactacctggaaatg

SEQ ID NO: 6905055 - DNA, 22 bp, Homo sapiens
aagtcctgggtgagaactgtcc

SEQ ID NO: 6905056 - DNA, 23 bp, Homo sapiens
aaggtcacagaacttagcaagcc

SEQ ID NO: 6905057 - DNA, 22 bp, Homo sapiens
tattacaaattataatgggaga

SEQ ID NO: 6905058 - DNA, 22 bp, Homo sapiens
tctctcagtcagatgctaaaga

SEQ ID NO: 6905059 - DNA, 22 bp, Homo sapiens
tctttgcatggacatgtgtttt

SEQ ID NO: 6905060 - DNA, 23 bp, Homo sapiens
ctgaaattcagatgctaaagata

SEQ ID NO: 6905061 - DNA, 22 bp, Homo sapiens
tcatttataaggatgcaattaa

SEQ ID NO: 6905062 - DNA, 22 bp, Homo sapiens
tagtgctttattgttcctgaaa

SEQ ID NO: 6905063 - DNA, 22 bp, Homo sapiens
tggcttctctgtgtgagggaga

SEQ ID NO: 6905064 - DNA, 22 bp, Homo sapiens
acaaatgtctacattgagaata

SEQ ID NO: 6905065 - DNA, 22 bp, Homo sapiens
ttggagtagatggttatggatt

SEQ ID NO: 6905066 - DNA, 22 bp, Homo sapiens
ggcagggacaggatagggtttt

SEQ ID NO: 6905067 - DNA, 23 bp, Homo sapiens
cagggccaggcagcagctgtcac

SEQ ID NO: 6905068 - DNA, 22 bp, Homo sapiens
ctggccagaggttcctctgccc

SEQ ID NO: 6905069 - DNA, 22 bp, Homo sapiens
tggaattctgaacagctcagtt

SEQ ID NO: 6905070 - DNA, 22 bp, Homo sapiens
tgtgcagctatctctctacagt

SEQ ID NO: 6905071 - DNA, 22 bp, Homo sapiens
gattgaaacataggcagtcgag

SEQ ID NO: 6905072 - DNA, 22 bp, Homo sapiens
tggcagcaattagctagagctg

SEQ ID NO: 6905073 - DNA, 22 bp, Homo sapiens
ggccttagctgtctttcctttg

SEQ ID NO: 6905074 - DNA, 19 bp, Homo sapiens
agacaatggggttggcagt

SEQ ID NO: 6905075 - DNA, 22 bp, Homo sapiens
tgaattccatcctgttgcaacc

SEQ ID NO: 6905076 - DNA, 22 bp, Homo sapiens
tcctttctgtgctgtcaggtcc

SEQ ID NO: 6905077 - DNA, 22 bp, Homo sapiens
taatgactaagcatcattaaac

SEQ ID NO: 6905078 - DNA, 22 bp, Homo sapiens
atgcccctggccactcatattg

SEQ ID NO: 6905079 - DNA, 22 bp, Homo sapiens
ctgtagcagtgttccagcattg

SEQ ID NO: 6905080 - DNA, 22 bp, Homo sapiens
ctattttaacttgattacctct

SEQ ID NO: 6905081 - DNA, 22 bp, Homo sapiens
tttggttaaacgagagaacata

SEQ ID NO: 6905082 - DNA, 21 bp, Homo sapiens
aagtttctccctaattgttgc

SEQ ID NO: 6905083 - DNA, 22 bp, Homo sapiens
aattggcttccattttctgttt

SEQ ID NO: 6905084 - DNA, 22 bp, Homo sapiens
tgacttactctagagaatgctg

SEQ ID NO: 6905085 - DNA, 22 bp, Homo sapiens
ctctgggcttgttgacctgcac

SEQ ID NO: 6905086 - DNA, 22 bp, Homo sapiens
tgtaatttcctgatgttagaac

SEQ ID NO: 6905087 - DNA, 22 bp, Homo sapiens
tcagtgttggctacatctgcct

SEQ ID NO: 6905088 - DNA, 22 bp, Homo sapiens
aaatgcaattcaggaagacaag

SEQ ID NO: 6905089 - DNA, 22 bp, Homo sapiens
agatttccctcttgtatttgca

SEQ ID NO: 6905090 - DNA, 22 bp, Homo sapiens
aagaccattgctgtatttgtag

SEQ ID NO: 6905091 - DNA, 22 bp, Homo sapiens
agcagctagacttcagaatctg

SEQ ID NO: 6905092 - DNA, 22 bp, Homo sapiens
agtgtgacataagagccctgga

SEQ ID NO: 6905093 - DNA, 22 bp, Homo sapiens
cgtgatttgcaaattgaggcag

SEQ ID NO: 6905094 - DNA, 22 bp, Homo sapiens
ggcattagcgttgaattttatt

SEQ ID NO: 6905095 - DNA, 22 bp, Homo sapiens
actcctgctgtcactgcagttc

SEQ ID NO: 6905096 - DNA, 22 bp, Homo sapiens
tcaccaggattcctatcagtag

SEQ ID NO: 6905097 - DNA, 22 bp, Homo sapiens
ccctgtttggatggggacccag

SEQ ID NO: 6905098 - DNA, 22 bp, Homo sapiens
gcaagcagacattcaggtaggt

SEQ ID NO: 6905099 - DNA, 22 bp, Homo sapiens
gcagccaggaagcctttccctc

SEQ ID NO: 6905100 - DNA, 22 bp, Homo sapiens
tgaggccctagggcatgggaga

SEQ ID NO: 6905101 - DNA, 22 bp, Homo sapiens
agcaccatcgggttcttgcttt

SEQ ID NO: 6905102 - DNA, 16 bp, Homo sapiens
agccttaggaacagcc

SEQ ID NO: 6905103 - DNA, 22 bp, Homo sapiens
cccactccctacgacacgctcc

SEQ ID NO: 6905104 - DNA, 23 bp, Homo sapiens
gcagagacagccccagcgcgatg

SEQ ID NO: 6905105 - DNA, 22 bp, Homo sapiens
caggagatcttaggaattctta

SEQ ID NO: 6905106 - DNA, 22 bp, Homo sapiens
atagctttttgtcatagagtct

SEQ ID NO: 6905107 - DNA, 22 bp, Homo sapiens
tacagcctcacatttacttaca

SEQ ID NO: 6905108 - DNA, 22 bp, Homo sapiens
agcagagccagaattggaccag

SEQ ID NO: 6905109 - DNA, 22 bp, Homo sapiens
agcaggcttatggttgaaggga

SEQ ID NO: 6905110 - DNA, 18 bp, Homo sapiens
accacagtgcttaatatg

SEQ ID NO: 6905111 - DNA, 22 bp, Homo sapiens
ttacacttctgaaagcctaggt

SEQ ID NO: 6905112 - DNA, 22 bp, Homo sapiens
cactttgcttagagaacaaggc

SEQ ID NO: 6905113 - DNA, 22 bp, Homo sapiens
gatggtcaggtcatctcatgga

SEQ ID NO: 6905114 - DNA, 22 bp, Homo sapiens
tgcctggcaagaggggctggct

SEQ ID NO: 6905115 - DNA, 22 bp, Homo sapiens
actgcataatgattctgctgcc

SEQ ID NO: 6905116 - DNA, 22 bp, Homo sapiens
ggcctctcatgtcctgggcttc

SEQ ID NO: 6905117 - DNA, 22 bp, Homo sapiens
ataccataggaaaggatcagcc

SEQ ID NO: 6905118 - DNA, 22 bp, Homo sapiens
ccctggctgctaccaggtagct

SEQ ID NO: 6905119 - DNA, 20 bp, Homo sapiens
ttcacaactctaggggaggt

SEQ ID NO: 6905120 - DNA, 22 bp, Homo sapiens
ataaacagagtagttgctactg

SEQ ID NO: 6905121 - DNA, 22 bp, Homo sapiens
gattctgcgatgaggacgagct

SEQ ID NO: 6905122 - DNA, 22 bp, Homo sapiens
ggtacaaagttagatttaactt

SEQ ID NO: 6905123 - DNA, 22 bp, Homo sapiens
atgtggcattcttggtcatttc

SEQ ID NO: 6905124 - DNA, 19 bp, Homo sapiens
ctccaagtgccaaggacag

SEQ ID NO: 6905125 - DNA, 22 bp, Homo sapiens
atgtatgtataacacccagcta

SEQ ID NO: 6905126 - DNA, 22 bp, Homo sapiens
tgattctgctttgatccttgtg

SEQ ID NO: 6905127 - DNA, 22 bp, Homo sapiens
tctgcttctgtgaaggcagtct

SEQ ID NO: 6905128 - DNA, 22 bp, Homo sapiens
ctgtgtagctctgggtgcaagt

SEQ ID NO: 6905129 - DNA, 22 bp, Homo sapiens
tagccgcgtcagcagttcccca

SEQ ID NO: 6905130 - DNA, 22 bp, Homo sapiens
ttcttggagataaattcttaca

SEQ ID NO: 6905131 - DNA, 22 bp, Homo sapiens
tattaagatacgtagttgtaaa

SEQ ID NO: 6905132 - DNA, 22 bp, Homo sapiens
ttccttgtgagggctctcttcc

SEQ ID NO: 6905133 - DNA, 22 bp, Homo sapiens
tacagaagtaaataccaaaagc

SEQ ID NO: 6905134 - DNA, 22 bp, Homo sapiens
tggagaatctggaaactgttga

SEQ ID NO: 6905135 - DNA, 22 bp, Homo sapiens
ccagcctttgcatcccccatct

SEQ ID NO: 6905136 - DNA, 22 bp, Homo sapiens
actgtatttccaacagacaaat

SEQ ID NO: 6905137 - DNA, 20 bp, Homo sapiens
tacccagtggtggatggtaa

SEQ ID NO: 6905138 - DNA, 19 bp, Homo sapiens
gtctctggatttcaggtcc

SEQ ID NO: 6905139 - DNA, 22 bp, Homo sapiens
tgggccactcttccctgggtct

SEQ ID NO: 6905140 - DNA, 22 bp, Homo sapiens
caactgaaaagattctacgcag

SEQ ID NO: 6905141 - DNA, 22 bp, Homo sapiens
cagcaggcccaggtgctggtga

SEQ ID NO: 6905142 - DNA, 17 bp, Homo sapiens
gctctgccaggaaagag

SEQ ID NO: 6905143 - DNA, 22 bp, Homo sapiens
ccctgtacagtctctgtggcac

SEQ ID NO: 6905144 - DNA, 22 bp, Homo sapiens
ttccagatgtttaagttctgct

SEQ ID NO: 6905145 - DNA, 22 bp, Homo sapiens
gatgatcatctgtaaagttaga

SEQ ID NO: 6905146 - DNA, 22 bp, Homo sapiens
gtgtccatgttgttcagggtga

SEQ ID NO: 6905147 - DNA, 16 bp, Homo sapiens
tcagggcagaatggca

SEQ ID NO: 6905148 - DNA, 22 bp, Homo sapiens
cagcctcttgcactttgaaggc

SEQ ID NO: 6905149 - DNA, 22 bp, Homo sapiens
ccaggcacactgccctgccctt

SEQ ID NO: 6905150 - DNA, 20 bp, Homo sapiens
tgcaaggccagggtcaggag

SEQ ID NO: 6905151 - DNA, 22 bp, Homo sapiens
gcccaaggtcccatggcagcac

SEQ ID NO: 6905152 - DNA, 22 bp, Homo sapiens
gatgtcttaggtaacattctat

SEQ ID NO: 6905153 - DNA, 22 bp, Homo sapiens
ctatggcatgtcacctgctgag

SEQ ID NO: 6905154 - DNA, 22 bp, Homo sapiens
aggcctctgtctttatatgact

SEQ ID NO: 6905155 - DNA, 22 bp, Homo sapiens
agaaccctaatacaatggacat

SEQ ID NO: 6905156 - DNA, 22 bp, Homo sapiens
ctaagttaagttagagtgaatt

SEQ ID NO: 6905157 - DNA, 23 bp, Homo sapiens
tgcagtgtagcatctacgaagct

SEQ ID NO: 6905158 - DNA, 19 bp, Homo sapiens
ctgtcccagactctgctct

SEQ ID NO: 6905159 - DNA, 22 bp, Homo sapiens
tggcagtcttgtaggcatctcc

SEQ ID NO: 6905160 - DNA, 22 bp, Homo sapiens
cagggttgatgaattgtctgta

SEQ ID NO: 6905161 - DNA, 22 bp, Homo sapiens
agacatctctatgcaggatctc

SEQ ID NO: 6905162 - DNA, 21 bp, Homo sapiens
cttgccaggccaggtgtcctc

SEQ ID NO: 6905163 - DNA, 22 bp, Homo sapiens
caaggcttggagagaatgccat

SEQ ID NO: 6905164 - DNA, 22 bp, Homo sapiens
cagtaaaaatgttgtcaaggca

SEQ ID NO: 6905165 - DNA, 20 bp, Homo sapiens
ggagatgcagcccaggtgcc

SEQ ID NO: 6905166 - DNA, 22 bp, Homo sapiens
agtcagtgaaggcattgctcaa

SEQ ID NO: 6905167 - DNA, 22 bp, Homo sapiens
tggaatgtgttctattttacag

SEQ ID NO: 6905168 - DNA, 22 bp, Homo sapiens
ccacagtagcatccaaacagta

SEQ ID NO: 6905169 - DNA, 22 bp, Homo sapiens
tgggagactccagaactgatcc

SEQ ID NO: 6905170 - DNA, 22 bp, Homo sapiens
taccaggaatgttttcaccact

SEQ ID NO: 6905171 - DNA, 22 bp, Homo sapiens
atttgaatggcttaacacaacg

SEQ ID NO: 6905172 - DNA, 22 bp, Homo sapiens
cagtttatttccaagatgacaa

SEQ ID NO: 6905173 - DNA, 22 bp, Homo sapiens
gagctgggtgtttatttgccaa

SEQ ID NO: 6905174 - DNA, 22 bp, Homo sapiens
gccctggaaaggaacctgggct

SEQ ID NO: 6905175 - DNA, 22 bp, Homo sapiens
tctgccaggccacacagggcac

SEQ ID NO: 6905176 - DNA, 22 bp, Homo sapiens
tttgaagataaatatggagaaa

SEQ ID NO: 6905177 - DNA, 22 bp, Homo sapiens
atacacatctatttaagagaca

SEQ ID NO: 6905178 - DNA, 22 bp, Homo sapiens
ctgagagtctgcatttctaaca

SEQ ID NO: 6905179 - DNA, 22 bp, Homo sapiens
aagcaggctcacgccaggcagt

SEQ ID NO: 6905180 - DNA, 22 bp, Homo sapiens
ggccactggccaggatctaaga

SEQ ID NO: 6905181 - DNA, 22 bp, Homo sapiens
tccaggatgcccgcttttgctt

SEQ ID NO: 6905182 - DNA, 22 bp, Homo sapiens
tccaggggagtgctacgcacag

SEQ ID NO: 6905183 - DNA, 22 bp, Homo sapiens
aatgaactgtgttaactgaata

SEQ ID NO: 6905184 - DNA, 22 bp, Homo sapiens
agtgcgtggacccctggctgct

SEQ ID NO: 6905185 - DNA, 22 bp, Homo sapiens
tggaacaattcttgaagggaat

SEQ ID NO: 6905186 - DNA, 22 bp, Homo sapiens
cttgctggtggtgttttctatg

SEQ ID NO: 6905187 - DNA, 22 bp, Homo sapiens
aaatcagttagtggtaggattg

SEQ ID NO: 6905188 - DNA, 23 bp, Homo sapiens
tttaccagaatagcaggggagag

SEQ ID NO: 6905189 - DNA, 21 bp, Homo sapiens
ttgcaacaacctatatatttt

SEQ ID NO: 6905190 - DNA, 18 bp, Homo sapiens
gcccccagatgctactga

SEQ ID NO: 6905191 - DNA, 22 bp, Homo sapiens
tcagaacatgaaggttaatttg

SEQ ID NO: 6905192 - DNA, 22 bp, Homo sapiens
agacacagtgttgaaggctagt

SEQ ID NO: 6905193 - DNA, 22 bp, Homo sapiens
acacatgagaaacatcagttgt

SEQ ID NO: 6905194 - DNA, 23 bp, Homo sapiens
agctgctgggcctgccgtggcct

SEQ ID NO: 6905195 - DNA, 22 bp, Homo sapiens
tccttgaaaggggctgcagggc

SEQ ID NO: 6905196 - DNA, 19 bp, Homo sapiens
gctgtattaaagatacatg

SEQ ID NO: 6905197 - DNA, 22 bp, Homo sapiens
ccacaccatcgtttttacctta

SEQ ID NO: 6905198 - DNA, 22 bp, Homo sapiens
gaagtcgtgatgcctcacatga

SEQ ID NO: 6905199 - DNA, 22 bp, Homo sapiens
agcagatgtgtctctgcactgt

SEQ ID NO: 6905200 - DNA, 22 bp, Homo sapiens
cacagtatccctctttctcccc

SEQ ID NO: 6905201 - DNA, 23 bp, Homo sapiens
tctacccacactgctctagaagg

SEQ ID NO: 6905202 - DNA, 22 bp, Homo sapiens
agccagtactgtgcaaggataa

SEQ ID NO: 6905203 - DNA, 22 bp, Homo sapiens
ggttctagtgacactgaattga

SEQ ID NO: 6905204 - DNA, 22 bp, Homo sapiens
aagagccaagcagtcatcaata

SEQ ID NO: 6905205 - DNA, 22 bp, Homo sapiens
aacagcatcaccccataacatt

SEQ ID NO: 6905206 - DNA, 22 bp, Homo sapiens
gaacacagtcaagggctgctgt

SEQ ID NO: 6905207 - DNA, 22 bp, Homo sapiens
cttggagtagagatttagtgaa

SEQ ID NO: 6905208 - DNA, 22 bp, Homo sapiens
aagctctggttaaaaggcctgg

SEQ ID NO: 6905209 - DNA, 21 bp, Homo sapiens
ataaggctgctggatttgtta

SEQ ID NO: 6905210 - DNA, 22 bp, Homo sapiens
cagcaatcgggtgatatgcaat

SEQ ID NO: 6905211 - DNA, 22 bp, Homo sapiens
tgacaccttgatcttggacttt

SEQ ID NO: 6905212 - DNA, 22 bp, Homo sapiens
cctgtatttgcatctggcctct

SEQ ID NO: 6905213 - DNA, 21 bp, Homo sapiens
tcaggtagttgctttgttgaa

SEQ ID NO: 6905214 - DNA, 22 bp, Homo sapiens
gcagcaggtctgtcaatgtcat

SEQ ID NO: 6905215 - DNA, 22 bp, Homo sapiens
gtagcccacctggggagggcga

SEQ ID NO: 6905216 - DNA, 22 bp, Homo sapiens
ctgaacattcttgaacatctgt

SEQ ID NO: 6905217 - DNA, 22 bp, Homo sapiens
atgtcctcttctgcctcaggcc

SEQ ID NO: 6905218 - DNA, 22 bp, Homo sapiens
tttctgggtttatgtcacagct

SEQ ID NO: 6905219 - DNA, 22 bp, Homo sapiens
aaagtgtcttacccagggagaa

SEQ ID NO: 6905220 - DNA, 22 bp, Homo sapiens
gtgttttattggtgcagtcaga

SEQ ID NO: 6905221 - DNA, 20 bp, Homo sapiens
aatccattggtctatatgtc

SEQ ID NO: 6905222 - DNA, 22 bp, Homo sapiens
accaggccaacagctaagttaa

SEQ ID NO: 6905223 - DNA, 21 bp, Homo sapiens
tgatacaggaatggttctatg

SEQ ID NO: 6905224 - DNA, 22 bp, Homo sapiens
aagtgtaaattcacagacttca

SEQ ID NO: 6905225 - DNA, 22 bp, Homo sapiens
gtaacagcgtgtatgttatcag

SEQ ID NO: 6905226 - DNA, 22 bp, Homo sapiens
gcctgtgtcatgtagtagcttc

SEQ ID NO: 6905227 - DNA, 22 bp, Homo sapiens
taggctttgtgcaggatacagg

SEQ ID NO: 6905228 - DNA, 22 bp, Homo sapiens
ctctggacagccctccaggaag

SEQ ID NO: 6905229 - DNA, 22 bp, Homo sapiens
agtgtcctggggccctaaggcc

SEQ ID NO: 6905230 - DNA, 22 bp, Homo sapiens
tatattgttggtgggaatataa

SEQ ID NO: 6905231 - DNA, 20 bp, Homo sapiens
attagctcaggtgaggtcat

SEQ ID NO: 6905232 - DNA, 22 bp, Homo sapiens
tctccaggaaccatcatggtaa

SEQ ID NO: 6905233 - DNA, 22 bp, Homo sapiens
taatgaactctttactttggga

SEQ ID NO: 6905234 - DNA, 22 bp, Homo sapiens
gggcaagctcttcagaagctct

SEQ ID NO: 6905235 - DNA, 20 bp, Homo sapiens
tcttgcagctcctgtaccat

SEQ ID NO: 6905236 - DNA, 22 bp, Homo sapiens
gacagacaaatgtttttaactt

SEQ ID NO: 6905237 - DNA, 22 bp, Homo sapiens
tgggctcagggaagcttggcct

SEQ ID NO: 6905238 - DNA, 21 bp, Homo sapiens
agcaggtgtaaaggaggaaat

SEQ ID NO: 6905239 - DNA, 22 bp, Homo sapiens
gctatgtaggcaagttgttaca

SEQ ID NO: 6905240 - DNA, 22 bp, Homo sapiens
acacatattcatatgtacttac

SEQ ID NO: 6905241 - DNA, 22 bp, Homo sapiens
agctggagatgagtgacgtgcc

SEQ ID NO: 6905242 - DNA, 20 bp, Homo sapiens
atgaagtcctgccctcagag

SEQ ID NO: 6905243 - DNA, 22 bp, Homo sapiens
tcaatcatagtccttctctaga

SEQ ID NO: 6905244 - DNA, 22 bp, Homo sapiens
tgtcctgtgcactgtagcatgt

SEQ ID NO: 6905245 - DNA, 22 bp, Homo sapiens
gtgaggagctctttgactcacg

SEQ ID NO: 6905246 - DNA, 22 bp, Homo sapiens
ggtgagaaaaatgagtatgatt

SEQ ID NO: 6905247 - DNA, 22 bp, Homo sapiens
ttttggttgttgggtaagagta

SEQ ID NO: 6905248 - DNA, 22 bp, Homo sapiens
tggaaacactcaagcttatatt

SEQ ID NO: 6905249 - DNA, 22 bp, Homo sapiens
aattttatgccttgcacgttgg

SEQ ID NO: 6905250 - DNA, 22 bp, Homo sapiens
tcagtagtctaggatttcacct

SEQ ID NO: 6905251 - DNA, 22 bp, Homo sapiens
taaaggaacagaggactcattt

SEQ ID NO: 6905252 - DNA, 23 bp, Homo sapiens
ttgaagtctgtgatgagaaaggg

SEQ ID NO: 6905253 - DNA, 22 bp, Homo sapiens
agggagctatttcagggttatt

SEQ ID NO: 6905254 - DNA, 22 bp, Homo sapiens
atgcttcagatttggggtatta

SEQ ID NO: 6905255 - DNA, 22 bp, Homo sapiens
cctcagagttggaatcacattt

SEQ ID NO: 6905256 - DNA, 22 bp, Homo sapiens
gcccctcccagtcaggagcact

SEQ ID NO: 6905257 - DNA, 22 bp, Homo sapiens
tgagtctcccagcgttaaacct

SEQ ID NO: 6905258 - DNA, 22 bp, Homo sapiens
gctgtctcggggctttctcctg

SEQ ID NO: 6905259 - DNA, 22 bp, Homo sapiens
tctaattttggcattttaacct

SEQ ID NO: 6905260 - DNA, 22 bp, Homo sapiens
aaagaccgtggttgtggagcta

SEQ ID NO: 6905261 - DNA, 22 bp, Homo sapiens
ttgccgccgtctgctcgccccg

SEQ ID NO: 6905262 - DNA, 22 bp, Homo sapiens
ttacagagtggtctggctatgt

SEQ ID NO: 6905263 - DNA, 22 bp, Homo sapiens
tgggcaggatgcgttgattctt

SEQ ID NO: 6905264 - DNA, 22 bp, Homo sapiens
aacacaggccagcctgtgcagt

SEQ ID NO: 6905265 - DNA, 22 bp, Homo sapiens
agacagcatggagctgataaca

SEQ ID NO: 6905266 - DNA, 22 bp, Homo sapiens
ggcccatgcatcctgtgcagcc

SEQ ID NO: 6905267 - DNA, 22 bp, Homo sapiens
ctgtaaagacactaactatgga

SEQ ID NO: 6905268 - DNA, 22 bp, Homo sapiens
gagctctggttcatgatctatt

SEQ ID NO: 6905269 - DNA, 22 bp, Homo sapiens
agatgagaatttttagagtgct

SEQ ID NO: 6905270 - DNA, 22 bp, Homo sapiens
tggaagccaggaagcaggggtc

SEQ ID NO: 6905271 - DNA, 22 bp, Homo sapiens
ggggccagcttcgcgtgctctt

SEQ ID NO: 6905272 - DNA, 22 bp, Homo sapiens
ttacaagacagtgtggtaaata

SEQ ID NO: 6905273 - DNA, 22 bp, Homo sapiens
acatgtctcttgtggttttcaa

SEQ ID NO: 6905274 - DNA, 22 bp, Homo sapiens
tgttagaaattattagtaatat

SEQ ID NO: 6905275 - DNA, 22 bp, Homo sapiens
tcttgagtctaatctgaacttt

SEQ ID NO: 6905276 - DNA, 18 bp, Homo sapiens
agggagttttagggaagg

SEQ ID NO: 6905277 - DNA, 21 bp, Homo sapiens
tgactgaggcttcttcacaca

SEQ ID NO: 6905278 - DNA, 22 bp, Homo sapiens
ctcttcttgctagactgagtgc

SEQ ID NO: 6905279 - DNA, 22 bp, Homo sapiens
tgatcttcaccttgttctttgg

SEQ ID NO: 6905280 - DNA, 22 bp, Homo sapiens
gaaatggtcaagctgcaggata

SEQ ID NO: 6905281 - DNA, 22 bp, Homo sapiens
agtcttggtttcattggcaatg

SEQ ID NO: 6905282 - DNA, 22 bp, Homo sapiens
tctttatttctgaatcccccat

SEQ ID NO: 6905283 - DNA, 22 bp, Homo sapiens
tccagctctgctgtgcgccggt

SEQ ID NO: 6905284 - DNA, 22 bp, Homo sapiens
tggcacttagatcaggttgggt

SEQ ID NO: 6905285 - DNA, 22 bp, Homo sapiens
gtcctggtgccacctgcgggat

SEQ ID NO: 6905286 - DNA, 23 bp, Homo sapiens
aaggtgtttgatgggttgaggaa

SEQ ID NO: 6905287 - DNA, 22 bp, Homo sapiens
tttgacagcttgttacaaagtt

SEQ ID NO: 6905288 - DNA, 22 bp, Homo sapiens
tctgccctcattgctgcctgga

SEQ ID NO: 6905289 - DNA, 17 bp, Homo sapiens
tagcacagtgcctggta

SEQ ID NO: 6905290 - DNA, 22 bp, Homo sapiens
ggatctgggctgcagtctaggc

SEQ ID NO: 6905291 - DNA, 22 bp, Homo sapiens
ttgtgctgagcttctagctgtg

SEQ ID NO: 6905292 - DNA, 22 bp, Homo sapiens
ttcaaatcactttggagcttaa

SEQ ID NO: 6905293 - DNA, 22 bp, Homo sapiens
tgctgggattacagtcatgagc

SEQ ID NO: 6905294 - DNA, 22 bp, Homo sapiens
tttcatgaggtctttcagcaag

SEQ ID NO: 6905295 - DNA, 22 bp, Homo sapiens
ctctgggtcctggggctacaag

SEQ ID NO: 6905296 - DNA, 22 bp, Homo sapiens
ttagccagtgaaatggagaaat

SEQ ID NO: 6905297 - DNA, 19 bp, Homo sapiens
agtgagcatggcttgactg

SEQ ID NO: 6905298 - DNA, 22 bp, Homo sapiens
cccactgcatgagttggtatta

SEQ ID NO: 6905299 - DNA, 22 bp, Homo sapiens
ctttctgaagtttaagttctaa

SEQ ID NO: 6905300 - DNA, 22 bp, Homo sapiens
gagaatatcttggcagtctctg

SEQ ID NO: 6905301 - DNA, 22 bp, Homo sapiens
gtttagctctgggacctggagc

SEQ ID NO: 6905302 - DNA, 22 bp, Homo sapiens
tgcaactctggatcttctggta

SEQ ID NO: 6905303 - DNA, 22 bp, Homo sapiens
gcttctctctcagactgcaagc

SEQ ID NO: 6905304 - DNA, 22 bp, Homo sapiens
attttagcagttctctaatttc

SEQ ID NO: 6905305 - DNA, 22 bp, Homo sapiens
aaggtagatgttgtcatgccca

SEQ ID NO: 6905306 - DNA, 22 bp, Homo sapiens
cctttagaattctgcccctcct

SEQ ID NO: 6905307 - DNA, 22 bp, Homo sapiens
agctttagagagccaagactca

SEQ ID NO: 6905308 - DNA, 22 bp, Homo sapiens
ttgagggagcctgggagccatg

SEQ ID NO: 6905309 - DNA, 22 bp, Homo sapiens
gagctcagggcattgagcaaga

SEQ ID NO: 6905310 - DNA, 22 bp, Homo sapiens
caacagagagaccagaaacagg

SEQ ID NO: 6905311 - DNA, 22 bp, Homo sapiens
aagtgctgggattacaggcgtc

SEQ ID NO: 6905312 - DNA, 22 bp, Homo sapiens
gaggctgggaagtccaagacca

SEQ ID NO: 6905313 - DNA, 22 bp, Homo sapiens
ttctccaagggatttctgcctt

SEQ ID NO: 6905314 - DNA, 22 bp, Homo sapiens
ttccaaggcatgttctcaagta

SEQ ID NO: 6905315 - DNA, 22 bp, Homo sapiens
agaagccatagtatctcagggt

SEQ ID NO: 6905316 - DNA, 22 bp, Homo sapiens
agccagaggaacttgatgactg

SEQ ID NO: 6905317 - DNA, 20 bp, Homo sapiens
tcacagatgaaagttcaaga

SEQ ID NO: 6905318 - DNA, 22 bp, Homo sapiens
ttaacatgtcttgacttcatct

SEQ ID NO: 6905319 - DNA, 22 bp, Homo sapiens
gttagaataaaaggtcagagag

SEQ ID NO: 6905320 - DNA, 22 bp, Homo sapiens
atcttgttaaaatgcagaaact

SEQ ID NO: 6905321 - DNA, 22 bp, Homo sapiens
acacaagaagttaatgggcaaa

SEQ ID NO: 6905322 - DNA, 22 bp, Homo sapiens
tgagagcagaggtgggcagcct

SEQ ID NO: 6905323 - DNA, 22 bp, Homo sapiens
ctgagccataagggaggctggg

SEQ ID NO: 6905324 - DNA, 22 bp, Homo sapiens
gttgggaaggcaagaagtagaa

SEQ ID NO: 6905325 - DNA, 22 bp, Homo sapiens
cccaggcagtctggctctaaag

SEQ ID NO: 6905326 - DNA, 21 bp, Homo sapiens
tttcttatctgtaaagtggga

SEQ ID NO: 6905327 - DNA, 22 bp, Homo sapiens
cccgcagtcggaatttctcagt

SEQ ID NO: 6905328 - DNA, 22 bp, Homo sapiens
taaagcatgtactgtgtgctag

SEQ ID NO: 6905329 - DNA, 22 bp, Homo sapiens
cactggaattcaagatactgag

SEQ ID NO: 6905330 - DNA, 22 bp, Homo sapiens
acgttgttctgcaatacccaag

SEQ ID NO: 6905331 - DNA, 22 bp, Homo sapiens
aggccacaggcaccctgtgttc

SEQ ID NO: 6905332 - DNA, 22 bp, Homo sapiens
tagctgcttagaaatcactgag

SEQ ID NO: 6905333 - DNA, 18 bp, Homo sapiens
cctgtgtgtgttgcaggc

SEQ ID NO: 6905334 - DNA, 22 bp, Homo sapiens
gtgtaggtaagcatgcagctga

SEQ ID NO: 6905335 - DNA, 23 bp, Homo sapiens
cctcagagaggcagagccacatg

SEQ ID NO: 6905336 - DNA, 22 bp, Homo sapiens
tctggccccgcatgcactttat

SEQ ID NO: 6905337 - DNA, 22 bp, Homo sapiens
tttaatgatagtcttacgaaaa

SEQ ID NO: 6905338 - DNA, 22 bp, Homo sapiens
cactgcagccacatagatgacg

SEQ ID NO: 6905339 - DNA, 22 bp, Homo sapiens
acagactgttggcctactgagc

SEQ ID NO: 6905340 - DNA, 22 bp, Homo sapiens
aagagcatctatttcacagtgg

SEQ ID NO: 6905341 - DNA, 22 bp, Homo sapiens
acaggggcaagggctcacggcc

SEQ ID NO: 6905342 - DNA, 17 bp, Homo sapiens
cctttcttcccagaggg

SEQ ID NO: 6905343 - DNA, 22 bp, Homo sapiens
agaggggaagtaatgaatgata

SEQ ID NO: 6905344 - DNA, 22 bp, Homo sapiens
accgagttagccaggatggtct

SEQ ID NO: 6905345 - DNA, 22 bp, Homo sapiens
ttttaaaggatactcttgtcta

SEQ ID NO: 6905346 - DNA, 22 bp, Homo sapiens
aggcaggtagaaggatctttat

SEQ ID NO: 6905347 - DNA, 18 bp, Homo sapiens
gagaagctgattgaatgc

SEQ ID NO: 6905348 - DNA, 22 bp, Homo sapiens
atgaggctgaaacacagaggct

SEQ ID NO: 6905349 - DNA, 22 bp, Homo sapiens
agttccaatcctggcatttatt

SEQ ID NO: 6905350 - DNA, 22 bp, Homo sapiens
tgatttcctagctgacatgaaa

SEQ ID NO: 6905351 - DNA, 22 bp, Homo sapiens
agctggcagaaagctttgcccg

SEQ ID NO: 6905352 - DNA, 22 bp, Homo sapiens
gtgctgagtcatctttatctgt

SEQ ID NO: 6905353 - DNA, 19 bp, Homo sapiens
gggactggaggatgtggag

SEQ ID NO: 6905354 - DNA, 22 bp, Homo sapiens
tcctggggccagcactggtgga

SEQ ID NO: 6905355 - DNA, 22 bp, Homo sapiens
gtcctcagggagtcccagtcat

SEQ ID NO: 6905356 - DNA, 19 bp, Homo sapiens
acaatgaatgtgttctctt

SEQ ID NO: 6905357 - DNA, 22 bp, Homo sapiens
ccatgattggaatgtcttttca

SEQ ID NO: 6905358 - DNA, 22 bp, Homo sapiens
tcctagaactccaggacagtcc

SEQ ID NO: 6905359 - DNA, 22 bp, Homo sapiens
tagaacttgagatcaggtcttc

SEQ ID NO: 6905360 - DNA, 22 bp, Homo sapiens
tctccacagaaggttccaggcc

SEQ ID NO: 6905361 - DNA, 17 bp, Homo sapiens
actggttttggcagcat

SEQ ID NO: 6905362 - DNA, 22 bp, Homo sapiens
ctgagggagaagtgatctctac

SEQ ID NO: 6905363 - DNA, 22 bp, Homo sapiens
agaaggctttaagtactggcat

SEQ ID NO: 6905364 - DNA, 22 bp, Homo sapiens
acataggcagagctttaaagct

SEQ ID NO: 6905365 - DNA, 22 bp, Homo sapiens
tatctctttattgacaataaaa

SEQ ID NO: 6905366 - DNA, 22 bp, Homo sapiens
atggacatttgagttatttcca

SEQ ID NO: 6905367 - DNA, 22 bp, Homo sapiens
tgcagtctctagtttctgaatg

SEQ ID NO: 6905368 - DNA, 22 bp, Homo sapiens
ggcacctggatgtagcagtgaa

SEQ ID NO: 6905369 - DNA, 22 bp, Homo sapiens
gatgaaattgttttgatacttt

SEQ ID NO: 6905370 - DNA, 22 bp, Homo sapiens
cagatggaacacagaaaggaga

SEQ ID NO: 6905371 - DNA, 22 bp, Homo sapiens
ctcttcagcctatttgagtgca

SEQ ID NO: 6905372 - DNA, 23 bp, Homo sapiens
gattcctagtacttctgacattg

SEQ ID NO: 6905373 - DNA, 22 bp, Homo sapiens
acagagatgaattagacagggt

SEQ ID NO: 6905374 - DNA, 22 bp, Homo sapiens
cctggactgtgtcctgtggtca

SEQ ID NO: 6905375 - DNA, 22 bp, Homo sapiens
tttcatgtatttcccaaagctt

SEQ ID NO: 6905376 - DNA, 22 bp, Homo sapiens
ctgttggcattaagatagtcat

SEQ ID NO: 6905377 - DNA, 22 bp, Homo sapiens
cctgaagcacaaaagcacagct

SEQ ID NO: 6905378 - DNA, 22 bp, Homo sapiens
tggcactgcactttaagattta

SEQ ID NO: 6905379 - DNA, 22 bp, Homo sapiens
aggttcttttggccaacctcat

SEQ ID NO: 6905380 - DNA, 22 bp, Homo sapiens
cagaagtttgaccttggtgggt

SEQ ID NO: 6905381 - DNA, 22 bp, Homo sapiens
tagaacttatttggcattattt

SEQ ID NO: 6905382 - DNA, 22 bp, Homo sapiens
tctggtggcacgtgtcttgcat

SEQ ID NO: 6905383 - DNA, 22 bp, Homo sapiens
tcagcaggtggtgggcaggtga

SEQ ID NO: 6905384 - DNA, 22 bp, Homo sapiens
tgggcctctgccacgctccccc

SEQ ID NO: 6905385 - DNA, 22 bp, Homo sapiens
gctgaggtggagattgcagtga

SEQ ID NO: 6905386 - DNA, 22 bp, Homo sapiens
actgttctccagcatggctgta

SEQ ID NO: 6905387 - DNA, 22 bp, Homo sapiens
tgtggacgtcattaaagcagtg

SEQ ID NO: 6905388 - DNA, 22 bp, Homo sapiens
tccttctctggtttttactgta

SEQ ID NO: 6905389 - DNA, 22 bp, Homo sapiens
tcacccaggatattgaagtcag

SEQ ID NO: 6905390 - DNA, 22 bp, Homo sapiens
acccagagatggacctggctgc

SEQ ID NO: 6905391 - DNA, 21 bp, Homo sapiens
cctgaccaatacttgatcaaa

SEQ ID NO: 6905392 - DNA, 22 bp, Homo sapiens
aagacatttatttgaatcaatt

SEQ ID NO: 6905393 - DNA, 21 bp, Homo sapiens
actgaacttgtgttctagagg

SEQ ID NO: 6905394 - DNA, 22 bp, Homo sapiens
cctctggacttgggacagtgag

SEQ ID NO: 6905395 - DNA, 22 bp, Homo sapiens
aaggctgtgtcagaagctccct

SEQ ID NO: 6905396 - DNA, 22 bp, Homo sapiens
tctctggcagcttgtgctgttg

SEQ ID NO: 6905397 - DNA, 22 bp, Homo sapiens
tgggtaagtgcataaaaagtaa

SEQ ID NO: 6905398 - DNA, 22 bp, Homo sapiens
tcttggctacttaggaggattc

SEQ ID NO: 6905399 - DNA, 22 bp, Homo sapiens
catgagtgagtatctcaagata

SEQ ID NO: 6905400 - DNA, 22 bp, Homo sapiens
gtggtctggggtcaggcctgag

SEQ ID NO: 6905401 - DNA, 22 bp, Homo sapiens
tatggttatcctcaaaagagga

SEQ ID NO: 6905402 - DNA, 22 bp, Homo sapiens
gataatttctccatctcaaggt

SEQ ID NO: 6905403 - DNA, 22 bp, Homo sapiens
cagccaggggctggcgtgttga

SEQ ID NO: 6905404 - DNA, 22 bp, Homo sapiens
tcaacgtttgttaaatgagtat

SEQ ID NO: 6905405 - DNA, 22 bp, Homo sapiens
agcccatgtggctgaggcttct

SEQ ID NO: 6905406 - DNA, 22 bp, Homo sapiens
taccaaggcttgtgggggcaac

SEQ ID NO: 6905407 - DNA, 22 bp, Homo sapiens
ttatggaaatgaaattttattg

SEQ ID NO: 6905408 - DNA, 22 bp, Homo sapiens
aaggcagtactttatgtccata

SEQ ID NO: 6905409 - DNA, 22 bp, Homo sapiens
tgtcagcagtatctctatctca

SEQ ID NO: 6905410 - DNA, 23 bp, Homo sapiens
agctaatgggacagattccatgg

SEQ ID NO: 6905411 - DNA, 22 bp, Homo sapiens
acatttttattcatcaaagcag

SEQ ID NO: 6905412 - DNA, 19 bp, Homo sapiens
agctcctcacctctcgcgg

SEQ ID NO: 6905413 - DNA, 22 bp, Homo sapiens
ctctggacttgtacatactcag

SEQ ID NO: 6905414 - DNA, 22 bp, Homo sapiens
gaagccagattatcacaagcca

SEQ ID NO: 6905415 - DNA, 22 bp, Homo sapiens
agagtctgaggcagctgcagcc

SEQ ID NO: 6905416 - DNA, 22 bp, Homo sapiens
tttagtagatgcagcattattt

SEQ ID NO: 6905417 - DNA, 22 bp, Homo sapiens
actgtgcaggggaagagagaaa

SEQ ID NO: 6905418 - DNA, 22 bp, Homo sapiens
tgaaggcacagtttaaccagta

SEQ ID NO: 6905419 - DNA, 22 bp, Homo sapiens
tctgcatccgaacccgccaccg

SEQ ID NO: 6905420 - DNA, 22 bp, Homo sapiens
tgcaagctgacatccagagaga

SEQ ID NO: 6905421 - DNA, 22 bp, Homo sapiens
acacaatttcctgtccatatgt

SEQ ID NO: 6905422 - DNA, 22 bp, Homo sapiens
cctagtttttcacttgtgctgt

SEQ ID NO: 6905423 - DNA, 22 bp, Homo sapiens
agggatgtggtgggagagaaag

SEQ ID NO: 6905424 - DNA, 22 bp, Homo sapiens
ccagggtgaccctcccggtggc

SEQ ID NO: 6905425 - DNA, 22 bp, Homo sapiens
agaatctgaaggcacctctggt

SEQ ID NO: 6905426 - DNA, 22 bp, Homo sapiens
ataggaaagaaaattatgtagg

SEQ ID NO: 6905427 - DNA, 22 bp, Homo sapiens
tggctgctcaagggaggaggct

SEQ ID NO: 6905428 - DNA, 22 bp, Homo sapiens
cttgagcacagcggcttcagga

SEQ ID NO: 6905429 - DNA, 22 bp, Homo sapiens
ttgtcctggaggttaatagagt

SEQ ID NO: 6905430 - DNA, 22 bp, Homo sapiens
tatgttctttacatctgtgcaa

SEQ ID NO: 6905431 - DNA, 20 bp, Homo sapiens
aagcagaagctgctctcagc

SEQ ID NO: 6905432 - DNA, 19 bp, Homo sapiens
tgtctgagtatgctgacaa

SEQ ID NO: 6905433 - DNA, 22 bp, Homo sapiens
gagctaagctatgttatgcagc

SEQ ID NO: 6905434 - DNA, 22 bp, Homo sapiens
gaaggcaaggagggaagccacc

SEQ ID NO: 6905435 - DNA, 22 bp, Homo sapiens
agaacactgctagtataatcac

SEQ ID NO: 6905436 - DNA, 20 bp, Homo sapiens
attccacttatatgaggtcc

SEQ ID NO: 6905437 - DNA, 22 bp, Homo sapiens
tgcagtgaaagtatcttaattt

SEQ ID NO: 6905438 - DNA, 22 bp, Homo sapiens
cagctggactgggatgtagcga

SEQ ID NO: 6905439 - DNA, 18 bp, Homo sapiens
gaaatgtgattctagggc

SEQ ID NO: 6905440 - DNA, 22 bp, Homo sapiens
ctgtttccaccttcatggctaa

SEQ ID NO: 6905441 - DNA, 22 bp, Homo sapiens
cactgcatggatgatggctgta

SEQ ID NO: 6905442 - DNA, 22 bp, Homo sapiens
atctgtggatatgaccttcctg

SEQ ID NO: 6905443 - DNA, 22 bp, Homo sapiens
tttcacagcagaatttctgagg

SEQ ID NO: 6905444 - DNA, 22 bp, Homo sapiens
tggctcatggaattagctatta

SEQ ID NO: 6905445 - DNA, 18 bp, Homo sapiens
tgagcaggggctgacctt

SEQ ID NO: 6905446 - DNA, 22 bp, Homo sapiens
ctgttcctctggcatatggaga

SEQ ID NO: 6905447 - DNA, 22 bp, Homo sapiens
attgttaaactgaagcattact

SEQ ID NO: 6905448 - DNA, 22 bp, Homo sapiens
agttctgtgacaatatcattac

SEQ ID NO: 6905449 - DNA, 22 bp, Homo sapiens
tgtcagtgagttgggtcctgag

SEQ ID NO: 6905450 - DNA, 22 bp, Homo sapiens
caagatttagcctgctgcctgt

SEQ ID NO: 6905451 - DNA, 22 bp, Homo sapiens
tcagaattacacagggccttga

SEQ ID NO: 6905452 - DNA, 22 bp, Homo sapiens
acaaggttggctctttctttgt

SEQ ID NO: 6905453 - DNA, 22 bp, Homo sapiens
tcacactaggatgttgtttcta

SEQ ID NO: 6905454 - DNA, 21 bp, Homo sapiens
cagacctagaaaagttcagaa

SEQ ID NO: 6905455 - DNA, 22 bp, Homo sapiens
taggcagctgcaaacttcggtc

SEQ ID NO: 6905456 - DNA, 22 bp, Homo sapiens
gccaatagcaatttctaggccc

SEQ ID NO: 6905457 - DNA, 19 bp, Homo sapiens
cctggagtcgcgctgcctc

SEQ ID NO: 6905458 - DNA, 20 bp, Homo sapiens
aggaactttgtagaatacaa

SEQ ID NO: 6905459 - DNA, 22 bp, Homo sapiens
aaagcatattaggactgaatta

SEQ ID NO: 6905460 - DNA, 17 bp, Homo sapiens
cctgagtgggagaggaa

SEQ ID NO: 6905461 - DNA, 19 bp, Homo sapiens
ccagggctccaagctgagt

SEQ ID NO: 6905462 - DNA, 21 bp, Homo sapiens
agagttcttgctgagcaagcc

SEQ ID NO: 6905463 - DNA, 22 bp, Homo sapiens
atctaaactatagtacctagtc

SEQ ID NO: 6905464 - DNA, 22 bp, Homo sapiens
ctgaggagtttgggttgttcaa

SEQ ID NO: 6905465 - DNA, 22 bp, Homo sapiens
gtgtagcagaaagaaaattaga

SEQ ID NO: 6905466 - DNA, 17 bp, Homo sapiens
ctgggatgtggactctt

SEQ ID NO: 6905467 - DNA, 22 bp, Homo sapiens
gagctttaagggataaaatgat

SEQ ID NO: 6905468 - DNA, 22 bp, Homo sapiens
tcttatttgcaactggctcaga

SEQ ID NO: 6905469 - DNA, 22 bp, Homo sapiens
aggggcctcagcctcctggtca

SEQ ID NO: 6905470 - DNA, 22 bp, Homo sapiens
ttcaccactttgcaccaggcct

SEQ ID NO: 6905471 - DNA, 22 bp, Homo sapiens
tggccctgtggaggtcagtgag

SEQ ID NO: 6905472 - DNA, 22 bp, Homo sapiens
cagaggctaagggtagcttggg

SEQ ID NO: 6905473 - DNA, 22 bp, Homo sapiens
atgcaagatgtatagaagactt

SEQ ID NO: 6905474 - DNA, 23 bp, Homo sapiens
tgtgtttacctgaggatcttgtt

SEQ ID NO: 6905475 - DNA, 22 bp, Homo sapiens
agagtgaagtaattgttaggat

SEQ ID NO: 6905476 - DNA, 22 bp, Homo sapiens
gcttcaaattaaggtgaatccc

SEQ ID NO: 6905477 - DNA, 22 bp, Homo sapiens
ctcctgcatggttgtgctattg

SEQ ID NO: 6905478 - DNA, 22 bp, Homo sapiens
tcctggaggacagaggcatctc

SEQ ID NO: 6905479 - DNA, 22 bp, Homo sapiens
gaccagatcgctgatgtgcact

SEQ ID NO: 6905480 - DNA, 22 bp, Homo sapiens
aatagcatttttaagggaatca

SEQ ID NO: 6905481 - DNA, 22 bp, Homo sapiens
aggaaatgccgcggctctcttt

SEQ ID NO: 6905482 - DNA, 22 bp, Homo sapiens
gtcagttcactaccactccatt

SEQ ID NO: 6905483 - DNA, 22 bp, Homo sapiens
aatgtgaactttgtcatgtaac

SEQ ID NO: 6905484 - DNA, 22 bp, Homo sapiens
tcacatttctttatgtagtctt

SEQ ID NO: 6905485 - DNA, 22 bp, Homo sapiens
tgtttccaaatggtataaagac

SEQ ID NO: 6905486 - DNA, 17 bp, Homo sapiens
cactgagaggtttgaga

SEQ ID NO: 6905487 - DNA, 20 bp, Homo sapiens
aaatgccagtgattctgctt

SEQ ID NO: 6905488 - DNA, 18 bp, Homo sapiens
cacaggcaggtgataggt

SEQ ID NO: 6905489 - DNA, 22 bp, Homo sapiens
accttaaaactgacacatggag

SEQ ID NO: 6905490 - DNA, 22 bp, Homo sapiens
cagtcacttacaaaaatataat

SEQ ID NO: 6905491 - DNA, 22 bp, Homo sapiens
actttggagggtgttgtagatg

SEQ ID NO: 6905492 - DNA, 22 bp, Homo sapiens
aattgcccttacagtaatcaga

SEQ ID NO: 6905493 - DNA, 22 bp, Homo sapiens
catctctggcttggattatggt

SEQ ID NO: 6905494 - DNA, 22 bp, Homo sapiens
atggctgggaggagagtatgat

SEQ ID NO: 6905495 - DNA, 22 bp, Homo sapiens
aggctccagggctgtgtgggag

SEQ ID NO: 6905496 - DNA, 22 bp, Homo sapiens
actgaggacagtgaggagggct

SEQ ID NO: 6905497 - DNA, 22 bp, Homo sapiens
gaattccttaggctcttgactg

SEQ ID NO: 6905498 - DNA, 20 bp, Homo sapiens
gtccagtgggccttcatttc

SEQ ID NO: 6905499 - DNA, 22 bp, Homo sapiens
aaggatcaagtggattttctta

SEQ ID NO: 6905500 - DNA, 22 bp, Homo sapiens
tctgtgttttgtgcctactgct

SEQ ID NO: 6905501 - DNA, 22 bp, Homo sapiens
agaatgatactctatgccaaat

SEQ ID NO: 6905502 - DNA, 22 bp, Homo sapiens
ttgaaatgcagattccaatcca

SEQ ID NO: 6905503 - DNA, 22 bp, Homo sapiens
cacagatttctggtcttcaccc

SEQ ID NO: 6905504 - DNA, 22 bp, Homo sapiens
agggctgcccagtgtgagagct

SEQ ID NO: 6905505 - DNA, 22 bp, Homo sapiens
ttgaagttggtgtggaaagtag

SEQ ID NO: 6905506 - DNA, 22 bp, Homo sapiens
tgtcctgttcttgctgtgtcct

SEQ ID NO: 6905507 - DNA, 22 bp, Homo sapiens
aagagtacttgcagccagggcc

SEQ ID NO: 6905508 - DNA, 22 bp, Homo sapiens
cttctgggcatggcagagcctg

SEQ ID NO: 6905509 - DNA, 22 bp, Homo sapiens
ctggcacatgtgagccacatca

SEQ ID NO: 6905510 - DNA, 22 bp, Homo sapiens
gcactgaaaatgttggattcca

SEQ ID NO: 6905511 - DNA, 22 bp, Homo sapiens
aggaaactgtcccctcatccta

SEQ ID NO: 6905512 - DNA, 22 bp, Homo sapiens
ccttcctttcagggctatgcct

SEQ ID NO: 6905513 - DNA, 22 bp, Homo sapiens
taagaagcagttcacaagtaaa

SEQ ID NO: 6905514 - DNA, 22 bp, Homo sapiens
aatgttttatagctcaagcaat

SEQ ID NO: 6905515 - DNA, 22 bp, Homo sapiens
gaggtgggtgtatcacaggtca

SEQ ID NO: 6905516 - DNA, 22 bp, Homo sapiens
cagctgagaccagaatgcaggt

SEQ ID NO: 6905517 - DNA, 22 bp, Homo sapiens
tttccatgttggtgaaatgagg

SEQ ID NO: 6905518 - DNA, 22 bp, Homo sapiens
cagatggcacagatttagagtg

SEQ ID NO: 6905519 - DNA, 22 bp, Homo sapiens
accttttccagcttctagaggc

SEQ ID NO: 6905520 - DNA, 22 bp, Homo sapiens
tatttggaaacaattcacatgc

SEQ ID NO: 6905521 - DNA, 22 bp, Homo sapiens
ggagggccatcttgggtgtgat

SEQ ID NO: 6905522 - DNA, 22 bp, Homo sapiens
gctggccatggcctgcgccatc

SEQ ID NO: 6905523 - DNA, 22 bp, Homo sapiens
accctgggtcatatacagtgtg

SEQ ID NO: 6905524 - DNA, 22 bp, Homo sapiens
ttgatggaatattttttgaggt

SEQ ID NO: 6905525 - DNA, 22 bp, Homo sapiens
tggctttatacttaagcacaat

SEQ ID NO: 6905526 - DNA, 22 bp, Homo sapiens
ctgcagcctccaccttttgggt

SEQ ID NO: 6905527 - DNA, 22 bp, Homo sapiens
acttgcagaaacttcaattctg

SEQ ID NO: 6905528 - DNA, 22 bp, Homo sapiens
ttttggtgaatttaagtgctgt

SEQ ID NO: 6905529 - DNA, 22 bp, Homo sapiens
aagggagcttaggagatcaggc

SEQ ID NO: 6905530 - DNA, 22 bp, Homo sapiens
acatcttcccacacttgcaaaa

SEQ ID NO: 6905531 - DNA, 22 bp, Homo sapiens
agtcacatgatccctgggcctg

SEQ ID NO: 6905532 - DNA, 22 bp, Homo sapiens
agatgtttgtgcagtggcatgc

SEQ ID NO: 6905533 - DNA, 22 bp, Homo sapiens
gcgtctcaaggcccccaggcca

SEQ ID NO: 6905534 - DNA, 22 bp, Homo sapiens
tagcacttctggggaatagaat

SEQ ID NO: 6905535 - DNA, 22 bp, Homo sapiens
aggtctcaagagaaaagtggtg

SEQ ID NO: 6905536 - DNA, 22 bp, Homo sapiens
gaagaacttataggaatgtcat

SEQ ID NO: 6905537 - DNA, 22 bp, Homo sapiens
ccaggtctgtcttcttagctca

SEQ ID NO: 6905538 - DNA, 22 bp, Homo sapiens
ttatatttctggtagccttcag

SEQ ID NO: 6905539 - DNA, 22 bp, Homo sapiens
agagtgcaaccgaaacaagcag

SEQ ID NO: 6905540 - DNA, 22 bp, Homo sapiens
ggcagctgattagcatcaagga

SEQ ID NO: 6905541 - DNA, 22 bp, Homo sapiens
aagaaatgtgaatattgaatag

SEQ ID NO: 6905542 - DNA, 22 bp, Homo sapiens
cactgaaggtaggaccaaggct

SEQ ID NO: 6905543 - DNA, 22 bp, Homo sapiens
tatgttcatgcttatgcagaat

SEQ ID NO: 6905544 - DNA, 22 bp, Homo sapiens
gctcctgtaatttttaaaagtc

SEQ ID NO: 6905545 - DNA, 22 bp, Homo sapiens
gagtctgatgtcccccaggcca

SEQ ID NO: 6905546 - DNA, 22 bp, Homo sapiens
gggggtcccaagctgggctgct

SEQ ID NO: 6905547 - DNA, 20 bp, Homo sapiens
tgggtccctgcagtttgaag

SEQ ID NO: 6905548 - DNA, 22 bp, Homo sapiens
catggtcatgctgagctacaaa

SEQ ID NO: 6905549 - DNA, 22 bp, Homo sapiens
atcatcatgcactctcaggttt

SEQ ID NO: 6905550 - DNA, 22 bp, Homo sapiens
tgtccatcaggctgcctgtcag

SEQ ID NO: 6905551 - DNA, 22 bp, Homo sapiens
taacccaataattggtggcctt

SEQ ID NO: 6905552 - DNA, 18 bp, Homo sapiens
atagacaggaaaaatgga

SEQ ID NO: 6905553 - DNA, 22 bp, Homo sapiens
attgtcagctcgaaatgcatca

SEQ ID NO: 6905554 - DNA, 22 bp, Homo sapiens
cccatttagataacagttcaaa

SEQ ID NO: 6905555 - DNA, 22 bp, Homo sapiens
gtgaggactggtaaggactgca

SEQ ID NO: 6905556 - DNA, 22 bp, Homo sapiens
ttccttctggaggctccagggg

SEQ ID NO: 6905557 - DNA, 22 bp, Homo sapiens
actccctctctagtccttgcaa

SEQ ID NO: 6905558 - DNA, 22 bp, Homo sapiens
tgttattgatatctaatgctct

SEQ ID NO: 6905559 - DNA, 22 bp, Homo sapiens
tgcaaaaattgctggaatcttt

SEQ ID NO: 6905560 - DNA, 22 bp, Homo sapiens
gcagggaagttgtaatgtaatg

SEQ ID NO: 6905561 - DNA, 22 bp, Homo sapiens
gcagctgtaaagcagaaatagt

SEQ ID NO: 6905562 - DNA, 22 bp, Homo sapiens
tccacaggtatttctccttgct

SEQ ID NO: 6905563 - DNA, 22 bp, Homo sapiens
atttggaaaagtttcttcaact

SEQ ID NO: 6905564 - DNA, 22 bp, Homo sapiens
agtgtcctacagctcctgcctg

SEQ ID NO: 6905565 - DNA, 22 bp, Homo sapiens
agtgttactacagactggttaa

SEQ ID NO: 6905566 - DNA, 22 bp, Homo sapiens
gatgcttaccgacttacagtgc

SEQ ID NO: 6905567 - DNA, 22 bp, Homo sapiens
tccagctgttgttttatctcag

SEQ ID NO: 6905568 - DNA, 22 bp, Homo sapiens
agctaatgaaatattttctgat

SEQ ID NO: 6905569 - DNA, 22 bp, Homo sapiens
ctggtttattcgtcacaccgga

SEQ ID NO: 6905570 - DNA, 22 bp, Homo sapiens
caaatagtttttcatgtattat

SEQ ID NO: 6905571 - DNA, 22 bp, Homo sapiens
caccatctagcatttatttgga

SEQ ID NO: 6905572 - DNA, 22 bp, Homo sapiens
ccaagaggcagaatgcagagaa

SEQ ID NO: 6905573 - DNA, 22 bp, Homo sapiens
agatacgcggctcttttcttga

SEQ ID NO: 6905574 - DNA, 22 bp, Homo sapiens
gggttagctgttactggttaca

SEQ ID NO: 6905575 - DNA, 22 bp, Homo sapiens
tggctatgaagtcttcacatga

SEQ ID NO: 6905576 - DNA, 22 bp, Homo sapiens
aatgttttacagatcccattag

SEQ ID NO: 6905577 - DNA, 22 bp, Homo sapiens
acacaatggcgtgtgccacaga

SEQ ID NO: 6905578 - DNA, 22 bp, Homo sapiens
ctggcttttcaaactgttcagt

SEQ ID NO: 6905579 - DNA, 22 bp, Homo sapiens
agggctggtatgtccatgaaag

SEQ ID NO: 6905580 - DNA, 22 bp, Homo sapiens
ttgcattgaaaatatattttaa

SEQ ID NO: 6905581 - DNA, 22 bp, Homo sapiens
tgcagcaggagccaggcctggt

SEQ ID NO: 6905582 - DNA, 22 bp, Homo sapiens
aaatgcactctgcttctgtgac

SEQ ID NO: 6905583 - DNA, 22 bp, Homo sapiens
gggcagcactcatacctatatt

SEQ ID NO: 6905584 - DNA, 21 bp, Homo sapiens
cgcttgtccccgttatcgccc

SEQ ID NO: 6905585 - DNA, 22 bp, Homo sapiens
gaggcaccagacatggcctcat

SEQ ID NO: 6905586 - DNA, 22 bp, Homo sapiens
aaagccttttctgtttaacaca

SEQ ID NO: 6905587 - DNA, 22 bp, Homo sapiens
tcatagtttagttagtatgatt

SEQ ID NO: 6905588 - DNA, 20 bp, Homo sapiens
tggaggccaggatactttgt

SEQ ID NO: 6905589 - DNA, 22 bp, Homo sapiens
ttaataataatgagcccatttt

SEQ ID NO: 6905590 - DNA, 22 bp, Homo sapiens
agggctgtcagactgaggaggc

SEQ ID NO: 6905591 - DNA, 22 bp, Homo sapiens
ctggctgtcttctgggagctgt

SEQ ID NO: 6905592 - DNA, 22 bp, Homo sapiens
ctgggatggctttcctgcatta

SEQ ID NO: 6905593 - DNA, 22 bp, Homo sapiens
tactttctgtccttctgttaaa

SEQ ID NO: 6905594 - DNA, 21 bp, Homo sapiens
aagtggtttacatccagctgt

SEQ ID NO: 6905595 - DNA, 22 bp, Homo sapiens
agacaaatggagtatgagcaac

SEQ ID NO: 6905596 - DNA, 22 bp, Homo sapiens
agggatgctttgctgacagatt

SEQ ID NO: 6905597 - DNA, 22 bp, Homo sapiens
gagcccagtctgctcctgcgcc

SEQ ID NO: 6905598 - DNA, 22 bp, Homo sapiens
tcctgcctgtttacctgtactt

SEQ ID NO: 6905599 - DNA, 22 bp, Homo sapiens
taccacagacagatttcagtaa

SEQ ID NO: 6905600 - DNA, 22 bp, Homo sapiens
ggggccagcactgtgcctttgt

SEQ ID NO: 6905601 - DNA, 22 bp, Homo sapiens
tggcagtagagctggaacttga

SEQ ID NO: 6905602 - DNA, 18 bp, Homo sapiens
tattcctgagtcatccct

SEQ ID NO: 6905603 - DNA, 22 bp, Homo sapiens
tgttagggtcctgtgcaggggc

SEQ ID NO: 6905604 - DNA, 22 bp, Homo sapiens
tgaggaaatatggtgaactctt

SEQ ID NO: 6905605 - DNA, 22 bp, Homo sapiens
agtactttttgttcaattgtgc

SEQ ID NO: 6905606 - DNA, 22 bp, Homo sapiens
agtccaggcattccagccattc

SEQ ID NO: 6905607 - DNA, 22 bp, Homo sapiens
gggatgaattgagtcagaaggg

SEQ ID NO: 6905608 - DNA, 22 bp, Homo sapiens
gccacccccaagtaggtggtct

SEQ ID NO: 6905609 - DNA, 22 bp, Homo sapiens
tattatccaaagagctgggagc

SEQ ID NO: 6905610 - DNA, 22 bp, Homo sapiens
gtgttcatgtgtcctggatata

SEQ ID NO: 6905611 - DNA, 22 bp, Homo sapiens
tgacaggttcgttagtcatgtt

SEQ ID NO: 6905612 - DNA, 22 bp, Homo sapiens
ctaaacatgcaagagcttctgg

SEQ ID NO: 6905613 - DNA, 22 bp, Homo sapiens
gtaagttactcttgggctattt

SEQ ID NO: 6905614 - DNA, 22 bp, Homo sapiens
aagcttcatttcaactcagggg

SEQ ID NO: 6905615 - DNA, 22 bp, Homo sapiens
acaggctgatagaccataaata

SEQ ID NO: 6905616 - DNA, 22 bp, Homo sapiens
acactggttctcaagactaggt

SEQ ID NO: 6905617 - DNA, 22 bp, Homo sapiens
atcattcaagtgctctaaaatg

SEQ ID NO: 6905618 - DNA, 21 bp, Homo sapiens
acaggcaaattttagacaatg

SEQ ID NO: 6905619 - DNA, 22 bp, Homo sapiens
attgaaatacataaaattgcca

SEQ ID NO: 6905620 - DNA, 22 bp, Homo sapiens
aagtcctgagaccagaaaatgg

SEQ ID NO: 6905621 - DNA, 22 bp, Homo sapiens
gcaccaggcttagagccccagg

SEQ ID NO: 6905622 - DNA, 22 bp, Homo sapiens
tgcaggcctcacacctggcacc

SEQ ID NO: 6905623 - DNA, 22 bp, Homo sapiens
tcttcctctctaattgatcaga

SEQ ID NO: 6905624 - DNA, 22 bp, Homo sapiens
atctaagagaaaggaagttcag

SEQ ID NO: 6905625 - DNA, 22 bp, Homo sapiens
gggtgggagtctggccctcaaa

SEQ ID NO: 6905626 - DNA, 22 bp, Homo sapiens
acatcattgtttataaagggag

SEQ ID NO: 6905627 - DNA, 22 bp, Homo sapiens
ggtgaagggtgtcatggcattt

SEQ ID NO: 6905628 - DNA, 22 bp, Homo sapiens
tgtctaggaaataaggagattc

SEQ ID NO: 6905629 - DNA, 22 bp, Homo sapiens
ttggcagcagggagttggccgc

SEQ ID NO: 6905630 - DNA, 22 bp, Homo sapiens
tattcacaggcacgaaatattg

SEQ ID NO: 6905631 - DNA, 22 bp, Homo sapiens
aagtacatgctttattcagagt

SEQ ID NO: 6905632 - DNA, 20 bp, Homo sapiens
ttatttccagtccaggtcct

SEQ ID NO: 6905633 - DNA, 22 bp, Homo sapiens
tttacagttccatgtgataggc

SEQ ID NO: 6905634 - DNA, 22 bp, Homo sapiens
tacatatgtaaacatgtataaa

SEQ ID NO: 6905635 - DNA, 22 bp, Homo sapiens
ttccaggcattaaagtttctcc

SEQ ID NO: 6905636 - DNA, 22 bp, Homo sapiens
tcagacatctcataatgtatta

SEQ ID NO: 6905637 - DNA, 22 bp, Homo sapiens
gggagccacagtagcagctact

SEQ ID NO: 6905638 - DNA, 22 bp, Homo sapiens
aagtcctgaataggggccctgg

SEQ ID NO: 6905639 - DNA, 22 bp, Homo sapiens
caggtggcatgactgcctacaa

SEQ ID NO: 6905640 - DNA, 22 bp, Homo sapiens
gcggggcgtgctgctgctgagg

SEQ ID NO: 6905641 - DNA, 22 bp, Homo sapiens
gggagagcgggaggtgccacag

SEQ ID NO: 6905642 - DNA, 22 bp, Homo sapiens
tgtttacttcatcgagtacttc

SEQ ID NO: 6905643 - DNA, 22 bp, Homo sapiens
tacaaagggaatattggcttta

SEQ ID NO: 6905644 - DNA, 16 bp, Homo sapiens
tgcggcaacttgcggc

SEQ ID NO: 6905645 - DNA, 22 bp, Homo sapiens
aagaaatggcttcatctgagta

SEQ ID NO: 6905646 - DNA, 22 bp, Homo sapiens
tatcttgatcaagtagaagagg

SEQ ID NO: 6905647 - DNA, 22 bp, Homo sapiens
gatgctgaccagctgtttcctt

SEQ ID NO: 6905648 - DNA, 22 bp, Homo sapiens
agacaaattgggacattgtgtt

SEQ ID NO: 6905649 - DNA, 22 bp, Homo sapiens
tggctctttcaaatttactaaa

SEQ ID NO: 6905650 - DNA, 22 bp, Homo sapiens
aatgtatgtgattattcctcta

SEQ ID NO: 6905651 - DNA, 22 bp, Homo sapiens
gcttggcagcaacaggcatccc

SEQ ID NO: 6905652 - DNA, 22 bp, Homo sapiens
ctggagggggaaatgttcattg

SEQ ID NO: 6905653 - DNA, 22 bp, Homo sapiens
cactttggttcacctgagtttc

SEQ ID NO: 6905654 - DNA, 22 bp, Homo sapiens
gctggcctgctgggcaccaccg

SEQ ID NO: 6905655 - DNA, 22 bp, Homo sapiens
ggtgagcaaagcttcatctgta

SEQ ID NO: 6905656 - DNA, 22 bp, Homo sapiens
ccttgggcttgggcatagcttt

SEQ ID NO: 6905657 - DNA, 22 bp, Homo sapiens
gtaaatattccctcggttccta

SEQ ID NO: 6905658 - DNA, 22 bp, Homo sapiens
atttatgcatcccagcatgtga

SEQ ID NO: 6905659 - DNA, 22 bp, Homo sapiens
gccagaggttcaacaactgtct

SEQ ID NO: 6905660 - DNA, 22 bp, Homo sapiens
tcactctgagaggtcactggaa

SEQ ID NO: 6905661 - DNA, 22 bp, Homo sapiens
tgatgtggccccacttagctgt

SEQ ID NO: 6905662 - DNA, 22 bp, Homo sapiens
ttgtaacaatctgtcataaatg

SEQ ID NO: 6905663 - DNA, 22 bp, Homo sapiens
aagaactgagtacgttaataaa

SEQ ID NO: 6905664 - DNA, 22 bp, Homo sapiens
tccccccagcctttcacatgag

SEQ ID NO: 6905665 - DNA, 22 bp, Homo sapiens
tccagctccacagcctccctgt

SEQ ID NO: 6905666 - DNA, 22 bp, Homo sapiens
actggcagagaccctgatggcc
